United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 103

SEQ ID NO: 3662946 - RNA, 19 nt, Salmonella enterica enterica serovar Typhi
ugacacagucauugguaag

SEQ ID NO: 3662947 - RNA, 14 nt, Salmonella enterica enterica serovar Typhi
ugacacccucugcg

SEQ ID NO: 3662948 - RNA, 14 nt, Salmonella enterica enterica serovar Typhi
ugacacggaacaac

SEQ ID NO: 3662949 - RNA, 20 nt, Salmonella enterica enterica serovar Typhi
ugacacggaacaacggcaca

SEQ ID NO: 3662950 - RNA, 16 nt, Salmonella enterica enterica serovar Typhi
ugacacucauccagac

SEQ ID NO: 3662951 - RNA, 14 nt, Salmonella enterica enterica serovar Typhi
ugacacugauauac

SEQ ID NO: 3662952 - RNA, 21 nt, Salmonella enterica enterica serovar Typhi
ugacagagcucgucaaaaauc

SEQ ID NO: 3662953 - RNA, 21 nt, Salmonella enterica enterica serovar Typhi
ugacagcaaguugcgccacug

SEQ ID NO: 3662954 - RNA, 19 nt, Salmonella enterica enterica serovar Typhi
ugacagcacaauuccggcc

SEQ ID NO: 3662955 - RNA, 18 nt, Salmonella enterica enterica serovar Typhi
ugacagcaucgauuccgc

SEQ ID NO: 3662956 - RNA, 19 nt, Salmonella enterica enterica serovar Typhi
ugacagcaucgauuccgcc

SEQ ID NO: 3662957 - RNA, 18 nt, Salmonella enterica enterica serovar Typhi
ugacauagcauaauaaug

SEQ ID NO: 3662958 - RNA, 13 nt, Salmonella enterica enterica serovar Typhi
ugacauauacaaa

SEQ ID NO: 3662959 - RNA, 18 nt, Salmonella enterica enterica serovar Typhi
ugacaucucaucggcuuu

SEQ ID NO: 3662960 - RNA, 20 nt, Salmonella enterica enterica serovar Typhi
ugacaucucuuuuaauuuuc

SEQ ID NO: 3662961 - RNA, 13 nt, Salmonella enterica enterica serovar Typhi
ugacaucugccgc

SEQ ID NO: 3662962 - RNA, 17 nt, Salmonella enterica enterica serovar Typhi
ugacauuuaucuuccgg

SEQ ID NO: 3662963 - RNA, 13 nt, Salmonella enterica enterica serovar Typhi
ugaccaacaacag

SEQ ID NO: 3662964 - RNA, 19 nt, Salmonella enterica enterica serovar Typhi
ugaccaacaucauuauucc

SEQ ID NO: 3662965 - RNA, 18 nt, Salmonella enterica enterica serovar Typhi
ugaccaacgucagcaucu

SEQ ID NO: 3662966 - RNA, 18 nt, Salmonella enterica enterica serovar Typhi
ugaccaagcgucagcaug

SEQ ID NO: 3662967 - RNA, 21 nt, Salmonella enterica enterica serovar Typhi
ugaccaauguuaauaagcaga

SEQ ID NO: 3662968 - RNA, 18 nt, Salmonella enterica enterica serovar Typhi
ugaccaccagcgcgaccg

SEQ ID NO: 3662969 - RNA, 13 nt, Salmonella enterica enterica serovar Typhi
ugaccaccgcauc

SEQ ID NO: 3662970 - RNA, 17 nt, Salmonella enterica enterica serovar Typhi
ugaccagggcaaauuau

SEQ ID NO: 3662971 - RNA, 19 nt, Salmonella enterica enterica serovar Typhi
ugaccaggucgccagcggg

SEQ ID NO: 3662972 - RNA, 22 nt, Salmonella enterica enterica serovar Typhi
ugaccaguaagggcagccgaga

SEQ ID NO: 3662973 - RNA, 22 nt, Salmonella enterica enterica serovar Typhi
ugaccaguuguuccgcgcugau

SEQ ID NO: 3662974 - RNA, 18 nt, Salmonella enterica enterica serovar Typhi
ugaccauauaugaaaucg

SEQ ID NO: 3662975 - RNA, 15 nt, Salmonella enterica enterica serovar Typhi
ugaccaucaaauaau

SEQ ID NO: 3662976 - RNA, 17 nt, Salmonella enterica enterica serovar Typhi
ugaccaugccacaacag

SEQ ID NO: 3662977 - RNA, 13 nt, Salmonella enterica enterica serovar Typhi
ugaccccggccuc

SEQ ID NO: 3662978 - RNA, 19 nt, Salmonella enterica enterica serovar Typhi
ugacccgccgccagcaccg

SEQ ID NO: 3662979 - RNA, 15 nt, Salmonella enterica enterica serovar Typhi
ugaccgaaaucuucg

SEQ ID NO: 3662980 - RNA, 20 nt, Salmonella enterica enterica serovar Typhi
ugaccgaaccgcuguagucu

SEQ ID NO: 3662981 - RNA, 15 nt, Salmonella enterica enterica serovar Typhi
ugaccgaagcaggcg

SEQ ID NO: 3662982 - RNA, 14 nt, Salmonella enterica enterica serovar Typhi
ugaccgaggaaauc

SEQ ID NO: 3662983 - RNA, 17 nt, Salmonella enterica enterica serovar Typhi
ugaccgauauagccacu

SEQ ID NO: 3662984 - RNA, 16 nt, Salmonella enterica enterica serovar Typhi
ugaccgcacagcagac

SEQ ID NO: 3662985 - RNA, 14 nt, Salmonella enterica enterica serovar Typhi
ugaccgccgcgcgu

SEQ ID NO: 3662986 - RNA, 17 nt, Salmonella enterica enterica serovar Typhi
ugaccgccgucauagca

SEQ ID NO: 3662987 - RNA, 23 nt, Salmonella enterica enterica serovar Typhi
ugaccgccgucauagcaggagau

SEQ ID NO: 3662988 - RNA, 19 nt, Salmonella enterica enterica serovar Typhi
ugaccgcuucgccuucgcc

SEQ ID NO: 3662989 - RNA, 21 nt, Salmonella enterica enterica serovar Typhi
ugaccgggcucacgcuggugc

SEQ ID NO: 3662990 - RNA, 18 nt, Salmonella enterica enterica serovar Typhi
ugaccgguaagcccaugg

SEQ ID NO: 3662991 - RNA, 19 nt, Salmonella enterica enterica serovar Typhi
ugaccgguaagcccauggc

SEQ ID NO: 3662992 - RNA, 14 nt, Salmonella enterica enterica serovar Typhi
ugaccguccccagc

SEQ ID NO: 3662993 - RNA, 22 nt, Salmonella enterica enterica serovar Typhi
ugaccguuaguaaucggaucaa

SEQ ID NO: 3662994 - RNA, 17 nt, Salmonella enterica enterica serovar Typhi
ugaccucaauccgugcc

SEQ ID NO: 3662995 - RNA, 15 nt, Salmonella enterica enterica serovar Typhi
ugaccugaaaucgcg

SEQ ID NO: 3662996 - RNA, 11 nt, Salmonella enterica enterica serovar Typhi
ugaccugaaua

SEQ ID NO: 3662997 - RNA, 18 nt, Salmonella enterica enterica serovar Typhi
ugaccugcagcuccgcaa

SEQ ID NO: 3662998 - RNA, 13 nt, Salmonella enterica enterica serovar Typhi
ugaccugcggcgc

SEQ ID NO: 3662999 - RNA, 12 nt, Salmonella enterica enterica serovar Typhi
ugagcagcgcga

SEQ ID NO: 3663000 - RNA, 20 nt, Salmonella enterica enterica serovar Typhi
ugagcaucaaacuuuuaaau

SEQ ID NO: 3663001 - RNA, 13 nt, Salmonella enterica enterica serovar Typhi
ugagcccacagcg

SEQ ID NO: 3663002 - RNA, 17 nt, Salmonella enterica enterica serovar Typhi
ugagcccacagcggaug

SEQ ID NO: 3663003 - RNA, 22 nt, Salmonella enterica enterica serovar Typhi
ugagcccuccuccagcgcgucc

SEQ ID NO: 3663004 - RNA, 16 nt, Salmonella enterica enterica serovar Typhi
ugagcgaaacuccagc

SEQ ID NO: 3663005 - RNA, 18 nt, Salmonella enterica enterica serovar Typhi
ugagcgaaacuccagcga

SEQ ID NO: 3663006 - RNA, 21 nt, Salmonella enterica enterica serovar Typhi
ugagcgaacggcuuuccagca

SEQ ID NO: 3663007 - RNA, 19 nt, Salmonella enterica enterica serovar Typhi
ugagcgaauccccgggaac

SEQ ID NO: 3663008 - RNA, 20 nt, Salmonella enterica enterica serovar Typhi
ugagcgagucagacaccagc

SEQ ID NO: 3663009 - RNA, 22 nt, Salmonella enterica enterica serovar Typhi
ugagcgcagcgacuucaggcgu

SEQ ID NO: 3663010 - RNA, 17 nt, Salmonella enterica enterica serovar Typhi
ugagcgcagugaccagc

SEQ ID NO: 3663011 - RNA, 18 nt, Salmonella enterica enterica serovar Typhi
ugagcgcauuugcggcgu

SEQ ID NO: 3663012 - RNA, 20 nt, Salmonella enterica enterica serovar Typhi
ugagcgccgcgccuaccagc

SEQ ID NO: 3663013 - RNA, 17 nt, Salmonella enterica enterica serovar Typhi
ugagcgcgaacgcucca

SEQ ID NO: 3663014 - RNA, 23 nt, Salmonella enterica enterica serovar Typhi
ugagcgcgccaugagacgcguaa

SEQ ID NO: 3663015 - RNA, 16 nt, Salmonella enterica enterica serovar Typhi
ugagcgcuugcugcgu

SEQ ID NO: 3663016 - RNA, 18 nt, Salmonella enterica enterica serovar Typhi
ugagcggcucauccagca

SEQ ID NO: 3663017 - RNA, 19 nt, Salmonella enterica enterica serovar Typhi
ugagcggcucauccagcaa

SEQ ID NO: 3663018 - RNA, 12 nt, Salmonella enterica enterica serovar Typhi
ugagcgggccgu

SEQ ID NO: 3663019 - RNA, 21 nt, Salmonella enterica enterica serovar Typhi
ugagcgguagcccgacaauaa

SEQ ID NO: 3663020 - RNA, 20 nt, Salmonella enterica enterica serovar Typhi
ugagcguagaccgcccagga

SEQ ID NO: 3663021 - RNA, 16 nt, Salmonella enterica enterica serovar Typhi
ugagcgucaggccauc

SEQ ID NO: 3663022 - RNA, 18 nt, Salmonella enterica enterica serovar Typhi
ugagcguuacgggaacag

SEQ ID NO: 3663023 - RNA, 18 nt, Salmonella enterica enterica serovar Typhi
ugagcuaaucacccacuu

SEQ ID NO: 3663024 - RNA, 14 nt, Salmonella enterica enterica serovar Typhi
ugagcucauccagc

SEQ ID NO: 3663025 - RNA, 19 nt, Salmonella enterica enterica serovar Typhi
ugagcucguuauaagcuuu

SEQ ID NO: 3663026 - RNA, 20 nt, Salmonella enterica enterica serovar Typhi
ugagcucguuauaagcuuua

SEQ ID NO: 3663027 - RNA, 17 nt, Salmonella enterica enterica serovar Typhi
ugagcucuuucugcgca

SEQ ID NO: 3663028 - RNA, 12 nt, Salmonella enterica enterica serovar Typhi
ugagcugaaagc

SEQ ID NO: 3663029 - RNA, 17 nt, Salmonella enterica enterica serovar Typhi
ugagcugacugacguga

SEQ ID NO: 3663030 - RNA, 15 nt, Salmonella enterica enterica serovar Typhi
ugagcuugagccagc

SEQ ID NO: 3663031 - RNA, 24 nt, Salmonella enterica enterica serovar Typhi
ugaggaaaaagcgcacuuuccaua

SEQ ID NO: 3663032 - RNA, 16 nt, Salmonella enterica enterica serovar Typhi
ugaggagcuggagcag

SEQ ID NO: 3663033 - RNA, 15 nt, Salmonella enterica enterica serovar Typhi
ugaggauauugguau

SEQ ID NO: 3663034 - RNA, 21 nt, Salmonella enterica enterica serovar Typhi
ugaggccguuuuuuuguuuua

SEQ ID NO: 3663035 - RNA, 19 nt, Salmonella enterica enterica serovar Typhi
ugaggccuguuucuuacca

SEQ ID NO: 3663036 - RNA, 17 nt, Salmonella enterica enterica serovar Typhi
ugaggcgacaaucucac

SEQ ID NO: 3663037 - RNA, 16 nt, Salmonella enterica enterica serovar Typhi
ugaggcugaagcgcga

SEQ ID NO: 3663038 - RNA, 16 nt, Salmonella enterica enterica serovar Typhi
ugagggcgauaauccg

SEQ ID NO: 3663039 - RNA, 20 nt, Salmonella enterica enterica serovar Typhi
ugagguggccgagaggcuga

SEQ ID NO: 3663040 - RNA, 19 nt, Salmonella enterica enterica serovar Typhi
ugaguaaagagaucaauuu

SEQ ID NO: 3663041 - RNA, 22 nt, Salmonella enterica enterica serovar Typhi
ugaguaacguuaauacaucaug

SEQ ID NO: 3663042 - RNA, 21 nt, Salmonella enterica enterica serovar Typhi
ugaguauaaaacucgccgcga

SEQ ID NO: 3663043 - RNA, 23 nt, Salmonella enterica enterica serovar Typhi
ugagucagaaacggccuggcccg

SEQ ID NO: 3663044 - RNA, 16 nt, Salmonella enterica enterica serovar Typhi
ugagucauccuucccc

SEQ ID NO: 3663045 - RNA, 22 nt, Salmonella enterica enterica serovar Typhi
ugaguucaauaugugcaucggc

SEQ ID NO: 3663046 - RNA, 16 nt, Salmonella enterica enterica serovar Typhi
ugaguuugucauccag

SEQ ID NO: 3663047 - RNA, 22 nt, Salmonella enterica enterica serovar Typhi
ugaguuuuaacgaaggauuuau

SEQ ID NO: 3663048 - RNA, 14 nt, Salmonella enterica enterica serovar Typhi
ugauaaaacgcagg

SEQ ID NO: 3663049 - RNA, 18 nt, Salmonella enterica enterica serovar Typhi
ugauaaaacgcaggcagu

SEQ ID NO: 3663050 - RNA, 17 nt, Salmonella enterica enterica serovar Typhi
ugauaaaauaaacacua

SEQ ID NO: 3663051 - RNA, 18 nt, Salmonella enterica enterica serovar Typhi
ugauaaaauaaacacuaa

SEQ ID NO: 3663052 - RNA, 16 nt, Salmonella enterica enterica serovar Typhi
ugauaaagcuuucauc

SEQ ID NO: 3663053 - RNA, 15 nt, Salmonella enterica enterica serovar Typhi
ugauaaauacgcugc

SEQ ID NO: 3663054 - RNA, 16 nt, Salmonella enterica enterica serovar Typhi
ugauaaauguuuacuu

SEQ ID NO: 3663055 - RNA, 15 nt, Salmonella enterica enterica serovar Typhi
ugauaaccgccgcca

SEQ ID NO: 3663056 - RNA, 19 nt, Salmonella enterica enterica serovar Typhi
ugauaaccuauuuugcaaa

SEQ ID NO: 3663057 - RNA, 18 nt, Salmonella enterica enterica serovar Typhi
ugauaagcauagcgccau

SEQ ID NO: 3663058 - RNA, 21 nt, Salmonella enterica enterica serovar Typhi
ugauaagcauagcgccaucag

SEQ ID NO: 3663059 - RNA, 13 nt, Salmonella enterica enterica serovar Typhi
ugauaagcgcagc

SEQ ID NO: 3663060 - RNA, 18 nt, Salmonella enterica enterica serovar Typhi
ugauaagcguagcgccau

SEQ ID NO: 3663061 - RNA, 21 nt, Salmonella enterica enterica serovar Typhi
ugauaagcguagcgccaucag

SEQ ID NO: 3663062 - RNA, 21 nt, Salmonella enterica enterica serovar Typhi
ugauaauaauuguaggcagga

SEQ ID NO: 3663063 - RNA, 12 nt, Salmonella enterica enterica serovar Typhi
ugauaauacugc

SEQ ID NO: 3663064 - RNA, 13 nt, Salmonella enterica enterica serovar Typhi
ugauaauaugcuc

SEQ ID NO: 3663065 - RNA, 22 nt, Salmonella enterica enterica serovar Typhi
ugauaauaugcucaacuuccag

SEQ ID NO: 3663066 - RNA, 23 nt, Salmonella enterica enterica serovar Typhi
ugauaaugguuuacccaggaaga

SEQ ID NO: 3663067 - RNA, 18 nt, Salmonella enterica enterica serovar Typhi
ugauaauuguuaauuauu

SEQ ID NO: 3663068 - RNA, 18 nt, Salmonella enterica enterica serovar Typhi
ugauacagaaaaccggca

SEQ ID NO: 3663069 - RNA, 14 nt, Salmonella enterica enterica serovar Typhi
ugauacagcagcac

SEQ ID NO: 3663070 - RNA, 19 nt, Salmonella enterica enterica serovar Typhi
ugauacaugcuacaggcaa

SEQ ID NO: 3663071 - RNA, 14 nt, Salmonella enterica enterica serovar Typhi
ugauaccggaggag

SEQ ID NO: 3663072 - RNA, 16 nt, Salmonella enterica enterica serovar Typhi
ugauaccuaaacgcgu

SEQ ID NO: 3663073 - RNA, 17 nt, Salmonella enterica enterica serovar Typhi
ugauaccuauuuaauaa

SEQ ID NO: 3663074 - RNA, 19 nt, Salmonella enterica enterica serovar Typhi
ugauacgcgucaaauagag

SEQ ID NO: 3663075 - RNA, 21 nt, Salmonella enterica enterica serovar Typhi
ugauacggcgugaucacuccc

SEQ ID NO: 3663076 - RNA, 21 nt, Salmonella enterica enterica serovar Typhi
ugauacuguacgcccagccgu

SEQ ID NO: 3663077 - RNA, 16 nt, Salmonella enterica enterica serovar Typhi
ugauagacguaaugau

SEQ ID NO: 3663078 - RNA, 20 nt, Salmonella enterica enterica serovar Typhi
ugauagcaggcacuguggug

SEQ ID NO: 3663079 - RNA, 21 nt, Salmonella enterica enterica serovar Typhi
ugauagcccguuaugccaucu

SEQ ID NO: 3663080 - RNA, 17 nt, Salmonella enterica enterica serovar Typhi
ugauagccguucuccag

SEQ ID NO: 3663081 - RNA, 18 nt, Salmonella enterica enterica serovar Typhi
ugauagcgaggcagcagg

SEQ ID NO: 3663082 - RNA, 20 nt, Salmonella enterica enterica serovar Typhi
ugauaggccagcuacaccug

SEQ ID NO: 3663083 - RNA, 13 nt, Salmonella enterica enterica serovar Typhi
ugauagggcagca

SEQ ID NO: 3663084 - RNA, 22 nt, Salmonella enterica enterica serovar Typhi
ugauucaucacguucaggcagu

SEQ ID NO: 3663085 - RNA, 23 nt, Salmonella enterica enterica serovar Typhi
ugauucaucacguucaggcagua

SEQ ID NO: 3663086 - RNA, 14 nt, Salmonella enterica enterica serovar Typhi
ugauuccuggcuug

SEQ ID NO: 3663087 - RNA, 21 nt, Salmonella enterica enterica serovar Typhi
ugauuccuggcuugccagaua

SEQ ID NO: 3663088 - RNA, 15 nt, Salmonella enterica enterica serovar Typhi
ugauucgcuggccuc

SEQ ID NO: 3663089 - RNA, 14 nt, Salmonella enterica enterica serovar Typhi
ugauucggguaaac

SEQ ID NO: 3663090 - RNA, 21 nt, Salmonella enterica enterica serovar Typhi
ugauucguuuuuacacugaag

SEQ ID NO: 3663091 - RNA, 18 nt, Salmonella enterica enterica serovar Typhi
ugauucugugaugaugcg

SEQ ID NO: 3663092 - RNA, 19 nt, Salmonella enterica enterica serovar Typhi
ugauugaaacucgccaugc

SEQ ID NO: 3663093 - RNA, 14 nt, Salmonella enterica enterica serovar Typhi
ugauugcaagaaua

SEQ ID NO: 3663094 - RNA, 23 nt, Salmonella enterica enterica serovar Typhi
ugauugccgccaucuuuacccug

SEQ ID NO: 3663095 - RNA, 21 nt, Salmonella enterica enterica serovar Typhi
ugauugccggagauuuaucuu

SEQ ID NO: 3663096 - RNA, 22 nt, Salmonella enterica enterica serovar Typhi
ugauugcgacaggcugccgaca

SEQ ID NO: 3663097 - RNA, 12 nt, Salmonella enterica enterica serovar Typhi
ugauuuaaaaaa

SEQ ID NO: 3663098 - RNA, 14 nt, Salmonella enterica enterica serovar Typhi
ugauuuacuccaaa

SEQ ID NO: 3663099 - RNA, 11 nt, Salmonella enterica enterica serovar Typhi
ugauuuauuca

SEQ ID NO: 3663100 - RNA, 15 nt, Salmonella enterica enterica serovar Typhi
ugauuuauuuugaau

SEQ ID NO: 3663101 - RNA, 18 nt, Salmonella enterica enterica serovar Typhi
ugauuucgccccacuggc

SEQ ID NO: 3663102 - RNA, 18 nt, Salmonella enterica enterica serovar Typhi
ugauuugcuuuauuuguu

SEQ ID NO: 3663103 - RNA, 18 nt, Salmonella enterica enterica serovar Typhi
ugauuuguaggccugaua

SEQ ID NO: 3663104 - RNA, 22 nt, Salmonella enterica enterica serovar Typhi
ugauuuguuuuuuauauuuuua

SEQ ID NO: 3663105 - RNA, 21 nt, Salmonella enterica enterica serovar Typhi
ugauuuuaacaucaccuuuca

SEQ ID NO: 3663106 - RNA, 11 nt, Salmonella enterica enterica serovar Typhi
ugauuuuauga

SEQ ID NO: 3663107 - RNA, 13 nt, Salmonella enterica enterica serovar Typhi
ugauuuuaugaug

SEQ ID NO: 3663108 - RNA, 14 nt, Salmonella enterica enterica serovar Typhi
ugauuuuaugaugc

SEQ ID NO: 3663109 - RNA, 18 nt, Salmonella enterica enterica serovar Typhi
ugcaaaaugcuucuucaa

SEQ ID NO: 3663110 - RNA, 22 nt, Salmonella enterica enterica serovar Typhi
ugcaaaccucucccccgccauu

SEQ ID NO: 3663111 - RNA, 16 nt, Salmonella enterica enterica serovar Typhi
ugcaaacgcggcgcca

SEQ ID NO: 3663112 - RNA, 17 nt, Salmonella enterica enterica serovar Typhi
ugcaaagaagggcaggg

SEQ ID NO: 3663113 - RNA, 22 nt, Salmonella enterica enterica serovar Typhi
ugcaaagacagcaggcuuugcu

SEQ ID NO: 3663114 - RNA, 13 nt, Salmonella enterica enterica serovar Typhi
ugcaaagcaaaaa

SEQ ID NO: 3663115 - RNA, 11 nt, Salmonella enterica enterica serovar Typhi
ugcaaauacca

SEQ ID NO: 3663116 - RNA, 15 nt, Salmonella enterica enterica serovar Typhi
ugcaaauaccacauc

SEQ ID NO: 3663117 - RNA, 15 nt, Salmonella enterica enterica serovar Typhi
ugcaaauacugcuuu

SEQ ID NO: 3663118 - RNA, 14 nt, Salmonella enterica enterica serovar Typhi
ugcaaauauucgcc

SEQ ID NO: 3663119 - RNA, 14 nt, Salmonella enterica enterica serovar Typhi
ugcaaauccaucuc

SEQ ID NO: 3663120 - RNA, 13 nt, Salmonella enterica enterica serovar Typhi
ugcaaauccgcca

SEQ ID NO: 3663121 - RNA, 21 nt, Salmonella enterica enterica serovar Typhi
ugcaacagaagaguuaacuuc

SEQ ID NO: 3663122 - RNA, 14 nt, Salmonella enterica enterica serovar Typhi
ugcaacagcaccag

SEQ ID NO: 3663123 - RNA, 15 nt, Salmonella enterica enterica serovar Typhi
ugcaacagcaccagc

SEQ ID NO: 3663124 - RNA, 22 nt, Salmonella enterica enterica serovar Typhi
ugcaacauuacugaccgagauc

SEQ ID NO: 3663125 - RNA, 19 nt, Salmonella enterica enterica serovar Typhi
ugcaacauugcaggucugg

SEQ ID NO: 3663126 - RNA, 23 nt, Salmonella enterica enterica serovar Typhi
ugcaacgaucccuaauaaaauaa

SEQ ID NO: 3663127 - RNA, 17 nt, Salmonella enterica enterica serovar Typhi
ugcaacgccagaugcgu

SEQ ID NO: 3663128 - RNA, 18 nt, Salmonella enterica enterica serovar Typhi
ugcaacgccgaugcuuuu

SEQ ID NO: 3663129 - RNA, 21 nt, Salmonella enterica enterica serovar Typhi
ugcaacgcuuuagugccgcca

SEQ ID NO: 3663130 - RNA, 17 nt, Salmonella enterica enterica serovar Typhi
ugcaacuccugggcaaa

SEQ ID NO: 3663131 - RNA, 16 nt, Salmonella enterica enterica serovar Typhi
ugcaacuucaccucag

SEQ ID NO: 3663132 - RNA, 19 nt, Salmonella enterica enterica serovar Typhi
ugcaacuucaccuucggug

SEQ ID NO: 3663133 - RNA, 13 nt, Salmonella enterica enterica serovar Typhi
ugcaagagaaaua

SEQ ID NO: 3663134 - RNA, 19 nt, Salmonella enterica enterica serovar Typhi
ugcaagccugauacuuuua

SEQ ID NO: 3663135 - RNA, 17 nt, Salmonella enterica enterica serovar Typhi
ugcaauaccggcugcuu

SEQ ID NO: 3663136 - RNA, 17 nt, Salmonella enterica enterica serovar Typhi
ugcaauacuacgcaccg

SEQ ID NO: 3663137 - RNA, 18 nt, Salmonella enterica enterica serovar Typhi
ugcaauaucccucgaagu

SEQ ID NO: 3663138 - RNA, 15 nt, Salmonella enterica enterica serovar Typhi
ugcaauaucgcggca

SEQ ID NO: 3663139 - RNA, 16 nt, Salmonella enterica enterica serovar Typhi
ugcaauaucgcggcaa

SEQ ID NO: 3663140 - RNA, 15 nt, Salmonella enterica enterica serovar Typhi
ugcaaucacacuaca

SEQ ID NO: 3663141 - RNA, 12 nt, Salmonella enterica enterica serovar Typhi
ugcaaucagauu

SEQ ID NO: 3663142 - RNA, 23 nt, Salmonella enterica enterica serovar Typhi
ugcaaucagcgaaggcaacugau

SEQ ID NO: 3663143 - RNA, 22 nt, Salmonella enterica enterica serovar Typhi
ugcaaucaguuccaaucucuuu

SEQ ID NO: 3663144 - RNA, 21 nt, Salmonella enterica enterica serovar Typhi
ugcaaucguucuugcacaaua

SEQ ID NO: 3663145 - RNA, 18 nt, Salmonella enterica enterica serovar Typhi
ugcaaucuuuacccggcg

SEQ ID NO: 3663146 - RNA, 17 nt, Salmonella enterica enterica serovar Typhi
ugcaaugcagaugcuca

SEQ ID NO: 3663147 - RNA, 21 nt, Salmonella enterica enterica serovar Typhi
ugcaaugcggcguguggcugu

SEQ ID NO: 3663148 - RNA, 15 nt, Salmonella enterica enterica serovar Typhi
ugcaauguucaauau

SEQ ID NO: 3663149 - RNA, 22 nt, Salmonella enterica enterica serovar Typhi
ugcaauguucaauaucaaauug

SEQ ID NO: 3663150 - RNA, 14 nt, Salmonella enterica enterica serovar Typhi
ugcaauuccggcga

SEQ ID NO: 3663151 - RNA, 17 nt, Salmonella enterica enterica serovar Typhi
ugcaauuccggcgaaaa

SEQ ID NO: 3663152 - RNA, 16 nt, Salmonella enterica enterica serovar Typhi
ugcaauuguuccugcg

SEQ ID NO: 3663153 - RNA, 24 nt, Salmonella enterica enterica serovar Typhi
ugcaauuucugcuggacaugauaa

SEQ ID NO: 3663154 - RNA, 23 nt, Salmonella enterica enterica serovar Typhi
ugcacaaaacccgcagccggaua

SEQ ID NO: 3663155 - RNA, 15 nt, Salmonella enterica enterica serovar Typhi
ugcacaaaauacugu

SEQ ID NO: 3663156 - RNA, 16 nt, Salmonella enterica enterica serovar Typhi
ugcacaaaauacuguu

SEQ ID NO: 3663157 - RNA, 22 nt, Salmonella enterica enterica serovar Typhi
ugcacaagaaacauguuguguc

SEQ ID NO: 3663158 - RNA, 15 nt, Salmonella enterica enterica serovar Typhi
ugcacaauaccaaua

SEQ ID NO: 3663159 - RNA, 22 nt, Salmonella enterica enterica serovar Typhi
ugcacaauacgccgagcaucgc

SEQ ID NO: 3663160 - RNA, 16 nt, Salmonella enterica enterica serovar Typhi
ugcacaaucgccagcc

SEQ ID NO: 3663161 - RNA, 13 nt, Salmonella enterica enterica serovar Typhi
ugcacagucugca

SEQ ID NO: 3663162 - RNA, 19 nt, Salmonella enterica enterica serovar Typhi
ugcacauaacgugccaucu

SEQ ID NO: 3663163 - RNA, 18 nt, Salmonella enterica enterica serovar Typhi
ugcacaucgccauuaaaa

SEQ ID NO: 3663164 - RNA, 15 nt, Salmonella enterica enterica serovar Typhi
ugcacauguuucagc

SEQ ID NO: 3663165 - RNA, 19 nt, Salmonella enterica enterica serovar Typhi
ugcacauguuucagcaccu

SEQ ID NO: 3663166 - RNA, 19 nt, Salmonella enterica enterica serovar Typhi
ugcacauuagcaauugcca

SEQ ID NO: 3663167 - RNA, 19 nt, Salmonella enterica enterica serovar Typhi
ugcacauucagguggcuga

SEQ ID NO: 3663168 - RNA, 17 nt, Salmonella enterica enterica serovar Typhi
ugcacauugcaggcuuu

SEQ ID NO: 3663169 - RNA, 16 nt, Salmonella enterica enterica serovar Typhi
ugcaccagaacucccu

SEQ ID NO: 3663170 - RNA, 15 nt, Salmonella enterica enterica serovar Typhi
ugcaugagcacgcgg

SEQ ID NO: 3663171 - RNA, 17 nt, Salmonella enterica enterica serovar Typhi
ugcauggcagauaaacc

SEQ ID NO: 3663172 - RNA, 23 nt, Salmonella enterica enterica serovar Typhi
ugcauggccggucuuaugcugcc

SEQ ID NO: 3663173 - RNA, 15 nt, Salmonella enterica enterica serovar Typhi
ugcaugggcagcuug

SEQ ID NO: 3663174 - RNA, 23 nt, Salmonella enterica enterica serovar Typhi
ugcaugguagucguuauaauccu

SEQ ID NO: 3663175 - RNA, 17 nt, Salmonella enterica enterica serovar Typhi
ugcauguaguaagccau

SEQ ID NO: 3663176 - RNA, 13 nt, Salmonella enterica enterica serovar Typhi
ugcauuacagggc

SEQ ID NO: 3663177 - RNA, 20 nt, Salmonella enterica enterica serovar Typhi
ugcauuauuuuagugaaaaa

SEQ ID NO: 3663178 - RNA, 14 nt, Salmonella enterica enterica serovar Typhi
ugcauucaggccuc

SEQ ID NO: 3663179 - RNA, 19 nt, Salmonella enterica enterica serovar Typhi
ugcauucaggccucugcuu

SEQ ID NO: 3663180 - RNA, 14 nt, Salmonella enterica enterica serovar Typhi
ugcauuccaggugu

SEQ ID NO: 3663181 - RNA, 13 nt, Salmonella enterica enterica serovar Typhi
ugcauucgcuccu

SEQ ID NO: 3663182 - RNA, 15 nt, Salmonella enterica enterica serovar Typhi
ugcauugauaggcug

SEQ ID NO: 3663183 - RNA, 16 nt, Salmonella enterica enterica serovar Typhi
ugcauugccgggcuga

SEQ ID NO: 3663184 - RNA, 15 nt, Salmonella enterica enterica serovar Typhi
ugcauugcuuuuagu

SEQ ID NO: 3663185 - RNA, 13 nt, Salmonella enterica enterica serovar Typhi
ugcauuggccagc

SEQ ID NO: 3663186 - RNA, 18 nt, Salmonella enterica enterica serovar Typhi
ugcauuguacuuuuaaau

SEQ ID NO: 3663187 - RNA, 16 nt, Salmonella enterica enterica serovar Typhi
ugcauuguccgcauuc

SEQ ID NO: 3663188 - RNA, 17 nt, Salmonella enterica enterica serovar Typhi
ugcauuguccgcauucu

SEQ ID NO: 3663189 - RNA, 15 nt, Salmonella enterica enterica serovar Typhi
ugcauuguuccugcu

SEQ ID NO: 3663190 - RNA, 20 nt, Salmonella enterica enterica serovar Typhi
ugcauuuaucaaucugcuuu

SEQ ID NO: 3663191 - RNA, 22 nt, Salmonella enterica enterica serovar Typhi
ugccaaaaaaacuaauccucuu

SEQ ID NO: 3663192 - RNA, 23 nt, Salmonella enterica enterica serovar Typhi
ugccaaaagguuagguuaaauag

SEQ ID NO: 3663193 - RNA, 21 nt, Salmonella enterica enterica serovar Typhi
ugccaaacaucgcucgcgcca

SEQ ID NO: 3663194 - RNA, 20 nt, Salmonella enterica enterica serovar Typhi
ugccaacauggggagcagca

SEQ ID NO: 3663195 - RNA, 14 nt, Salmonella enterica enterica serovar Typhi
ugccaacggcgauc

SEQ ID NO: 3663196 - RNA, 16 nt, Salmonella enterica enterica serovar Typhi
ugccaaguaauaaaga

SEQ ID NO: 3663197 - RNA, 13 nt, Salmonella enterica enterica serovar Typhi
ugccaaucuccag

SEQ ID NO: 3663198 - RNA, 15 nt, Salmonella enterica enterica serovar Typhi
ugccaaugaaauaau

SEQ ID NO: 3663199 - RNA, 23 nt, Salmonella enterica enterica serovar Typhi
ugccaauggcgauaaaaauaucc

SEQ ID NO: 3663200 - RNA, 22 nt, Salmonella enterica enterica serovar Typhi
ugccacacccugagcgccgcca

SEQ ID NO: 3663201 - RNA, 15 nt, Salmonella enterica enterica serovar Typhi
ugccacagccucagc

SEQ ID NO: 3663202 - RNA, 13 nt, Salmonella enterica enterica serovar Typhi
ugccacaggccaa

SEQ ID NO: 3663203 - RNA, 14 nt, Salmonella enterica enterica serovar Typhi
ugccaccagcgcca

SEQ ID NO: 3663204 - RNA, 20 nt, Salmonella enterica enterica serovar Typhi
ugccacgaacgauauaaaaa

SEQ ID NO: 3663205 - RNA, 20 nt, Salmonella enterica enterica serovar Typhi
ugccacuacgcagcuccagc

SEQ ID NO: 3663206 - RNA, 13 nt, Salmonella enterica enterica serovar Typhi
ugccacuggccuc

SEQ ID NO: 3663207 - RNA, 21 nt, Salmonella enterica enterica serovar Typhi
ugccacuguucagaaaucggc

SEQ ID NO: 3663208 - RNA, 12 nt, Salmonella enterica enterica serovar Typhi
ugccacuguucg

SEQ ID NO: 3663209 - RNA, 22 nt, Salmonella enterica enterica serovar Typhi
ugccagaaacaacgcgggccau

SEQ ID NO: 3663210 - RNA, 15 nt, Salmonella enterica enterica serovar Typhi
ugccagaauacaccg

SEQ ID NO: 3663211 - RNA, 18 nt, Salmonella enterica enterica serovar Typhi
ugccagagauaauuuucc

SEQ ID NO: 3663212 - RNA, 12 nt, Salmonella enterica enterica serovar Typhi
ugccagcaccag

SEQ ID NO: 3663213 - RNA, 14 nt, Salmonella enterica enterica serovar Typhi
ugccagcaccagca

SEQ ID NO: 3663214 - RNA, 16 nt, Salmonella enterica enterica serovar Typhi
ugccagccauagccca

SEQ ID NO: 3663215 - RNA, 15 nt, Salmonella enterica enterica serovar Typhi
ugccagcccaauauc

SEQ ID NO: 3663216 - RNA, 15 nt, Salmonella enterica enterica serovar Typhi
ugccagccgccgccg

SEQ ID NO: 3663217 - RNA, 14 nt, Salmonella enterica enterica serovar Typhi
ugccagcgcugaga

SEQ ID NO: 3663218 - RNA, 14 nt, Salmonella enterica enterica serovar Typhi
ugccagcggccagg

SEQ ID NO: 3663219 - RNA, 20 nt, Salmonella enterica enterica serovar Typhi
ugccagcggccagggcguca

SEQ ID NO: 3663220 - RNA, 23 nt, Salmonella enterica enterica serovar Typhi
ugccagcgucgcugauugccgcc

SEQ ID NO: 3663221 - RNA, 19 nt, Salmonella enterica enterica serovar Typhi
ugccagcucguuauuuccg

SEQ ID NO: 3663222 - RNA, 20 nt, Salmonella enterica enterica serovar Typhi
ugccagcuuaaaucgcggcg

SEQ ID NO: 3663223 - RNA, 11 nt, Salmonella enterica enterica serovar Typhi
ugccaggcauu

SEQ ID NO: 3663224 - RNA, 16 nt, Salmonella enterica enterica serovar Typhi
ugccaggcuuccugcg

SEQ ID NO: 3663225 - RNA, 19 nt, Salmonella enterica enterica serovar Typhi
ugccagggcggaagcagau

SEQ ID NO: 3663226 - RNA, 14 nt, Salmonella enterica enterica serovar Typhi
ugccaggguucaac

SEQ ID NO: 3663227 - RNA, 14 nt, Salmonella enterica enterica serovar Typhi
ugccagguuauuuc

SEQ ID NO: 3663228 - RNA, 19 nt, Salmonella enterica enterica serovar Typhi
ugccaguaacguucuucga

SEQ ID NO: 3663229 - RNA, 23 nt, Salmonella enterica enterica serovar Typhi
ugccaguaaucccggucgcgcca

SEQ ID NO: 3663230 - RNA, 14 nt, Salmonella enterica enterica serovar Typhi
ugccaguacagcag

SEQ ID NO: 3663231 - RNA, 15 nt, Salmonella enterica enterica serovar Typhi
ugccaguacagcagc

SEQ ID NO: 3663232 - RNA, 16 nt, Salmonella enterica enterica serovar Typhi
ugccaguacagcagcg

SEQ ID NO: 3663233 - RNA, 14 nt, Salmonella enterica enterica serovar Typhi
ugccaguaccgccg

SEQ ID NO: 3663234 - RNA, 17 nt, Salmonella enterica enterica serovar Typhi
ugccaguaccgccgccg

SEQ ID NO: 3663235 - RNA, 23 nt, Salmonella enterica enterica serovar Typhi
ugccaguagcggaauaucuuccc

SEQ ID NO: 3663236 - RNA, 15 nt, Salmonella enterica enterica serovar Typhi
ugccaguagcugcuc

SEQ ID NO: 3663237 - RNA, 13 nt, Salmonella enterica enterica serovar Typhi
ugccagugaaaaa

SEQ ID NO: 3663238 - RNA, 14 nt, Salmonella enterica enterica serovar Typhi
ugccaguuaaugcc

SEQ ID NO: 3663239 - RNA, 17 nt, Salmonella enterica enterica serovar Typhi
ugccauaaaaacaauaa

SEQ ID NO: 3663240 - RNA, 20 nt, Salmonella enterica enterica serovar Typhi
ugccauaaagcggacugccu

SEQ ID NO: 3663241 - RNA, 19 nt, Salmonella enterica enterica serovar Typhi
ugccauaaucgauauaauu

SEQ ID NO: 3663242 - RNA, 22 nt, Salmonella enterica enterica serovar Typhi
ugccauaaucgauauaauuuua

SEQ ID NO: 3663243 - RNA, 17 nt, Salmonella enterica enterica serovar Typhi
ugccauacuguuuauca

SEQ ID NO: 3663244 - RNA, 13 nt, Salmonella enterica enterica serovar Typhi
ugccauauucaac

SEQ ID NO: 3663245 - RNA, 21 nt, Salmonella enterica enterica serovar Typhi
ugccauauuguucaguuucaa

SEQ ID NO: 3663246 - RNA, 19 nt, Salmonella enterica enterica serovar Typhi
ugccauauuuuuccagcgc

SEQ ID NO: 3663247 - RNA, 21 nt, Salmonella enterica enterica serovar Typhi
ugccauauuuuuccagcgccu

SEQ ID NO: 3663248 - RNA, 16 nt, Salmonella enterica enterica serovar Typhi
ugccaucaucaguaac

SEQ ID NO: 3663249 - RNA, 19 nt, Salmonella enterica enterica serovar Typhi
ugccaucaucaguaacacc

SEQ ID NO: 3663250 - RNA, 23 nt, Salmonella enterica enterica serovar Typhi
ugccaucgaccgauugggcucag

SEQ ID NO: 3663251 - RNA, 17 nt, Salmonella enterica enterica serovar Typhi
ugccaucggauauauuu

SEQ ID NO: 3663252 - RNA, 14 nt, Salmonella enterica enterica serovar Typhi
ugccaucggccagc

SEQ ID NO: 3663253 - RNA, 17 nt, Salmonella enterica enterica serovar Typhi
ugccaucuccugcgaua

SEQ ID NO: 3663254 - RNA, 15 nt, Salmonella enterica enterica serovar Typhi
ugccauguuaauacc

SEQ ID NO: 3663255 - RNA, 13 nt, Salmonella enterica enterica serovar Typhi
ugccauguuucuu

SEQ ID NO: 3663256 - RNA, 21 nt, Salmonella enterica enterica serovar Typhi
ugccgcccguuuuuuccagcg

SEQ ID NO: 3663257 - RNA, 21 nt, Salmonella enterica enterica serovar Typhi
ugccgccgacaaccagcgaaa

SEQ ID NO: 3663258 - RNA, 14 nt, Salmonella enterica enterica serovar Typhi
ugccgccgcaccac

SEQ ID NO: 3663259 - RNA, 23 nt, Salmonella enterica enterica serovar Typhi
ugccgccgucaucugcgccgaca

SEQ ID NO: 3663260 - RNA, 23 nt, Salmonella enterica enterica serovar Typhi
ugccgcgaccacgcauaccagcc

SEQ ID NO: 3663261 - RNA, 14 nt, Salmonella enterica enterica serovar Typhi
ugccgcgaucgcgg

SEQ ID NO: 3663262 - RNA, 15 nt, Salmonella enterica enterica serovar Typhi
ugccgcgaucgcggc

SEQ ID NO: 3663263 - RNA, 18 nt, Salmonella enterica enterica serovar Typhi
ugccgcgccugccauagc

SEQ ID NO: 3663264 - RNA, 23 nt, Salmonella enterica enterica serovar Typhi
ugccgcgcuggugggacuguuca

SEQ ID NO: 3663265 - RNA, 16 nt, Salmonella enterica enterica serovar Typhi
ugccgcguuacucggc

SEQ ID NO: 3663266 - RNA, 18 nt, Salmonella enterica enterica serovar Typhi
ugccgcugaccgccggaa

SEQ ID NO: 3663267 - RNA, 15 nt, Salmonella enterica enterica serovar Typhi
ugccgcugcugccuu

SEQ ID NO: 3663268 - RNA, 17 nt, Salmonella enterica enterica serovar Typhi
ugccgcuuccaguccag

SEQ ID NO: 3663269 - RNA, 23 nt, Salmonella enterica enterica serovar Typhi
ugccggaaagacggcagcgccau

SEQ ID NO: 3663270 - RNA, 23 nt, Salmonella enterica enterica serovar Typhi
ugccggaaaucgcggcgauggaa

SEQ ID NO: 3663271 - RNA, 19 nt, Salmonella enterica enterica serovar Typhi
ugccggaagcggacgggcg

SEQ ID NO: 3663272 - RNA, 15 nt, Salmonella enterica enterica serovar Typhi
ugccggacgccacca

SEQ ID NO: 3663273 - RNA, 15 nt, Salmonella enterica enterica serovar Typhi
ugccggacugauacc

SEQ ID NO: 3663274 - RNA, 17 nt, Salmonella enterica enterica serovar Typhi
ugccggauaagcguagc

SEQ ID NO: 3663275 - RNA, 19 nt, Salmonella enterica enterica serovar Typhi
ugccggauggcgcuaaugc

SEQ ID NO: 3663276 - RNA, 17 nt, Salmonella enterica enterica serovar Typhi
ugccggauggcggcgug

SEQ ID NO: 3663277 - RNA, 21 nt, Salmonella enterica enterica serovar Typhi
ugccggccugauauccacguu

SEQ ID NO: 3663278 - RNA, 12 nt, Salmonella enterica enterica serovar Typhi
ugccggcguucc

SEQ ID NO: 3663279 - RNA, 23 nt, Salmonella enterica enterica serovar Typhi
ugccgggacuuuaaacgucaugc

SEQ ID NO: 3663280 - RNA, 13 nt, Salmonella enterica enterica serovar Typhi
ugccgggcaaaaa

SEQ ID NO: 3663281 - RNA, 14 nt, Salmonella enterica enterica serovar Typhi
ugccgggcaaaaaa

SEQ ID NO: 3663282 - RNA, 20 nt, Salmonella enterica enterica serovar Typhi
ugccgggcaaaaaacggaac

SEQ ID NO: 3663283 - RNA, 21 nt, Salmonella enterica enterica serovar Typhi
ugccgggcauaaacuaauccc

SEQ ID NO: 3663284 - RNA, 13 nt, Salmonella enterica enterica serovar Typhi
ugccgggccuggc

SEQ ID NO: 3663285 - RNA, 15 nt, Salmonella enterica enterica serovar Typhi
ugccgggccuggcau

SEQ ID NO: 3663286 - RNA, 16 nt, Salmonella enterica enterica serovar Typhi
ugccgggugcggcgcu

SEQ ID NO: 3663287 - RNA, 23 nt, Salmonella enterica enterica serovar Typhi
ugccggguucguuaacccggcau

SEQ ID NO: 3663288 - RNA, 15 nt, Salmonella enterica enterica serovar Typhi
ugccgguuaacucuu

SEQ ID NO: 3663289 - RNA, 23 nt, Salmonella enterica enterica serovar Typhi
ugccgguuuuagcaaugaugaug

SEQ ID NO: 3663290 - RNA, 18 nt, Salmonella enterica enterica serovar Typhi
ugccgguuuuugaaccau

SEQ ID NO: 3663291 - RNA, 17 nt, Salmonella enterica enterica serovar Typhi
ugccguaaggcgauuca

SEQ ID NO: 3663292 - RNA, 21 nt, Salmonella enterica enterica serovar Typhi
ugccguagaaaaugcgcuggg

SEQ ID NO: 3663293 - RNA, 20 nt, Salmonella enterica enterica serovar Typhi
ugccgucaaacaagccgcca

SEQ ID NO: 3663294 - RNA, 18 nt, Salmonella enterica enterica serovar Typhi
ugccgucaauuuuaagaa

SEQ ID NO: 3663295 - RNA, 13 nt, Salmonella enterica enterica serovar Typhi
ugccgucaucgac

SEQ ID NO: 3663296 - RNA, 18 nt, Salmonella enterica enterica serovar Typhi
ugccguccggcaucacaa

SEQ ID NO: 3663297 - RNA, 21 nt, Salmonella enterica enterica serovar Typhi
ugccguccggucuacaaguga

SEQ ID NO: 3663298 - RNA, 19 nt, Salmonella enterica enterica serovar Typhi
ugccgucgcggcuuucagc

SEQ ID NO: 3663299 - RNA, 21 nt, Salmonella enterica enterica serovar Typhi
ugccgucggcaauuaacauuu

SEQ ID NO: 3663300 - RNA, 20 nt, Salmonella enterica enterica serovar Typhi
ugccgugaauauucagaucg

SEQ ID NO: 3663301 - RNA, 12 nt, Salmonella enterica enterica serovar Typhi
ugccgugccggg

SEQ ID NO: 3663302 - RNA, 17 nt, Salmonella enterica enterica serovar Typhi
ugccguuaacugcugcu

SEQ ID NO: 3663303 - RNA, 14 nt, Salmonella enterica enterica serovar Typhi
ugccguuaauaaug

SEQ ID NO: 3663304 - RNA, 15 nt, Salmonella enterica enterica serovar Typhi
ugccguuaauaaugu

SEQ ID NO: 3663305 - RNA, 21 nt, Salmonella enterica enterica serovar Typhi
ugccguuugcgccagcccggc

SEQ ID NO: 3663306 - RNA, 17 nt, Salmonella enterica enterica serovar Typhi
ugccguuuuccagccgu

SEQ ID NO: 3663307 - RNA, 18 nt, Salmonella enterica enterica serovar Typhi
ugccguuuuucucaucaa

SEQ ID NO: 3663308 - RNA, 12 nt, Salmonella enterica enterica serovar Typhi
ugccuaaagaaa

SEQ ID NO: 3663309 - RNA, 19 nt, Salmonella enterica enterica serovar Typhi
ugccuaacuggaaaaagac

SEQ ID NO: 3663310 - RNA, 20 nt, Salmonella enterica enterica serovar Typhi
ugccuaagauggcgccuugc

SEQ ID NO: 3663311 - RNA, 12 nt, Salmonella enterica enterica serovar Typhi
ugccuaccgggc

SEQ ID NO: 3663312 - RNA, 14 nt, Salmonella enterica enterica serovar Typhi
ugccuacgcggcca

SEQ ID NO: 3663313 - RNA, 21 nt, Salmonella enterica enterica serovar Typhi
ugccuacugcccuacgcuucu

SEQ ID NO: 3663314 - RNA, 17 nt, Salmonella enterica enterica serovar Typhi
ugccuauucaccagacu

SEQ ID NO: 3663315 - RNA, 19 nt, Salmonella enterica enterica serovar Typhi
ugccucaccccauggcguc

SEQ ID NO: 3663316 - RNA, 16 nt, Salmonella enterica enterica serovar Typhi
ugccucacccugaaau

SEQ ID NO: 3663317 - RNA, 15 nt, Salmonella enterica enterica serovar Typhi
ugccucgcgcaccau

SEQ ID NO: 3663318 - RNA, 17 nt, Salmonella enterica enterica serovar Typhi
ugccucguuucccucau

SEQ ID NO: 3663319 - RNA, 19 nt, Salmonella enterica enterica serovar Typhi
ugccucguuucccucauau

SEQ ID NO: 3663320 - RNA, 19 nt, Salmonella enterica enterica serovar Typhi
ugccucuggccaguuucaa

SEQ ID NO: 3663321 - RNA, 14 nt, Salmonella enterica enterica serovar Typhi
ugccugaaccggug

SEQ ID NO: 3663322 - RNA, 16 nt, Salmonella enterica enterica serovar Typhi
ugccugacaaugacgc

SEQ ID NO: 3663323 - RNA, 17 nt, Salmonella enterica enterica serovar Typhi
ugccugacagcaaugag

SEQ ID NO: 3663324 - RNA, 15 nt, Salmonella enterica enterica serovar Typhi
ugccugacgccugaa

SEQ ID NO: 3663325 - RNA, 14 nt, Salmonella enterica enterica serovar Typhi
ugccugaucgccac

SEQ ID NO: 3663326 - RNA, 17 nt, Salmonella enterica enterica serovar Typhi
ugccugauuucccaguu

SEQ ID NO: 3663327 - RNA, 22 nt, Salmonella enterica enterica serovar Typhi
ugccugccgucgcggcuuucag

SEQ ID NO: 3663328 - RNA, 22 nt, Salmonella enterica enterica serovar Typhi
ugccugccguuuuuaacgccgg

SEQ ID NO: 3663329 - RNA, 18 nt, Salmonella enterica enterica serovar Typhi
ugccugcguugcuauggc

SEQ ID NO: 3663330 - RNA, 15 nt, Salmonella enterica enterica serovar Typhi
ugccugcuucagaca

SEQ ID NO: 3663331 - RNA, 12 nt, Salmonella enterica enterica serovar Typhi
ugccuggccucc

SEQ ID NO: 3663332 - RNA, 17 nt, Salmonella enterica enterica serovar Typhi
ugccuguagcagcgcca

SEQ ID NO: 3663333 - RNA, 18 nt, Salmonella enterica enterica serovar Typhi
ugccugucgucaccugua

SEQ ID NO: 3663334 - RNA, 13 nt, Salmonella enterica enterica serovar Typhi
ugccugugccagc

SEQ ID NO: 3663335 - RNA, 18 nt, Salmonella enterica enterica serovar Typhi
ugccuguguaucgcccug

SEQ ID NO: 3663336 - RNA, 22 nt, Salmonella enterica enterica serovar Typhi
ugccuguguucguggacgagca

SEQ ID NO: 3663337 - RNA, 18 nt, Salmonella enterica enterica serovar Typhi
ugccuguugcgggccagc

SEQ ID NO: 3663338 - RNA, 14 nt, Salmonella enterica enterica serovar Typhi
ugccuuauccggcc

SEQ ID NO: 3663339 - RNA, 18 nt, Salmonella enterica enterica serovar Typhi
ugccuucaaauauauuga

SEQ ID NO: 3663340 - RNA, 17 nt, Salmonella enterica enterica serovar Typhi
ugccuuccaggcgguga

SEQ ID NO: 3663341 - RNA, 20 nt, Salmonella enterica enterica serovar Typhi
ugcgccugucuccagcgccg

SEQ ID NO: 3663342 - RNA, 18 nt, Salmonella enterica enterica serovar Typhi
ugcgccugugguuuaaaa

SEQ ID NO: 3663343 - RNA, 22 nt, Salmonella enterica enterica serovar Typhi
ugcgccuguuagggcgcggcug

SEQ ID NO: 3663344 - RNA, 23 nt, Salmonella enterica enterica serovar Typhi
ugcgccuguuagggcgcggcugg

SEQ ID NO: 3663345 - RNA, 16 nt, Salmonella enterica enterica serovar Typhi
ugcgccuguugacgcg

SEQ ID NO: 3663346 - RNA, 23 nt, Salmonella enterica enterica serovar Typhi
ugcgccuuaucaagccuacaccu

SEQ ID NO: 3663347 - RNA, 12 nt, Salmonella enterica enterica serovar Typhi
ugcgccuuccag

SEQ ID NO: 3663348 - RNA, 13 nt, Salmonella enterica enterica serovar Typhi
ugcgccuuccagu

SEQ ID NO: 3663349 - RNA, 17 nt, Salmonella enterica enterica serovar Typhi
ugcgcgacgacgccagc

SEQ ID NO: 3663350 - RNA, 18 nt, Salmonella enterica enterica serovar Typhi
ugcgcgacgacgccagcc

SEQ ID NO: 3663351 - RNA, 18 nt, Salmonella enterica enterica serovar Typhi
ugcgcgcgaugcugcucc

SEQ ID NO: 3663352 - RNA, 19 nt, Salmonella enterica enterica serovar Typhi
ugcgcgcgaugcugcucca

SEQ ID NO: 3663353 - RNA, 12 nt, Salmonella enterica enterica serovar Typhi
ugcgcgcuauuc

SEQ ID NO: 3663354 - RNA, 23 nt, Salmonella enterica enterica serovar Typhi
ugcgcgcuggugucgccguggaa

SEQ ID NO: 3663355 - RNA, 15 nt, Salmonella enterica enterica serovar Typhi
ugcgcggauaccggc

SEQ ID NO: 3663356 - RNA, 23 nt, Salmonella enterica enterica serovar Typhi
ugcgcggcacacuuucaucagcc

SEQ ID NO: 3663357 - RNA, 17 nt, Salmonella enterica enterica serovar Typhi
ugcgcggcgaaaaagcc

SEQ ID NO: 3663358 - RNA, 22 nt, Salmonella enterica enterica serovar Typhi
ugcgcggcgacgcgaggcuuuu

SEQ ID NO: 3663359 - RNA, 17 nt, Salmonella enterica enterica serovar Typhi
ugcgcgguccacaggcc

SEQ ID NO: 3663360 - RNA, 22 nt, Salmonella enterica enterica serovar Typhi
ugcgcguaaacgcaacaccauc

SEQ ID NO: 3663361 - RNA, 14 nt, Salmonella enterica enterica serovar Typhi
ugcgcguaaauuuc

SEQ ID NO: 3663362 - RNA, 16 nt, Salmonella enterica enterica serovar Typhi
ugcgcguaaauuucac

SEQ ID NO: 3663363 - RNA, 20 nt, Salmonella enterica enterica serovar Typhi
ugcgcguaaauuucacuuau

SEQ ID NO: 3663364 - RNA, 20 nt, Salmonella enterica enterica serovar Typhi
ugcgcguagcccacagguag

SEQ ID NO: 3663365 - RNA, 14 nt, Salmonella enterica enterica serovar Typhi
ugcgcgucccucuc

SEQ ID NO: 3663366 - RNA, 17 nt, Salmonella enterica enterica serovar Typhi
ugcgcgucccucuccag

SEQ ID NO: 3663367 - RNA, 17 nt, Salmonella enterica enterica serovar Typhi
ugcgcguucugcuccag

SEQ ID NO: 3663368 - RNA, 20 nt, Salmonella enterica enterica serovar Typhi
ugcgcguuuagcgccagcag

SEQ ID NO: 3663369 - RNA, 16 nt, Salmonella enterica enterica serovar Typhi
ugcgcuaacuggccaa

SEQ ID NO: 3663370 - RNA, 23 nt, Salmonella enterica enterica serovar Typhi
ugcgcuaagcguuacggaaaaaa

SEQ ID NO: 3663371 - RNA, 22 nt, Salmonella enterica enterica serovar Typhi
ugcgcucacgcuuauccggccu

SEQ ID NO: 3663372 - RNA, 16 nt, Salmonella enterica enterica serovar Typhi
ugcgcucagggucaga

SEQ ID NO: 3663373 - RNA, 18 nt, Salmonella enterica enterica serovar Typhi
ugcgcucaugcgccuggc

SEQ ID NO: 3663374 - RNA, 15 nt, Salmonella enterica enterica serovar Typhi
ugcgcuccugcuccc

SEQ ID NO: 3663375 - RNA, 17 nt, Salmonella enterica enterica serovar Typhi
ugcgcucucauagccga

SEQ ID NO: 3663376 - RNA, 17 nt, Salmonella enterica enterica serovar Typhi
ugcgcugcggccagacc

SEQ ID NO: 3663377 - RNA, 15 nt, Salmonella enterica enterica serovar Typhi
ugcgcuggaacugau

SEQ ID NO: 3663378 - RNA, 19 nt, Salmonella enterica enterica serovar Typhi
ugcgcuggaacugaucgug

SEQ ID NO: 3663379 - RNA, 14 nt, Salmonella enterica enterica serovar Typhi
ugcgcuggacuggg

SEQ ID NO: 3663380 - RNA, 18 nt, Salmonella enterica enterica serovar Typhi
ugcgcugguuggcgcgcu

SEQ ID NO: 3663381 - RNA, 15 nt, Salmonella enterica enterica serovar Typhi
ugcgcugucaccagc

SEQ ID NO: 3663382 - RNA, 16 nt, Salmonella enterica enterica serovar Typhi
ugcgcugucaccagca

SEQ ID NO: 3663383 - RNA, 11 nt, Salmonella enterica enterica serovar Typhi
ugcgcuuacca

SEQ ID NO: 3663384 - RNA, 16 nt, Salmonella enterica enterica serovar Typhi
ugcgcuuaccgggccu

SEQ ID NO: 3663385 - RNA, 19 nt, Salmonella enterica enterica serovar Typhi
ugcgcuuaucagaccgaca

SEQ ID NO: 3663386 - RNA, 15 nt, Salmonella enterica enterica serovar Typhi
ugcgcuuccagcaug

SEQ ID NO: 3663387 - RNA, 17 nt, Salmonella enterica enterica serovar Typhi
ugcgcuucgaugcguuc

SEQ ID NO: 3663388 - RNA, 22 nt, Salmonella enterica enterica serovar Typhi
ugcgcuucgaugcguucaaaaa

SEQ ID NO: 3663389 - RNA, 16 nt, Salmonella enterica enterica serovar Typhi
ugcgcuucggccacgg

SEQ ID NO: 3663390 - RNA, 15 nt, Salmonella enterica enterica serovar Typhi
ugcgcuucguuaccg

SEQ ID NO: 3663391 - RNA, 16 nt, Salmonella enterica enterica serovar Typhi
ugcgcuuuacuguucc

SEQ ID NO: 3663392 - RNA, 16 nt, Salmonella enterica enterica serovar Typhi
ugcgcuuuuccaggcg

SEQ ID NO: 3663393 - RNA, 15 nt, Salmonella enterica enterica serovar Typhi
ugcggaacaccagcg

SEQ ID NO: 3663394 - RNA, 17 nt, Salmonella enterica enterica serovar Typhi
ugcggaacaccagcgcc

SEQ ID NO: 3663395 - RNA, 18 nt, Salmonella enterica enterica serovar Typhi
ugcggaacaccagcgccg

SEQ ID NO: 3663396 - RNA, 21 nt, Salmonella enterica enterica serovar Typhi
ugcggaacaccagcgccgcgg

SEQ ID NO: 3663397 - RNA, 16 nt, Salmonella enterica enterica serovar Typhi
ugcggaaccgcccauc

SEQ ID NO: 3663398 - RNA, 17 nt, Salmonella enterica enterica serovar Typhi
ugcggaauacacgaaca

SEQ ID NO: 3663399 - RNA, 20 nt, Salmonella enterica enterica serovar Typhi
ugcggacgcagcucauaccc

SEQ ID NO: 3663400 - RNA, 21 nt, Salmonella enterica enterica serovar Typhi
ugcggagagagcaauggcgug

SEQ ID NO: 3663401 - RNA, 21 nt, Salmonella enterica enterica serovar Typhi
ugcggauuaucguccggcauc

SEQ ID NO: 3663402 - RNA, 14 nt, Salmonella enterica enterica serovar Typhi
ugcggcaagcgcgc

SEQ ID NO: 3663403 - RNA, 18 nt, Salmonella enterica enterica serovar Typhi
ugcggcagggcggucugg

SEQ ID NO: 3663404 - RNA, 16 nt, Salmonella enterica enterica serovar Typhi
ugcggcaucgaacggg

SEQ ID NO: 3663405 - RNA, 18 nt, Salmonella enterica enterica serovar Typhi
ugcggcauuagcaugggc

SEQ ID NO: 3663406 - RNA, 22 nt, Salmonella enterica enterica serovar Typhi
ugcggcgaaacagaguaacccg

SEQ ID NO: 3663407 - RNA, 11 nt, Salmonella enterica enterica serovar Typhi
ugcggcgacuu

SEQ ID NO: 3663408 - RNA, 22 nt, Salmonella enterica enterica serovar Typhi
ugcggcgaggaguaguuaaaaa

SEQ ID NO: 3663409 - RNA, 16 nt, Salmonella enterica enterica serovar Typhi
ugcggcggacgccggg

SEQ ID NO: 3663410 - RNA, 18 nt, Salmonella enterica enterica serovar Typhi
ugcggcguguuguaaaac

SEQ ID NO: 3663411 - RNA, 20 nt, Salmonella enterica enterica serovar Typhi
ugcggcuauauaaaaucggg

SEQ ID NO: 3663412 - RNA, 16 nt, Salmonella enterica enterica serovar Typhi
ugcggcuucagcgaca

SEQ ID NO: 3663413 - RNA, 15 nt, Salmonella enterica enterica serovar Typhi
ugcggcuuucaucau

SEQ ID NO: 3663414 - RNA, 20 nt, Salmonella enterica enterica serovar Typhi
ugcggcuuugcgccggcagu

SEQ ID NO: 3663415 - RNA, 23 nt, Salmonella enterica enterica serovar Typhi
ugcgggaaauaccauccgcgccg

SEQ ID NO: 3663416 - RNA, 18 nt, Salmonella enterica enterica serovar Typhi
ugcgggaacagauaaaug

SEQ ID NO: 3663417 - RNA, 16 nt, Salmonella enterica enterica serovar Typhi
ugcgggacgcaucauc

SEQ ID NO: 3663418 - RNA, 22 nt, Salmonella enterica enterica serovar Typhi
ugcgggaguggcgaaauuggua

SEQ ID NO: 3663419 - RNA, 15 nt, Salmonella enterica enterica serovar Typhi
ugcgggccagcagcc

SEQ ID NO: 3663420 - RNA, 22 nt, Salmonella enterica enterica serovar Typhi
ugcgggccguaaaguucccagc

SEQ ID NO: 3663421 - RNA, 19 nt, Salmonella enterica enterica serovar Typhi
ugcggggagcgaaaaggcc

SEQ ID NO: 3663422 - RNA, 20 nt, Salmonella enterica enterica serovar Typhi
ugcggguguccguuccugcc

SEQ ID NO: 3663423 - RNA, 19 nt, Salmonella enterica enterica serovar Typhi
ugcgguagcuccagacagg

SEQ ID NO: 3663424 - RNA, 17 nt, Salmonella enterica enterica serovar Typhi
ugcggucaaaagcugca

SEQ ID NO: 3663425 - RNA, 15 nt, Salmonella enterica enterica serovar Typhi
ugcggucuccugaac

SEQ ID NO: 3663426 - RNA, 18 nt, Salmonella enterica enterica serovar Typhi
ugcugcaaauugauacca

SEQ ID NO: 3663427 - RNA, 16 nt, Salmonella enterica enterica serovar Typhi
ugcugcaacgacgcgg

SEQ ID NO: 3663428 - RNA, 14 nt, Salmonella enterica enterica serovar Typhi
ugcugcaccgcauc

SEQ ID NO: 3663429 - RNA, 20 nt, Salmonella enterica enterica serovar Typhi
ugcugcaucuccagcguggc

SEQ ID NO: 3663430 - RNA, 16 nt, Salmonella enterica enterica serovar Typhi
ugcugccacgucacgc

SEQ ID NO: 3663431 - RNA, 16 nt, Salmonella enterica enterica serovar Typhi
ugcugccagucugccc

SEQ ID NO: 3663432 - RNA, 14 nt, Salmonella enterica enterica serovar Typhi
ugcugcgcuuuguc

SEQ ID NO: 3663433 - RNA, 22 nt, Salmonella enterica enterica serovar Typhi
ugcugcggcacgaaaaauaaaa

SEQ ID NO: 3663434 - RNA, 22 nt, Salmonella enterica enterica serovar Typhi
ugcugcgguuauaauaauaauu

SEQ ID NO: 3663435 - RNA, 15 nt, Salmonella enterica enterica serovar Typhi
ugcugcucccucacg

SEQ ID NO: 3663436 - RNA, 16 nt, Salmonella enterica enterica serovar Typhi
ugcugcucgaagauga

SEQ ID NO: 3663437 - RNA, 17 nt, Salmonella enterica enterica serovar Typhi
ugcugcucgcuaugaaa

SEQ ID NO: 3663438 - RNA, 13 nt, Salmonella enterica enterica serovar Typhi
ugcugcugaaaga

SEQ ID NO: 3663439 - RNA, 19 nt, Salmonella enterica enterica serovar Typhi
ugcugcugaaagaagacga

SEQ ID NO: 3663440 - RNA, 18 nt, Salmonella enterica enterica serovar Typhi
ugcugcuuuaaccuggcg

SEQ ID NO: 3663441 - RNA, 22 nt, Salmonella enterica enterica serovar Typhi
ugcugcuuuaaccuggcgcaca

SEQ ID NO: 3663442 - RNA, 11 nt, Salmonella enterica enterica serovar Typhi
ugcuggcagau

SEQ ID NO: 3663443 - RNA, 12 nt, Salmonella enterica enterica serovar Typhi
ugcuggccgcgu

SEQ ID NO: 3663444 - RNA, 14 nt, Salmonella enterica enterica serovar Typhi
ugcuggcgaugagu

SEQ ID NO: 3663445 - RNA, 13 nt, Salmonella enterica enterica serovar Typhi
ugcuggcgcguca

SEQ ID NO: 3663446 - RNA, 20 nt, Salmonella enterica enterica serovar Typhi
ugcuggcgcgucacaacagc

SEQ ID NO: 3663447 - RNA, 21 nt, Salmonella enterica enterica serovar Typhi
ugcuggcgcgucacaacagcc

SEQ ID NO: 3663448 - RNA, 15 nt, Salmonella enterica enterica serovar Typhi
ugcuggcggcaaggc

SEQ ID NO: 3663449 - RNA, 16 nt, Salmonella enterica enterica serovar Typhi
ugcuggcuuaacucac

SEQ ID NO: 3663450 - RNA, 20 nt, Salmonella enterica enterica serovar Typhi
ugcuggucagcaacgccucc

SEQ ID NO: 3663451 - RNA, 16 nt, Salmonella enterica enterica serovar Typhi
ugcuggugaccgccuu

SEQ ID NO: 3663452 - RNA, 13 nt, Salmonella enterica enterica serovar Typhi
ugcuggugguggg

SEQ ID NO: 3663453 - RNA, 14 nt, Salmonella enterica enterica serovar Typhi
ugcugguggugggc

SEQ ID NO: 3663454 - RNA, 13 nt, Salmonella enterica enterica serovar Typhi
ugcuguaaaauau

SEQ ID NO: 3663455 - RNA, 14 nt, Salmonella enterica enterica serovar Typhi
ugcuguaaccccug

SEQ ID NO: 3663456 - RNA, 17 nt, Salmonella enterica enterica serovar Typhi
ugcuguacauauccagu

SEQ ID NO: 3663457 - RNA, 19 nt, Salmonella enterica enterica serovar Typhi
ugcuguagcgucucaucaa

SEQ ID NO: 3663458 - RNA, 18 nt, Salmonella enterica enterica serovar Typhi
ugcuguagcugcccggau

SEQ ID NO: 3663459 - RNA, 16 nt, Salmonella enterica enterica serovar Typhi
ugcuguaggccggaug

SEQ ID NO: 3663460 - RNA, 16 nt, Salmonella enterica enterica serovar Typhi
ugcuguaggccgggua

SEQ ID NO: 3663461 - RNA, 16 nt, Salmonella enterica enterica serovar Typhi
ugcuguccgccagcaa

SEQ ID NO: 3663462 - RNA, 20 nt, Salmonella enterica enterica serovar Typhi
ugcuguccggcugcauauac

SEQ ID NO: 3663463 - RNA, 18 nt, Salmonella enterica enterica serovar Typhi
ugcugucgcccauugaaa

SEQ ID NO: 3663464 - RNA, 23 nt, Salmonella enterica enterica serovar Typhi
ugcugucgcccauugaaaucgcc

SEQ ID NO: 3663465 - RNA, 16 nt, Salmonella enterica enterica serovar Typhi
ugcugucuuagugaaa

SEQ ID NO: 3663466 - RNA, 12 nt, Salmonella enterica enterica serovar Typhi
ugcugugaagua

SEQ ID NO: 3663467 - RNA, 15 nt, Salmonella enterica enterica serovar Typhi
ugcugugacaucgcc

SEQ ID NO: 3663468 - RNA, 14 nt, Salmonella enterica enterica serovar Typhi
ugcugugcauaaau

SEQ ID NO: 3663469 - RNA, 14 nt, Salmonella enterica enterica serovar Typhi
ugcugugcauaucu

SEQ ID NO: 3663470 - RNA, 20 nt, Salmonella enterica enterica serovar Typhi
ugcugugccaguaccgccgc

SEQ ID NO: 3663471 - RNA, 16 nt, Salmonella enterica enterica serovar Typhi
ugcugugccugccugu

SEQ ID NO: 3663472 - RNA, 22 nt, Salmonella enterica enterica serovar Typhi
ugcuguggauuuauggcgucac

SEQ ID NO: 3663473 - RNA, 14 nt, Salmonella enterica enterica serovar Typhi
ugcugugugaccag

SEQ ID NO: 3663474 - RNA, 16 nt, Salmonella enterica enterica serovar Typhi
ugcugugugaccagca

SEQ ID NO: 3663475 - RNA, 14 nt, Salmonella enterica enterica serovar Typhi
ugcuguucuucccu

SEQ ID NO: 3663476 - RNA, 17 nt, Salmonella enterica enterica serovar Typhi
ugcuguuuauggcgcuu

SEQ ID NO: 3663477 - RNA, 15 nt, Salmonella enterica enterica serovar Typhi
ugcuuaaaggcggca

SEQ ID NO: 3663478 - RNA, 21 nt, Salmonella enterica enterica serovar Typhi
ugcuuaauauccaguugcgcc

SEQ ID NO: 3663479 - RNA, 17 nt, Salmonella enterica enterica serovar Typhi
ugcuuaaugcucugcug

SEQ ID NO: 3663480 - RNA, 13 nt, Salmonella enterica enterica serovar Typhi
ugcuuaccagacc

SEQ ID NO: 3663481 - RNA, 20 nt, Salmonella enterica enterica serovar Typhi
ugcuuaccuuguucuuccau

SEQ ID NO: 3663482 - RNA, 22 nt, Salmonella enterica enterica serovar Typhi
ugcuuagcuggccaaucagcgg

SEQ ID NO: 3663483 - RNA, 17 nt, Salmonella enterica enterica serovar Typhi
ugcuuaucaaguaacgu

SEQ ID NO: 3663484 - RNA, 18 nt, Salmonella enterica enterica serovar Typhi
ugcuuaucgauaucugcc

SEQ ID NO: 3663485 - RNA, 14 nt, Salmonella enterica enterica serovar Typhi
ugcuuaugaucgcc

SEQ ID NO: 3663486 - RNA, 18 nt, Salmonella enterica enterica serovar Typhi
ugcuuauguaggccugau

SEQ ID NO: 3663487 - RNA, 18 nt, Salmonella enterica enterica serovar Typhi
ugcuucacggaaggggcc

SEQ ID NO: 3663488 - RNA, 21 nt, Salmonella enterica enterica serovar Typhi
ugcuucacgggguugaaguag

SEQ ID NO: 3663489 - RNA, 20 nt, Salmonella enterica enterica serovar Typhi
ugcuucacguuuuccaggug

SEQ ID NO: 3663490 - RNA, 22 nt, Salmonella enterica enterica serovar Typhi
ugcuucacguuuuccaggugcu

SEQ ID NO: 3663491 - RNA, 13 nt, Salmonella enterica enterica serovar Typhi
ugcuucagccaga

SEQ ID NO: 3663492 - RNA, 14 nt, Salmonella enterica enterica serovar Typhi
ugcuucaugcacaa

SEQ ID NO: 3663493 - RNA, 13 nt, Salmonella enterica enterica serovar Typhi
ugcuuccagcucc

SEQ ID NO: 3663494 - RNA, 14 nt, Salmonella enterica enterica serovar Typhi
ugcuuccagcucca

SEQ ID NO: 3663495 - RNA, 19 nt, Salmonella enterica enterica serovar Typhi
ugcuuccagcuccauccac

SEQ ID NO: 3663496 - RNA, 12 nt, Salmonella enterica enterica serovar Typhi
ugcuucgcgccu

SEQ ID NO: 3663497 - RNA, 16 nt, Salmonella enterica enterica serovar Typhi
ugcuucgucccugcau

SEQ ID NO: 3663498 - RNA, 13 nt, Salmonella enterica enterica serovar Typhi
ugcuucucuucaa

SEQ ID NO: 3663499 - RNA, 12 nt, Salmonella enterica enterica serovar Typhi
ugcuuuaauauu

SEQ ID NO: 3663500 - RNA, 16 nt, Salmonella enterica enterica serovar Typhi
ugcuuucaauaaauca

SEQ ID NO: 3663501 - RNA, 23 nt, Salmonella enterica enterica serovar Typhi
ugcuuucgagcguaggccugaua

SEQ ID NO: 3663502 - RNA, 19 nt, Salmonella enterica enterica serovar Typhi
ugcuuucgcgauaaucaac

SEQ ID NO: 3663503 - RNA, 16 nt, Salmonella enterica enterica serovar Typhi
ugcuuucucgggccug

SEQ ID NO: 3663504 - RNA, 21 nt, Salmonella enterica enterica serovar Typhi
ugcuuuggccgguucggccag

SEQ ID NO: 3663505 - RNA, 21 nt, Salmonella enterica enterica serovar Typhi
ugcuuuuaauagcguagccug

SEQ ID NO: 3663506 - RNA, 22 nt, Salmonella enterica enterica serovar Typhi
ugcuuuuaguuguacaaacugu

SEQ ID NO: 3663507 - RNA, 18 nt, Salmonella enterica enterica serovar Typhi
ugcuuuuggcaacggcag

SEQ ID NO: 3663508 - RNA, 16 nt, Salmonella enterica enterica serovar Typhi
ugcuuuuuauuuuucu

SEQ ID NO: 3663509 - RNA, 20 nt, Salmonella enterica enterica serovar Typhi
ugcuuuuuauuuuucuggcu

SEQ ID NO: 3663510 - RNA, 22 nt, Salmonella enterica enterica serovar Typhi
ugcuuuuugauacagcagcacc

SEQ ID NO: 3663511 - RNA, 23 nt, Salmonella enterica enterica serovar Typhi
ugcuuuuuuuauuugugauaaag

SEQ ID NO: 3663512 - RNA, 17 nt, Salmonella enterica enterica serovar Typhi
uggcaaaacgcauccag

SEQ ID NO: 3663513 - RNA, 14 nt, Salmonella enterica enterica serovar Typhi
uggcaaaauccaac

SEQ ID NO: 3663514 - RNA, 20 nt, Salmonella enterica enterica serovar Typhi
uggcaaaaucguuaaccagc

SEQ ID NO: 3663515 - RNA, 15 nt, Salmonella enterica enterica serovar Typhi
uggcaaaccccugcu

SEQ ID NO: 3663516 - RNA, 18 nt, Salmonella enterica enterica serovar Typhi
uggcaacaaagccugcug

SEQ ID NO: 3663517 - RNA, 22 nt, Salmonella enterica enterica serovar Typhi
uggcaacauagcaucguuaccg

SEQ ID NO: 3663518 - RNA, 16 nt, Salmonella enterica enterica serovar Typhi
uggcaacaugaccagc

SEQ ID NO: 3663519 - RNA, 22 nt, Salmonella enterica enterica serovar Typhi
uggcaacauuaaucuuauccag

SEQ ID NO: 3663520 - RNA, 22 nt, Salmonella enterica enterica serovar Typhi
uggcaacccguaccuccagcga

SEQ ID NO: 3663521 - RNA, 17 nt, Salmonella enterica enterica serovar Typhi
uggcaacggcagccagc

SEQ ID NO: 3663522 - RNA, 20 nt, Salmonella enterica enterica serovar Typhi
uggcaagaaccgcuuuuccu

SEQ ID NO: 3663523 - RNA, 17 nt, Salmonella enterica enterica serovar Typhi
uggcaagaauuauuuca

SEQ ID NO: 3663524 - RNA, 17 nt, Salmonella enterica enterica serovar Typhi
uggcaagauuaaccagc

SEQ ID NO: 3663525 - RNA, 21 nt, Salmonella enterica enterica serovar Typhi
uggcaaucauaccgucagauu

SEQ ID NO: 3663526 - RNA, 23 nt, Salmonella enterica enterica serovar Typhi
uggcaaucauaccgucagauucu

SEQ ID NO: 3663527 - RNA, 16 nt, Salmonella enterica enterica serovar Typhi
uggcacagggcaauaa

SEQ ID NO: 3663528 - RNA, 16 nt, Salmonella enterica enterica serovar Typhi
uggcacgauaaccaga

SEQ ID NO: 3663529 - RNA, 20 nt, Salmonella enterica enterica serovar Typhi
uggcacuuuccgguuuccau

SEQ ID NO: 3663530 - RNA, 14 nt, Salmonella enterica enterica serovar Typhi
uggcagacagccau

SEQ ID NO: 3663531 - RNA, 15 nt, Salmonella enterica enterica serovar Typhi
uggcagauaaaccac

SEQ ID NO: 3663532 - RNA, 18 nt, Salmonella enterica enterica serovar Typhi
uggcagcggcaguaaauu

SEQ ID NO: 3663533 - RNA, 12 nt, Salmonella enterica enterica serovar Typhi
uggcaggccucu

SEQ ID NO: 3663534 - RNA, 12 nt, Salmonella enterica enterica serovar Typhi
uggcagggcuga

SEQ ID NO: 3663535 - RNA, 19 nt, Salmonella enterica enterica serovar Typhi
uggcauaaccgcagcgcgg

SEQ ID NO: 3663536 - RNA, 21 nt, Salmonella enterica enterica serovar Typhi
uggcauaaccgcagcgcggcc

SEQ ID NO: 3663537 - RNA, 19 nt, Salmonella enterica enterica serovar Typhi
uggcaucauaaaaggcauc

SEQ ID NO: 3663538 - RNA, 24 nt, Salmonella enterica enterica serovar Typhi
uggcaugcccggugauauuguguu

SEQ ID NO: 3663539 - RNA, 15 nt, Salmonella enterica enterica serovar Typhi
uggcauggugcagcc

SEQ ID NO: 3663540 - RNA, 16 nt, Salmonella enterica enterica serovar Typhi
uggcauucuuacgaua

SEQ ID NO: 3663541 - RNA, 14 nt, Salmonella enterica enterica serovar Typhi
uggcauuggcaucu

SEQ ID NO: 3663542 - RNA, 16 nt, Salmonella enterica enterica serovar Typhi
uggcauuuugcggcgu

SEQ ID NO: 3663543 - RNA, 13 nt, Salmonella enterica enterica serovar Typhi
uggccaaauaacc

SEQ ID NO: 3663544 - RNA, 14 nt, Salmonella enterica enterica serovar Typhi
uggccaaucagcgg

SEQ ID NO: 3663545 - RNA, 21 nt, Salmonella enterica enterica serovar Typhi
uggccaaucagcggguauugc

SEQ ID NO: 3663546 - RNA, 13 nt, Salmonella enterica enterica serovar Typhi
uggccacaucguu

SEQ ID NO: 3663547 - RNA, 15 nt, Salmonella enterica enterica serovar Typhi
uggccacaucguuac

SEQ ID NO: 3663548 - RNA, 12 nt, Salmonella enterica enterica serovar Typhi
uggccaccagcu

SEQ ID NO: 3663549 - RNA, 22 nt, Salmonella enterica enterica serovar Typhi
uggccaccuuuacgguggccuu

SEQ ID NO: 3663550 - RNA, 20 nt, Salmonella enterica enterica serovar Typhi
uggccacggagugcgcggcg

SEQ ID NO: 3663551 - RNA, 21 nt, Salmonella enterica enterica serovar Typhi
uggccacggagugcgcggcga

SEQ ID NO: 3663552 - RNA, 19 nt, Salmonella enterica enterica serovar Typhi
uggccacguagccgucggc

SEQ ID NO: 3663553 - RNA, 16 nt, Salmonella enterica enterica serovar Typhi
uggccagaaugaucgc

SEQ ID NO: 3663554 - RNA, 12 nt, Salmonella enterica enterica serovar Typhi
uggccaggcuuu

SEQ ID NO: 3663555 - RNA, 17 nt, Salmonella enterica enterica serovar Typhi
uggccauauuuuuucag

SEQ ID NO: 3663556 - RNA, 14 nt, Salmonella enterica enterica serovar Typhi
uggccaucuuccag

SEQ ID NO: 3663557 - RNA, 18 nt, Salmonella enterica enterica serovar Typhi
uggccaucuuccagcauc

SEQ ID NO: 3663558 - RNA, 19 nt, Salmonella enterica enterica serovar Typhi
uggccaucuuccagcauca

SEQ ID NO: 3663559 - RNA, 20 nt, Salmonella enterica enterica serovar Typhi
uggccaugccuaaaccgaca

SEQ ID NO: 3663560 - RNA, 17 nt, Salmonella enterica enterica serovar Typhi
uggcccagcuaaaccac

SEQ ID NO: 3663561 - RNA, 19 nt, Salmonella enterica enterica serovar Typhi
uggcccaguuaacagaaug

SEQ ID NO: 3663562 - RNA, 19 nt, Salmonella enterica enterica serovar Typhi
uggcccauuuuggccgcuu

SEQ ID NO: 3663563 - RNA, 14 nt, Salmonella enterica enterica serovar Typhi
uggcccucccuggc

SEQ ID NO: 3663564 - RNA, 18 nt, Salmonella enterica enterica serovar Typhi
uggccgagaguccagcgc

SEQ ID NO: 3663565 - RNA, 17 nt, Salmonella enterica enterica serovar Typhi
uggccgcuauccucgcc

SEQ ID NO: 3663566 - RNA, 18 nt, Salmonella enterica enterica serovar Typhi
uggccgggauauccugcu

SEQ ID NO: 3663567 - RNA, 16 nt, Salmonella enterica enterica serovar Typhi
uggccggucuuaugcu

SEQ ID NO: 3663568 - RNA, 21 nt, Salmonella enterica enterica serovar Typhi
uggccgugacuuguuccaguc

SEQ ID NO: 3663569 - RNA, 17 nt, Salmonella enterica enterica serovar Typhi
uggccguuuucccggca

SEQ ID NO: 3663570 - RNA, 13 nt, Salmonella enterica enterica serovar Typhi
uggccucaucaug

SEQ ID NO: 3663571 - RNA, 12 nt, Salmonella enterica enterica serovar Typhi
uggccucauccg

SEQ ID NO: 3663572 - RNA, 16 nt, Salmonella enterica enterica serovar Typhi
uggccucccaguuccc

SEQ ID NO: 3663573 - RNA, 14 nt, Salmonella enterica enterica serovar Typhi
uggccucugccagu

SEQ ID NO: 3663574 - RNA, 20 nt, Salmonella enterica enterica serovar Typhi
uggccucugccaguugcuca

SEQ ID NO: 3663575 - RNA, 21 nt, Salmonella enterica enterica serovar Typhi
uggccugcagaccuauauggc

SEQ ID NO: 3663576 - RNA, 19 nt, Salmonella enterica enterica serovar Typhi
uggccugcucaauacuuuc

SEQ ID NO: 3663577 - RNA, 15 nt, Salmonella enterica enterica serovar Typhi
uggccugcucaucag

SEQ ID NO: 3663578 - RNA, 11 nt, Salmonella enterica enterica serovar Typhi
uggccugcugg

SEQ ID NO: 3663579 - RNA, 14 nt, Salmonella enterica enterica serovar Typhi
uggcgaaacgccug

SEQ ID NO: 3663580 - RNA, 21 nt, Salmonella enterica enterica serovar Typhi
uggcgaaacuccuccgggaaa

SEQ ID NO: 3663581 - RNA, 20 nt, Salmonella enterica enterica serovar Typhi
uggcgaacagccccaccgcc

SEQ ID NO: 3663582 - RNA, 23 nt, Salmonella enterica enterica serovar Typhi
uggcgaaccacggcuucagcggc

SEQ ID NO: 3663583 - RNA, 21 nt, Salmonella enterica enterica serovar Typhi
uggcgaauaaaauucagcgca

SEQ ID NO: 3663584 - RNA, 20 nt, Salmonella enterica enterica serovar Typhi
uggcgaauacuguuccaggc

SEQ ID NO: 3663585 - RNA, 23 nt, Salmonella enterica enterica serovar Typhi
uggcgaauccgggaaauggcaau

SEQ ID NO: 3663586 - RNA, 17 nt, Salmonella enterica enterica serovar Typhi
uggcgaauucggcagac

SEQ ID NO: 3663587 - RNA, 17 nt, Salmonella enterica enterica serovar Typhi
uggcgaauuuacgggcg

SEQ ID NO: 3663588 - RNA, 15 nt, Salmonella enterica enterica serovar Typhi
uggcgaccagcagau

SEQ ID NO: 3663589 - RNA, 14 nt, Salmonella enterica enterica serovar Typhi
uggcgaccgggucg

SEQ ID NO: 3663590 - RNA, 15 nt, Salmonella enterica enterica serovar Typhi
uggcgaccgggucga

SEQ ID NO: 3663591 - RNA, 21 nt, Salmonella enterica enterica serovar Typhi
uggcgaccugauugaccagca

SEQ ID NO: 3663592 - RNA, 16 nt, Salmonella enterica enterica serovar Typhi
uggcgacgaccgguca

SEQ ID NO: 3663593 - RNA, 19 nt, Salmonella enterica enterica serovar Typhi
uggcgacgaucagcgccac

SEQ ID NO: 3663594 - RNA, 14 nt, Salmonella enterica enterica serovar Typhi
uggcgacgccagcc

SEQ ID NO: 3663595 - RNA, 21 nt, Salmonella enterica enterica serovar Typhi
uggcgacgccagccggaaaag

SEQ ID NO: 3663596 - RNA, 17 nt, Salmonella enterica enterica serovar Typhi
uggcgacuaaccagcgc

SEQ ID NO: 3663597 - RNA, 22 nt, Salmonella enterica enterica serovar Typhi
uggcgaggaacaucagccagca

SEQ ID NO: 3663598 - RNA, 14 nt, Salmonella enterica enterica serovar Typhi
ugggaauaggccgc

SEQ ID NO: 3663599 - RNA, 23 nt, Salmonella enterica enterica serovar Typhi
ugggaaucgccugaugaagcgga

SEQ ID NO: 3663600 - RNA, 18 nt, Salmonella enterica enterica serovar Typhi
ugggacauaauugcugcc

SEQ ID NO: 3663601 - RNA, 14 nt, Salmonella enterica enterica serovar Typhi
ugggauauuacaga

SEQ ID NO: 3663602 - RNA, 22 nt, Salmonella enterica enterica serovar Typhi
ugggaucuucaaugaacaauaa

SEQ ID NO: 3663603 - RNA, 21 nt, Salmonella enterica enterica serovar Typhi
ugggaugaccugaaaucgcgc

SEQ ID NO: 3663604 - RNA, 17 nt, Salmonella enterica enterica serovar Typhi
ugggauuugaugcccaa

SEQ ID NO: 3663605 - RNA, 14 nt, Salmonella enterica enterica serovar Typhi
ugggcaaucaucag

SEQ ID NO: 3663606 - RNA, 20 nt, Salmonella enterica enterica serovar Typhi
ugggcauaaucgacaguggc

SEQ ID NO: 3663607 - RNA, 13 nt, Salmonella enterica enterica serovar Typhi
ugggccagcagcg

SEQ ID NO: 3663608 - RNA, 19 nt, Salmonella enterica enterica serovar Typhi
ugggccagcagcgcaucau

SEQ ID NO: 3663609 - RNA, 15 nt, Salmonella enterica enterica serovar Typhi
ugggcgcaacaguca

SEQ ID NO: 3663610 - RNA, 17 nt, Salmonella enterica enterica serovar Typhi
ugggcgcaacagucagc

SEQ ID NO: 3663611 - RNA, 17 nt, Salmonella enterica enterica serovar Typhi
ugggcgcacagcgccau

SEQ ID NO: 3663612 - RNA, 17 nt, Salmonella enterica enterica serovar Typhi
ugggcgugcugacggag

SEQ ID NO: 3663613 - RNA, 21 nt, Salmonella enterica enterica serovar Typhi
ugggcucaucaaacagcggca

SEQ ID NO: 3663614 - RNA, 15 nt, Salmonella enterica enterica serovar Typhi
ugggcugagaaaaau

SEQ ID NO: 3663615 - RNA, 16 nt, Salmonella enterica enterica serovar Typhi
ugggcuugcuuuucuc

SEQ ID NO: 3663616 - RNA, 15 nt, Salmonella enterica enterica serovar Typhi
uggggaaccuggcag

SEQ ID NO: 3663617 - RNA, 14 nt, Salmonella enterica enterica serovar Typhi
uggggaaguuaugu

SEQ ID NO: 3663618 - RNA, 18 nt, Salmonella enterica enterica serovar Typhi
uggggauuaucaggauga

SEQ ID NO: 3663619 - RNA, 15 nt, Salmonella enterica enterica serovar Typhi
uggggcaagcucagc

SEQ ID NO: 3663620 - RNA, 19 nt, Salmonella enterica enterica serovar Typhi
uggggcaagcucagcggca

SEQ ID NO: 3663621 - RNA, 20 nt, Salmonella enterica enterica serovar Typhi
uggggccuaaugagccagau

SEQ ID NO: 3663622 - RNA, 22 nt, Salmonella enterica enterica serovar Typhi
ugggguugcuucuguccuuucu

SEQ ID NO: 3663623 - RNA, 16 nt, Salmonella enterica enterica serovar Typhi
uggguaaauaccaggc

SEQ ID NO: 3663624 - RNA, 17 nt, Salmonella enterica enterica serovar Typhi
uggguaaauaccaggca

SEQ ID NO: 3663625 - RNA, 19 nt, Salmonella enterica enterica serovar Typhi
uggguaaauaccaggcacu

SEQ ID NO: 3663626 - RNA, 15 nt, Salmonella enterica enterica serovar Typhi
uggguaaauccgcga

SEQ ID NO: 3663627 - RNA, 19 nt, Salmonella enterica enterica serovar Typhi
uggguacguucggacuggg

SEQ ID NO: 3663628 - RNA, 20 nt, Salmonella enterica enterica serovar Typhi
uggguauuuuuuagcgccaa

SEQ ID NO: 3663629 - RNA, 19 nt, Salmonella enterica enterica serovar Typhi
ugggucacgauaaccaggu

SEQ ID NO: 3663630 - RNA, 14 nt, Salmonella enterica enterica serovar Typhi
ugggucucauccau

SEQ ID NO: 3663631 - RNA, 20 nt, Salmonella enterica enterica serovar Typhi
uggguuauggguguuuucac

SEQ ID NO: 3663632 - RNA, 13 nt, Salmonella enterica enterica serovar Typhi
ugguaaaccgugc

SEQ ID NO: 3663633 - RNA, 15 nt, Salmonella enterica enterica serovar Typhi
ugguaaaggcguaga

SEQ ID NO: 3663634 - RNA, 16 nt, Salmonella enterica enterica serovar Typhi
ugguaaauccaauaga

SEQ ID NO: 3663635 - RNA, 19 nt, Salmonella enterica enterica serovar Typhi
ugguaagagcgacucaggu

SEQ ID NO: 3663636 - RNA, 19 nt, Salmonella enterica enterica serovar Typhi
ugguaagcgccaagcggca

SEQ ID NO: 3663637 - RNA, 16 nt, Salmonella enterica enterica serovar Typhi
ugguacaucaaaucag

SEQ ID NO: 3663638 - RNA, 18 nt, Salmonella enterica enterica serovar Typhi
ugguaccaaacagcagaa

SEQ ID NO: 3663639 - RNA, 12 nt, Salmonella enterica enterica serovar Typhi
ugguaccagauc

SEQ ID NO: 3663640 - RNA, 22 nt, Salmonella enterica enterica serovar Typhi
ugguaccgccaucggcgccggg

SEQ ID NO: 3663641 - RNA, 14 nt, Salmonella enterica enterica serovar Typhi
ugguacguccaucc

SEQ ID NO: 3663642 - RNA, 16 nt, Salmonella enterica enterica serovar Typhi
ugguacguccauccgc

SEQ ID NO: 3663643 - RNA, 16 nt, Salmonella enterica enterica serovar Typhi
ugguacuuuucaucca

SEQ ID NO: 3663644 - RNA, 15 nt, Salmonella enterica enterica serovar Typhi
ugguagacccggcau

SEQ ID NO: 3663645 - RNA, 16 nt, Salmonella enterica enterica serovar Typhi
ugguagacgcaccaga

SEQ ID NO: 3663646 - RNA, 16 nt, Salmonella enterica enterica serovar Typhi
ugguagagcaucgcgg

SEQ ID NO: 3663647 - RNA, 23 nt, Salmonella enterica enterica serovar Typhi
ugguagagguugcggauaugcgu

SEQ ID NO: 3663648 - RNA, 22 nt, Salmonella enterica enterica serovar Typhi
ugguagcgcugaugcaggcaau

SEQ ID NO: 3663649 - RNA, 16 nt, Salmonella enterica enterica serovar Typhi
ugguaguaagucagcu

SEQ ID NO: 3663650 - RNA, 14 nt, Salmonella enterica enterica serovar Typhi
ugguauaaaucccg

SEQ ID NO: 3663651 - RNA, 16 nt, Salmonella enterica enterica serovar Typhi
ugguauaggccaggcu

SEQ ID NO: 3663652 - RNA, 15 nt, Salmonella enterica enterica serovar Typhi
ugguauucauuacag

SEQ ID NO: 3663653 - RNA, 20 nt, Salmonella enterica enterica serovar Typhi
uggucaaaaucgacagcgac

SEQ ID NO: 3663654 - RNA, 20 nt, Salmonella enterica enterica serovar Typhi
uggucaaggcacaagcgccu

SEQ ID NO: 3663655 - RNA, 19 nt, Salmonella enterica enterica serovar Typhi
uggucacaaaggccagcag

SEQ ID NO: 3663656 - RNA, 15 nt, Salmonella enterica enterica serovar Typhi
uggucaccaugacgc

SEQ ID NO: 3663657 - RNA, 23 nt, Salmonella enterica enterica serovar Typhi
uggucaccaugacgcagggcaau

SEQ ID NO: 3663658 - RNA, 12 nt, Salmonella enterica enterica serovar Typhi
uggucagcagcc

SEQ ID NO: 3663659 - RNA, 18 nt, Salmonella enterica enterica serovar Typhi
uggucagcgaugacgccu

SEQ ID NO: 3663660 - RNA, 12 nt, Salmonella enterica enterica serovar Typhi
uggucagcgcgc

SEQ ID NO: 3663661 - RNA, 14 nt, Salmonella enterica enterica serovar Typhi
uggucaggcgacca

SEQ ID NO: 3663662 - RNA, 15 nt, Salmonella enterica enterica serovar Typhi
uggucaggcuaaaug

SEQ ID NO: 3663663 - RNA, 20 nt, Salmonella enterica enterica serovar Typhi
uggucaguagcguucuuucc

SEQ ID NO: 3663664 - RNA, 12 nt, Salmonella enterica enterica serovar Typhi
uggucaucgcgg

SEQ ID NO: 3663665 - RNA, 20 nt, Salmonella enterica enterica serovar Typhi
uggucaucgcggccagcaug

SEQ ID NO: 3663666 - RNA, 21 nt, Salmonella enterica enterica serovar Typhi
uggucauuaggcguaauuauu

SEQ ID NO: 3663667 - RNA, 16 nt, Salmonella enterica enterica serovar Typhi
uggucauucccgucuc

SEQ ID NO: 3663668 - RNA, 15 nt, Salmonella enterica enterica serovar Typhi
uggucgagauacugc

SEQ ID NO: 3663669 - RNA, 11 nt, Salmonella enterica enterica serovar Typhi
uggucgcgcca

SEQ ID NO: 3663670 - RNA, 22 nt, Salmonella enterica enterica serovar Typhi
uggucgcgguuuacuucuucag

SEQ ID NO: 3663671 - RNA, 19 nt, Salmonella enterica enterica serovar Typhi
uggucgcuaacccaggccg

SEQ ID NO: 3663672 - RNA, 21 nt, Salmonella enterica enterica serovar Typhi
uggucggacgggcccuggccg

SEQ ID NO: 3663673 - RNA, 23 nt, Salmonella enterica enterica serovar Typhi
uggucggcgaccagcagcgcggc

SEQ ID NO: 3663674 - RNA, 19 nt, Salmonella enterica enterica serovar Typhi
uggucggcguaacccagug

SEQ ID NO: 3663675 - RNA, 16 nt, Salmonella enterica enterica serovar Typhi
uggucuccaguaucag

SEQ ID NO: 3663676 - RNA, 16 nt, Salmonella enterica enterica serovar Typhi
uggucugaaucugcuc

SEQ ID NO: 3663677 - RNA, 18 nt, Salmonella enterica enterica serovar Typhi
uggucugaaucugcuccg

SEQ ID NO: 3663678 - RNA, 18 nt, Salmonella enterica enterica serovar Typhi
uggugaaacguguuuauc

SEQ ID NO: 3663679 - RNA, 21 nt, Salmonella enterica enterica serovar Typhi
uggugagagcacguaggccug

SEQ ID NO: 3663680 - RNA, 16 nt, Salmonella enterica enterica serovar Typhi
uggugaguggccuguc

SEQ ID NO: 3663681 - RNA, 16 nt, Salmonella enterica enterica serovar Typhi
uggugauauaaacggg

SEQ ID NO: 3663682 - RNA, 17 nt, Salmonella enterica enterica serovar Typhi
uggugauauaaacgggc

SEQ ID NO: 3663683 - RNA, 16 nt, Salmonella enterica enterica serovar Typhi
uggugauuaacagcgc

SEQ ID NO: 3663684 - RNA, 20 nt, Salmonella enterica enterica serovar Typhi
uguaggccggauaagcauua

SEQ ID NO: 3663685 - RNA, 20 nt, Salmonella enterica enterica serovar Typhi
uguaggccgggcaagcgaag

SEQ ID NO: 3663686 - RNA, 20 nt, Salmonella enterica enterica serovar Typhi
uguaggccugauaagcguag

SEQ ID NO: 3663687 - RNA, 21 nt, Salmonella enterica enterica serovar Typhi
uguaggccugauagcacagcg

SEQ ID NO: 3663688 - RNA, 20 nt, Salmonella enterica enterica serovar Typhi
uguaggccugguaagcguag

SEQ ID NO: 3663689 - RNA, 15 nt, Salmonella enterica enterica serovar Typhi
uguaggcuuccagaa

SEQ ID NO: 3663690 - RNA, 20 nt, Salmonella enterica enterica serovar Typhi
uguaggcuuccagaagguag

SEQ ID NO: 3663691 - RNA, 16 nt, Salmonella enterica enterica serovar Typhi
uguagugcgauaugug

SEQ ID NO: 3663692 - RNA, 17 nt, Salmonella enterica enterica serovar Typhi
uguaguuauaaauuuau

SEQ ID NO: 3663693 - RNA, 12 nt, Salmonella enterica enterica serovar Typhi
uguaguuuuuug

SEQ ID NO: 3663694 - RNA, 13 nt, Salmonella enterica enterica serovar Typhi
uguauaaaauauu

SEQ ID NO: 3663695 - RNA, 15 nt, Salmonella enterica enterica serovar Typhi
uguauaaacucagca

SEQ ID NO: 3663696 - RNA, 20 nt, Salmonella enterica enterica serovar Typhi
uguauaauccaacauuauca

SEQ ID NO: 3663697 - RNA, 21 nt, Salmonella enterica enterica serovar Typhi
uguauaauccaacauuaucaa

SEQ ID NO: 3663698 - RNA, 12 nt, Salmonella enterica enterica serovar Typhi
uguauaauuauu

SEQ ID NO: 3663699 - RNA, 17 nt, Salmonella enterica enterica serovar Typhi
uguauaccaaaaauaau

SEQ ID NO: 3663700 - RNA, 18 nt, Salmonella enterica enterica serovar Typhi
uguauaccaaaaauaauu

SEQ ID NO: 3663701 - RNA, 16 nt, Salmonella enterica enterica serovar Typhi
uguaucagcauuuaca

SEQ ID NO: 3663702 - RNA, 19 nt, Salmonella enterica enterica serovar Typhi
uguaucgcccugccagcuc

SEQ ID NO: 3663703 - RNA, 21 nt, Salmonella enterica enterica serovar Typhi
uguaucuucgccguguucuua

SEQ ID NO: 3663704 - RNA, 17 nt, Salmonella enterica enterica serovar Typhi
uguaugaacugcaucag

SEQ ID NO: 3663705 - RNA, 22 nt, Salmonella enterica enterica serovar Typhi
uguauuaaaggaucgauuaagg

SEQ ID NO: 3663706 - RNA, 17 nt, Salmonella enterica enterica serovar Typhi
uguauuguaauaacgaa

SEQ ID NO: 3663707 - RNA, 16 nt, Salmonella enterica enterica serovar Typhi
uguauuguucaugcaa

SEQ ID NO: 3663708 - RNA, 18 nt, Salmonella enterica enterica serovar Typhi
uguauuuaauaccuggua

SEQ ID NO: 3663709 - RNA, 15 nt, Salmonella enterica enterica serovar Typhi
ugucaaauucaagcc

SEQ ID NO: 3663710 - RNA, 17 nt, Salmonella enterica enterica serovar Typhi
ugucaacgugugccagg

SEQ ID NO: 3663711 - RNA, 17 nt, Salmonella enterica enterica serovar Typhi
ugucaacuuaaacguuc

SEQ ID NO: 3663712 - RNA, 16 nt, Salmonella enterica enterica serovar Typhi
ugucacccgcuuuucc

SEQ ID NO: 3663713 - RNA, 14 nt, Salmonella enterica enterica serovar Typhi
ugucacgcaggggg

SEQ ID NO: 3663714 - RNA, 15 nt, Salmonella enterica enterica serovar Typhi
ugucagacaugauaa

SEQ ID NO: 3663715 - RNA, 18 nt, Salmonella enterica enterica serovar Typhi
ugucagauccuucauuca

SEQ ID NO: 3663716 - RNA, 15 nt, Salmonella enterica enterica serovar Typhi
ugucaggaugcugau

SEQ ID NO: 3663717 - RNA, 15 nt, Salmonella enterica enterica serovar Typhi
ugucagggcggaaca

SEQ ID NO: 3663718 - RNA, 21 nt, Salmonella enterica enterica serovar Typhi
ugucaguaucgguacgcgcgu

SEQ ID NO: 3663719 - RNA, 16 nt, Salmonella enterica enterica serovar Typhi
ugucaguggacgauaa

SEQ ID NO: 3663720 - RNA, 21 nt, Salmonella enterica enterica serovar Typhi
ugucauagucggcgccaaagu

SEQ ID NO: 3663721 - RNA, 22 nt, Salmonella enterica enterica serovar Typhi
ugucauagucggcgccaaaguu

SEQ ID NO: 3663722 - RNA, 23 nt, Salmonella enterica enterica serovar Typhi
ugucauagucggcgccaaaguua

SEQ ID NO: 3663723 - RNA, 21 nt, Salmonella enterica enterica serovar Typhi
ugucaucaaaaucaucgccac

SEQ ID NO: 3663724 - RNA, 19 nt, Salmonella enterica enterica serovar Typhi
ugucaucaguaugagcgaa

SEQ ID NO: 3663725 - RNA, 13 nt, Salmonella enterica enterica serovar Typhi
ugucaucggcuuu

SEQ ID NO: 3663726 - RNA, 17 nt, Salmonella enterica enterica serovar Typhi
ugucaucgucagcaacg

SEQ ID NO: 3663727 - RNA, 16 nt, Salmonella enterica enterica serovar Typhi
ugucaugcgccacgac

SEQ ID NO: 3663728 - RNA, 16 nt, Salmonella enterica enterica serovar Typhi
ugucaugcuaaaacag

SEQ ID NO: 3663729 - RNA, 17 nt, Salmonella enterica enterica serovar Typhi
ugucaugcuaaaacaga

SEQ ID NO: 3663730 - RNA, 17 nt, Salmonella enterica enterica serovar Typhi
ugucaugguaaaugccg

SEQ ID NO: 3663731 - RNA, 21 nt, Salmonella enterica enterica serovar Typhi
ugucauuccuuccacgcguac

SEQ ID NO: 3663732 - RNA, 19 nt, Salmonella enterica enterica serovar Typhi
ugucauucgccucaaaacc

SEQ ID NO: 3663733 - RNA, 14 nt, Salmonella enterica enterica serovar Typhi
uguccaaacuggcu

SEQ ID NO: 3663734 - RNA, 18 nt, Salmonella enterica enterica serovar Typhi
uguccacggggcggcaau

SEQ ID NO: 3663735 - RNA, 20 nt, Salmonella enterica enterica serovar Typhi
uguccaggucaucaccucca

SEQ ID NO: 3663736 - RNA, 22 nt, Salmonella enterica enterica serovar Typhi
uguccaggucaucaccuccagc

SEQ ID NO: 3663737 - RNA, 19 nt, Salmonella enterica enterica serovar Typhi
uguccagucaaaaugucag

SEQ ID NO: 3663738 - RNA, 20 nt, Salmonella enterica enterica serovar Typhi
uguccaucagauucaacagg

SEQ ID NO: 3663739 - RNA, 17 nt, Salmonella enterica enterica serovar Typhi
uguccauguaaacucca

SEQ ID NO: 3663740 - RNA, 18 nt, Salmonella enterica enterica serovar Typhi
uguccauugcgagaaaaa

SEQ ID NO: 3663741 - RNA, 19 nt, Salmonella enterica enterica serovar Typhi
uguccauugcgagaaaaaa

SEQ ID NO: 3663742 - RNA, 13 nt, Salmonella enterica enterica serovar Typhi
ugucccagccuuc

SEQ ID NO: 3663743 - RNA, 20 nt, Salmonella enterica enterica serovar Typhi
ugucccaucguaacgccguc

SEQ ID NO: 3663744 - RNA, 20 nt, Salmonella enterica enterica serovar Typhi
uguccgccuuaucaggccug

SEQ ID NO: 3663745 - RNA, 16 nt, Salmonella enterica enterica serovar Typhi
uguccggcgacuccag

SEQ ID NO: 3663746 - RNA, 19 nt, Salmonella enterica enterica serovar Typhi
uguccggcgacuccagaau

SEQ ID NO: 3663747 - RNA, 15 nt, Salmonella enterica enterica serovar Typhi
uguccggcgcguuca

SEQ ID NO: 3663748 - RNA, 16 nt, Salmonella enterica enterica serovar Typhi
uguccguuuucucaaa

SEQ ID NO: 3663749 - RNA, 15 nt, Salmonella enterica enterica serovar Typhi
ugucgaaaccagcau

SEQ ID NO: 3663750 - RNA, 13 nt, Salmonella enterica enterica serovar Typhi
ugucgaauuccgc

SEQ ID NO: 3663751 - RNA, 14 nt, Salmonella enterica enterica serovar Typhi
ugucgaauuccgcc

SEQ ID NO: 3663752 - RNA, 21 nt, Salmonella enterica enterica serovar Typhi
ugucgagcaucuccagcgcau

SEQ ID NO: 3663753 - RNA, 15 nt, Salmonella enterica enterica serovar Typhi
ugucgauaaacucau

SEQ ID NO: 3663754 - RNA, 22 nt, Salmonella enterica enterica serovar Typhi
ugucgaugagcucguuauaagc

SEQ ID NO: 3663755 - RNA, 18 nt, Salmonella enterica enterica serovar Typhi
ugucgaugauauccagca

SEQ ID NO: 3663756 - RNA, 12 nt, Salmonella enterica enterica serovar Typhi
ugucgccaauaa

SEQ ID NO: 3663757 - RNA, 21 nt, Salmonella enterica enterica serovar Typhi
ugucgccauaucuucgcgcgu

SEQ ID NO: 3663758 - RNA, 15 nt, Salmonella enterica enterica serovar Typhi
ugucgccggaaaaaa

SEQ ID NO: 3663759 - RNA, 17 nt, Salmonella enterica enterica serovar Typhi
ugucgcgagcuuccagu

SEQ ID NO: 3663760 - RNA, 21 nt, Salmonella enterica enterica serovar Typhi
ugucgcggauaugcagcagcc

SEQ ID NO: 3663761 - RNA, 19 nt, Salmonella enterica enterica serovar Typhi
ugucgcucaucaggcgugc

SEQ ID NO: 3663762 - RNA, 18 nt, Salmonella enterica enterica serovar Typhi
ugucgcuggauagcacca

SEQ ID NO: 3663763 - RNA, 21 nt, Salmonella enterica enterica serovar Typhi
ugucggauacggcugucagga

SEQ ID NO: 3663764 - RNA, 23 nt, Salmonella enterica enterica serovar Typhi
ugucggccaggugccgagguuaa

SEQ ID NO: 3663765 - RNA, 18 nt, Salmonella enterica enterica serovar Typhi
ugucggccugauuucuga

SEQ ID NO: 3663766 - RNA, 22 nt, Salmonella enterica enterica serovar Typhi
ugucguuaaugcucuuaaaaug

SEQ ID NO: 3663767 - RNA, 16 nt, Salmonella enterica enterica serovar Typhi
ugucuauaggccugau

SEQ ID NO: 3663768 - RNA, 23 nt, Salmonella enterica enterica serovar Typhi
ugucuauaggccugauaaacgua

SEQ ID NO: 3663769 - RNA, 18 nt, Salmonella enterica enterica serovar Typhi
uguuauauauuuuucagc

SEQ ID NO: 3663770 - RNA, 16 nt, Salmonella enterica enterica serovar Typhi
uguuauccuaaaucug

SEQ ID NO: 3663771 - RNA, 15 nt, Salmonella enterica enterica serovar Typhi
uguuauggcaggcga

SEQ ID NO: 3663772 - RNA, 14 nt, Salmonella enterica enterica serovar Typhi
uguuauuuucaaaa

SEQ ID NO: 3663773 - RNA, 24 nt, Salmonella enterica enterica serovar Typhi
uguucaaagccgccauccggccug

SEQ ID NO: 3663774 - RNA, 13 nt, Salmonella enterica enterica serovar Typhi
uguucaacuuuuc

SEQ ID NO: 3663775 - RNA, 16 nt, Salmonella enterica enterica serovar Typhi
uguucaagcaauaaug

SEQ ID NO: 3663776 - RNA, 16 nt, Salmonella enterica enterica serovar Typhi
uguucaagcugguuaa

SEQ ID NO: 3663777 - RNA, 13 nt, Salmonella enterica enterica serovar Typhi
uguucaauauucc

SEQ ID NO: 3663778 - RNA, 16 nt, Salmonella enterica enterica serovar Typhi
uguucaauauuccugg

SEQ ID NO: 3663779 - RNA, 16 nt, Salmonella enterica enterica serovar Typhi
uguucacaucgcucag

SEQ ID NO: 3663780 - RNA, 20 nt, Salmonella enterica enterica serovar Typhi
uguucagaaaucggcagcac

SEQ ID NO: 3663781 - RNA, 12 nt, Salmonella enterica enterica serovar Typhi
uguucagccagc

SEQ ID NO: 3663782 - RNA, 14 nt, Salmonella enterica enterica serovar Typhi
uguucauaaagugc

SEQ ID NO: 3663783 - RNA, 19 nt, Salmonella enterica enterica serovar Typhi
uguucauaccggauauggc

SEQ ID NO: 3663784 - RNA, 21 nt, Salmonella enterica enterica serovar Typhi
uguucaucaaagaaaaccacg

SEQ ID NO: 3663785 - RNA, 22 nt, Salmonella enterica enterica serovar Typhi
uguucauccauauaucugaaua

SEQ ID NO: 3663786 - RNA, 14 nt, Salmonella enterica enterica serovar Typhi
uguuccaccugcgg

SEQ ID NO: 3663787 - RNA, 12 nt, Salmonella enterica enterica serovar Typhi
uguuccagguuu

SEQ ID NO: 3663788 - RNA, 22 nt, Salmonella enterica enterica serovar Typhi
uguuccgaaauaaaucgauagc

SEQ ID NO: 3663789 - RNA, 18 nt, Salmonella enterica enterica serovar Typhi
uguuccggaugcgggccg

SEQ ID NO: 3663790 - RNA, 14 nt, Salmonella enterica enterica serovar Typhi
uguuccucuuuccc

SEQ ID NO: 3663791 - RNA, 14 nt, Salmonella enterica enterica serovar Typhi
uguuccugcaauau

SEQ ID NO: 3663792 - RNA, 17 nt, Salmonella enterica enterica serovar Typhi
uguuccugcuggcaaaa

SEQ ID NO: 3663793 - RNA, 14 nt, Salmonella enterica enterica serovar Typhi
uguucgauccggcg

SEQ ID NO: 3663794 - RNA, 23 nt, Salmonella enterica enterica serovar Typhi
uguucgcaaccuaaccaaacaga

SEQ ID NO: 3663795 - RNA, 20 nt, Salmonella enterica enterica serovar Typhi
uguucgcuuauuccuccgcc

SEQ ID NO: 3663796 - RNA, 21 nt, Salmonella enterica enterica serovar Typhi
uguucgcuucuucuaccaccu

SEQ ID NO: 3663797 - RNA, 13 nt, Salmonella enterica enterica serovar Typhi
uguucuaaacguu

SEQ ID NO: 3663798 - RNA, 19 nt, Salmonella enterica enterica serovar Typhi
uguucuguccauguuuuau

SEQ ID NO: 3663799 - RNA, 23 nt, Salmonella enterica enterica serovar Typhi
uguucuugcugcugcugauggcc

SEQ ID NO: 3663800 - RNA, 16 nt, Salmonella enterica enterica serovar Typhi
uguugacgacuuuugc

SEQ ID NO: 3663801 - RNA, 22 nt, Salmonella enterica enterica serovar Typhi
uguugaguucccuucuccucaa

SEQ ID NO: 3663802 - RNA, 13 nt, Salmonella enterica enterica serovar Typhi
uguugauacagaa

SEQ ID NO: 3663803 - RNA, 23 nt, Salmonella enterica enterica serovar Typhi
uguugauauggugcgcuuuuggc

SEQ ID NO: 3663804 - RNA, 15 nt, Salmonella enterica enterica serovar Typhi
uguugaugucacuca

SEQ ID NO: 3663805 - RNA, 15 nt, Salmonella enterica enterica serovar Typhi
uguugauuaagcacg

SEQ ID NO: 3663806 - RNA, 14 nt, Salmonella enterica enterica serovar Typhi
uguugcaaauauuc

SEQ ID NO: 3663807 - RNA, 13 nt, Salmonella enterica enterica serovar Typhi
uguugccaugauc

SEQ ID NO: 3663808 - RNA, 21 nt, Salmonella enterica enterica serovar Typhi
uguugcggaugaccgcaaacc

SEQ ID NO: 3663809 - RNA, 14 nt, Salmonella enterica enterica serovar Typhi
uguugcuaaaucca

SEQ ID NO: 3663810 - RNA, 13 nt, Salmonella enterica enterica serovar Typhi
uguugcuccagca

SEQ ID NO: 3663811 - RNA, 22 nt, Salmonella enterica enterica serovar Typhi
uguuggugcgcguugccaucgg

SEQ ID NO: 3663812 - RNA, 17 nt, Salmonella enterica enterica serovar Typhi
uguuguaaagaaauuua

SEQ ID NO: 3663813 - RNA, 22 nt, Salmonella enterica enterica serovar Typhi
uguuguaagggcuggaaaauca

SEQ ID NO: 3663814 - RNA, 14 nt, Salmonella enterica enterica serovar Typhi
uguuguacagcaau

SEQ ID NO: 3663815 - RNA, 18 nt, Salmonella enterica enterica serovar Typhi
uguugucgagguuauaaa

SEQ ID NO: 3663816 - RNA, 21 nt, Salmonella enterica enterica serovar Typhi
uguuguucgucuuuugaauag

SEQ ID NO: 3663817 - RNA, 21 nt, Salmonella enterica enterica serovar Typhi
uguuguucuuuucuuucagcu

SEQ ID NO: 3663818 - RNA, 15 nt, Salmonella enterica enterica serovar Typhi
uguuuaaaaucaacg

SEQ ID NO: 3663819 - RNA, 16 nt, Salmonella enterica enterica serovar Typhi
uguuuaauacgcuguc

SEQ ID NO: 3663820 - RNA, 17 nt, Salmonella enterica enterica serovar Typhi
uguuuaaugcuuucaau

SEQ ID NO: 3663821 - RNA, 14 nt, Salmonella enterica enterica serovar Typhi
uguuuaccaucgcg

SEQ ID NO: 3663822 - RNA, 21 nt, Salmonella enterica enterica serovar Typhi
uguuuaccgcgauagaaaguc

SEQ ID NO: 3663823 - RNA, 23 nt, Salmonella enterica enterica serovar Typhi
uguuuagccuuauagagguguua

SEQ ID NO: 3663824 - RNA, 23 nt, Salmonella enterica enterica serovar Typhi
uguuuaguacgcaaggaaauauu

SEQ ID NO: 3663825 - RNA, 22 nt, Salmonella enterica enterica serovar Typhi
uguuuaucagaccuguaaaaaa

SEQ ID NO: 3663826 - RNA, 13 nt, Salmonella enterica enterica serovar Typhi
uguuuaucgggcu

SEQ ID NO: 3663827 - RNA, 16 nt, Salmonella enterica enterica serovar Typhi
uguuuaugacccugcg

SEQ ID NO: 3663828 - RNA, 20 nt, Salmonella enterica enterica serovar Typhi
uguuuauucuucgucagaug

SEQ ID NO: 3663829 - RNA, 18 nt, Salmonella enterica enterica serovar Typhi
uguuucagcaccucuuug

SEQ ID NO: 3663830 - RNA, 15 nt, Salmonella enterica enterica serovar Typhi
uguuucaguucggag

SEQ ID NO: 3663831 - RNA, 18 nt, Salmonella enterica enterica serovar Typhi
uguuucaucgucagcucc

SEQ ID NO: 3663832 - RNA, 23 nt, Salmonella enterica enterica serovar Typhi
uguuuccauacauuuuuguaaua

SEQ ID NO: 3663833 - RNA, 19 nt, Salmonella enterica enterica serovar Typhi
uguuucgacaguuucuucu

SEQ ID NO: 3663834 - RNA, 17 nt, Salmonella enterica enterica serovar Typhi
uguuucggauaauucug

SEQ ID NO: 3663835 - RNA, 15 nt, Salmonella enterica enterica serovar Typhi
uguuucugcuggccu

SEQ ID NO: 3663836 - RNA, 23 nt, Salmonella enterica enterica serovar Typhi
uguuucuuuuaaggcggcaaaga

SEQ ID NO: 3663837 - RNA, 21 nt, Salmonella enterica enterica serovar Typhi
uguuugcccaccguaauaguu

SEQ ID NO: 3663838 - RNA, 20 nt, Salmonella enterica enterica serovar Typhi
uguuugcgcaguugccagua

SEQ ID NO: 3663839 - RNA, 20 nt, Salmonella enterica enterica serovar Typhi
uguuugcugagaauuuccag

SEQ ID NO: 3663840 - RNA, 15 nt, Salmonella enterica enterica serovar Typhi
uguuugcugauaaga

SEQ ID NO: 3663841 - RNA, 13 nt, Salmonella enterica enterica serovar Typhi
uguuuggugcuga

SEQ ID NO: 3663842 - RNA, 20 nt, Salmonella enterica enterica serovar Typhi
uguuuuauacucaaaaaauc

SEQ ID NO: 3663843 - RNA, 16 nt, Salmonella enterica enterica serovar Typhi
uguuuuauuaccuccu

SEQ ID NO: 3663844 - RNA, 21 nt, Salmonella enterica enterica serovar Typhi
uguuuuauugcuucagccaga

SEQ ID NO: 3663845 - RNA, 19 nt, Salmonella enterica enterica serovar Typhi
uguuuucauauguuugaua

SEQ ID NO: 3663846 - RNA, 15 nt, Salmonella enterica enterica serovar Typhi
uguuuuccagcguaa

SEQ ID NO: 3663847 - RNA, 20 nt, Salmonella enterica enterica serovar Typhi
uguuuucccagaauccgcgc

SEQ ID NO: 3663848 - RNA, 17 nt, Salmonella enterica enterica serovar Typhi
uguuuucgagccuugcc

SEQ ID NO: 3663849 - RNA, 21 nt, Salmonella enterica enterica serovar Typhi
uguuuucgagccuugccgcaa

SEQ ID NO: 3663850 - RNA, 13 nt, Salmonella enterica enterica serovar Typhi
uguuuuuaaaaga

SEQ ID NO: 3663851 - RNA, 12 nt, Salmonella enterica enterica serovar Typhi
uguuuuucucuu

SEQ ID NO: 3663852 - RNA, 16 nt, Salmonella enterica enterica serovar Typhi
uguuuuugaaaaugug

SEQ ID NO: 3663853 - RNA, 16 nt, Salmonella enterica enterica serovar Typhi
uguuuuugcuuuaaua

SEQ ID NO: 3663854 - RNA, 14 nt, Salmonella enterica enterica serovar Typhi
uguuuuuguaccag

SEQ ID NO: 3663855 - RNA, 19 nt, Salmonella enterica enterica serovar Typhi
uuaauacguacugaaauaa

SEQ ID NO: 3663856 - RNA, 21 nt, Salmonella enterica enterica serovar Typhi
uuaauagcguagccugcaugu

SEQ ID NO: 3663857 - RNA, 21 nt, Salmonella enterica enterica serovar Typhi
uuaauauaugaaccaagauaa

SEQ ID NO: 3663858 - RNA, 16 nt, Salmonella enterica enterica serovar Typhi
uuaaucaccagcgcau

SEQ ID NO: 3663859 - RNA, 13 nt, Salmonella enterica enterica serovar Typhi
uuaaucacccgcg

SEQ ID NO: 3663860 - RNA, 12 nt, Salmonella enterica enterica serovar Typhi
uuaauccagcag

SEQ ID NO: 3663861 - RNA, 14 nt, Salmonella enterica enterica serovar Typhi
uuaaucccaacccg

SEQ ID NO: 3663862 - RNA, 22 nt, Salmonella enterica enterica serovar Typhi
uuaaucccuugcuggcgacggc

SEQ ID NO: 3663863 - RNA, 14 nt, Salmonella enterica enterica serovar Typhi
uuaaucgauuuucu

SEQ ID NO: 3663864 - RNA, 21 nt, Salmonella enterica enterica serovar Typhi
uuaaucucuucaucuguggca

SEQ ID NO: 3663865 - RNA, 21 nt, Salmonella enterica enterica serovar Typhi
uuaaucugcgcuggguuuuuc

SEQ ID NO: 3663866 - RNA, 14 nt, Salmonella enterica enterica serovar Typhi
uuaaucugucgaug

SEQ ID NO: 3663867 - RNA, 14 nt, Salmonella enterica enterica serovar Typhi
uuaaugaaaucguc

SEQ ID NO: 3663868 - RNA, 15 nt, Salmonella enterica enterica serovar Typhi
uuaaugaccugccgc

SEQ ID NO: 3663869 - RNA, 16 nt, Salmonella enterica enterica serovar Typhi
uuaaugacuuuuuaua

SEQ ID NO: 3663870 - RNA, 18 nt, Salmonella enterica enterica serovar Typhi
uuaaugacuuuuuauaua

SEQ ID NO: 3663871 - RNA, 19 nt, Salmonella enterica enterica serovar Typhi
uuaaugacuuuuuauauaa

SEQ ID NO: 3663872 - RNA, 22 nt, Salmonella enterica enterica serovar Typhi
uuaaugaguagaacguauuauu

SEQ ID NO: 3663873 - RNA, 17 nt, Salmonella enterica enterica serovar Typhi
uuaaugauguccagaau

SEQ ID NO: 3663874 - RNA, 16 nt, Salmonella enterica enterica serovar Typhi
uuaaugauuaaaauaa

SEQ ID NO: 3663875 - RNA, 16 nt, Salmonella enterica enterica serovar Typhi
uuaaugauuugcuuua

SEQ ID NO: 3663876 - RNA, 21 nt, Salmonella enterica enterica serovar Typhi
uuaaugauuugcuuuauuugu

SEQ ID NO: 3663877 - RNA, 20 nt, Salmonella enterica enterica serovar Typhi
uuaaugccgacccaccugac

SEQ ID NO: 3663878 - RNA, 22 nt, Salmonella enterica enterica serovar Typhi
uuaaugccgccguacaaacccu

SEQ ID NO: 3663879 - RNA, 19 nt, Salmonella enterica enterica serovar Typhi
uuaaugccuucgccgccgc

SEQ ID NO: 3663880 - RNA, 15 nt, Salmonella enterica enterica serovar Typhi
uuaaugcgacgccca

SEQ ID NO: 3663881 - RNA, 12 nt, Salmonella enterica enterica serovar Typhi
uuaaugcgcgcu

SEQ ID NO: 3663882 - RNA, 21 nt, Salmonella enterica enterica serovar Typhi
uuaaugcucugcugugccagu

SEQ ID NO: 3663883 - RNA, 16 nt, Salmonella enterica enterica serovar Typhi
uuaaugcuguccugca

SEQ ID NO: 3663884 - RNA, 15 nt, Salmonella enterica enterica serovar Typhi
uuaaugguaccaaua

SEQ ID NO: 3663885 - RNA, 23 nt, Salmonella enterica enterica serovar Typhi
uuaauggucuuaaaugccgccgg

SEQ ID NO: 3663886 - RNA, 20 nt, Salmonella enterica enterica serovar Typhi
uuaauggugguugcaucauc

SEQ ID NO: 3663887 - RNA, 17 nt, Salmonella enterica enterica serovar Typhi
uuaauucuggcaauaag

SEQ ID NO: 3663888 - RNA, 18 nt, Salmonella enterica enterica serovar Typhi
uuaauucuuuuaacauaa

SEQ ID NO: 3663889 - RNA, 19 nt, Salmonella enterica enterica serovar Typhi
uuaauuguaccgauuguuu

SEQ ID NO: 3663890 - RNA, 15 nt, Salmonella enterica enterica serovar Typhi
uuaauuucuuuccaa

SEQ ID NO: 3663891 - RNA, 16 nt, Salmonella enterica enterica serovar Typhi
uuaauuugcuguuuuu

SEQ ID NO: 3663892 - RNA, 18 nt, Salmonella enterica enterica serovar Typhi
uuaauuugugccagcgug

SEQ ID NO: 3663893 - RNA, 19 nt, Salmonella enterica enterica serovar Typhi
uuacaaaugaccucaagaa

SEQ ID NO: 3663894 - RNA, 23 nt, Salmonella enterica enterica serovar Typhi
uuacaaccgcaccggaucaauau

SEQ ID NO: 3663895 - RNA, 19 nt, Salmonella enterica enterica serovar Typhi
uuacaagaauaugcagugc

SEQ ID NO: 3663896 - RNA, 19 nt, Salmonella enterica enterica serovar Typhi
uuacaagugucgugaaucg

SEQ ID NO: 3663897 - RNA, 16 nt, Salmonella enterica enterica serovar Typhi
uuacaauguacagaau

SEQ ID NO: 3663898 - RNA, 18 nt, Salmonella enterica enterica serovar Typhi
uuacaauuuaucugcgug

SEQ ID NO: 3663899 - RNA, 19 nt, Salmonella enterica enterica serovar Typhi
uuacaauuuaucugcguga

SEQ ID NO: 3663900 - RNA, 17 nt, Salmonella enterica enterica serovar Typhi
uuacaauuucgcaaaca

SEQ ID NO: 3663901 - RNA, 19 nt, Salmonella enterica enterica serovar Typhi
uuacacacccggccuauca

SEQ ID NO: 3663902 - RNA, 17 nt, Salmonella enterica enterica serovar Typhi
uuacaccccacuauuca

SEQ ID NO: 3663903 - RNA, 22 nt, Salmonella enterica enterica serovar Typhi
uuacaccucgccacauucaauu

SEQ ID NO: 3663904 - RNA, 12 nt, Salmonella enterica enterica serovar Typhi
uuacacugaagc

SEQ ID NO: 3663905 - RNA, 19 nt, Salmonella enterica enterica serovar Typhi
uuacacugauaccccagcg

SEQ ID NO: 3663906 - RNA, 14 nt, Salmonella enterica enterica serovar Typhi
uuacagcucauaaa

SEQ ID NO: 3663907 - RNA, 15 nt, Salmonella enterica enterica serovar Typhi
uuacaggcgcaucag

SEQ ID NO: 3663908 - RNA, 20 nt, Salmonella enterica enterica serovar Typhi
uuacaggcgcaucagaaaaa

SEQ ID NO: 3663909 - RNA, 13 nt, Salmonella enterica enterica serovar Typhi
uuacaggugccug

SEQ ID NO: 3663910 - RNA, 15 nt, Salmonella enterica enterica serovar Typhi
uuacaucaauaaaca

SEQ ID NO: 3663911 - RNA, 13 nt, Salmonella enterica enterica serovar Typhi
uuacaucagauaa

SEQ ID NO: 3663912 - RNA, 12 nt, Salmonella enterica enterica serovar Typhi
uuacauuuucca

SEQ ID NO: 3663913 - RNA, 15 nt, Salmonella enterica enterica serovar Typhi
uuacauuuuccaugc

SEQ ID NO: 3663914 - RNA, 13 nt, Salmonella enterica enterica serovar Typhi
uuaccaaucgcgg

SEQ ID NO: 3663915 - RNA, 18 nt, Salmonella enterica enterica serovar Typhi
uuaccaaugccaaaaaaa

SEQ ID NO: 3663916 - RNA, 18 nt, Salmonella enterica enterica serovar Typhi
uuaccacgguaacgccuu

SEQ ID NO: 3663917 - RNA, 13 nt, Salmonella enterica enterica serovar Typhi
uuaccacuuugcg

SEQ ID NO: 3663918 - RNA, 14 nt, Salmonella enterica enterica serovar Typhi
uuaccagaaccacu

SEQ ID NO: 3663919 - RNA, 22 nt, Salmonella enterica enterica serovar Typhi
uuaccagaccggcaucucaucu

SEQ ID NO: 3663920 - RNA, 14 nt, Salmonella enterica enterica serovar Typhi
uuaccauuacgcua

SEQ ID NO: 3663921 - RNA, 22 nt, Salmonella enterica enterica serovar Typhi
uuaccauuccucacgaaguuua

SEQ ID NO: 3663922 - RNA, 13 nt, Salmonella enterica enterica serovar Typhi
uuacccaauaaug

SEQ ID NO: 3663923 - RNA, 21 nt, Salmonella enterica enterica serovar Typhi
uuacccacaucaaucaccuga

SEQ ID NO: 3663924 - RNA, 22 nt, Salmonella enterica enterica serovar Typhi
uuacccagcaauaguggacaca

SEQ ID NO: 3663925 - RNA, 20 nt, Salmonella enterica enterica serovar Typhi
uuacccggcguauugguaca

SEQ ID NO: 3663926 - RNA, 18 nt, Salmonella enterica enterica serovar Typhi
uuacccgggccaucuuuu

SEQ ID NO: 3663927 - RNA, 23 nt, Salmonella enterica enterica serovar Typhi
uuacccuuacggccacugguuug

SEQ ID NO: 3663928 - RNA, 20 nt, Salmonella enterica enterica serovar Typhi
uuacccuucagauaucccau

SEQ ID NO: 3663929 - RNA, 22 nt, Salmonella enterica enterica serovar Typhi
uuacccuucagauaucccauga

SEQ ID NO: 3663930 - RNA, 22 nt, Salmonella enterica enterica serovar Typhi
uuacccuuccccggcagccuca

SEQ ID NO: 3663931 - RNA, 14 nt, Salmonella enterica enterica serovar Typhi
uuaccgcccgcuuc

SEQ ID NO: 3663932 - RNA, 19 nt, Salmonella enterica enterica serovar Typhi
uuaccgcccuguccuccau

SEQ ID NO: 3663933 - RNA, 18 nt, Salmonella enterica enterica serovar Typhi
uuaccgccgguuuauccc

SEQ ID NO: 3663934 - RNA, 16 nt, Salmonella enterica enterica serovar Typhi
uuaccgcgcucaaaug

SEQ ID NO: 3663935 - RNA, 20 nt, Salmonella enterica enterica serovar Typhi
uuaccgggcaaacggcacua

SEQ ID NO: 3663936 - RNA, 14 nt, Salmonella enterica enterica serovar Typhi
uuaccgggcaucug

SEQ ID NO: 3663937 - RNA, 15 nt, Salmonella enterica enterica serovar Typhi
uuaccggugcagacc

SEQ ID NO: 3663938 - RNA, 20 nt, Salmonella enterica enterica serovar Typhi
uuaccguaucccaccauaaa

SEQ ID NO: 3663939 - RNA, 19 nt, Salmonella enterica enterica serovar Typhi
uuaccguaugcaaaaggca

SEQ ID NO: 3663940 - RNA, 22 nt, Salmonella enterica enterica serovar Typhi
uuaguaccgaacagccaggcuu

SEQ ID NO: 3663941 - RNA, 21 nt, Salmonella enterica enterica serovar Typhi
uuaguugauucgcuaauaauu

SEQ ID NO: 3663942 - RNA, 23 nt, Salmonella enterica enterica serovar Typhi
uuaguuucuauuaaaucagauaa

SEQ ID NO: 3663943 - RNA, 13 nt, Salmonella enterica enterica serovar Typhi
uuauaaaauaacg

SEQ ID NO: 3663944 - RNA, 19 nt, Salmonella enterica enterica serovar Typhi
uuauaaaucaggaaaaagg

SEQ ID NO: 3663945 - RNA, 14 nt, Salmonella enterica enterica serovar Typhi
uuauaaauuuuuua

SEQ ID NO: 3663946 - RNA, 21 nt, Salmonella enterica enterica serovar Typhi
uuauaaauuuuuuaacagaag

SEQ ID NO: 3663947 - RNA, 13 nt, Salmonella enterica enterica serovar Typhi
uuauaacauaaau

SEQ ID NO: 3663948 - RNA, 22 nt, Salmonella enterica enterica serovar Typhi
uuauaacuaaacucaucuuuau

SEQ ID NO: 3663949 - RNA, 21 nt, Salmonella enterica enterica serovar Typhi
uuauaagaaccaucuaccaua

SEQ ID NO: 3663950 - RNA, 16 nt, Salmonella enterica enterica serovar Typhi
uuauaagccugagcgc

SEQ ID NO: 3663951 - RNA, 17 nt, Salmonella enterica enterica serovar Typhi
uuauaagcuuuaaccac

SEQ ID NO: 3663952 - RNA, 18 nt, Salmonella enterica enterica serovar Typhi
uuauacaccgggaaaagc

SEQ ID NO: 3663953 - RNA, 22 nt, Salmonella enterica enterica serovar Typhi
uuauagaugucagauccuucau

SEQ ID NO: 3663954 - RNA, 18 nt, Salmonella enterica enterica serovar Typhi
uuauagcucagcgcggca

SEQ ID NO: 3663955 - RNA, 22 nt, Salmonella enterica enterica serovar Typhi
uuauauaaaaaaugguuuuauu

SEQ ID NO: 3663956 - RNA, 14 nt, Salmonella enterica enterica serovar Typhi
uuauauaaaaauag

SEQ ID NO: 3663957 - RNA, 13 nt, Salmonella enterica enterica serovar Typhi
uuauauaagcaua

SEQ ID NO: 3663958 - RNA, 13 nt, Salmonella enterica enterica serovar Typhi
uuauauagucuua

SEQ ID NO: 3663959 - RNA, 21 nt, Salmonella enterica enterica serovar Typhi
uuauaugcguguagcagauag

SEQ ID NO: 3663960 - RNA, 12 nt, Salmonella enterica enterica serovar Typhi
uuauauuuaaaa

SEQ ID NO: 3663961 - RNA, 19 nt, Salmonella enterica enterica serovar Typhi
uuauauuuaaaauuccaau

SEQ ID NO: 3663962 - RNA, 19 nt, Salmonella enterica enterica serovar Typhi
uuaucaacaaauuccggca

SEQ ID NO: 3663963 - RNA, 14 nt, Salmonella enterica enterica serovar Typhi
uuaucaagccuaca

SEQ ID NO: 3663964 - RNA, 19 nt, Salmonella enterica enterica serovar Typhi
uuaucaauaaccgccagca

SEQ ID NO: 3663965 - RNA, 19 nt, Salmonella enterica enterica serovar Typhi
uuaucaauuucauauuauu

SEQ ID NO: 3663966 - RNA, 23 nt, Salmonella enterica enterica serovar Typhi
uuaucaccaaguagacagagaag

SEQ ID NO: 3663967 - RNA, 24 nt, Salmonella enterica enterica serovar Typhi
uuaucacccugaauuucaauaauc

SEQ ID NO: 3663968 - RNA, 19 nt, Salmonella enterica enterica serovar Typhi
uuaucacugguuauaugaa

SEQ ID NO: 3663969 - RNA, 11 nt, Salmonella enterica enterica serovar Typhi
uuaucaggccu

SEQ ID NO: 3663970 - RNA, 19 nt, Salmonella enterica enterica serovar Typhi
uuaucaggccuacauccgg

SEQ ID NO: 3663971 - RNA, 21 nt, Salmonella enterica enterica serovar Typhi
uuaucaggccuaccaucgcgc

SEQ ID NO: 3663972 - RNA, 14 nt, Salmonella enterica enterica serovar Typhi
uuaucaggcgaccc

SEQ ID NO: 3663973 - RNA, 17 nt, Salmonella enterica enterica serovar Typhi
uuaucaucguaaaauca

SEQ ID NO: 3663974 - RNA, 13 nt, Salmonella enterica enterica serovar Typhi
uuaucaugcgcca

SEQ ID NO: 3663975 - RNA, 14 nt, Salmonella enterica enterica serovar Typhi
uuaucaugcugacu

SEQ ID NO: 3663976 - RNA, 14 nt, Salmonella enterica enterica serovar Typhi
uuauccaaauccuu

SEQ ID NO: 3663977 - RNA, 17 nt, Salmonella enterica enterica serovar Typhi
uuauccagucagaggaa

SEQ ID NO: 3663978 - RNA, 11 nt, Salmonella enterica enterica serovar Typhi
uuauccccuuc

SEQ ID NO: 3663979 - RNA, 14 nt, Salmonella enterica enterica serovar Typhi
uuaucccguggugg

SEQ ID NO: 3663980 - RNA, 21 nt, Salmonella enterica enterica serovar Typhi
uuauccgccagcgcaacgcgc

SEQ ID NO: 3663981 - RNA, 15 nt, Salmonella enterica enterica serovar Typhi
uuauccggcaaaaga

SEQ ID NO: 3663982 - RNA, 14 nt, Salmonella enterica enterica serovar Typhi
uuauccggccuaca

SEQ ID NO: 3663983 - RNA, 18 nt, Salmonella enterica enterica serovar Typhi
uuauccggccuacgcuua

SEQ ID NO: 3663984 - RNA, 15 nt, Salmonella enterica enterica serovar Typhi
uuauccggccugcac

SEQ ID NO: 3663985 - RNA, 22 nt, Salmonella enterica enterica serovar Typhi
uuauccuccgaacaggcguuug

SEQ ID NO: 3663986 - RNA, 17 nt, Salmonella enterica enterica serovar Typhi
uuauccugcaaauagcg

SEQ ID NO: 3663987 - RNA, 18 nt, Salmonella enterica enterica serovar Typhi
uuauccugcaaauagcgc

SEQ ID NO: 3663988 - RNA, 20 nt, Salmonella enterica enterica serovar Typhi
uuauccuguguuuggccgcc

SEQ ID NO: 3663989 - RNA, 22 nt, Salmonella enterica enterica serovar Typhi
uuaucgaaauagcggugaacuu

SEQ ID NO: 3663990 - RNA, 15 nt, Salmonella enterica enterica serovar Typhi
uuaucgccaaagaua

SEQ ID NO: 3663991 - RNA, 14 nt, Salmonella enterica enterica serovar Typhi
uuaucgccgaucac

SEQ ID NO: 3663992 - RNA, 12 nt, Salmonella enterica enterica serovar Typhi
uuaucgcuauca

SEQ ID NO: 3663993 - RNA, 23 nt, Salmonella enterica enterica serovar Typhi
uuaucggcgucgcggcaauagcg

SEQ ID NO: 3663994 - RNA, 23 nt, Salmonella enterica enterica serovar Typhi
uuaucgggccuacgagauaaaaa

SEQ ID NO: 3663995 - RNA, 21 nt, Salmonella enterica enterica serovar Typhi
uuaucgguaaugauaucgccc

SEQ ID NO: 3663996 - RNA, 22 nt, Salmonella enterica enterica serovar Typhi
uuaucuccccaauugcugcuau

SEQ ID NO: 3663997 - RNA, 14 nt, Salmonella enterica enterica serovar Typhi
uuaucucuuuugcu

SEQ ID NO: 3663998 - RNA, 16 nt, Salmonella enterica enterica serovar Typhi
uuaucucuuuugcuuc

SEQ ID NO: 3663999 - RNA, 22 nt, Salmonella enterica enterica serovar Typhi
uuaucucuuuugcuucaauaag

SEQ ID NO: 3664000 - RNA, 19 nt, Salmonella enterica enterica serovar Typhi
uuaucuggcgcaaccggcg

SEQ ID NO: 3664001 - RNA, 17 nt, Salmonella enterica enterica serovar Typhi
uuaucuguaauuauaaa

SEQ ID NO: 3664002 - RNA, 18 nt, Salmonella enterica enterica serovar Typhi
uuaucuucaagguuaugc

SEQ ID NO: 3664003 - RNA, 20 nt, Salmonella enterica enterica serovar Typhi
uuaucuuccacgguaaaaca

SEQ ID NO: 3664004 - RNA, 13 nt, Salmonella enterica enterica serovar Typhi
uuaucuuccggca

SEQ ID NO: 3664005 - RNA, 18 nt, Salmonella enterica enterica serovar Typhi
uuaucuucggucgagcuu

SEQ ID NO: 3664006 - RNA, 23 nt, Salmonella enterica enterica serovar Typhi
uuaugaauaguuucaccuucugc

SEQ ID NO: 3664007 - RNA, 19 nt, Salmonella enterica enterica serovar Typhi
uuaugaccaauaauaaucc

SEQ ID NO: 3664008 - RNA, 16 nt, Salmonella enterica enterica serovar Typhi
uuaugacggggaacag

SEQ ID NO: 3664009 - RNA, 14 nt, Salmonella enterica enterica serovar Typhi
uuaugauuucaggc

SEQ ID NO: 3664010 - RNA, 13 nt, Salmonella enterica enterica serovar Typhi
uuaugcacgcuau

SEQ ID NO: 3664011 - RNA, 15 nt, Salmonella enterica enterica serovar Typhi
uuaugcgguucuccc

SEQ ID NO: 3664012 - RNA, 22 nt, Salmonella enterica enterica serovar Typhi
uuaugcgucaaaguugcaucaa

SEQ ID NO: 3664013 - RNA, 19 nt, Salmonella enterica enterica serovar Typhi
uuaugcguuuaauugaauu

SEQ ID NO: 3664014 - RNA, 22 nt, Salmonella enterica enterica serovar Typhi
uuaugcguuuuuaucuuucuuu

SEQ ID NO: 3664015 - RNA, 14 nt, Salmonella enterica enterica serovar Typhi
uuaugcugccagcg

SEQ ID NO: 3664016 - RNA, 19 nt, Salmonella enterica enterica serovar Typhi
uuauguagccagccauggc

SEQ ID NO: 3664017 - RNA, 14 nt, Salmonella enterica enterica serovar Typhi
uuaugucauucagg

SEQ ID NO: 3664018 - RNA, 15 nt, Salmonella enterica enterica serovar Typhi
uuaugucauuuauuu

SEQ ID NO: 3664019 - RNA, 14 nt, Salmonella enterica enterica serovar Typhi
uuauguugauaacg

SEQ ID NO: 3664020 - RNA, 14 nt, Salmonella enterica enterica serovar Typhi
uuauguuugcugau

SEQ ID NO: 3664021 - RNA, 15 nt, Salmonella enterica enterica serovar Typhi
uuauuaaagccccuu

SEQ ID NO: 3664022 - RNA, 18 nt, Salmonella enterica enterica serovar Typhi
uuauuaaagccccuuccu

SEQ ID NO: 3664023 - RNA, 12 nt, Salmonella enterica enterica serovar Typhi
uuauuaacccuu

SEQ ID NO: 3664024 - RNA, 13 nt, Salmonella enterica enterica serovar Typhi
uuauuaacgugcu

SEQ ID NO: 3664025 - RNA, 15 nt, Salmonella enterica enterica serovar Typhi
uuauuaaucuuuaca

SEQ ID NO: 3664026 - RNA, 20 nt, Salmonella enterica enterica serovar Typhi
uucaccguuuaaaaacauca

SEQ ID NO: 3664027 - RNA, 13 nt, Salmonella enterica enterica serovar Typhi
uucaccucccugc

SEQ ID NO: 3664028 - RNA, 14 nt, Salmonella enterica enterica serovar Typhi
uucaccucccugca

SEQ ID NO: 3664029 - RNA, 14 nt, Salmonella enterica enterica serovar Typhi
uucaccuuuccagu

SEQ ID NO: 3664030 - RNA, 17 nt, Salmonella enterica enterica serovar Typhi
uucaccuuucugccagg

SEQ ID NO: 3664031 - RNA, 18 nt, Salmonella enterica enterica serovar Typhi
uucacgaaaccggcgaug

SEQ ID NO: 3664032 - RNA, 19 nt, Salmonella enterica enterica serovar Typhi
uucacgagcggucaggcca

SEQ ID NO: 3664033 - RNA, 20 nt, Salmonella enterica enterica serovar Typhi
uucacgagcggucaggccag

SEQ ID NO: 3664034 - RNA, 18 nt, Salmonella enterica enterica serovar Typhi
uucacgcacagaucgucg

SEQ ID NO: 3664035 - RNA, 23 nt, Salmonella enterica enterica serovar Typhi
uucacgcagcgcauccaccagac

SEQ ID NO: 3664036 - RNA, 19 nt, Salmonella enterica enterica serovar Typhi
uucacgcauugccacagcc

SEQ ID NO: 3664037 - RNA, 20 nt, Salmonella enterica enterica serovar Typhi
uucacgccuuuugacgcuuc

SEQ ID NO: 3664038 - RNA, 15 nt, Salmonella enterica enterica serovar Typhi
uucacgcucacgcag

SEQ ID NO: 3664039 - RNA, 21 nt, Salmonella enterica enterica serovar Typhi
uucacgcucgaguucuucacg

SEQ ID NO: 3664040 - RNA, 20 nt, Salmonella enterica enterica serovar Typhi
uucacguaccaggcagcgcg

SEQ ID NO: 3664041 - RNA, 15 nt, Salmonella enterica enterica serovar Typhi
uucacguuuuccagg

SEQ ID NO: 3664042 - RNA, 18 nt, Salmonella enterica enterica serovar Typhi
uucacguuuuccaggugc

SEQ ID NO: 3664043 - RNA, 22 nt, Salmonella enterica enterica serovar Typhi
uucacuaaaaacaggcugcgua

SEQ ID NO: 3664044 - RNA, 23 nt, Salmonella enterica enterica serovar Typhi
uucacuaauuugaugccuggcag

SEQ ID NO: 3664045 - RNA, 18 nt, Salmonella enterica enterica serovar Typhi
uucacuccuaagagaaaa

SEQ ID NO: 3664046 - RNA, 16 nt, Salmonella enterica enterica serovar Typhi
uucacuggcaugcgcc

SEQ ID NO: 3664047 - RNA, 21 nt, Salmonella enterica enterica serovar Typhi
uucacuguagcugauaagcua

SEQ ID NO: 3664048 - RNA, 24 nt, Salmonella enterica enterica serovar Typhi
uucacugucaugguuauuuugucc

SEQ ID NO: 3664049 - RNA, 17 nt, Salmonella enterica enterica serovar Typhi
uucacuuuaccaggcau

SEQ ID NO: 3664050 - RNA, 20 nt, Salmonella enterica enterica serovar Typhi
uucagagcgucuuuuauccc

SEQ ID NO: 3664051 - RNA, 16 nt, Salmonella enterica enterica serovar Typhi
uucagauaauucuaaa

SEQ ID NO: 3664052 - RNA, 14 nt, Salmonella enterica enterica serovar Typhi
uucagaugcagcgg

SEQ ID NO: 3664053 - RNA, 13 nt, Salmonella enterica enterica serovar Typhi
uucagcagcgccc

SEQ ID NO: 3664054 - RNA, 17 nt, Salmonella enterica enterica serovar Typhi
uucagcagcgcccagcc

SEQ ID NO: 3664055 - RNA, 15 nt, Salmonella enterica enterica serovar Typhi
uucagcauauccagc

SEQ ID NO: 3664056 - RNA, 19 nt, Salmonella enterica enterica serovar Typhi
uucagcauauccagcgccu

SEQ ID NO: 3664057 - RNA, 16 nt, Salmonella enterica enterica serovar Typhi
uucagcauccuccggc

SEQ ID NO: 3664058 - RNA, 14 nt, Salmonella enterica enterica serovar Typhi
uucagcauuggcau

SEQ ID NO: 3664059 - RNA, 13 nt, Salmonella enterica enterica serovar Typhi
uucagccugaagc

SEQ ID NO: 3664060 - RNA, 15 nt, Salmonella enterica enterica serovar Typhi
uucagccugaagcca

SEQ ID NO: 3664061 - RNA, 16 nt, Salmonella enterica enterica serovar Typhi
uucagccuuuucauau

SEQ ID NO: 3664062 - RNA, 18 nt, Salmonella enterica enterica serovar Typhi
uucagcgccagauaguca

SEQ ID NO: 3664063 - RNA, 19 nt, Salmonella enterica enterica serovar Typhi
uucagcgccagauagucac

SEQ ID NO: 3664064 - RNA, 15 nt, Salmonella enterica enterica serovar Typhi
uucagcgccugaaug

SEQ ID NO: 3664065 - RNA, 16 nt, Salmonella enterica enterica serovar Typhi
uucagcguacagaagg

SEQ ID NO: 3664066 - RNA, 23 nt, Salmonella enterica enterica serovar Typhi
uucagcguaccgaagaacauaaa

SEQ ID NO: 3664067 - RNA, 16 nt, Salmonella enterica enterica serovar Typhi
uucagcguugcagcca

SEQ ID NO: 3664068 - RNA, 22 nt, Salmonella enterica enterica serovar Typhi
uucagcucgcaggccauaaaac

SEQ ID NO: 3664069 - RNA, 18 nt, Salmonella enterica enterica serovar Typhi
uucagcucgcugccgauc

SEQ ID NO: 3664070 - RNA, 23 nt, Salmonella enterica enterica serovar Typhi
uucagcuucagucauaauccuuc

SEQ ID NO: 3664071 - RNA, 14 nt, Salmonella enterica enterica serovar Typhi
uucaggaauacauu

SEQ ID NO: 3664072 - RNA, 17 nt, Salmonella enterica enterica serovar Typhi
uucaggcaaaggaaugc

SEQ ID NO: 3664073 - RNA, 20 nt, Salmonella enterica enterica serovar Typhi
uucaggcauccagacccaca

SEQ ID NO: 3664074 - RNA, 17 nt, Salmonella enterica enterica serovar Typhi
uucaggccgccagcaaa

SEQ ID NO: 3664075 - RNA, 17 nt, Salmonella enterica enterica serovar Typhi
uucaggcggcaaaaaac

SEQ ID NO: 3664076 - RNA, 20 nt, Salmonella enterica enterica serovar Typhi
uucaggcucaucagcgccau

SEQ ID NO: 3664077 - RNA, 23 nt, Salmonella enterica enterica serovar Typhi
uucaggcugccaaccagcgcuuu

SEQ ID NO: 3664078 - RNA, 23 nt, Salmonella enterica enterica serovar Typhi
uucagggcuuauucaagcaacug

SEQ ID NO: 3664079 - RNA, 15 nt, Salmonella enterica enterica serovar Typhi
uucagguauugguau

SEQ ID NO: 3664080 - RNA, 21 nt, Salmonella enterica enterica serovar Typhi
uucaggucauacggcaugcca

SEQ ID NO: 3664081 - RNA, 16 nt, Salmonella enterica enterica serovar Typhi
uucaguacugacgcaa

SEQ ID NO: 3664082 - RNA, 16 nt, Salmonella enterica enterica serovar Typhi
uucaguaggacaaaaa

SEQ ID NO: 3664083 - RNA, 19 nt, Salmonella enterica enterica serovar Typhi
uucagucauaauccuuccu

SEQ ID NO: 3664084 - RNA, 22 nt, Salmonella enterica enterica serovar Typhi
uucagucuaauuuauuaacccu

SEQ ID NO: 3664085 - RNA, 23 nt, Salmonella enterica enterica serovar Typhi
uucagugccugauagcgcugugc

SEQ ID NO: 3664086 - RNA, 20 nt, Salmonella enterica enterica serovar Typhi
uucaguggcuaauuucaauu

SEQ ID NO: 3664087 - RNA, 23 nt, Salmonella enterica enterica serovar Typhi
uucaguggucaggcgaccaauau

SEQ ID NO: 3664088 - RNA, 20 nt, Salmonella enterica enterica serovar Typhi
uucaguuaaauaaacaaaaa

SEQ ID NO: 3664089 - RNA, 21 nt, Salmonella enterica enterica serovar Typhi
uucaguucgacuuaacgauaa

SEQ ID NO: 3664090 - RNA, 16 nt, Salmonella enterica enterica serovar Typhi
uucaguucggagauca

SEQ ID NO: 3664091 - RNA, 20 nt, Salmonella enterica enterica serovar Typhi
uucaguugcccauuuuccuc

SEQ ID NO: 3664092 - RNA, 21 nt, Salmonella enterica enterica serovar Typhi
uucaguugcccauuuuccucc

SEQ ID NO: 3664093 - RNA, 21 nt, Salmonella enterica enterica serovar Typhi
uucauaaagugccagggcgga

SEQ ID NO: 3664094 - RNA, 12 nt, Salmonella enterica enterica serovar Typhi
uucauaaauacg

SEQ ID NO: 3664095 - RNA, 22 nt, Salmonella enterica enterica serovar Typhi
uucauaacgaccuuuacugaca

SEQ ID NO: 3664096 - RNA, 15 nt, Salmonella enterica enterica serovar Typhi
uucauaagucaucca

SEQ ID NO: 3664097 - RNA, 21 nt, Salmonella enterica enterica serovar Typhi
uucauaccggauauggcaaaa

SEQ ID NO: 3664098 - RNA, 15 nt, Salmonella enterica enterica serovar Typhi
uucauagaaccacuu

SEQ ID NO: 3664099 - RNA, 17 nt, Salmonella enterica enterica serovar Typhi
uucauaggugaacauga

SEQ ID NO: 3664100 - RNA, 21 nt, Salmonella enterica enterica serovar Typhi
uucauauagucauaauacuca

SEQ ID NO: 3664101 - RNA, 14 nt, Salmonella enterica enterica serovar Typhi
uucaucaaaaugca

SEQ ID NO: 3664102 - RNA, 17 nt, Salmonella enterica enterica serovar Typhi
uucaucaaaaugcacau

SEQ ID NO: 3664103 - RNA, 13 nt, Salmonella enterica enterica serovar Typhi
uucaucaaauaag

SEQ ID NO: 3664104 - RNA, 21 nt, Salmonella enterica enterica serovar Typhi
uucaucaggcaauaaacauca

SEQ ID NO: 3664105 - RNA, 22 nt, Salmonella enterica enterica serovar Typhi
uucaucaggcaauaaacaucag

SEQ ID NO: 3664106 - RNA, 16 nt, Salmonella enterica enterica serovar Typhi
uucaucaggccugcaa

SEQ ID NO: 3664107 - RNA, 13 nt, Salmonella enterica enterica serovar Typhi
uucaucaggcuga

SEQ ID NO: 3664108 - RNA, 14 nt, Salmonella enterica enterica serovar Typhi
uucaucaguaacug

SEQ ID NO: 3664109 - RNA, 17 nt, Salmonella enterica enterica serovar Typhi
uucaucaguaacugacg

SEQ ID NO: 3664110 - RNA, 20 nt, Salmonella enterica enterica serovar Typhi
uucauccaugccaagcggca

SEQ ID NO: 3664111 - RNA, 20 nt, Salmonella enterica enterica serovar Typhi
uucccaccgcgaauuucacc

SEQ ID NO: 3664112 - RNA, 23 nt, Salmonella enterica enterica serovar Typhi
uucccacgggcgcaccauaccua

SEQ ID NO: 3664113 - RNA, 14 nt, Salmonella enterica enterica serovar Typhi
uucccacuccgccc

SEQ ID NO: 3664114 - RNA, 16 nt, Salmonella enterica enterica serovar Typhi
uucccacuccgcccag

SEQ ID NO: 3664115 - RNA, 12 nt, Salmonella enterica enterica serovar Typhi
uucccagcgccc

SEQ ID NO: 3664116 - RNA, 17 nt, Salmonella enterica enterica serovar Typhi
uucccagcgggaacauc

SEQ ID NO: 3664117 - RNA, 18 nt, Salmonella enterica enterica serovar Typhi
uucccagcgggaacauca

SEQ ID NO: 3664118 - RNA, 22 nt, Salmonella enterica enterica serovar Typhi
uucccagguuuuggucagcuca

SEQ ID NO: 3664119 - RNA, 15 nt, Salmonella enterica enterica serovar Typhi
uucccagucauccgg

SEQ ID NO: 3664120 - RNA, 14 nt, Salmonella enterica enterica serovar Typhi
uucccaucgcuuug

SEQ ID NO: 3664121 - RNA, 15 nt, Salmonella enterica enterica serovar Typhi
uuccccaccaggaau

SEQ ID NO: 3664122 - RNA, 16 nt, Salmonella enterica enterica serovar Typhi
uuccccaccaggaaug

SEQ ID NO: 3664123 - RNA, 18 nt, Salmonella enterica enterica serovar Typhi
uuccccacgccgaccacc

SEQ ID NO: 3664124 - RNA, 12 nt, Salmonella enterica enterica serovar Typhi
uuccccauaauc

SEQ ID NO: 3664125 - RNA, 12 nt, Salmonella enterica enterica serovar Typhi
uuccccaucgcg

SEQ ID NO: 3664126 - RNA, 20 nt, Salmonella enterica enterica serovar Typhi
uucccccacuucugacagaa

SEQ ID NO: 3664127 - RNA, 16 nt, Salmonella enterica enterica serovar Typhi
uucccccagauugucg

SEQ ID NO: 3664128 - RNA, 17 nt, Salmonella enterica enterica serovar Typhi
uucccccauccgcgccg

SEQ ID NO: 3664129 - RNA, 20 nt, Salmonella enterica enterica serovar Typhi
uuccccgaucagaaaaccuu

SEQ ID NO: 3664130 - RNA, 19 nt, Salmonella enterica enterica serovar Typhi
uuccccgccgcacacgccg

SEQ ID NO: 3664131 - RNA, 11 nt, Salmonella enterica enterica serovar Typhi
uuccccuccgc

SEQ ID NO: 3664132 - RNA, 20 nt, Salmonella enterica enterica serovar Typhi
uuccccuuuaggcggcgccg

SEQ ID NO: 3664133 - RNA, 14 nt, Salmonella enterica enterica serovar Typhi
uucccgaaaggaag

SEQ ID NO: 3664134 - RNA, 21 nt, Salmonella enterica enterica serovar Typhi
uucccgaaaggaagcgggcca

SEQ ID NO: 3664135 - RNA, 21 nt, Salmonella enterica enterica serovar Typhi
uucccgacuuuacaccccacu

SEQ ID NO: 3664136 - RNA, 11 nt, Salmonella enterica enterica serovar Typhi
uucccgagcgg

SEQ ID NO: 3664137 - RNA, 16 nt, Salmonella enterica enterica serovar Typhi
uucccgauuccguguc

SEQ ID NO: 3664138 - RNA, 16 nt, Salmonella enterica enterica serovar Typhi
uucccgccgcaauucc

SEQ ID NO: 3664139 - RNA, 17 nt, Salmonella enterica enterica serovar Typhi
uucccgcgccagcgucg

SEQ ID NO: 3664140 - RNA, 17 nt, Salmonella enterica enterica serovar Typhi
uucccgcuauagaaugc

SEQ ID NO: 3664141 - RNA, 23 nt, Salmonella enterica enterica serovar Typhi
uucccgcuauagaaugcaagcag

SEQ ID NO: 3664142 - RNA, 13 nt, Salmonella enterica enterica serovar Typhi
uucccgcuggcug

SEQ ID NO: 3664143 - RNA, 17 nt, Salmonella enterica enterica serovar Typhi
uucccgcugguugccuu

SEQ ID NO: 3664144 - RNA, 15 nt, Salmonella enterica enterica serovar Typhi
uucccggaaaaguau

SEQ ID NO: 3664145 - RNA, 15 nt, Salmonella enterica enterica serovar Typhi
uucccggaucgcuaa

SEQ ID NO: 3664146 - RNA, 23 nt, Salmonella enterica enterica serovar Typhi
uucccggaucggucuggcgcaua

SEQ ID NO: 3664147 - RNA, 18 nt, Salmonella enterica enterica serovar Typhi
uucccggcaauuaccgcc

SEQ ID NO: 3664148 - RNA, 16 nt, Salmonella enterica enterica serovar Typhi
uucccggcuaaccugu

SEQ ID NO: 3664149 - RNA, 17 nt, Salmonella enterica enterica serovar Typhi
uucccuacucucgcaug

SEQ ID NO: 3664150 - RNA, 12 nt, Salmonella enterica enterica serovar Typhi
uucccugaccag

SEQ ID NO: 3664151 - RNA, 21 nt, Salmonella enterica enterica serovar Typhi
uucccugacgcgcagcgauau

SEQ ID NO: 3664152 - RNA, 15 nt, Salmonella enterica enterica serovar Typhi
uucccuuaucugcaa

SEQ ID NO: 3664153 - RNA, 16 nt, Salmonella enterica enterica serovar Typhi
uucccuucugaaauga

SEQ ID NO: 3664154 - RNA, 23 nt, Salmonella enterica enterica serovar Typhi
uuccgacagugaacggcauaauc

SEQ ID NO: 3664155 - RNA, 12 nt, Salmonella enterica enterica serovar Typhi
uuccgcaauaag

SEQ ID NO: 3664156 - RNA, 15 nt, Salmonella enterica enterica serovar Typhi
uuccgcaauacagcc

SEQ ID NO: 3664157 - RNA, 22 nt, Salmonella enterica enterica serovar Typhi
uuccgcaauaugcgucagcgcg

SEQ ID NO: 3664158 - RNA, 18 nt, Salmonella enterica enterica serovar Typhi
uuccgcacgcgcgcccau

SEQ ID NO: 3664159 - RNA, 18 nt, Salmonella enterica enterica serovar Typhi
uuccgcagccaacaacag

SEQ ID NO: 3664160 - RNA, 22 nt, Salmonella enterica enterica serovar Typhi
uuccgcagccaacaacaggccg

SEQ ID NO: 3664161 - RNA, 14 nt, Salmonella enterica enterica serovar Typhi
uuccgccaccacgc

SEQ ID NO: 3664162 - RNA, 19 nt, Salmonella enterica enterica serovar Typhi
uuccgccaccagauaguca

SEQ ID NO: 3664163 - RNA, 14 nt, Salmonella enterica enterica serovar Typhi
uuccgccagacuca

SEQ ID NO: 3664164 - RNA, 21 nt, Salmonella enterica enterica serovar Typhi
uuccgccagcgccagcagcag

SEQ ID NO: 3664165 - RNA, 19 nt, Salmonella enterica enterica serovar Typhi
uuccgccgcgguauucaua

SEQ ID NO: 3664166 - RNA, 19 nt, Salmonella enterica enterica serovar Typhi
uuccgcgagagaaaaaaau

SEQ ID NO: 3664167 - RNA, 17 nt, Salmonella enterica enterica serovar Typhi
uuccgcguuaucaagag

SEQ ID NO: 3664168 - RNA, 15 nt, Salmonella enterica enterica serovar Typhi
uuccgcuuccagaau

SEQ ID NO: 3664169 - RNA, 22 nt, Salmonella enterica enterica serovar Typhi
uuccggaucgccgaagcggcag

SEQ ID NO: 3664170 - RNA, 16 nt, Salmonella enterica enterica serovar Typhi
uuccggcagacggcug

SEQ ID NO: 3664171 - RNA, 14 nt, Salmonella enterica enterica serovar Typhi
uuccggcaucacau

SEQ ID NO: 3664172 - RNA, 16 nt, Salmonella enterica enterica serovar Typhi
uuccggcgaaaaaccg

SEQ ID NO: 3664173 - RNA, 22 nt, Salmonella enterica enterica serovar Typhi
uuccggcuucguuaagcgguuu

SEQ ID NO: 3664174 - RNA, 17 nt, Salmonella enterica enterica serovar Typhi
uuccgggcgcaccaguu

SEQ ID NO: 3664175 - RNA, 14 nt, Salmonella enterica enterica serovar Typhi
uuccggugugacca

SEQ ID NO: 3664176 - RNA, 12 nt, Salmonella enterica enterica serovar Typhi
uuccucacagcc

SEQ ID NO: 3664177 - RNA, 14 nt, Salmonella enterica enterica serovar Typhi
uuccucagaauccg

SEQ ID NO: 3664178 - RNA, 12 nt, Salmonella enterica enterica serovar Typhi
uuccucccggug

SEQ ID NO: 3664179 - RNA, 13 nt, Salmonella enterica enterica serovar Typhi
uuccucccggugc

SEQ ID NO: 3664180 - RNA, 20 nt, Salmonella enterica enterica serovar Typhi
uuccucgauaucuucauagc

SEQ ID NO: 3664181 - RNA, 15 nt, Salmonella enterica enterica serovar Typhi
uuccucgucggcaag

SEQ ID NO: 3664182 - RNA, 20 nt, Salmonella enterica enterica serovar Typhi
uuccucuaaaugggcaggag

SEQ ID NO: 3664183 - RNA, 14 nt, Salmonella enterica enterica serovar Typhi
uuccugaaaaaauu

SEQ ID NO: 3664184 - RNA, 22 nt, Salmonella enterica enterica serovar Typhi
uuccugagcagacauauuuuca

SEQ ID NO: 3664185 - RNA, 17 nt, Salmonella enterica enterica serovar Typhi
uuccugaguuuaugagg

SEQ ID NO: 3664186 - RNA, 18 nt, Salmonella enterica enterica serovar Typhi
uuccugccaggccggacu

SEQ ID NO: 3664187 - RNA, 19 nt, Salmonella enterica enterica serovar Typhi
uuccugcgccaguugcugg

SEQ ID NO: 3664188 - RNA, 21 nt, Salmonella enterica enterica serovar Typhi
uuccugcgcugucaccagcag

SEQ ID NO: 3664189 - RNA, 21 nt, Salmonella enterica enterica serovar Typhi
uuccugcggcgguaacgccuu

SEQ ID NO: 3664190 - RNA, 16 nt, Salmonella enterica enterica serovar Typhi
uuccugcugcgcuuug

SEQ ID NO: 3664191 - RNA, 14 nt, Salmonella enterica enterica serovar Typhi
uuccuggugcgaca

SEQ ID NO: 3664192 - RNA, 14 nt, Salmonella enterica enterica serovar Typhi
uuccuguuccugag

SEQ ID NO: 3664193 - RNA, 16 nt, Salmonella enterica enterica serovar Typhi
uuccuuguuccaccug

SEQ ID NO: 3664194 - RNA, 19 nt, Salmonella enterica enterica serovar Typhi
uuccuuguuuuaacggaau

SEQ ID NO: 3664195 - RNA, 15 nt, Salmonella enterica enterica serovar Typhi
uuccuuugccuuucu

SEQ ID NO: 3664196 - RNA, 18 nt, Salmonella enterica enterica serovar Typhi
uucgaaacaggaaaaaca

SEQ ID NO: 3664197 - RNA, 13 nt, Salmonella enterica enterica serovar Typhi
uucuacugguuaa

SEQ ID NO: 3664198 - RNA, 16 nt, Salmonella enterica enterica serovar Typhi
uucuaucguuauauau

SEQ ID NO: 3664199 - RNA, 15 nt, Salmonella enterica enterica serovar Typhi
uucucaauacgauau

SEQ ID NO: 3664200 - RNA, 14 nt, Salmonella enterica enterica serovar Typhi
uucucaaugaacag

SEQ ID NO: 3664201 - RNA, 22 nt, Salmonella enterica enterica serovar Typhi
uucucacagaaucaucaggcua

SEQ ID NO: 3664202 - RNA, 16 nt, Salmonella enterica enterica serovar Typhi
uucucauccagcuugc

SEQ ID NO: 3664203 - RNA, 19 nt, Salmonella enterica enterica serovar Typhi
uucuccacgcgaugagcug

SEQ ID NO: 3664204 - RNA, 18 nt, Salmonella enterica enterica serovar Typhi
uucucccgccagaugcag

SEQ ID NO: 3664205 - RNA, 15 nt, Salmonella enterica enterica serovar Typhi
uucuccggcagucca

SEQ ID NO: 3664206 - RNA, 18 nt, Salmonella enterica enterica serovar Typhi
uucuccggcaguccaugc

SEQ ID NO: 3664207 - RNA, 12 nt, Salmonella enterica enterica serovar Typhi
uucuccguuguu

SEQ ID NO: 3664208 - RNA, 16 nt, Salmonella enterica enterica serovar Typhi
uucuccugcauuugcg

SEQ ID NO: 3664209 - RNA, 14 nt, Salmonella enterica enterica serovar Typhi
uucuccugccagcg

SEQ ID NO: 3664210 - RNA, 19 nt, Salmonella enterica enterica serovar Typhi
uucuccugcgcuugcggcc

SEQ ID NO: 3664211 - RNA, 21 nt, Salmonella enterica enterica serovar Typhi
uucuccugcggccuugccgcc

SEQ ID NO: 3664212 - RNA, 16 nt, Salmonella enterica enterica serovar Typhi
uucucgcuaauuggcu

SEQ ID NO: 3664213 - RNA, 24 nt, Salmonella enterica enterica serovar Typhi
uucucgggccuguuccggcgagga

SEQ ID NO: 3664214 - RNA, 16 nt, Salmonella enterica enterica serovar Typhi
uucucguucaacggca

SEQ ID NO: 3664215 - RNA, 17 nt, Salmonella enterica enterica serovar Typhi
uucucuaucagcgccuc

SEQ ID NO: 3664216 - RNA, 23 nt, Salmonella enterica enterica serovar Typhi
uucucugcccccgagccagaacg

SEQ ID NO: 3664217 - RNA, 19 nt, Salmonella enterica enterica serovar Typhi
uucucuuaugccgcuuuug

SEQ ID NO: 3664218 - RNA, 14 nt, Salmonella enterica enterica serovar Typhi
uucucuuccacaaa

SEQ ID NO: 3664219 - RNA, 19 nt, Salmonella enterica enterica serovar Typhi
uucucuucguuauuuuccu

SEQ ID NO: 3664220 - RNA, 13 nt, Salmonella enterica enterica serovar Typhi
uucucuucugcug

SEQ ID NO: 3664221 - RNA, 13 nt, Salmonella enterica enterica serovar Typhi
uucugaacgcugc

SEQ ID NO: 3664222 - RNA, 18 nt, Salmonella enterica enterica serovar Typhi
uucugaagcguaacagcg

SEQ ID NO: 3664223 - RNA, 19 nt, Salmonella enterica enterica serovar Typhi
uucugaagcguaacagcgc

SEQ ID NO: 3664224 - RNA, 19 nt, Salmonella enterica enterica serovar Typhi
uucugaagcuaaccgcgca

SEQ ID NO: 3664225 - RNA, 13 nt, Salmonella enterica enterica serovar Typhi
uucugaauaaauu

SEQ ID NO: 3664226 - RNA, 15 nt, Salmonella enterica enterica serovar Typhi
uucugaauuucacgc

SEQ ID NO: 3664227 - RNA, 20 nt, Salmonella enterica enterica serovar Typhi
uucugacagaauauaggaga

SEQ ID NO: 3664228 - RNA, 21 nt, Salmonella enterica enterica serovar Typhi
uucugaccacauuuucucgug

SEQ ID NO: 3664229 - RNA, 18 nt, Salmonella enterica enterica serovar Typhi
uucugaucgauaaaaguu

SEQ ID NO: 3664230 - RNA, 16 nt, Salmonella enterica enterica serovar Typhi
uucugauggcuuugcu

SEQ ID NO: 3664231 - RNA, 17 nt, Salmonella enterica enterica serovar Typhi
uucugauuauugacauu

SEQ ID NO: 3664232 - RNA, 11 nt, Salmonella enterica enterica serovar Typhi
uucugcaaaau

SEQ ID NO: 3664233 - RNA, 17 nt, Salmonella enterica enterica serovar Typhi
uucugccagcagaagac

SEQ ID NO: 3664234 - RNA, 12 nt, Salmonella enterica enterica serovar Typhi
uucugccagguu

SEQ ID NO: 3664235 - RNA, 22 nt, Salmonella enterica enterica serovar Typhi
uucugccgcgcgguauuucgca

SEQ ID NO: 3664236 - RNA, 16 nt, Salmonella enterica enterica serovar Typhi
uucugcgccagcacau

SEQ ID NO: 3664237 - RNA, 22 nt, Salmonella enterica enterica serovar Typhi
uucugcgccgcuugugccgaca

SEQ ID NO: 3664238 - RNA, 15 nt, Salmonella enterica enterica serovar Typhi
uucugcugaugcugg

SEQ ID NO: 3664239 - RNA, 9 nt, Salmonella enterica enterica serovar Typhi
uucuggaag

SEQ ID NO: 3664240 - RNA, 14 nt, Salmonella enterica enterica serovar Typhi
uucuggaagugacu

SEQ ID NO: 3664241 - RNA, 22 nt, Salmonella enterica enterica serovar Typhi
uucuggacgggcuaucaauaug

SEQ ID NO: 3664242 - RNA, 16 nt, Salmonella enterica enterica serovar Typhi
uucuggauagcgguuu

SEQ ID NO: 3664243 - RNA, 16 nt, Salmonella enterica enterica serovar Typhi
uucuggccauuucauc

SEQ ID NO: 3664244 - RNA, 21 nt, Salmonella enterica enterica serovar Typhi
uucuggcgaguuucaccggua

SEQ ID NO: 3664245 - RNA, 22 nt, Salmonella enterica enterica serovar Typhi
uucuggcgaugugcccgaguga

SEQ ID NO: 3664246 - RNA, 14 nt, Salmonella enterica enterica serovar Typhi
uucuggcucggccu

SEQ ID NO: 3664247 - RNA, 15 nt, Salmonella enterica enterica serovar Typhi
uucugguaaaccuca

SEQ ID NO: 3664248 - RNA, 13 nt, Salmonella enterica enterica serovar Typhi
uucuguaucgcuu

SEQ ID NO: 3664249 - RNA, 16 nt, Salmonella enterica enterica serovar Typhi
uucugucagaaaucug

SEQ ID NO: 3664250 - RNA, 14 nt, Salmonella enterica enterica serovar Typhi
uucugucagccuug

SEQ ID NO: 3664251 - RNA, 13 nt, Salmonella enterica enterica serovar Typhi
uucuguucagugg

SEQ ID NO: 3664252 - RNA, 20 nt, Salmonella enterica enterica serovar Typhi
uucuguuuucgagccuugcc

SEQ ID NO: 3664253 - RNA, 23 nt, Salmonella enterica enterica serovar Typhi
uucuuacgauaccccauccacuu

SEQ ID NO: 3664254 - RNA, 20 nt, Salmonella enterica enterica serovar Typhi
uucuuacuaauaaauauuca

SEQ ID NO: 3664255 - RNA, 22 nt, Salmonella enterica enterica serovar Typhi
uucuuagcgccagcagaaaacc

SEQ ID NO: 3664256 - RNA, 16 nt, Salmonella enterica enterica serovar Typhi
uucuuauuacaagaaa

SEQ ID NO: 3664257 - RNA, 12 nt, Salmonella enterica enterica serovar Typhi
uucuucaaugaa

SEQ ID NO: 3664258 - RNA, 20 nt, Salmonella enterica enterica serovar Typhi
uucuucaguuccgccagacu

SEQ ID NO: 3664259 - RNA, 13 nt, Salmonella enterica enterica serovar Typhi
uucuuccagaacg

SEQ ID NO: 3664260 - RNA, 18 nt, Salmonella enterica enterica serovar Typhi
uucuuccagguuaaccca

SEQ ID NO: 3664261 - RNA, 12 nt, Salmonella enterica enterica serovar Typhi
uucuuccgugcc

SEQ ID NO: 3664262 - RNA, 19 nt, Salmonella enterica enterica serovar Typhi
uucuucgccgucauaaaac

SEQ ID NO: 3664263 - RNA, 13 nt, Salmonella enterica enterica serovar Typhi
uucuucucuucuu

SEQ ID NO: 3664264 - RNA, 19 nt, Salmonella enterica enterica serovar Typhi
uucuugcccgcugaguggu

SEQ ID NO: 3664265 - RNA, 13 nt, Salmonella enterica enterica serovar Typhi
uucuugcccggug

SEQ ID NO: 3664266 - RNA, 20 nt, Salmonella enterica enterica serovar Typhi
uucuuuaagaacgguuggaa

SEQ ID NO: 3664267 - RNA, 15 nt, Salmonella enterica enterica serovar Typhi
uucuuuaauuugugc

SEQ ID NO: 3664268 - RNA, 19 nt, Salmonella enterica enterica serovar Typhi
uucuuuauucacuuuuucu

SEQ ID NO: 3664269 - RNA, 18 nt, Salmonella enterica enterica serovar Typhi
uucuuucagcucuucaau

SEQ ID NO: 3664270 - RNA, 14 nt, Salmonella enterica enterica serovar Typhi
uucuuuccugcaaa

SEQ ID NO: 3664271 - RNA, 15 nt, Salmonella enterica enterica serovar Typhi
uucuuugccuuuuuc

SEQ ID NO: 3664272 - RNA, 13 nt, Salmonella enterica enterica serovar Typhi
uucuuugguauug

SEQ ID NO: 3664273 - RNA, 12 nt, Salmonella enterica enterica serovar Typhi
uucuuuuuauau

SEQ ID NO: 3664274 - RNA, 15 nt, Salmonella enterica enterica serovar Typhi
uucuuuuuauauucc

SEQ ID NO: 3664275 - RNA, 16 nt, Salmonella enterica enterica serovar Typhi
uugaaaacaccaggga

SEQ ID NO: 3664276 - RNA, 12 nt, Salmonella enterica enterica serovar Typhi
uugaaauccucu

SEQ ID NO: 3664277 - RNA, 13 nt, Salmonella enterica enterica serovar Typhi
uugaaauccucua

SEQ ID NO: 3664278 - RNA, 22 nt, Salmonella enterica enterica serovar Typhi
uugaacagcgucauccaguguu

SEQ ID NO: 3664279 - RNA, 15 nt, Salmonella enterica enterica serovar Typhi
uugaacauauccgcg

SEQ ID NO: 3664280 - RNA, 17 nt, Salmonella enterica enterica serovar Typhi
uugaacaugcgcagaaa

SEQ ID NO: 3664281 - RNA, 13 nt, Salmonella enterica enterica serovar Typhi
uugaaccaucucg

SEQ ID NO: 3664282 - RNA, 17 nt, Salmonella enterica enterica serovar Typhi
uugaacccguaagcccu

SEQ ID NO: 3664283 - RNA, 22 nt, Salmonella enterica enterica serovar Typhi
uugccaucggauauauuuuacc

SEQ ID NO: 3664284 - RNA, 15 nt, Salmonella enterica enterica serovar Typhi
uugccaugguucaca

SEQ ID NO: 3664285 - RNA, 17 nt, Salmonella enterica enterica serovar Typhi
uugccaugugccgcgaa

SEQ ID NO: 3664286 - RNA, 13 nt, Salmonella enterica enterica serovar Typhi
uugccauucgcca

SEQ ID NO: 3664287 - RNA, 15 nt, Salmonella enterica enterica serovar Typhi
uugccccgcuuucag

SEQ ID NO: 3664288 - RNA, 23 nt, Salmonella enterica enterica serovar Typhi
uugccccguggcgggaugcccca

SEQ ID NO: 3664289 - RNA, 12 nt, Salmonella enterica enterica serovar Typhi
uugccccuuccg

SEQ ID NO: 3664290 - RNA, 15 nt, Salmonella enterica enterica serovar Typhi
uugcccgaugcgccc

SEQ ID NO: 3664291 - RNA, 23 nt, Salmonella enterica enterica serovar Typhi
uugcccgcaggcuuccagauaca

SEQ ID NO: 3664292 - RNA, 22 nt, Salmonella enterica enterica serovar Typhi
uugcccggccguuaccguggcg

SEQ ID NO: 3664293 - RNA, 20 nt, Salmonella enterica enterica serovar Typhi
uugcccgguggcgcugcgcu

SEQ ID NO: 3664294 - RNA, 16 nt, Salmonella enterica enterica serovar Typhi
uugcccuggaauuuuu

SEQ ID NO: 3664295 - RNA, 18 nt, Salmonella enterica enterica serovar Typhi
uugcccuggaauuuuucc

SEQ ID NO: 3664296 - RNA, 20 nt, Salmonella enterica enterica serovar Typhi
uugccgauuccaugcccagu

SEQ ID NO: 3664297 - RNA, 23 nt, Salmonella enterica enterica serovar Typhi
uugccgcacgguacuauuaccgc

SEQ ID NO: 3664298 - RNA, 16 nt, Salmonella enterica enterica serovar Typhi
uugccgcccugaaagc

SEQ ID NO: 3664299 - RNA, 15 nt, Salmonella enterica enterica serovar Typhi
uugccgccgagcaga

SEQ ID NO: 3664300 - RNA, 24 nt, Salmonella enterica enterica serovar Typhi
uugccgcgccagacgccauaucgc

SEQ ID NO: 3664301 - RNA, 20 nt, Salmonella enterica enterica serovar Typhi
uugccgcgcggauucuccag

SEQ ID NO: 3664302 - RNA, 16 nt, Salmonella enterica enterica serovar Typhi
uugccggauagcucgc

SEQ ID NO: 3664303 - RNA, 17 nt, Salmonella enterica enterica serovar Typhi
uugccggauggcgcuuu

SEQ ID NO: 3664304 - RNA, 12 nt, Salmonella enterica enterica serovar Typhi
uugccgggcaug

SEQ ID NO: 3664305 - RNA, 17 nt, Salmonella enterica enterica serovar Typhi
uugccgguuaacucuuu

SEQ ID NO: 3664306 - RNA, 23 nt, Salmonella enterica enterica serovar Typhi
uugccgucaaacgcuaucaccgc

SEQ ID NO: 3664307 - RNA, 23 nt, Salmonella enterica enterica serovar Typhi
uugccgucgccggaaugcgaaua

SEQ ID NO: 3664308 - RNA, 15 nt, Salmonella enterica enterica serovar Typhi
uugccgugaaaacga

SEQ ID NO: 3664309 - RNA, 18 nt, Salmonella enterica enterica serovar Typhi
uugccgugaauauucaga

SEQ ID NO: 3664310 - RNA, 13 nt, Salmonella enterica enterica serovar Typhi
uugccugauggcg

SEQ ID NO: 3664311 - RNA, 20 nt, Salmonella enterica enterica serovar Typhi
uugccugauggcgcugcgcu

SEQ ID NO: 3664312 - RNA, 19 nt, Salmonella enterica enterica serovar Typhi
uugccugcggauuugcugc

SEQ ID NO: 3664313 - RNA, 20 nt, Salmonella enterica enterica serovar Typhi
uugccugcggauuugcugcu

SEQ ID NO: 3664314 - RNA, 13 nt, Salmonella enterica enterica serovar Typhi
uugccuuccugau

SEQ ID NO: 3664315 - RNA, 17 nt, Salmonella enterica enterica serovar Typhi
uugccuucgauuaacgc

SEQ ID NO: 3664316 - RNA, 17 nt, Salmonella enterica enterica serovar Typhi
uugccuucgccgcccaa

SEQ ID NO: 3664317 - RNA, 15 nt, Salmonella enterica enterica serovar Typhi
uugccuuucagaucg

SEQ ID NO: 3664318 - RNA, 17 nt, Salmonella enterica enterica serovar Typhi
uugcgacaaccuguagg

SEQ ID NO: 3664319 - RNA, 21 nt, Salmonella enterica enterica serovar Typhi
uugcgacaagcucauuuccca

SEQ ID NO: 3664320 - RNA, 13 nt, Salmonella enterica enterica serovar Typhi
uugcgagaaaaaa

SEQ ID NO: 3664321 - RNA, 20 nt, Salmonella enterica enterica serovar Typhi
uugcgauuuguccgcugcug

SEQ ID NO: 3664322 - RNA, 18 nt, Salmonella enterica enterica serovar Typhi
uugcgccacuuuuccggc

SEQ ID NO: 3664323 - RNA, 14 nt, Salmonella enterica enterica serovar Typhi
uugcgccagcgcca

SEQ ID NO: 3664324 - RNA, 22 nt, Salmonella enterica enterica serovar Typhi
uugcgccauccuuaauugccgc

SEQ ID NO: 3664325 - RNA, 15 nt, Salmonella enterica enterica serovar Typhi
uugcgcccaggccaa

SEQ ID NO: 3664326 - RNA, 17 nt, Salmonella enterica enterica serovar Typhi
uugcgcccaggccaaaa

SEQ ID NO: 3664327 - RNA, 14 nt, Salmonella enterica enterica serovar Typhi
uugcgccgucacac

SEQ ID NO: 3664328 - RNA, 23 nt, Salmonella enterica enterica serovar Typhi
uugcgccuuuccggccugaaugc

SEQ ID NO: 3664329 - RNA, 20 nt, Salmonella enterica enterica serovar Typhi
uugcgcgguuaacagccgcu

SEQ ID NO: 3664330 - RNA, 14 nt, Salmonella enterica enterica serovar Typhi
uugcgcuaaaaucc

SEQ ID NO: 3664331 - RNA, 16 nt, Salmonella enterica enterica serovar Typhi
uugcgcuccggcgcug

SEQ ID NO: 3664332 - RNA, 13 nt, Salmonella enterica enterica serovar Typhi
uugcgcucugcca

SEQ ID NO: 3664333 - RNA, 20 nt, Salmonella enterica enterica serovar Typhi
uugcggaauacacgaacaca

SEQ ID NO: 3664334 - RNA, 19 nt, Salmonella enterica enterica serovar Typhi
uugcggaucgaucucgaua

SEQ ID NO: 3664335 - RNA, 22 nt, Salmonella enterica enterica serovar Typhi
uugcguaucguaagccaccgcc

SEQ ID NO: 3664336 - RNA, 12 nt, Salmonella enterica enterica serovar Typhi
uugcgucaugcg

SEQ ID NO: 3664337 - RNA, 22 nt, Salmonella enterica enterica serovar Typhi
uugcgucguuaacugcauuaca

SEQ ID NO: 3664338 - RNA, 13 nt, Salmonella enterica enterica serovar Typhi
uugcgugucauca

SEQ ID NO: 3664339 - RNA, 11 nt, Salmonella enterica enterica serovar Typhi
uugcucaagcu

SEQ ID NO: 3664340 - RNA, 12 nt, Salmonella enterica enterica serovar Typhi
uugcucaaugga

SEQ ID NO: 3664341 - RNA, 17 nt, Salmonella enterica enterica serovar Typhi
uugcucaauggauuuuc

SEQ ID NO: 3664342 - RNA, 22 nt, Salmonella enterica enterica serovar Typhi
uugcucacccauuuuauccucu

SEQ ID NO: 3664343 - RNA, 23 nt, Salmonella enterica enterica serovar Typhi
uugcuccagcagcgccaguuuuu

SEQ ID NO: 3664344 - RNA, 20 nt, Salmonella enterica enterica serovar Typhi
uugcuccccaaccgccagcc

SEQ ID NO: 3664345 - RNA, 19 nt, Salmonella enterica enterica serovar Typhi
uugcucgcggcgugaugcc

SEQ ID NO: 3664346 - RNA, 18 nt, Salmonella enterica enterica serovar Typhi
uugcucucaggcaguaac

SEQ ID NO: 3664347 - RNA, 14 nt, Salmonella enterica enterica serovar Typhi
uugcucugccagcg

SEQ ID NO: 3664348 - RNA, 23 nt, Salmonella enterica enterica serovar Typhi
uugcugauuaaucccgaaucacu

SEQ ID NO: 3664349 - RNA, 16 nt, Salmonella enterica enterica serovar Typhi
uugcugcgcaggggcu

SEQ ID NO: 3664350 - RNA, 19 nt, Salmonella enterica enterica serovar Typhi
uugcugcgccagccagacg

SEQ ID NO: 3664351 - RNA, 15 nt, Salmonella enterica enterica serovar Typhi
uugcugcuauauaac

SEQ ID NO: 3664352 - RNA, 14 nt, Salmonella enterica enterica serovar Typhi
uugcugcuauguaa

SEQ ID NO: 3664353 - RNA, 21 nt, Salmonella enterica enterica serovar Typhi
uugcugcugcggaucgucucu

SEQ ID NO: 3664354 - RNA, 21 nt, Salmonella enterica enterica serovar Typhi
uugcuggagcaggugcggcug

SEQ ID NO: 3664355 - RNA, 14 nt, Salmonella enterica enterica serovar Typhi
uugcuggauucucu

SEQ ID NO: 3664356 - RNA, 18 nt, Salmonella enterica enterica serovar Typhi
uugcuggcaagaaccgcu

SEQ ID NO: 3664357 - RNA, 17 nt, Salmonella enterica enterica serovar Typhi
uugcuggcuugcucagg

SEQ ID NO: 3664358 - RNA, 17 nt, Salmonella enterica enterica serovar Typhi
uugcuguuaauuucccg

SEQ ID NO: 3664359 - RNA, 18 nt, Salmonella enterica enterica serovar Typhi
uugcuuauccggccuaca

SEQ ID NO: 3664360 - RNA, 20 nt, Salmonella enterica enterica serovar Typhi
uugcuuauuagaggcguaag

SEQ ID NO: 3664361 - RNA, 17 nt, Salmonella enterica enterica serovar Typhi
uugcuucgauggccuca

SEQ ID NO: 3664362 - RNA, 23 nt, Salmonella enterica enterica serovar Typhi
uugcuucgcucucgugccaguaa

SEQ ID NO: 3664363 - RNA, 17 nt, Salmonella enterica enterica serovar Typhi
uugcuucguuaccggug

SEQ ID NO: 3664364 - RNA, 22 nt, Salmonella enterica enterica serovar Typhi
uugcuucuguccuuucugcugc

SEQ ID NO: 3664365 - RNA, 14 nt, Salmonella enterica enterica serovar Typhi
uugcuuucuugaau

SEQ ID NO: 3664366 - RNA, 17 nt, Salmonella enterica enterica serovar Typhi
uugcuuugcggcauaac

SEQ ID NO: 3664367 - RNA, 16 nt, Salmonella enterica enterica serovar Typhi
uugcuuuuucggcaau

SEQ ID NO: 3664368 - RNA, 15 nt, Salmonella enterica enterica serovar Typhi
uuguucgcuucuucu

SEQ ID NO: 3664369 - RNA, 18 nt, Salmonella enterica enterica serovar Typhi
uuguucgucuuuugaaua

SEQ ID NO: 3664370 - RNA, 14 nt, Salmonella enterica enterica serovar Typhi
uuguucuaaacguu

SEQ ID NO: 3664371 - RNA, 23 nt, Salmonella enterica enterica serovar Typhi
uuguugccgcccguuuuuuccag

SEQ ID NO: 3664372 - RNA, 13 nt, Salmonella enterica enterica serovar Typhi
uuguuuaccccag

SEQ ID NO: 3664373 - RNA, 19 nt, Salmonella enterica enterica serovar Typhi
uuguuuacgcccucaucgg

SEQ ID NO: 3664374 - RNA, 17 nt, Salmonella enterica enterica serovar Typhi
uuguuuauuccauucau

SEQ ID NO: 3664375 - RNA, 19 nt, Salmonella enterica enterica serovar Typhi
uuguuucggauaauucuga

SEQ ID NO: 3664376 - RNA, 14 nt, Salmonella enterica enterica serovar Typhi
uuguuucuuaaccc

SEQ ID NO: 3664377 - RNA, 15 nt, Salmonella enterica enterica serovar Typhi
uuguuucuuaacccc

SEQ ID NO: 3664378 - RNA, 20 nt, Salmonella enterica enterica serovar Typhi
uuguuuuaaauucaaccagu

SEQ ID NO: 3664379 - RNA, 23 nt, Salmonella enterica enterica serovar Typhi
uuuaaaacuucccgcgcagugca

SEQ ID NO: 3664380 - RNA, 13 nt, Salmonella enterica enterica serovar Typhi
uuuaaaaucaacg

SEQ ID NO: 3664381 - RNA, 18 nt, Salmonella enterica enterica serovar Typhi
uuuaaaauguuuuuguug

SEQ ID NO: 3664382 - RNA, 22 nt, Salmonella enterica enterica serovar Typhi
uuuaaaauuccaauauuuauuu

SEQ ID NO: 3664383 - RNA, 15 nt, Salmonella enterica enterica serovar Typhi
uuuaaaccacaccug

SEQ ID NO: 3664384 - RNA, 20 nt, Salmonella enterica enterica serovar Typhi
uuuaacaaaucgacagccag

SEQ ID NO: 3664385 - RNA, 21 nt, Salmonella enterica enterica serovar Typhi
uuuaacaaauuaaauccugaa

SEQ ID NO: 3664386 - RNA, 17 nt, Salmonella enterica enterica serovar Typhi
uuuaacaauuuaucaga

SEQ ID NO: 3664387 - RNA, 14 nt, Salmonella enterica enterica serovar Typhi
uuuaacagauaauu

SEQ ID NO: 3664388 - RNA, 20 nt, Salmonella enterica enterica serovar Typhi
uuuaacagauaauuaauaau

SEQ ID NO: 3664389 - RNA, 15 nt, Salmonella enterica enterica serovar Typhi
uuuaacgauuucccc

SEQ ID NO: 3664390 - RNA, 16 nt, Salmonella enterica enterica serovar Typhi
uuuaagcauccaggaa

SEQ ID NO: 3664391 - RNA, 18 nt, Salmonella enterica enterica serovar Typhi
uuuaagcgcaggugcgau

SEQ ID NO: 3664392 - RNA, 15 nt, Salmonella enterica enterica serovar Typhi
uuuaaggacauucag

SEQ ID NO: 3664393 - RNA, 19 nt, Salmonella enterica enterica serovar Typhi
uuuaaggcggcaaagauaa

SEQ ID NO: 3664394 - RNA, 18 nt, Salmonella enterica enterica serovar Typhi
uuuaagucaucuguucaa

SEQ ID NO: 3664395 - RNA, 14 nt, Salmonella enterica enterica serovar Typhi
uuuaauaacggcga

SEQ ID NO: 3664396 - RNA, 18 nt, Salmonella enterica enterica serovar Typhi
uuuaauaccgcguaaaaa

SEQ ID NO: 3664397 - RNA, 16 nt, Salmonella enterica enterica serovar Typhi
uuuaauccaccacagu

SEQ ID NO: 3664398 - RNA, 18 nt, Salmonella enterica enterica serovar Typhi
uuuaaugcuuuccagcca

SEQ ID NO: 3664399 - RNA, 15 nt, Salmonella enterica enterica serovar Typhi
uuuaauuuucuguaa

SEQ ID NO: 3664400 - RNA, 21 nt, Salmonella enterica enterica serovar Typhi
uuuaauuuucuguaauucucc

SEQ ID NO: 3664401 - RNA, 14 nt, Salmonella enterica enterica serovar Typhi
uuuaauuuuuaugu

SEQ ID NO: 3664402 - RNA, 14 nt, Salmonella enterica enterica serovar Typhi
uuuacaauaauucg

SEQ ID NO: 3664403 - RNA, 17 nt, Salmonella enterica enterica serovar Typhi
uuuacaauuucgcaaac

SEQ ID NO: 3664404 - RNA, 23 nt, Salmonella enterica enterica serovar Typhi
uuuacacggugugaucaccgccc

SEQ ID NO: 3664405 - RNA, 23 nt, Salmonella enterica enterica serovar Typhi
uuuaccagugcuaaaauuauaca

SEQ ID NO: 3664406 - RNA, 18 nt, Salmonella enterica enterica serovar Typhi
uuuacccacuucuuccag

SEQ ID NO: 3664407 - RNA, 20 nt, Salmonella enterica enterica serovar Typhi
uuuacccacuucuuccagcg

SEQ ID NO: 3664408 - RNA, 20 nt, Salmonella enterica enterica serovar Typhi
uuuacccagcgaaugcugca

SEQ ID NO: 3664409 - RNA, 18 nt, Salmonella enterica enterica serovar Typhi
uuuaccgccgcuuuucag

SEQ ID NO: 3664410 - RNA, 21 nt, Salmonella enterica enterica serovar Typhi
uuuaccggaucgaucccggca

SEQ ID NO: 3664411 - RNA, 22 nt, Salmonella enterica enterica serovar Typhi
uuuaccggugcagaccucugca

SEQ ID NO: 3664412 - RNA, 16 nt, Salmonella enterica enterica serovar Typhi
uuuaccucacggugac

SEQ ID NO: 3664413 - RNA, 17 nt, Salmonella enterica enterica serovar Typhi
uuuaccuguuuaucuga

SEQ ID NO: 3664414 - RNA, 21 nt, Salmonella enterica enterica serovar Typhi
uuuacgauacguuuaaaauga

SEQ ID NO: 3664415 - RNA, 19 nt, Salmonella enterica enterica serovar Typhi
uuuacgcagcaagaacaga

SEQ ID NO: 3664416 - RNA, 23 nt, Salmonella enterica enterica serovar Typhi
uuuacgcuguaacccgccgccau

SEQ ID NO: 3664417 - RNA, 16 nt, Salmonella enterica enterica serovar Typhi
uuuacgcuuguuguaa

SEQ ID NO: 3664418 - RNA, 20 nt, Salmonella enterica enterica serovar Typhi
uuuacggcccuaccauuacc

SEQ ID NO: 3664419 - RNA, 16 nt, Salmonella enterica enterica serovar Typhi
uuuacgguuggccauu

SEQ ID NO: 3664420 - RNA, 20 nt, Salmonella enterica enterica serovar Typhi
uuuacugaauaacagcacca

SEQ ID NO: 3664421 - RNA, 14 nt, Salmonella enterica enterica serovar Typhi
uuuacugacaauaa

SEQ ID NO: 3664422 - RNA, 14 nt, Salmonella enterica enterica serovar Typhi
uuuacugaugccag

SEQ ID NO: 3664423 - RNA, 20 nt, Salmonella enterica enterica serovar Typhi
uuuacugauuagccuguugg

SEQ ID NO: 3664424 - RNA, 16 nt, Salmonella enterica enterica serovar Typhi
uuuacuuaauucugcu

SEQ ID NO: 3664425 - RNA, 12 nt, Salmonella enterica enterica serovar Typhi
uuuacuuucauu

SEQ ID NO: 3664426 - RNA, 14 nt, Salmonella enterica enterica serovar Typhi
uuuagaaaauauau

SEQ ID NO: 3664427 - RNA, 17 nt, Salmonella enterica enterica serovar Typhi
uuuagaauuaucugaaa

SEQ ID NO: 3664428 - RNA, 13 nt, Salmonella enterica enterica serovar Typhi
uuuagcaccagac

SEQ ID NO: 3664429 - RNA, 15 nt, Salmonella enterica enterica serovar Typhi
uuuagcaugacaaua

SEQ ID NO: 3664430 - RNA, 14 nt, Salmonella enterica enterica serovar Typhi
uuuagccagcagcg

SEQ ID NO: 3664431 - RNA, 18 nt, Salmonella enterica enterica serovar Typhi
uuuagccaucccggcgac

SEQ ID NO: 3664432 - RNA, 23 nt, Salmonella enterica enterica serovar Typhi
uuuagccgcaaacuuugcgccau

SEQ ID NO: 3664433 - RNA, 16 nt, Salmonella enterica enterica serovar Typhi
uuuagcgccagcagca

SEQ ID NO: 3664434 - RNA, 19 nt, Salmonella enterica enterica serovar Typhi
uuuagcguaggccacaaag

SEQ ID NO: 3664435 - RNA, 20 nt, Salmonella enterica enterica serovar Typhi
uuuagcguuucaucggugua

SEQ ID NO: 3664436 - RNA, 11 nt, Salmonella enterica enterica serovar Typhi
uuuagcuuuuc

SEQ ID NO: 3664437 - RNA, 19 nt, Salmonella enterica enterica serovar Typhi
uuuaggcggcuucacgcca

SEQ ID NO: 3664438 - RNA, 15 nt, Salmonella enterica enterica serovar Typhi
uuuaggucaaaaaag

SEQ ID NO: 3664439 - RNA, 13 nt, Salmonella enterica enterica serovar Typhi
uuuagugcucagc

SEQ ID NO: 3664440 - RNA, 21 nt, Salmonella enterica enterica serovar Typhi
uuuaguucagcauauuucuaa

SEQ ID NO: 3664441 - RNA, 13 nt, Salmonella enterica enterica serovar Typhi
uuuauaaaguaaa

SEQ ID NO: 3664442 - RNA, 13 nt, Salmonella enterica enterica serovar Typhi
uuuauaacauaaa

SEQ ID NO: 3664443 - RNA, 14 nt, Salmonella enterica enterica serovar Typhi
uuuauaacauaaau

SEQ ID NO: 3664444 - RNA, 15 nt, Salmonella enterica enterica serovar Typhi
uuuauacucaaaaaa

SEQ ID NO: 3664445 - RNA, 21 nt, Salmonella enterica enterica serovar Typhi
uuuauauucugggcuuacuuu

SEQ ID NO: 3664446 - RNA, 14 nt, Salmonella enterica enterica serovar Typhi
uuuaucaaaaagac

SEQ ID NO: 3664447 - RNA, 21 nt, Salmonella enterica enterica serovar Typhi
uuuaucaaaaagacuccggca

SEQ ID NO: 3664448 - RNA, 23 nt, Salmonella enterica enterica serovar Typhi
uuuauccggauggaacgcaucca

SEQ ID NO: 3664449 - RNA, 15 nt, Salmonella enterica enterica serovar Typhi
uuuaucgggcuguug

SEQ ID NO: 3664450 - RNA, 18 nt, Salmonella enterica enterica serovar Typhi
uuuaucuuuuacgcuguc

SEQ ID NO: 3664451 - RNA, 22 nt, Salmonella enterica enterica serovar Typhi
uuuaugacuggggcguuuuuua

SEQ ID NO: 3664452 - RNA, 20 nt, Salmonella enterica enterica serovar Typhi
uuuaugcaguuccguugcaa

SEQ ID NO: 3664453 - RNA, 11 nt, Salmonella enterica enterica serovar Typhi
uuuaugcgccu

SEQ ID NO: 3664454 - RNA, 20 nt, Salmonella enterica enterica serovar Typhi
uuuccaguucuggcugcgcu

SEQ ID NO: 3664455 - RNA, 22 nt, Salmonella enterica enterica serovar Typhi
uuuccauacauuuuuguaauaa

SEQ ID NO: 3664456 - RNA, 11 nt, Salmonella enterica enterica serovar Typhi
uuuccauauuu

SEQ ID NO: 3664457 - RNA, 15 nt, Salmonella enterica enterica serovar Typhi
uuuccauucguucug

SEQ ID NO: 3664458 - RNA, 20 nt, Salmonella enterica enterica serovar Typhi
uuucccaacuguauuuugaa

SEQ ID NO: 3664459 - RNA, 22 nt, Salmonella enterica enterica serovar Typhi
uuuccccaaagguguuauuucu

SEQ ID NO: 3664460 - RNA, 15 nt, Salmonella enterica enterica serovar Typhi
uuucccccacuucug

SEQ ID NO: 3664461 - RNA, 15 nt, Salmonella enterica enterica serovar Typhi
uuuccccgacggccu

SEQ ID NO: 3664462 - RNA, 18 nt, Salmonella enterica enterica serovar Typhi
uuucccgcgugaacacca

SEQ ID NO: 3664463 - RNA, 17 nt, Salmonella enterica enterica serovar Typhi
uuuccgcaucguuauca

SEQ ID NO: 3664464 - RNA, 18 nt, Salmonella enterica enterica serovar Typhi
uuuccgccugaucuuucu

SEQ ID NO: 3664465 - RNA, 18 nt, Salmonella enterica enterica serovar Typhi
uuuccgcgagagaaaaaa

SEQ ID NO: 3664466 - RNA, 20 nt, Salmonella enterica enterica serovar Typhi
uuuccgcuaucuguugcgcc

SEQ ID NO: 3664467 - RNA, 16 nt, Salmonella enterica enterica serovar Typhi
uuuccgcugucuaucc

SEQ ID NO: 3664468 - RNA, 18 nt, Salmonella enterica enterica serovar Typhi
uuuccgcuuuuccugcca

SEQ ID NO: 3664469 - RNA, 18 nt, Salmonella enterica enterica serovar Typhi
uuuccggcgggagcucua

SEQ ID NO: 3664470 - RNA, 16 nt, Salmonella enterica enterica serovar Typhi
uuuccguccaccuggc

SEQ ID NO: 3664471 - RNA, 13 nt, Salmonella enterica enterica serovar Typhi
uuuccguuuuuau

SEQ ID NO: 3664472 - RNA, 16 nt, Salmonella enterica enterica serovar Typhi
uuuccucaaccucuuu

SEQ ID NO: 3664473 - RNA, 23 nt, Salmonella enterica enterica serovar Typhi
uuuccugaucaaucaacucuuua

SEQ ID NO: 3664474 - RNA, 23 nt, Salmonella enterica enterica serovar Typhi
uuuccugcauuaacggcaacagu

SEQ ID NO: 3664475 - RNA, 18 nt, Salmonella enterica enterica serovar Typhi
uuuccugccuucugaaag

SEQ ID NO: 3664476 - RNA, 16 nt, Salmonella enterica enterica serovar Typhi
uuuccugcugccaucg

SEQ ID NO: 3664477 - RNA, 22 nt, Salmonella enterica enterica serovar Typhi
uuuccugguaaucgauacggga

SEQ ID NO: 3664478 - RNA, 20 nt, Salmonella enterica enterica serovar Typhi
uuucgaagccgaccaccauc

SEQ ID NO: 3664479 - RNA, 17 nt, Salmonella enterica enterica serovar Typhi
uuucgacggcaaccuuc

SEQ ID NO: 3664480 - RNA, 16 nt, Salmonella enterica enterica serovar Typhi
uuucgacuuucauuuc

SEQ ID NO: 3664481 - RNA, 18 nt, Salmonella enterica enterica serovar Typhi
uuucgagcagaacuggcg

SEQ ID NO: 3664482 - RNA, 16 nt, Salmonella enterica enterica serovar Typhi
uuucgaugaaaaagag

SEQ ID NO: 3664483 - RNA, 13 nt, Salmonella enterica enterica serovar Typhi
uuucgccagcaac

SEQ ID NO: 3664484 - RNA, 17 nt, Salmonella enterica enterica serovar Typhi
uuucgcccgcucgcgau

SEQ ID NO: 3664485 - RNA, 15 nt, Salmonella enterica enterica serovar Typhi
uuucgcccucgccac

SEQ ID NO: 3664486 - RNA, 17 nt, Salmonella enterica enterica serovar Typhi
uuucgcgaauaaucugu

SEQ ID NO: 3664487 - RNA, 19 nt, Salmonella enterica enterica serovar Typhi
uuucgcgaauaaucuguuu

SEQ ID NO: 3664488 - RNA, 23 nt, Salmonella enterica enterica serovar Typhi
uuucgcgauaauagaacccaaag

SEQ ID NO: 3664489 - RNA, 15 nt, Salmonella enterica enterica serovar Typhi
uuucgcuguaauagu

SEQ ID NO: 3664490 - RNA, 15 nt, Salmonella enterica enterica serovar Typhi
uuucggacuuccugu

SEQ ID NO: 3664491 - RNA, 23 nt, Salmonella enterica enterica serovar Typhi
uuucggcguguaacugcaaacgc

SEQ ID NO: 3664492 - RNA, 15 nt, Salmonella enterica enterica serovar Typhi
uuucgggcacuggcg

SEQ ID NO: 3664493 - RNA, 24 nt, Salmonella enterica enterica serovar Typhi
uuucguaaaauauauauuuucuca

SEQ ID NO: 3664494 - RNA, 18 nt, Salmonella enterica enterica serovar Typhi
uuucguccggcugccacu

SEQ ID NO: 3664495 - RNA, 13 nt, Salmonella enterica enterica serovar Typhi
uuucuacaaaugu

SEQ ID NO: 3664496 - RNA, 19 nt, Salmonella enterica enterica serovar Typhi
uuucuagggauaacaguau

SEQ ID NO: 3664497 - RNA, 18 nt, Salmonella enterica enterica serovar Typhi
uuucuaucagguaacaua

SEQ ID NO: 3664498 - RNA, 13 nt, Salmonella enterica enterica serovar Typhi
uuucuaucccuuc

SEQ ID NO: 3664499 - RNA, 16 nt, Salmonella enterica enterica serovar Typhi
uuucuaucguuauaua

SEQ ID NO: 3664500 - RNA, 18 nt, Salmonella enterica enterica serovar Typhi
uuucucccgccagaugca

SEQ ID NO: 3664501 - RNA, 14 nt, Salmonella enterica enterica serovar Typhi
uuucuccguuguug

SEQ ID NO: 3664502 - RNA, 11 nt, Salmonella enterica enterica serovar Typhi
uuucuccugcg

SEQ ID NO: 3664503 - RNA, 15 nt, Salmonella enterica enterica serovar Typhi
uuucuccugcggccu

SEQ ID NO: 3664504 - RNA, 14 nt, Salmonella enterica enterica serovar Typhi
uuucucgccgccau

SEQ ID NO: 3664505 - RNA, 17 nt, Salmonella enterica enterica serovar Typhi
uuucucggcuuuccagc

SEQ ID NO: 3664506 - RNA, 16 nt, Salmonella enterica enterica serovar Typhi
uuucucguguagccag

SEQ ID NO: 3664507 - RNA, 22 nt, Salmonella enterica enterica serovar Typhi
uuucucugguuucccugccuca

SEQ ID NO: 3664508 - RNA, 14 nt, Salmonella enterica enterica serovar Typhi
uuucugaauagaaa

SEQ ID NO: 3664509 - RNA, 19 nt, Salmonella enterica enterica serovar Typhi
uuucugacagugaugaauc

SEQ ID NO: 3664510 - RNA, 18 nt, Salmonella enterica enterica serovar Typhi
uuucugacguaacuuauc

SEQ ID NO: 3664511 - RNA, 20 nt, Salmonella enterica enterica serovar Typhi
uuucugccagguuccccaau

SEQ ID NO: 3664512 - RNA, 18 nt, Salmonella enterica enterica serovar Typhi
uuucugccuuuaacaaau

SEQ ID NO: 3664513 - RNA, 15 nt, Salmonella enterica enterica serovar Typhi
uuucugcuggccuuu

SEQ ID NO: 3664514 - RNA, 17 nt, Salmonella enterica enterica serovar Typhi
uuucuggcaacagccau

SEQ ID NO: 3664515 - RNA, 17 nt, Salmonella enterica enterica serovar Typhi
uuucuggcgaugugccc

SEQ ID NO: 3664516 - RNA, 21 nt, Salmonella enterica enterica serovar Typhi
uuucuggcuucagccugugca

SEQ ID NO: 3664517 - RNA, 17 nt, Salmonella enterica enterica serovar Typhi
uuucuguaauuugaaau

SEQ ID NO: 3664518 - RNA, 20 nt, Salmonella enterica enterica serovar Typhi
uuucuguguugcucaaaaaa

SEQ ID NO: 3664519 - RNA, 14 nt, Salmonella enterica enterica serovar Typhi
uuucuguuaucagg

SEQ ID NO: 3664520 - RNA, 18 nt, Salmonella enterica enterica serovar Typhi
uuucuuaauaugcugccu

SEQ ID NO: 3664521 - RNA, 13 nt, Salmonella enterica enterica serovar Typhi
uuucuuaauuccu

SEQ ID NO: 3664522 - RNA, 21 nt, Salmonella enterica enterica serovar Typhi
uuucuucaagcguuuccagag

SEQ ID NO: 3664523 - RNA, 13 nt, Salmonella enterica enterica serovar Typhi
uuucuuccagguu

SEQ ID NO: 3664524 - RNA, 21 nt, Salmonella enterica enterica serovar Typhi
uuucuucccuccccugcgccu

SEQ ID NO: 3664525 - RNA, 11 nt, Salmonella enterica enterica serovar Typhi
uuucuucuuca

SEQ ID NO: 3664526 - RNA, 22 nt, Salmonella enterica enterica serovar Typhi
uuucuugaugugucuauuuauu

SEQ ID NO: 3664527 - RNA, 21 nt, Salmonella enterica enterica serovar Typhi
uuucuugccacuggccuccca

SEQ ID NO: 3664528 - RNA, 13 nt, Salmonella enterica enterica serovar Typhi
uuucuuucaucaa

SEQ ID NO: 3664529 - RNA, 17 nt, Salmonella enterica enterica serovar Typhi
uuucuuugcgaaacauc

SEQ ID NO: 3664530 - RNA, 18 nt, Salmonella enterica enterica serovar Typhi
uuugaacgagucuuacca

SEQ ID NO: 3664531 - RNA, 14 nt, Salmonella enterica enterica serovar Typhi
uuugacauugucau

SEQ ID NO: 3664532 - RNA, 13 nt, Salmonella enterica enterica serovar Typhi
uuugaccucgccu

SEQ ID NO: 3664533 - RNA, 22 nt, Salmonella enterica enterica serovar Typhi
uuugacgccgggaaauuuuucg

SEQ ID NO: 3664534 - RNA, 15 nt, Salmonella enterica enterica serovar Typhi
uuugagaaaaacauc

SEQ ID NO: 3664535 - RNA, 18 nt, Salmonella enterica enterica serovar Typhi
uuugaggaaaccuuucuu

SEQ ID NO: 3664536 - RNA, 17 nt, Salmonella enterica enterica serovar Typhi
uuugagucgcauccagu

SEQ ID NO: 3664537 - RNA, 15 nt, Salmonella enterica enterica serovar Typhi
uuugauaagagaaaa

SEQ ID NO: 3664538 - RNA, 21 nt, Salmonella enterica enterica serovar Typhi
uuugaucccguccgcgcucau

SEQ ID NO: 3664539 - RNA, 20 nt, Salmonella enterica enterica serovar Typhi
uuugauccguuucagaaaga

SEQ ID NO: 3664540 - RNA, 18 nt, Salmonella enterica enterica serovar Typhi
uuuuaagcauccaggaag

SEQ ID NO: 3664541 - RNA, 20 nt, Salmonella enterica enterica serovar Typhi
uuuuaaggcggcaaagauaa

SEQ ID NO: 3664542 - RNA, 17 nt, Salmonella enterica enterica serovar Typhi
uuuuaauguccagcagu

SEQ ID NO: 3664543 - RNA, 22 nt, Salmonella enterica enterica serovar Typhi
uuuuaauguccagcagugucug

SEQ ID NO: 3664544 - RNA, 12 nt, Salmonella enterica enterica serovar Typhi
uuuuaauuuuua

SEQ ID NO: 3664545 - RNA, 19 nt, Salmonella enterica enterica serovar Typhi
uuuuaauuuuuaugucauu

SEQ ID NO: 3664546 - RNA, 13 nt, Salmonella enterica enterica serovar Typhi
uuuuacacugaag

SEQ ID NO: 3664547 - RNA, 18 nt, Salmonella enterica enterica serovar Typhi
uuuuacaggcacuuacuc

SEQ ID NO: 3664548 - RNA, 20 nt, Salmonella enterica enterica serovar Typhi
uuuuaccaguacaauuucug

SEQ ID NO: 3664549 - RNA, 19 nt, Salmonella enterica enterica serovar Typhi
uuuuaccgcccgcgccagu

SEQ ID NO: 3664550 - RNA, 19 nt, Salmonella enterica enterica serovar Typhi
uuuuacugcguaaucuuuu

SEQ ID NO: 3664551 - RNA, 18 nt, Salmonella enterica enterica serovar Typhi
uuuuacuuaaaauugaau

SEQ ID NO: 3664552 - RNA, 14 nt, Salmonella enterica enterica serovar Typhi
uuuuagaauuaucu

SEQ ID NO: 3664553 - RNA, 19 nt, Salmonella enterica enterica serovar Typhi
uuuuagaauuaucugaaag

SEQ ID NO: 3664554 - RNA, 20 nt, Salmonella enterica enterica serovar Typhi
uuuuagauccccaaacugcu

SEQ ID NO: 3664555 - RNA, 20 nt, Salmonella enterica enterica serovar Typhi
uuuuagcaauaacucaauag

SEQ ID NO: 3664556 - RNA, 14 nt, Salmonella enterica enterica serovar Typhi
uuuuagcuuaaaaa

SEQ ID NO: 3664557 - RNA, 14 nt, Salmonella enterica enterica serovar Typhi
uuuuauaaauauag

SEQ ID NO: 3664558 - RNA, 13 nt, Salmonella enterica enterica serovar Typhi
uuuuauaacauaa

SEQ ID NO: 3664559 - RNA, 13 nt, Salmonella enterica enterica serovar Typhi
uuuuauacauccu

SEQ ID NO: 3664560 - RNA, 15 nt, Salmonella enterica enterica serovar Typhi
uuuuauagcagucag

SEQ ID NO: 3664561 - RNA, 20 nt, Salmonella enterica enterica serovar Typhi
uuuuauauguugaauauuca

SEQ ID NO: 3664562 - RNA, 22 nt, Salmonella enterica enterica serovar Typhi
uuuuauauguugaauauucaau

SEQ ID NO: 3664563 - RNA, 17 nt, Salmonella enterica enterica serovar Typhi
uuuuaucaggccugccu

SEQ ID NO: 3664564 - RNA, 23 nt, Salmonella enterica enterica serovar Typhi
uuuuauccguuuccgcaauaagu

SEQ ID NO: 3664565 - RNA, 21 nt, Salmonella enterica enterica serovar Typhi
uuuuauccuguguuuggccgc

SEQ ID NO: 3664566 - RNA, 23 nt, Salmonella enterica enterica serovar Typhi
uuuuaucucuuuugcuucaauaa

SEQ ID NO: 3664567 - RNA, 19 nt, Salmonella enterica enterica serovar Typhi
uuuuaugaugcauuugauu

SEQ ID NO: 3664568 - RNA, 12 nt, Salmonella enterica enterica serovar Typhi
uuuuaugcguuu

SEQ ID NO: 3664569 - RNA, 16 nt, Salmonella enterica enterica serovar Typhi
uuuuauuauauuuaaa

SEQ ID NO: 3664570 - RNA, 19 nt, Salmonella enterica enterica serovar Typhi
uuuuauuuguguauuuuuu

SEQ ID NO: 3664571 - RNA, 12 nt, Salmonella enterica enterica serovar Typhi
uuuucaaaaaca

SEQ ID NO: 3664572 - RNA, 17 nt, Salmonella enterica enterica serovar Typhi
uuuucaaccacggauaa

SEQ ID NO: 3664573 - RNA, 21 nt, Salmonella enterica enterica serovar Typhi
uuuucaacggcaucaauaauu

SEQ ID NO: 3664574 - RNA, 12 nt, Salmonella enterica enterica serovar Typhi
uuuucaauaauc

SEQ ID NO: 3664575 - RNA, 13 nt, Salmonella enterica enterica serovar Typhi
uuuucaccauaau

SEQ ID NO: 3664576 - RNA, 13 nt, Salmonella enterica enterica serovar Typhi
uuuucaccauuaa

SEQ ID NO: 3664577 - RNA, 19 nt, Salmonella enterica enterica serovar Typhi
uuuucacgaccaaccaaca

SEQ ID NO: 3664578 - RNA, 18 nt, Salmonella enterica enterica serovar Typhi
uuuucagaggucaggauu

SEQ ID NO: 3664579 - RNA, 21 nt, Salmonella enterica enterica serovar Typhi
uuuucagauaacgaaccauca

SEQ ID NO: 3664580 - RNA, 16 nt, Salmonella enterica enterica serovar Typhi
uuuucagcagugcaaa

SEQ ID NO: 3664581 - RNA, 18 nt, Salmonella enterica enterica serovar Typhi
uuuucagcggcagcucug

SEQ ID NO: 3664582 - RNA, 17 nt, Salmonella enterica enterica serovar Typhi
uuuucagcgucuuucuu

SEQ ID NO: 3664583 - RNA, 17 nt, Salmonella enterica enterica serovar Typhi
uuuucaggaaguuuaac

SEQ ID NO: 3664584 - RNA, 15 nt, Salmonella enterica enterica serovar Typhi
uuuucauauguuuga

SEQ ID NO: 3664585 - RNA, 13 nt, Salmonella enterica enterica serovar Typhi
uuuucaucaucau

SEQ ID NO: 3664586 - RNA, 15 nt, Salmonella enterica enterica serovar Typhi
uuuucaugcaauaau

SEQ ID NO: 3664587 - RNA, 20 nt, Salmonella enterica enterica serovar Typhi
uuuucauucgaucuguguac

SEQ ID NO: 3664588 - RNA, 14 nt, Salmonella enterica enterica serovar Typhi
uuuuccacaauacc

SEQ ID NO: 3664589 - RNA, 19 nt, Salmonella enterica enterica serovar Typhi
uuuuccagcauuucuucaa

SEQ ID NO: 3664590 - RNA, 22 nt, Salmonella enterica enterica serovar Typhi
uuuuccagccgcuuuucgcuua

SEQ ID NO: 3664591 - RNA, 18 nt, Salmonella enterica enterica serovar Typhi
uuuuccagcguaauccgc

SEQ ID NO: 3664592 - RNA, 21 nt, Salmonella enterica enterica serovar Typhi
uuuucccgccagcugcgcgcu

SEQ ID NO: 3664593 - RNA, 15 nt, Salmonella enterica enterica serovar Typhi
uuuuccgcuuuuccu

SEQ ID NO: 3664594 - RNA, 16 nt, Salmonella enterica enterica serovar Typhi
uuuuccugcggcuuga

SEQ ID NO: 3664595 - RNA, 13 nt, Salmonella enterica enterica serovar Typhi
uuuucgaaaauuu

SEQ ID NO: 3664596 - RNA, 15 nt, Salmonella enterica enterica serovar Typhi
uuuucgaaaauuucg

SEQ ID NO: 3664597 - RNA, 15 nt, Salmonella enterica enterica serovar Typhi
uuuucgacagcggcg

SEQ ID NO: 3664598 - RNA, 16 nt, Salmonella enterica enterica serovar Typhi
uuuucgauaaucgcgc

SEQ ID NO: 3664599 - RNA, 17 nt, Salmonella enterica enterica serovar Typhi
uuuucgccaguuuugca

SEQ ID NO: 3664600 - RNA, 20 nt, Salmonella enterica enterica serovar Typhi
uuuucgcccccagcacgaca

SEQ ID NO: 3664601 - RNA, 12 nt, Salmonella enterica enterica serovar Typhi
uuuucggcucac

SEQ ID NO: 3664602 - RNA, 22 nt, Salmonella enterica enterica serovar Typhi
uuuucuaacgaggugacgccau

SEQ ID NO: 3664603 - RNA, 19 nt, Salmonella enterica enterica serovar Typhi
uuuucucguguagccagua

SEQ ID NO: 3664604 - RNA, 18 nt, Salmonella enterica enterica serovar Typhi
uuuucugcgccaccagcg

SEQ ID NO: 3664605 - RNA, 14 nt, Salmonella enterica enterica serovar Typhi
uuuucugcuuucuu

SEQ ID NO: 3664606 - RNA, 16 nt, Salmonella enterica enterica serovar Typhi
uuuucuuauuacaaga

SEQ ID NO: 3664607 - RNA, 12 nt, Salmonella enterica enterica serovar Typhi
uuuucuucuucg

SEQ ID NO: 3664608 - RNA, 17 nt, Salmonella enterica enterica serovar Typhi
uuuugaaaucacgccac

SEQ ID NO: 3664609 - RNA, 18 nt, Salmonella enterica enterica serovar Typhi
uuuugacaacaaaaagau

SEQ ID NO: 3664610 - RNA, 19 nt, Salmonella enterica enterica serovar Typhi
uuuugaguuugucauccag

SEQ ID NO: 3664611 - RNA, 17 nt, Salmonella enterica enterica serovar Typhi
uuuugauaaaucagcac

SEQ ID NO: 3664612 - RNA, 20 nt, Salmonella enterica enterica serovar Typhi
uuuugauaagagaaaauacc

SEQ ID NO: 3664613 - RNA, 16 nt, Salmonella enterica enterica serovar Typhi
uuuugcagaauugaua

SEQ ID NO: 3664614 - RNA, 22 nt, Salmonella enterica enterica serovar Typhi
uuuugcagcaacugauucaaaa

SEQ ID NO: 3664615 - RNA, 21 nt, Salmonella enterica enterica serovar Typhi
uuuugcccgaucccaugcuca

SEQ ID NO: 3664616 - RNA, 17 nt, Salmonella enterica enterica serovar Typhi
uuuugcccgcucgcuua

SEQ ID NO: 3664617 - RNA, 17 nt, Salmonella enterica enterica serovar Typhi
uuuugccgagcaggacg

SEQ ID NO: 3664618 - RNA, 24 nt, Salmonella enterica enterica serovar Typhi
uuuugccggauggcacugcgcuua

SEQ ID NO: 3664619 - RNA, 19 nt, Salmonella enterica enterica serovar Typhi
uuuugccugcggauuugcu

SEQ ID NO: 3664620 - RNA, 11 nt, Salmonella enterica enterica serovar Typhi
uuuugcucagu

SEQ ID NO: 3664621 - RNA, 17 nt, Salmonella enterica enterica serovar Typhi
uuuuggccggaccugcg

SEQ ID NO: 3664622 - RNA, 15 nt, Salmonella enterica enterica serovar Typhi
uuuuguagacucgcg

SEQ ID NO: 3664623 - RNA, 23 nt, Salmonella enterica enterica serovar Typhi
uuuuguauugcgcgucacaagcu

SEQ ID NO: 3664624 - RNA, 13 nt, Salmonella enterica enterica serovar Typhi
uuuugucaucaga

SEQ ID NO: 3664625 - RNA, 11 nt, Salmonella enterica enterica serovar Typhi
uuuugucaugg

SEQ ID NO: 3664626 - RNA, 22 nt, Salmonella enterica enterica serovar Typhi
auucaacagggguuccggcaau

SEQ ID NO: 3664627 - RNA, 22 nt, Salmonella enterica enterica serovar Typhi
auucaaccagccgaucagcgcc

SEQ ID NO: 3664628 - RNA, 23 nt, Salmonella enterica enterica serovar Typhi
auucaaccagccgaucagcgcca

SEQ ID NO: 3664629 - RNA, 17 nt, Salmonella enterica enterica serovar Typhi
auucaaccaguuaauuu

SEQ ID NO: 3664630 - RNA, 19 nt, Salmonella enterica enterica serovar Typhi
auucaacgccaucuuccuc

SEQ ID NO: 3664631 - RNA, 11 nt, Salmonella enterica enterica serovar Typhi
auucaaucacu

SEQ ID NO: 3664632 - RNA, 18 nt, Salmonella enterica enterica serovar Typhi
auucaauucuggaaucaa

SEQ ID NO: 3664633 - RNA, 19 nt, Salmonella enterica enterica serovar Typhi
auucaauucuggaaucaau

SEQ ID NO: 3664634 - RNA, 22 nt, Salmonella enterica enterica serovar Typhi
auucacacgcucacccaguuuu

SEQ ID NO: 3664635 - RNA, 21 nt, Salmonella enterica enterica serovar Typhi
auucacauuauucacgcuaug

SEQ ID NO: 3664636 - RNA, 17 nt, Salmonella enterica enterica serovar Typhi
auucaccaaauccucac

SEQ ID NO: 3664637 - RNA, 19 nt, Salmonella enterica enterica serovar Typhi
auucacccaauaaauaaua

SEQ ID NO: 3664638 - RNA, 21 nt, Salmonella enterica enterica serovar Typhi
auucacccaauaaauaauauc

SEQ ID NO: 3664639 - RNA, 21 nt, Salmonella enterica enterica serovar Typhi
auucaccucccugcaacagca

SEQ ID NO: 3664640 - RNA, 17 nt, Salmonella enterica enterica serovar Typhi
auucacgcgauuguuau

SEQ ID NO: 3664641 - RNA, 16 nt, Salmonella enterica enterica serovar Typhi
auucacguagcggcgc

SEQ ID NO: 3664642 - RNA, 15 nt, Salmonella enterica enterica serovar Typhi
auucacguuccauuu

SEQ ID NO: 3664643 - RNA, 12 nt, Salmonella enterica enterica serovar Typhi
auucagaaaguu

SEQ ID NO: 3664644 - RNA, 16 nt, Salmonella enterica enterica serovar Typhi
auucagaaccugcgau

SEQ ID NO: 3664645 - RNA, 16 nt, Salmonella enterica enterica serovar Typhi
auucagaauaugccag

SEQ ID NO: 3664646 - RNA, 14 nt, Salmonella enterica enterica serovar Typhi
auucagcagcgccc

SEQ ID NO: 3664647 - RNA, 16 nt, Salmonella enterica enterica serovar Typhi
auucagcaggaggcuu

SEQ ID NO: 3664648 - RNA, 20 nt, Salmonella enterica enterica serovar Typhi
auucagggcuuuauuuuaca

SEQ ID NO: 3664649 - RNA, 21 nt, Salmonella enterica enterica serovar Typhi
auucagggcuuuauuuuacaa

SEQ ID NO: 3664650 - RNA, 15 nt, Salmonella enterica enterica serovar Typhi
auucagggugcugau

SEQ ID NO: 3664651 - RNA, 11 nt, Salmonella enterica enterica serovar Typhi
auucagguaau

SEQ ID NO: 3664652 - RNA, 12 nt, Salmonella enterica enterica serovar Typhi
auucagguaaua

SEQ ID NO: 3664653 - RNA, 20 nt, Salmonella enterica enterica serovar Typhi
auucagguuuugcugaucaa

SEQ ID NO: 3664654 - RNA, 14 nt, Salmonella enterica enterica serovar Typhi
auucauaaaagauc

SEQ ID NO: 3664655 - RNA, 17 nt, Salmonella enterica enterica serovar Typhi
auucauaacaccaauac

SEQ ID NO: 3664656 - RNA, 20 nt, Salmonella enterica enterica serovar Typhi
auucauaaugguugugccag

SEQ ID NO: 3664657 - RNA, 24 nt, Salmonella enterica enterica serovar Typhi
auucauagagcgcguccagacguu

SEQ ID NO: 3664658 - RNA, 14 nt, Salmonella enterica enterica serovar Typhi
auucauauuagcuc

SEQ ID NO: 3664659 - RNA, 16 nt, Salmonella enterica enterica serovar Typhi
auucauauuagcuccg

SEQ ID NO: 3664660 - RNA, 12 nt, Salmonella enterica enterica serovar Typhi
auucauauugcc

SEQ ID NO: 3664661 - RNA, 22 nt, Salmonella enterica enterica serovar Typhi
auucauauugcccaucgcgcca

SEQ ID NO: 3664662 - RNA, 13 nt, Salmonella enterica enterica serovar Typhi
auucaucaaaaug

SEQ ID NO: 3664663 - RNA, 15 nt, Salmonella enterica enterica serovar Typhi
auucaucaaaaugca

SEQ ID NO: 3664664 - RNA, 16 nt, Salmonella enterica enterica serovar Typhi
auucaucacguucagg

SEQ ID NO: 3664665 - RNA, 13 nt, Salmonella enterica enterica serovar Typhi
auucaucuccucu

SEQ ID NO: 3664666 - RNA, 15 nt, Salmonella enterica enterica serovar Typhi
auucaucuccucuuc

SEQ ID NO: 3664667 - RNA, 21 nt, Salmonella enterica enterica serovar Typhi
auucaugaucuuuccuuuuuc

SEQ ID NO: 3664668 - RNA, 19 nt, Salmonella enterica enterica serovar Typhi
auucaugguacucaacauc

SEQ ID NO: 3664669 - RNA, 21 nt, Salmonella enterica enterica serovar Typhi
auucaugguacucaacaucau

SEQ ID NO: 3664670 - RNA, 21 nt, Salmonella enterica enterica serovar Typhi
auucauucacccaauaaauaa

SEQ ID NO: 3664671 - RNA, 15 nt, Salmonella enterica enterica serovar Typhi
auucauucccauacu

SEQ ID NO: 3664672 - RNA, 16 nt, Salmonella enterica enterica serovar Typhi
auucauucugucagaa

SEQ ID NO: 3664673 - RNA, 18 nt, Salmonella enterica enterica serovar Typhi
auucauugucuuuuucuc

SEQ ID NO: 3664674 - RNA, 15 nt, Salmonella enterica enterica serovar Typhi
auucauuucaaugua

SEQ ID NO: 3664675 - RNA, 14 nt, Salmonella enterica enterica serovar Typhi
auuccaaaauaaua

SEQ ID NO: 3664676 - RNA, 12 nt, Salmonella enterica enterica serovar Typhi
auuccaauauuu

SEQ ID NO: 3664677 - RNA, 21 nt, Salmonella enterica enterica serovar Typhi
auuccagaaaggaugcccgua

SEQ ID NO: 3664678 - RNA, 21 nt, Salmonella enterica enterica serovar Typhi
auuccagaagcgcuuugccaa

SEQ ID NO: 3664679 - RNA, 11 nt, Salmonella enterica enterica serovar Typhi
auuccagaccc

SEQ ID NO: 3664680 - RNA, 22 nt, Salmonella enterica enterica serovar Typhi
auuccagauagcgcugcgccag

SEQ ID NO: 3664681 - RNA, 12 nt, Salmonella enterica enterica serovar Typhi
auuccagccagg

SEQ ID NO: 3664682 - RNA, 18 nt, Salmonella enterica enterica serovar Typhi
auuccagcgugccgagca

SEQ ID NO: 3664683 - RNA, 23 nt, Salmonella enterica enterica serovar Typhi
auuccagggcauuuuuuccagua

SEQ ID NO: 3664684 - RNA, 21 nt, Salmonella enterica enterica serovar Typhi
auuccaguccuuucgacgcau

SEQ ID NO: 3664685 - RNA, 20 nt, Salmonella enterica enterica serovar Typhi
auuccauuagcauucccuua

SEQ ID NO: 3664686 - RNA, 22 nt, Salmonella enterica enterica serovar Typhi
auucccacgcauaguccugccg

SEQ ID NO: 3664687 - RNA, 13 nt, Salmonella enterica enterica serovar Typhi
auucccagcgccc

SEQ ID NO: 3664688 - RNA, 22 nt, Salmonella enterica enterica serovar Typhi
auucccaguaaccuauuuuaca

SEQ ID NO: 3664689 - RNA, 16 nt, Salmonella enterica enterica serovar Typhi
auucccauuccugcaa

SEQ ID NO: 3664690 - RNA, 17 nt, Salmonella enterica enterica serovar Typhi
auuccccaccaggaaug

SEQ ID NO: 3664691 - RNA, 13 nt, Salmonella enterica enterica serovar Typhi
auucccccugcgu

SEQ ID NO: 3664692 - RNA, 16 nt, Salmonella enterica enterica serovar Typhi
auuccccguccugaau

SEQ ID NO: 3664693 - RNA, 14 nt, Salmonella enterica enterica serovar Typhi
auucccgccuuaag

SEQ ID NO: 3664694 - RNA, 16 nt, Salmonella enterica enterica serovar Typhi
auucccggccacaggc

SEQ ID NO: 3664695 - RNA, 15 nt, Salmonella enterica enterica serovar Typhi
auucccguaaaagaa

SEQ ID NO: 3664696 - RNA, 17 nt, Salmonella enterica enterica serovar Typhi
auucccguaucuucaug

SEQ ID NO: 3664697 - RNA, 21 nt, Salmonella enterica enterica serovar Typhi
auucccguaucuucauguucu

SEQ ID NO: 3664698 - RNA, 15 nt, Salmonella enterica enterica serovar Typhi
auucccgucccugca

SEQ ID NO: 3664699 - RNA, 22 nt, Salmonella enterica enterica serovar Typhi
auucccugcgcauacgucaugc

SEQ ID NO: 3664700 - RNA, 15 nt, Salmonella enterica enterica serovar Typhi
auuccgcagaagccg

SEQ ID NO: 3664701 - RNA, 17 nt, Salmonella enterica enterica serovar Typhi
auuccgccaacgguaag

SEQ ID NO: 3664702 - RNA, 14 nt, Salmonella enterica enterica serovar Typhi
auuccgccugcugu

SEQ ID NO: 3664703 - RNA, 13 nt, Salmonella enterica enterica serovar Typhi
auuccgcgcauaa

SEQ ID NO: 3664704 - RNA, 12 nt, Salmonella enterica enterica serovar Typhi
gacgcaccagcc

SEQ ID NO: 3664705 - RNA, 19 nt, Salmonella enterica enterica serovar Typhi
gacgcaccagccaggcgau

SEQ ID NO: 3664706 - RNA, 15 nt, Salmonella enterica enterica serovar Typhi
gacgcagacaauaaa

SEQ ID NO: 3664707 - RNA, 15 nt, Salmonella enterica enterica serovar Typhi
gacgcagcucauacc

SEQ ID NO: 3664708 - RNA, 22 nt, Salmonella enterica enterica serovar Typhi
gacgcagcucauacccuuccag

SEQ ID NO: 3664709 - RNA, 15 nt, Salmonella enterica enterica serovar Typhi
gacgcagcuucgccg

SEQ ID NO: 3664710 - RNA, 16 nt, Salmonella enterica enterica serovar Typhi
gacgcagcuucgccgc

SEQ ID NO: 3664711 - RNA, 12 nt, Salmonella enterica enterica serovar Typhi
gacgcagcuucu

SEQ ID NO: 3664712 - RNA, 17 nt, Salmonella enterica enterica serovar Typhi
gacgccaagcugcagaa

SEQ ID NO: 3664713 - RNA, 21 nt, Salmonella enterica enterica serovar Typhi
gacgccaauuccuaucaguac

SEQ ID NO: 3664714 - RNA, 21 nt, Salmonella enterica enterica serovar Typhi
gacgccaccggguuaaagccc

SEQ ID NO: 3664715 - RNA, 13 nt, Salmonella enterica enterica serovar Typhi
gacgccaggcaga

SEQ ID NO: 3664716 - RNA, 21 nt, Salmonella enterica enterica serovar Typhi
gacgccaggcagauugaggcg

SEQ ID NO: 3664717 - RNA, 17 nt, Salmonella enterica enterica serovar Typhi
gacgccauaucgccgcc

SEQ ID NO: 3664718 - RNA, 22 nt, Salmonella enterica enterica serovar Typhi
gacgccauccguacguauuauc

SEQ ID NO: 3664719 - RNA, 16 nt, Salmonella enterica enterica serovar Typhi
gacgccaugcaaaaaa

SEQ ID NO: 3664720 - RNA, 15 nt, Salmonella enterica enterica serovar Typhi
gacgccaugggguga

SEQ ID NO: 3664721 - RNA, 17 nt, Salmonella enterica enterica serovar Typhi
gacgcccaucagcaucc

SEQ ID NO: 3664722 - RNA, 23 nt, Salmonella enterica enterica serovar Typhi
gacgccccauguggccagcggcc

SEQ ID NO: 3664723 - RNA, 16 nt, Salmonella enterica enterica serovar Typhi
gacgccgauaaagccc

SEQ ID NO: 3664724 - RNA, 21 nt, Salmonella enterica enterica serovar Typhi
gacgccggguaaacgcagcgu

SEQ ID NO: 3664725 - RNA, 17 nt, Salmonella enterica enterica serovar Typhi
gacgccguccaggcucg

SEQ ID NO: 3664726 - RNA, 23 nt, Salmonella enterica enterica serovar Typhi
gacgccgucugguacggccacca

SEQ ID NO: 3664727 - RNA, 14 nt, Salmonella enterica enterica serovar Typhi
gacgcgaagcggcg

SEQ ID NO: 3664728 - RNA, 21 nt, Salmonella enterica enterica serovar Typhi
gacgcgacuuuuuucacccag

SEQ ID NO: 3664729 - RNA, 21 nt, Salmonella enterica enterica serovar Typhi
gacgcgauauuacuccagcgu

SEQ ID NO: 3664730 - RNA, 13 nt, Salmonella enterica enterica serovar Typhi
gacgcgcagcacc

SEQ ID NO: 3664731 - RNA, 13 nt, Salmonella enterica enterica serovar Typhi
gacgcgcaggccg

SEQ ID NO: 3664732 - RNA, 20 nt, Salmonella enterica enterica serovar Typhi
gacgcgccacuuccagcgcg

SEQ ID NO: 3664733 - RNA, 14 nt, Salmonella enterica enterica serovar Typhi
gacgcgccagccag

SEQ ID NO: 3664734 - RNA, 13 nt, Salmonella enterica enterica serovar Typhi
gacgcgccagcgg

SEQ ID NO: 3664735 - RNA, 21 nt, Salmonella enterica enterica serovar Typhi
gacgcgcgcgaaaagaaacug

SEQ ID NO: 3664736 - RNA, 19 nt, Salmonella enterica enterica serovar Typhi
gacgcgcucaccuccgcca

SEQ ID NO: 3664737 - RNA, 16 nt, Salmonella enterica enterica serovar Typhi
gacgcgcuccagcaac

SEQ ID NO: 3664738 - RNA, 17 nt, Salmonella enterica enterica serovar Typhi
gacgcgggccgcauugc

SEQ ID NO: 3664739 - RNA, 15 nt, Salmonella enterica enterica serovar Typhi
gacgcgguacccacc

SEQ ID NO: 3664740 - RNA, 19 nt, Salmonella enterica enterica serovar Typhi
gacgcguuuuccagcacca

SEQ ID NO: 3664741 - RNA, 21 nt, Salmonella enterica enterica serovar Typhi
gacgcuacgcgucgccauccg

SEQ ID NO: 3664742 - RNA, 15 nt, Salmonella enterica enterica serovar Typhi
gacgcuccagaaucu

SEQ ID NO: 3664743 - RNA, 20 nt, Salmonella enterica enterica serovar Typhi
gacgcuccaucacgguaaac

SEQ ID NO: 3664744 - RNA, 18 nt, Salmonella enterica enterica serovar Typhi
gacgcugaaccuuccauu

SEQ ID NO: 3664745 - RNA, 15 nt, Salmonella enterica enterica serovar Typhi
gacgcugagagaacu

SEQ ID NO: 3664746 - RNA, 17 nt, Salmonella enterica enterica serovar Typhi
gacgcugauagccacgg

SEQ ID NO: 3664747 - RNA, 14 nt, Salmonella enterica enterica serovar Typhi
gacgcugaugaaaa

SEQ ID NO: 3664748 - RNA, 16 nt, Salmonella enterica enterica serovar Typhi
gacgcugcaacucucc

SEQ ID NO: 3664749 - RNA, 16 nt, Salmonella enterica enterica serovar Typhi
gacgcugcgccuggau

SEQ ID NO: 3664750 - RNA, 15 nt, Salmonella enterica enterica serovar Typhi
gacgcugcgcggcga

SEQ ID NO: 3664751 - RNA, 15 nt, Salmonella enterica enterica serovar Typhi
gacgcuggaaaauuu

SEQ ID NO: 3664752 - RNA, 16 nt, Salmonella enterica enterica serovar Typhi
gacgcuggcacuggca

SEQ ID NO: 3664753 - RNA, 12 nt, Salmonella enterica enterica serovar Typhi
gacgcugguugu

SEQ ID NO: 3664754 - RNA, 21 nt, Salmonella enterica enterica serovar Typhi
gacgcuuacaucgccauccgg

SEQ ID NO: 3664755 - RNA, 22 nt, Salmonella enterica enterica serovar Typhi
gacggacucgcgcagaaucagc

SEQ ID NO: 3664756 - RNA, 12 nt, Salmonella enterica enterica serovar Typhi
gacggagaaaaa

SEQ ID NO: 3664757 - RNA, 18 nt, Salmonella enterica enterica serovar Typhi
gacggagaugaucguuuc

SEQ ID NO: 3664758 - RNA, 18 nt, Salmonella enterica enterica serovar Typhi
gacggaggcgggcgcgca

SEQ ID NO: 3664759 - RNA, 11 nt, Salmonella enterica enterica serovar Typhi
gacggaucugg

SEQ ID NO: 3664760 - RNA, 16 nt, Salmonella enterica enterica serovar Typhi
gacggauucuuccucu

SEQ ID NO: 3664761 - RNA, 15 nt, Salmonella enterica enterica serovar Typhi
gacggcaaaaagcau

SEQ ID NO: 3664762 - RNA, 22 nt, Salmonella enterica enterica serovar Typhi
gacggcaacggcgacaagaaua

SEQ ID NO: 3664763 - RNA, 22 nt, Salmonella enterica enterica serovar Typhi
gacggcaauagaacgucgcgcg

SEQ ID NO: 3664764 - RNA, 14 nt, Salmonella enterica enterica serovar Typhi
gacggcagccacgc

SEQ ID NO: 3664765 - RNA, 13 nt, Salmonella enterica enterica serovar Typhi
gacggcagcgcca

SEQ ID NO: 3664766 - RNA, 18 nt, Salmonella enterica enterica serovar Typhi
gacggcagcgccauccgg

SEQ ID NO: 3664767 - RNA, 12 nt, Salmonella enterica enterica serovar Typhi
gacggcaucagg

SEQ ID NO: 3664768 - RNA, 21 nt, Salmonella enterica enterica serovar Typhi
gacggcccaacagcaauguuu

SEQ ID NO: 3664769 - RNA, 20 nt, Salmonella enterica enterica serovar Typhi
gacggcccguaucgcucagg

SEQ ID NO: 3664770 - RNA, 16 nt, Salmonella enterica enterica serovar Typhi
gacggcccuuuugcag

SEQ ID NO: 3664771 - RNA, 22 nt, Salmonella enterica enterica serovar Typhi
gacggccucuucacgcagcgcc

SEQ ID NO: 3664772 - RNA, 23 nt, Salmonella enterica enterica serovar Typhi
gacggcgaaucaauuuacgcacu

SEQ ID NO: 3664773 - RNA, 15 nt, Salmonella enterica enterica serovar Typhi
gacggcggccagcau

SEQ ID NO: 3664774 - RNA, 15 nt, Salmonella enterica enterica serovar Typhi
gacggcuaagcugau

SEQ ID NO: 3664775 - RNA, 23 nt, Salmonella enterica enterica serovar Typhi
gacgggacgaauuuccagcgggc

SEQ ID NO: 3664776 - RNA, 22 nt, Salmonella enterica enterica serovar Typhi
gacgggaucgaaccgccgaccc

SEQ ID NO: 3664777 - RNA, 23 nt, Salmonella enterica enterica serovar Typhi
gacgggaugugaccuuugugcag

SEQ ID NO: 3664778 - RNA, 19 nt, Salmonella enterica enterica serovar Typhi
gacgggauuaaaugacgcc

SEQ ID NO: 3664779 - RNA, 22 nt, Salmonella enterica enterica serovar Typhi
gacgggcaagguuaugcagcau

SEQ ID NO: 3664780 - RNA, 13 nt, Salmonella enterica enterica serovar Typhi
gacgggccaggcg

SEQ ID NO: 3664781 - RNA, 17 nt, Salmonella enterica enterica serovar Typhi
gacgggcccuggccgca

SEQ ID NO: 3664782 - RNA, 19 nt, Salmonella enterica enterica serovar Typhi
gacgggggcgaucagcagg

SEQ ID NO: 3664783 - RNA, 21 nt, Salmonella enterica enterica serovar Typhi
gacggguauuacugauaaagu

SEQ ID NO: 3664784 - RNA, 16 nt, Salmonella enterica enterica serovar Typhi
gacgggugcgcccaga

SEQ ID NO: 3664785 - RNA, 16 nt, Salmonella enterica enterica serovar Typhi
gacgguaagaauaaua

SEQ ID NO: 3664786 - RNA, 14 nt, Salmonella enterica enterica serovar Typhi
gacggugagcugaa

SEQ ID NO: 3664787 - RNA, 15 nt, Salmonella enterica enterica serovar Typhi
gacggugcucaugac

SEQ ID NO: 3664788 - RNA, 13 nt, Salmonella enterica enterica serovar Typhi
gacgguuuucacu

SEQ ID NO: 3664789 - RNA, 12 nt, Salmonella enterica enterica serovar Typhi
gacguacaaaca

SEQ ID NO: 3664790 - RNA, 20 nt, Salmonella enterica enterica serovar Typhi
gacguaccgcuuuaucauac

SEQ ID NO: 3664791 - RNA, 12 nt, Salmonella enterica enterica serovar Typhi
gacguagcgcca

SEQ ID NO: 3664792 - RNA, 20 nt, Salmonella enterica enterica serovar Typhi
gacguauucaccucccugca

SEQ ID NO: 3664793 - RNA, 23 nt, Salmonella enterica enterica serovar Typhi
gacgucaagaucgcgcagcaggc

SEQ ID NO: 3664794 - RNA, 13 nt, Salmonella enterica enterica serovar Typhi
gacgucgccauau

SEQ ID NO: 3664795 - RNA, 18 nt, Salmonella enterica enterica serovar Typhi
gacgucgccauauccaag

SEQ ID NO: 3664796 - RNA, 15 nt, Salmonella enterica enterica serovar Typhi
gacgucgucaccacg

SEQ ID NO: 3664797 - RNA, 22 nt, Salmonella enterica enterica serovar Typhi
gacgugcaccguaucggcaguc

SEQ ID NO: 3664798 - RNA, 14 nt, Salmonella enterica enterica serovar Typhi
gacgugccggaagc

SEQ ID NO: 3664799 - RNA, 19 nt, Salmonella enterica enterica serovar Typhi
gacguucagcauauccagc

SEQ ID NO: 3664800 - RNA, 15 nt, Salmonella enterica enterica serovar Typhi
gacguuuauacccca

SEQ ID NO: 3664801 - RNA, 18 nt, Salmonella enterica enterica serovar Typhi
gacguuugcguaaagcug

SEQ ID NO: 3664802 - RNA, 15 nt, Salmonella enterica enterica serovar Typhi
gacuaaaaagcgcgu

SEQ ID NO: 3664803 - RNA, 14 nt, Salmonella enterica enterica serovar Typhi
gacuaaaacgugcu

SEQ ID NO: 3664804 - RNA, 16 nt, Salmonella enterica enterica serovar Typhi
gacuaaaagacgccau

SEQ ID NO: 3664805 - RNA, 15 nt, Salmonella enterica enterica serovar Typhi
gacuaaccuugauuc

SEQ ID NO: 3664806 - RNA, 18 nt, Salmonella enterica enterica serovar Typhi
gacuaaccuugauucccu

SEQ ID NO: 3664807 - RNA, 16 nt, Salmonella enterica enterica serovar Typhi
gacuaauggcauuucc

SEQ ID NO: 3664808 - RNA, 15 nt, Salmonella enterica enterica serovar Typhi
gacuaauuauuuuuc

SEQ ID NO: 3664809 - RNA, 15 nt, Salmonella enterica enterica serovar Typhi
gacuacccaucacgc

SEQ ID NO: 3664810 - RNA, 19 nt, Salmonella enterica enterica serovar Typhi
gacuacgguaaaccaggcc

SEQ ID NO: 3664811 - RNA, 14 nt, Salmonella enterica enterica serovar Typhi
gacuacgucagaug

SEQ ID NO: 3664812 - RNA, 16 nt, Salmonella enterica enterica serovar Typhi
gacuagacagccucuc

SEQ ID NO: 3664813 - RNA, 17 nt, Salmonella enterica enterica serovar Typhi
gacuaucagaaaaaauu

SEQ ID NO: 3664814 - RNA, 18 nt, Salmonella enterica enterica serovar Typhi
gacuauccagccagggau

SEQ ID NO: 3664815 - RNA, 16 nt, Salmonella enterica enterica serovar Typhi
gacuaucccucugaaa

SEQ ID NO: 3664816 - RNA, 22 nt, Salmonella enterica enterica serovar Typhi
gacuaucgaaagagcaaauacu

SEQ ID NO: 3664817 - RNA, 15 nt, Salmonella enterica enterica serovar Typhi
gacuaucgucacccu

SEQ ID NO: 3664818 - RNA, 17 nt, Salmonella enterica enterica serovar Typhi
gacuauggucugaaaga

SEQ ID NO: 3664819 - RNA, 19 nt, Salmonella enterica enterica serovar Typhi
gacuauucgcuaucagaau

SEQ ID NO: 3664820 - RNA, 16 nt, Salmonella enterica enterica serovar Typhi
gacuauuggaaucgcu

SEQ ID NO: 3664821 - RNA, 17 nt, Salmonella enterica enterica serovar Typhi
gacucacauaacaaaac

SEQ ID NO: 3664822 - RNA, 20 nt, Salmonella enterica enterica serovar Typhi
gacucaccccuucuuuaucu

SEQ ID NO: 3664823 - RNA, 12 nt, Salmonella enterica enterica serovar Typhi
gacucacgcagc

SEQ ID NO: 3664824 - RNA, 15 nt, Salmonella enterica enterica serovar Typhi
gacucagcagcgcau

SEQ ID NO: 3664825 - RNA, 12 nt, Salmonella enterica enterica serovar Typhi
gacucagccagg

SEQ ID NO: 3664826 - RNA, 16 nt, Salmonella enterica enterica serovar Typhi
gacucaggccuuuuua

SEQ ID NO: 3664827 - RNA, 16 nt, Salmonella enterica enterica serovar Typhi
gacucauccagcaucg

SEQ ID NO: 3664828 - RNA, 21 nt, Salmonella enterica enterica serovar Typhi
gacucaucuuuuacaggccgg

SEQ ID NO: 3664829 - RNA, 16 nt, Salmonella enterica enterica serovar Typhi
gacucauggacaaaaa

SEQ ID NO: 3664830 - RNA, 22 nt, Salmonella enterica enterica serovar Typhi
gacucauggacaaaaaaggaaa

SEQ ID NO: 3664831 - RNA, 18 nt, Salmonella enterica enterica serovar Typhi
gacucauuaaaaaaacau

SEQ ID NO: 3664832 - RNA, 22 nt, Salmonella enterica enterica serovar Typhi
gacucccaggcgcgcagcugcc

SEQ ID NO: 3664833 - RNA, 23 nt, Salmonella enterica enterica serovar Typhi
gacuccccacaaucccgccagac

SEQ ID NO: 3664834 - RNA, 13 nt, Salmonella enterica enterica serovar Typhi
gacuccggcagca

SEQ ID NO: 3664835 - RNA, 19 nt, Salmonella enterica enterica serovar Typhi
gacuccucaaccgacgcga

SEQ ID NO: 3664836 - RNA, 18 nt, Salmonella enterica enterica serovar Typhi
gacucgcuacgcucgccc

SEQ ID NO: 3664837 - RNA, 18 nt, Salmonella enterica enterica serovar Typhi
gacucugaagcgggaaag

SEQ ID NO: 3664838 - RNA, 23 nt, Salmonella enterica enterica serovar Typhi
gacucugaagcgggaaagcguaa

SEQ ID NO: 3664839 - RNA, 15 nt, Salmonella enterica enterica serovar Typhi
gacucuguuauauau

SEQ ID NO: 3664840 - RNA, 17 nt, Salmonella enterica enterica serovar Typhi
gacucuuuuuucagaau

SEQ ID NO: 3664841 - RNA, 18 nt, Salmonella enterica enterica serovar Typhi
gacugaaaaucaaaaaca

SEQ ID NO: 3664842 - RNA, 19 nt, Salmonella enterica enterica serovar Typhi
gacugaaaaucaaaaacau

SEQ ID NO: 3664843 - RNA, 16 nt, Salmonella enterica enterica serovar Typhi
gacugaaccuucacgc

SEQ ID NO: 3664844 - RNA, 15 nt, Salmonella enterica enterica serovar Typhi
gacugaauuuucagc

SEQ ID NO: 3664845 - RNA, 14 nt, Salmonella enterica enterica serovar Typhi
gacugacaaugacg

SEQ ID NO: 3664846 - RNA, 17 nt, Salmonella enterica enterica serovar Typhi
gacugaccagacagauu

SEQ ID NO: 3664847 - RNA, 20 nt, Salmonella enterica enterica serovar Typhi
gacugaguauuggcaagaau

SEQ ID NO: 3664848 - RNA, 20 nt, Salmonella enterica enterica serovar Typhi
gacugauaaaagcccuuauc

SEQ ID NO: 3664849 - RNA, 14 nt, Salmonella enterica enterica serovar Typhi
gacugauacccagc

SEQ ID NO: 3664850 - RNA, 14 nt, Salmonella enterica enterica serovar Typhi
gacugauaccgcgu

SEQ ID NO: 3664851 - RNA, 16 nt, Salmonella enterica enterica serovar Typhi
gacugauaccgcguuu

SEQ ID NO: 3664852 - RNA, 24 nt, Salmonella enterica enterica serovar Typhi
gacugauaccgcguuugcgcaaca

SEQ ID NO: 3664853 - RNA, 13 nt, Salmonella enterica enterica serovar Typhi
gacugaucccacu

SEQ ID NO: 3664854 - RNA, 19 nt, Salmonella enterica enterica serovar Typhi
gacugaucccacuuaggca

SEQ ID NO: 3664855 - RNA, 16 nt, Salmonella enterica enterica serovar Typhi
gacugcaaaucugccg

SEQ ID NO: 3664856 - RNA, 14 nt, Salmonella enterica enterica serovar Typhi
gacugcacuuccug

SEQ ID NO: 3664857 - RNA, 16 nt, Salmonella enterica enterica serovar Typhi
gacugcacuuccugcg

SEQ ID NO: 3664858 - RNA, 12 nt, Salmonella enterica enterica serovar Typhi
gacugccgcaga

SEQ ID NO: 3664859 - RNA, 19 nt, Salmonella enterica enterica serovar Typhi
gacugccguauaauccagc

SEQ ID NO: 3664860 - RNA, 19 nt, Salmonella enterica enterica serovar Typhi
gacugccuaacuggaaaaa

SEQ ID NO: 3664861 - RNA, 12 nt, Salmonella enterica enterica serovar Typhi
gacugcggccug

SEQ ID NO: 3664862 - RNA, 16 nt, Salmonella enterica enterica serovar Typhi
gacugcggggagcgaa

SEQ ID NO: 3664863 - RNA, 15 nt, Salmonella enterica enterica serovar Typhi
gacuggaacaggcca

SEQ ID NO: 3664864 - RNA, 21 nt, Salmonella enterica enterica serovar Typhi
gacuggcgaccgccaccaucc

SEQ ID NO: 3664865 - RNA, 21 nt, Salmonella enterica enterica serovar Typhi
gacuggcuaaacaauuugccc

SEQ ID NO: 3664866 - RNA, 19 nt, Salmonella enterica enterica serovar Typhi
gacugggucgauguaguug

SEQ ID NO: 3664867 - RNA, 20 nt, Salmonella enterica enterica serovar Typhi
gacugguggcgagauaagcc

SEQ ID NO: 3664868 - RNA, 16 nt, Salmonella enterica enterica serovar Typhi
gacugucgaaaccagc

SEQ ID NO: 3664869 - RNA, 13 nt, Salmonella enterica enterica serovar Typhi
gacugugauggcg

SEQ ID NO: 3664870 - RNA, 15 nt, Salmonella enterica enterica serovar Typhi
gacuguucacaucca

SEQ ID NO: 3664871 - RNA, 16 nt, Salmonella enterica enterica serovar Typhi
gacuguucacauccag

SEQ ID NO: 3664872 - RNA, 22 nt, Salmonella enterica enterica serovar Typhi
gacuguucacgcagcgcaucca

SEQ ID NO: 3664873 - RNA, 16 nt, Salmonella enterica enterica serovar Typhi
gacuguucagcugaca

SEQ ID NO: 3664874 - RNA, 12 nt, Salmonella enterica enterica serovar Typhi
gacuguugaaag

SEQ ID NO: 3664875 - RNA, 23 nt, Salmonella enterica enterica serovar Typhi
gacuguuucauuacucguccuuc

SEQ ID NO: 3664876 - RNA, 22 nt, Salmonella enterica enterica serovar Typhi
gacuuaaaguacuucacaauca

SEQ ID NO: 3664877 - RNA, 19 nt, Salmonella enterica enterica serovar Typhi
gacuuacggaaaaaugucg

SEQ ID NO: 3664878 - RNA, 22 nt, Salmonella enterica enterica serovar Typhi
gacuuaggaaugcccagcucag

SEQ ID NO: 3664879 - RNA, 13 nt, Salmonella enterica enterica serovar Typhi
gacuuauuaaaaa

SEQ ID NO: 3664880 - RNA, 15 nt, Salmonella enterica enterica serovar Typhi
gacuuauuaaaaaua

SEQ ID NO: 3664881 - RNA, 18 nt, Salmonella enterica enterica serovar Typhi
gacuucaacgcaggcgaa

SEQ ID NO: 3664882 - RNA, 14 nt, Salmonella enterica enterica serovar Typhi
gacuucaccucagc

SEQ ID NO: 3664883 - RNA, 14 nt, Salmonella enterica enterica serovar Typhi
gacuucacuuuccc

SEQ ID NO: 3664884 - RNA, 14 nt, Salmonella enterica enterica serovar Typhi
gacuucauuuucca

SEQ ID NO: 3664885 - RNA, 23 nt, Salmonella enterica enterica serovar Typhi
gacuucauuuuccacaauaccgu

SEQ ID NO: 3664886 - RNA, 20 nt, Salmonella enterica enterica serovar Typhi
gacuuccgcacgcgcgcccu

SEQ ID NO: 3664887 - RNA, 17 nt, Salmonella enterica enterica serovar Typhi
gacuucgcuuccugcau

SEQ ID NO: 3664888 - RNA, 13 nt, Salmonella enterica enterica serovar Typhi
gacuucucccucu

SEQ ID NO: 3664889 - RNA, 18 nt, Salmonella enterica enterica serovar Typhi
gacuugucggcaaucuca

SEQ ID NO: 3664890 - RNA, 22 nt, Salmonella enterica enterica serovar Typhi
gacuuuaaacuuauccgccauc

SEQ ID NO: 3664891 - RNA, 16 nt, Salmonella enterica enterica serovar Typhi
gacuuugaccagcauc

SEQ ID NO: 3664892 - RNA, 13 nt, Salmonella enterica enterica serovar Typhi
gacuuuggauaaa

SEQ ID NO: 3664893 - RNA, 22 nt, Salmonella enterica enterica serovar Typhi
gagaaaaauacgccagauaacg

SEQ ID NO: 3664894 - RNA, 16 nt, Salmonella enterica enterica serovar Typhi
gagaaaacgcggccug

SEQ ID NO: 3664895 - RNA, 20 nt, Salmonella enterica enterica serovar Typhi
gagaaaauaccgcacaucac

SEQ ID NO: 3664896 - RNA, 12 nt, Salmonella enterica enterica serovar Typhi
gagaaaguggug

SEQ ID NO: 3664897 - RNA, 17 nt, Salmonella enterica enterica serovar Typhi
gagaaagugguggguga

SEQ ID NO: 3664898 - RNA, 18 nt, Salmonella enterica enterica serovar Typhi
gagaaauuuagcaguaac

SEQ ID NO: 3664899 - RNA, 12 nt, Salmonella enterica enterica serovar Typhi
gagaacagcauc

SEQ ID NO: 3664900 - RNA, 22 nt, Salmonella enterica enterica serovar Typhi
gagaacggaccggcaaucgccu

SEQ ID NO: 3664901 - RNA, 22 nt, Salmonella enterica enterica serovar Typhi
gagaacgguucauccagcagca

SEQ ID NO: 3664902 - RNA, 14 nt, Salmonella enterica enterica serovar Typhi
gagaagaagaauua

SEQ ID NO: 3664903 - RNA, 17 nt, Salmonella enterica enterica serovar Typhi
gagaagaagaauuauua

SEQ ID NO: 3664904 - RNA, 20 nt, Salmonella enterica enterica serovar Typhi
gagaagaauuccgaugaaaa

SEQ ID NO: 3664905 - RNA, 21 nt, Salmonella enterica enterica serovar Typhi
gagaagcccggccacagcgcc

SEQ ID NO: 3664906 - RNA, 22 nt, Salmonella enterica enterica serovar Typhi
gagaagcccggccacagcgcca

SEQ ID NO: 3664907 - RNA, 21 nt, Salmonella enterica enterica serovar Typhi
gagaagccgauggaaguacug

SEQ ID NO: 3664908 - RNA, 15 nt, Salmonella enterica enterica serovar Typhi
gagaaggucagucca

SEQ ID NO: 3664909 - RNA, 18 nt, Salmonella enterica enterica serovar Typhi
gagaaucaccuggcagcc

SEQ ID NO: 3664910 - RNA, 15 nt, Salmonella enterica enterica serovar Typhi
gagaauccuuccagu

SEQ ID NO: 3664911 - RNA, 17 nt, Salmonella enterica enterica serovar Typhi
gagaaugcgagcaaaac

SEQ ID NO: 3664912 - RNA, 15 nt, Salmonella enterica enterica serovar Typhi
gagaauggaugugaa

SEQ ID NO: 3664913 - RNA, 16 nt, Salmonella enterica enterica serovar Typhi
gagaauggccagcaca

SEQ ID NO: 3664914 - RNA, 19 nt, Salmonella enterica enterica serovar Typhi
gagaaugucgccauaucuu

SEQ ID NO: 3664915 - RNA, 21 nt, Salmonella enterica enterica serovar Typhi
gagacagagaaccugaacaau

SEQ ID NO: 3664916 - RNA, 18 nt, Salmonella enterica enterica serovar Typhi
gagacagcgggcaauggc

SEQ ID NO: 3664917 - RNA, 22 nt, Salmonella enterica enterica serovar Typhi
gagacaggccagaauucagcau

SEQ ID NO: 3664918 - RNA, 16 nt, Salmonella enterica enterica serovar Typhi
gagacaugccgccaga

SEQ ID NO: 3664919 - RNA, 20 nt, Salmonella enterica enterica serovar Typhi
gagaccgggcuuuguugucu

SEQ ID NO: 3664920 - RNA, 19 nt, Salmonella enterica enterica serovar Typhi
gagacuacccaucacgccc

SEQ ID NO: 3664921 - RNA, 14 nt, Salmonella enterica enterica serovar Typhi
gagacucagcagcg

SEQ ID NO: 3664922 - RNA, 20 nt, Salmonella enterica enterica serovar Typhi
gagacuguuugacacuauau

SEQ ID NO: 3664923 - RNA, 12 nt, Salmonella enterica enterica serovar Typhi
gagagaaaaaaa

SEQ ID NO: 3664924 - RNA, 15 nt, Salmonella enterica enterica serovar Typhi
gagagaaaaucacgc

SEQ ID NO: 3664925 - RNA, 13 nt, Salmonella enterica enterica serovar Typhi
gagagcaucaucu

SEQ ID NO: 3664926 - RNA, 18 nt, Salmonella enterica enterica serovar Typhi
gagagcaucaucugccau

SEQ ID NO: 3664927 - RNA, 17 nt, Salmonella enterica enterica serovar Typhi
gagagccuuacaggcgc

SEQ ID NO: 3664928 - RNA, 19 nt, Salmonella enterica enterica serovar Typhi
gagagccuuacaggcgcau

SEQ ID NO: 3664929 - RNA, 23 nt, Salmonella enterica enterica serovar Typhi
gagagccuuacaggcgcaucaga

SEQ ID NO: 3664930 - RNA, 16 nt, Salmonella enterica enterica serovar Typhi
gagagcgggccguggc

SEQ ID NO: 3664931 - RNA, 13 nt, Salmonella enterica enterica serovar Typhi
gagaggaggagau

SEQ ID NO: 3664932 - RNA, 18 nt, Salmonella enterica enterica serovar Typhi
gagaggccaccagcgcca

SEQ ID NO: 3664933 - RNA, 22 nt, Salmonella enterica enterica serovar Typhi
gagaggcugaaggcgcuccccu

SEQ ID NO: 3664934 - RNA, 14 nt, Salmonella enterica enterica serovar Typhi
gagaguccagcgcc

SEQ ID NO: 3664935 - RNA, 15 nt, Salmonella enterica enterica serovar Typhi
gagaguccagcgcca

SEQ ID NO: 3664936 - RNA, 18 nt, Salmonella enterica enterica serovar Typhi
gagagucgauacgcugaa

SEQ ID NO: 3664937 - RNA, 13 nt, Salmonella enterica enterica serovar Typhi
gagagucgccagg

SEQ ID NO: 3664938 - RNA, 20 nt, Salmonella enterica enterica serovar Typhi
gagagucgccaggaucgccg

SEQ ID NO: 3664939 - RNA, 18 nt, Salmonella enterica enterica serovar Typhi
gagaguugaugccggaua

SEQ ID NO: 3664940 - RNA, 20 nt, Salmonella enterica enterica serovar Typhi
gagauaagccgucauaaaau

SEQ ID NO: 3664941 - RNA, 15 nt, Salmonella enterica enterica serovar Typhi
gagauaauuuaugau

SEQ ID NO: 3664942 - RNA, 15 nt, Salmonella enterica enterica serovar Typhi
gagaucagcaguugc

SEQ ID NO: 3664943 - RNA, 21 nt, Salmonella enterica enterica serovar Typhi
gagaucgacaaaccacugcug

SEQ ID NO: 3664944 - RNA, 16 nt, Salmonella enterica enterica serovar Typhi
gagaucgguaauuucc

SEQ ID NO: 3664945 - RNA, 17 nt, Salmonella enterica enterica serovar Typhi
gagaucgguaauuucca

SEQ ID NO: 3664946 - RNA, 18 nt, Salmonella enterica enterica serovar Typhi
gagaucgguaauuuccac

SEQ ID NO: 3664947 - RNA, 20 nt, Salmonella enterica enterica serovar Typhi
gagaucgguaauuuccacgc

SEQ ID NO: 3664948 - RNA, 21 nt, Salmonella enterica enterica serovar Typhi
gagaucguuauuaaacagaca

SEQ ID NO: 3664949 - RNA, 18 nt, Salmonella enterica enterica serovar Typhi
gagaugaucguuuccagc

SEQ ID NO: 3664950 - RNA, 17 nt, Salmonella enterica enterica serovar Typhi
gagaugcaggccaagca

SEQ ID NO: 3664951 - RNA, 23 nt, Salmonella enterica enterica serovar Typhi
gagaugcaggccaagcagcgcca

SEQ ID NO: 3664952 - RNA, 23 nt, Salmonella enterica enterica serovar Typhi
gagauuacugcgugcuggcggcc

SEQ ID NO: 3664953 - RNA, 18 nt, Salmonella enterica enterica serovar Typhi
gagauucaggccgccagc

SEQ ID NO: 3664954 - RNA, 15 nt, Salmonella enterica enterica serovar Typhi
gagauuuaucuucuc

SEQ ID NO: 3664955 - RNA, 17 nt, Salmonella enterica enterica serovar Typhi
gagcaacagaaaccaua

SEQ ID NO: 3664956 - RNA, 20 nt, Salmonella enterica enterica serovar Typhi
gagcaacagaaaccauaaac

SEQ ID NO: 3664957 - RNA, 19 nt, Salmonella enterica enterica serovar Typhi
gagcaacgccaucagcaaa

SEQ ID NO: 3664958 - RNA, 15 nt, Salmonella enterica enterica serovar Typhi
gagcaagcgcauugc

SEQ ID NO: 3664959 - RNA, 15 nt, Salmonella enterica enterica serovar Typhi
gagcaauggcguggc

SEQ ID NO: 3664960 - RNA, 15 nt, Salmonella enterica enterica serovar Typhi
gagcaccacgcgggc

SEQ ID NO: 3664961 - RNA, 16 nt, Salmonella enterica enterica serovar Typhi
gagcacugcccaggac

SEQ ID NO: 3664962 - RNA, 21 nt, Salmonella enterica enterica serovar Typhi
gagcagacuguaaaucugccg

SEQ ID NO: 3664963 - RNA, 19 nt, Salmonella enterica enterica serovar Typhi
gagcagcgccagcgacaga

SEQ ID NO: 3664964 - RNA, 11 nt, Salmonella enterica enterica serovar Typhi
gagcaggccag

SEQ ID NO: 3664965 - RNA, 22 nt, Salmonella enterica enterica serovar Typhi
gagcaggggcuccugcgccgga

SEQ ID NO: 3664966 - RNA, 18 nt, Salmonella enterica enterica serovar Typhi
gagcagguuacucuucca

SEQ ID NO: 3664967 - RNA, 19 nt, Salmonella enterica enterica serovar Typhi
gagcagguuacucuuccac

SEQ ID NO: 3664968 - RNA, 18 nt, Salmonella enterica enterica serovar Typhi
gagcagugauuuuaucuc

SEQ ID NO: 3664969 - RNA, 15 nt, Salmonella enterica enterica serovar Typhi
gagcaguucagcagc

SEQ ID NO: 3664970 - RNA, 21 nt, Salmonella enterica enterica serovar Typhi
gagcaguuuuacguggacgcc

SEQ ID NO: 3664971 - RNA, 15 nt, Salmonella enterica enterica serovar Typhi
gagcauaugcgcugc

SEQ ID NO: 3664972 - RNA, 18 nt, Salmonella enterica enterica serovar Typhi
gagcaucagcgccggauc

SEQ ID NO: 3664973 - RNA, 16 nt, Salmonella enterica enterica serovar Typhi
gagcauccagaucggc

SEQ ID NO: 3664974 - RNA, 14 nt, Salmonella enterica enterica serovar Typhi
gagcauuggaaauu

SEQ ID NO: 3664975 - RNA, 15 nt, Salmonella enterica enterica serovar Typhi
gagccaaacacuucc

SEQ ID NO: 3664976 - RNA, 23 nt, Salmonella enterica enterica serovar Typhi
gagccaccggcagggccaguucu

SEQ ID NO: 3664977 - RNA, 19 nt, Salmonella enterica enterica serovar Typhi
gagccacuauccagucagc

SEQ ID NO: 3664978 - RNA, 19 nt, Salmonella enterica enterica serovar Typhi
gagccauuaaugcaggcag

SEQ ID NO: 3664979 - RNA, 21 nt, Salmonella enterica enterica serovar Typhi
gagcccugugcgguauugaua

SEQ ID NO: 3664980 - RNA, 15 nt, Salmonella enterica enterica serovar Typhi
gagccgauauccgga

SEQ ID NO: 3664981 - RNA, 20 nt, Salmonella enterica enterica serovar Typhi
gagccgcccggcgcgcugga

SEQ ID NO: 3664982 - RNA, 23 nt, Salmonella enterica enterica serovar Typhi
gagccggacacugcgagggauuu

SEQ ID NO: 3664983 - RNA, 17 nt, Salmonella enterica enterica serovar Typhi
gagccgucgcuaucaau

SEQ ID NO: 3664984 - RNA, 17 nt, Salmonella enterica enterica serovar Typhi
gagccuguuccagcugc

SEQ ID NO: 3664985 - RNA, 14 nt, Salmonella enterica enterica serovar Typhi
gagccuuacaggcg

SEQ ID NO: 3664986 - RNA, 20 nt, Salmonella enterica enterica serovar Typhi
gagcgaacaguacggucagg

SEQ ID NO: 3664987 - RNA, 21 nt, Salmonella enterica enterica serovar Typhi
gagcgaaggggcgggcagcag

SEQ ID NO: 3664988 - RNA, 16 nt, Salmonella enterica enterica serovar Typhi
gagcgaauguauaauc

SEQ ID NO: 3664989 - RNA, 21 nt, Salmonella enterica enterica serovar Typhi
gagcgacaaugaaccagccca

SEQ ID NO: 3664990 - RNA, 14 nt, Salmonella enterica enterica serovar Typhi
gagcgacagcccgg

SEQ ID NO: 3664991 - RNA, 15 nt, Salmonella enterica enterica serovar Typhi
gagcgacgcccugcc

SEQ ID NO: 3664992 - RNA, 16 nt, Salmonella enterica enterica serovar Typhi
gagcgacgcccugccc

SEQ ID NO: 3664993 - RNA, 21 nt, Salmonella enterica enterica serovar Typhi
gagcgacgguuuuauccccuu

SEQ ID NO: 3664994 - RNA, 17 nt, Salmonella enterica enterica serovar Typhi
gagcgacgucccgucag

SEQ ID NO: 3664995 - RNA, 13 nt, Salmonella enterica enterica serovar Typhi
gagcgcaaacauc

SEQ ID NO: 3664996 - RNA, 19 nt, Salmonella enterica enterica serovar Typhi
gagcgcauccggccagcga

SEQ ID NO: 3664997 - RNA, 13 nt, Salmonella enterica enterica serovar Typhi
gagcgccaaaaag

SEQ ID NO: 3664998 - RNA, 17 nt, Salmonella enterica enterica serovar Typhi
gagcgccagcaacagcg

SEQ ID NO: 3664999 - RNA, 13 nt, Salmonella enterica enterica serovar Typhi
gagcgccagcccc

SEQ ID NO: 3665000 - RNA, 16 nt, Salmonella enterica enterica serovar Typhi
gagcgccguaccgcgu

SEQ ID NO: 3665001 - RNA, 16 nt, Salmonella enterica enterica serovar Typhi
gagcgccucugauuuu

SEQ ID NO: 3665002 - RNA, 14 nt, Salmonella enterica enterica serovar Typhi
gagcgccugaugcc

SEQ ID NO: 3665003 - RNA, 15 nt, Salmonella enterica enterica serovar Typhi
gagcgcgaaaucaaa

SEQ ID NO: 3665004 - RNA, 14 nt, Salmonella enterica enterica serovar Typhi
gagcgcgcgcgccu

SEQ ID NO: 3665005 - RNA, 12 nt, Salmonella enterica enterica serovar Typhi
gagcgcgcuggc

SEQ ID NO: 3665006 - RNA, 13 nt, Salmonella enterica enterica serovar Typhi
gagcgcgcuggca

SEQ ID NO: 3665007 - RNA, 16 nt, Salmonella enterica enterica serovar Typhi
gagcgcgucagcgccu

SEQ ID NO: 3665008 - RNA, 17 nt, Salmonella enterica enterica serovar Typhi
gagcgcguccagacguu

SEQ ID NO: 3665009 - RNA, 19 nt, Salmonella enterica enterica serovar Typhi
gagcggagagagcgcuucc

SEQ ID NO: 3665010 - RNA, 20 nt, Salmonella enterica enterica serovar Typhi
gagcggagagagcgcuucca

SEQ ID NO: 3665011 - RNA, 19 nt, Salmonella enterica enterica serovar Typhi
gagcggauaauccgccacu

SEQ ID NO: 3665012 - RNA, 14 nt, Salmonella enterica enterica serovar Typhi
gagcggcacgccga

SEQ ID NO: 3665013 - RNA, 13 nt, Salmonella enterica enterica serovar Typhi
gagcggccagcgg

SEQ ID NO: 3665014 - RNA, 22 nt, Salmonella enterica enterica serovar Typhi
gagcggcgacuagucgcccgcu

SEQ ID NO: 3665015 - RNA, 16 nt, Salmonella enterica enterica serovar Typhi
gagcgguaagagccag

SEQ ID NO: 3665016 - RNA, 15 nt, Salmonella enterica enterica serovar Typhi
gagcggucaggccag

SEQ ID NO: 3665017 - RNA, 20 nt, Salmonella enterica enterica serovar Typhi
gagcguaaugguggcaaccu

SEQ ID NO: 3665018 - RNA, 17 nt, Salmonella enterica enterica serovar Typhi
gagcgugaucucauugg

SEQ ID NO: 3665019 - RNA, 21 nt, Salmonella enterica enterica serovar Typhi
gagcguuacccagacagcaaa

SEQ ID NO: 3665020 - RNA, 19 nt, Salmonella enterica enterica serovar Typhi
gagcguucgcguagcgccc

SEQ ID NO: 3665021 - RNA, 22 nt, Salmonella enterica enterica serovar Typhi
gagcuaaucaauaaguuuuuuc

SEQ ID NO: 3665022 - RNA, 18 nt, Salmonella enterica enterica serovar Typhi
gagcuaaucacccacuuc

SEQ ID NO: 3665023 - RNA, 12 nt, Salmonella enterica enterica serovar Typhi
gagcucagucca

SEQ ID NO: 3665024 - RNA, 13 nt, Salmonella enterica enterica serovar Typhi
gagcugcgguggu

SEQ ID NO: 3665025 - RNA, 14 nt, Salmonella enterica enterica serovar Typhi
gagcuggauaagcu

SEQ ID NO: 3665026 - RNA, 22 nt, Salmonella enterica enterica serovar Typhi
gagcuggcacgcgaugucggga

SEQ ID NO: 3665027 - RNA, 18 nt, Salmonella enterica enterica serovar Typhi
gagcuguagcgaagggua

SEQ ID NO: 3665028 - RNA, 18 nt, Salmonella enterica enterica serovar Typhi
gagcuuugacgacccgcu

SEQ ID NO: 3665029 - RNA, 13 nt, Salmonella enterica enterica serovar Typhi
gaggaaaccuuuc

SEQ ID NO: 3665030 - RNA, 18 nt, Salmonella enterica enterica serovar Typhi
gaggaaaccuuucuucuc

SEQ ID NO: 3665031 - RNA, 15 nt, Salmonella enterica enterica serovar Typhi
gaggaacaucagcca

SEQ ID NO: 3665032 - RNA, 20 nt, Salmonella enterica enterica serovar Typhi
gaggaagcugcgcagcacuu

SEQ ID NO: 3665033 - RNA, 15 nt, Salmonella enterica enterica serovar Typhi
gaggacauuaaaguc

SEQ ID NO: 3665034 - RNA, 19 nt, Salmonella enterica enterica serovar Typhi
gaggacuguacaagaaggg

SEQ ID NO: 3665035 - RNA, 16 nt, Salmonella enterica enterica serovar Typhi
gaggauaaaaucgcca

SEQ ID NO: 3665036 - RNA, 17 nt, Salmonella enterica enterica serovar Typhi
gaggauaaaaucgccaa

SEQ ID NO: 3665037 - RNA, 22 nt, Salmonella enterica enterica serovar Typhi
gaggauauuuauuugcauugua

SEQ ID NO: 3665038 - RNA, 23 nt, Salmonella enterica enterica serovar Typhi
gaggcaggggcucuaaaaaggaa

SEQ ID NO: 3665039 - RNA, 13 nt, Salmonella enterica enterica serovar Typhi
gaggcauaaaaaa

SEQ ID NO: 3665040 - RNA, 20 nt, Salmonella enterica enterica serovar Typhi
gaggcauaccgcccagaacg

SEQ ID NO: 3665041 - RNA, 16 nt, Salmonella enterica enterica serovar Typhi
gaggccaccagcgcca

SEQ ID NO: 3665042 - RNA, 18 nt, Salmonella enterica enterica serovar Typhi
gaggccagauucaccacc

SEQ ID NO: 3665043 - RNA, 23 nt, Salmonella enterica enterica serovar Typhi
gaggccguuauugucaugcuaaa

SEQ ID NO: 3665044 - RNA, 20 nt, Salmonella enterica enterica serovar Typhi
gaggcgcuggcuugaccgcu

SEQ ID NO: 3665045 - RNA, 15 nt, Salmonella enterica enterica serovar Typhi
gaggcguaucccagu

SEQ ID NO: 3665046 - RNA, 14 nt, Salmonella enterica enterica serovar Typhi
gaggcuaagccaga

SEQ ID NO: 3665047 - RNA, 23 nt, Salmonella enterica enterica serovar Typhi
gaggcuaccguucagaucgccaa

SEQ ID NO: 3665048 - RNA, 22 nt, Salmonella enterica enterica serovar Typhi
gaggggcuuugugccgcacaga

SEQ ID NO: 3665049 - RNA, 22 nt, Salmonella enterica enterica serovar Typhi
gaggguuuucaauuccacaggc

SEQ ID NO: 3665050 - RNA, 19 nt, Salmonella enterica enterica serovar Typhi
gagguaguccugcucaugc

SEQ ID NO: 3665051 - RNA, 16 nt, Salmonella enterica enterica serovar Typhi
gaggucauuauucagg

SEQ ID NO: 3665052 - RNA, 13 nt, Salmonella enterica enterica serovar Typhi
gaggucucagguu

SEQ ID NO: 3665053 - RNA, 23 nt, Salmonella enterica enterica serovar Typhi
gaggucugcauucaggccucugc

SEQ ID NO: 3665054 - RNA, 18 nt, Salmonella enterica enterica serovar Typhi
gaggugacggaggcgggc

SEQ ID NO: 3665055 - RNA, 12 nt, Salmonella enterica enterica serovar Typhi
gaggugauaauc

SEQ ID NO: 3665056 - RNA, 15 nt, Salmonella enterica enterica serovar Typhi
gaggugcucucccag

SEQ ID NO: 3665057 - RNA, 22 nt, Salmonella enterica enterica serovar Typhi
gaggugcucucccagcugagcu

SEQ ID NO: 3665058 - RNA, 14 nt, Salmonella enterica enterica serovar Typhi
gaggugcugguggu

SEQ ID NO: 3665059 - RNA, 18 nt, Salmonella enterica enterica serovar Typhi
gagguucccgccgccauu

SEQ ID NO: 3665060 - RNA, 19 nt, Salmonella enterica enterica serovar Typhi
gagguucgccucccucacc

SEQ ID NO: 3665061 - RNA, 13 nt, Salmonella enterica enterica serovar Typhi
gagguugcggaua

SEQ ID NO: 3665062 - RNA, 18 nt, Salmonella enterica enterica serovar Typhi
gagguuuucucauccagc

SEQ ID NO: 3665063 - RNA, 15 nt, Salmonella enterica enterica serovar Typhi
gaguaaaaccggcac

SEQ ID NO: 3665064 - RNA, 23 nt, Salmonella enterica enterica serovar Typhi
gaguaaaguuauucacguagggu

SEQ ID NO: 3665065 - RNA, 16 nt, Salmonella enterica enterica serovar Typhi
gaguaaauaaaucagc

SEQ ID NO: 3665066 - RNA, 14 nt, Salmonella enterica enterica serovar Typhi
gaguaacgggcagc

SEQ ID NO: 3665067 - RNA, 22 nt, Salmonella enterica enterica serovar Typhi
gaguaagcccaaaggaaagguc

SEQ ID NO: 3665068 - RNA, 19 nt, Salmonella enterica enterica serovar Typhi
gaguaauaacaaaaaacau

SEQ ID NO: 3665069 - RNA, 20 nt, Salmonella enterica enterica serovar Typhi
gaguaaucacuaacugacca

SEQ ID NO: 3665070 - RNA, 18 nt, Salmonella enterica enterica serovar Typhi
gaguaauccauagccaac

SEQ ID NO: 3665071 - RNA, 16 nt, Salmonella enterica enterica serovar Typhi
gaguaaugaccacacc

SEQ ID NO: 3665072 - RNA, 12 nt, Salmonella enterica enterica serovar Typhi
gaguagauguag

SEQ ID NO: 3665073 - RNA, 21 nt, Salmonella enterica enterica serovar Typhi
gaguagcgcagcuugguagcg

SEQ ID NO: 3665074 - RNA, 16 nt, Salmonella enterica enterica serovar Typhi
gaguaguuaaaaaagg

SEQ ID NO: 3665075 - RNA, 13 nt, Salmonella enterica enterica serovar Typhi
gaguaugaacagg

SEQ ID NO: 3665076 - RNA, 18 nt, Salmonella enterica enterica serovar Typhi
gaguaugaacaggcagcg

SEQ ID NO: 3665077 - RNA, 21 nt, Salmonella enterica enterica serovar Typhi
gaguaugcccgcgagagauua

SEQ ID NO: 3665078 - RNA, 14 nt, Salmonella enterica enterica serovar Typhi
gaguaugcggucaa

SEQ ID NO: 3665079 - RNA, 21 nt, Salmonella enterica enterica serovar Typhi
gaguauuuaccuacuguggug

SEQ ID NO: 3665080 - RNA, 22 nt, Salmonella enterica enterica serovar Typhi
gaguauuuaccuacuguggugu

SEQ ID NO: 3665081 - RNA, 18 nt, Salmonella enterica enterica serovar Typhi
gagucaaaagauugauuu

SEQ ID NO: 3665082 - RNA, 17 nt, Salmonella enterica enterica serovar Typhi
gagucaaggcauccagc

SEQ ID NO: 3665083 - RNA, 18 nt, Salmonella enterica enterica serovar Typhi
gagucaaggcauccagca

SEQ ID NO: 3665084 - RNA, 18 nt, Salmonella enterica enterica serovar Typhi
gagucagacaccagcccu

SEQ ID NO: 3665085 - RNA, 15 nt, Salmonella enterica enterica serovar Typhi
gaguccagcggcagc

SEQ ID NO: 3665086 - RNA, 14 nt, Salmonella enterica enterica serovar Typhi
gaguccauuuccuc

SEQ ID NO: 3665087 - RNA, 19 nt, Salmonella enterica enterica serovar Typhi
gaguccccucaaacaggcu

SEQ ID NO: 3665088 - RNA, 16 nt, Salmonella enterica enterica serovar Typhi
gaguccugccggacug

SEQ ID NO: 3665089 - RNA, 21 nt, Salmonella enterica enterica serovar Typhi
gagucgacugguaggccugau

SEQ ID NO: 3665090 - RNA, 18 nt, Salmonella enterica enterica serovar Typhi
gagucgauagaucgccac

SEQ ID NO: 3665091 - RNA, 15 nt, Salmonella enterica enterica serovar Typhi
gagucgcgcgcgcca

SEQ ID NO: 3665092 - RNA, 14 nt, Salmonella enterica enterica serovar Typhi
gagucuacaucaag

SEQ ID NO: 3665093 - RNA, 19 nt, Salmonella enterica enterica serovar Typhi
gagucuacaucaagagaaa

SEQ ID NO: 3665094 - RNA, 19 nt, Salmonella enterica enterica serovar Typhi
gagucugaaaacucacgcc

SEQ ID NO: 3665095 - RNA, 20 nt, Salmonella enterica enterica serovar Typhi
gagucuuauccgacugacca

SEQ ID NO: 3665096 - RNA, 11 nt, Salmonella enterica enterica serovar Typhi
gagugaacacg

SEQ ID NO: 3665097 - RNA, 18 nt, Salmonella enterica enterica serovar Typhi
gagugacgguuuucacug

SEQ ID NO: 3665098 - RNA, 21 nt, Salmonella enterica enterica serovar Typhi
gagugcgcggcgaaaaagccg

SEQ ID NO: 3665099 - RNA, 15 nt, Salmonella enterica enterica serovar Typhi
gagugcguucuucca

SEQ ID NO: 3665100 - RNA, 19 nt, Salmonella enterica enterica serovar Typhi
gagugcguucuuccacuuc

SEQ ID NO: 3665101 - RNA, 20 nt, Salmonella enterica enterica serovar Typhi
gagugcuuauguaggccuga

SEQ ID NO: 3665102 - RNA, 22 nt, Salmonella enterica enterica serovar Typhi
gaguggaugacaucgcaaugcc

SEQ ID NO: 3665103 - RNA, 17 nt, Salmonella enterica enterica serovar Typhi
gaguggcgaaauuggua

SEQ ID NO: 3665104 - RNA, 19 nt, Salmonella enterica enterica serovar Typhi
gaguguggaaaacagcgcc

SEQ ID NO: 3665105 - RNA, 20 nt, Salmonella enterica enterica serovar Typhi
gaguguggaaaacagcgccg

SEQ ID NO: 3665106 - RNA, 16 nt, Salmonella enterica enterica serovar Typhi
gaguguuggucuuggu

SEQ ID NO: 3665107 - RNA, 20 nt, Salmonella enterica enterica serovar Typhi
gaguuaacuucuccgccauc

SEQ ID NO: 3665108 - RNA, 17 nt, Salmonella enterica enterica serovar Typhi
gaguuaguggucauauu

SEQ ID NO: 3665109 - RNA, 13 nt, Salmonella enterica enterica serovar Typhi
gaguuccggauac

SEQ ID NO: 3665110 - RNA, 18 nt, Salmonella enterica enterica serovar Typhi
gaguucguuaaucucaaa

SEQ ID NO: 3665111 - RNA, 16 nt, Salmonella enterica enterica serovar Typhi
gaguuugcaauccaga

SEQ ID NO: 3665112 - RNA, 10 nt, Salmonella enterica enterica serovar Typhi
gaguuuuaac

SEQ ID NO: 3665113 - RNA, 11 nt, Salmonella enterica enterica serovar Typhi
gauaaaaaaag

SEQ ID NO: 3665114 - RNA, 13 nt, Salmonella enterica enterica serovar Typhi
gauaaaaaaagua

SEQ ID NO: 3665115 - RNA, 14 nt, Salmonella enterica enterica serovar Typhi
gauaaaaaaaguau

SEQ ID NO: 3665116 - RNA, 22 nt, Salmonella enterica enterica serovar Typhi
gauaaaaacccaccagcgccag

SEQ ID NO: 3665117 - RNA, 16 nt, Salmonella enterica enterica serovar Typhi
gauaaaaagcaaagag

SEQ ID NO: 3665118 - RNA, 16 nt, Salmonella enterica enterica serovar Typhi
gauaaaacgcaggcag

SEQ ID NO: 3665119 - RNA, 15 nt, Salmonella enterica enterica serovar Typhi
gauaaaauaaacacu

SEQ ID NO: 3665120 - RNA, 16 nt, Salmonella enterica enterica serovar Typhi
gauaaacaccggaauu

SEQ ID NO: 3665121 - RNA, 14 nt, Salmonella enterica enterica serovar Typhi
gauaaacagcagcg

SEQ ID NO: 3665122 - RNA, 15 nt, Salmonella enterica enterica serovar Typhi
gauaaaccaacagcc

SEQ ID NO: 3665123 - RNA, 22 nt, Salmonella enterica enterica serovar Typhi
gauaaaccaacagccgccuguu

SEQ ID NO: 3665124 - RNA, 15 nt, Salmonella enterica enterica serovar Typhi
gauaaaccaggcagc

SEQ ID NO: 3665125 - RNA, 21 nt, Salmonella enterica enterica serovar Typhi
gauaaacccguaaagcauucc

SEQ ID NO: 3665126 - RNA, 19 nt, Salmonella enterica enterica serovar Typhi
gauaaacgcgucuucauca

SEQ ID NO: 3665127 - RNA, 18 nt, Salmonella enterica enterica serovar Typhi
gauaaagauauucuccuc

SEQ ID NO: 3665128 - RNA, 17 nt, Salmonella enterica enterica serovar Typhi
gauaaagcagcgacaau

SEQ ID NO: 3665129 - RNA, 14 nt, Salmonella enterica enterica serovar Typhi
gauaaagcgaauaa

SEQ ID NO: 3665130 - RNA, 20 nt, Salmonella enterica enterica serovar Typhi
gauaaagcgaccgaucauca

SEQ ID NO: 3665131 - RNA, 17 nt, Salmonella enterica enterica serovar Typhi
gauaaagcuuucaucuu

SEQ ID NO: 3665132 - RNA, 16 nt, Salmonella enterica enterica serovar Typhi
gauaaaggauaauagu

SEQ ID NO: 3665133 - RNA, 12 nt, Salmonella enterica enterica serovar Typhi
gauaaaucagcc

SEQ ID NO: 3665134 - RNA, 19 nt, Salmonella enterica enterica serovar Typhi
gauaacaguauuuguucag

SEQ ID NO: 3665135 - RNA, 22 nt, Salmonella enterica enterica serovar Typhi
gauaaccagaaaaccgacagca

SEQ ID NO: 3665136 - RNA, 20 nt, Salmonella enterica enterica serovar Typhi
gauaaccagcgcgccgccaa

SEQ ID NO: 3665137 - RNA, 20 nt, Salmonella enterica enterica serovar Typhi
gauaaccaggucaccggaaa

SEQ ID NO: 3665138 - RNA, 16 nt, Salmonella enterica enterica serovar Typhi
gauaaccgcccgcggc

SEQ ID NO: 3665139 - RNA, 17 nt, Salmonella enterica enterica serovar Typhi
gauaaccuauuuugcaa

SEQ ID NO: 3665140 - RNA, 13 nt, Salmonella enterica enterica serovar Typhi
gauaaccugcugu

SEQ ID NO: 3665141 - RNA, 16 nt, Salmonella enterica enterica serovar Typhi
gauaaccugcugugac

SEQ ID NO: 3665142 - RNA, 16 nt, Salmonella enterica enterica serovar Typhi
gauaaccuucuucguu

SEQ ID NO: 3665143 - RNA, 15 nt, Salmonella enterica enterica serovar Typhi
gauaacgcaacaaca

SEQ ID NO: 3665144 - RNA, 14 nt, Salmonella enterica enterica serovar Typhi
gauaacgcgcuggc

SEQ ID NO: 3665145 - RNA, 15 nt, Salmonella enterica enterica serovar Typhi
gauaacgcgcuggcg

SEQ ID NO: 3665146 - RNA, 17 nt, Salmonella enterica enterica serovar Typhi
gauaacggaugacagca

SEQ ID NO: 3665147 - RNA, 12 nt, Salmonella enterica enterica serovar Typhi
gauaacggcgca

SEQ ID NO: 3665148 - RNA, 20 nt, Salmonella enterica enterica serovar Typhi
gauaacggucgcucccuacc

SEQ ID NO: 3665149 - RNA, 15 nt, Salmonella enterica enterica serovar Typhi
gauaacguauuucuu

SEQ ID NO: 3665150 - RNA, 13 nt, Salmonella enterica enterica serovar Typhi
gauaacucuucau

SEQ ID NO: 3665151 - RNA, 23 nt, Salmonella enterica enterica serovar Typhi
gauaacugaagguuuuucccgga

SEQ ID NO: 3665152 - RNA, 23 nt, Salmonella enterica enterica serovar Typhi
gauaacuuccuuugccuuucuua

SEQ ID NO: 3665153 - RNA, 19 nt, Salmonella enterica enterica serovar Typhi
gauaagaaagauaaaauac

SEQ ID NO: 3665154 - RNA, 19 nt, Salmonella enterica enterica serovar Typhi
gauaagaaguaaacagaau

SEQ ID NO: 3665155 - RNA, 22 nt, Salmonella enterica enterica serovar Typhi
gauaagacgcgaagcggcgcua

SEQ ID NO: 3665156 - RNA, 22 nt, Salmonella enterica enterica serovar Typhi
gauaagacugauauccauuggg

SEQ ID NO: 3665157 - RNA, 13 nt, Salmonella enterica enterica serovar Typhi
gauaagagaaaau

SEQ ID NO: 3665158 - RNA, 16 nt, Salmonella enterica enterica serovar Typhi
gauaagcaacgcgcca

SEQ ID NO: 3665159 - RNA, 23 nt, Salmonella enterica enterica serovar Typhi
gauaagcaacgcgccauccggca

SEQ ID NO: 3665160 - RNA, 14 nt, Salmonella enterica enterica serovar Typhi
gauaagcacaggcc

SEQ ID NO: 3665161 - RNA, 20 nt, Salmonella enterica enterica serovar Typhi
gauaagcaccguaaacggcu

SEQ ID NO: 3665162 - RNA, 16 nt, Salmonella enterica enterica serovar Typhi
gauaagcauagcgcca

SEQ ID NO: 3665163 - RNA, 21 nt, Salmonella enterica enterica serovar Typhi
gauaagcauuagcgccauccg

SEQ ID NO: 3665164 - RNA, 23 nt, Salmonella enterica enterica serovar Typhi
gauaagccagcgaugagcgccag

SEQ ID NO: 3665165 - RNA, 12 nt, Salmonella enterica enterica serovar Typhi
gauaagccuccg

SEQ ID NO: 3665166 - RNA, 21 nt, Salmonella enterica enterica serovar Typhi
gauaagccugugcgccugcug

SEQ ID NO: 3665167 - RNA, 16 nt, Salmonella enterica enterica serovar Typhi
gauaagcgaagcgcca

SEQ ID NO: 3665168 - RNA, 20 nt, Salmonella enterica enterica serovar Typhi
gauaagcgaagcgucauccg

SEQ ID NO: 3665169 - RNA, 16 nt, Salmonella enterica enterica serovar Typhi
gauaagcgcagcgcca

SEQ ID NO: 3665170 - RNA, 17 nt, Salmonella enterica enterica serovar Typhi
gauaagcgcagcgccau

SEQ ID NO: 3665171 - RNA, 20 nt, Salmonella enterica enterica serovar Typhi
gauaagcgcagcgccaucag

SEQ ID NO: 3665172 - RNA, 20 nt, Salmonella enterica enterica serovar Typhi
gauaagcguagcgccaucag

SEQ ID NO: 3665173 - RNA, 15 nt, Salmonella enterica enterica serovar Typhi
gauaagcgucagcgu

SEQ ID NO: 3665174 - RNA, 20 nt, Salmonella enterica enterica serovar Typhi
gauaagcgugcgccauccgg

SEQ ID NO: 3665175 - RNA, 19 nt, Salmonella enterica enterica serovar Typhi
gauaagcuaguaaagaaau

SEQ ID NO: 3665176 - RNA, 18 nt, Salmonella enterica enterica serovar Typhi
gauaaggcauucacgcca

SEQ ID NO: 3665177 - RNA, 23 nt, Salmonella enterica enterica serovar Typhi
gauaaggcggagccgccauccgg

SEQ ID NO: 3665178 - RNA, 22 nt, Salmonella enterica enterica serovar Typhi
gauaaggcguaaccgccauccg

SEQ ID NO: 3665179 - RNA, 19 nt, Salmonella enterica enterica serovar Typhi
gauaagguaaagccgccau

SEQ ID NO: 3665180 - RNA, 19 nt, Salmonella enterica enterica serovar Typhi
gauaaggucgcuauccagc

SEQ ID NO: 3665181 - RNA, 22 nt, Salmonella enterica enterica serovar Typhi
gauaagguguuuacgccgccau

SEQ ID NO: 3665182 - RNA, 21 nt, Salmonella enterica enterica serovar Typhi
gauaaguccuaacaccugcca

SEQ ID NO: 3665183 - RNA, 16 nt, Salmonella enterica enterica serovar Typhi
gauaauaagacgccag

SEQ ID NO: 3665184 - RNA, 14 nt, Salmonella enterica enterica serovar Typhi
gauaauaaucauau

SEQ ID NO: 3665185 - RNA, 17 nt, Salmonella enterica enterica serovar Typhi
gauaauacauugccgca

SEQ ID NO: 3665186 - RNA, 17 nt, Salmonella enterica enterica serovar Typhi
gauaauaccucaaaugc

SEQ ID NO: 3665187 - RNA, 16 nt, Salmonella enterica enterica serovar Typhi
gauaauagaaccgaau

SEQ ID NO: 3665188 - RNA, 17 nt, Salmonella enterica enterica serovar Typhi
gauaauaguggugcgca

SEQ ID NO: 3665189 - RNA, 22 nt, Salmonella enterica enterica serovar Typhi
gauaaucaauggccuugccagc

SEQ ID NO: 3665190 - RNA, 13 nt, Salmonella enterica enterica serovar Typhi
gauaaucaccagc

SEQ ID NO: 3665191 - RNA, 21 nt, Salmonella enterica enterica serovar Typhi
gauaaucacggcggaggccga

SEQ ID NO: 3665192 - RNA, 14 nt, Salmonella enterica enterica serovar Typhi
gauaaucagcagcg

SEQ ID NO: 3665193 - RNA, 18 nt, Salmonella enterica enterica serovar Typhi
gauaaucgccgccagcuc

SEQ ID NO: 3665194 - RNA, 20 nt, Salmonella enterica enterica serovar Typhi
gauaauggcgccgauaacac

SEQ ID NO: 3665195 - RNA, 23 nt, Salmonella enterica enterica serovar Typhi
gauaauguauuaucgaugcgcca

SEQ ID NO: 3665196 - RNA, 20 nt, Salmonella enterica enterica serovar Typhi
gauaauguuggauuauacau

SEQ ID NO: 3665197 - RNA, 16 nt, Salmonella enterica enterica serovar Typhi
gauaauucccccagua

SEQ ID NO: 3665198 - RNA, 22 nt, Salmonella enterica enterica serovar Typhi
gauaauuuucccaguucaucca

SEQ ID NO: 3665199 - RNA, 17 nt, Salmonella enterica enterica serovar Typhi
gauaauuuuucagacgu

SEQ ID NO: 3665200 - RNA, 18 nt, Salmonella enterica enterica serovar Typhi
gauacacgccuuccucca

SEQ ID NO: 3665201 - RNA, 18 nt, Salmonella enterica enterica serovar Typhi
gauacagaaaaccggcaa

SEQ ID NO: 3665202 - RNA, 13 nt, Salmonella enterica enterica serovar Typhi
gauacagcagcac

SEQ ID NO: 3665203 - RNA, 15 nt, Salmonella enterica enterica serovar Typhi
gauacagcagcaccu

SEQ ID NO: 3665204 - RNA, 20 nt, Salmonella enterica enterica serovar Typhi
gauacagccgacuauuccgc

SEQ ID NO: 3665205 - RNA, 17 nt, Salmonella enterica enterica serovar Typhi
gauacaggacugacugc

SEQ ID NO: 3665206 - RNA, 18 nt, Salmonella enterica enterica serovar Typhi
gauacauggcuauuccac

SEQ ID NO: 3665207 - RNA, 17 nt, Salmonella enterica enterica serovar Typhi
gauaccagucgacagua

SEQ ID NO: 3665208 - RNA, 19 nt, Salmonella enterica enterica serovar Typhi
gauacccagcgucccggcg

SEQ ID NO: 3665209 - RNA, 20 nt, Salmonella enterica enterica serovar Typhi
gauacccagcgucccggcgu

SEQ ID NO: 3665210 - RNA, 16 nt, Salmonella enterica enterica serovar Typhi
gauacccccuaucugg

SEQ ID NO: 3665211 - RNA, 17 nt, Salmonella enterica enterica serovar Typhi
gauacccgcccagauca

SEQ ID NO: 3665212 - RNA, 16 nt, Salmonella enterica enterica serovar Typhi
gauaccgcgccagcga

SEQ ID NO: 3665213 - RNA, 22 nt, Salmonella enterica enterica serovar Typhi
gauaccggaggagugcgccagu

SEQ ID NO: 3665214 - RNA, 14 nt, Salmonella enterica enterica serovar Typhi
gauaccggccgccc

SEQ ID NO: 3665215 - RNA, 21 nt, Salmonella enterica enterica serovar Typhi
gauaccguaauaaguaucagc

SEQ ID NO: 3665216 - RNA, 22 nt, Salmonella enterica enterica serovar Typhi
gauaccuaaacgcgucagaaau

SEQ ID NO: 3665217 - RNA, 17 nt, Salmonella enterica enterica serovar Typhi
gauacgauguaaaaaug

SEQ ID NO: 3665218 - RNA, 15 nt, Salmonella enterica enterica serovar Typhi
gauacgauugcgcgu

SEQ ID NO: 3665219 - RNA, 19 nt, Salmonella enterica enterica serovar Typhi
gauacgauugcgcguguua

SEQ ID NO: 3665220 - RNA, 21 nt, Salmonella enterica enterica serovar Typhi
gauacgcagcaccgccgcgau

SEQ ID NO: 3665221 - RNA, 14 nt, Salmonella enterica enterica serovar Typhi
gauacgccagcaga

SEQ ID NO: 3665222 - RNA, 14 nt, Salmonella enterica enterica serovar Typhi
gauacgccagguua

SEQ ID NO: 3665223 - RNA, 20 nt, Salmonella enterica enterica serovar Typhi
gauacgcgucaaagcacaug

SEQ ID NO: 3665224 - RNA, 18 nt, Salmonella enterica enterica serovar Typhi
gauacgcgucaaauagag

SEQ ID NO: 3665225 - RNA, 20 nt, Salmonella enterica enterica serovar Typhi
gauacgcugcgucaggcgau

SEQ ID NO: 3665226 - RNA, 20 nt, Salmonella enterica enterica serovar Typhi
gauacggauagcgucaacgc

SEQ ID NO: 3665227 - RNA, 15 nt, Salmonella enterica enterica serovar Typhi
gauacggcugucagg

SEQ ID NO: 3665228 - RNA, 22 nt, Salmonella enterica enterica serovar Typhi
gauacgggaucgauaauugcuc

SEQ ID NO: 3665229 - RNA, 17 nt, Salmonella enterica enterica serovar Typhi
gauacggguaaucagac

SEQ ID NO: 3665230 - RNA, 14 nt, Salmonella enterica enterica serovar Typhi
gauacguuccagca

SEQ ID NO: 3665231 - RNA, 17 nt, Salmonella enterica enterica serovar Typhi
gauacguuuaaaaugaa

SEQ ID NO: 3665232 - RNA, 12 nt, Salmonella enterica enterica serovar Typhi
gauacugcaacg

SEQ ID NO: 3665233 - RNA, 21 nt, Salmonella enterica enterica serovar Typhi
gauagacagcaccaucaugca

SEQ ID NO: 3665234 - RNA, 15 nt, Salmonella enterica enterica serovar Typhi
gauagacaugaccgg

SEQ ID NO: 3665235 - RNA, 19 nt, Salmonella enterica enterica serovar Typhi
gauagacggcugaauguuc

SEQ ID NO: 3665236 - RNA, 18 nt, Salmonella enterica enterica serovar Typhi
gauagagacugccgccgu

SEQ ID NO: 3665237 - RNA, 19 nt, Salmonella enterica enterica serovar Typhi
gauagagaguuccuccugg

SEQ ID NO: 3665238 - RNA, 23 nt, Salmonella enterica enterica serovar Typhi
gauagagcgccugcaggcgacuc

SEQ ID NO: 3665239 - RNA, 16 nt, Salmonella enterica enterica serovar Typhi
gauagagguuaccggg

SEQ ID NO: 3665240 - RNA, 12 nt, Salmonella enterica enterica serovar Typhi
gauagaugaaga

SEQ ID NO: 3665241 - RNA, 16 nt, Salmonella enterica enterica serovar Typhi
gauagcaauuaauaaa

SEQ ID NO: 3665242 - RNA, 12 nt, Salmonella enterica enterica serovar Typhi
gauagcauuuuu

SEQ ID NO: 3665243 - RNA, 20 nt, Salmonella enterica enterica serovar Typhi
gauagccauacgauucaggu

SEQ ID NO: 3665244 - RNA, 14 nt, Salmonella enterica enterica serovar Typhi
gauagccauuauag

SEQ ID NO: 3665245 - RNA, 17 nt, Salmonella enterica enterica serovar Typhi
gauagcccauccagcac

SEQ ID NO: 3665246 - RNA, 17 nt, Salmonella enterica enterica serovar Typhi
gauagcccgccagcacc

SEQ ID NO: 3665247 - RNA, 18 nt, Salmonella enterica enterica serovar Typhi
gauagcgacggcgcgcca

SEQ ID NO: 3665248 - RNA, 16 nt, Salmonella enterica enterica serovar Typhi
gauagcgagcaagacu

SEQ ID NO: 3665249 - RNA, 16 nt, Salmonella enterica enterica serovar Typhi
gauagcgaggcguuuu

SEQ ID NO: 3665250 - RNA, 14 nt, Salmonella enterica enterica serovar Typhi
gauagcgauuuuug

SEQ ID NO: 3665251 - RNA, 18 nt, Salmonella enterica enterica serovar Typhi
gauagcgcagcacgguaa

SEQ ID NO: 3665252 - RNA, 19 nt, Salmonella enterica enterica serovar Typhi
gauagcgcagcacgguaac

SEQ ID NO: 3665253 - RNA, 22 nt, Salmonella enterica enterica serovar Typhi
gauagcgccgguuucuccagcc

SEQ ID NO: 3665254 - RNA, 18 nt, Salmonella enterica enterica serovar Typhi
gauagcgcggaauaucaa

SEQ ID NO: 3665255 - RNA, 14 nt, Salmonella enterica enterica serovar Typhi
gauagcgcuuucca

SEQ ID NO: 3665256 - RNA, 19 nt, Salmonella enterica enterica serovar Typhi
gauagcgcuuuccaguccc

SEQ ID NO: 3665257 - RNA, 14 nt, Salmonella enterica enterica serovar Typhi
gauagcggcgcaga

SEQ ID NO: 3665258 - RNA, 21 nt, Salmonella enterica enterica serovar Typhi
gauagcggcuucgccagaucc

SEQ ID NO: 3665259 - RNA, 17 nt, Salmonella enterica enterica serovar Typhi
gauagcgguuugcaaac

SEQ ID NO: 3665260 - RNA, 19 nt, Salmonella enterica enterica serovar Typhi
gauagcguagcgccauccg

SEQ ID NO: 3665261 - RNA, 16 nt, Salmonella enterica enterica serovar Typhi
gauagcuacgauaaag

SEQ ID NO: 3665262 - RNA, 22 nt, Salmonella enterica enterica serovar Typhi
gauagcuaucacacauaucgcc

SEQ ID NO: 3665263 - RNA, 17 nt, Salmonella enterica enterica serovar Typhi
gauaggagacgccgccc

SEQ ID NO: 3665264 - RNA, 14 nt, Salmonella enterica enterica serovar Typhi
gauagggccaggcg

SEQ ID NO: 3665265 - RNA, 22 nt, Salmonella enterica enterica serovar Typhi
gauaguacugaccagacagccc

SEQ ID NO: 3665266 - RNA, 17 nt, Salmonella enterica enterica serovar Typhi
gauagucauugacagca

SEQ ID NO: 3665267 - RNA, 15 nt, Salmonella enterica enterica serovar Typhi
gauagucuucaagcc

SEQ ID NO: 3665268 - RNA, 18 nt, Salmonella enterica enterica serovar Typhi
gauagugauauagcgcca

SEQ ID NO: 3665269 - RNA, 12 nt, Salmonella enterica enterica serovar Typhi
gauagugcgugu

SEQ ID NO: 3665270 - RNA, 19 nt, Salmonella enterica enterica serovar Typhi
gauaguguaaacgcgccau

SEQ ID NO: 3665271 - RNA, 20 nt, Salmonella enterica enterica serovar Typhi
gauagugucgccauaaauca

SEQ ID NO: 3665272 - RNA, 16 nt, Salmonella enterica enterica serovar Typhi
gauaguuugccagaga

SEQ ID NO: 3665273 - RNA, 16 nt, Salmonella enterica enterica serovar Typhi
gauauaaaacgggcca

SEQ ID NO: 3665274 - RNA, 22 nt, Salmonella enterica enterica serovar Typhi
gauauaaaacgggccacugcug

SEQ ID NO: 3665275 - RNA, 12 nt, Salmonella enterica enterica serovar Typhi
gauauaaaaugg

SEQ ID NO: 3665276 - RNA, 13 nt, Salmonella enterica enterica serovar Typhi
gauauaaagguua

SEQ ID NO: 3665277 - RNA, 13 nt, Salmonella enterica enterica serovar Typhi
gauauaagcgcca

SEQ ID NO: 3665278 - RNA, 20 nt, Salmonella enterica enterica serovar Typhi
gauauaauuuuauuauauuu

SEQ ID NO: 3665279 - RNA, 23 nt, Salmonella enterica enterica serovar Typhi
gauauaccacccgcuaugaagac

SEQ ID NO: 3665280 - RNA, 22 nt, Salmonella enterica enterica serovar Typhi
gauauaccaugcugccauuuua

SEQ ID NO: 3665281 - RNA, 21 nt, Salmonella enterica enterica serovar Typhi
gauauagcaacguccgcagcc

SEQ ID NO: 3665282 - RNA, 23 nt, Salmonella enterica enterica serovar Typhi
gauauagcugcgauccaggucuu

SEQ ID NO: 3665283 - RNA, 16 nt, Salmonella enterica enterica serovar Typhi
gauauauucagcaaau

SEQ ID NO: 3665284 - RNA, 17 nt, Salmonella enterica enterica serovar Typhi
gauaucaacccaguuuu

SEQ ID NO: 3665285 - RNA, 15 nt, Salmonella enterica enterica serovar Typhi
gauaucaaugcgaaa

SEQ ID NO: 3665286 - RNA, 22 nt, Salmonella enterica enterica serovar Typhi
gauaucagggcuuuuuucucgc

SEQ ID NO: 3665287 - RNA, 19 nt, Salmonella enterica enterica serovar Typhi
gauauccagcaccucauca

SEQ ID NO: 3665288 - RNA, 13 nt, Salmonella enterica enterica serovar Typhi
gauauccgccagu

SEQ ID NO: 3665289 - RNA, 18 nt, Salmonella enterica enterica serovar Typhi
gauauccgcgcucaacac

SEQ ID NO: 3665290 - RNA, 14 nt, Salmonella enterica enterica serovar Typhi
gauaucgccccaga

SEQ ID NO: 3665291 - RNA, 13 nt, Salmonella enterica enterica serovar Typhi
gauaucugccgcg

SEQ ID NO: 3665292 - RNA, 19 nt, Salmonella enterica enterica serovar Typhi
gauaucugccugcagaccc

SEQ ID NO: 3665293 - RNA, 12 nt, Salmonella enterica enterica serovar Typhi
gauaucuuccag

SEQ ID NO: 3665294 - RNA, 17 nt, Salmonella enterica enterica serovar Typhi
gauaucuucgauaagau

SEQ ID NO: 3665295 - RNA, 23 nt, Salmonella enterica enterica serovar Typhi
gauaucuuuauucgcuuguuuca

SEQ ID NO: 3665296 - RNA, 18 nt, Salmonella enterica enterica serovar Typhi
gauaugaccaguacaggc

SEQ ID NO: 3665297 - RNA, 23 nt, Salmonella enterica enterica serovar Typhi
gauaugaugcgccccgcuucccg

SEQ ID NO: 3665298 - RNA, 14 nt, Salmonella enterica enterica serovar Typhi
gauaugcagcagcc

SEQ ID NO: 3665299 - RNA, 18 nt, Salmonella enterica enterica serovar Typhi
gauaugcgacgaaagcgg

SEQ ID NO: 3665300 - RNA, 20 nt, Salmonella enterica enterica serovar Typhi
gauaugcgggggcaguaaau

SEQ ID NO: 3665301 - RNA, 21 nt, Salmonella enterica enterica serovar Typhi
gauaugcggucguauuaccaa

SEQ ID NO: 3665302 - RNA, 13 nt, Salmonella enterica enterica serovar Typhi
gauauggcaaacg

SEQ ID NO: 3665303 - RNA, 23 nt, Salmonella enterica enterica serovar Typhi
gauauggccguuuucaugcacga

SEQ ID NO: 3665304 - RNA, 16 nt, Salmonella enterica enterica serovar Typhi
gauauuacuaauaaaa

SEQ ID NO: 3665305 - RNA, 17 nt, Salmonella enterica enterica serovar Typhi
gauauuacuuuccagca

SEQ ID NO: 3665306 - RNA, 14 nt, Salmonella enterica enterica serovar Typhi
gauauucaacagcc

SEQ ID NO: 3665307 - RNA, 13 nt, Salmonella enterica enterica serovar Typhi
gauauucaucgcc

SEQ ID NO: 3665308 - RNA, 13 nt, Salmonella enterica enterica serovar Typhi
gauauuccauaca

SEQ ID NO: 3665309 - RNA, 18 nt, Salmonella enterica enterica serovar Typhi
gauauucccguuccagcu

SEQ ID NO: 3665310 - RNA, 15 nt, Salmonella enterica enterica serovar Typhi
gauauucgccugucu

SEQ ID NO: 3665311 - RNA, 20 nt, Salmonella enterica enterica serovar Typhi
gauauugucgaauuccgccu

SEQ ID NO: 3665312 - RNA, 20 nt, Salmonella enterica enterica serovar Typhi
gauauugugcauacugauuu

SEQ ID NO: 3665313 - RNA, 22 nt, Salmonella enterica enterica serovar Typhi
gauauuguguuuaccucauaua

SEQ ID NO: 3665314 - RNA, 15 nt, Salmonella enterica enterica serovar Typhi
gauauuuaaaacugg

SEQ ID NO: 3665315 - RNA, 22 nt, Salmonella enterica enterica serovar Typhi
gauauuuauuauuuccagguua

SEQ ID NO: 3665316 - RNA, 19 nt, Salmonella enterica enterica serovar Typhi
gauauuucgccuaucaugc

SEQ ID NO: 3665317 - RNA, 21 nt, Salmonella enterica enterica serovar Typhi
gauauuuuguuuuaaauucaa

SEQ ID NO: 3665318 - RNA, 16 nt, Salmonella enterica enterica serovar Typhi
gaucaaacuccgcgcu

SEQ ID NO: 3665319 - RNA, 20 nt, Salmonella enterica enterica serovar Typhi
gaucaacgggguuagcguuu

SEQ ID NO: 3665320 - RNA, 17 nt, Salmonella enterica enterica serovar Typhi
gaucaaguuuuacgccg

SEQ ID NO: 3665321 - RNA, 18 nt, Salmonella enterica enterica serovar Typhi
gaucaauaacgccgguuc

SEQ ID NO: 3665322 - RNA, 13 nt, Salmonella enterica enterica serovar Typhi
gaucaaucacgcc

SEQ ID NO: 3665323 - RNA, 14 nt, Salmonella enterica enterica serovar Typhi
gaucaaucacgccg

SEQ ID NO: 3665324 - RNA, 16 nt, Salmonella enterica enterica serovar Typhi
gaucaauugcgguggc

SEQ ID NO: 3665325 - RNA, 14 nt, Salmonella enterica enterica serovar Typhi
gaucaauuugccuu

SEQ ID NO: 3665326 - RNA, 14 nt, Salmonella enterica enterica serovar Typhi
gaucaccagcccuu

SEQ ID NO: 3665327 - RNA, 17 nt, Salmonella enterica enterica serovar Typhi
gaucacccacaccacag

SEQ ID NO: 3665328 - RNA, 16 nt, Salmonella enterica enterica serovar Typhi
gaucacccacaucagc

SEQ ID NO: 3665329 - RNA, 18 nt, Salmonella enterica enterica serovar Typhi
gaucacccacaucagcgg

SEQ ID NO: 3665330 - RNA, 15 nt, Salmonella enterica enterica serovar Typhi
gaucacgccagcgcu

SEQ ID NO: 3665331 - RNA, 20 nt, Salmonella enterica enterica serovar Typhi
gaucacggcgaaucgccugu

SEQ ID NO: 3665332 - RNA, 22 nt, Salmonella enterica enterica serovar Typhi
gaucacgguacgcaucaccagg

SEQ ID NO: 3665333 - RNA, 20 nt, Salmonella enterica enterica serovar Typhi
gaucacuaccgccaucaaac

SEQ ID NO: 3665334 - RNA, 21 nt, Salmonella enterica enterica serovar Typhi
gaucacuuccgccaccacgcc

SEQ ID NO: 3665335 - RNA, 12 nt, Salmonella enterica enterica serovar Typhi
gaucacuuguuu

SEQ ID NO: 3665336 - RNA, 22 nt, Salmonella enterica enterica serovar Typhi
gaucagaaauucgcagcgcagg

SEQ ID NO: 3665337 - RNA, 11 nt, Salmonella enterica enterica serovar Typhi
gaucagcgcca

SEQ ID NO: 3665338 - RNA, 19 nt, Salmonella enterica enterica serovar Typhi
gaucagcgccauuaacgcc

SEQ ID NO: 3665339 - RNA, 17 nt, Salmonella enterica enterica serovar Typhi
gaucaggaaaucuucca

SEQ ID NO: 3665340 - RNA, 20 nt, Salmonella enterica enterica serovar Typhi
gaucaggcaaaaaucggccu

SEQ ID NO: 3665341 - RNA, 13 nt, Salmonella enterica enterica serovar Typhi
gaucaggcuaaag

SEQ ID NO: 3665342 - RNA, 17 nt, Salmonella enterica enterica serovar Typhi
gaucaguagacgguaac

SEQ ID NO: 3665343 - RNA, 20 nt, Salmonella enterica enterica serovar Typhi
gaucaguucuugcaggcagg

SEQ ID NO: 3665344 - RNA, 19 nt, Salmonella enterica enterica serovar Typhi
gaucaucacgaaauaacgc

SEQ ID NO: 3665345 - RNA, 20 nt, Salmonella enterica enterica serovar Typhi
gaucaucuucacuucacaaa

SEQ ID NO: 3665346 - RNA, 23 nt, Salmonella enterica enterica serovar Typhi
gaucaucuucacuucacaaacaa

SEQ ID NO: 3665347 - RNA, 19 nt, Salmonella enterica enterica serovar Typhi
gaucaugaggaugagcguu

SEQ ID NO: 3665348 - RNA, 18 nt, Salmonella enterica enterica serovar Typhi
gauccaaauggcguacua

SEQ ID NO: 3665349 - RNA, 23 nt, Salmonella enterica enterica serovar Typhi
gauccaacacaucgacaugcaga

SEQ ID NO: 3665350 - RNA, 16 nt, Salmonella enterica enterica serovar Typhi
gauccaacacggcgcu

SEQ ID NO: 3665351 - RNA, 22 nt, Salmonella enterica enterica serovar Typhi
gauccaccaaguauuugaguuc

SEQ ID NO: 3665352 - RNA, 16 nt, Salmonella enterica enterica serovar Typhi
gauccaccaccagcau

SEQ ID NO: 3665353 - RNA, 20 nt, Salmonella enterica enterica serovar Typhi
gauccaccaccagcaucacg

SEQ ID NO: 3665354 - RNA, 12 nt, Salmonella enterica enterica serovar Typhi
gauccagaaccg

SEQ ID NO: 3665355 - RNA, 21 nt, Salmonella enterica enterica serovar Typhi
gauccagccccagcgccagcu

SEQ ID NO: 3665356 - RNA, 18 nt, Salmonella enterica enterica serovar Typhi
gauccaucgccugcggcg

SEQ ID NO: 3665357 - RNA, 20 nt, Salmonella enterica enterica serovar Typhi
gauccaucgguucucugcca

SEQ ID NO: 3665358 - RNA, 13 nt, Salmonella enterica enterica serovar Typhi
gaucccaggccgg

SEQ ID NO: 3665359 - RNA, 16 nt, Salmonella enterica enterica serovar Typhi
gaucccaggccggcau

SEQ ID NO: 3665360 - RNA, 17 nt, Salmonella enterica enterica serovar Typhi
gaucccaggccggcaua

SEQ ID NO: 3665361 - RNA, 22 nt, Salmonella enterica enterica serovar Typhi
gaucccaggccggcauaaugau

SEQ ID NO: 3665362 - RNA, 22 nt, Salmonella enterica enterica serovar Typhi
gauccccaucccaaucaggcuu

SEQ ID NO: 3665363 - RNA, 13 nt, Salmonella enterica enterica serovar Typhi
gaucccccagaau

SEQ ID NO: 3665364 - RNA, 15 nt, Salmonella enterica enterica serovar Typhi
gaucccccagaaucg

SEQ ID NO: 3665365 - RNA, 20 nt, Salmonella enterica enterica serovar Typhi
gauccccucuuccaucagcc

SEQ ID NO: 3665366 - RNA, 22 nt, Salmonella enterica enterica serovar Typhi
gauccccucuuccaucagccag

SEQ ID NO: 3665367 - RNA, 23 nt, Salmonella enterica enterica serovar Typhi
gauccccucuuccaucagccagg

SEQ ID NO: 3665368 - RNA, 14 nt, Salmonella enterica enterica serovar Typhi
gaucccgacucuga

SEQ ID NO: 3665369 - RNA, 16 nt, Salmonella enterica enterica serovar Typhi
gaucccgacucugacg

SEQ ID NO: 3665370 - RNA, 15 nt, Salmonella enterica enterica serovar Typhi
gaucccgcgcgccuc

SEQ ID NO: 3665371 - RNA, 20 nt, Salmonella enterica enterica serovar Typhi
gaucccgggcgauaaaccag

SEQ ID NO: 3665372 - RNA, 14 nt, Salmonella enterica enterica serovar Typhi
gaucccuaauaaaa

SEQ ID NO: 3665373 - RNA, 19 nt, Salmonella enterica enterica serovar Typhi
gaucccuaauaaaauaacu

SEQ ID NO: 3665374 - RNA, 21 nt, Salmonella enterica enterica serovar Typhi
gauccgacaugaugccaaaua

SEQ ID NO: 3665375 - RNA, 20 nt, Salmonella enterica enterica serovar Typhi
gauccgaugcgcuuuacugu

SEQ ID NO: 3665376 - RNA, 15 nt, Salmonella enterica enterica serovar Typhi
gauccgccgucggca

SEQ ID NO: 3665377 - RNA, 13 nt, Salmonella enterica enterica serovar Typhi
gauccggcagcca

SEQ ID NO: 3665378 - RNA, 15 nt, Salmonella enterica enterica serovar Typhi
gauccggcagccaau

SEQ ID NO: 3665379 - RNA, 18 nt, Salmonella enterica enterica serovar Typhi
gauccggcuguuccagua

SEQ ID NO: 3665380 - RNA, 14 nt, Salmonella enterica enterica serovar Typhi
gauccguaaccagu

SEQ ID NO: 3665381 - RNA, 22 nt, Salmonella enterica enterica serovar Typhi
gauccguucgaucagcuggcuu

SEQ ID NO: 3665382 - RNA, 16 nt, Salmonella enterica enterica serovar Typhi
gauccugcaacagcac

SEQ ID NO: 3665383 - RNA, 22 nt, Salmonella enterica enterica serovar Typhi
gauccugcguuaacgacccauc

SEQ ID NO: 3665384 - RNA, 17 nt, Salmonella enterica enterica serovar Typhi
gauccuggcgaaagcga

SEQ ID NO: 3665385 - RNA, 20 nt, Salmonella enterica enterica serovar Typhi
gauccuguaaaaaauccagc

SEQ ID NO: 3665386 - RNA, 20 nt, Salmonella enterica enterica serovar Typhi
gauccuguucaaacaucagc

SEQ ID NO: 3665387 - RNA, 14 nt, Salmonella enterica enterica serovar Typhi
gaucgaaucucccg

SEQ ID NO: 3665388 - RNA, 19 nt, Salmonella enterica enterica serovar Typhi
gaucgacaaaccacugcug

SEQ ID NO: 3665389 - RNA, 13 nt, Salmonella enterica enterica serovar Typhi
gaucgacaaugau

SEQ ID NO: 3665390 - RNA, 15 nt, Salmonella enterica enterica serovar Typhi
gaucgacaaugauca

SEQ ID NO: 3665391 - RNA, 23 nt, Salmonella enterica enterica serovar Typhi
gaucgacauaagaguccauucgg

SEQ ID NO: 3665392 - RNA, 20 nt, Salmonella enterica enterica serovar Typhi
gaucgagccgucgccggccu

SEQ ID NO: 3665393 - RNA, 16 nt, Salmonella enterica enterica serovar Typhi
gaucgaggucagcauu

SEQ ID NO: 3665394 - RNA, 17 nt, Salmonella enterica enterica serovar Typhi
gaucgauauccgugcgc

SEQ ID NO: 3665395 - RNA, 15 nt, Salmonella enterica enterica serovar Typhi
gaucgaucccggcaa

SEQ ID NO: 3665396 - RNA, 20 nt, Salmonella enterica enterica serovar Typhi
gaucgcaagauccugauauu

SEQ ID NO: 3665397 - RNA, 15 nt, Salmonella enterica enterica serovar Typhi
gaucgcaaggcgcga

SEQ ID NO: 3665398 - RNA, 18 nt, Salmonella enterica enterica serovar Typhi
gaucgcauaaauauccgg

SEQ ID NO: 3665399 - RNA, 19 nt, Salmonella enterica enterica serovar Typhi
gaucgcauuuaaucgccug

SEQ ID NO: 3665400 - RNA, 20 nt, Salmonella enterica enterica serovar Typhi
gaucgcauuuaaucgccugc

SEQ ID NO: 3665401 - RNA, 19 nt, Salmonella enterica enterica serovar Typhi
gaucgccaacgaccggcgc

SEQ ID NO: 3665402 - RNA, 21 nt, Salmonella enterica enterica serovar Typhi
gaucgccagcguuagcacauu

SEQ ID NO: 3665403 - RNA, 14 nt, Salmonella enterica enterica serovar Typhi
gaucgccgccgaau

SEQ ID NO: 3665404 - RNA, 21 nt, Salmonella enterica enterica serovar Typhi
gaucgccgucguucagccagc

SEQ ID NO: 3665405 - RNA, 10 nt, Salmonella enterica enterica serovar Typhi
gaucgccugg

SEQ ID NO: 3665406 - RNA, 14 nt, Salmonella enterica enterica serovar Typhi
gaucgccuggccga

SEQ ID NO: 3665407 - RNA, 13 nt, Salmonella enterica enterica serovar Typhi
gaucgcgcagcag

SEQ ID NO: 3665408 - RNA, 14 nt, Salmonella enterica enterica serovar Typhi
gaucgcgcagcagg

SEQ ID NO: 3665409 - RNA, 14 nt, Salmonella enterica enterica serovar Typhi
gaucgcgccagccu

SEQ ID NO: 3665410 - RNA, 19 nt, Salmonella enterica enterica serovar Typhi
gaucgcgcugcgcaggcgu

SEQ ID NO: 3665411 - RNA, 16 nt, Salmonella enterica enterica serovar Typhi
gaucgcguacagcgcc

SEQ ID NO: 3665412 - RNA, 13 nt, Salmonella enterica enterica serovar Typhi
gaucgcgugucgg

SEQ ID NO: 3665413 - RNA, 20 nt, Salmonella enterica enterica serovar Typhi
gaucggaaaucaaaccaucc

SEQ ID NO: 3665414 - RNA, 22 nt, Salmonella enterica enterica serovar Typhi
gaucggcaaaagugugauaagc

SEQ ID NO: 3665415 - RNA, 18 nt, Salmonella enterica enterica serovar Typhi
gaucggcaagcaucugau

SEQ ID NO: 3665416 - RNA, 20 nt, Salmonella enterica enterica serovar Typhi
gaucggccagcaagcggcga

SEQ ID NO: 3665417 - RNA, 14 nt, Salmonella enterica enterica serovar Typhi
gaucggcgcaggga

SEQ ID NO: 3665418 - RNA, 20 nt, Salmonella enterica enterica serovar Typhi
gaucggcgcagguccauuuu

SEQ ID NO: 3665419 - RNA, 21 nt, Salmonella enterica enterica serovar Typhi
gaucggcggcccacucaucca

SEQ ID NO: 3665420 - RNA, 20 nt, Salmonella enterica enterica serovar Typhi
gaucggcuggguuuccggau

SEQ ID NO: 3665421 - RNA, 14 nt, Salmonella enterica enterica serovar Typhi
gaucgggcuuccag

SEQ ID NO: 3665422 - RNA, 15 nt, Salmonella enterica enterica serovar Typhi
gaucgggcuuccagc

SEQ ID NO: 3665423 - RNA, 17 nt, Salmonella enterica enterica serovar Typhi
gaucggggcgaccggcu

SEQ ID NO: 3665424 - RNA, 16 nt, Salmonella enterica enterica serovar Typhi
gaucggguuuuccuga

SEQ ID NO: 3665425 - RNA, 18 nt, Salmonella enterica enterica serovar Typhi
gaucguaaaaugaaaaac

SEQ ID NO: 3665426 - RNA, 22 nt, Salmonella enterica enterica serovar Typhi
gaucguaaagcgcauccagcuc

SEQ ID NO: 3665427 - RNA, 16 nt, Salmonella enterica enterica serovar Typhi
gaucguagccauguuc

SEQ ID NO: 3665428 - RNA, 16 nt, Salmonella enterica enterica serovar Typhi
gaucguaggcggcgga

SEQ ID NO: 3665429 - RNA, 21 nt, Salmonella enterica enterica serovar Typhi
gaucguaugcagccaggccau

SEQ ID NO: 3665430 - RNA, 14 nt, Salmonella enterica enterica serovar Typhi
gaucguaugcgccu

SEQ ID NO: 3665431 - RNA, 12 nt, Salmonella enterica enterica serovar Typhi
gaucgucaacga

SEQ ID NO: 3665432 - RNA, 13 nt, Salmonella enterica enterica serovar Typhi
gaucgucaacgac

SEQ ID NO: 3665433 - RNA, 12 nt, Salmonella enterica enterica serovar Typhi
gaucgucaacgc

SEQ ID NO: 3665434 - RNA, 17 nt, Salmonella enterica enterica serovar Typhi
gaucgucacgacggcga

SEQ ID NO: 3665435 - RNA, 20 nt, Salmonella enterica enterica serovar Typhi
gaucgucauauguugcgcuu

SEQ ID NO: 3665436 - RNA, 17 nt, Salmonella enterica enterica serovar Typhi
gaucguccauuggcgga

SEQ ID NO: 3665437 - RNA, 23 nt, Salmonella enterica enterica serovar Typhi
gaucguuauccagcagccacagg

SEQ ID NO: 3665438 - RNA, 14 nt, Salmonella enterica enterica serovar Typhi
gaucguuuccagca

SEQ ID NO: 3665439 - RNA, 17 nt, Salmonella enterica enterica serovar Typhi
gaucuaaagccaguuuc

SEQ ID NO: 3665440 - RNA, 22 nt, Salmonella enterica enterica serovar Typhi
gaucuaacgaaaccggcggcga

SEQ ID NO: 3665441 - RNA, 16 nt, Salmonella enterica enterica serovar Typhi
gaucuacggaucccuu

SEQ ID NO: 3665442 - RNA, 15 nt, Salmonella enterica enterica serovar Typhi
gaucucauaaacgcc

SEQ ID NO: 3665443 - RNA, 12 nt, Salmonella enterica enterica serovar Typhi
gaucuccagaag

SEQ ID NO: 3665444 - RNA, 17 nt, Salmonella enterica enterica serovar Typhi
gaucucgauauucacac

SEQ ID NO: 3665445 - RNA, 12 nt, Salmonella enterica enterica serovar Typhi
gaucucucccug

SEQ ID NO: 3665446 - RNA, 21 nt, Salmonella enterica enterica serovar Typhi
gaucugacauuugcaucaaac

SEQ ID NO: 3665447 - RNA, 19 nt, Salmonella enterica enterica serovar Typhi
gaucugcgcaacauucugc

SEQ ID NO: 3665448 - RNA, 15 nt, Salmonella enterica enterica serovar Typhi
gaucuggccgucugg

SEQ ID NO: 3665449 - RNA, 15 nt, Salmonella enterica enterica serovar Typhi
gaucugguuauccac

SEQ ID NO: 3665450 - RNA, 19 nt, Salmonella enterica enterica serovar Typhi
gaucuuauaugagcgggcc

SEQ ID NO: 3665451 - RNA, 19 nt, Salmonella enterica enterica serovar Typhi
gaucuuaucuuucagcgcc

SEQ ID NO: 3665452 - RNA, 17 nt, Salmonella enterica enterica serovar Typhi
gaucuucaucccauccg

SEQ ID NO: 3665453 - RNA, 12 nt, Salmonella enterica enterica serovar Typhi
gaucuuccugcg

SEQ ID NO: 3665454 - RNA, 18 nt, Salmonella enterica enterica serovar Typhi
gaucuucguuggcgcugc

SEQ ID NO: 3665455 - RNA, 19 nt, Salmonella enterica enterica serovar Typhi
gaucuugucacaauaacgc

SEQ ID NO: 3665456 - RNA, 15 nt, Salmonella enterica enterica serovar Typhi
gaucuuuccuuuuuc

SEQ ID NO: 3665457 - RNA, 21 nt, Salmonella enterica enterica serovar Typhi
gaucuuuccuuuuucaggcac

SEQ ID NO: 3665458 - RNA, 13 nt, Salmonella enterica enterica serovar Typhi
gaucuuugccgcg

SEQ ID NO: 3665459 - RNA, 23 nt, Salmonella enterica enterica serovar Typhi
gaucuuugccgcgcggauucucc

SEQ ID NO: 3665460 - RNA, 13 nt, Salmonella enterica enterica serovar Typhi
gaugaaaaagagg

SEQ ID NO: 3665461 - RNA, 22 nt, Salmonella enterica enterica serovar Typhi
gaugaaacaguccggcgaaaaa

SEQ ID NO: 3665462 - RNA, 23 nt, Salmonella enterica enterica serovar Typhi
gaugaaacugcauaucgccgcuu

SEQ ID NO: 3665463 - RNA, 11 nt, Salmonella enterica enterica serovar Typhi
gaugaaagguc

SEQ ID NO: 3665464 - RNA, 22 nt, Salmonella enterica enterica serovar Typhi
gaugaaaggucgaaaacggcca

SEQ ID NO: 3665465 - RNA, 22 nt, Salmonella enterica enterica serovar Typhi
gaugaaauaaacgaccacucuu

SEQ ID NO: 3665466 - RNA, 14 nt, Salmonella enterica enterica serovar Typhi
gaugaaaucaccca

SEQ ID NO: 3665467 - RNA, 22 nt, Salmonella enterica enterica serovar Typhi
gaugaacgacgcugauuugcca

SEQ ID NO: 3665468 - RNA, 23 nt, Salmonella enterica enterica serovar Typhi
gaugaacucuaugcaaaagaaaa

SEQ ID NO: 3665469 - RNA, 12 nt, Salmonella enterica enterica serovar Typhi
gaugaagcgcau

SEQ ID NO: 3665470 - RNA, 19 nt, Salmonella enterica enterica serovar Typhi
gaugaauuccugcggcggu

SEQ ID NO: 3665471 - RNA, 22 nt, Salmonella enterica enterica serovar Typhi
gaugacaucgcaaugccaccac

SEQ ID NO: 3665472 - RNA, 20 nt, Salmonella enterica enterica serovar Typhi
gaugaccaguuaagcaaaaa

SEQ ID NO: 3665473 - RNA, 16 nt, Salmonella enterica enterica serovar Typhi
gaugaccauaaaugaa

SEQ ID NO: 3665474 - RNA, 18 nt, Salmonella enterica enterica serovar Typhi
gaugacccgcaauauuaa

SEQ ID NO: 3665475 - RNA, 21 nt, Salmonella enterica enterica serovar Typhi
gaugacgcuaacgcuuauccg

SEQ ID NO: 3665476 - RNA, 20 nt, Salmonella enterica enterica serovar Typhi
gaugacgcugcgcuuauccg

SEQ ID NO: 3665477 - RNA, 22 nt, Salmonella enterica enterica serovar Typhi
gaugacgcuucgcuuauccggc

SEQ ID NO: 3665478 - RNA, 16 nt, Salmonella enterica enterica serovar Typhi
gaugacggcaggggcg

SEQ ID NO: 3665479 - RNA, 17 nt, Salmonella enterica enterica serovar Typhi
gaugacggcgcguuauc

SEQ ID NO: 3665480 - RNA, 13 nt, Salmonella enterica enterica serovar Typhi
gaugacguccaga

SEQ ID NO: 3665481 - RNA, 16 nt, Salmonella enterica enterica serovar Typhi
gaugacuaaaucagca

SEQ ID NO: 3665482 - RNA, 17 nt, Salmonella enterica enterica serovar Typhi
gaugacuaaaucagcau

SEQ ID NO: 3665483 - RNA, 19 nt, Salmonella enterica enterica serovar Typhi
gaugacucauuaaaaaaac

SEQ ID NO: 3665484 - RNA, 17 nt, Salmonella enterica enterica serovar Typhi
gaugacucucggccuau

SEQ ID NO: 3665485 - RNA, 14 nt, Salmonella enterica enterica serovar Typhi
gaugagcaggccag

SEQ ID NO: 3665486 - RNA, 13 nt, Salmonella enterica enterica serovar Typhi
gaugagcgcgaaa

SEQ ID NO: 3665487 - RNA, 21 nt, Salmonella enterica enterica serovar Typhi
gaugagcgugacgaccggcac

SEQ ID NO: 3665488 - RNA, 13 nt, Salmonella enterica enterica serovar Typhi
gaugaggcgcugc

SEQ ID NO: 3665489 - RNA, 24 nt, Salmonella enterica enterica serovar Typhi
gaugauagccguugucauggcgcc

SEQ ID NO: 3665490 - RNA, 22 nt, Salmonella enterica enterica serovar Typhi
gaugaucgucgcgaucgcgcca

SEQ ID NO: 3665491 - RNA, 13 nt, Salmonella enterica enterica serovar Typhi
gaugaucuucaua

SEQ ID NO: 3665492 - RNA, 15 nt, Salmonella enterica enterica serovar Typhi
gaugaugaaaaagaa

SEQ ID NO: 3665493 - RNA, 13 nt, Salmonella enterica enterica serovar Typhi
gaugauggcggcu

SEQ ID NO: 3665494 - RNA, 15 nt, Salmonella enterica enterica serovar Typhi
gaugauguucaucgc

SEQ ID NO: 3665495 - RNA, 21 nt, Salmonella enterica enterica serovar Typhi
gaugauguuuaccugcaaaaa

SEQ ID NO: 3665496 - RNA, 14 nt, Salmonella enterica enterica serovar Typhi
gaugauucacccuc

SEQ ID NO: 3665497 - RNA, 14 nt, Salmonella enterica enterica serovar Typhi
gaugauuuucaagc

SEQ ID NO: 3665498 - RNA, 22 nt, Salmonella enterica enterica serovar Typhi
gaugcaccuuucuccugcgcuu

SEQ ID NO: 3665499 - RNA, 18 nt, Salmonella enterica enterica serovar Typhi
gaugcacggaugcaucau

SEQ ID NO: 3665500 - RNA, 11 nt, Salmonella enterica enterica serovar Typhi
gaugcagcacc

SEQ ID NO: 3665501 - RNA, 16 nt, Salmonella enterica enterica serovar Typhi
gaugcaucagaacaaa

SEQ ID NO: 3665502 - RNA, 13 nt, Salmonella enterica enterica serovar Typhi
gaugcauuugauu

SEQ ID NO: 3665503 - RNA, 21 nt, Salmonella enterica enterica serovar Typhi
gaugcccaccugaaaaagggu

SEQ ID NO: 3665504 - RNA, 19 nt, Salmonella enterica enterica serovar Typhi
gaugcccagguuagcagcc

SEQ ID NO: 3665505 - RNA, 15 nt, Salmonella enterica enterica serovar Typhi
gaugccccaucacgg

SEQ ID NO: 3665506 - RNA, 15 nt, Salmonella enterica enterica serovar Typhi
gaugcccguaaagcu

SEQ ID NO: 3665507 - RNA, 18 nt, Salmonella enterica enterica serovar Typhi
gaugccgaucaccagcgc

SEQ ID NO: 3665508 - RNA, 18 nt, Salmonella enterica enterica serovar Typhi
gaugccgccgacaaccag

SEQ ID NO: 3665509 - RNA, 17 nt, Salmonella enterica enterica serovar Typhi
gaugccgcuucgccacu

SEQ ID NO: 3665510 - RNA, 16 nt, Salmonella enterica enterica serovar Typhi
gaugccgugaggcuga

SEQ ID NO: 3665511 - RNA, 17 nt, Salmonella enterica enterica serovar Typhi
gaugccuuccacggcga

SEQ ID NO: 3665512 - RNA, 19 nt, Salmonella enterica enterica serovar Typhi
gaugccuuguaagccggau

SEQ ID NO: 3665513 - RNA, 20 nt, Salmonella enterica enterica serovar Typhi
gaugcgaaucuucaucgucg

SEQ ID NO: 3665514 - RNA, 18 nt, Salmonella enterica enterica serovar Typhi
gaugcgaguagcaaaucc

SEQ ID NO: 3665515 - RNA, 20 nt, Salmonella enterica enterica serovar Typhi
gaugcgccagccagucgcca

SEQ ID NO: 3665516 - RNA, 13 nt, Salmonella enterica enterica serovar Typhi
gaugcgccaguac

SEQ ID NO: 3665517 - RNA, 13 nt, Salmonella enterica enterica serovar Typhi
gaugcgccauccc

SEQ ID NO: 3665518 - RNA, 18 nt, Salmonella enterica enterica serovar Typhi
gaugcgcguuuagcgcca

SEQ ID NO: 3665519 - RNA, 20 nt, Salmonella enterica enterica serovar Typhi
gaugcgcucacgcuuauccg

SEQ ID NO: 3665520 - RNA, 16 nt, Salmonella enterica enterica serovar Typhi
gaugcgcugcgcgcga

SEQ ID NO: 3665521 - RNA, 14 nt, Salmonella enterica enterica serovar Typhi
gaugcgcugcuaaa

SEQ ID NO: 3665522 - RNA, 21 nt, Salmonella enterica enterica serovar Typhi
gaugcggcaaaaauccuucuu

SEQ ID NO: 3665523 - RNA, 20 nt, Salmonella enterica enterica serovar Typhi
gaugcggcgccaacgcgcua

SEQ ID NO: 3665524 - RNA, 22 nt, Salmonella enterica enterica serovar Typhi
gaugcggcuagcgccuuauccg

SEQ ID NO: 3665525 - RNA, 19 nt, Salmonella enterica enterica serovar Typhi
gaugcgggcgaucggcugu

SEQ ID NO: 3665526 - RNA, 17 nt, Salmonella enterica enterica serovar Typhi
gaugcguaauccggccu

SEQ ID NO: 3665527 - RNA, 14 nt, Salmonella enterica enterica serovar Typhi
gaugcguucaaaga

SEQ ID NO: 3665528 - RNA, 22 nt, Salmonella enterica enterica serovar Typhi
gaugcuaaccucuauaguaaau

SEQ ID NO: 3665529 - RNA, 13 nt, Salmonella enterica enterica serovar Typhi
gaugcuaucgcgg

SEQ ID NO: 3665530 - RNA, 21 nt, Salmonella enterica enterica serovar Typhi
gaugcuaucgcggauaagccc

SEQ ID NO: 3665531 - RNA, 22 nt, Salmonella enterica enterica serovar Typhi
gaugcucgccgucggcagacug

SEQ ID NO: 3665532 - RNA, 15 nt, Salmonella enterica enterica serovar Typhi
gaugcucgcucauca

SEQ ID NO: 3665533 - RNA, 17 nt, Salmonella enterica enterica serovar Typhi
gaugcugaauagccagc

SEQ ID NO: 3665534 - RNA, 18 nt, Salmonella enterica enterica serovar Typhi
gaugcugauguccgcagc

SEQ ID NO: 3665535 - RNA, 19 nt, Salmonella enterica enterica serovar Typhi
gaugcugauguccgcagcc

SEQ ID NO: 3665536 - RNA, 18 nt, Salmonella enterica enterica serovar Typhi
gaugcugccugccugaag

SEQ ID NO: 3665537 - RNA, 16 nt, Salmonella enterica enterica serovar Typhi
gaugcugcguuuuuuc

SEQ ID NO: 3665538 - RNA, 18 nt, Salmonella enterica enterica serovar Typhi
gaugcuguaggccggaug

SEQ ID NO: 3665539 - RNA, 19 nt, Salmonella enterica enterica serovar Typhi
gaugcugucuuagugaaag

SEQ ID NO: 3665540 - RNA, 15 nt, Salmonella enterica enterica serovar Typhi
gauggaacagacgcc

SEQ ID NO: 3665541 - RNA, 17 nt, Salmonella enterica enterica serovar Typhi
gauggaacgcauccagc

SEQ ID NO: 3665542 - RNA, 18 nt, Salmonella enterica enterica serovar Typhi
gauggcaaaaacagccgg

SEQ ID NO: 3665543 - RNA, 19 nt, Salmonella enterica enterica serovar Typhi
gauggcacgauaaccagau

SEQ ID NO: 3665544 - RNA, 11 nt, Salmonella enterica enterica serovar Typhi
gauggcacugc

SEQ ID NO: 3665545 - RNA, 16 nt, Salmonella enterica enterica serovar Typhi
gauggccagcaccagc

SEQ ID NO: 3665546 - RNA, 20 nt, Salmonella enterica enterica serovar Typhi
gauggccgguuauaccgcca

SEQ ID NO: 3665547 - RNA, 23 nt, Salmonella enterica enterica serovar Typhi
gauggcgacuaacgucuuauccg

SEQ ID NO: 3665548 - RNA, 16 nt, Salmonella enterica enterica serovar Typhi
gauggcgaucagcgcc

SEQ ID NO: 3665549 - RNA, 13 nt, Salmonella enterica enterica serovar Typhi
gauggcgccagcc

SEQ ID NO: 3665550 - RNA, 18 nt, Salmonella enterica enterica serovar Typhi
gauggcgcgcuuaucugg

SEQ ID NO: 3665551 - RNA, 16 nt, Salmonella enterica enterica serovar Typhi
gauggcgcuaagccag

SEQ ID NO: 3665552 - RNA, 21 nt, Salmonella enterica enterica serovar Typhi
gauggcgcuaaugcuuauccg

SEQ ID NO: 3665553 - RNA, 20 nt, Salmonella enterica enterica serovar Typhi
gauggcgcuacgcuuauccg

SEQ ID NO: 3665554 - RNA, 18 nt, Salmonella enterica enterica serovar Typhi
gauggcgcuagcuuaucg

SEQ ID NO: 3665555 - RNA, 15 nt, Salmonella enterica enterica serovar Typhi
gauggcgcuccugaa

SEQ ID NO: 3665556 - RNA, 21 nt, Salmonella enterica enterica serovar Typhi
gauggcgcugccgcuuauccg

SEQ ID NO: 3665557 - RNA, 20 nt, Salmonella enterica enterica serovar Typhi
gauggcgcugcgcuuaccca

SEQ ID NO: 3665558 - RNA, 17 nt, Salmonella enterica enterica serovar Typhi
gauggcgcugcgcuuau

SEQ ID NO: 3665559 - RNA, 20 nt, Salmonella enterica enterica serovar Typhi
gauggcgcugcgcuuaucag

SEQ ID NO: 3665560 - RNA, 19 nt, Salmonella enterica enterica serovar Typhi
gauggcgcuucgcuuacca

SEQ ID NO: 3665561 - RNA, 19 nt, Salmonella enterica enterica serovar Typhi
gauggcgcuucgcuuauca

SEQ ID NO: 3665562 - RNA, 20 nt, Salmonella enterica enterica serovar Typhi
gauggcgcuucgcuuaucag

SEQ ID NO: 3665563 - RNA, 20 nt, Salmonella enterica enterica serovar Typhi
gauggcgcuuugcuuauccg

SEQ ID NO: 3665564 - RNA, 22 nt, Salmonella enterica enterica serovar Typhi
gauggcggcgaugccuuauccg

SEQ ID NO: 3665565 - RNA, 14 nt, Salmonella enterica enterica serovar Typhi
gauggcggcguaaa

SEQ ID NO: 3665566 - RNA, 21 nt, Salmonella enterica enterica serovar Typhi
gauggcggcugcgccuuauca

SEQ ID NO: 3665567 - RNA, 21 nt, Salmonella enterica enterica serovar Typhi
gauggcguaauuaaccgcgcc

SEQ ID NO: 3665568 - RNA, 19 nt, Salmonella enterica enterica serovar Typhi
gauggcuaugaagcuggag

SEQ ID NO: 3665569 - RNA, 23 nt, Salmonella enterica enterica serovar Typhi
gaugggcagauagaaugcuucuu

SEQ ID NO: 3665570 - RNA, 20 nt, Salmonella enterica enterica serovar Typhi
gaugggccgaguaauccgua

SEQ ID NO: 3665571 - RNA, 18 nt, Salmonella enterica enterica serovar Typhi
gaugggcgcacagcgcca

SEQ ID NO: 3665572 - RNA, 14 nt, Salmonella enterica enterica serovar Typhi
gaugggcuucagau

SEQ ID NO: 3665573 - RNA, 17 nt, Salmonella enterica enterica serovar Typhi
gaugggcuucagauguu

SEQ ID NO: 3665574 - RNA, 22 nt, Salmonella enterica enterica serovar Typhi
gauggugcagccccggcggcgu

SEQ ID NO: 3665575 - RNA, 13 nt, Salmonella enterica enterica serovar Typhi
gaugguuaagcag

SEQ ID NO: 3665576 - RNA, 16 nt, Salmonella enterica enterica serovar Typhi
gaugguuauuuucaga

SEQ ID NO: 3665577 - RNA, 21 nt, Salmonella enterica enterica serovar Typhi
gaugguuucggcaugccacug

SEQ ID NO: 3665578 - RNA, 13 nt, Salmonella enterica enterica serovar Typhi
gaugguuucuucg

SEQ ID NO: 3665579 - RNA, 15 nt, Salmonella enterica enterica serovar Typhi
gauguaaaaccuggc

SEQ ID NO: 3665580 - RNA, 22 nt, Salmonella enterica enterica serovar Typhi
gauguacuguauucgguggaaa

SEQ ID NO: 3665581 - RNA, 16 nt, Salmonella enterica enterica serovar Typhi
gauguaguuguucuuu

SEQ ID NO: 3665582 - RNA, 18 nt, Salmonella enterica enterica serovar Typhi
gaugucaauuacgcacca

SEQ ID NO: 3665583 - RNA, 12 nt, Salmonella enterica enterica serovar Typhi
gaugucagaucc

SEQ ID NO: 3665584 - RNA, 15 nt, Salmonella enterica enterica serovar Typhi
gaugucauaaucgcc

SEQ ID NO: 3665585 - RNA, 20 nt, Salmonella enterica enterica serovar Typhi
gauguccgccuugaggcguu

SEQ ID NO: 3665586 - RNA, 20 nt, Salmonella enterica enterica serovar Typhi
gauguccgucuuuucugucg

SEQ ID NO: 3665587 - RNA, 20 nt, Salmonella enterica enterica serovar Typhi
gaugucgcuucgcuuaucug

SEQ ID NO: 3665588 - RNA, 20 nt, Salmonella enterica enterica serovar Typhi
gaugucggcguaaauccagc

SEQ ID NO: 3665589 - RNA, 14 nt, Salmonella enterica enterica serovar Typhi
gaugucucagcgca

SEQ ID NO: 3665590 - RNA, 23 nt, Salmonella enterica enterica serovar Typhi
gaugugauuuuugacccgcagca

SEQ ID NO: 3665591 - RNA, 12 nt, Salmonella enterica enterica serovar Typhi
gauguucaacgu

SEQ ID NO: 3665592 - RNA, 21 nt, Salmonella enterica enterica serovar Typhi
gauguucgcgauuuucaucaa

SEQ ID NO: 3665593 - RNA, 22 nt, Salmonella enterica enterica serovar Typhi
gauguugguuaauauaucgcag

SEQ ID NO: 3665594 - RNA, 14 nt, Salmonella enterica enterica serovar Typhi
gauguuuuuaaaag

SEQ ID NO: 3665595 - RNA, 20 nt, Salmonella enterica enterica serovar Typhi
gauguuuuuaucaugcugac

SEQ ID NO: 3665596 - RNA, 19 nt, Salmonella enterica enterica serovar Typhi
gauuaaagauaagcacaug

SEQ ID NO: 3665597 - RNA, 17 nt, Salmonella enterica enterica serovar Typhi
gauuaagcgaauccagc

SEQ ID NO: 3665598 - RNA, 20 nt, Salmonella enterica enterica serovar Typhi
gauuaagcgaauccagcgcc

SEQ ID NO: 3665599 - RNA, 17 nt, Salmonella enterica enterica serovar Typhi
gauuaagggacgguaaa

SEQ ID NO: 3665600 - RNA, 19 nt, Salmonella enterica enterica serovar Typhi
gauuaauaaaauuuuugcc

SEQ ID NO: 3665601 - RNA, 15 nt, Salmonella enterica enterica serovar Typhi
gauuaaucagcagau

SEQ ID NO: 3665602 - RNA, 16 nt, Salmonella enterica enterica serovar Typhi
gauuaaucagcagaua

SEQ ID NO: 3665603 - RNA, 18 nt, Salmonella enterica enterica serovar Typhi
gauuaaugcuccaauaaa

SEQ ID NO: 3665604 - RNA, 23 nt, Salmonella enterica enterica serovar Typhi
gauuaccauugaucaggcaaaaa

SEQ ID NO: 3665605 - RNA, 18 nt, Salmonella enterica enterica serovar Typhi
gauuaccgggauuuccau

SEQ ID NO: 3665606 - RNA, 16 nt, Salmonella enterica enterica serovar Typhi
gauuacgacccacaau

SEQ ID NO: 3665607 - RNA, 16 nt, Salmonella enterica enterica serovar Typhi
gauuacggaacaaaac

SEQ ID NO: 3665608 - RNA, 18 nt, Salmonella enterica enterica serovar Typhi
gauuacucucuugccagc

SEQ ID NO: 3665609 - RNA, 20 nt, Salmonella enterica enterica serovar Typhi
gauuacucucuugccagcgc

SEQ ID NO: 3665610 - RNA, 21 nt, Salmonella enterica enterica serovar Typhi
gauuacucucuugccagcgca

SEQ ID NO: 3665611 - RNA, 22 nt, Salmonella enterica enterica serovar Typhi
gauuacucucuugccagcgcau

SEQ ID NO: 3665612 - RNA, 16 nt, Salmonella enterica enterica serovar Typhi
gauuacugcgugcugg

SEQ ID NO: 3665613 - RNA, 16 nt, Salmonella enterica enterica serovar Typhi
gauuagacuucuucca

SEQ ID NO: 3665614 - RNA, 17 nt, Salmonella enterica enterica serovar Typhi
gauuagccccagcgcca

SEQ ID NO: 3665615 - RNA, 18 nt, Salmonella enterica enterica serovar Typhi
gauuagccccagcgccag

SEQ ID NO: 3665616 - RNA, 20 nt, Salmonella enterica enterica serovar Typhi
gauuagcuuuaauccguuac

SEQ ID NO: 3665617 - RNA, 12 nt, Salmonella enterica enterica serovar Typhi
gauuauagagag

SEQ ID NO: 3665618 - RNA, 20 nt, Salmonella enterica enterica serovar Typhi
gauuaucaggaugaauauga

SEQ ID NO: 3665619 - RNA, 21 nt, Salmonella enterica enterica serovar Typhi
gauuaucaggaugaauaugaa

SEQ ID NO: 3665620 - RNA, 11 nt, Salmonella enterica enterica serovar Typhi
gauuauccagu

SEQ ID NO: 3665621 - RNA, 16 nt, Salmonella enterica enterica serovar Typhi
gauuaucggccagcgc

SEQ ID NO: 3665622 - RNA, 17 nt, Salmonella enterica enterica serovar Typhi
gauuaucguccggcauc

SEQ ID NO: 3665623 - RNA, 15 nt, Salmonella enterica enterica serovar Typhi
gauuauuguuaaaaa

SEQ ID NO: 3665624 - RNA, 20 nt, Salmonella enterica enterica serovar Typhi
gauucaaaaggugagaaaaa

SEQ ID NO: 3665625 - RNA, 19 nt, Salmonella enterica enterica serovar Typhi
gauucaaccaaugcaacgc

SEQ ID NO: 3665626 - RNA, 22 nt, Salmonella enterica enterica serovar Typhi
gauucaacgcgugauccacagc

SEQ ID NO: 3665627 - RNA, 22 nt, Salmonella enterica enterica serovar Typhi
gauucaacguuucgcuaucgcc

SEQ ID NO: 3665628 - RNA, 16 nt, Salmonella enterica enterica serovar Typhi
gauucaccaacugcug

SEQ ID NO: 3665629 - RNA, 13 nt, Salmonella enterica enterica serovar Typhi
gauucagcauugg

SEQ ID NO: 3665630 - RNA, 18 nt, Salmonella enterica enterica serovar Typhi
gauucagcgcaggcaguu

SEQ ID NO: 3665631 - RNA, 20 nt, Salmonella enterica enterica serovar Typhi
gauucagguuuugcugauca

SEQ ID NO: 3665632 - RNA, 21 nt, Salmonella enterica enterica serovar Typhi
gauucaguaagaggguggcga

SEQ ID NO: 3665633 - RNA, 18 nt, Salmonella enterica enterica serovar Typhi
gauuccaugcccaguuca

SEQ ID NO: 3665634 - RNA, 13 nt, Salmonella enterica enterica serovar Typhi
gauucccauccgu

SEQ ID NO: 3665635 - RNA, 14 nt, Salmonella enterica enterica serovar Typhi
gauucgaaccugcg

SEQ ID NO: 3665636 - RNA, 17 nt, Salmonella enterica enterica serovar Typhi
gauucgcccacggauga

SEQ ID NO: 3665637 - RNA, 17 nt, Salmonella enterica enterica serovar Typhi
gauucgcuacugcaucu

SEQ ID NO: 3665638 - RNA, 19 nt, Salmonella enterica enterica serovar Typhi
gauucgcuggccucggcga

SEQ ID NO: 3665639 - RNA, 14 nt, Salmonella enterica enterica serovar Typhi
gauucgggccgcac

SEQ ID NO: 3665640 - RNA, 13 nt, Salmonella enterica enterica serovar Typhi
gauucuacugguu

SEQ ID NO: 3665641 - RNA, 22 nt, Salmonella enterica enterica serovar Typhi
gauucuaucuguuuuaauuccu

SEQ ID NO: 3665642 - RNA, 20 nt, Salmonella enterica enterica serovar Typhi
gauucucuaacgucagcgcc

SEQ ID NO: 3665643 - RNA, 15 nt, Salmonella enterica enterica serovar Typhi
gauucugcaggccaa

SEQ ID NO: 3665644 - RNA, 18 nt, Salmonella enterica enterica serovar Typhi
gauucuggcgaguuucac

SEQ ID NO: 3665645 - RNA, 13 nt, Salmonella enterica enterica serovar Typhi
gauucuucugccu

SEQ ID NO: 3665646 - RNA, 16 nt, Salmonella enterica enterica serovar Typhi
gauugagacaaauaac

SEQ ID NO: 3665647 - RNA, 20 nt, Salmonella enterica enterica serovar Typhi
gauugauuuauucacuggca

SEQ ID NO: 3665648 - RNA, 17 nt, Salmonella enterica enterica serovar Typhi
gauugccggaagcggac

SEQ ID NO: 3665649 - RNA, 12 nt, Salmonella enterica enterica serovar Typhi
gauuggcaaaau

SEQ ID NO: 3665650 - RNA, 19 nt, Salmonella enterica enterica serovar Typhi
gauuggcugugacaauuca

SEQ ID NO: 3665651 - RNA, 20 nt, Salmonella enterica enterica serovar Typhi
gauuggcuguuaguaagcug

SEQ ID NO: 3665652 - RNA, 20 nt, Salmonella enterica enterica serovar Typhi
gauugucacaccggcggagu

SEQ ID NO: 3665653 - RNA, 18 nt, Salmonella enterica enterica serovar Typhi
gauugucuuaaauaugaa

SEQ ID NO: 3665654 - RNA, 23 nt, Salmonella enterica enterica serovar Typhi
gauuguuucggauaauucugacu

SEQ ID NO: 3665655 - RNA, 14 nt, Salmonella enterica enterica serovar Typhi
gauuuaaaacaagc

SEQ ID NO: 3665656 - RNA, 12 nt, Salmonella enterica enterica serovar Typhi
gauuuacuccaa

SEQ ID NO: 3665657 - RNA, 15 nt, Salmonella enterica enterica serovar Typhi
gauuuagcguaaaua

SEQ ID NO: 3665658 - RNA, 23 nt, Salmonella enterica enterica serovar Typhi
gauuuagcguuggcgucaucgac

SEQ ID NO: 3665659 - RNA, 15 nt, Salmonella enterica enterica serovar Typhi
gauuuauagagcagc

SEQ ID NO: 3665660 - RNA, 14 nt, Salmonella enterica enterica serovar Typhi
gauuuaucuucucu

SEQ ID NO: 3665661 - RNA, 16 nt, Salmonella enterica enterica serovar Typhi
gauuuauucuuugucu

SEQ ID NO: 3665662 - RNA, 19 nt, Salmonella enterica enterica serovar Typhi
gauuucacgaucaucgcau

SEQ ID NO: 3665663 - RNA, 14 nt, Salmonella enterica enterica serovar Typhi
gauuucaucaggcu

SEQ ID NO: 3665664 - RNA, 22 nt, Salmonella enterica enterica serovar Typhi
gauuucaugcggugcaugaaua

SEQ ID NO: 3665665 - RNA, 24 nt, Salmonella enterica enterica serovar Typhi
gauuucaugcggugcaugaauauc

SEQ ID NO: 3665666 - RNA, 19 nt, Salmonella enterica enterica serovar Typhi
gauuuccagcgaauaauga

SEQ ID NO: 3665667 - RNA, 20 nt, Salmonella enterica enterica serovar Typhi
gauuucgacgauaaaaaaag

SEQ ID NO: 3665668 - RNA, 17 nt, Salmonella enterica enterica serovar Typhi
gauuucgccccacuggc

SEQ ID NO: 3665669 - RNA, 15 nt, Salmonella enterica enterica serovar Typhi
gauuucuuaauuccu

SEQ ID NO: 3665670 - RNA, 23 nt, Salmonella enterica enterica serovar Typhi
gauuucuuaauuccucagaaucc

SEQ ID NO: 3665671 - RNA, 14 nt, Salmonella enterica enterica serovar Typhi
gauuucuucuggcu

SEQ ID NO: 3665672 - RNA, 17 nt, Salmonella enterica enterica serovar Typhi
gauuugcccuuccagca

SEQ ID NO: 3665673 - RNA, 16 nt, Salmonella enterica enterica serovar Typhi
gauuugccgcgccuuc

SEQ ID NO: 3665674 - RNA, 14 nt, Salmonella enterica enterica serovar Typhi
gauuugcguuguuu

SEQ ID NO: 3665675 - RNA, 21 nt, Salmonella enterica enterica serovar Typhi
gauuuggcguaaucgauaagc

SEQ ID NO: 3665676 - RNA, 16 nt, Salmonella enterica enterica serovar Typhi
gauuuguuucaucgcc

SEQ ID NO: 3665677 - RNA, 20 nt, Salmonella enterica enterica serovar Typhi
gauuuguuuuuuauauuuuu

SEQ ID NO: 3665678 - RNA, 21 nt, Salmonella enterica enterica serovar Typhi
gauuuuaagcauccaggaagu

SEQ ID NO: 3665679 - RNA, 17 nt, Salmonella enterica enterica serovar Typhi
gauuuuccguuaagcug

SEQ ID NO: 3665680 - RNA, 20 nt, Salmonella enterica enterica serovar Typhi
gauuuucuuauuacaagaaa

SEQ ID NO: 3665681 - RNA, 13 nt, Salmonella enterica enterica serovar Typhi
gauuuucuuuaau

SEQ ID NO: 3665682 - RNA, 13 nt, Salmonella enterica enterica serovar Typhi
gauuuugaaggug

SEQ ID NO: 3665683 - RNA, 13 nt, Salmonella enterica enterica serovar Typhi
gauuuuguuaugc

SEQ ID NO: 3665684 - RNA, 16 nt, Salmonella enterica enterica serovar Typhi
gauuuuuaaaauguuu

SEQ ID NO: 3665685 - RNA, 15 nt, Salmonella enterica enterica serovar Typhi
gauuuuucauugcaa

SEQ ID NO: 3665686 - RNA, 22 nt, Salmonella enterica enterica serovar Typhi
gauuuuucgcgucaaaacuuau

SEQ ID NO: 3665687 - RNA, 16 nt, Salmonella enterica enterica serovar Typhi
gauuuuuuaucucgcc

SEQ ID NO: 3665688 - RNA, 14 nt, Salmonella enterica enterica serovar Typhi
gcaaaaaaggccag

SEQ ID NO: 3665689 - RNA, 19 nt, Salmonella enterica enterica serovar Typhi
gcaaaaauaggcuuuugau

SEQ ID NO: 3665690 - RNA, 13 nt, Salmonella enterica enterica serovar Typhi
gcaaaaauuugcg

SEQ ID NO: 3665691 - RNA, 12 nt, Salmonella enterica enterica serovar Typhi
gcaaaacauggc

SEQ ID NO: 3665692 - RNA, 15 nt, Salmonella enterica enterica serovar Typhi
gcaaaaccagacgcc

SEQ ID NO: 3665693 - RNA, 18 nt, Salmonella enterica enterica serovar Typhi
gcaaaaccuucauaaaua

SEQ ID NO: 3665694 - RNA, 15 nt, Salmonella enterica enterica serovar Typhi
gcaaaacgccgcaga

SEQ ID NO: 3665695 - RNA, 20 nt, Salmonella enterica enterica serovar Typhi
gcaaaacuaaacccggccug

SEQ ID NO: 3665696 - RNA, 22 nt, Salmonella enterica enterica serovar Typhi
gcaaaagaggcuaauuaucugc

SEQ ID NO: 3665697 - RNA, 18 nt, Salmonella enterica enterica serovar Typhi
gcaaaagggccauggcug

SEQ ID NO: 3665698 - RNA, 17 nt, Salmonella enterica enterica serovar Typhi
gcaaaauaccggcagcg

SEQ ID NO: 3665699 - RNA, 21 nt, Salmonella enterica enterica serovar Typhi
gcaaaaucguuaaccagcggc

SEQ ID NO: 3665700 - RNA, 14 nt, Salmonella enterica enterica serovar Typhi
gcaaaaugcuucuu

SEQ ID NO: 3665701 - RNA, 19 nt, Salmonella enterica enterica serovar Typhi
gcaaaauggcaauugcgcc

SEQ ID NO: 3665702 - RNA, 13 nt, Salmonella enterica enterica serovar Typhi
gcaaaauuacuuc

SEQ ID NO: 3665703 - RNA, 16 nt, Salmonella enterica enterica serovar Typhi
gcaaaauuccggcuga

SEQ ID NO: 3665704 - RNA, 18 nt, Salmonella enterica enterica serovar Typhi
gcaaacagagcgccggca

SEQ ID NO: 3665705 - RNA, 12 nt, Salmonella enterica enterica serovar Typhi
gcaaacagcacg

SEQ ID NO: 3665706 - RNA, 14 nt, Salmonella enterica enterica serovar Typhi
gcaaacagcacgcc

SEQ ID NO: 3665707 - RNA, 14 nt, Salmonella enterica enterica serovar Typhi
gcaaacagcuucau

SEQ ID NO: 3665708 - RNA, 19 nt, Salmonella enterica enterica serovar Typhi
gcaaaccccugcucgcgca

SEQ ID NO: 3665709 - RNA, 14 nt, Salmonella enterica enterica serovar Typhi
gcaaacccucaucg

SEQ ID NO: 3665710 - RNA, 21 nt, Salmonella enterica enterica serovar Typhi
gcaaaccgaauucguccacac

SEQ ID NO: 3665711 - RNA, 20 nt, Salmonella enterica enterica serovar Typhi
gcaaaccgauaaucaccagc

SEQ ID NO: 3665712 - RNA, 18 nt, Salmonella enterica enterica serovar Typhi
gcaaaccggcaugaagac

SEQ ID NO: 3665713 - RNA, 20 nt, Salmonella enterica enterica serovar Typhi
gcaaaccgggguaucuguuu

SEQ ID NO: 3665714 - RNA, 17 nt, Salmonella enterica enterica serovar Typhi
gcaaaccuaccggcaua

SEQ ID NO: 3665715 - RNA, 15 nt, Salmonella enterica enterica serovar Typhi
gcaaacgacgcugac

SEQ ID NO: 3665716 - RNA, 14 nt, Salmonella enterica enterica serovar Typhi
gcaaacgccauagc

SEQ ID NO: 3665717 - RNA, 21 nt, Salmonella enterica enterica serovar Typhi
gcaaacgccgaagccagcgca

SEQ ID NO: 3665718 - RNA, 14 nt, Salmonella enterica enterica serovar Typhi
gcaaacgccgccug

SEQ ID NO: 3665719 - RNA, 14 nt, Salmonella enterica enterica serovar Typhi
gcaaacgccugcuc

SEQ ID NO: 3665720 - RNA, 16 nt, Salmonella enterica enterica serovar Typhi
gcaaacgccugcuccg

SEQ ID NO: 3665721 - RNA, 12 nt, Salmonella enterica enterica serovar Typhi
gcaaacgcggcg

SEQ ID NO: 3665722 - RNA, 17 nt, Salmonella enterica enterica serovar Typhi
gcaaacgcggcgccagc

SEQ ID NO: 3665723 - RNA, 19 nt, Salmonella enterica enterica serovar Typhi
gcaaacggaauagcgccuu

SEQ ID NO: 3665724 - RNA, 20 nt, Salmonella enterica enterica serovar Typhi
gcaaacggcacuacagcccu

SEQ ID NO: 3665725 - RNA, 15 nt, Salmonella enterica enterica serovar Typhi
gcaaacggcuggaua

SEQ ID NO: 3665726 - RNA, 23 nt, Salmonella enterica enterica serovar Typhi
gcaaacgguaaacgugccacagu

SEQ ID NO: 3665727 - RNA, 13 nt, Salmonella enterica enterica serovar Typhi
gcaaacgguuaau

SEQ ID NO: 3665728 - RNA, 16 nt, Salmonella enterica enterica serovar Typhi
gcaaacgguuaauacu

SEQ ID NO: 3665729 - RNA, 18 nt, Salmonella enterica enterica serovar Typhi
gcaaacgguuaauacuga

SEQ ID NO: 3665730 - RNA, 16 nt, Salmonella enterica enterica serovar Typhi
gcaaacuauguacgcc

SEQ ID NO: 3665731 - RNA, 15 nt, Salmonella enterica enterica serovar Typhi
gcaaacucagcggcu

SEQ ID NO: 3665732 - RNA, 15 nt, Salmonella enterica enterica serovar Typhi
gcaaacugaucgagg

SEQ ID NO: 3665733 - RNA, 15 nt, Salmonella enterica enterica serovar Typhi
gcaaacugcgcgccc

SEQ ID NO: 3665734 - RNA, 22 nt, Salmonella enterica enterica serovar Typhi
gcaaacuguauccguaauauga

SEQ ID NO: 3665735 - RNA, 22 nt, Salmonella enterica enterica serovar Typhi
gcaaacuuugcgccauuucaau

SEQ ID NO: 3665736 - RNA, 17 nt, Salmonella enterica enterica serovar Typhi
gcaaagaagggcagggg

SEQ ID NO: 3665737 - RNA, 19 nt, Salmonella enterica enterica serovar Typhi
gcaaagagguugcugauua

SEQ ID NO: 3665738 - RNA, 16 nt, Salmonella enterica enterica serovar Typhi
gcaaagauaaucugaa

SEQ ID NO: 3665739 - RNA, 18 nt, Salmonella enterica enterica serovar Typhi
gcaaagcacugcugcuga

SEQ ID NO: 3665740 - RNA, 23 nt, Salmonella enterica enterica serovar Typhi
gcaaagcacugcugcugaaagaa

SEQ ID NO: 3665741 - RNA, 19 nt, Salmonella enterica enterica serovar Typhi
gcaaagcccacgcccugca

SEQ ID NO: 3665742 - RNA, 17 nt, Salmonella enterica enterica serovar Typhi
gcaaagcgacgcgcggu

SEQ ID NO: 3665743 - RNA, 18 nt, Salmonella enterica enterica serovar Typhi
gcaaagcucaacgcaggc

SEQ ID NO: 3665744 - RNA, 18 nt, Salmonella enterica enterica serovar Typhi
gcaaaggaaugcuuuaca

SEQ ID NO: 3665745 - RNA, 20 nt, Salmonella enterica enterica serovar Typhi
gcaaaggaccaacaccagcc

SEQ ID NO: 3665746 - RNA, 17 nt, Salmonella enterica enterica serovar Typhi
gcaaagguugccgcaau

SEQ ID NO: 3665747 - RNA, 19 nt, Salmonella enterica enterica serovar Typhi
gcaaaguacgggugaagca

SEQ ID NO: 3665748 - RNA, 17 nt, Salmonella enterica enterica serovar Typhi
gcaaaguggguauauuu

SEQ ID NO: 3665749 - RNA, 13 nt, Salmonella enterica enterica serovar Typhi
gcaaauaauacca

SEQ ID NO: 3665750 - RNA, 17 nt, Salmonella enterica enterica serovar Typhi
gcaaauacuggaaaaaa

SEQ ID NO: 3665751 - RNA, 20 nt, Salmonella enterica enterica serovar Typhi
gcaaauacuggaaaaaacgg

SEQ ID NO: 3665752 - RNA, 13 nt, Salmonella enterica enterica serovar Typhi
gcaaaucaccaca

SEQ ID NO: 3665753 - RNA, 19 nt, Salmonella enterica enterica serovar Typhi
gcaaaucagcuacuuuaaa

SEQ ID NO: 3665754 - RNA, 19 nt, Salmonella enterica enterica serovar Typhi
gcaaauccaucucaggccg

SEQ ID NO: 3665755 - RNA, 13 nt, Salmonella enterica enterica serovar Typhi
gcaaaucgccauc

SEQ ID NO: 3665756 - RNA, 20 nt, Salmonella enterica enterica serovar Typhi
gcaaaucgcccaucacaugu

SEQ ID NO: 3665757 - RNA, 23 nt, Salmonella enterica enterica serovar Typhi
gcaaaucgcgguaaaaagcugau

SEQ ID NO: 3665758 - RNA, 19 nt, Salmonella enterica enterica serovar Typhi
gcaaaucugccgucaucga

SEQ ID NO: 3665759 - RNA, 22 nt, Salmonella enterica enterica serovar Typhi
gcaaaucugccgucaucgacuu

SEQ ID NO: 3665760 - RNA, 15 nt, Salmonella enterica enterica serovar Typhi
gcaaaucuuguaggc

SEQ ID NO: 3665761 - RNA, 21 nt, Salmonella enterica enterica serovar Typhi
gcaaaugauuaucuccaucuu

SEQ ID NO: 3665762 - RNA, 12 nt, Salmonella enterica enterica serovar Typhi
gcaaaugucaga

SEQ ID NO: 3665763 - RNA, 21 nt, Salmonella enterica enterica serovar Typhi
gcaaaugucagaucguaugcg

SEQ ID NO: 3665764 - RNA, 15 nt, Salmonella enterica enterica serovar Typhi
gcaaauuaugauuca

SEQ ID NO: 3665765 - RNA, 22 nt, Salmonella enterica enterica serovar Typhi
gcaacaaacauaagcaaauccu

SEQ ID NO: 3665766 - RNA, 12 nt, Salmonella enterica enterica serovar Typhi
gcaacaaagccu

SEQ ID NO: 3665767 - RNA, 20 nt, Salmonella enterica enterica serovar Typhi
gcaacaacaaacacaaucac

SEQ ID NO: 3665768 - RNA, 21 nt, Salmonella enterica enterica serovar Typhi
gcaacaacaguugcagcaccu

SEQ ID NO: 3665769 - RNA, 18 nt, Salmonella enterica enterica serovar Typhi
gcaacacagccagcacga

SEQ ID NO: 3665770 - RNA, 21 nt, Salmonella enterica enterica serovar Typhi
gcaacacuuugcgcugcgcau

SEQ ID NO: 3665771 - RNA, 18 nt, Salmonella enterica enterica serovar Typhi
gcaacagcaagucgcggg

SEQ ID NO: 3665772 - RNA, 17 nt, Salmonella enterica enterica serovar Typhi
gcaacagcaccagcagg

SEQ ID NO: 3665773 - RNA, 23 nt, Salmonella enterica enterica serovar Typhi
gcaacagcaccagcaggugguac

SEQ ID NO: 3665774 - RNA, 21 nt, Salmonella enterica enterica serovar Typhi
gcaacagcacgggaugcgccg

SEQ ID NO: 3665775 - RNA, 15 nt, Salmonella enterica enterica serovar Typhi
gcaacaggccgcauc

SEQ ID NO: 3665776 - RNA, 18 nt, Salmonella enterica enterica serovar Typhi
gcaacaguugcuggagca

SEQ ID NO: 3665777 - RNA, 17 nt, Salmonella enterica enterica serovar Typhi
gcaacauaaauaaacag

SEQ ID NO: 3665778 - RNA, 17 nt, Salmonella enterica enterica serovar Typhi
gcaacaugaccagcgca

SEQ ID NO: 3665779 - RNA, 13 nt, Salmonella enterica enterica serovar Typhi
gcaacaugcccac

SEQ ID NO: 3665780 - RNA, 16 nt, Salmonella enterica enterica serovar Typhi
gcaacauggacaccgg

SEQ ID NO: 3665781 - RNA, 17 nt, Salmonella enterica enterica serovar Typhi
gcaacauucugcuucca

SEQ ID NO: 3665782 - RNA, 18 nt, Salmonella enterica enterica serovar Typhi
gcaaccccuugcggugca

SEQ ID NO: 3665783 - RNA, 12 nt, Salmonella enterica enterica serovar Typhi
gcaacccggcua

SEQ ID NO: 3665784 - RNA, 23 nt, Salmonella enterica enterica serovar Typhi
gcaacccugccgucucaaccagc

SEQ ID NO: 3665785 - RNA, 22 nt, Salmonella enterica enterica serovar Typhi
gcaaccgauagcuaaugcgguu

SEQ ID NO: 3665786 - RNA, 14 nt, Salmonella enterica enterica serovar Typhi
gcaaccgccugcac

SEQ ID NO: 3665787 - RNA, 18 nt, Salmonella enterica enterica serovar Typhi
gcaaccgcucuccgcaau

SEQ ID NO: 3665788 - RNA, 19 nt, Salmonella enterica enterica serovar Typhi
gcaaccgguacucuuccag

SEQ ID NO: 3665789 - RNA, 16 nt, Salmonella enterica enterica serovar Typhi
gcaaccguccgcucac

SEQ ID NO: 3665790 - RNA, 18 nt, Salmonella enterica enterica serovar Typhi
gcaaccugacgcugcgcc

SEQ ID NO: 3665791 - RNA, 19 nt, Salmonella enterica enterica serovar Typhi
gcaaccugacgcugcgccu

SEQ ID NO: 3665792 - RNA, 14 nt, Salmonella enterica enterica serovar Typhi
gcaaccugagcgcg

SEQ ID NO: 3665793 - RNA, 20 nt, Salmonella enterica enterica serovar Typhi
gcaacgacgucuuucuucgc

SEQ ID NO: 3665794 - RNA, 21 nt, Salmonella enterica enterica serovar Typhi
gcaacgagaacccacuuugcu

SEQ ID NO: 3665795 - RNA, 21 nt, Salmonella enterica enterica serovar Typhi
gcaacgaucccuaauaaaaua

SEQ ID NO: 3665796 - RNA, 22 nt, Salmonella enterica enterica serovar Typhi
gcaacgauucguaaauugacug

SEQ ID NO: 3665797 - RNA, 21 nt, Salmonella enterica enterica serovar Typhi
gcaacgccaucagcaaaauac

SEQ ID NO: 3665798 - RNA, 17 nt, Salmonella enterica enterica serovar Typhi
gcaacgccccgucacca

SEQ ID NO: 3665799 - RNA, 18 nt, Salmonella enterica enterica serovar Typhi
gcaacgccccgucaccag

SEQ ID NO: 3665800 - RNA, 12 nt, Salmonella enterica enterica serovar Typhi
gcaacgccgccg

SEQ ID NO: 3665801 - RNA, 18 nt, Salmonella enterica enterica serovar Typhi
gcaacgccguacuccagc

SEQ ID NO: 3665802 - RNA, 23 nt, Salmonella enterica enterica serovar Typhi
gcaacgccguacuccagcccauc

SEQ ID NO: 3665803 - RNA, 19 nt, Salmonella enterica enterica serovar Typhi
gcaacgccuccagcgggcu

SEQ ID NO: 3665804 - RNA, 13 nt, Salmonella enterica enterica serovar Typhi
gcaacgcgccauc

SEQ ID NO: 3665805 - RNA, 17 nt, Salmonella enterica enterica serovar Typhi
gcaacgcugcauccugu

SEQ ID NO: 3665806 - RNA, 20 nt, Salmonella enterica enterica serovar Typhi
gcaacgcuucugagaauuug

SEQ ID NO: 3665807 - RNA, 22 nt, Salmonella enterica enterica serovar Typhi
gcaacgcuuuagugccgccauu

SEQ ID NO: 3665808 - RNA, 18 nt, Salmonella enterica enterica serovar Typhi
gcaacggaaggaaauaac

SEQ ID NO: 3665809 - RNA, 14 nt, Salmonella enterica enterica serovar Typhi
gcaacggcagccag

SEQ ID NO: 3665810 - RNA, 16 nt, Salmonella enterica enterica serovar Typhi
gcaacggcgggauacu

SEQ ID NO: 3665811 - RNA, 16 nt, Salmonella enterica enterica serovar Typhi
gcaacgggacggcggc

SEQ ID NO: 3665812 - RNA, 20 nt, Salmonella enterica enterica serovar Typhi
gcaacgggacggcggccagc

SEQ ID NO: 3665813 - RNA, 23 nt, Salmonella enterica enterica serovar Typhi
gcaacgggacggcggccagcauu

SEQ ID NO: 3665814 - RNA, 16 nt, Salmonella enterica enterica serovar Typhi
gcaacgggcaaugcca

SEQ ID NO: 3665815 - RNA, 19 nt, Salmonella enterica enterica serovar Typhi
gcaacguaaucccgccagc

SEQ ID NO: 3665816 - RNA, 12 nt, Salmonella enterica enterica serovar Typhi
gcaacgucagua

SEQ ID NO: 3665817 - RNA, 14 nt, Salmonella enterica enterica serovar Typhi
gcaacgugaacugc

SEQ ID NO: 3665818 - RNA, 18 nt, Salmonella enterica enterica serovar Typhi
gcaacgugaacugcgccu

SEQ ID NO: 3665819 - RNA, 22 nt, Salmonella enterica enterica serovar Typhi
gcaacguucagcucgauccggc

SEQ ID NO: 3665820 - RNA, 15 nt, Salmonella enterica enterica serovar Typhi
gcaacguuuccgcua

SEQ ID NO: 3665821 - RNA, 21 nt, Salmonella enterica enterica serovar Typhi
gcaacguuucuuucaucagau

SEQ ID NO: 3665822 - RNA, 17 nt, Salmonella enterica enterica serovar Typhi
gcaacucacgccauucc

SEQ ID NO: 3665823 - RNA, 14 nt, Salmonella enterica enterica serovar Typhi
gcaacucgcacuga

SEQ ID NO: 3665824 - RNA, 19 nt, Salmonella enterica enterica serovar Typhi
gcaacucucccacuuugcu

SEQ ID NO: 3665825 - RNA, 15 nt, Salmonella enterica enterica serovar Typhi
gcaacugaaaccagg

SEQ ID NO: 3665826 - RNA, 15 nt, Salmonella enterica enterica serovar Typhi
gcaacugccggcuua

SEQ ID NO: 3665827 - RNA, 19 nt, Salmonella enterica enterica serovar Typhi
gcaacugccggcuuaccag

SEQ ID NO: 3665828 - RNA, 11 nt, Salmonella enterica enterica serovar Typhi
gcaacugcgcc

SEQ ID NO: 3665829 - RNA, 13 nt, Salmonella enterica enterica serovar Typhi
gcaacugcugcgc

SEQ ID NO: 3665830 - RNA, 17 nt, Salmonella enterica enterica serovar Typhi
gcaacugcugcgcgugc

SEQ ID NO: 3665831 - RNA, 19 nt, Salmonella enterica enterica serovar Typhi
gcaacugcugcgcgugcug

SEQ ID NO: 3665832 - RNA, 21 nt, Salmonella enterica enterica serovar Typhi
gcaacuggcaagcgcuaagca

SEQ ID NO: 3665833 - RNA, 15 nt, Salmonella enterica enterica serovar Typhi
gcaacuggcaauagc

SEQ ID NO: 3665834 - RNA, 14 nt, Salmonella enterica enterica serovar Typhi
gcaacuguuuuacc

SEQ ID NO: 3665835 - RNA, 22 nt, Salmonella enterica enterica serovar Typhi
gcaacuguuuuaccaaaucaau

SEQ ID NO: 3665836 - RNA, 22 nt, Salmonella enterica enterica serovar Typhi
gcaacuuacgcccuauccggcc

SEQ ID NO: 3665837 - RNA, 15 nt, Salmonella enterica enterica serovar Typhi
gcaacuuagugucca

SEQ ID NO: 3665838 - RNA, 17 nt, Salmonella enterica enterica serovar Typhi
gcaacuucagaauccag

SEQ ID NO: 3665839 - RNA, 17 nt, Salmonella enterica enterica serovar Typhi
gcaagaaccgcuuuucc

SEQ ID NO: 3665840 - RNA, 19 nt, Salmonella enterica enterica serovar Typhi
gcaagaaucacgccgauga

SEQ ID NO: 3665841 - RNA, 18 nt, Salmonella enterica enterica serovar Typhi
gcaagacccgaaccugcg

SEQ ID NO: 3665842 - RNA, 14 nt, Salmonella enterica enterica serovar Typhi
gcaagaccuauccg

SEQ ID NO: 3665843 - RNA, 14 nt, Salmonella enterica enterica serovar Typhi
gcaagagauucagg

SEQ ID NO: 3665844 - RNA, 16 nt, Salmonella enterica enterica serovar Typhi
gcaagaggugacucac

SEQ ID NO: 3665845 - RNA, 16 nt, Salmonella enterica enterica serovar Typhi
gcaagauuucaaaacc

SEQ ID NO: 3665846 - RNA, 16 nt, Salmonella enterica enterica serovar Typhi
gcaagcacuggucaag

SEQ ID NO: 3665847 - RNA, 13 nt, Salmonella enterica enterica serovar Typhi
gcaagcagcacac

SEQ ID NO: 3665848 - RNA, 20 nt, Salmonella enterica enterica serovar Typhi
gcaagcauaaaaaacaucau

SEQ ID NO: 3665849 - RNA, 17 nt, Salmonella enterica enterica serovar Typhi
gcaagcgcuaagcaaca

SEQ ID NO: 3665850 - RNA, 20 nt, Salmonella enterica enterica serovar Typhi
gcaagcugcuuuuugagcgg

SEQ ID NO: 3665851 - RNA, 20 nt, Salmonella enterica enterica serovar Typhi
gcaaggaacaguagaggggg

SEQ ID NO: 3665852 - RNA, 21 nt, Salmonella enterica enterica serovar Typhi
gcaaggagacgcccgucacca

SEQ ID NO: 3665853 - RNA, 17 nt, Salmonella enterica enterica serovar Typhi
gcaaggucugcgcccac

SEQ ID NO: 3665854 - RNA, 19 nt, Salmonella enterica enterica serovar Typhi
gcaauaaacaucagccauu

SEQ ID NO: 3665855 - RNA, 22 nt, Salmonella enterica enterica serovar Typhi
gcaauaacaccggcggcgccau

SEQ ID NO: 3665856 - RNA, 18 nt, Salmonella enterica enterica serovar Typhi
gcaauaauguuugcgcca

SEQ ID NO: 3665857 - RNA, 19 nt, Salmonella enterica enterica serovar Typhi
gcaauacuguaagccucgc

SEQ ID NO: 3665858 - RNA, 22 nt, Salmonella enterica enterica serovar Typhi
gcaauagaauaggaaauaauua

SEQ ID NO: 3665859 - RNA, 17 nt, Salmonella enterica enterica serovar Typhi
gcaauagaguaaugaca

SEQ ID NO: 3665860 - RNA, 17 nt, Salmonella enterica enterica serovar Typhi
gcaauagccaauaacgu

SEQ ID NO: 3665861 - RNA, 16 nt, Salmonella enterica enterica serovar Typhi
gcaauaucgaugccag

SEQ ID NO: 3665862 - RNA, 14 nt, Salmonella enterica enterica serovar Typhi
gcaauaugcggcgc

SEQ ID NO: 3665863 - RNA, 18 nt, Salmonella enterica enterica serovar Typhi
gcaauaugcggcgccauc

SEQ ID NO: 3665864 - RNA, 24 nt, Salmonella enterica enterica serovar Typhi
gcaauaugucuuaaacagcgauca

SEQ ID NO: 3665865 - RNA, 19 nt, Salmonella enterica enterica serovar Typhi
gcaauauguuuaaagaaga

SEQ ID NO: 3665866 - RNA, 20 nt, Salmonella enterica enterica serovar Typhi
gcaauauuaaugucaugcgc

SEQ ID NO: 3665867 - RNA, 20 nt, Salmonella enterica enterica serovar Typhi
gcaauauuacaaagcaguaa

SEQ ID NO: 3665868 - RNA, 18 nt, Salmonella enterica enterica serovar Typhi
gcaauauugccgcacggu

SEQ ID NO: 3665869 - RNA, 17 nt, Salmonella enterica enterica serovar Typhi
gcaaucacaagcuguuu

SEQ ID NO: 3665870 - RNA, 14 nt, Salmonella enterica enterica serovar Typhi
gcaaucacacuaca

SEQ ID NO: 3665871 - RNA, 18 nt, Salmonella enterica enterica serovar Typhi
gcaaucacauacagcacu

SEQ ID NO: 3665872 - RNA, 15 nt, Salmonella enterica enterica serovar Typhi
gcaaucaccugcauc

SEQ ID NO: 3665873 - RNA, 22 nt, Salmonella enterica enterica serovar Typhi
gcaaucacguuuugcagcgcca

SEQ ID NO: 3665874 - RNA, 12 nt, Salmonella enterica enterica serovar Typhi
gcaaucacuuca

SEQ ID NO: 3665875 - RNA, 19 nt, Salmonella enterica enterica serovar Typhi
gcaaucacuuccgccucgc

SEQ ID NO: 3665876 - RNA, 13 nt, Salmonella enterica enterica serovar Typhi
gcaaucagcagcc

SEQ ID NO: 3665877 - RNA, 18 nt, Salmonella enterica enterica serovar Typhi
gcaaucaguggcggcaaa

SEQ ID NO: 3665878 - RNA, 12 nt, Salmonella enterica enterica serovar Typhi
gcaaucaucaga

SEQ ID NO: 3665879 - RNA, 18 nt, Salmonella enterica enterica serovar Typhi
gcaaucauccugauuuua

SEQ ID NO: 3665880 - RNA, 22 nt, Salmonella enterica enterica serovar Typhi
gcaaucauccugauuuuacuga

SEQ ID NO: 3665881 - RNA, 21 nt, Salmonella enterica enterica serovar Typhi
gcaaucgacguugaucgccau

SEQ ID NO: 3665882 - RNA, 14 nt, Salmonella enterica enterica serovar Typhi
gcaaucgagaucag

SEQ ID NO: 3665883 - RNA, 14 nt, Salmonella enterica enterica serovar Typhi
gcaaucgccucauc

SEQ ID NO: 3665884 - RNA, 20 nt, Salmonella enterica enterica serovar Typhi
gcaaucgccugcaacgcuuu

SEQ ID NO: 3665885 - RNA, 15 nt, Salmonella enterica enterica serovar Typhi
gcaaucggcuuugac

SEQ ID NO: 3665886 - RNA, 18 nt, Salmonella enterica enterica serovar Typhi
gcaaucucuggccaggca

SEQ ID NO: 3665887 - RNA, 20 nt, Salmonella enterica enterica serovar Typhi
gcaaucucuuuauugcuggu

SEQ ID NO: 3665888 - RNA, 21 nt, Salmonella enterica enterica serovar Typhi
gcaaucuuuacccggcgcaaa

SEQ ID NO: 3665889 - RNA, 19 nt, Salmonella enterica enterica serovar Typhi
gcaaugagcggccagcggg

SEQ ID NO: 3665890 - RNA, 22 nt, Salmonella enterica enterica serovar Typhi
gcaaugauuuuaucaagucgcg

SEQ ID NO: 3665891 - RNA, 15 nt, Salmonella enterica enterica serovar Typhi
gcaaugccaccacac

SEQ ID NO: 3665892 - RNA, 18 nt, Salmonella enterica enterica serovar Typhi
gcaaugccaccagcgcca

SEQ ID NO: 3665893 - RNA, 20 nt, Salmonella enterica enterica serovar Typhi
gcaaugccaccagcgccaua

SEQ ID NO: 3665894 - RNA, 13 nt, Salmonella enterica enterica serovar Typhi
gcaaugcccacgc

SEQ ID NO: 3665895 - RNA, 15 nt, Salmonella enterica enterica serovar Typhi
gcaaugccccgccgc

SEQ ID NO: 3665896 - RNA, 16 nt, Salmonella enterica enterica serovar Typhi
gcaaugcgaauaacau

SEQ ID NO: 3665897 - RNA, 20 nt, Salmonella enterica enterica serovar Typhi
gcaaugcgcuuuuuuugccc

SEQ ID NO: 3665898 - RNA, 17 nt, Salmonella enterica enterica serovar Typhi
gcaaugucugccucggg

SEQ ID NO: 3665899 - RNA, 16 nt, Salmonella enterica enterica serovar Typhi
gcaauguggacaauca

SEQ ID NO: 3665900 - RNA, 20 nt, Salmonella enterica enterica serovar Typhi
gcaauguggacaaucaggcu

SEQ ID NO: 3665901 - RNA, 20 nt, Salmonella enterica enterica serovar Typhi
gcaauguucaauaucaaauu

SEQ ID NO: 3665902 - RNA, 15 nt, Salmonella enterica enterica serovar Typhi
gcaauuaaauuagaa

SEQ ID NO: 3665903 - RNA, 16 nt, Salmonella enterica enterica serovar Typhi
gcaauuaacaaauaaa

SEQ ID NO: 3665904 - RNA, 23 nt, Salmonella enterica enterica serovar Typhi
gcaauuaauaaacaaugcaggua

SEQ ID NO: 3665905 - RNA, 12 nt, Salmonella enterica enterica serovar Typhi
gcaauuaauauu

SEQ ID NO: 3665906 - RNA, 21 nt, Salmonella enterica enterica serovar Typhi
gcaauuauauugcguaaaaac

SEQ ID NO: 3665907 - RNA, 19 nt, Salmonella enterica enterica serovar Typhi
gcaauucaaacugacugau

SEQ ID NO: 3665908 - RNA, 22 nt, Salmonella enterica enterica serovar Typhi
gcaauucagguaauacgcgucu

SEQ ID NO: 3665909 - RNA, 12 nt, Salmonella enterica enterica serovar Typhi
gcaauucauccu

SEQ ID NO: 3665910 - RNA, 16 nt, Salmonella enterica enterica serovar Typhi
gcaauuccgccaucuc

SEQ ID NO: 3665911 - RNA, 23 nt, Salmonella enterica enterica serovar Typhi
gcaauuccgcuuucuucccggca

SEQ ID NO: 3665912 - RNA, 21 nt, Salmonella enterica enterica serovar Typhi
gcaauuccggcgaaaaaccga

SEQ ID NO: 3665913 - RNA, 17 nt, Salmonella enterica enterica serovar Typhi
gcaauuccggucaucgc

SEQ ID NO: 3665914 - RNA, 23 nt, Salmonella enterica enterica serovar Typhi
gcaauucgagauuuuucugcgcc

SEQ ID NO: 3665915 - RNA, 16 nt, Salmonella enterica enterica serovar Typhi
gcaauucggacacgcu

SEQ ID NO: 3665916 - RNA, 17 nt, Salmonella enterica enterica serovar Typhi
gcaauugauacauuuuu

SEQ ID NO: 3665917 - RNA, 13 nt, Salmonella enterica enterica serovar Typhi
gcaauugccgaua

SEQ ID NO: 3665918 - RNA, 15 nt, Salmonella enterica enterica serovar Typhi
gcaauuguugcgcca

SEQ ID NO: 3665919 - RNA, 20 nt, Salmonella enterica enterica serovar Typhi
gcacaaaaaguaguuccagc

SEQ ID NO: 3665920 - RNA, 23 nt, Salmonella enterica enterica serovar Typhi
gcacaacacgcuuuucagcgcca

SEQ ID NO: 3665921 - RNA, 13 nt, Salmonella enterica enterica serovar Typhi
gcacaacaggggg

SEQ ID NO: 3665922 - RNA, 15 nt, Salmonella enterica enterica serovar Typhi
gcacaacccaaaggc

SEQ ID NO: 3665923 - RNA, 21 nt, Salmonella enterica enterica serovar Typhi
gcacaacgcauuggcaauuaa

SEQ ID NO: 3665924 - RNA, 16 nt, Salmonella enterica enterica serovar Typhi
gcacaacggccagcaa

SEQ ID NO: 3665925 - RNA, 11 nt, Salmonella enterica enterica serovar Typhi
gcacaagccau

SEQ ID NO: 3665926 - RNA, 22 nt, Salmonella enterica enterica serovar Typhi
gcacaauaacgucacgauagcg

SEQ ID NO: 3665927 - RNA, 20 nt, Salmonella enterica enterica serovar Typhi
gcacaauaccaauaagaacu

SEQ ID NO: 3665928 - RNA, 13 nt, Salmonella enterica enterica serovar Typhi
gcacaauagcgcu

SEQ ID NO: 3665929 - RNA, 13 nt, Salmonella enterica enterica serovar Typhi
gcacaaucgccag

SEQ ID NO: 3665930 - RNA, 17 nt, Salmonella enterica enterica serovar Typhi
gcacaaugcccggcaua

SEQ ID NO: 3665931 - RNA, 12 nt, Salmonella enterica enterica serovar Typhi
gcacacagcgcu

SEQ ID NO: 3665932 - RNA, 12 nt, Salmonella enterica enterica serovar Typhi
gcacacaggccg

SEQ ID NO: 3665933 - RNA, 13 nt, Salmonella enterica enterica serovar Typhi
gcacaccauuuca

SEQ ID NO: 3665934 - RNA, 15 nt, Salmonella enterica enterica serovar Typhi
gcacaccauuucaca

SEQ ID NO: 3665935 - RNA, 16 nt, Salmonella enterica enterica serovar Typhi
gcacacgcagcugaug

SEQ ID NO: 3665936 - RNA, 14 nt, Salmonella enterica enterica serovar Typhi
gcacacgucugagc

SEQ ID NO: 3665937 - RNA, 18 nt, Salmonella enterica enterica serovar Typhi
gcacacucauuuugccgu

SEQ ID NO: 3665938 - RNA, 13 nt, Salmonella enterica enterica serovar Typhi
gcacagaagcgcc

SEQ ID NO: 3665939 - RNA, 15 nt, Salmonella enterica enterica serovar Typhi
gcacagcacauagaa

SEQ ID NO: 3665940 - RNA, 20 nt, Salmonella enterica enterica serovar Typhi
gcacagcacuaacgaggcca

SEQ ID NO: 3665941 - RNA, 14 nt, Salmonella enterica enterica serovar Typhi
gcacagcauaccgu

SEQ ID NO: 3665942 - RNA, 15 nt, Salmonella enterica enterica serovar Typhi
gcacagccaguaaga

SEQ ID NO: 3665943 - RNA, 19 nt, Salmonella enterica enterica serovar Typhi
gcacagccaguaagaacga

SEQ ID NO: 3665944 - RNA, 19 nt, Salmonella enterica enterica serovar Typhi
gcacagcgcuaucaggcac

SEQ ID NO: 3665945 - RNA, 16 nt, Salmonella enterica enterica serovar Typhi
gcacaggccuucauga

SEQ ID NO: 3665946 - RNA, 22 nt, Salmonella enterica enterica serovar Typhi
gcacaggcgcggagacgugacc

SEQ ID NO: 3665947 - RNA, 18 nt, Salmonella enterica enterica serovar Typhi
gcacagggugaaaucacg

SEQ ID NO: 3665948 - RNA, 15 nt, Salmonella enterica enterica serovar Typhi
gcacagguacaggcc

SEQ ID NO: 3665949 - RNA, 20 nt, Salmonella enterica enterica serovar Typhi
gcacagguacaggccgccgc

SEQ ID NO: 3665950 - RNA, 21 nt, Salmonella enterica enterica serovar Typhi
gcacagguacaggccgccgcc

SEQ ID NO: 3665951 - RNA, 12 nt, Salmonella enterica enterica serovar Typhi
gcacaucagcaa

SEQ ID NO: 3665952 - RNA, 21 nt, Salmonella enterica enterica serovar Typhi
gcacaucaugaugaucuucag

SEQ ID NO: 3665953 - RNA, 17 nt, Salmonella enterica enterica serovar Typhi
gcacaucgccauuaaaa

SEQ ID NO: 3665954 - RNA, 18 nt, Salmonella enterica enterica serovar Typhi
gcacaucgccauuaaaag

SEQ ID NO: 3665955 - RNA, 16 nt, Salmonella enterica enterica serovar Typhi
gcacaugacggcugac

SEQ ID NO: 3665956 - RNA, 17 nt, Salmonella enterica enterica serovar Typhi
gcacaugacggcugacg

SEQ ID NO: 3665957 - RNA, 14 nt, Salmonella enterica enterica serovar Typhi
gcacaugggcagga

SEQ ID NO: 3665958 - RNA, 18 nt, Salmonella enterica enterica serovar Typhi
gcacauguuucagcaccu

SEQ ID NO: 3665959 - RNA, 13 nt, Salmonella enterica enterica serovar Typhi
gcacauuacaggc

SEQ ID NO: 3665960 - RNA, 13 nt, Salmonella enterica enterica serovar Typhi
gcacauuagcaau

SEQ ID NO: 3665961 - RNA, 18 nt, Salmonella enterica enterica serovar Typhi
gcacauucagcagcgccc

SEQ ID NO: 3665962 - RNA, 17 nt, Salmonella enterica enterica serovar Typhi
gcacauuguugcaggga

SEQ ID NO: 3665963 - RNA, 18 nt, Salmonella enterica enterica serovar Typhi
gcacauuuacgccagcca

SEQ ID NO: 3665964 - RNA, 15 nt, Salmonella enterica enterica serovar Typhi
gcaccaccaggaacg

SEQ ID NO: 3665965 - RNA, 19 nt, Salmonella enterica enterica serovar Typhi
gcaccaccaggaacgccau

SEQ ID NO: 3665966 - RNA, 20 nt, Salmonella enterica enterica serovar Typhi
gcaccaccaggaacgccaua

SEQ ID NO: 3665967 - RNA, 19 nt, Salmonella enterica enterica serovar Typhi
gcaccacgaccagacuggu

SEQ ID NO: 3665968 - RNA, 17 nt, Salmonella enterica enterica serovar Typhi
gcaccacgcaaaccgcu

SEQ ID NO: 3665969 - RNA, 19 nt, Salmonella enterica enterica serovar Typhi
gcaccacuuuguuuuuguc

SEQ ID NO: 3665970 - RNA, 21 nt, Salmonella enterica enterica serovar Typhi
gcaccagaacucccuguuccu

SEQ ID NO: 3665971 - RNA, 13 nt, Salmonella enterica enterica serovar Typhi
gcaccagcaacac

SEQ ID NO: 3665972 - RNA, 16 nt, Salmonella enterica enterica serovar Typhi
gcaccagcaacacauc

SEQ ID NO: 3665973 - RNA, 15 nt, Salmonella enterica enterica serovar Typhi
gcaccagcaaugaua

SEQ ID NO: 3665974 - RNA, 15 nt, Salmonella enterica enterica serovar Typhi
gcaccagcauuagcg

SEQ ID NO: 3665975 - RNA, 13 nt, Salmonella enterica enterica serovar Typhi
gcaccagccagga

SEQ ID NO: 3665976 - RNA, 13 nt, Salmonella enterica enterica serovar Typhi
gcaccagccaggc

SEQ ID NO: 3665977 - RNA, 14 nt, Salmonella enterica enterica serovar Typhi
gcaccagccaggcg

SEQ ID NO: 3665978 - RNA, 23 nt, Salmonella enterica enterica serovar Typhi
gcaccagccaggcgaucgcacag

SEQ ID NO: 3665979 - RNA, 20 nt, Salmonella enterica enterica serovar Typhi
gcaccagcucuacaucgccg

SEQ ID NO: 3665980 - RNA, 20 nt, Salmonella enterica enterica serovar Typhi
gcaccaguucacuccuaaga

SEQ ID NO: 3665981 - RNA, 23 nt, Salmonella enterica enterica serovar Typhi
gcaccaguucacuccuaagagaa

SEQ ID NO: 3665982 - RNA, 20 nt, Salmonella enterica enterica serovar Typhi
gcaccaguuccccauacuga

SEQ ID NO: 3665983 - RNA, 20 nt, Salmonella enterica enterica serovar Typhi
gcaccauaccuauaaaaaug

SEQ ID NO: 3665984 - RNA, 24 nt, Salmonella enterica enterica serovar Typhi
gcaccaucaacgccggugauuuua

SEQ ID NO: 3665985 - RNA, 18 nt, Salmonella enterica enterica serovar Typhi
gcaccaucuuuuccggca

SEQ ID NO: 3665986 - RNA, 22 nt, Salmonella enterica enterica serovar Typhi
gcaccaucuuuuccggcagggu

SEQ ID NO: 3665987 - RNA, 17 nt, Salmonella enterica enterica serovar Typhi
gcaccauucccacgcau

SEQ ID NO: 3665988 - RNA, 14 nt, Salmonella enterica enterica serovar Typhi
gcacccaucuuuac

SEQ ID NO: 3665989 - RNA, 15 nt, Salmonella enterica enterica serovar Typhi
gcacccggagagaaa

SEQ ID NO: 3665990 - RNA, 18 nt, Salmonella enterica enterica serovar Typhi
gcacccuucgcuauccau

SEQ ID NO: 3665991 - RNA, 16 nt, Salmonella enterica enterica serovar Typhi
gcaccgccagcgccgc

SEQ ID NO: 3665992 - RNA, 13 nt, Salmonella enterica enterica serovar Typhi
gcaccgccgcauc

SEQ ID NO: 3665993 - RNA, 16 nt, Salmonella enterica enterica serovar Typhi
gcaccgcuaaaaaaca

SEQ ID NO: 3665994 - RNA, 15 nt, Salmonella enterica enterica serovar Typhi
gcaccguaaacggcu

SEQ ID NO: 3665995 - RNA, 18 nt, Salmonella enterica enterica serovar Typhi
gcaccucaauaugaaauu

SEQ ID NO: 3665996 - RNA, 21 nt, Salmonella enterica enterica serovar Typhi
gcaccucaauaugaaauucuu

SEQ ID NO: 3665997 - RNA, 13 nt, Salmonella enterica enterica serovar Typhi
gcaccuccagcgc

SEQ ID NO: 3665998 - RNA, 12 nt, Salmonella enterica enterica serovar Typhi
gcaccuggaagu

SEQ ID NO: 3665999 - RNA, 18 nt, Salmonella enterica enterica serovar Typhi
gcaccuggagcgccuccc

SEQ ID NO: 3666000 - RNA, 20 nt, Salmonella enterica enterica serovar Typhi
gcaccugggaaucgugcaau

SEQ ID NO: 3666001 - RNA, 20 nt, Salmonella enterica enterica serovar Typhi
gcaccuguuucugcuggccu

SEQ ID NO: 3666002 - RNA, 21 nt, Salmonella enterica enterica serovar Typhi
gcaccuuaaccgucugcucag

SEQ ID NO: 3666003 - RNA, 12 nt, Salmonella enterica enterica serovar Typhi
gcacgaaaaaua

SEQ ID NO: 3666004 - RNA, 14 nt, Salmonella enterica enterica serovar Typhi
gcacgaaaaauaaa

SEQ ID NO: 3666005 - RNA, 13 nt, Salmonella enterica enterica serovar Typhi
gcacgaaauguag

SEQ ID NO: 3666006 - RNA, 22 nt, Salmonella enterica enterica serovar Typhi
gcacgaacauaccggagccugg

SEQ ID NO: 3666007 - RNA, 16 nt, Salmonella enterica enterica serovar Typhi
gcacgacacaaaagca

SEQ ID NO: 3666008 - RNA, 17 nt, Salmonella enterica enterica serovar Typhi
gcacgacagagaucagg

SEQ ID NO: 3666009 - RNA, 13 nt, Salmonella enterica enterica serovar Typhi
gcacgacagugcu

SEQ ID NO: 3666010 - RNA, 16 nt, Salmonella enterica enterica serovar Typhi
gcacgacguagcccau

SEQ ID NO: 3666011 - RNA, 18 nt, Salmonella enterica enterica serovar Typhi
gcacgauauccagcaccu

SEQ ID NO: 3666012 - RNA, 17 nt, Salmonella enterica enterica serovar Typhi
gcacgcacgacagugcu

SEQ ID NO: 3666013 - RNA, 12 nt, Salmonella enterica enterica serovar Typhi
gcacgccagcgc

SEQ ID NO: 3666014 - RNA, 12 nt, Salmonella enterica enterica serovar Typhi
gcacgccagcgg

SEQ ID NO: 3666015 - RNA, 12 nt, Salmonella enterica enterica serovar Typhi
gcacgccagggu

SEQ ID NO: 3666016 - RNA, 14 nt, Salmonella enterica enterica serovar Typhi
gcacgccaggguaa

SEQ ID NO: 3666017 - RNA, 18 nt, Salmonella enterica enterica serovar Typhi
gcacgcccauauccagcu

SEQ ID NO: 3666018 - RNA, 17 nt, Salmonella enterica enterica serovar Typhi
gcacgcccgcauucaua

SEQ ID NO: 3666019 - RNA, 21 nt, Salmonella enterica enterica serovar Typhi
gcacgcccgcauucauaagca

SEQ ID NO: 3666020 - RNA, 18 nt, Salmonella enterica enterica serovar Typhi
gcacgcccuucgucagga

SEQ ID NO: 3666021 - RNA, 21 nt, Salmonella enterica enterica serovar Typhi
gcacgccguuugccauaucug

SEQ ID NO: 3666022 - RNA, 16 nt, Salmonella enterica enterica serovar Typhi
gcacgccugcauaaag

SEQ ID NO: 3666023 - RNA, 16 nt, Salmonella enterica enterica serovar Typhi
gcacgcgauuugcagc

SEQ ID NO: 3666024 - RNA, 19 nt, Salmonella enterica enterica serovar Typhi
gcacgcgccgaaugcguuu

SEQ ID NO: 3666025 - RNA, 20 nt, Salmonella enterica enterica serovar Typhi
gcacgcgucaucggcgcgcu

SEQ ID NO: 3666026 - RNA, 18 nt, Salmonella enterica enterica serovar Typhi
gcacgcuaaagcgcuggc

SEQ ID NO: 3666027 - RNA, 12 nt, Salmonella enterica enterica serovar Typhi
gcacgcugcgca

SEQ ID NO: 3666028 - RNA, 15 nt, Salmonella enterica enterica serovar Typhi
gcacgcuggcaucaa

SEQ ID NO: 3666029 - RNA, 18 nt, Salmonella enterica enterica serovar Typhi
gcacgcuggcaucaauau

SEQ ID NO: 3666030 - RNA, 14 nt, Salmonella enterica enterica serovar Typhi
gcacggauacugcu

SEQ ID NO: 3666031 - RNA, 23 nt, Salmonella enterica enterica serovar Typhi
gcacgguuaaugaaaucgucgcc

SEQ ID NO: 3666032 - RNA, 23 nt, Salmonella enterica enterica serovar Typhi
gcacguaguaaugcauggucgcc

SEQ ID NO: 3666033 - RNA, 16 nt, Salmonella enterica enterica serovar Typhi
gcacguccagauacgc

SEQ ID NO: 3666034 - RNA, 15 nt, Salmonella enterica enterica serovar Typhi
gcacgucgcgcucgc

SEQ ID NO: 3666035 - RNA, 23 nt, Salmonella enterica enterica serovar Typhi
gcacguuaaagccgaccaucgcg

SEQ ID NO: 3666036 - RNA, 15 nt, Salmonella enterica enterica serovar Typhi
gcacguuuuccaggu

SEQ ID NO: 3666037 - RNA, 14 nt, Salmonella enterica enterica serovar Typhi
gcacuaccaccuca

SEQ ID NO: 3666038 - RNA, 24 nt, Salmonella enterica enterica serovar Typhi
gcacuacgguccaguugcccucuu

SEQ ID NO: 3666039 - RNA, 13 nt, Salmonella enterica enterica serovar Typhi
gcacucaccucuu

SEQ ID NO: 3666040 - RNA, 14 nt, Salmonella enterica enterica serovar Typhi
gcacucaccucuuc

SEQ ID NO: 3666041 - RNA, 17 nt, Salmonella enterica enterica serovar Typhi
gcacucagaaaauuauu

SEQ ID NO: 3666042 - RNA, 22 nt, Salmonella enterica enterica serovar Typhi
gcacucagaaaauuauuuuaaa

SEQ ID NO: 3666043 - RNA, 16 nt, Salmonella enterica enterica serovar Typhi
gcacucgcgacauggc

SEQ ID NO: 3666044 - RNA, 19 nt, Salmonella enterica enterica serovar Typhi
gcacucuauucaugcauua

SEQ ID NO: 3666045 - RNA, 17 nt, Salmonella enterica enterica serovar Typhi
gcacugauagccgccag

SEQ ID NO: 3666046 - RNA, 18 nt, Salmonella enterica enterica serovar Typhi
gcacugauagccgccagu

SEQ ID NO: 3666047 - RNA, 19 nt, Salmonella enterica enterica serovar Typhi
gcacugcaauuucugcugg

SEQ ID NO: 3666048 - RNA, 12 nt, Salmonella enterica enterica serovar Typhi
gcacugcaccug

SEQ ID NO: 3666049 - RNA, 14 nt, Salmonella enterica enterica serovar Typhi
gcacugcaccuggu

SEQ ID NO: 3666050 - RNA, 15 nt, Salmonella enterica enterica serovar Typhi
gcacugcaccugguc

SEQ ID NO: 3666051 - RNA, 18 nt, Salmonella enterica enterica serovar Typhi
gcacuguaacgcacuggu

SEQ ID NO: 3666052 - RNA, 21 nt, Salmonella enterica enterica serovar Typhi
gcacuuacucuacauucuguu

SEQ ID NO: 3666053 - RNA, 14 nt, Salmonella enterica enterica serovar Typhi
gcacuucgcugaua

SEQ ID NO: 3666054 - RNA, 17 nt, Salmonella enterica enterica serovar Typhi
gcacuugagaaauuauu

SEQ ID NO: 3666055 - RNA, 13 nt, Salmonella enterica enterica serovar Typhi
gcacuuuaaacca

SEQ ID NO: 3666056 - RNA, 14 nt, Salmonella enterica enterica serovar Typhi
gcacuuuugccagg

SEQ ID NO: 3666057 - RNA, 17 nt, Salmonella enterica enterica serovar Typhi
gcacuuuuuccuccugc

SEQ ID NO: 3666058 - RNA, 20 nt, Salmonella enterica enterica serovar Typhi
gcagaaaaagcccccaucac

SEQ ID NO: 3666059 - RNA, 16 nt, Salmonella enterica enterica serovar Typhi
gcagaaaaaucagcau

SEQ ID NO: 3666060 - RNA, 12 nt, Salmonella enterica enterica serovar Typhi
gcagaaaaccgg

SEQ ID NO: 3666061 - RNA, 20 nt, Salmonella enterica enterica serovar Typhi
gcagaaauaaaauacuucca

SEQ ID NO: 3666062 - RNA, 18 nt, Salmonella enterica enterica serovar Typhi
gcagaaauucggcagcgu

SEQ ID NO: 3666063 - RNA, 18 nt, Salmonella enterica enterica serovar Typhi
gcagaacaaacagaccgc

SEQ ID NO: 3666064 - RNA, 15 nt, Salmonella enterica enterica serovar Typhi
gcagaacggcgacgg

SEQ ID NO: 3666065 - RNA, 17 nt, Salmonella enterica enterica serovar Typhi
gcagaaguaaauccggc

SEQ ID NO: 3666066 - RNA, 20 nt, Salmonella enterica enterica serovar Typhi
gcagaauauuuuucucagcc

SEQ ID NO: 3666067 - RNA, 22 nt, Salmonella enterica enterica serovar Typhi
gcagaauauuuuucucagccag

SEQ ID NO: 3666068 - RNA, 18 nt, Salmonella enterica enterica serovar Typhi
gcagaauuaacucaucac

SEQ ID NO: 3666069 - RNA, 16 nt, Salmonella enterica enterica serovar Typhi
gcagaauuuauuucug

SEQ ID NO: 3666070 - RNA, 21 nt, Salmonella enterica enterica serovar Typhi
gcagaauuuauuucugcgcga

SEQ ID NO: 3666071 - RNA, 16 nt, Salmonella enterica enterica serovar Typhi
gcagacaauaaacggu

SEQ ID NO: 3666072 - RNA, 18 nt, Salmonella enterica enterica serovar Typhi
gcagacaauuuccgccgc

SEQ ID NO: 3666073 - RNA, 19 nt, Salmonella enterica enterica serovar Typhi
gcagacaauuuucuucaug

SEQ ID NO: 3666074 - RNA, 14 nt, Salmonella enterica enterica serovar Typhi
gcagacacugccac

SEQ ID NO: 3666075 - RNA, 15 nt, Salmonella enterica enterica serovar Typhi
gcagacacugccacc

SEQ ID NO: 3666076 - RNA, 21 nt, Salmonella enterica enterica serovar Typhi
gcagacaguggccaucuucca

SEQ ID NO: 3666077 - RNA, 17 nt, Salmonella enterica enterica serovar Typhi
gcagacauauuuucucu

SEQ ID NO: 3666078 - RNA, 13 nt, Salmonella enterica enterica serovar Typhi
gcagacaucgcgc

SEQ ID NO: 3666079 - RNA, 15 nt, Salmonella enterica enterica serovar Typhi
gcagacaucgcgcca

SEQ ID NO: 3666080 - RNA, 22 nt, Salmonella enterica enterica serovar Typhi
gcagacaugaccgcacagcaga

SEQ ID NO: 3666081 - RNA, 14 nt, Salmonella enterica enterica serovar Typhi
gcagacauucgcgc

SEQ ID NO: 3666082 - RNA, 15 nt, Salmonella enterica enterica serovar Typhi
gcagacauucgcgca

SEQ ID NO: 3666083 - RNA, 21 nt, Salmonella enterica enterica serovar Typhi
gcagacccacuuucagcuccg

SEQ ID NO: 3666084 - RNA, 14 nt, Salmonella enterica enterica serovar Typhi
gcagaccggcagcc

SEQ ID NO: 3666085 - RNA, 16 nt, Salmonella enterica enterica serovar Typhi
gcagaccggcagccug

SEQ ID NO: 3666086 - RNA, 14 nt, Salmonella enterica enterica serovar Typhi
gcagaccuauaugg

SEQ ID NO: 3666087 - RNA, 20 nt, Salmonella enterica enterica serovar Typhi
gcagaccuguucuguaggcu

SEQ ID NO: 3666088 - RNA, 13 nt, Salmonella enterica enterica serovar Typhi
gcagacgccgcgg

SEQ ID NO: 3666089 - RNA, 21 nt, Salmonella enterica enterica serovar Typhi
gcagacgccgcgguugacggc

SEQ ID NO: 3666090 - RNA, 14 nt, Salmonella enterica enterica serovar Typhi
gcagacgccugccg

SEQ ID NO: 3666091 - RNA, 15 nt, Salmonella enterica enterica serovar Typhi
gcagacggagaugau

SEQ ID NO: 3666092 - RNA, 18 nt, Salmonella enterica enterica serovar Typhi
gcagacuaaaaagcgcgu

SEQ ID NO: 3666093 - RNA, 18 nt, Salmonella enterica enterica serovar Typhi
gcagacucauggacaaaa

SEQ ID NO: 3666094 - RNA, 17 nt, Salmonella enterica enterica serovar Typhi
gcagagauagccagcga

SEQ ID NO: 3666095 - RNA, 14 nt, Salmonella enterica enterica serovar Typhi
gcagagaucaggag

SEQ ID NO: 3666096 - RNA, 23 nt, Salmonella enterica enterica serovar Typhi
gcagagcgaacaguacggucagg

SEQ ID NO: 3666097 - RNA, 16 nt, Salmonella enterica enterica serovar Typhi
gcagagcggggaaacu

SEQ ID NO: 3666098 - RNA, 14 nt, Salmonella enterica enterica serovar Typhi
gcagaggucucagg

SEQ ID NO: 3666099 - RNA, 14 nt, Salmonella enterica enterica serovar Typhi
gcagagugagcagg

SEQ ID NO: 3666100 - RNA, 15 nt, Salmonella enterica enterica serovar Typhi
gcagauaaaccacgc

SEQ ID NO: 3666101 - RNA, 14 nt, Salmonella enterica enterica serovar Typhi
gcagauaacaggca

SEQ ID NO: 3666102 - RNA, 18 nt, Salmonella enterica enterica serovar Typhi
gcagauaaccgucggcgc

SEQ ID NO: 3666103 - RNA, 13 nt, Salmonella enterica enterica serovar Typhi
gcagauaccagcc

SEQ ID NO: 3666104 - RNA, 14 nt, Salmonella enterica enterica serovar Typhi
gcagauacgcguca

SEQ ID NO: 3666105 - RNA, 15 nt, Salmonella enterica enterica serovar Typhi
gcagauacugguaaa

SEQ ID NO: 3666106 - RNA, 21 nt, Salmonella enterica enterica serovar Typhi
gcagauagcaaaaaagcgccu

SEQ ID NO: 3666107 - RNA, 17 nt, Salmonella enterica enterica serovar Typhi
gcagauagcccgccagc

SEQ ID NO: 3666108 - RNA, 14 nt, Salmonella enterica enterica serovar Typhi
gcagauaucuucca

SEQ ID NO: 3666109 - RNA, 18 nt, Salmonella enterica enterica serovar Typhi
gcagauccaaauggcgua

SEQ ID NO: 3666110 - RNA, 23 nt, Salmonella enterica enterica serovar Typhi
gcagauccuuaacgucaaagcua

SEQ ID NO: 3666111 - RNA, 14 nt, Salmonella enterica enterica serovar Typhi
gcagaucgccugga

SEQ ID NO: 3666112 - RNA, 19 nt, Salmonella enterica enterica serovar Typhi
gcagaucggccuguuuuuc

SEQ ID NO: 3666113 - RNA, 15 nt, Salmonella enterica enterica serovar Typhi
gcagaucguauccag

SEQ ID NO: 3666114 - RNA, 18 nt, Salmonella enterica enterica serovar Typhi
gcagaucguuuacgaccu

SEQ ID NO: 3666115 - RNA, 17 nt, Salmonella enterica enterica serovar Typhi
gcagaucugucgccaug

SEQ ID NO: 3666116 - RNA, 18 nt, Salmonella enterica enterica serovar Typhi
gcagaucugucgccauga

SEQ ID NO: 3666117 - RNA, 23 nt, Salmonella enterica enterica serovar Typhi
gcagaucugucgccaugaccugg

SEQ ID NO: 3666118 - RNA, 19 nt, Salmonella enterica enterica serovar Typhi
gcagaugcugcguuuuuuc

SEQ ID NO: 3666119 - RNA, 17 nt, Salmonella enterica enterica serovar Typhi
gcagaugguauaaauca

SEQ ID NO: 3666120 - RNA, 21 nt, Salmonella enterica enterica serovar Typhi
gcagaugguauaaaucacgcu

SEQ ID NO: 3666121 - RNA, 13 nt, Salmonella enterica enterica serovar Typhi
gcagauuuuuauc

SEQ ID NO: 3666122 - RNA, 16 nt, Salmonella enterica enterica serovar Typhi
gcagauuuuuauccgu

SEQ ID NO: 3666123 - RNA, 15 nt, Salmonella enterica enterica serovar Typhi
gcagcaaacgccaua

SEQ ID NO: 3666124 - RNA, 16 nt, Salmonella enterica enterica serovar Typhi
gcagcaaacgccauag

SEQ ID NO: 3666125 - RNA, 17 nt, Salmonella enterica enterica serovar Typhi
gcagcaaacgccauagc

SEQ ID NO: 3666126 - RNA, 12 nt, Salmonella enterica enterica serovar Typhi
gcagcaaauaau

SEQ ID NO: 3666127 - RNA, 14 nt, Salmonella enterica enterica serovar Typhi
gcagcaacccugcc

SEQ ID NO: 3666128 - RNA, 17 nt, Salmonella enterica enterica serovar Typhi
gcagcaagaauaccacu

SEQ ID NO: 3666129 - RNA, 23 nt, Salmonella enterica enterica serovar Typhi
gcagcaaucagguauuuccugcu

SEQ ID NO: 3666130 - RNA, 16 nt, Salmonella enterica enterica serovar Typhi
gcagcaaugugcgcca

SEQ ID NO: 3666131 - RNA, 20 nt, Salmonella enterica enterica serovar Typhi
gcagcaaugugcgccagaau

SEQ ID NO: 3666132 - RNA, 15 nt, Salmonella enterica enterica serovar Typhi
gcagcaccgccgcga

SEQ ID NO: 3666133 - RNA, 13 nt, Salmonella enterica enterica serovar Typhi
gcagcaccggcau

SEQ ID NO: 3666134 - RNA, 17 nt, Salmonella enterica enterica serovar Typhi
gcagcaccgguuuuucc

SEQ ID NO: 3666135 - RNA, 21 nt, Salmonella enterica enterica serovar Typhi
gcagcaccucgguauguccug

SEQ ID NO: 3666136 - RNA, 14 nt, Salmonella enterica enterica serovar Typhi
gcagcacguccaga

SEQ ID NO: 3666137 - RNA, 14 nt, Salmonella enterica enterica serovar Typhi
gcagcacugcuuaa

SEQ ID NO: 3666138 - RNA, 18 nt, Salmonella enterica enterica serovar Typhi
gcagcagaaucaggcaca

SEQ ID NO: 3666139 - RNA, 13 nt, Salmonella enterica enterica serovar Typhi
gcagcagcaggcu

SEQ ID NO: 3666140 - RNA, 20 nt, Salmonella enterica enterica serovar Typhi
gcagcagccgguauccagcg

SEQ ID NO: 3666141 - RNA, 21 nt, Salmonella enterica enterica serovar Typhi
gcagcagggauauacaaauau

SEQ ID NO: 3666142 - RNA, 18 nt, Salmonella enterica enterica serovar Typhi
gcagcaguuccccgccgc

SEQ ID NO: 3666143 - RNA, 22 nt, Salmonella enterica enterica serovar Typhi
gcagcaguuccccgccgcggcg

SEQ ID NO: 3666144 - RNA, 13 nt, Salmonella enterica enterica serovar Typhi
gcagcaucgccau

SEQ ID NO: 3666145 - RNA, 14 nt, Salmonella enterica enterica serovar Typhi
gcagcaugauaucg

SEQ ID NO: 3666146 - RNA, 22 nt, Salmonella enterica enterica serovar Typhi
gcagcauugggucaugcggaug

SEQ ID NO: 3666147 - RNA, 16 nt, Salmonella enterica enterica serovar Typhi
gcagccaacaacaggc

SEQ ID NO: 3666148 - RNA, 19 nt, Salmonella enterica enterica serovar Typhi
gcagccaacaacaggccgc

SEQ ID NO: 3666149 - RNA, 18 nt, Salmonella enterica enterica serovar Typhi
gcagccaacgccgccaua

SEQ ID NO: 3666150 - RNA, 21 nt, Salmonella enterica enterica serovar Typhi
gcagccacccuggcauaugga

SEQ ID NO: 3666151 - RNA, 13 nt, Salmonella enterica enterica serovar Typhi
gcagccacgccga

SEQ ID NO: 3666152 - RNA, 13 nt, Salmonella enterica enterica serovar Typhi
gcagccacucccg

SEQ ID NO: 3666153 - RNA, 23 nt, Salmonella enterica enterica serovar Typhi
gcagccagaaaaagggaaaagcc

SEQ ID NO: 3666154 - RNA, 19 nt, Salmonella enterica enterica serovar Typhi
gcagccaggcaaagcccca

SEQ ID NO: 3666155 - RNA, 21 nt, Salmonella enterica enterica serovar Typhi
gcagccaggcaaagccccagu

SEQ ID NO: 3666156 - RNA, 13 nt, Salmonella enterica enterica serovar Typhi
gcagccaggccau

SEQ ID NO: 3666157 - RNA, 17 nt, Salmonella enterica enterica serovar Typhi
gcagccauagcgcgccg

SEQ ID NO: 3666158 - RNA, 14 nt, Salmonella enterica enterica serovar Typhi
gcagccccagcgcc

SEQ ID NO: 3666159 - RNA, 23 nt, Salmonella enterica enterica serovar Typhi
gcagccccaguugguuguagcac

SEQ ID NO: 3666160 - RNA, 23 nt, Salmonella enterica enterica serovar Typhi
gcaggcucccuuauacaggcgca

SEQ ID NO: 3666161 - RNA, 17 nt, Salmonella enterica enterica serovar Typhi
gcaggcuggagagcaac

SEQ ID NO: 3666162 - RNA, 24 nt, Salmonella enterica enterica serovar Typhi
gcaggcuugcccauucgccgacgc

SEQ ID NO: 3666163 - RNA, 18 nt, Salmonella enterica enterica serovar Typhi
gcaggcuuugcugcugcg

SEQ ID NO: 3666164 - RNA, 21 nt, Salmonella enterica enterica serovar Typhi
gcagggauauacaaauauccc

SEQ ID NO: 3666165 - RNA, 18 nt, Salmonella enterica enterica serovar Typhi
gcagggaucguuuuucuu

SEQ ID NO: 3666166 - RNA, 14 nt, Salmonella enterica enterica serovar Typhi
gcagggcagacgcc

SEQ ID NO: 3666167 - RNA, 12 nt, Salmonella enterica enterica serovar Typhi
gcagggcugcug

SEQ ID NO: 3666168 - RNA, 15 nt, Salmonella enterica enterica serovar Typhi
gcaggggcuccugcg

SEQ ID NO: 3666169 - RNA, 18 nt, Salmonella enterica enterica serovar Typhi
gcaggguaucaucgcuua

SEQ ID NO: 3666170 - RNA, 19 nt, Salmonella enterica enterica serovar Typhi
gcagggucaggaacugcgg

SEQ ID NO: 3666171 - RNA, 18 nt, Salmonella enterica enterica serovar Typhi
gcaggguuugaccucauc

SEQ ID NO: 3666172 - RNA, 18 nt, Salmonella enterica enterica serovar Typhi
gcagguagucauauucac

SEQ ID NO: 3666173 - RNA, 17 nt, Salmonella enterica enterica serovar Typhi
gcagguaucguauccgg

SEQ ID NO: 3666174 - RNA, 14 nt, Salmonella enterica enterica serovar Typhi
gcaggucggcccga

SEQ ID NO: 3666175 - RNA, 22 nt, Salmonella enterica enterica serovar Typhi
gcaggucuucgucagcgcauac

SEQ ID NO: 3666176 - RNA, 17 nt, Salmonella enterica enterica serovar Typhi
gcaggugauggcggcuu

SEQ ID NO: 3666177 - RNA, 15 nt, Salmonella enterica enterica serovar Typhi
gcaggugcggcuggg

SEQ ID NO: 3666178 - RNA, 18 nt, Salmonella enterica enterica serovar Typhi
gcagguuaaacagacaau

SEQ ID NO: 3666179 - RNA, 20 nt, Salmonella enterica enterica serovar Typhi
gcagguuacucacugccgcc

SEQ ID NO: 3666180 - RNA, 22 nt, Salmonella enterica enterica serovar Typhi
gcagguuacucuuccaccaucc

SEQ ID NO: 3666181 - RNA, 16 nt, Salmonella enterica enterica serovar Typhi
gcagguugagucugcu

SEQ ID NO: 3666182 - RNA, 19 nt, Salmonella enterica enterica serovar Typhi
gcaguaacgcacuuuucca

SEQ ID NO: 3666183 - RNA, 22 nt, Salmonella enterica enterica serovar Typhi
gcaguaacgcacuuuuccagcc

SEQ ID NO: 3666184 - RNA, 14 nt, Salmonella enterica enterica serovar Typhi
gcaguacgcgcaac

SEQ ID NO: 3666185 - RNA, 21 nt, Salmonella enterica enterica serovar Typhi
gcaguacgcgcaaccgcauca

SEQ ID NO: 3666186 - RNA, 13 nt, Salmonella enterica enterica serovar Typhi
gcaguacggcgca

SEQ ID NO: 3666187 - RNA, 12 nt, Salmonella enterica enterica serovar Typhi
gcaguagccaug

SEQ ID NO: 3666188 - RNA, 13 nt, Salmonella enterica enterica serovar Typhi
gcaguagccaugc

SEQ ID NO: 3666189 - RNA, 14 nt, Salmonella enterica enterica serovar Typhi
gcaguauuaccgaa

SEQ ID NO: 3666190 - RNA, 21 nt, Salmonella enterica enterica serovar Typhi
gcagucagccuugaccgccug

SEQ ID NO: 3666191 - RNA, 13 nt, Salmonella enterica enterica serovar Typhi
gcaguccaacaag

SEQ ID NO: 3666192 - RNA, 16 nt, Salmonella enterica enterica serovar Typhi
gcaguccaacaaggau

SEQ ID NO: 3666193 - RNA, 14 nt, Salmonella enterica enterica serovar Typhi
gcaguccguccaga

SEQ ID NO: 3666194 - RNA, 17 nt, Salmonella enterica enterica serovar Typhi
gcagucgcuacaaccag

SEQ ID NO: 3666195 - RNA, 17 nt, Salmonella enterica enterica serovar Typhi
gcagucuggcggcagcc

SEQ ID NO: 3666196 - RNA, 16 nt, Salmonella enterica enterica serovar Typhi
gcagugaaccaucggc

SEQ ID NO: 3666197 - RNA, 17 nt, Salmonella enterica enterica serovar Typhi
gcagugaagaauggcgc

SEQ ID NO: 3666198 - RNA, 15 nt, Salmonella enterica enterica serovar Typhi
gcagugacagaggaa

SEQ ID NO: 3666199 - RNA, 23 nt, Salmonella enterica enterica serovar Typhi
gcagugacauuuaucuuccggca

SEQ ID NO: 3666200 - RNA, 16 nt, Salmonella enterica enterica serovar Typhi
gcagugaccagcauca

SEQ ID NO: 3666201 - RNA, 21 nt, Salmonella enterica enterica serovar Typhi
gcagugaguaacguuaauaca

SEQ ID NO: 3666202 - RNA, 22 nt, Salmonella enterica enterica serovar Typhi
gcagugcaguauugcaccagga

SEQ ID NO: 3666203 - RNA, 16 nt, Salmonella enterica enterica serovar Typhi
gcagugcgcuaacugg

SEQ ID NO: 3666204 - RNA, 17 nt, Salmonella enterica enterica serovar Typhi
gcagugcucgccaaaac

SEQ ID NO: 3666205 - RNA, 20 nt, Salmonella enterica enterica serovar Typhi
gcaguggccagaaugaucgc

SEQ ID NO: 3666206 - RNA, 15 nt, Salmonella enterica enterica serovar Typhi
gcaguggcucaguca

SEQ ID NO: 3666207 - RNA, 14 nt, Salmonella enterica enterica serovar Typhi
gcaguguuaaucuc

SEQ ID NO: 3666208 - RNA, 13 nt, Salmonella enterica enterica serovar Typhi
gcaguucagcagc

SEQ ID NO: 3666209 - RNA, 22 nt, Salmonella enterica enterica serovar Typhi
gcaguucagucgggaucgccag

SEQ ID NO: 3666210 - RNA, 21 nt, Salmonella enterica enterica serovar Typhi
gcaguucaucuucccgcagau

SEQ ID NO: 3666211 - RNA, 15 nt, Salmonella enterica enterica serovar Typhi
gcaguuccccgccgc

SEQ ID NO: 3666212 - RNA, 16 nt, Salmonella enterica enterica serovar Typhi
gcaguucccuacucuc

SEQ ID NO: 3666213 - RNA, 24 nt, Salmonella enterica enterica serovar Typhi
gcaguucugaagcuaaccgcgcaa

SEQ ID NO: 3666214 - RNA, 17 nt, Salmonella enterica enterica serovar Typhi
gcaguucuucgccggua

SEQ ID NO: 3666215 - RNA, 22 nt, Salmonella enterica enterica serovar Typhi
gcaguugaucguaaagcgcauc

SEQ ID NO: 3666216 - RNA, 20 nt, Salmonella enterica enterica serovar Typhi
gcaguuuauccggcgccaua

SEQ ID NO: 3666217 - RNA, 23 nt, Salmonella enterica enterica serovar Typhi
gcaguuuuaccguaaaaugcugg

SEQ ID NO: 3666218 - RNA, 14 nt, Salmonella enterica enterica serovar Typhi
gcauaaaaaagagg

SEQ ID NO: 3666219 - RNA, 14 nt, Salmonella enterica enterica serovar Typhi
gcauaaaaaaugag

SEQ ID NO: 3666220 - RNA, 19 nt, Salmonella enterica enterica serovar Typhi
gcauaaaaaaugagaaagg

SEQ ID NO: 3666221 - RNA, 17 nt, Salmonella enterica enterica serovar Typhi
gcauaaaaccgccgccc

SEQ ID NO: 3666222 - RNA, 13 nt, Salmonella enterica enterica serovar Typhi
gcauaaauaaugc

SEQ ID NO: 3666223 - RNA, 18 nt, Salmonella enterica enterica serovar Typhi
gcauaaccgcagcgcggc

SEQ ID NO: 3666224 - RNA, 19 nt, Salmonella enterica enterica serovar Typhi
gcauaaccgcgcguaaauc

SEQ ID NO: 3666225 - RNA, 12 nt, Salmonella enterica enterica serovar Typhi
gcauaagcgcga

SEQ ID NO: 3666226 - RNA, 18 nt, Salmonella enterica enterica serovar Typhi
gcauaauaaagcagcggc

SEQ ID NO: 3666227 - RNA, 15 nt, Salmonella enterica enterica serovar Typhi
gcauaauauccagga

SEQ ID NO: 3666228 - RNA, 16 nt, Salmonella enterica enterica serovar Typhi
gcauaauauccaggag

SEQ ID NO: 3666229 - RNA, 17 nt, Salmonella enterica enterica serovar Typhi
gcauaauauccaggagc

SEQ ID NO: 3666230 - RNA, 10 nt, Salmonella enterica enterica serovar Typhi
gcauaauaug

SEQ ID NO: 3666231 - RNA, 22 nt, Salmonella enterica enterica serovar Typhi
gcauaauccagcaggugcggac

SEQ ID NO: 3666232 - RNA, 16 nt, Salmonella enterica enterica serovar Typhi
gcauaaugcagccauc

SEQ ID NO: 3666233 - RNA, 20 nt, Salmonella enterica enterica serovar Typhi
gcauaauuguggaaauaaga

SEQ ID NO: 3666234 - RNA, 21 nt, Salmonella enterica enterica serovar Typhi
gcauacacgccgggcacgcug

SEQ ID NO: 3666235 - RNA, 22 nt, Salmonella enterica enterica serovar Typhi
gcauacacgccgggcacgcuga

SEQ ID NO: 3666236 - RNA, 19 nt, Salmonella enterica enterica serovar Typhi
gcauacagaugccguccau

SEQ ID NO: 3666237 - RNA, 23 nt, Salmonella enterica enterica serovar Typhi
gcauacagcgauaaccgccgccg

SEQ ID NO: 3666238 - RNA, 19 nt, Salmonella enterica enterica serovar Typhi
gcauacaggucuuuccgac

SEQ ID NO: 3666239 - RNA, 23 nt, Salmonella enterica enterica serovar Typhi
gcauacauucuguuuucgagccu

SEQ ID NO: 3666240 - RNA, 18 nt, Salmonella enterica enterica serovar Typhi
gcauaccaaguuuggcaa

SEQ ID NO: 3666241 - RNA, 23 nt, Salmonella enterica enterica serovar Typhi
gcauaccaaguuuggcaaucaaa

SEQ ID NO: 3666242 - RNA, 14 nt, Salmonella enterica enterica serovar Typhi
gcauaccagccaua

SEQ ID NO: 3666243 - RNA, 13 nt, Salmonella enterica enterica serovar Typhi
gcauaccgcccaa

SEQ ID NO: 3666244 - RNA, 17 nt, Salmonella enterica enterica serovar Typhi
gcauaccgcccagaacg

SEQ ID NO: 3666245 - RNA, 14 nt, Salmonella enterica enterica serovar Typhi
guaaugacgcggaa

SEQ ID NO: 3666246 - RNA, 24 nt, Salmonella enterica enterica serovar Typhi
guaaugacuggcuuugcgccacuu

SEQ ID NO: 3666247 - RNA, 15 nt, Salmonella enterica enterica serovar Typhi
guaaugcgccaggca

SEQ ID NO: 3666248 - RNA, 22 nt, Salmonella enterica enterica serovar Typhi
guaaugcucgcccagaauuucc

SEQ ID NO: 3666249 - RNA, 17 nt, Salmonella enterica enterica serovar Typhi
guaauggccuacacacu

SEQ ID NO: 3666250 - RNA, 12 nt, Salmonella enterica enterica serovar Typhi
guaauggucagc

SEQ ID NO: 3666251 - RNA, 22 nt, Salmonella enterica enterica serovar Typhi
guaauguugcugcaucuccagc

SEQ ID NO: 3666252 - RNA, 19 nt, Salmonella enterica enterica serovar Typhi
guaauucagcucgcugccg

SEQ ID NO: 3666253 - RNA, 23 nt, Salmonella enterica enterica serovar Typhi
guaauucaugcuguauaaacuca

SEQ ID NO: 3666254 - RNA, 14 nt, Salmonella enterica enterica serovar Typhi
guaauucucccaaa

SEQ ID NO: 3666255 - RNA, 14 nt, Salmonella enterica enterica serovar Typhi
guaauugacauggc

SEQ ID NO: 3666256 - RNA, 12 nt, Salmonella enterica enterica serovar Typhi
guaauugacgcg

SEQ ID NO: 3666257 - RNA, 23 nt, Salmonella enterica enterica serovar Typhi
guaauugcgccguucacuucaaa

SEQ ID NO: 3666258 - RNA, 13 nt, Salmonella enterica enterica serovar Typhi
guaauuuauaaag

SEQ ID NO: 3666259 - RNA, 18 nt, Salmonella enterica enterica serovar Typhi
guaauuucgcuggcggcc

SEQ ID NO: 3666260 - RNA, 19 nt, Salmonella enterica enterica serovar Typhi
guaauuugaacauauccgc

SEQ ID NO: 3666261 - RNA, 13 nt, Salmonella enterica enterica serovar Typhi
guacaaaaaaugu

SEQ ID NO: 3666262 - RNA, 13 nt, Salmonella enterica enterica serovar Typhi
guacaaacaaaua

SEQ ID NO: 3666263 - RNA, 15 nt, Salmonella enterica enterica serovar Typhi
guacaaacaaauaaa

SEQ ID NO: 3666264 - RNA, 20 nt, Salmonella enterica enterica serovar Typhi
guacaaacaaauaaauccau

SEQ ID NO: 3666265 - RNA, 21 nt, Salmonella enterica enterica serovar Typhi
guacaaaccccacccacugau

SEQ ID NO: 3666266 - RNA, 18 nt, Salmonella enterica enterica serovar Typhi
guacaagagccgccgcca

SEQ ID NO: 3666267 - RNA, 19 nt, Salmonella enterica enterica serovar Typhi
guacaagagccgccgccau

SEQ ID NO: 3666268 - RNA, 15 nt, Salmonella enterica enterica serovar Typhi
guacaauggcaggca

SEQ ID NO: 3666269 - RNA, 17 nt, Salmonella enterica enterica serovar Typhi
guacacacgcgcugacc

SEQ ID NO: 3666270 - RNA, 19 nt, Salmonella enterica enterica serovar Typhi
guacaccaguacaucuuca

SEQ ID NO: 3666271 - RNA, 19 nt, Salmonella enterica enterica serovar Typhi
guacaccugcaacuccugg

SEQ ID NO: 3666272 - RNA, 13 nt, Salmonella enterica enterica serovar Typhi
guacaccugcagg

SEQ ID NO: 3666273 - RNA, 17 nt, Salmonella enterica enterica serovar Typhi
guacaccuuaucugugg

SEQ ID NO: 3666274 - RNA, 15 nt, Salmonella enterica enterica serovar Typhi
guacacgaaauagcg

SEQ ID NO: 3666275 - RNA, 14 nt, Salmonella enterica enterica serovar Typhi
guacacgcagucca

SEQ ID NO: 3666276 - RNA, 22 nt, Salmonella enterica enterica serovar Typhi
guacacguauaaacgccgccgc

SEQ ID NO: 3666277 - RNA, 17 nt, Salmonella enterica enterica serovar Typhi
guacacuucauccggcg

SEQ ID NO: 3666278 - RNA, 16 nt, Salmonella enterica enterica serovar Typhi
guacagaagguuauuc

SEQ ID NO: 3666279 - RNA, 16 nt, Salmonella enterica enterica serovar Typhi
guacagacaucaucga

SEQ ID NO: 3666280 - RNA, 12 nt, Salmonella enterica enterica serovar Typhi
guacagaugcug

SEQ ID NO: 3666281 - RNA, 17 nt, Salmonella enterica enterica serovar Typhi
guacagcaauaaaagga

SEQ ID NO: 3666282 - RNA, 16 nt, Salmonella enterica enterica serovar Typhi
guacagcagcgacgca

SEQ ID NO: 3666283 - RNA, 17 nt, Salmonella enterica enterica serovar Typhi
guacagccuaaaaaacc

SEQ ID NO: 3666284 - RNA, 20 nt, Salmonella enterica enterica serovar Typhi
guacagcuuaaucaccagcg

SEQ ID NO: 3666285 - RNA, 23 nt, Salmonella enterica enterica serovar Typhi
guacagcuuaaucaccagcgcau

SEQ ID NO: 3666286 - RNA, 14 nt, Salmonella enterica enterica serovar Typhi
guacagggcgauuu

SEQ ID NO: 3666287 - RNA, 16 nt, Salmonella enterica enterica serovar Typhi
guacauaacagcagca

SEQ ID NO: 3666288 - RNA, 17 nt, Salmonella enterica enterica serovar Typhi
guacauaacagcagcag

SEQ ID NO: 3666289 - RNA, 11 nt, Salmonella enterica enterica serovar Typhi
guacauaucca

SEQ ID NO: 3666290 - RNA, 13 nt, Salmonella enterica enterica serovar Typhi
guacaucauuggc

SEQ ID NO: 3666291 - RNA, 13 nt, Salmonella enterica enterica serovar Typhi
guacaucuuccau

SEQ ID NO: 3666292 - RNA, 19 nt, Salmonella enterica enterica serovar Typhi
guacaugaauaauaauaca

SEQ ID NO: 3666293 - RNA, 14 nt, Salmonella enterica enterica serovar Typhi
guaccaauacccag

SEQ ID NO: 3666294 - RNA, 16 nt, Salmonella enterica enterica serovar Typhi
guaccaauacccagcg

SEQ ID NO: 3666295 - RNA, 20 nt, Salmonella enterica enterica serovar Typhi
guaccaccagaaucgccagc

SEQ ID NO: 3666296 - RNA, 18 nt, Salmonella enterica enterica serovar Typhi
guaccacccgggaaaaau

SEQ ID NO: 3666297 - RNA, 13 nt, Salmonella enterica enterica serovar Typhi
guaccacguuauc

SEQ ID NO: 3666298 - RNA, 12 nt, Salmonella enterica enterica serovar Typhi
guaccagcagcg

SEQ ID NO: 3666299 - RNA, 23 nt, Salmonella enterica enterica serovar Typhi
guaccauaccggugcgccccagc

SEQ ID NO: 3666300 - RNA, 21 nt, Salmonella enterica enterica serovar Typhi
guaccauugagcuuucuucca

SEQ ID NO: 3666301 - RNA, 13 nt, Salmonella enterica enterica serovar Typhi
guaccauugucaa

SEQ ID NO: 3666302 - RNA, 15 nt, Salmonella enterica enterica serovar Typhi
guaccccgccugacg

SEQ ID NO: 3666303 - RNA, 23 nt, Salmonella enterica enterica serovar Typhi
guacccggcuuacaacauuguua

SEQ ID NO: 3666304 - RNA, 14 nt, Salmonella enterica enterica serovar Typhi
guacccucugcacc

SEQ ID NO: 3666305 - RNA, 13 nt, Salmonella enterica enterica serovar Typhi
guaccgaaagcga

SEQ ID NO: 3666306 - RNA, 18 nt, Salmonella enterica enterica serovar Typhi
guaccgaacagccaggcu

SEQ ID NO: 3666307 - RNA, 20 nt, Salmonella enterica enterica serovar Typhi
guaccgacgccauuccccag

SEQ ID NO: 3666308 - RNA, 15 nt, Salmonella enterica enterica serovar Typhi
guaccgcguccugac

SEQ ID NO: 3666309 - RNA, 22 nt, Salmonella enterica enterica serovar Typhi
guaccggcaggacaaucauaau

SEQ ID NO: 3666310 - RNA, 23 nt, Salmonella enterica enterica serovar Typhi
guaccggcaggacaaucauaaua

SEQ ID NO: 3666311 - RNA, 23 nt, Salmonella enterica enterica serovar Typhi
guaccgggcaggaaaagacuacu

SEQ ID NO: 3666312 - RNA, 17 nt, Salmonella enterica enterica serovar Typhi
guaccgucucggccugg

SEQ ID NO: 3666313 - RNA, 17 nt, Salmonella enterica enterica serovar Typhi
guaccugaagccauccu

SEQ ID NO: 3666314 - RNA, 20 nt, Salmonella enterica enterica serovar Typhi
guacgacgccaugccguacc

SEQ ID NO: 3666315 - RNA, 22 nt, Salmonella enterica enterica serovar Typhi
guacgaucugacugaucgaucc

SEQ ID NO: 3666316 - RNA, 14 nt, Salmonella enterica enterica serovar Typhi
guacgcaagcguaa

SEQ ID NO: 3666317 - RNA, 14 nt, Salmonella enterica enterica serovar Typhi
guacgcaggaggga

SEQ ID NO: 3666318 - RNA, 22 nt, Salmonella enterica enterica serovar Typhi
guacgccaaaucuguucugucc

SEQ ID NO: 3666319 - RNA, 12 nt, Salmonella enterica enterica serovar Typhi
guacgcccagcc

SEQ ID NO: 3666320 - RNA, 11 nt, Salmonella enterica enterica serovar Typhi
guacgccgcca

SEQ ID NO: 3666321 - RNA, 16 nt, Salmonella enterica enterica serovar Typhi
guacgccuaaaugaac

SEQ ID NO: 3666322 - RNA, 22 nt, Salmonella enterica enterica serovar Typhi
guacgccuaaaugaacuuacac

SEQ ID NO: 3666323 - RNA, 20 nt, Salmonella enterica enterica serovar Typhi
guacgcgucugaaugacgcc

SEQ ID NO: 3666324 - RNA, 15 nt, Salmonella enterica enterica serovar Typhi
guacgcuccagggcu

SEQ ID NO: 3666325 - RNA, 21 nt, Salmonella enterica enterica serovar Typhi
guacggaaaugaucagacgca

SEQ ID NO: 3666326 - RNA, 22 nt, Salmonella enterica enterica serovar Typhi
guacggaauaucccgcaagaaa

SEQ ID NO: 3666327 - RNA, 12 nt, Salmonella enterica enterica serovar Typhi
guacggcauauu

SEQ ID NO: 3666328 - RNA, 14 nt, Salmonella enterica enterica serovar Typhi
guacggcauggcgu

SEQ ID NO: 3666329 - RNA, 15 nt, Salmonella enterica enterica serovar Typhi
guacggcauggcguc

SEQ ID NO: 3666330 - RNA, 13 nt, Salmonella enterica enterica serovar Typhi
guacggcgcgaau

SEQ ID NO: 3666331 - RNA, 15 nt, Salmonella enterica enterica serovar Typhi
guacggcgucagcca

SEQ ID NO: 3666332 - RNA, 19 nt, Salmonella enterica enterica serovar Typhi
guacggcuuucuuucucca

SEQ ID NO: 3666333 - RNA, 22 nt, Salmonella enterica enterica serovar Typhi
guacgggcagauggucgcaugg

SEQ ID NO: 3666334 - RNA, 17 nt, Salmonella enterica enterica serovar Typhi
guacggggcaucuauuu

SEQ ID NO: 3666335 - RNA, 17 nt, Salmonella enterica enterica serovar Typhi
guacguccauccgccgg

SEQ ID NO: 3666336 - RNA, 20 nt, Salmonella enterica enterica serovar Typhi
guacuccccuuuuuucuguu

SEQ ID NO: 3666337 - RNA, 17 nt, Salmonella enterica enterica serovar Typhi
guacuccgcgcgcguaa

SEQ ID NO: 3666338 - RNA, 22 nt, Salmonella enterica enterica serovar Typhi
guacucggcuacgaaccgagcg

SEQ ID NO: 3666339 - RNA, 20 nt, Salmonella enterica enterica serovar Typhi
guacugccaaagcgaugcgg

SEQ ID NO: 3666340 - RNA, 20 nt, Salmonella enterica enterica serovar Typhi
guacugcccguggcggaggu

SEQ ID NO: 3666341 - RNA, 14 nt, Salmonella enterica enterica serovar Typhi
guacugcuggcgcg

SEQ ID NO: 3666342 - RNA, 14 nt, Salmonella enterica enterica serovar Typhi
guacuucagagcug

SEQ ID NO: 3666343 - RNA, 16 nt, Salmonella enterica enterica serovar Typhi
guacuugcgccgccau

SEQ ID NO: 3666344 - RNA, 11 nt, Salmonella enterica enterica serovar Typhi
guacuuucaaa

SEQ ID NO: 3666345 - RNA, 16 nt, Salmonella enterica enterica serovar Typhi
guacuuucaaauagcu

SEQ ID NO: 3666346 - RNA, 13 nt, Salmonella enterica enterica serovar Typhi
guacuuucacuac

SEQ ID NO: 3666347 - RNA, 21 nt, Salmonella enterica enterica serovar Typhi
guacuuucuacaaauguuguc

SEQ ID NO: 3666348 - RNA, 15 nt, Salmonella enterica enterica serovar Typhi
guacuuuuaaaucau

SEQ ID NO: 3666349 - RNA, 13 nt, Salmonella enterica enterica serovar Typhi
guacuuuucaucc

SEQ ID NO: 3666350 - RNA, 21 nt, Salmonella enterica enterica serovar Typhi
guacuuuucauccacagcgcc

SEQ ID NO: 3666351 - RNA, 17 nt, Salmonella enterica enterica serovar Typhi
guacuuuugcuuccagu

SEQ ID NO: 3666352 - RNA, 17 nt, Salmonella enterica enterica serovar Typhi
guagaagugaagcgccg

SEQ ID NO: 3666353 - RNA, 16 nt, Salmonella enterica enterica serovar Typhi
guagacaaacagcgcg

SEQ ID NO: 3666354 - RNA, 16 nt, Salmonella enterica enterica serovar Typhi
guagacauagccggug

SEQ ID NO: 3666355 - RNA, 14 nt, Salmonella enterica enterica serovar Typhi
guagaccgcaucga

SEQ ID NO: 3666356 - RNA, 13 nt, Salmonella enterica enterica serovar Typhi
guagacucaggcg

SEQ ID NO: 3666357 - RNA, 16 nt, Salmonella enterica enterica serovar Typhi
guagacucaggcgcau

SEQ ID NO: 3666358 - RNA, 14 nt, Salmonella enterica enterica serovar Typhi
guagagaacagcau

SEQ ID NO: 3666359 - RNA, 17 nt, Salmonella enterica enterica serovar Typhi
guagagaucgacaaacc

SEQ ID NO: 3666360 - RNA, 20 nt, Salmonella enterica enterica serovar Typhi
guagagauucugcaggccaa

SEQ ID NO: 3666361 - RNA, 16 nt, Salmonella enterica enterica serovar Typhi
guagagcgcggucagg

SEQ ID NO: 3666362 - RNA, 19 nt, Salmonella enterica enterica serovar Typhi
guagagcgcggucagguuc

SEQ ID NO: 3666363 - RNA, 18 nt, Salmonella enterica enterica serovar Typhi
guagagcggauaagcgca

SEQ ID NO: 3666364 - RNA, 13 nt, Salmonella enterica enterica serovar Typhi
guagaucacgcca

SEQ ID NO: 3666365 - RNA, 13 nt, Salmonella enterica enterica serovar Typhi
guagaucauuuac

SEQ ID NO: 3666366 - RNA, 13 nt, Salmonella enterica enterica serovar Typhi
guagcagcgauga

SEQ ID NO: 3666367 - RNA, 15 nt, Salmonella enterica enterica serovar Typhi
guagcagcgaugaca

SEQ ID NO: 3666368 - RNA, 18 nt, Salmonella enterica enterica serovar Typhi
guagcagcgaugacagca

SEQ ID NO: 3666369 - RNA, 20 nt, Salmonella enterica enterica serovar Typhi
guagcagcgaugacagcagg

SEQ ID NO: 3666370 - RNA, 18 nt, Salmonella enterica enterica serovar Typhi
guagcaguguaucgaaga

SEQ ID NO: 3666371 - RNA, 14 nt, Salmonella enterica enterica serovar Typhi
guagcccucgcaaa

SEQ ID NO: 3666372 - RNA, 18 nt, Salmonella enterica enterica serovar Typhi
guagccgcgcgccgccuc

SEQ ID NO: 3666373 - RNA, 20 nt, Salmonella enterica enterica serovar Typhi
guagccguuuaaaagcggau

SEQ ID NO: 3666374 - RNA, 16 nt, Salmonella enterica enterica serovar Typhi
guagcgagaaggcuuu

SEQ ID NO: 3666375 - RNA, 13 nt, Salmonella enterica enterica serovar Typhi
guagcgccaucag

SEQ ID NO: 3666376 - RNA, 14 nt, Salmonella enterica enterica serovar Typhi
guagcgccauccgg

SEQ ID NO: 3666377 - RNA, 14 nt, Salmonella enterica enterica serovar Typhi
guagcgcguucagg

SEQ ID NO: 3666378 - RNA, 21 nt, Salmonella enterica enterica serovar Typhi
guagcggaaccagccaugcca

SEQ ID NO: 3666379 - RNA, 15 nt, Salmonella enterica enterica serovar Typhi
guagcggcaacagca

SEQ ID NO: 3666380 - RNA, 18 nt, Salmonella enterica enterica serovar Typhi
guagcggcaacagcacca

SEQ ID NO: 3666381 - RNA, 14 nt, Salmonella enterica enterica serovar Typhi
guagcggcgccggg

SEQ ID NO: 3666382 - RNA, 16 nt, Salmonella enterica enterica serovar Typhi
guagcgggggccggcu

SEQ ID NO: 3666383 - RNA, 16 nt, Salmonella enterica enterica serovar Typhi
guagcguacaggcgga

SEQ ID NO: 3666384 - RNA, 21 nt, Salmonella enterica enterica serovar Typhi
guagcgucagguagcccggca

SEQ ID NO: 3666385 - RNA, 16 nt, Salmonella enterica enterica serovar Typhi
guagcgucucaucaaa

SEQ ID NO: 3666386 - RNA, 21 nt, Salmonella enterica enterica serovar Typhi
guagcgucucaucaaaaaggc

SEQ ID NO: 3666387 - RNA, 20 nt, Salmonella enterica enterica serovar Typhi
guagcguuauccagucagag

SEQ ID NO: 3666388 - RNA, 23 nt, Salmonella enterica enterica serovar Typhi
guagcguuucacgcgcgccugcc

SEQ ID NO: 3666389 - RNA, 20 nt, Salmonella enterica enterica serovar Typhi
guagcuauaaucacaggggu

SEQ ID NO: 3666390 - RNA, 16 nt, Salmonella enterica enterica serovar Typhi
guagcucauaacucgc

SEQ ID NO: 3666391 - RNA, 14 nt, Salmonella enterica enterica serovar Typhi
guagcugcgccagc

SEQ ID NO: 3666392 - RNA, 16 nt, Salmonella enterica enterica serovar Typhi
guagcugcgccugaaa

SEQ ID NO: 3666393 - RNA, 18 nt, Salmonella enterica enterica serovar Typhi
guagcuggucgccagcgc

SEQ ID NO: 3666394 - RNA, 15 nt, Salmonella enterica enterica serovar Typhi
guagcuucagcugga

SEQ ID NO: 3666395 - RNA, 13 nt, Salmonella enterica enterica serovar Typhi
guaggccaggcau

SEQ ID NO: 3666396 - RNA, 22 nt, Salmonella enterica enterica serovar Typhi
guaggccggauaagcggcagcg

SEQ ID NO: 3666397 - RNA, 18 nt, Salmonella enterica enterica serovar Typhi
guaggccggauaaggcgu

SEQ ID NO: 3666398 - RNA, 20 nt, Salmonella enterica enterica serovar Typhi
guaggccggauaaggcguuu

SEQ ID NO: 3666399 - RNA, 21 nt, Salmonella enterica enterica serovar Typhi
guaggccggauuaaggcguuu

SEQ ID NO: 3666400 - RNA, 20 nt, Salmonella enterica enterica serovar Typhi
guaggccugauagcacagcg

SEQ ID NO: 3666401 - RNA, 19 nt, Salmonella enterica enterica serovar Typhi
guaggcucuccgguugcug

SEQ ID NO: 3666402 - RNA, 21 nt, Salmonella enterica enterica serovar Typhi
guaggcucuccgguugcugau

SEQ ID NO: 3666403 - RNA, 14 nt, Salmonella enterica enterica serovar Typhi
guaggguugccaga

SEQ ID NO: 3666404 - RNA, 16 nt, Salmonella enterica enterica serovar Typhi
guagguauccagcaga

SEQ ID NO: 3666405 - RNA, 14 nt, Salmonella enterica enterica serovar Typhi
guaguaaaccgguu

SEQ ID NO: 3666406 - RNA, 13 nt, Salmonella enterica enterica serovar Typhi
guaguaaauagga

SEQ ID NO: 3666407 - RNA, 15 nt, Salmonella enterica enterica serovar Typhi
guaguaauauuaaaa

SEQ ID NO: 3666408 - RNA, 18 nt, Salmonella enterica enterica serovar Typhi
gccguaaagggaagauca

SEQ ID NO: 3666409 - RNA, 22 nt, Salmonella enterica enterica serovar Typhi
gccguaaggcguaccgccgcga

SEQ ID NO: 3666410 - RNA, 12 nt, Salmonella enterica enterica serovar Typhi
gccguacagccu

SEQ ID NO: 3666411 - RNA, 16 nt, Salmonella enterica enterica serovar Typhi
gccguacuccagccca

SEQ ID NO: 3666412 - RNA, 19 nt, Salmonella enterica enterica serovar Typhi
gccguagaaaaugcgcugg

SEQ ID NO: 3666413 - RNA, 14 nt, Salmonella enterica enterica serovar Typhi
gccguagcgcgcuu

SEQ ID NO: 3666414 - RNA, 19 nt, Salmonella enterica enterica serovar Typhi
gccguagcgcgcuuccugc

SEQ ID NO: 3666415 - RNA, 13 nt, Salmonella enterica enterica serovar Typhi
gccguaggagaua

SEQ ID NO: 3666416 - RNA, 12 nt, Salmonella enterica enterica serovar Typhi
gccguaggcaac

SEQ ID NO: 3666417 - RNA, 15 nt, Salmonella enterica enterica serovar Typhi
gccguaggcgacgcc

SEQ ID NO: 3666418 - RNA, 22 nt, Salmonella enterica enterica serovar Typhi
gccguauuucacuuuugccggu

SEQ ID NO: 3666419 - RNA, 20 nt, Salmonella enterica enterica serovar Typhi
gccgucaaacaagccgccaa

SEQ ID NO: 3666420 - RNA, 23 nt, Salmonella enterica enterica serovar Typhi
gccgucaaacaagccgccaacgc

SEQ ID NO: 3666421 - RNA, 17 nt, Salmonella enterica enterica serovar Typhi
gccgucaaacaucgcgc

SEQ ID NO: 3666422 - RNA, 22 nt, Salmonella enterica enterica serovar Typhi
gccgucaacacgcagacccagg

SEQ ID NO: 3666423 - RNA, 15 nt, Salmonella enterica enterica serovar Typhi
gccgucacagagagc

SEQ ID NO: 3666424 - RNA, 17 nt, Salmonella enterica enterica serovar Typhi
gccgucacagagagcgu

SEQ ID NO: 3666425 - RNA, 16 nt, Salmonella enterica enterica serovar Typhi
gccgucacuuuaucac

SEQ ID NO: 3666426 - RNA, 15 nt, Salmonella enterica enterica serovar Typhi
gcccggcaugucgcc

SEQ ID NO: 3666427 - RNA, 17 nt, Salmonella enterica enterica serovar Typhi
gcccggccacagcgcca

SEQ ID NO: 3666428 - RNA, 15 nt, Salmonella enterica enterica serovar Typhi
gcccggccuacguuu

SEQ ID NO: 3666429 - RNA, 14 nt, Salmonella enterica enterica serovar Typhi
gcccggcgccagcu

SEQ ID NO: 3666430 - RNA, 17 nt, Salmonella enterica enterica serovar Typhi
gcccggcgcgacaccuu

SEQ ID NO: 3666431 - RNA, 20 nt, Salmonella enterica enterica serovar Typhi
gcccggcgcgacgccgcaua

SEQ ID NO: 3666432 - RNA, 18 nt, Salmonella enterica enterica serovar Typhi
gcccggcgcgcuggaggc

SEQ ID NO: 3666433 - RNA, 21 nt, Salmonella enterica enterica serovar Typhi
gcccggcguucucccgggccg

SEQ ID NO: 3666434 - RNA, 15 nt, Salmonella enterica enterica serovar Typhi
gcccggcguugaaau

SEQ ID NO: 3666435 - RNA, 14 nt, Salmonella enterica enterica serovar Typhi
gcccggcuucccau

SEQ ID NO: 3666436 - RNA, 18 nt, Salmonella enterica enterica serovar Typhi
gcccgggcacgauggccu

SEQ ID NO: 3666437 - RNA, 19 nt, Salmonella enterica enterica serovar Typhi
gcccgggcgauaucacgga

SEQ ID NO: 3666438 - RNA, 16 nt, Salmonella enterica enterica serovar Typhi
gcccgguaagcacaac

SEQ ID NO: 3666439 - RNA, 18 nt, Salmonella enterica enterica serovar Typhi
gcccgguaagcgcagcgc

SEQ ID NO: 3666440 - RNA, 17 nt, Salmonella enterica enterica serovar Typhi
gcccgguacguuaaccg

SEQ ID NO: 3666441 - RNA, 23 nt, Salmonella enterica enterica serovar Typhi
gcccgguagcgcaaacuaccggg

SEQ ID NO: 3666442 - RNA, 15 nt, Salmonella enterica enterica serovar Typhi
gcccggugauggugc

SEQ ID NO: 3666443 - RNA, 19 nt, Salmonella enterica enterica serovar Typhi
gcccggugauggugcagcc

SEQ ID NO: 3666444 - RNA, 23 nt, Salmonella enterica enterica serovar Typhi
gcccggugauggugcagccccgg

SEQ ID NO: 3666445 - RNA, 15 nt, Salmonella enterica enterica serovar Typhi
gcccgguggcgcugc

SEQ ID NO: 3666446 - RNA, 15 nt, Salmonella enterica enterica serovar Typhi
gcccgguuacgcuuc

SEQ ID NO: 3666447 - RNA, 13 nt, Salmonella enterica enterica serovar Typhi
gcccgguucaccg

SEQ ID NO: 3666448 - RNA, 14 nt, Salmonella enterica enterica serovar Typhi
gcccguaaacaggc

SEQ ID NO: 3666449 - RNA, 15 nt, Salmonella enterica enterica serovar Typhi
gcccguaaacaggcu

SEQ ID NO: 3666450 - RNA, 18 nt, Salmonella enterica enterica serovar Typhi
gcccguaaacaggcugcc

SEQ ID NO: 3666451 - RNA, 19 nt, Salmonella enterica enterica serovar Typhi
gcccguaaacaggcugccc

SEQ ID NO: 3666452 - RNA, 14 nt, Salmonella enterica enterica serovar Typhi
gcccguaaacgggc

SEQ ID NO: 3666453 - RNA, 19 nt, Salmonella enterica enterica serovar Typhi
gcccguaaacgggcugccc

SEQ ID NO: 3666454 - RNA, 16 nt, Salmonella enterica enterica serovar Typhi
gcccguagcucagcug

SEQ ID NO: 3666455 - RNA, 12 nt, Salmonella enterica enterica serovar Typhi
gcccgucagggg

SEQ ID NO: 3666456 - RNA, 21 nt, Salmonella enterica enterica serovar Typhi
gcccgucaucuucuaccugga

SEQ ID NO: 3666457 - RNA, 18 nt, Salmonella enterica enterica serovar Typhi
gcccguccagauaaugau

SEQ ID NO: 3666458 - RNA, 20 nt, Salmonella enterica enterica serovar Typhi
gcccgucugggagccgcugc

SEQ ID NO: 3666459 - RNA, 21 nt, Salmonella enterica enterica serovar Typhi
gcccgucugggagccgcugcu

SEQ ID NO: 3666460 - RNA, 16 nt, Salmonella enterica enterica serovar Typhi
gcccgugacgccaggc

SEQ ID NO: 3666461 - RNA, 13 nt, Salmonella enterica enterica serovar Typhi
gcccguuccaggc

SEQ ID NO: 3666462 - RNA, 17 nt, Salmonella enterica enterica serovar Typhi
gcccguucucgccgcgu

SEQ ID NO: 3666463 - RNA, 17 nt, Salmonella enterica enterica serovar Typhi
gcccguugucacaggcu

SEQ ID NO: 3666464 - RNA, 18 nt, Salmonella enterica enterica serovar Typhi
gcccguuuuuuccagcgc

SEQ ID NO: 3666465 - RNA, 19 nt, Salmonella enterica enterica serovar Typhi
gcccguuuuuuccagcgcc

SEQ ID NO: 3666466 - RNA, 18 nt, Salmonella enterica enterica serovar Typhi
gcccuaaaaauagcacca

SEQ ID NO: 3666467 - RNA, 15 nt, Salmonella enterica enterica serovar Typhi
gcccuaacaggcgca

SEQ ID NO: 3666468 - RNA, 17 nt, Salmonella enterica enterica serovar Typhi
gcccuacgcuucucucc

SEQ ID NO: 3666469 - RNA, 17 nt, Salmonella enterica enterica serovar Typhi
gcccuauaacagcgcug

SEQ ID NO: 3666470 - RNA, 14 nt, Salmonella enterica enterica serovar Typhi
gcccuaucgcugcg

SEQ ID NO: 3666471 - RNA, 18 nt, Salmonella enterica enterica serovar Typhi
gcccuccagcuccgcgua

SEQ ID NO: 3666472 - RNA, 15 nt, Salmonella enterica enterica serovar Typhi
gcccucgcaaagcug

SEQ ID NO: 3666473 - RNA, 14 nt, Salmonella enterica enterica serovar Typhi
gcccucgccagcaa

SEQ ID NO: 3666474 - RNA, 15 nt, Salmonella enterica enterica serovar Typhi
gcccucgccagcaac

SEQ ID NO: 3666475 - RNA, 21 nt, Salmonella enterica enterica serovar Typhi
gcccucgggucgaauuccagu

SEQ ID NO: 3666476 - RNA, 19 nt, Salmonella enterica enterica serovar Typhi
gcccucuaagcgcucaaau

SEQ ID NO: 3666477 - RNA, 23 nt, Salmonella enterica enterica serovar Typhi
gcccucuaagcgcucaaauaaug

SEQ ID NO: 3666478 - RNA, 17 nt, Salmonella enterica enterica serovar Typhi
gcccucuuccagcgcca

SEQ ID NO: 3666479 - RNA, 20 nt, Salmonella enterica enterica serovar Typhi
gcccucuucuucuuccguca

SEQ ID NO: 3666480 - RNA, 17 nt, Salmonella enterica enterica serovar Typhi
gcccucuuuaucaaaca

SEQ ID NO: 3666481 - RNA, 19 nt, Salmonella enterica enterica serovar Typhi
gcccucuuuaucaaacaaa

SEQ ID NO: 3666482 - RNA, 16 nt, Salmonella enterica enterica serovar Typhi
gcccucuuuuagcaau

SEQ ID NO: 3666483 - RNA, 20 nt, Salmonella enterica enterica serovar Typhi
gcccugaaagccgacccgca

SEQ ID NO: 3666484 - RNA, 23 nt, Salmonella enterica enterica serovar Typhi
gcccugaagggcggcuggauaaa

SEQ ID NO: 3666485 - RNA, 15 nt, Salmonella enterica enterica serovar Typhi
gcccugacgccgcug

SEQ ID NO: 3666486 - RNA, 16 nt, Salmonella enterica enterica serovar Typhi
gcccugagcccacagc

SEQ ID NO: 3666487 - RNA, 20 nt, Salmonella enterica enterica serovar Typhi
gcccugagcccacagcggau

SEQ ID NO: 3666488 - RNA, 16 nt, Salmonella enterica enterica serovar Typhi
gcccugauggcgcgcc

SEQ ID NO: 3666489 - RNA, 17 nt, Salmonella enterica enterica serovar Typhi
gcccugauggcgcgcca

SEQ ID NO: 3666490 - RNA, 21 nt, Salmonella enterica enterica serovar Typhi
gcguuucaagcaguuccagca

SEQ ID NO: 3666491 - RNA, 23 nt, Salmonella enterica enterica serovar Typhi
gcguuucacaucgccaguuauca

SEQ ID NO: 3666492 - RNA, 22 nt, Salmonella enterica enterica serovar Typhi
gcguuucacgcgcgccugccgc

SEQ ID NO: 3666493 - RNA, 23 nt, Salmonella enterica enterica serovar Typhi
gcguuucccgcgcggaaggcgcc

SEQ ID NO: 3666494 - RNA, 13 nt, Salmonella enterica enterica serovar Typhi
gcguuucguaaug

SEQ ID NO: 3666495 - RNA, 20 nt, Salmonella enterica enterica serovar Typhi
gcguuucguaauggccuaca

SEQ ID NO: 3666496 - RNA, 22 nt, Salmonella enterica enterica serovar Typhi
gcguuucguaauggccuacaca

SEQ ID NO: 3666497 - RNA, 18 nt, Salmonella enterica enterica serovar Typhi
gcguuucguuuagcgccu

SEQ ID NO: 3666498 - RNA, 12 nt, Salmonella enterica enterica serovar Typhi
gcguuucugaac

SEQ ID NO: 3666499 - RNA, 15 nt, Salmonella enterica enterica serovar Typhi
gcguuugcgccgcca

SEQ ID NO: 3666500 - RNA, 20 nt, Salmonella enterica enterica serovar Typhi
gcguuugggcgcaacaguca

SEQ ID NO: 3666501 - RNA, 22 nt, Salmonella enterica enterica serovar Typhi
gcguuugucuucuuaguaacau

SEQ ID NO: 3666502 - RNA, 20 nt, Salmonella enterica enterica serovar Typhi
gcguuuucauaucugcgccg

SEQ ID NO: 3666503 - RNA, 16 nt, Salmonella enterica enterica serovar Typhi
gcguuuuccagcaucc

SEQ ID NO: 3666504 - RNA, 18 nt, Salmonella enterica enterica serovar Typhi
gcguuuuccaucaucagg

SEQ ID NO: 3666505 - RNA, 23 nt, Salmonella enterica enterica serovar Typhi
gcguuuugacuuugaccagcauc

SEQ ID NO: 3666506 - RNA, 16 nt, Salmonella enterica enterica serovar Typhi
gcguuuuggcagacag

SEQ ID NO: 3666507 - RNA, 23 nt, Salmonella enterica enterica serovar Typhi
gcguuuuuaucuuuuacgcuguc

SEQ ID NO: 3666508 - RNA, 21 nt, Salmonella enterica enterica serovar Typhi
gcguuuuuucgguaaucgccu

SEQ ID NO: 3666509 - RNA, 16 nt, Salmonella enterica enterica serovar Typhi
gcuaaaaacagcgcaa

SEQ ID NO: 3666510 - RNA, 15 nt, Salmonella enterica enterica serovar Typhi
gcuaaaacagauaac

SEQ ID NO: 3666511 - RNA, 18 nt, Salmonella enterica enterica serovar Typhi
gcuaaaacccaccaccuc

SEQ ID NO: 3666512 - RNA, 12 nt, Salmonella enterica enterica serovar Typhi
gcuaaaauaccc

SEQ ID NO: 3666513 - RNA, 18 nt, Salmonella enterica enterica serovar Typhi
gcuaaaccaaacuuaucu

SEQ ID NO: 3666514 - RNA, 19 nt, Salmonella enterica enterica serovar Typhi
gcuaaaccacaugaccagc

SEQ ID NO: 3666515 - RNA, 16 nt, Salmonella enterica enterica serovar Typhi
gcuaaaccggcggaau

SEQ ID NO: 3666516 - RNA, 18 nt, Salmonella enterica enterica serovar Typhi
gcuaaacguagcauuucc

SEQ ID NO: 3666517 - RNA, 18 nt, Salmonella enterica enterica serovar Typhi
gcuaaagacgugccggaa

SEQ ID NO: 3666518 - RNA, 19 nt, Salmonella enterica enterica serovar Typhi
gcuaaagcgacuuauccgg

SEQ ID NO: 3666519 - RNA, 23 nt, Salmonella enterica enterica serovar Typhi
gcuaaagcgacuuauccggccua

SEQ ID NO: 3666520 - RNA, 15 nt, Salmonella enterica enterica serovar Typhi
gcuaaauaaaaauaa

SEQ ID NO: 3666521 - RNA, 12 nt, Salmonella enterica enterica serovar Typhi
gcuaaccggcgg

SEQ ID NO: 3666522 - RNA, 16 nt, Salmonella enterica enterica serovar Typhi
gcuaaccuguaucugc

SEQ ID NO: 3666523 - RNA, 18 nt, Salmonella enterica enterica serovar Typhi
gcuaaccuguaucugcug

SEQ ID NO: 3666524 - RNA, 21 nt, Salmonella enterica enterica serovar Typhi
gcuaacgaugucaucgccauc

SEQ ID NO: 3666525 - RNA, 21 nt, Salmonella enterica enterica serovar Typhi
gcuaacgccugauccggccua

SEQ ID NO: 3666526 - RNA, 16 nt, Salmonella enterica enterica serovar Typhi
gcuaacgcgccccagg

SEQ ID NO: 3666527 - RNA, 20 nt, Salmonella enterica enterica serovar Typhi
gcuaacgcguacccggcuua

SEQ ID NO: 3666528 - RNA, 17 nt, Salmonella enterica enterica serovar Typhi
gcuaacgcuuauccggc

SEQ ID NO: 3666529 - RNA, 18 nt, Salmonella enterica enterica serovar Typhi
gcuaacgcuuauccggcc

SEQ ID NO: 3666530 - RNA, 21 nt, Salmonella enterica enterica serovar Typhi
gcuaacgcuuauccggccuac

SEQ ID NO: 3666531 - RNA, 15 nt, Salmonella enterica enterica serovar Typhi
gcuaagagugacggu

SEQ ID NO: 3666532 - RNA, 17 nt, Salmonella enterica enterica serovar Typhi
gcuaagcaacaguucac

SEQ ID NO: 3666533 - RNA, 22 nt, Salmonella enterica enterica serovar Typhi
gcuaagcguuacggaaaaaaua

SEQ ID NO: 3666534 - RNA, 23 nt, Salmonella enterica enterica serovar Typhi
gcuaagcguuacggaaaaaauac

SEQ ID NO: 3666535 - RNA, 21 nt, Salmonella enterica enterica serovar Typhi
gcuaauauccaccagcccauc

SEQ ID NO: 3666536 - RNA, 13 nt, Salmonella enterica enterica serovar Typhi
gcuaaucaccacc

SEQ ID NO: 3666537 - RNA, 23 nt, Salmonella enterica enterica serovar Typhi
gcuaaucaccaccucaaacgaug

SEQ ID NO: 3666538 - RNA, 20 nt, Salmonella enterica enterica serovar Typhi
gcuaaucaggacaucaaagg

SEQ ID NO: 3666539 - RNA, 16 nt, Salmonella enterica enterica serovar Typhi
gcuaauccccagcgcu

SEQ ID NO: 3666540 - RNA, 18 nt, Salmonella enterica enterica serovar Typhi
gcuaaugaggaaaaagcc

SEQ ID NO: 3666541 - RNA, 21 nt, Salmonella enterica enterica serovar Typhi
gcuaaugcccggcgcggcauc

SEQ ID NO: 3666542 - RNA, 20 nt, Salmonella enterica enterica serovar Typhi
gcuaaugcuuauccggccua

SEQ ID NO: 3666543 - RNA, 22 nt, Salmonella enterica enterica serovar Typhi
gcuaauuaaucugucgaugcgg

SEQ ID NO: 3666544 - RNA, 13 nt, Salmonella enterica enterica serovar Typhi
gcuacacgcgaau

SEQ ID NO: 3666545 - RNA, 19 nt, Salmonella enterica enterica serovar Typhi
gcuacacgcguaaacuucc

SEQ ID NO: 3666546 - RNA, 23 nt, Salmonella enterica enterica serovar Typhi
gcuacacguucacgaucaccugg

SEQ ID NO: 3666547 - RNA, 22 nt, Salmonella enterica enterica serovar Typhi
gcuacagacaucuuugccaaac

SEQ ID NO: 3666548 - RNA, 22 nt, Salmonella enterica enterica serovar Typhi
gcuacauccgccagccgccauu

SEQ ID NO: 3666549 - RNA, 14 nt, Salmonella enterica enterica serovar Typhi
gcuaccagcgcggc

SEQ ID NO: 3666550 - RNA, 18 nt, Salmonella enterica enterica serovar Typhi
gcuaccagcgcggcgcca

SEQ ID NO: 3666551 - RNA, 21 nt, Salmonella enterica enterica serovar Typhi
gcuaccagcgcggcgccagua

SEQ ID NO: 3666552 - RNA, 23 nt, Salmonella enterica enterica serovar Typhi
gcuaccagcgcggcgccaguacu

SEQ ID NO: 3666553 - RNA, 12 nt, Salmonella enterica enterica serovar Typhi
gcuacccagaca

SEQ ID NO: 3666554 - RNA, 14 nt, Salmonella enterica enterica serovar Typhi
gcuacccagacaag

SEQ ID NO: 3666555 - RNA, 17 nt, Salmonella enterica enterica serovar Typhi
gcuaccccggaaauaac

SEQ ID NO: 3666556 - RNA, 19 nt, Salmonella enterica enterica serovar Typhi
gcuacccgcugacgcugcc

SEQ ID NO: 3666557 - RNA, 14 nt, Salmonella enterica enterica serovar Typhi
gcuaccgcgcgaac

SEQ ID NO: 3666558 - RNA, 15 nt, Salmonella enterica enterica serovar Typhi
gcuaccgcguaauga

SEQ ID NO: 3666559 - RNA, 21 nt, Salmonella enterica enterica serovar Typhi
gcuaccgucgacgucuuucuu

SEQ ID NO: 3666560 - RNA, 17 nt, Salmonella enterica enterica serovar Typhi
gcuaccuucuucccaua

SEQ ID NO: 3666561 - RNA, 20 nt, Salmonella enterica enterica serovar Typhi
gcuacgaccggucagccggu

SEQ ID NO: 3666562 - RNA, 14 nt, Salmonella enterica enterica serovar Typhi
gcuacgcagcggcg

SEQ ID NO: 3666563 - RNA, 21 nt, Salmonella enterica enterica serovar Typhi
gcuacgccaucaggcauggca

SEQ ID NO: 3666564 - RNA, 17 nt, Salmonella enterica enterica serovar Typhi
gcuacgccuuauccggc

SEQ ID NO: 3666565 - RNA, 18 nt, Salmonella enterica enterica serovar Typhi
gcuacgccuuauccggcc

SEQ ID NO: 3666566 - RNA, 20 nt, Salmonella enterica enterica serovar Typhi
gcuacgccuuauccggccua

SEQ ID NO: 3666567 - RNA, 21 nt, Salmonella enterica enterica serovar Typhi
gcuacgcgucgccauccggcg

SEQ ID NO: 3666568 - RNA, 16 nt, Salmonella enterica enterica serovar Typhi
gcuacgcuuauccggc

SEQ ID NO: 3666569 - RNA, 17 nt, Salmonella enterica enterica serovar Typhi
gcuacgcuuauccggcu

SEQ ID NO: 3666570 - RNA, 12 nt, Salmonella enterica enterica serovar Typhi
gcuacgggccgc

SEQ ID NO: 3666571 - RNA, 17 nt, Salmonella enterica enterica serovar Typhi
gcuacgggccgcggcgg

SEQ ID NO: 3666572 - RNA, 14 nt, Salmonella enterica enterica serovar Typhi
gcuacgguuuuaau

SEQ ID NO: 3666573 - RNA, 17 nt, Salmonella enterica enterica serovar Typhi
gcuacugagcgucacgc

SEQ ID NO: 3666574 - RNA, 13 nt, Salmonella enterica enterica serovar Typhi
gcuacugcaucug

SEQ ID NO: 3666575 - RNA, 17 nt, Salmonella enterica enterica serovar Typhi
gcuacugccgccaucgc

SEQ ID NO: 3666576 - RNA, 17 nt, Salmonella enterica enterica serovar Typhi
gcuagcgccuuauccgg

SEQ ID NO: 3666577 - RNA, 21 nt, Salmonella enterica enterica serovar Typhi
gcuagcgccuuauccggccua

SEQ ID NO: 3666578 - RNA, 13 nt, Salmonella enterica enterica serovar Typhi
gcuagcugcagcg

SEQ ID NO: 3666579 - RNA, 19 nt, Salmonella enterica enterica serovar Typhi
gcuagcuuaucgggccuac

SEQ ID NO: 3666580 - RNA, 13 nt, Salmonella enterica enterica serovar Typhi
gcuagcuucaggu

SEQ ID NO: 3666581 - RNA, 16 nt, Salmonella enterica enterica serovar Typhi
gcuaggaacagugaca

SEQ ID NO: 3666582 - RNA, 15 nt, Salmonella enterica enterica serovar Typhi
gcuagggcaucagac

SEQ ID NO: 3666583 - RNA, 23 nt, Salmonella enterica enterica serovar Typhi
gcuauaaaguucccaugcuucca

SEQ ID NO: 3666584 - RNA, 19 nt, Salmonella enterica enterica serovar Typhi
gcuauaaucacagggguca

SEQ ID NO: 3666585 - RNA, 16 nt, Salmonella enterica enterica serovar Typhi
gcuauacgcggcguac

SEQ ID NO: 3666586 - RNA, 22 nt, Salmonella enterica enterica serovar Typhi
gcuauagccgcguuugaguagc

SEQ ID NO: 3666587 - RNA, 22 nt, Salmonella enterica enterica serovar Typhi
gcuauaugauagaaguuaugca

SEQ ID NO: 3666588 - RNA, 13 nt, Salmonella enterica enterica serovar Typhi
gcucaucggcggc

SEQ ID NO: 3666589 - RNA, 24 nt, Salmonella enterica enterica serovar Typhi
gcucaugacaucgcccugggucac

SEQ ID NO: 3666590 - RNA, 17 nt, Salmonella enterica enterica serovar Typhi
gcucaugauagggcagc

SEQ ID NO: 3666591 - RNA, 19 nt, Salmonella enterica enterica serovar Typhi
gcucaugauagggcagcag

SEQ ID NO: 3666592 - RNA, 22 nt, Salmonella enterica enterica serovar Typhi
gcucaugcgagguauacgccac

SEQ ID NO: 3666593 - RNA, 23 nt, Salmonella enterica enterica serovar Typhi
gcucaugcgaucgggcaauccau

SEQ ID NO: 3666594 - RNA, 15 nt, Salmonella enterica enterica serovar Typhi
gcucaugcgccuggc

SEQ ID NO: 3666595 - RNA, 16 nt, Salmonella enterica enterica serovar Typhi
gcucaugcgcggcggg

SEQ ID NO: 3666596 - RNA, 14 nt, Salmonella enterica enterica serovar Typhi
gcucaugcgcgucc

SEQ ID NO: 3666597 - RNA, 22 nt, Salmonella enterica enterica serovar Typhi
gcucaugcgcgucccggcagug

SEQ ID NO: 3666598 - RNA, 20 nt, Salmonella enterica enterica serovar Typhi
gcucaugugcagcauccagc

SEQ ID NO: 3666599 - RNA, 13 nt, Salmonella enterica enterica serovar Typhi
gcucauuucccaa

SEQ ID NO: 3666600 - RNA, 15 nt, Salmonella enterica enterica serovar Typhi
gcucauuugcggcgu

SEQ ID NO: 3666601 - RNA, 22 nt, Salmonella enterica enterica serovar Typhi
gcucauuugcggcgucgccugg

SEQ ID NO: 3666602 - RNA, 21 nt, Salmonella enterica enterica serovar Typhi
gcuccagaagcacuucuccac

SEQ ID NO: 3666603 - RNA, 22 nt, Salmonella enterica enterica serovar Typhi
gcuccagaagcacuucuccacg

SEQ ID NO: 3666604 - RNA, 17 nt, Salmonella enterica enterica serovar Typhi
gcuccagacaggacgcc

SEQ ID NO: 3666605 - RNA, 19 nt, Salmonella enterica enterica serovar Typhi
gcuccagaccaccagcgac

SEQ ID NO: 3666606 - RNA, 9 nt, Salmonella enterica enterica serovar Typhi
gcuccagca

SEQ ID NO: 3666607 - RNA, 15 nt, Salmonella enterica enterica serovar Typhi
gcuccagcaucacau

SEQ ID NO: 3666608 - RNA, 12 nt, Salmonella enterica enterica serovar Typhi
gcuccagccgcu

SEQ ID NO: 3666609 - RNA, 17 nt, Salmonella enterica enterica serovar Typhi
gcuccagcgccagcucc

SEQ ID NO: 3666610 - RNA, 18 nt, Salmonella enterica enterica serovar Typhi
gcuccagcgccagcucca

SEQ ID NO: 3666611 - RNA, 16 nt, Salmonella enterica enterica serovar Typhi
gcuccagcuggcuggc

SEQ ID NO: 3666612 - RNA, 23 nt, Salmonella enterica enterica serovar Typhi
gcuccagggauugauggccagcc

SEQ ID NO: 3666613 - RNA, 23 nt, Salmonella enterica enterica serovar Typhi
gcuccagggcugcuggccuucca

SEQ ID NO: 3666614 - RNA, 20 nt, Salmonella enterica enterica serovar Typhi
gcuccaguuguuccagcagc

SEQ ID NO: 3666615 - RNA, 15 nt, Salmonella enterica enterica serovar Typhi
gcuccauagaaauca

SEQ ID NO: 3666616 - RNA, 18 nt, Salmonella enterica enterica serovar Typhi
gcuccauagaaaucagca

SEQ ID NO: 3666617 - RNA, 19 nt, Salmonella enterica enterica serovar Typhi
gcuccauagaaaucagcag

SEQ ID NO: 3666618 - RNA, 18 nt, Salmonella enterica enterica serovar Typhi
gcuccauccaccagcccc

SEQ ID NO: 3666619 - RNA, 15 nt, Salmonella enterica enterica serovar Typhi
gcuccaucuccggca

SEQ ID NO: 3666620 - RNA, 17 nt, Salmonella enterica enterica serovar Typhi
gcuccaucuccggcagc

SEQ ID NO: 3666621 - RNA, 22 nt, Salmonella enterica enterica serovar Typhi
gcuccaugaucgccuggccgau

SEQ ID NO: 3666622 - RNA, 20 nt, Salmonella enterica enterica serovar Typhi
gcuccaugucuugcuaucaa

SEQ ID NO: 3666623 - RNA, 16 nt, Salmonella enterica enterica serovar Typhi
gcucccacucuuccag

SEQ ID NO: 3666624 - RNA, 21 nt, Salmonella enterica enterica serovar Typhi
gcucccagauuaaaucauccu

SEQ ID NO: 3666625 - RNA, 13 nt, Salmonella enterica enterica serovar Typhi
gcuccccaacagg

SEQ ID NO: 3666626 - RNA, 18 nt, Salmonella enterica enterica serovar Typhi
gcuccccguuccaccgcc

SEQ ID NO: 3666627 - RNA, 18 nt, Salmonella enterica enterica serovar Typhi
gcucccgcagccacuccc

SEQ ID NO: 3666628 - RNA, 20 nt, Salmonella enterica enterica serovar Typhi
gcucccgcauggacaaggau

SEQ ID NO: 3666629 - RNA, 22 nt, Salmonella enterica enterica serovar Typhi
gcucccgccagcgagaugaaaa

SEQ ID NO: 3666630 - RNA, 15 nt, Salmonella enterica enterica serovar Typhi
gcucccgcugcggcg

SEQ ID NO: 3666631 - RNA, 20 nt, Salmonella enterica enterica serovar Typhi
gcuccgaauaauccuucccg

SEQ ID NO: 3666632 - RNA, 22 nt, Salmonella enterica enterica serovar Typhi
gcuccgagacucaaagaaaaca

SEQ ID NO: 3666633 - RNA, 20 nt, Salmonella enterica enterica serovar Typhi
gcuccgcaaagcccaucagc

SEQ ID NO: 3666634 - RNA, 12 nt, Salmonella enterica enterica serovar Typhi
gcuccgcacggu

SEQ ID NO: 3666635 - RNA, 14 nt, Salmonella enterica enterica serovar Typhi
gcuccgccagcaau

SEQ ID NO: 3666636 - RNA, 15 nt, Salmonella enterica enterica serovar Typhi
gcuccgccagcaaug

SEQ ID NO: 3666637 - RNA, 19 nt, Salmonella enterica enterica serovar Typhi
gcuccgcgccgaaauuuuc

SEQ ID NO: 3666638 - RNA, 20 nt, Salmonella enterica enterica serovar Typhi
gcuccggacgcaccagccag

SEQ ID NO: 3666639 - RNA, 17 nt, Salmonella enterica enterica serovar Typhi
gcuccggguugccugau

SEQ ID NO: 3666640 - RNA, 17 nt, Salmonella enterica enterica serovar Typhi
gcuccgguuuuugcgcg

SEQ ID NO: 3666641 - RNA, 20 nt, Salmonella enterica enterica serovar Typhi
gcuccguucccucgacaauu

SEQ ID NO: 3666642 - RNA, 13 nt, Salmonella enterica enterica serovar Typhi
gcuccugccagau

SEQ ID NO: 3666643 - RNA, 15 nt, Salmonella enterica enterica serovar Typhi
gcuccugccagauuu

SEQ ID NO: 3666644 - RNA, 15 nt, Salmonella enterica enterica serovar Typhi
gcuccugcgggcuua

SEQ ID NO: 3666645 - RNA, 12 nt, Salmonella enterica enterica serovar Typhi
gcuccuggaacc

SEQ ID NO: 3666646 - RNA, 16 nt, Salmonella enterica enterica serovar Typhi
gcuccugguccguaac

SEQ ID NO: 3666647 - RNA, 17 nt, Salmonella enterica enterica serovar Typhi
gcuccugucaggcgagc

SEQ ID NO: 3666648 - RNA, 18 nt, Salmonella enterica enterica serovar Typhi
gcuccuugauugcaagaa

SEQ ID NO: 3666649 - RNA, 19 nt, Salmonella enterica enterica serovar Typhi
gcuccuuucggacuuccug

SEQ ID NO: 3666650 - RNA, 16 nt, Salmonella enterica enterica serovar Typhi
gcucgaguucuucacg

SEQ ID NO: 3666651 - RNA, 19 nt, Salmonella enterica enterica serovar Typhi
gcucgaucccgacccauac

SEQ ID NO: 3666652 - RNA, 15 nt, Salmonella enterica enterica serovar Typhi
gcucgcaccguaggc

SEQ ID NO: 3666653 - RNA, 20 nt, Salmonella enterica enterica serovar Typhi
gcucgccagcauacgucugc

SEQ ID NO: 3666654 - RNA, 22 nt, Salmonella enterica enterica serovar Typhi
gcucgccagcgcugucagugaa

SEQ ID NO: 3666655 - RNA, 13 nt, Salmonella enterica enterica serovar Typhi
gcucgcccgccgc

SEQ ID NO: 3666656 - RNA, 19 nt, Salmonella enterica enterica serovar Typhi
gcucgccgaccggcgcgcc

SEQ ID NO: 3666657 - RNA, 18 nt, Salmonella enterica enterica serovar Typhi
gcucgccgccucccccuc

SEQ ID NO: 3666658 - RNA, 21 nt, Salmonella enterica enterica serovar Typhi
gcucgcgacgcagacccgcaa

SEQ ID NO: 3666659 - RNA, 21 nt, Salmonella enterica enterica serovar Typhi
gcucgcggaagcgaccggcgu

SEQ ID NO: 3666660 - RNA, 11 nt, Salmonella enterica enterica serovar Typhi
gcucgcggcgg

SEQ ID NO: 3666661 - RNA, 20 nt, Salmonella enterica enterica serovar Typhi
gcucgcggcggaccgcaacg

SEQ ID NO: 3666662 - RNA, 18 nt, Salmonella enterica enterica serovar Typhi
gcucgcuaccuuuuuuca

SEQ ID NO: 3666663 - RNA, 22 nt, Salmonella enterica enterica serovar Typhi
gcucgcuaugaaaacgcagccc

SEQ ID NO: 3666664 - RNA, 23 nt, Salmonella enterica enterica serovar Typhi
gcucgcuaugaaaacgcagcccc

SEQ ID NO: 3666665 - RNA, 20 nt, Salmonella enterica enterica serovar Typhi
gcucgcugccgaucagauug

SEQ ID NO: 3666666 - RNA, 11 nt, Salmonella enterica enterica serovar Typhi
gcucgcuggug

SEQ ID NO: 3666667 - RNA, 19 nt, Salmonella enterica enterica serovar Typhi
gcucgcuuacgcggcgcgc

SEQ ID NO: 3666668 - RNA, 15 nt, Salmonella enterica enterica serovar Typhi
gcucgcuuugccgcc

SEQ ID NO: 3666669 - RNA, 16 nt, Salmonella enterica enterica serovar Typhi
gcucggaugugcauug

SEQ ID NO: 3666670 - RNA, 15 nt, Salmonella enterica enterica serovar Typhi
gcucggcaauuucuu

SEQ ID NO: 3666671 - RNA, 15 nt, Salmonella enterica enterica serovar Typhi
gcucggcgucauccc

SEQ ID NO: 3666672 - RNA, 15 nt, Salmonella enterica enterica serovar Typhi
gcucgguaaaaaguu

SEQ ID NO: 3666673 - RNA, 22 nt, Salmonella enterica enterica serovar Typhi
gcugaucuaacgaaaccggcgg

SEQ ID NO: 3666674 - RNA, 13 nt, Salmonella enterica enterica serovar Typhi
gcugaugacgcgc

SEQ ID NO: 3666675 - RNA, 15 nt, Salmonella enterica enterica serovar Typhi
gcugaugacgcgccg

SEQ ID NO: 3666676 - RNA, 17 nt, Salmonella enterica enterica serovar Typhi
gcugaugauuggccucc

SEQ ID NO: 3666677 - RNA, 13 nt, Salmonella enterica enterica serovar Typhi
gcugaugcagaua

SEQ ID NO: 3666678 - RNA, 21 nt, Salmonella enterica enterica serovar Typhi
gcugaugccagauggcaagau

SEQ ID NO: 3666679 - RNA, 16 nt, Salmonella enterica enterica serovar Typhi
gcugaugugcggccug

SEQ ID NO: 3666680 - RNA, 18 nt, Salmonella enterica enterica serovar Typhi
gcugauguuugcgcucuu

SEQ ID NO: 3666681 - RNA, 20 nt, Salmonella enterica enterica serovar Typhi
gcugcaauagcagaucgcgc

SEQ ID NO: 3666682 - RNA, 19 nt, Salmonella enterica enterica serovar Typhi
gcugcacaaaauacuguuu

SEQ ID NO: 3666683 - RNA, 17 nt, Salmonella enterica enterica serovar Typhi
gcugcacgccaucggcu

SEQ ID NO: 3666684 - RNA, 15 nt, Salmonella enterica enterica serovar Typhi
gcugcauccgcgcuu

SEQ ID NO: 3666685 - RNA, 16 nt, Salmonella enterica enterica serovar Typhi
gcugcaucuuacugac

SEQ ID NO: 3666686 - RNA, 21 nt, Salmonella enterica enterica serovar Typhi
gcugcaucuuacugaccggcc

SEQ ID NO: 3666687 - RNA, 22 nt, Salmonella enterica enterica serovar Typhi
gcugcaucuuacugaccggccc

SEQ ID NO: 3666688 - RNA, 13 nt, Salmonella enterica enterica serovar Typhi
gcugccagcugcg

SEQ ID NO: 3666689 - RNA, 15 nt, Salmonella enterica enterica serovar Typhi
gcugccccagacgcc

SEQ ID NO: 3666690 - RNA, 13 nt, Salmonella enterica enterica serovar Typhi
gcugcccugcggu

SEQ ID NO: 3666691 - RNA, 22 nt, Salmonella enterica enterica serovar Typhi
gcugccgacaaagagcucccca

SEQ ID NO: 3666692 - RNA, 19 nt, Salmonella enterica enterica serovar Typhi
gcugccgauacuccauugu

SEQ ID NO: 3666693 - RNA, 16 nt, Salmonella enterica enterica serovar Typhi
gcugccgaucagauug

SEQ ID NO: 3666694 - RNA, 9 nt, Salmonella enterica enterica serovar Typhi
gcugccgca

SEQ ID NO: 3666695 - RNA, 19 nt, Salmonella enterica enterica serovar Typhi
gcugccgcaacggucgguc

SEQ ID NO: 3666696 - RNA, 19 nt, Salmonella enterica enterica serovar Typhi
gcugccggaaagggaagag

SEQ ID NO: 3666697 - RNA, 14 nt, Salmonella enterica enterica serovar Typhi
gcugccgucaaagu

SEQ ID NO: 3666698 - RNA, 17 nt, Salmonella enterica enterica serovar Typhi
gcugccuuauccggccu

SEQ ID NO: 3666699 - RNA, 18 nt, Salmonella enterica enterica serovar Typhi
gcugccuuauccggccug

SEQ ID NO: 3666700 - RNA, 19 nt, Salmonella enterica enterica serovar Typhi
gcugcgcaggggcuauuga

SEQ ID NO: 3666701 - RNA, 13 nt, Salmonella enterica enterica serovar Typhi
gcugcgcauccgc

SEQ ID NO: 3666702 - RNA, 15 nt, Salmonella enterica enterica serovar Typhi
gcugcgcauccgcgg

SEQ ID NO: 3666703 - RNA, 19 nt, Salmonella enterica enterica serovar Typhi
gcugcgcauccgcggcgcu

SEQ ID NO: 3666704 - RNA, 13 nt, Salmonella enterica enterica serovar Typhi
gcugcgccagcgu

SEQ ID NO: 3666705 - RNA, 13 nt, Salmonella enterica enterica serovar Typhi
gcugcgccguucc

SEQ ID NO: 3666706 - RNA, 18 nt, Salmonella enterica enterica serovar Typhi
gcugcgccugcgggucca

SEQ ID NO: 3666707 - RNA, 17 nt, Salmonella enterica enterica serovar Typhi
gcugcgccuuauccggc

SEQ ID NO: 3666708 - RNA, 18 nt, Salmonella enterica enterica serovar Typhi
gcugcgccuuauccggcg

SEQ ID NO: 3666709 - RNA, 12 nt, Salmonella enterica enterica serovar Typhi
gcugcgcgcgau

SEQ ID NO: 3666710 - RNA, 13 nt, Salmonella enterica enterica serovar Typhi
gcugcgcucagaa

SEQ ID NO: 3666711 - RNA, 17 nt, Salmonella enterica enterica serovar Typhi
gcugcgcuuaccgggcc

SEQ ID NO: 3666712 - RNA, 20 nt, Salmonella enterica enterica serovar Typhi
gcugcgcuuaccgggccuac

SEQ ID NO: 3666713 - RNA, 16 nt, Salmonella enterica enterica serovar Typhi
gcugcggaacaccagc

SEQ ID NO: 3666714 - RNA, 24 nt, Salmonella enterica enterica serovar Typhi
gcugcggacauuaacgccgcguuc

SEQ ID NO: 3666715 - RNA, 11 nt, Salmonella enterica enterica serovar Typhi
gcugcggauga

SEQ ID NO: 3666716 - RNA, 18 nt, Salmonella enterica enterica serovar Typhi
gcugcggcaaacuggcga

SEQ ID NO: 3666717 - RNA, 23 nt, Salmonella enterica enterica serovar Typhi
gcugcggcguuccccaauguuca

SEQ ID NO: 3666718 - RNA, 18 nt, Salmonella enterica enterica serovar Typhi
gcugcgucagcgcuugcc

SEQ ID NO: 3666719 - RNA, 21 nt, Salmonella enterica enterica serovar Typhi
gcugcguucggaagacugcuc

SEQ ID NO: 3666720 - RNA, 21 nt, Salmonella enterica enterica serovar Typhi
gcugcucauuuaugcgcuggg

SEQ ID NO: 3666721 - RNA, 17 nt, Salmonella enterica enterica serovar Typhi
gcugcuccaucuccggc

SEQ ID NO: 3666722 - RNA, 13 nt, Salmonella enterica enterica serovar Typhi
gcugcucuccuug

SEQ ID NO: 3666723 - RNA, 20 nt, Salmonella enterica enterica serovar Typhi
gcugcugaaagaagacgaaa

SEQ ID NO: 3666724 - RNA, 11 nt, Salmonella enterica enterica serovar Typhi
gcugcugaugg

SEQ ID NO: 3666725 - RNA, 21 nt, Salmonella enterica enterica serovar Typhi
gcugcuggcgagcaggaaaag

SEQ ID NO: 3666726 - RNA, 22 nt, Salmonella enterica enterica serovar Typhi
gcugcuguaacagacgcaggcc

SEQ ID NO: 3666727 - RNA, 20 nt, Salmonella enterica enterica serovar Typhi
gcugcuguggauuuauggcg

SEQ ID NO: 3666728 - RNA, 22 nt, Salmonella enterica enterica serovar Typhi
gcugcuguuaaccuugcgccuc

SEQ ID NO: 3666729 - RNA, 17 nt, Salmonella enterica enterica serovar Typhi
gcugcuuaccauacuga

SEQ ID NO: 3666730 - RNA, 21 nt, Salmonella enterica enterica serovar Typhi
gcugcuucacguuuuccaggu

SEQ ID NO: 3666731 - RNA, 22 nt, Salmonella enterica enterica serovar Typhi
gcugcuugcuuuucaucaccau

SEQ ID NO: 3666732 - RNA, 21 nt, Salmonella enterica enterica serovar Typhi
gcugcuuuaaccuggcgcaca

SEQ ID NO: 3666733 - RNA, 21 nt, Salmonella enterica enterica serovar Typhi
gcuggaaaaauaagagggcgc

SEQ ID NO: 3666734 - RNA, 15 nt, Salmonella enterica enterica serovar Typhi
gcuggacaugauaau

SEQ ID NO: 3666735 - RNA, 17 nt, Salmonella enterica enterica serovar Typhi
gcuggacgucaugccgc

SEQ ID NO: 3666736 - RNA, 21 nt, Salmonella enterica enterica serovar Typhi
gcuggagcaggugcggcuggg

SEQ ID NO: 3666737 - RNA, 20 nt, Salmonella enterica enterica serovar Typhi
gcuggauaauugcucugcca

SEQ ID NO: 3666738 - RNA, 22 nt, Salmonella enterica enterica serovar Typhi
gcuggauaccgcgccagcgaug

SEQ ID NO: 3666739 - RNA, 17 nt, Salmonella enterica enterica serovar Typhi
gcuggauagagcgcugc

SEQ ID NO: 3666740 - RNA, 15 nt, Salmonella enterica enterica serovar Typhi
gcuggaugcgcaaau

SEQ ID NO: 3666741 - RNA, 18 nt, Salmonella enterica enterica serovar Typhi
gcuggcaaaacgcaucca

SEQ ID NO: 3666742 - RNA, 20 nt, Salmonella enterica enterica serovar Typhi
gcuggcaaaacgcauccagc

SEQ ID NO: 3666743 - RNA, 15 nt, Salmonella enterica enterica serovar Typhi
gcuggcacguucucg

SEQ ID NO: 3666744 - RNA, 14 nt, Salmonella enterica enterica serovar Typhi
gcuggcagggggag

SEQ ID NO: 3666745 - RNA, 17 nt, Salmonella enterica enterica serovar Typhi
gcuggcauuacgcuggc

SEQ ID NO: 3666746 - RNA, 21 nt, Salmonella enterica enterica serovar Typhi
gcuggccgaauagcugauaaa

SEQ ID NO: 3666747 - RNA, 14 nt, Salmonella enterica enterica serovar Typhi
gcuggccgcgugcu

SEQ ID NO: 3666748 - RNA, 12 nt, Salmonella enterica enterica serovar Typhi
gcuggccgguug

SEQ ID NO: 3666749 - RNA, 17 nt, Salmonella enterica enterica serovar Typhi
gcuggcgaaccaccagc

SEQ ID NO: 3666750 - RNA, 17 nt, Salmonella enterica enterica serovar Typhi
gcuggcgauauccgugc

SEQ ID NO: 3666751 - RNA, 23 nt, Salmonella enterica enterica serovar Typhi
gcuggcgauauccgugccgccgc

SEQ ID NO: 3666752 - RNA, 22 nt, Salmonella enterica enterica serovar Typhi
gcuggcgcacauuuacgccagc

SEQ ID NO: 3666753 - RNA, 12 nt, Salmonella enterica enterica serovar Typhi
gcuggcgcgcua

SEQ ID NO: 3666754 - RNA, 18 nt, Salmonella enterica enterica serovar Typhi
gcuggcgcggggaacaca

SEQ ID NO: 3666755 - RNA, 19 nt, Salmonella enterica enterica serovar Typhi
gcuggcgcggggaacacua

SEQ ID NO: 3666756 - RNA, 16 nt, Salmonella enterica enterica serovar Typhi
gcuggcgcggggaucg

SEQ ID NO: 3666757 - RNA, 17 nt, Salmonella enterica enterica serovar Typhi
gcuggcgcggggaucgg

SEQ ID NO: 3666758 - RNA, 22 nt, Salmonella enterica enterica serovar Typhi
gcuggcgcucacgauaacgcag

SEQ ID NO: 3666759 - RNA, 13 nt, Salmonella enterica enterica serovar Typhi
gcuguuuuuuguu

SEQ ID NO: 3666760 - RNA, 17 nt, Salmonella enterica enterica serovar Typhi
gcuuaaaaaauccugca

SEQ ID NO: 3666761 - RNA, 18 nt, Salmonella enterica enterica serovar Typhi
gcuuaaagccaauccaga

SEQ ID NO: 3666762 - RNA, 16 nt, Salmonella enterica enterica serovar Typhi
gcuuaaauggcgcugu

SEQ ID NO: 3666763 - RNA, 22 nt, Salmonella enterica enterica serovar Typhi
gcuuaacagcguacaggcggaa

SEQ ID NO: 3666764 - RNA, 23 nt, Salmonella enterica enterica serovar Typhi
gcuuaacccugccguuugcgcca

SEQ ID NO: 3666765 - RNA, 16 nt, Salmonella enterica enterica serovar Typhi
gcuuaacuucugcagg

SEQ ID NO: 3666766 - RNA, 20 nt, Salmonella enterica enterica serovar Typhi
gcuuaauaauaagcggccua

SEQ ID NO: 3666767 - RNA, 21 nt, Salmonella enterica enterica serovar Typhi
gcuuaaucaccagcgcauuga

SEQ ID NO: 3666768 - RNA, 16 nt, Salmonella enterica enterica serovar Typhi
gcuuaaucgagagcgg

SEQ ID NO: 3666769 - RNA, 16 nt, Salmonella enterica enterica serovar Typhi
gcuuaaugcucugcug

SEQ ID NO: 3666770 - RNA, 15 nt, Salmonella enterica enterica serovar Typhi
gcuuacaauuuaucu

SEQ ID NO: 3666771 - RNA, 18 nt, Salmonella enterica enterica serovar Typhi
gcuuacaauuuaucugcg

SEQ ID NO: 3666772 - RNA, 18 nt, Salmonella enterica enterica serovar Typhi
gcuuacacagacugcuug

SEQ ID NO: 3666773 - RNA, 13 nt, Salmonella enterica enterica serovar Typhi
gcuuacaggcacg

SEQ ID NO: 3666774 - RNA, 17 nt, Salmonella enterica enterica serovar Typhi
gcuuacaggcacgccug

SEQ ID NO: 3666775 - RNA, 20 nt, Salmonella enterica enterica serovar Typhi
gcuuacaucgccauccggca

SEQ ID NO: 3666776 - RNA, 14 nt, Salmonella enterica enterica serovar Typhi
gcuuacauuucagg

SEQ ID NO: 3666777 - RNA, 22 nt, Salmonella enterica enterica serovar Typhi
gcuuacauuucaggcaaaaaaa

SEQ ID NO: 3666778 - RNA, 14 nt, Salmonella enterica enterica serovar Typhi
gcuuaccagaccgg

SEQ ID NO: 3666779 - RNA, 20 nt, Salmonella enterica enterica serovar Typhi
gcuuaccagcgggccgcuga

SEQ ID NO: 3666780 - RNA, 18 nt, Salmonella enterica enterica serovar Typhi
gcuuaccaucuggccuac

SEQ ID NO: 3666781 - RNA, 13 nt, Salmonella enterica enterica serovar Typhi
gcuuacccagucu

SEQ ID NO: 3666782 - RNA, 17 nt, Salmonella enterica enterica serovar Typhi
gcuuaccgggccugcgu

SEQ ID NO: 3666783 - RNA, 22 nt, Salmonella enterica enterica serovar Typhi
gcuuaccggguuuggucaggua

SEQ ID NO: 3666784 - RNA, 18 nt, Salmonella enterica enterica serovar Typhi
gcuuaccuuguucuucca

SEQ ID NO: 3666785 - RNA, 20 nt, Salmonella enterica enterica serovar Typhi
gcuuacgcuuacccggccua

SEQ ID NO: 3666786 - RNA, 15 nt, Salmonella enterica enterica serovar Typhi
gcuuacggccaugga

SEQ ID NO: 3666787 - RNA, 15 nt, Salmonella enterica enterica serovar Typhi
gcuuacggcuauucc

SEQ ID NO: 3666788 - RNA, 17 nt, Salmonella enterica enterica serovar Typhi
gcuuacuuucagauaau

SEQ ID NO: 3666789 - RNA, 23 nt, Salmonella enterica enterica serovar Typhi
gcuuacuuuccaaaauccaggga

SEQ ID NO: 3666790 - RNA, 16 nt, Salmonella enterica enterica serovar Typhi
gcuuacuuuuagaauu

SEQ ID NO: 3666791 - RNA, 21 nt, Salmonella enterica enterica serovar Typhi
gcuuacuuuuagaauuaucug

SEQ ID NO: 3666792 - RNA, 21 nt, Salmonella enterica enterica serovar Typhi
gcuuagaucguaucggcuggc

SEQ ID NO: 3666793 - RNA, 17 nt, Salmonella enterica enterica serovar Typhi
gcuuagcucaucagccu

SEQ ID NO: 3666794 - RNA, 16 nt, Salmonella enterica enterica serovar Typhi
gcuuaguaaccccagg

SEQ ID NO: 3666795 - RNA, 18 nt, Salmonella enterica enterica serovar Typhi
gcuuauaacccugucugc

SEQ ID NO: 3666796 - RNA, 16 nt, Salmonella enterica enterica serovar Typhi
gcuuaucaaguaacgu

SEQ ID NO: 3666797 - RNA, 20 nt, Salmonella enterica enterica serovar Typhi
gcuuaucacguagccagagc

SEQ ID NO: 3666798 - RNA, 17 nt, Salmonella enterica enterica serovar Typhi
gcuuaucaggccuacaa

SEQ ID NO: 3666799 - RNA, 18 nt, Salmonella enterica enterica serovar Typhi
gcuuaucaggccuacaau

SEQ ID NO: 3666800 - RNA, 23 nt, Salmonella enterica enterica serovar Typhi
gcuuaucaggccuacauccggcu

SEQ ID NO: 3666801 - RNA, 22 nt, Salmonella enterica enterica serovar Typhi
gcuuaucaggccuacauuuuua

SEQ ID NO: 3666802 - RNA, 17 nt, Salmonella enterica enterica serovar Typhi
gcuuaucaggccuacgc

SEQ ID NO: 3666803 - RNA, 15 nt, Salmonella enterica enterica serovar Typhi
gcuuauccggccuac

SEQ ID NO: 3666804 - RNA, 16 nt, Salmonella enterica enterica serovar Typhi
gcuuauccggccuaca

SEQ ID NO: 3666805 - RNA, 17 nt, Salmonella enterica enterica serovar Typhi
gcuuauccggccuacag

SEQ ID NO: 3666806 - RNA, 18 nt, Salmonella enterica enterica serovar Typhi
gcuuauccggccuacaga

SEQ ID NO: 3666807 - RNA, 16 nt, Salmonella enterica enterica serovar Typhi
gcuuauccggccuacg

SEQ ID NO: 3666808 - RNA, 20 nt, Salmonella enterica enterica serovar Typhi
gcuuauccggccuacgauuu

SEQ ID NO: 3666809 - RNA, 18 nt, Salmonella enterica enterica serovar Typhi
gcuuauccggccugcaca

SEQ ID NO: 3666810 - RNA, 21 nt, Salmonella enterica enterica serovar Typhi
gcuuaucgccaaaccagaccc

SEQ ID NO: 3666811 - RNA, 16 nt, Salmonella enterica enterica serovar Typhi
gcuuaucgccaaagau

SEQ ID NO: 3666812 - RNA, 14 nt, Salmonella enterica enterica serovar Typhi
gcuuaucgggccua

SEQ ID NO: 3666813 - RNA, 17 nt, Salmonella enterica enterica serovar Typhi
gcuuaucgggccuacga

SEQ ID NO: 3666814 - RNA, 14 nt, Salmonella enterica enterica serovar Typhi
gcuuaucugaccau

SEQ ID NO: 3666815 - RNA, 18 nt, Salmonella enterica enterica serovar Typhi
gcuuaucugaccaugcca

SEQ ID NO: 3666816 - RNA, 21 nt, Salmonella enterica enterica serovar Typhi
gcuuauuagaggcguaaguaa

SEQ ID NO: 3666817 - RNA, 19 nt, Salmonella enterica enterica serovar Typhi
gcuuauuccagucauuaac

SEQ ID NO: 3666818 - RNA, 17 nt, Salmonella enterica enterica serovar Typhi
gcuucaacagcggcggc

SEQ ID NO: 3666819 - RNA, 14 nt, Salmonella enterica enterica serovar Typhi
gcuucaaccuccug

SEQ ID NO: 3666820 - RNA, 21 nt, Salmonella enterica enterica serovar Typhi
gcuucaaucgucguuccgcca

SEQ ID NO: 3666821 - RNA, 18 nt, Salmonella enterica enterica serovar Typhi
gcuucaccgauuuaaaau

SEQ ID NO: 3666822 - RNA, 13 nt, Salmonella enterica enterica serovar Typhi
gcuucaccucagc

SEQ ID NO: 3666823 - RNA, 19 nt, Salmonella enterica enterica serovar Typhi
gcuucacgaagcggguuuu

SEQ ID NO: 3666824 - RNA, 23 nt, Salmonella enterica enterica serovar Typhi
gcuucacgagcggucaggccagc

SEQ ID NO: 3666825 - RNA, 14 nt, Salmonella enterica enterica serovar Typhi
gcuucacgccacag

SEQ ID NO: 3666826 - RNA, 22 nt, Salmonella enterica enterica serovar Typhi
gcuucacgcgcuguaacuucac

SEQ ID NO: 3666827 - RNA, 16 nt, Salmonella enterica enterica serovar Typhi
gcuucacgucagcgac

SEQ ID NO: 3666828 - RNA, 17 nt, Salmonella enterica enterica serovar Typhi
gcuucacguuuuccagg

SEQ ID NO: 3666829 - RNA, 19 nt, Salmonella enterica enterica serovar Typhi
gcuucagacaacgccgccu

SEQ ID NO: 3666830 - RNA, 17 nt, Salmonella enterica enterica serovar Typhi
gcuuccagcuccaucca

SEQ ID NO: 3666831 - RNA, 19 nt, Salmonella enterica enterica serovar Typhi
gcuucccacagucggcgaa

SEQ ID NO: 3666832 - RNA, 18 nt, Salmonella enterica enterica serovar Typhi
gcuucccgaugccagcaa

SEQ ID NO: 3666833 - RNA, 15 nt, Salmonella enterica enterica serovar Typhi
gcuuccgccaugguu

SEQ ID NO: 3666834 - RNA, 14 nt, Salmonella enterica enterica serovar Typhi
gcuuccgccgggaa

SEQ ID NO: 3666835 - RNA, 19 nt, Salmonella enterica enterica serovar Typhi
gcuuccgcgacgaugcgca

SEQ ID NO: 3666836 - RNA, 14 nt, Salmonella enterica enterica serovar Typhi
gcuuccugcagugg

SEQ ID NO: 3666837 - RNA, 19 nt, Salmonella enterica enterica serovar Typhi
gcuuccugcgcugucacca

SEQ ID NO: 3666838 - RNA, 19 nt, Salmonella enterica enterica serovar Typhi
gcuucgacauagccuuugu

SEQ ID NO: 3666839 - RNA, 22 nt, Salmonella enterica enterica serovar Typhi
gcuucgccaauaaugccgccgu

SEQ ID NO: 3666840 - RNA, 24 nt, Salmonella enterica enterica serovar Typhi
gcuucgcgaacugcacucggaugu

SEQ ID NO: 3666841 - RNA, 15 nt, Salmonella enterica enterica serovar Typhi
gcuucgcgcgccagu

SEQ ID NO: 3666842 - RNA, 14 nt, Salmonella enterica enterica serovar Typhi
gcuucgcuuaccag

SEQ ID NO: 3666843 - RNA, 18 nt, Salmonella enterica enterica serovar Typhi
gcuucggacuccugacgc

SEQ ID NO: 3666844 - RNA, 17 nt, Salmonella enterica enterica serovar Typhi
gcuucgguccggcgcua

SEQ ID NO: 3666845 - RNA, 17 nt, Salmonella enterica enterica serovar Typhi
gcuucgucaggcggcug

SEQ ID NO: 3666846 - RNA, 19 nt, Salmonella enterica enterica serovar Typhi
gcuucgucaggcggcugcg

SEQ ID NO: 3666847 - RNA, 22 nt, Salmonella enterica enterica serovar Typhi
gcuucgucgagcagugauucgc

SEQ ID NO: 3666848 - RNA, 14 nt, Salmonella enterica enterica serovar Typhi
gcuucgucuuuauu

SEQ ID NO: 3666849 - RNA, 20 nt, Salmonella enterica enterica serovar Typhi
gcuucguggcaaucagcaau

SEQ ID NO: 3666850 - RNA, 21 nt, Salmonella enterica enterica serovar Typhi
gcuucguggcaaucagcaauu

SEQ ID NO: 3666851 - RNA, 22 nt, Salmonella enterica enterica serovar Typhi
gcuucguuccgcgauuuccugu

SEQ ID NO: 3666852 - RNA, 16 nt, Salmonella enterica enterica serovar Typhi
gcuucguucuguauca

SEQ ID NO: 3666853 - RNA, 13 nt, Salmonella enterica enterica serovar Typhi
gcuucuauccacu

SEQ ID NO: 3666854 - RNA, 16 nt, Salmonella enterica enterica serovar Typhi
gcuucuauuaccgcag

SEQ ID NO: 3666855 - RNA, 22 nt, Salmonella enterica enterica serovar Typhi
gcuucucacggauccagaacug

SEQ ID NO: 3666856 - RNA, 18 nt, Salmonella enterica enterica serovar Typhi
gcuucucgccuucggccu

SEQ ID NO: 3666857 - RNA, 16 nt, Salmonella enterica enterica serovar Typhi
gcuucugauacugcuc

SEQ ID NO: 3666858 - RNA, 21 nt, Salmonella enterica enterica serovar Typhi
gcuucugcgccuuuggcagga

SEQ ID NO: 3666859 - RNA, 15 nt, Salmonella enterica enterica serovar Typhi
gcuucuggcguaaug

SEQ ID NO: 3666860 - RNA, 16 nt, Salmonella enterica enterica serovar Typhi
gcuucugucagccuug

SEQ ID NO: 3666861 - RNA, 20 nt, Salmonella enterica enterica serovar Typhi
gcuucuguccuuucugcugc

SEQ ID NO: 3666862 - RNA, 19 nt, Salmonella enterica enterica serovar Typhi
gcuucuuaaaauagccauc

SEQ ID NO: 3666863 - RNA, 15 nt, Salmonella enterica enterica serovar Typhi
gcuucuucgccagcu

SEQ ID NO: 3666864 - RNA, 18 nt, Salmonella enterica enterica serovar Typhi
gcuucuucuuuagauaau

SEQ ID NO: 3666865 - RNA, 19 nt, Salmonella enterica enterica serovar Typhi
gcuucuucuuuagauaauu

SEQ ID NO: 3666866 - RNA, 20 nt, Salmonella enterica enterica serovar Typhi
gcuucuuugaaauugaucac

SEQ ID NO: 3666867 - RNA, 21 nt, Salmonella enterica enterica serovar Typhi
gcuucuuugaagcguuccagu

SEQ ID NO: 3666868 - RNA, 15 nt, Salmonella enterica enterica serovar Typhi
gcuugacucugaagc

SEQ ID NO: 3666869 - RNA, 19 nt, Salmonella enterica enterica serovar Typhi
gcuugaguuuuccgccauu

SEQ ID NO: 3666870 - RNA, 12 nt, Salmonella enterica enterica serovar Typhi
gcuugauaaaua

SEQ ID NO: 3666871 - RNA, 14 nt, Salmonella enterica enterica serovar Typhi
gcuugauaaauauc

SEQ ID NO: 3666872 - RNA, 13 nt, Salmonella enterica enterica serovar Typhi
gcuugauacgcca

SEQ ID NO: 3666873 - RNA, 20 nt, Salmonella enterica enterica serovar Typhi
gcuugauacgccaucuuucu

SEQ ID NO: 3666874 - RNA, 15 nt, Salmonella enterica enterica serovar Typhi
gcuugaucgcgcagc

SEQ ID NO: 3666875 - RNA, 19 nt, Salmonella enterica enterica serovar Typhi
gcuugcauugcuuuuaguu

SEQ ID NO: 3666876 - RNA, 16 nt, Salmonella enterica enterica serovar Typhi
gcuugccgaccgcaac

SEQ ID NO: 3666877 - RNA, 19 nt, Salmonella enterica enterica serovar Typhi
gcuugccgggccguagugc

SEQ ID NO: 3666878 - RNA, 22 nt, Salmonella enterica enterica serovar Typhi
gcuugccgucacaggcggccag

SEQ ID NO: 3666879 - RNA, 19 nt, Salmonella enterica enterica serovar Typhi
gcuugccugugcccgcggu

SEQ ID NO: 3666880 - RNA, 16 nt, Salmonella enterica enterica serovar Typhi
gcuugcgccaucaucc

SEQ ID NO: 3666881 - RNA, 19 nt, Salmonella enterica enterica serovar Typhi
gcuugcgccaucauccggc

SEQ ID NO: 3666882 - RNA, 20 nt, Salmonella enterica enterica serovar Typhi
gcuugcgccaucauccggca

SEQ ID NO: 3666883 - RNA, 17 nt, Salmonella enterica enterica serovar Typhi
gcuugcgccgccauccg

SEQ ID NO: 3666884 - RNA, 14 nt, Salmonella enterica enterica serovar Typhi
gcuugcgcuauccg

SEQ ID NO: 3666885 - RNA, 15 nt, Salmonella enterica enterica serovar Typhi
gcuugcgcuauccgc

SEQ ID NO: 3666886 - RNA, 20 nt, Salmonella enterica enterica serovar Typhi
gcuugcguguuugggcgagg

SEQ ID NO: 3666887 - RNA, 19 nt, Salmonella enterica enterica serovar Typhi
gcuugcuuuucaucaccau

SEQ ID NO: 3666888 - RNA, 17 nt, Salmonella enterica enterica serovar Typhi
gcuuggcggcuuccugu

SEQ ID NO: 3666889 - RNA, 20 nt, Salmonella enterica enterica serovar Typhi
gcuuggcguauagccgcccc

SEQ ID NO: 3666890 - RNA, 14 nt, Salmonella enterica enterica serovar Typhi
gcuuggugacguag

SEQ ID NO: 3666891 - RNA, 15 nt, Salmonella enterica enterica serovar Typhi
gcuugucauccugcu

SEQ ID NO: 3666892 - RNA, 17 nt, Salmonella enterica enterica serovar Typhi
gcuugucgccaugcacc

SEQ ID NO: 3666893 - RNA, 19 nt, Salmonella enterica enterica serovar Typhi
gcuugucgcgagcuuccag

SEQ ID NO: 3666894 - RNA, 21 nt, Salmonella enterica enterica serovar Typhi
gcuuguuacugcauuccgcgu

SEQ ID NO: 3666895 - RNA, 19 nt, Salmonella enterica enterica serovar Typhi
gcuuguucuuuucaauaaa

SEQ ID NO: 3666896 - RNA, 17 nt, Salmonella enterica enterica serovar Typhi
gcuuguuguaaagaaau

SEQ ID NO: 3666897 - RNA, 17 nt, Salmonella enterica enterica serovar Typhi
gcuuuaacgcugcaaag

SEQ ID NO: 3666898 - RNA, 13 nt, Salmonella enterica enterica serovar Typhi
gcuuuaagcgcug

SEQ ID NO: 3666899 - RNA, 13 nt, Salmonella enterica enterica serovar Typhi
gcuuuaaguuuuu

SEQ ID NO: 3666900 - RNA, 17 nt, Salmonella enterica enterica serovar Typhi
gcuuuaauaccgguggc

SEQ ID NO: 3666901 - RNA, 14 nt, Salmonella enterica enterica serovar Typhi
gcuuuaauauucau

SEQ ID NO: 3666902 - RNA, 18 nt, Salmonella enterica enterica serovar Typhi
gcuuuaauauucauucug

SEQ ID NO: 3666903 - RNA, 17 nt, Salmonella enterica enterica serovar Typhi
gcuuuaaucaccauggc

SEQ ID NO: 3666904 - RNA, 21 nt, Salmonella enterica enterica serovar Typhi
gcuuuaaugcuuuaaaugccu

SEQ ID NO: 3666905 - RNA, 14 nt, Salmonella enterica enterica serovar Typhi
gcuuuacagcgacg

SEQ ID NO: 3666906 - RNA, 20 nt, Salmonella enterica enterica serovar Typhi
gcuuuacccggcgcaaacag

SEQ ID NO: 3666907 - RNA, 23 nt, Salmonella enterica enterica serovar Typhi
gcuuuacgaccgcagaaacagau

SEQ ID NO: 3666908 - RNA, 16 nt, Salmonella enterica enterica serovar Typhi
gcuuuagcuuuacucu

SEQ ID NO: 3666909 - RNA, 20 nt, Salmonella enterica enterica serovar Typhi
gcuuuaggguaucauuucca

SEQ ID NO: 3666910 - RNA, 16 nt, Salmonella enterica enterica serovar Typhi
gcuuuagugccgccau

SEQ ID NO: 3666911 - RNA, 12 nt, Salmonella enterica enterica serovar Typhi
gcuuuauauaaa

SEQ ID NO: 3666912 - RNA, 21 nt, Salmonella enterica enterica serovar Typhi
gcuuuauucugucgccaccac

SEQ ID NO: 3666913 - RNA, 22 nt, Salmonella enterica enterica serovar Typhi
gcuuuauucugucgccaccacu

SEQ ID NO: 3666914 - RNA, 13 nt, Salmonella enterica enterica serovar Typhi
gcuuucaauaaau

SEQ ID NO: 3666915 - RNA, 12 nt, Salmonella enterica enterica serovar Typhi
gcuuucacgcca

SEQ ID NO: 3666916 - RNA, 20 nt, Salmonella enterica enterica serovar Typhi
gcuuucaguaauaauauaaa

SEQ ID NO: 3666917 - RNA, 17 nt, Salmonella enterica enterica serovar Typhi
gcuuuccagccaugcca

SEQ ID NO: 3666918 - RNA, 12 nt, Salmonella enterica enterica serovar Typhi
gcuuuccagcuc

SEQ ID NO: 3666919 - RNA, 13 nt, Salmonella enterica enterica serovar Typhi
gcuuuccgccaug

SEQ ID NO: 3666920 - RNA, 16 nt, Salmonella enterica enterica serovar Typhi
gcuuuccgccaugaaa

SEQ ID NO: 3666921 - RNA, 20 nt, Salmonella enterica enterica serovar Typhi
gcuuuccgccaugaaaaaaa

SEQ ID NO: 3666922 - RNA, 21 nt, Salmonella enterica enterica serovar Typhi
gcuuuccgccaugaaaaaaac

SEQ ID NO: 3666923 - RNA, 14 nt, Salmonella enterica enterica serovar Typhi
gcuuuccgccgccg

SEQ ID NO: 3666924 - RNA, 19 nt, Salmonella enterica enterica serovar Typhi
gcuuuccguuaccucaaaa

SEQ ID NO: 3666925 - RNA, 12 nt, Salmonella enterica enterica serovar Typhi
gcuuucucaccc

SEQ ID NO: 3666926 - RNA, 13 nt, Salmonella enterica enterica serovar Typhi
gcuuucuggauga

SEQ ID NO: 3666927 - RNA, 20 nt, Salmonella enterica enterica serovar Typhi
gcuuucuguaggccggauaa

SEQ ID NO: 3666928 - RNA, 13 nt, Salmonella enterica enterica serovar Typhi
gcuuucuucuuca

SEQ ID NO: 3666929 - RNA, 14 nt, Salmonella enterica enterica serovar Typhi
gcuuucuucuucac

SEQ ID NO: 3666930 - RNA, 17 nt, Salmonella enterica enterica serovar Typhi
gcuuucuucuucacgac

SEQ ID NO: 3666931 - RNA, 23 nt, Salmonella enterica enterica serovar Typhi
gcuuucuuucuccagcguacugc

SEQ ID NO: 3666932 - RNA, 22 nt, Salmonella enterica enterica serovar Typhi
gcuuugaacagcgucauccagu

SEQ ID NO: 3666933 - RNA, 23 nt, Salmonella enterica enterica serovar Typhi
gcuuugauguccggcgcguucau

SEQ ID NO: 3666934 - RNA, 17 nt, Salmonella enterica enterica serovar Typhi
gcuuugcaagcaugaua

SEQ ID NO: 3666935 - RNA, 21 nt, Salmonella enterica enterica serovar Typhi
gcuuugcgauagcccggcaug

SEQ ID NO: 3666936 - RNA, 16 nt, Salmonella enterica enterica serovar Typhi
gcuuugcgccaucggg

SEQ ID NO: 3666937 - RNA, 17 nt, Salmonella enterica enterica serovar Typhi
gcuuugcuuauccggcc

SEQ ID NO: 3666938 - RNA, 18 nt, Salmonella enterica enterica serovar Typhi
gcuuugcuuauccggccu

SEQ ID NO: 3666939 - RNA, 19 nt, Salmonella enterica enterica serovar Typhi
gcuuugcuuauccggccua

SEQ ID NO: 3666940 - RNA, 18 nt, Salmonella enterica enterica serovar Typhi
gcuuuggcaaacggcgcc

SEQ ID NO: 3666941 - RNA, 14 nt, Salmonella enterica enterica serovar Typhi
gcuuuggcaggccu

SEQ ID NO: 3666942 - RNA, 18 nt, Salmonella enterica enterica serovar Typhi
gcuuuguaaaacauucaa

SEQ ID NO: 3666943 - RNA, 22 nt, Salmonella enterica enterica serovar Typhi
gcuuuguagcauaaucaggccc

SEQ ID NO: 3666944 - RNA, 17 nt, Salmonella enterica enterica serovar Typhi
gcuuuuaaaacuucccg

SEQ ID NO: 3666945 - RNA, 19 nt, Salmonella enterica enterica serovar Typhi
gcuuuuauguuacccagcc

SEQ ID NO: 3666946 - RNA, 15 nt, Salmonella enterica enterica serovar Typhi
gcuuuucagcccagg

SEQ ID NO: 3666947 - RNA, 14 nt, Salmonella enterica enterica serovar Typhi
gcuuuucagcgcca

SEQ ID NO: 3666948 - RNA, 19 nt, Salmonella enterica enterica serovar Typhi
gcuuuucagcgucuuucuu

SEQ ID NO: 3666949 - RNA, 12 nt, Salmonella enterica enterica serovar Typhi
gcuuuucaggcu

SEQ ID NO: 3666950 - RNA, 17 nt, Salmonella enterica enterica serovar Typhi
gcuuuucaugaaacucg

SEQ ID NO: 3666951 - RNA, 22 nt, Salmonella enterica enterica serovar Typhi
gcuuuucaugacgcucuccucc

SEQ ID NO: 3666952 - RNA, 17 nt, Salmonella enterica enterica serovar Typhi
gcuuuugauucaaaugu

SEQ ID NO: 3666953 - RNA, 18 nt, Salmonella enterica enterica serovar Typhi
gcuuuugcgcacugcucg

SEQ ID NO: 3666954 - RNA, 23 nt, Salmonella enterica enterica serovar Typhi
gcuuuuggcggccagcgugucau

SEQ ID NO: 3666955 - RNA, 20 nt, Salmonella enterica enterica serovar Typhi
gcuuuugguuuuucaaccac

SEQ ID NO: 3666956 - RNA, 15 nt, Salmonella enterica enterica serovar Typhi
gcuuuuuaaauacug

SEQ ID NO: 3666957 - RNA, 13 nt, Salmonella enterica enterica serovar Typhi
gcuuuuucaucau

SEQ ID NO: 3666958 - RNA, 20 nt, Salmonella enterica enterica serovar Typhi
gcuuuuuuaacgauuucccc

SEQ ID NO: 3666959 - RNA, 19 nt, Salmonella enterica enterica serovar Typhi
gcuuuuuucucugcuuucg

SEQ ID NO: 3666960 - RNA, 22 nt, Salmonella enterica enterica serovar Typhi
gcuuuuuucucugcuuucggug

SEQ ID NO: 3666961 - RNA, 21 nt, Salmonella enterica enterica serovar Typhi
gcuuuuuugcuggcuggcggu

SEQ ID NO: 3666962 - RNA, 14 nt, Salmonella enterica enterica serovar Typhi
ggaaaaaaagaaua

SEQ ID NO: 3666963 - RNA, 17 nt, Salmonella enterica enterica serovar Typhi
ggaaaaaagcagcaucc

SEQ ID NO: 3666964 - RNA, 15 nt, Salmonella enterica enterica serovar Typhi
ggaaaaagccgccgu

SEQ ID NO: 3666965 - RNA, 13 nt, Salmonella enterica enterica serovar Typhi
ggaaaaauaagag

SEQ ID NO: 3666966 - RNA, 13 nt, Salmonella enterica enterica serovar Typhi
ggaaaacagcgcc

SEQ ID NO: 3666967 - RNA, 17 nt, Salmonella enterica enterica serovar Typhi
ggaaaacagcgccggca

SEQ ID NO: 3666968 - RNA, 21 nt, Salmonella enterica enterica serovar Typhi
ggaaaacagcgccggcagcag

SEQ ID NO: 3666969 - RNA, 22 nt, Salmonella enterica enterica serovar Typhi
ggaaaacggccagugaaauaaa

SEQ ID NO: 3666970 - RNA, 23 nt, Salmonella enterica enterica serovar Typhi
ggaaaacggccagugaaauaaau

SEQ ID NO: 3666971 - RNA, 14 nt, Salmonella enterica enterica serovar Typhi
ggaaaacuccagca

SEQ ID NO: 3666972 - RNA, 21 nt, Salmonella enterica enterica serovar Typhi
ggaaaacuggaagaagaaagg

SEQ ID NO: 3666973 - RNA, 15 nt, Salmonella enterica enterica serovar Typhi
ggaaaagcuguagca

SEQ ID NO: 3666974 - RNA, 22 nt, Salmonella enterica enterica serovar Typhi
ggaaaaugaugacucauuaaaa

SEQ ID NO: 3666975 - RNA, 13 nt, Salmonella enterica enterica serovar Typhi
ggaaaaugcgcca

SEQ ID NO: 3666976 - RNA, 14 nt, Salmonella enterica enterica serovar Typhi
ggaaaccaaccacg

SEQ ID NO: 3666977 - RNA, 16 nt, Salmonella enterica enterica serovar Typhi
ggaaacccgcucgccc

SEQ ID NO: 3666978 - RNA, 21 nt, Salmonella enterica enterica serovar Typhi
ggaaaccgucguuacccuccu

SEQ ID NO: 3666979 - RNA, 23 nt, Salmonella enterica enterica serovar Typhi
ggaaaccuuucuucucuucuuca

SEQ ID NO: 3666980 - RNA, 16 nt, Salmonella enterica enterica serovar Typhi
ggaaacuccagcggca

SEQ ID NO: 3666981 - RNA, 15 nt, Salmonella enterica enterica serovar Typhi
ggaaacucuuuuccc

SEQ ID NO: 3666982 - RNA, 15 nt, Salmonella enterica enterica serovar Typhi
ggaaacuguaguaau

SEQ ID NO: 3666983 - RNA, 23 nt, Salmonella enterica enterica serovar Typhi
ggaaacugugcgacaaccugcgc

SEQ ID NO: 3666984 - RNA, 21 nt, Salmonella enterica enterica serovar Typhi
ggaaagauuacuucaggcugc

SEQ ID NO: 3666985 - RNA, 17 nt, Salmonella enterica enterica serovar Typhi
ggaaagcauucgcagca

SEQ ID NO: 3666986 - RNA, 20 nt, Salmonella enterica enterica serovar Typhi
ggaaagcauucgcagcagac

SEQ ID NO: 3666987 - RNA, 14 nt, Salmonella enterica enterica serovar Typhi
ggaaagccccuacc

SEQ ID NO: 3666988 - RNA, 22 nt, Salmonella enterica enterica serovar Typhi
ggaaagccccuaccgaggcagg

SEQ ID NO: 3666989 - RNA, 13 nt, Salmonella enterica enterica serovar Typhi
ggaaaggcagaga

SEQ ID NO: 3666990 - RNA, 14 nt, Salmonella enterica enterica serovar Typhi
ggaaagggacgaug

SEQ ID NO: 3666991 - RNA, 21 nt, Salmonella enterica enterica serovar Typhi
ggaaaguaccaaaacagaaaa

SEQ ID NO: 3666992 - RNA, 22 nt, Salmonella enterica enterica serovar Typhi
ggaaagucuuaccuguauuaug

SEQ ID NO: 3666993 - RNA, 14 nt, Salmonella enterica enterica serovar Typhi
ggaaauaaagguuc

SEQ ID NO: 3666994 - RNA, 11 nt, Salmonella enterica enterica serovar Typhi
ggaaauaacgu

SEQ ID NO: 3666995 - RNA, 15 nt, Salmonella enterica enterica serovar Typhi
ggaaauaauuaaucc

SEQ ID NO: 3666996 - RNA, 13 nt, Salmonella enterica enterica serovar Typhi
ggaaauagagcag

SEQ ID NO: 3666997 - RNA, 23 nt, Salmonella enterica enterica serovar Typhi
ggaaaucaaaccaucccagguua

SEQ ID NO: 3666998 - RNA, 22 nt, Salmonella enterica enterica serovar Typhi
ggaaaucaugccagaauugcac

SEQ ID NO: 3666999 - RNA, 21 nt, Salmonella enterica enterica serovar Typhi
ggaaauggcgaacagcccgcu

SEQ ID NO: 3667000 - RNA, 16 nt, Salmonella enterica enterica serovar Typhi
ggacuaccugccggaa

SEQ ID NO: 3667001 - RNA, 14 nt, Salmonella enterica enterica serovar Typhi
ggacuauaggcaau

SEQ ID NO: 3667002 - RNA, 12 nt, Salmonella enterica enterica serovar Typhi
ggacucaggccu

SEQ ID NO: 3667003 - RNA, 14 nt, Salmonella enterica enterica serovar Typhi
ggacuccaggcaac

SEQ ID NO: 3667004 - RNA, 18 nt, Salmonella enterica enterica serovar Typhi
ggacuccugacgcugaga

SEQ ID NO: 3667005 - RNA, 23 nt, Salmonella enterica enterica serovar Typhi
ggacugauacagccaaaucagca

SEQ ID NO: 3667006 - RNA, 22 nt, Salmonella enterica enterica serovar Typhi
ggacugaucccacuuaggcagc

SEQ ID NO: 3667007 - RNA, 13 nt, Salmonella enterica enterica serovar Typhi
ggacugggcugau

SEQ ID NO: 3667008 - RNA, 12 nt, Salmonella enterica enterica serovar Typhi
ggacuggugcau

SEQ ID NO: 3667009 - RNA, 15 nt, Salmonella enterica enterica serovar Typhi
ggacuguacaagaag

SEQ ID NO: 3667010 - RNA, 12 nt, Salmonella enterica enterica serovar Typhi
ggacuuucgcuu

SEQ ID NO: 3667011 - RNA, 17 nt, Salmonella enterica enterica serovar Typhi
ggacuuucgcuucacga

SEQ ID NO: 3667012 - RNA, 17 nt, Salmonella enterica enterica serovar Typhi
ggagaaaacgcggccug

SEQ ID NO: 3667013 - RNA, 15 nt, Salmonella enterica enterica serovar Typhi
ggagaacgccgggcc

SEQ ID NO: 3667014 - RNA, 22 nt, Salmonella enterica enterica serovar Typhi
ggagaacgguucauccagcagc

SEQ ID NO: 3667015 - RNA, 16 nt, Salmonella enterica enterica serovar Typhi
ggagaagacgccgccg

SEQ ID NO: 3667016 - RNA, 19 nt, Salmonella enterica enterica serovar Typhi
ggagaagacgccgccgcau

SEQ ID NO: 3667017 - RNA, 15 nt, Salmonella enterica enterica serovar Typhi
ggagacagaacagga

SEQ ID NO: 3667018 - RNA, 18 nt, Salmonella enterica enterica serovar Typhi
ggagaccccacacuacca

SEQ ID NO: 3667019 - RNA, 15 nt, Salmonella enterica enterica serovar Typhi
ggagagcaacgccau

SEQ ID NO: 3667020 - RNA, 16 nt, Salmonella enterica enterica serovar Typhi
ggagagcaguccuaaa

SEQ ID NO: 3667021 - RNA, 23 nt, Salmonella enterica enterica serovar Typhi
ggagagcauuuguagcggcaaca

SEQ ID NO: 3667022 - RNA, 15 nt, Salmonella enterica enterica serovar Typhi
ggagagccagaagaa

SEQ ID NO: 3667023 - RNA, 13 nt, Salmonella enterica enterica serovar Typhi
ggagaguuuugcc

SEQ ID NO: 3667024 - RNA, 23 nt, Salmonella enterica enterica serovar Typhi
ggagaguuuugccgucacagaga

SEQ ID NO: 3667025 - RNA, 16 nt, Salmonella enterica enterica serovar Typhi
ggagauauggcgggga

SEQ ID NO: 3667026 - RNA, 19 nt, Salmonella enterica enterica serovar Typhi
ggagauauggcggggaggu

SEQ ID NO: 3667027 - RNA, 20 nt, Salmonella enterica enterica serovar Typhi
ggagcacgcggugccgaugg

SEQ ID NO: 3667028 - RNA, 21 nt, Salmonella enterica enterica serovar Typhi
ggagcagugauuaugcucccg

SEQ ID NO: 3667029 - RNA, 11 nt, Salmonella enterica enterica serovar Typhi
ggagcccagua

SEQ ID NO: 3667030 - RNA, 18 nt, Salmonella enterica enterica serovar Typhi
ggagccgccuggccuguc

SEQ ID NO: 3667031 - RNA, 18 nt, Salmonella enterica enterica serovar Typhi
ggagcgaaaaggccuggc

SEQ ID NO: 3667032 - RNA, 18 nt, Salmonella enterica enterica serovar Typhi
ggagcgaagaauucgcaa

SEQ ID NO: 3667033 - RNA, 14 nt, Salmonella enterica enterica serovar Typhi
ggagcggcguccgc

SEQ ID NO: 3667034 - RNA, 11 nt, Salmonella enterica enterica serovar Typhi
ggagcgugcuu

SEQ ID NO: 3667035 - RNA, 16 nt, Salmonella enterica enterica serovar Typhi
ggagcguucaugcugg

SEQ ID NO: 3667036 - RNA, 18 nt, Salmonella enterica enterica serovar Typhi
ggagcugacugcaaaucu

SEQ ID NO: 3667037 - RNA, 15 nt, Salmonella enterica enterica serovar Typhi
ggaggaacagcgccg

SEQ ID NO: 3667038 - RNA, 22 nt, Salmonella enterica enterica serovar Typhi
ggaggaacagcgccgucacccg

SEQ ID NO: 3667039 - RNA, 16 nt, Salmonella enterica enterica serovar Typhi
ggaggcgcguuuacug

SEQ ID NO: 3667040 - RNA, 13 nt, Salmonella enterica enterica serovar Typhi
ggaggcgggcgcg

SEQ ID NO: 3667041 - RNA, 15 nt, Salmonella enterica enterica serovar Typhi
ggaggucauuauuca

SEQ ID NO: 3667042 - RNA, 23 nt, Salmonella enterica enterica serovar Typhi
ggaggucauuauucaggccuccu

SEQ ID NO: 3667043 - RNA, 14 nt, Salmonella enterica enterica serovar Typhi
ggagguucaccacc

SEQ ID NO: 3667044 - RNA, 22 nt, Salmonella enterica enterica serovar Typhi
ggagucauuacccaauaaugaa

SEQ ID NO: 3667045 - RNA, 13 nt, Salmonella enterica enterica serovar Typhi
ggaguccagcaac

SEQ ID NO: 3667046 - RNA, 13 nt, Salmonella enterica enterica serovar Typhi
ggagucugaaaau

SEQ ID NO: 3667047 - RNA, 17 nt, Salmonella enterica enterica serovar Typhi
ggagucugaaaauaauu

SEQ ID NO: 3667048 - RNA, 12 nt, Salmonella enterica enterica serovar Typhi
ggagugaacacg

SEQ ID NO: 3667049 - RNA, 13 nt, Salmonella enterica enterica serovar Typhi
ggagugcgcggcg

SEQ ID NO: 3667050 - RNA, 12 nt, Salmonella enterica enterica serovar Typhi
ggauaaaaaagc

SEQ ID NO: 3667051 - RNA, 12 nt, Salmonella enterica enterica serovar Typhi
ggauaaaacaga

SEQ ID NO: 3667052 - RNA, 14 nt, Salmonella enterica enterica serovar Typhi
ggauaaagaccggc

SEQ ID NO: 3667053 - RNA, 23 nt, Salmonella enterica enterica serovar Typhi
ggauaaagccaauggugcucagc

SEQ ID NO: 3667054 - RNA, 21 nt, Salmonella enterica enterica serovar Typhi
ggauaaccuuuaacagauggc

SEQ ID NO: 3667055 - RNA, 20 nt, Salmonella enterica enterica serovar Typhi
ggauaacgcagaagacagaa

SEQ ID NO: 3667056 - RNA, 18 nt, Salmonella enterica enterica serovar Typhi
ggauaagcaacgcgccau

SEQ ID NO: 3667057 - RNA, 18 nt, Salmonella enterica enterica serovar Typhi
ggauaagcgcagcgccau

SEQ ID NO: 3667058 - RNA, 18 nt, Salmonella enterica enterica serovar Typhi
ggauaagcggcagcgcca

SEQ ID NO: 3667059 - RNA, 13 nt, Salmonella enterica enterica serovar Typhi
ggauaagcguagc

SEQ ID NO: 3667060 - RNA, 15 nt, Salmonella enterica enterica serovar Typhi
ggauaaggcagcaau

SEQ ID NO: 3667061 - RNA, 23 nt, Salmonella enterica enterica serovar Typhi
ggauaaggcauucacgccaccau

SEQ ID NO: 3667062 - RNA, 22 nt, Salmonella enterica enterica serovar Typhi
ggauaaggcauuucgccgccau

SEQ ID NO: 3667063 - RNA, 20 nt, Salmonella enterica enterica serovar Typhi
ggauaaggccacgccgccau

SEQ ID NO: 3667064 - RNA, 20 nt, Salmonella enterica enterica serovar Typhi
ggauaaggcgcuugcgccau

SEQ ID NO: 3667065 - RNA, 23 nt, Salmonella enterica enterica serovar Typhi
ggauaaggcgcuugcgccgccau

SEQ ID NO: 3667066 - RNA, 15 nt, Salmonella enterica enterica serovar Typhi
ggauaaggcgugagc

SEQ ID NO: 3667067 - RNA, 23 nt, Salmonella enterica enterica serovar Typhi
ggauaaggcguuuacgccgccau

SEQ ID NO: 3667068 - RNA, 20 nt, Salmonella enterica enterica serovar Typhi
ggauaaggcguuuacgcugc

SEQ ID NO: 3667069 - RNA, 23 nt, Salmonella enterica enterica serovar Typhi
ggauaagguguuuacgccgccau

SEQ ID NO: 3667070 - RNA, 18 nt, Salmonella enterica enterica serovar Typhi
ggauaaugucgacgcgcu

SEQ ID NO: 3667071 - RNA, 14 nt, Salmonella enterica enterica serovar Typhi
ggauaauuuaucca

SEQ ID NO: 3667072 - RNA, 16 nt, Salmonella enterica enterica serovar Typhi
ggauacacaucaggaa

SEQ ID NO: 3667073 - RNA, 15 nt, Salmonella enterica enterica serovar Typhi
ggauaccacgcacau

SEQ ID NO: 3667074 - RNA, 16 nt, Salmonella enterica enterica serovar Typhi
ggauacccccuaucug

SEQ ID NO: 3667075 - RNA, 15 nt, Salmonella enterica enterica serovar Typhi
ggauaccgcgccagc

SEQ ID NO: 3667076 - RNA, 15 nt, Salmonella enterica enterica serovar Typhi
ggauacgauguaaaa

SEQ ID NO: 3667077 - RNA, 19 nt, Salmonella enterica enterica serovar Typhi
ggauacgauguaaaaaugc

SEQ ID NO: 3667078 - RNA, 15 nt, Salmonella enterica enterica serovar Typhi
ggauacguucauccu

SEQ ID NO: 3667079 - RNA, 21 nt, Salmonella enterica enterica serovar Typhi
ggauacuaaagggaucuuccu

SEQ ID NO: 3667080 - RNA, 14 nt, Salmonella enterica enterica serovar Typhi
ggauagcgaccagc

SEQ ID NO: 3667081 - RNA, 14 nt, Salmonella enterica enterica serovar Typhi
ggauaguacugacc

SEQ ID NO: 3667082 - RNA, 21 nt, Salmonella enterica enterica serovar Typhi
ggauauaaaaaacauauaauu

SEQ ID NO: 3667083 - RNA, 16 nt, Salmonella enterica enterica serovar Typhi
ggauauacuucaucag

SEQ ID NO: 3667084 - RNA, 16 nt, Salmonella enterica enterica serovar Typhi
ggauaucaaugcgcgu

SEQ ID NO: 3667085 - RNA, 20 nt, Salmonella enterica enterica serovar Typhi
ggauaucuugaugauucacc

SEQ ID NO: 3667086 - RNA, 16 nt, Salmonella enterica enterica serovar Typhi
ggcaauauuaauguca

SEQ ID NO: 3667087 - RNA, 13 nt, Salmonella enterica enterica serovar Typhi
ggcaaucaaaucc

SEQ ID NO: 3667088 - RNA, 22 nt, Salmonella enterica enterica serovar Typhi
ggcaaucauaccgucagauucu

SEQ ID NO: 3667089 - RNA, 17 nt, Salmonella enterica enterica serovar Typhi
ggcaaucgccugcaacg

SEQ ID NO: 3667090 - RNA, 12 nt, Salmonella enterica enterica serovar Typhi
ggcaaugccacc

SEQ ID NO: 3667091 - RNA, 12 nt, Salmonella enterica enterica serovar Typhi
ggcaaugccccc

SEQ ID NO: 3667092 - RNA, 23 nt, Salmonella enterica enterica serovar Typhi
ggcaauggccagaugaaacugca

SEQ ID NO: 3667093 - RNA, 12 nt, Salmonella enterica enterica serovar Typhi
ggcaauuuccgc

SEQ ID NO: 3667094 - RNA, 15 nt, Salmonella enterica enterica serovar Typhi
ggcaauuuccggcga

SEQ ID NO: 3667095 - RNA, 13 nt, Salmonella enterica enterica serovar Typhi
ggcaauuucucgc

SEQ ID NO: 3667096 - RNA, 17 nt, Salmonella enterica enterica serovar Typhi
ggcacaauagcgcuaaa

SEQ ID NO: 3667097 - RNA, 19 nt, Salmonella enterica enterica serovar Typhi
ggcacaauagcgcuaaaca

SEQ ID NO: 3667098 - RNA, 13 nt, Salmonella enterica enterica serovar Typhi
ggcacacagcacu

SEQ ID NO: 3667099 - RNA, 14 nt, Salmonella enterica enterica serovar Typhi
ggcacacagcacua

SEQ ID NO: 3667100 - RNA, 23 nt, Salmonella enterica enterica serovar Typhi
ggcacacaggccgccgggucagc

SEQ ID NO: 3667101 - RNA, 11 nt, Salmonella enterica enterica serovar Typhi
ggcacagccag

SEQ ID NO: 3667102 - RNA, 21 nt, Salmonella enterica enterica serovar Typhi
ggcacauauuccggcgcuggc

SEQ ID NO: 3667103 - RNA, 13 nt, Salmonella enterica enterica serovar Typhi
ggcacaucaggca

SEQ ID NO: 3667104 - RNA, 12 nt, Salmonella enterica enterica serovar Typhi
ggcaccagcaau

SEQ ID NO: 3667105 - RNA, 21 nt, Salmonella enterica enterica serovar Typhi
ggcaccggaaccggcaucggg

SEQ ID NO: 3667106 - RNA, 19 nt, Salmonella enterica enterica serovar Typhi
ggcaccucguccagauggg

SEQ ID NO: 3667107 - RNA, 19 nt, Salmonella enterica enterica serovar Typhi
ggcaccuggagcgccuccc

SEQ ID NO: 3667108 - RNA, 15 nt, Salmonella enterica enterica serovar Typhi
ggcacgauaaauugc

SEQ ID NO: 3667109 - RNA, 13 nt, Salmonella enterica enterica serovar Typhi
ggcacgccaaaau

SEQ ID NO: 3667110 - RNA, 18 nt, Salmonella enterica enterica serovar Typhi
ggcacggucaaucaucag

SEQ ID NO: 3667111 - RNA, 24 nt, Salmonella enterica enterica serovar Typhi
ggcacguuaaacaccucaccggcu

SEQ ID NO: 3667112 - RNA, 18 nt, Salmonella enterica enterica serovar Typhi
ggcacuacgguccaguug

SEQ ID NO: 3667113 - RNA, 19 nt, Salmonella enterica enterica serovar Typhi
ggcacucugcgccagguuu

SEQ ID NO: 3667114 - RNA, 18 nt, Salmonella enterica enterica serovar Typhi
ggcacugcgcuuauccgg

SEQ ID NO: 3667115 - RNA, 14 nt, Salmonella enterica enterica serovar Typhi
ggcagaaaaaucag

SEQ ID NO: 3667116 - RNA, 22 nt, Salmonella enterica enterica serovar Typhi
ggcagaauuaacucaucacagc

SEQ ID NO: 3667117 - RNA, 13 nt, Salmonella enterica enterica serovar Typhi
ggcagacagccau

SEQ ID NO: 3667118 - RNA, 15 nt, Salmonella enterica enterica serovar Typhi
ggcagacaucgccgu

SEQ ID NO: 3667119 - RNA, 14 nt, Salmonella enterica enterica serovar Typhi
ggcagagcgcgcuc

SEQ ID NO: 3667120 - RNA, 16 nt, Salmonella enterica enterica serovar Typhi
ggcagaguccagcggc

SEQ ID NO: 3667121 - RNA, 16 nt, Salmonella enterica enterica serovar Typhi
ggcagaucgcgcuccc

SEQ ID NO: 3667122 - RNA, 18 nt, Salmonella enterica enterica serovar Typhi
ggcagcacccggcccggc

SEQ ID NO: 3667123 - RNA, 17 nt, Salmonella enterica enterica serovar Typhi
ggcagcaggaucuccag

SEQ ID NO: 3667124 - RNA, 23 nt, Salmonella enterica enterica serovar Typhi
ggcagccaugcuauucagcaguu

SEQ ID NO: 3667125 - RNA, 18 nt, Salmonella enterica enterica serovar Typhi
ggcagccauucggcugcc

SEQ ID NO: 3667126 - RNA, 14 nt, Salmonella enterica enterica serovar Typhi
ggcagccgccacca

SEQ ID NO: 3667127 - RNA, 16 nt, Salmonella enterica enterica serovar Typhi
ggcagccgccaccaca

SEQ ID NO: 3667128 - RNA, 21 nt, Salmonella enterica enterica serovar Typhi
ggcagcgcaacgcuuaauccc

SEQ ID NO: 3667129 - RNA, 15 nt, Salmonella enterica enterica serovar Typhi
ggcagcgccagcggu

SEQ ID NO: 3667130 - RNA, 18 nt, Salmonella enterica enterica serovar Typhi
ggcagcgccagugacgcc

SEQ ID NO: 3667131 - RNA, 19 nt, Salmonella enterica enterica serovar Typhi
ggcagcgccugacggcgcu

SEQ ID NO: 3667132 - RNA, 19 nt, Salmonella enterica enterica serovar Typhi
ggcagcgcgaacaggcugg

SEQ ID NO: 3667133 - RNA, 17 nt, Salmonella enterica enterica serovar Typhi
ggcagcgcgccagcgcu

SEQ ID NO: 3667134 - RNA, 12 nt, Salmonella enterica enterica serovar Typhi
ggcagcgucagc

SEQ ID NO: 3667135 - RNA, 20 nt, Salmonella enterica enterica serovar Typhi
ggcagcgucggcuucaucac

SEQ ID NO: 3667136 - RNA, 14 nt, Salmonella enterica enterica serovar Typhi
ggcagcgucuuccc

SEQ ID NO: 3667137 - RNA, 15 nt, Salmonella enterica enterica serovar Typhi
ggcagcucugccugu

SEQ ID NO: 3667138 - RNA, 20 nt, Salmonella enterica enterica serovar Typhi
ggcagcuuccagcaaaccuu

SEQ ID NO: 3667139 - RNA, 19 nt, Salmonella enterica enterica serovar Typhi
ggcaggaaauccagcagaa

SEQ ID NO: 3667140 - RNA, 15 nt, Salmonella enterica enterica serovar Typhi
ggcaggcagcgccag

SEQ ID NO: 3667141 - RNA, 16 nt, Salmonella enterica enterica serovar Typhi
ggcaggcauggccaau

SEQ ID NO: 3667142 - RNA, 15 nt, Salmonella enterica enterica serovar Typhi
ggcaggccuaacaca

SEQ ID NO: 3667143 - RNA, 11 nt, Salmonella enterica enterica serovar Typhi
ggcaggcggaa

SEQ ID NO: 3667144 - RNA, 13 nt, Salmonella enterica enterica serovar Typhi
ggcaggcucacca

SEQ ID NO: 3667145 - RNA, 16 nt, Salmonella enterica enterica serovar Typhi
ggcaggcuuccacgca

SEQ ID NO: 3667146 - RNA, 17 nt, Salmonella enterica enterica serovar Typhi
ggcagguaucgauacag

SEQ ID NO: 3667147 - RNA, 22 nt, Salmonella enterica enterica serovar Typhi
ggcagucccaaugcggaaacca

SEQ ID NO: 3667148 - RNA, 19 nt, Salmonella enterica enterica serovar Typhi
ggcaguccuugcagccaga

SEQ ID NO: 3667149 - RNA, 21 nt, Salmonella enterica enterica serovar Typhi
ggcagucgcuacaaccagcgc

SEQ ID NO: 3667150 - RNA, 23 nt, Salmonella enterica enterica serovar Typhi
ggcagucgcuacaaccagcgcgg

SEQ ID NO: 3667151 - RNA, 18 nt, Salmonella enterica enterica serovar Typhi
ggcagucuggcggcagcc

SEQ ID NO: 3667152 - RNA, 13 nt, Salmonella enterica enterica serovar Typhi
ggcagugcauaaa

SEQ ID NO: 3667153 - RNA, 22 nt, Salmonella enterica enterica serovar Typhi
ggcaguucagucgggaucgcca

SEQ ID NO: 3667154 - RNA, 12 nt, Salmonella enterica enterica serovar Typhi
ggcaguucccua

SEQ ID NO: 3667155 - RNA, 20 nt, Salmonella enterica enterica serovar Typhi
ggcaguuuaagcgccgauaa

SEQ ID NO: 3667156 - RNA, 14 nt, Salmonella enterica enterica serovar Typhi
ggcaguuuauccgg

SEQ ID NO: 3667157 - RNA, 14 nt, Salmonella enterica enterica serovar Typhi
ggcaguuuauucag

SEQ ID NO: 3667158 - RNA, 19 nt, Salmonella enterica enterica serovar Typhi
ggcauaaaaaagaggaaug

SEQ ID NO: 3667159 - RNA, 16 nt, Salmonella enterica enterica serovar Typhi
ggcauaaacacagcaa

SEQ ID NO: 3667160 - RNA, 15 nt, Salmonella enterica enterica serovar Typhi
ggcauagacauccag

SEQ ID NO: 3667161 - RNA, 23 nt, Salmonella enterica enterica serovar Typhi
ggcauauggauauucaucgccgu

SEQ ID NO: 3667162 - RNA, 22 nt, Salmonella enterica enterica serovar Typhi
ggcaucaagcauaaaccggcgg

SEQ ID NO: 3667163 - RNA, 16 nt, Salmonella enterica enterica serovar Typhi
ggcaucaauaaaauca

SEQ ID NO: 3667164 - RNA, 13 nt, Salmonella enterica enterica serovar Typhi
ggcaucacgccgg

SEQ ID NO: 3667165 - RNA, 17 nt, Salmonella enterica enterica serovar Typhi
ggcaucagacgguggcc

SEQ ID NO: 3667166 - RNA, 16 nt, Salmonella enterica enterica serovar Typhi
ggcaucauaaaaggca

SEQ ID NO: 3667167 - RNA, 19 nt, Salmonella enterica enterica serovar Typhi
ggcauccagcgcucaauca

SEQ ID NO: 3667168 - RNA, 18 nt, Salmonella enterica enterica serovar Typhi
ggcauccggcccgugcca

SEQ ID NO: 3667169 - RNA, 18 nt, Salmonella enterica enterica serovar Typhi
ggcauccgugaccugcug

SEQ ID NO: 3667170 - RNA, 18 nt, Salmonella enterica enterica serovar Typhi
ggcaucgcccguuuuacc

SEQ ID NO: 3667171 - RNA, 16 nt, Salmonella enterica enterica serovar Typhi
ggcaucgccgcccagu

SEQ ID NO: 3667172 - RNA, 18 nt, Salmonella enterica enterica serovar Typhi
ggcccgguaagcgcagcg

SEQ ID NO: 3667173 - RNA, 16 nt, Salmonella enterica enterica serovar Typhi
ggcccguaucgcucag

SEQ ID NO: 3667174 - RNA, 17 nt, Salmonella enterica enterica serovar Typhi
ggcccguggcccaggcc

SEQ ID NO: 3667175 - RNA, 16 nt, Salmonella enterica enterica serovar Typhi
ggcccguugucuucac

SEQ ID NO: 3667176 - RNA, 17 nt, Salmonella enterica enterica serovar Typhi
ggcccuaacgggcucgu

SEQ ID NO: 3667177 - RNA, 15 nt, Salmonella enterica enterica serovar Typhi
ggccgacacaacaug

SEQ ID NO: 3667178 - RNA, 21 nt, Salmonella enterica enterica serovar Typhi
ggccgauauugcggccuuccu

SEQ ID NO: 3667179 - RNA, 17 nt, Salmonella enterica enterica serovar Typhi
ggccgauggucgcgcca

SEQ ID NO: 3667180 - RNA, 21 nt, Salmonella enterica enterica serovar Typhi
ggccgauuuuuuaucucgccg

SEQ ID NO: 3667181 - RNA, 20 nt, Salmonella enterica enterica serovar Typhi
ggccgcaaacagcacgcccu

SEQ ID NO: 3667182 - RNA, 18 nt, Salmonella enterica enterica serovar Typhi
ggccgcaaccgccaauaa

SEQ ID NO: 3667183 - RNA, 13 nt, Salmonella enterica enterica serovar Typhi
ggccgccagcaac

SEQ ID NO: 3667184 - RNA, 17 nt, Salmonella enterica enterica serovar Typhi
ggccgcccggacccgcu

SEQ ID NO: 3667185 - RNA, 13 nt, Salmonella enterica enterica serovar Typhi
ggccgccgcagca

SEQ ID NO: 3667186 - RNA, 20 nt, Salmonella enterica enterica serovar Typhi
ggccgcgcugaugugcggcc

SEQ ID NO: 3667187 - RNA, 14 nt, Salmonella enterica enterica serovar Typhi
ggccgcggcuguaa

SEQ ID NO: 3667188 - RNA, 20 nt, Salmonella enterica enterica serovar Typhi
ggccgcgugcucgcggcgga

SEQ ID NO: 3667189 - RNA, 19 nt, Salmonella enterica enterica serovar Typhi
ggccgcguuaacgccguug

SEQ ID NO: 3667190 - RNA, 14 nt, Salmonella enterica enterica serovar Typhi
ggccgcguuaucgg

SEQ ID NO: 3667191 - RNA, 22 nt, Salmonella enterica enterica serovar Typhi
ggccgcucgccauaucuucuac

SEQ ID NO: 3667192 - RNA, 23 nt, Salmonella enterica enterica serovar Typhi
ggccgcuuaauaauaagcggccu

SEQ ID NO: 3667193 - RNA, 20 nt, Salmonella enterica enterica serovar Typhi
ggccgcuuacugugccgccg

SEQ ID NO: 3667194 - RNA, 21 nt, Salmonella enterica enterica serovar Typhi
ggccggauaagcaacgcgcca

SEQ ID NO: 3667195 - RNA, 22 nt, Salmonella enterica enterica serovar Typhi
ggccggauaagcauuagcgcca

SEQ ID NO: 3667196 - RNA, 21 nt, Salmonella enterica enterica serovar Typhi
ggccggauaagcgcagcgcca

SEQ ID NO: 3667197 - RNA, 21 nt, Salmonella enterica enterica serovar Typhi
ggccggauaagcgcagcguca

SEQ ID NO: 3667198 - RNA, 19 nt, Salmonella enterica enterica serovar Typhi
ggccggauaagcggcagcg

SEQ ID NO: 3667199 - RNA, 23 nt, Salmonella enterica enterica serovar Typhi
ggccggauaaggcgcagccgcca

SEQ ID NO: 3667200 - RNA, 19 nt, Salmonella enterica enterica serovar Typhi
ggccggauaaggcguaacc

SEQ ID NO: 3667201 - RNA, 20 nt, Salmonella enterica enterica serovar Typhi
ggccggauagggcguaacac

SEQ ID NO: 3667202 - RNA, 15 nt, Salmonella enterica enterica serovar Typhi
ggccggaugagcguu

SEQ ID NO: 3667203 - RNA, 22 nt, Salmonella enterica enterica serovar Typhi
ggccggaugagcguuagcgcca

SEQ ID NO: 3667204 - RNA, 16 nt, Salmonella enterica enterica serovar Typhi
ggccggaugaggcgca

SEQ ID NO: 3667205 - RNA, 23 nt, Salmonella enterica enterica serovar Typhi
ggccggaugaggcgcagccgcca

SEQ ID NO: 3667206 - RNA, 22 nt, Salmonella enterica enterica serovar Typhi
ggccggauuagcgacagcgcua

SEQ ID NO: 3667207 - RNA, 17 nt, Salmonella enterica enterica serovar Typhi
ggccggcuucuccacca

SEQ ID NO: 3667208 - RNA, 17 nt, Salmonella enterica enterica serovar Typhi
ggccgguuggcuccagu

SEQ ID NO: 3667209 - RNA, 22 nt, Salmonella enterica enterica serovar Typhi
ggccgguuguuuacacggcaaa

SEQ ID NO: 3667210 - RNA, 19 nt, Salmonella enterica enterica serovar Typhi
ggccgucaaaccggcgguc

SEQ ID NO: 3667211 - RNA, 21 nt, Salmonella enterica enterica serovar Typhi
ggccgucagacauauacucuu

SEQ ID NO: 3667212 - RNA, 14 nt, Salmonella enterica enterica serovar Typhi
ggccgucggcgcca

SEQ ID NO: 3667213 - RNA, 15 nt, Salmonella enterica enterica serovar Typhi
ggccguuaaaccaaa

SEQ ID NO: 3667214 - RNA, 23 nt, Salmonella enterica enterica serovar Typhi
ggccguuggcuuuaugcacgccg

SEQ ID NO: 3667215 - RNA, 15 nt, Salmonella enterica enterica serovar Typhi
ggccguuuucccggc

SEQ ID NO: 3667216 - RNA, 16 nt, Salmonella enterica enterica serovar Typhi
ggccuacaaagccaaa

SEQ ID NO: 3667217 - RNA, 18 nt, Salmonella enterica enterica serovar Typhi
ggccuacagaacugcacg

SEQ ID NO: 3667218 - RNA, 17 nt, Salmonella enterica enterica serovar Typhi
ggccuacagacuguacc

SEQ ID NO: 3667219 - RNA, 16 nt, Salmonella enterica enterica serovar Typhi
ggccuacauucauuaa

SEQ ID NO: 3667220 - RNA, 23 nt, Salmonella enterica enterica serovar Typhi
ggccuacauuuuuacaguuacca

SEQ ID NO: 3667221 - RNA, 20 nt, Salmonella enterica enterica serovar Typhi
ggccuacggauucgcugcug

SEQ ID NO: 3667222 - RNA, 15 nt, Salmonella enterica enterica serovar Typhi
ggccuauagacaccu

SEQ ID NO: 3667223 - RNA, 19 nt, Salmonella enterica enterica serovar Typhi
ggccuauagcuaauggcuu

SEQ ID NO: 3667224 - RNA, 13 nt, Salmonella enterica enterica serovar Typhi
ggccuccggcggg

SEQ ID NO: 3667225 - RNA, 12 nt, Salmonella enterica enterica serovar Typhi
ggccuccugacg

SEQ ID NO: 3667226 - RNA, 18 nt, Salmonella enterica enterica serovar Typhi
ggccuccugacgaagggc

SEQ ID NO: 3667227 - RNA, 13 nt, Salmonella enterica enterica serovar Typhi
ggccuccuggcuu

SEQ ID NO: 3667228 - RNA, 18 nt, Salmonella enterica enterica serovar Typhi
ggccuccuuuccugugcu

SEQ ID NO: 3667229 - RNA, 18 nt, Salmonella enterica enterica serovar Typhi
ggccugauaagcgcagcg

SEQ ID NO: 3667230 - RNA, 21 nt, Salmonella enterica enterica serovar Typhi
ggccugauaagcguagcgcca

SEQ ID NO: 3667231 - RNA, 16 nt, Salmonella enterica enterica serovar Typhi
ggccugauagcacagc

SEQ ID NO: 3667232 - RNA, 17 nt, Salmonella enterica enterica serovar Typhi
ggccugcaaaccgccuc

SEQ ID NO: 3667233 - RNA, 14 nt, Salmonella enterica enterica serovar Typhi
ggccugcagagcgg

SEQ ID NO: 3667234 - RNA, 12 nt, Salmonella enterica enterica serovar Typhi
ggccugcaucaa

SEQ ID NO: 3667235 - RNA, 21 nt, Salmonella enterica enterica serovar Typhi
ggccugcauuugcuggcguga

SEQ ID NO: 3667236 - RNA, 15 nt, Salmonella enterica enterica serovar Typhi
ggccugccguccuga

SEQ ID NO: 3667237 - RNA, 12 nt, Salmonella enterica enterica serovar Typhi
ggccugcuccgu

SEQ ID NO: 3667238 - RNA, 19 nt, Salmonella enterica enterica serovar Typhi
ggccugcuuaaacaguauu

SEQ ID NO: 3667239 - RNA, 17 nt, Salmonella enterica enterica serovar Typhi
ggccuggcugagaaaaa

SEQ ID NO: 3667240 - RNA, 19 nt, Salmonella enterica enterica serovar Typhi
ggccuggcuuguuacugca

SEQ ID NO: 3667241 - RNA, 20 nt, Salmonella enterica enterica serovar Typhi
ggccugguuaacaauauugc

SEQ ID NO: 3667242 - RNA, 22 nt, Salmonella enterica enterica serovar Typhi
ggccugucacguaaaauuagac

SEQ ID NO: 3667243 - RNA, 13 nt, Salmonella enterica enterica serovar Typhi
ggccugucaggcc

SEQ ID NO: 3667244 - RNA, 22 nt, Salmonella enterica enterica serovar Typhi
ggccugugacguuaacgcagca

SEQ ID NO: 3667245 - RNA, 23 nt, Salmonella enterica enterica serovar Typhi
ggccugugccugacagcaaugag

SEQ ID NO: 3667246 - RNA, 20 nt, Salmonella enterica enterica serovar Typhi
ggccuguuccuuacagcuuc

SEQ ID NO: 3667247 - RNA, 17 nt, Salmonella enterica enterica serovar Typhi
ggccuguuucuuaccac

SEQ ID NO: 3667248 - RNA, 14 nt, Salmonella enterica enterica serovar Typhi
ggccuuauccggcc

SEQ ID NO: 3667249 - RNA, 16 nt, Salmonella enterica enterica serovar Typhi
ggccuuauuuuucagc

SEQ ID NO: 3667250 - RNA, 19 nt, Salmonella enterica enterica serovar Typhi
ggccuucugcuaucaggau

SEQ ID NO: 3667251 - RNA, 23 nt, Salmonella enterica enterica serovar Typhi
ggccuugaaguuauccagcgccc

SEQ ID NO: 3667252 - RNA, 17 nt, Salmonella enterica enterica serovar Typhi
ggccuugccagcgagaa

SEQ ID NO: 3667253 - RNA, 21 nt, Salmonella enterica enterica serovar Typhi
ggccuuguagcgcuguccaau

SEQ ID NO: 3667254 - RNA, 17 nt, Salmonella enterica enterica serovar Typhi
ggccuuuuuccgucagc

SEQ ID NO: 3667255 - RNA, 18 nt, Salmonella enterica enterica serovar Typhi
ggccuuuuuccgucagca

SEQ ID NO: 3667256 - RNA, 12 nt, Salmonella enterica enterica serovar Typhi
ggcgaaaaaccg

SEQ ID NO: 3667257 - RNA, 13 nt, Salmonella enterica enterica serovar Typhi
ggcgcacagcgcc

SEQ ID NO: 3667258 - RNA, 22 nt, Salmonella enterica enterica serovar Typhi
ggcgcacaguacgcgaccgccg

SEQ ID NO: 3667259 - RNA, 19 nt, Salmonella enterica enterica serovar Typhi
ggcgcacuuccucucccac

SEQ ID NO: 3667260 - RNA, 17 nt, Salmonella enterica enterica serovar Typhi
ggcgcagcauacgcugc

SEQ ID NO: 3667261 - RNA, 14 nt, Salmonella enterica enterica serovar Typhi
ggcgcagcgcggga

SEQ ID NO: 3667262 - RNA, 20 nt, Salmonella enterica enterica serovar Typhi
ggcgcaggcauuaaaaaaac

SEQ ID NO: 3667263 - RNA, 18 nt, Salmonella enterica enterica serovar Typhi
ggcgcaguucgccgccag

SEQ ID NO: 3667264 - RNA, 14 nt, Salmonella enterica enterica serovar Typhi
ggcgcaguuuacgc

SEQ ID NO: 3667265 - RNA, 19 nt, Salmonella enterica enterica serovar Typhi
ggcgcauaaugacguccag

SEQ ID NO: 3667266 - RNA, 15 nt, Salmonella enterica enterica serovar Typhi
ggcgcauaucgcccu

SEQ ID NO: 3667267 - RNA, 14 nt, Salmonella enterica enterica serovar Typhi
ggcgcaucagaaaa

SEQ ID NO: 3667268 - RNA, 15 nt, Salmonella enterica enterica serovar Typhi
ggcgcaucagaaaaa

SEQ ID NO: 3667269 - RNA, 23 nt, Salmonella enterica enterica serovar Typhi
ggcgcaucagaaaaaccuccggc

SEQ ID NO: 3667270 - RNA, 18 nt, Salmonella enterica enterica serovar Typhi
ggcgcaucuggucauggc

SEQ ID NO: 3667271 - RNA, 18 nt, Salmonella enterica enterica serovar Typhi
ggcgccagcgacaacgcu

SEQ ID NO: 3667272 - RNA, 11 nt, Salmonella enterica enterica serovar Typhi
ggcgccaguac

SEQ ID NO: 3667273 - RNA, 18 nt, Salmonella enterica enterica serovar Typhi
ggcgccauuggcucggcg

SEQ ID NO: 3667274 - RNA, 15 nt, Salmonella enterica enterica serovar Typhi
ggcgcccauccgccc

SEQ ID NO: 3667275 - RNA, 22 nt, Salmonella enterica enterica serovar Typhi
ggcgcccauuucguuaaugcug

SEQ ID NO: 3667276 - RNA, 15 nt, Salmonella enterica enterica serovar Typhi
ggcgccgaucauccc

SEQ ID NO: 3667277 - RNA, 15 nt, Salmonella enterica enterica serovar Typhi
ggcgccggggcagca

SEQ ID NO: 3667278 - RNA, 17 nt, Salmonella enterica enterica serovar Typhi
ggcgcgaaaacagcugg

SEQ ID NO: 3667279 - RNA, 18 nt, Salmonella enterica enterica serovar Typhi
ggcgcgaaacugcugccg

SEQ ID NO: 3667280 - RNA, 13 nt, Salmonella enterica enterica serovar Typhi
ggcgcgaaagcgc

SEQ ID NO: 3667281 - RNA, 16 nt, Salmonella enterica enterica serovar Typhi
ggcgcgauauccacca

SEQ ID NO: 3667282 - RNA, 20 nt, Salmonella enterica enterica serovar Typhi
ggcgcgcgcgccuaccgcca

SEQ ID NO: 3667283 - RNA, 13 nt, Salmonella enterica enterica serovar Typhi
ggcgcgcguacug

SEQ ID NO: 3667284 - RNA, 21 nt, Salmonella enterica enterica serovar Typhi
ggcgcgcucauuuuauugaua

SEQ ID NO: 3667285 - RNA, 11 nt, Salmonella enterica enterica serovar Typhi
ggcgcgcuggc

SEQ ID NO: 3667286 - RNA, 15 nt, Salmonella enterica enterica serovar Typhi
ggcgcggggaacaca

SEQ ID NO: 3667287 - RNA, 20 nt, Salmonella enterica enterica serovar Typhi
ggcgcgguauuucgccgccg

SEQ ID NO: 3667288 - RNA, 16 nt, Salmonella enterica enterica serovar Typhi
ggcgcguagcuggccu

SEQ ID NO: 3667289 - RNA, 22 nt, Salmonella enterica enterica serovar Typhi
ggcgcgucuucccggcgcucgg

SEQ ID NO: 3667290 - RNA, 22 nt, Salmonella enterica enterica serovar Typhi
ggcgcguuuacuggcgacgacc

SEQ ID NO: 3667291 - RNA, 23 nt, Salmonella enterica enterica serovar Typhi
ggcgcuaaaccggcggaauagcu

SEQ ID NO: 3667292 - RNA, 18 nt, Salmonella enterica enterica serovar Typhi
ggcgcuaagccagccaaa

SEQ ID NO: 3667293 - RNA, 19 nt, Salmonella enterica enterica serovar Typhi
ggcgcuacgcuuaucaggc

SEQ ID NO: 3667294 - RNA, 20 nt, Salmonella enterica enterica serovar Typhi
ggcgcuacgcuuaucaggcc

SEQ ID NO: 3667295 - RNA, 22 nt, Salmonella enterica enterica serovar Typhi
ggcgcuacgcuuaucaggccua

SEQ ID NO: 3667296 - RNA, 20 nt, Salmonella enterica enterica serovar Typhi
ggcgcuacgcuuaucgggcc

SEQ ID NO: 3667297 - RNA, 19 nt, Salmonella enterica enterica serovar Typhi
ggcgcuagccgcauccggc

SEQ ID NO: 3667298 - RNA, 18 nt, Salmonella enterica enterica serovar Typhi
ggcgcucaauagccagaa

SEQ ID NO: 3667299 - RNA, 15 nt, Salmonella enterica enterica serovar Typhi
ggcgcucaaucagaa

SEQ ID NO: 3667300 - RNA, 18 nt, Salmonella enterica enterica serovar Typhi
ggcgcucacgcugacagg

SEQ ID NO: 3667301 - RNA, 21 nt, Salmonella enterica enterica serovar Typhi
ggcgcucagccagaaacgguc

SEQ ID NO: 3667302 - RNA, 23 nt, Salmonella enterica enterica serovar Typhi
ggcgcucggaugugcauugacua

SEQ ID NO: 3667303 - RNA, 21 nt, Salmonella enterica enterica serovar Typhi
ggcgcugaguuucucccgcca

SEQ ID NO: 3667304 - RNA, 14 nt, Salmonella enterica enterica serovar Typhi
ggcgcugcgcggcg

SEQ ID NO: 3667305 - RNA, 20 nt, Salmonella enterica enterica serovar Typhi
ggcgcugcgcuuaucagacc

SEQ ID NO: 3667306 - RNA, 18 nt, Salmonella enterica enterica serovar Typhi
ggcgcugcgcuuaucagg

SEQ ID NO: 3667307 - RNA, 19 nt, Salmonella enterica enterica serovar Typhi
ggcgcugcgcuuaucaggc

SEQ ID NO: 3667308 - RNA, 22 nt, Salmonella enterica enterica serovar Typhi
ggcgcugcgcuuaucaggccua

SEQ ID NO: 3667309 - RNA, 17 nt, Salmonella enterica enterica serovar Typhi
ggcgcugcgcuuauccg

SEQ ID NO: 3667310 - RNA, 20 nt, Salmonella enterica enterica serovar Typhi
ggcgcugcguuuauuaggcc

SEQ ID NO: 3667311 - RNA, 20 nt, Salmonella enterica enterica serovar Typhi
ggcgcugcuggcagcgcuga

SEQ ID NO: 3667312 - RNA, 18 nt, Salmonella enterica enterica serovar Typhi
ggcgcuggcuugaccgcu

SEQ ID NO: 3667313 - RNA, 19 nt, Salmonella enterica enterica serovar Typhi
ggcgcuggugacaucgccg

SEQ ID NO: 3667314 - RNA, 17 nt, Salmonella enterica enterica serovar Typhi
ggcgcugucgccgcgca

SEQ ID NO: 3667315 - RNA, 18 nt, Salmonella enterica enterica serovar Typhi
ggcgcugucgcuuaccgg

SEQ ID NO: 3667316 - RNA, 15 nt, Salmonella enterica enterica serovar Typhi
ggcgcuuacgggcga

SEQ ID NO: 3667317 - RNA, 12 nt, Salmonella enterica enterica serovar Typhi
ggcgcuuaucca

SEQ ID NO: 3667318 - RNA, 17 nt, Salmonella enterica enterica serovar Typhi
ggcgcuuccugcagugg

SEQ ID NO: 3667319 - RNA, 23 nt, Salmonella enterica enterica serovar Typhi
ggcgcuuuacaugacgcucuccg

SEQ ID NO: 3667320 - RNA, 17 nt, Salmonella enterica enterica serovar Typhi
ggcgcuuugcuuauccg

SEQ ID NO: 3667321 - RNA, 20 nt, Salmonella enterica enterica serovar Typhi
ggcgcuuugcuuauccggcc

SEQ ID NO: 3667322 - RNA, 18 nt, Salmonella enterica enterica serovar Typhi
ggcggaaaauagccagaa

SEQ ID NO: 3667323 - RNA, 13 nt, Salmonella enterica enterica serovar Typhi
ggcggaaaucaac

SEQ ID NO: 3667324 - RNA, 23 nt, Salmonella enterica enterica serovar Typhi
ggcggaaguagccuccggcggug

SEQ ID NO: 3667325 - RNA, 14 nt, Salmonella enterica enterica serovar Typhi
ggcggaauggcggg

SEQ ID NO: 3667326 - RNA, 20 nt, Salmonella enterica enterica serovar Typhi
ggcggacaacgcuccagcag

SEQ ID NO: 3667327 - RNA, 21 nt, Salmonella enterica enterica serovar Typhi
ggcggacccaaaagaaguggc

SEQ ID NO: 3667328 - RNA, 14 nt, Salmonella enterica enterica serovar Typhi
ggcggacucgcugg

SEQ ID NO: 3667329 - RNA, 19 nt, Salmonella enterica enterica serovar Typhi
ggcggaggugacggaggcg

SEQ ID NO: 3667330 - RNA, 15 nt, Salmonella enterica enterica serovar Typhi
ggcggauaaggcgcu

SEQ ID NO: 3667331 - RNA, 13 nt, Salmonella enterica enterica serovar Typhi
ggcggcaaagaaa

SEQ ID NO: 3667332 - RNA, 19 nt, Salmonella enterica enterica serovar Typhi
ggcggcaagggagugaguc

SEQ ID NO: 3667333 - RNA, 17 nt, Salmonella enterica enterica serovar Typhi
ggcggcauaaaugccuu

SEQ ID NO: 3667334 - RNA, 19 nt, Salmonella enterica enterica serovar Typhi
ggcggccaaccccggcaaa

SEQ ID NO: 3667335 - RNA, 16 nt, Salmonella enterica enterica serovar Typhi
ggcggccaaucagaua

SEQ ID NO: 3667336 - RNA, 13 nt, Salmonella enterica enterica serovar Typhi
ggcggccagcauu

SEQ ID NO: 3667337 - RNA, 18 nt, Salmonella enterica enterica serovar Typhi
ggcggcccacucauccag

SEQ ID NO: 3667338 - RNA, 16 nt, Salmonella enterica enterica serovar Typhi
ggcggcgaaaugccuu

SEQ ID NO: 3667339 - RNA, 20 nt, Salmonella enterica enterica serovar Typhi
ggcggcgaugccuuauccgg

SEQ ID NO: 3667340 - RNA, 23 nt, Salmonella enterica enterica serovar Typhi
ggcggcgcaaaggccuuauccgg

SEQ ID NO: 3667341 - RNA, 12 nt, Salmonella enterica enterica serovar Typhi
ggcggcgcagcg

SEQ ID NO: 3667342 - RNA, 21 nt, Salmonella enterica enterica serovar Typhi
ggcuaugaagcuggagccaca

SEQ ID NO: 3667343 - RNA, 17 nt, Salmonella enterica enterica serovar Typhi
ggcuauuaccggcugga

SEQ ID NO: 3667344 - RNA, 22 nt, Salmonella enterica enterica serovar Typhi
ggcuauuccacccgaccauuuu

SEQ ID NO: 3667345 - RNA, 13 nt, Salmonella enterica enterica serovar Typhi
ggcuauuuuauuc

SEQ ID NO: 3667346 - RNA, 21 nt, Salmonella enterica enterica serovar Typhi
ggcuauuuuuugcuggcggca

SEQ ID NO: 3667347 - RNA, 16 nt, Salmonella enterica enterica serovar Typhi
ggcucaaacggccugc

SEQ ID NO: 3667348 - RNA, 22 nt, Salmonella enterica enterica serovar Typhi
ggcucaaacggccugcgcugga

SEQ ID NO: 3667349 - RNA, 18 nt, Salmonella enterica enterica serovar Typhi
ggcucaaaguuaccggca

SEQ ID NO: 3667350 - RNA, 12 nt, Salmonella enterica enterica serovar Typhi
ggcucaaauugg

SEQ ID NO: 3667351 - RNA, 12 nt, Salmonella enterica enterica serovar Typhi
ggcucaccagcc

SEQ ID NO: 3667352 - RNA, 21 nt, Salmonella enterica enterica serovar Typhi
ggcucaggaaaacaaauugca

SEQ ID NO: 3667353 - RNA, 21 nt, Salmonella enterica enterica serovar Typhi
ggcucagguuauauuccgccu

SEQ ID NO: 3667354 - RNA, 13 nt, Salmonella enterica enterica serovar Typhi
ggcucaucaaaca

SEQ ID NO: 3667355 - RNA, 20 nt, Salmonella enterica enterica serovar Typhi
ggcucaucaaacagcggcac

SEQ ID NO: 3667356 - RNA, 15 nt, Salmonella enterica enterica serovar Typhi
ggcucaucagcgcca

SEQ ID NO: 3667357 - RNA, 17 nt, Salmonella enterica enterica serovar Typhi
ggcucccacucuuccag

SEQ ID NO: 3667358 - RNA, 19 nt, Salmonella enterica enterica serovar Typhi
ggcucccacucuuccagca

SEQ ID NO: 3667359 - RNA, 18 nt, Salmonella enterica enterica serovar Typhi
ggcuccgaccaucgccgc

SEQ ID NO: 3667360 - RNA, 21 nt, Salmonella enterica enterica serovar Typhi
ggcuccgaccaucgccgcgaa

SEQ ID NO: 3667361 - RNA, 17 nt, Salmonella enterica enterica serovar Typhi
ggcucgcagaugcccgc

SEQ ID NO: 3667362 - RNA, 22 nt, Salmonella enterica enterica serovar Typhi
ggcucgucguugaaaucgucag

SEQ ID NO: 3667363 - RNA, 13 nt, Salmonella enterica enterica serovar Typhi
ggcucuaaaaagg

SEQ ID NO: 3667364 - RNA, 15 nt, Salmonella enterica enterica serovar Typhi
ggcugaaagcgccuu

SEQ ID NO: 3667365 - RNA, 16 nt, Salmonella enterica enterica serovar Typhi
ggcugaacgccaggcc

SEQ ID NO: 3667366 - RNA, 12 nt, Salmonella enterica enterica serovar Typhi
ggcugaagcccc

SEQ ID NO: 3667367 - RNA, 11 nt, Salmonella enterica enterica serovar Typhi
ggcugaagcgg

SEQ ID NO: 3667368 - RNA, 22 nt, Salmonella enterica enterica serovar Typhi
ggcugacugaauuuucagccau

SEQ ID NO: 3667369 - RNA, 14 nt, Salmonella enterica enterica serovar Typhi
ggcugagaaaaaua

SEQ ID NO: 3667370 - RNA, 16 nt, Salmonella enterica enterica serovar Typhi
ggcugauaggccugga

SEQ ID NO: 3667371 - RNA, 23 nt, Salmonella enterica enterica serovar Typhi
ggcugauaggccuggauagacga

SEQ ID NO: 3667372 - RNA, 19 nt, Salmonella enterica enterica serovar Typhi
ggcugauugacuaucagcc

SEQ ID NO: 3667373 - RNA, 20 nt, Salmonella enterica enterica serovar Typhi
ggcugccgucgaugucgccg

SEQ ID NO: 3667374 - RNA, 20 nt, Salmonella enterica enterica serovar Typhi
ggcugccguuaaucuggccu

SEQ ID NO: 3667375 - RNA, 22 nt, Salmonella enterica enterica serovar Typhi
ggcugcgauaaugaagcauaaa

SEQ ID NO: 3667376 - RNA, 20 nt, Salmonella enterica enterica serovar Typhi
ggcugcgccuuaucaagccu

SEQ ID NO: 3667377 - RNA, 17 nt, Salmonella enterica enterica serovar Typhi
ggcugcgcugccagcug

SEQ ID NO: 3667378 - RNA, 22 nt, Salmonella enterica enterica serovar Typhi
ggcugcguaaaaucagcauccu

SEQ ID NO: 3667379 - RNA, 18 nt, Salmonella enterica enterica serovar Typhi
ggcuggagagcaacgcca

SEQ ID NO: 3667380 - RNA, 19 nt, Salmonella enterica enterica serovar Typhi
ggcuggauaaccguacggc

SEQ ID NO: 3667381 - RNA, 14 nt, Salmonella enterica enterica serovar Typhi
ggcuggaugacggu

SEQ ID NO: 3667382 - RNA, 20 nt, Salmonella enterica enterica serovar Typhi
ggcuggcaaugcgcuguauu

SEQ ID NO: 3667383 - RNA, 14 nt, Salmonella enterica enterica serovar Typhi
ggcuggccagggca

SEQ ID NO: 3667384 - RNA, 14 nt, Salmonella enterica enterica serovar Typhi
ggcuggcgcaacug

SEQ ID NO: 3667385 - RNA, 15 nt, Salmonella enterica enterica serovar Typhi
ggcugggcgaggcca

SEQ ID NO: 3667386 - RNA, 13 nt, Salmonella enterica enterica serovar Typhi
ggcuggggaaguu

SEQ ID NO: 3667387 - RNA, 21 nt, Salmonella enterica enterica serovar Typhi
ggcuggucagcguacccgcgg

SEQ ID NO: 3667388 - RNA, 17 nt, Salmonella enterica enterica serovar Typhi
ggcuguaccuuaaccgg

SEQ ID NO: 3667389 - RNA, 23 nt, Salmonella enterica enterica serovar Typhi
ggcuguauguaggguacagcgcg

SEQ ID NO: 3667390 - RNA, 23 nt, Salmonella enterica enterica serovar Typhi
ggcugucaggagccaccggcagg

SEQ ID NO: 3667391 - RNA, 13 nt, Salmonella enterica enterica serovar Typhi
ggcugucccagag

SEQ ID NO: 3667392 - RNA, 21 nt, Salmonella enterica enterica serovar Typhi
ggcugucgauaacagcauaaa

SEQ ID NO: 3667393 - RNA, 13 nt, Salmonella enterica enterica serovar Typhi
ggcugucgauccc

SEQ ID NO: 3667394 - RNA, 16 nt, Salmonella enterica enterica serovar Typhi
ggcugucgcggcggca

SEQ ID NO: 3667395 - RNA, 18 nt, Salmonella enterica enterica serovar Typhi
ggcugugcgugacccaca

SEQ ID NO: 3667396 - RNA, 23 nt, Salmonella enterica enterica serovar Typhi
ggcuguggcguuuuaccgcccga

SEQ ID NO: 3667397 - RNA, 16 nt, Salmonella enterica enterica serovar Typhi
ggcuguuaguaagcug

SEQ ID NO: 3667398 - RNA, 20 nt, Salmonella enterica enterica serovar Typhi
ggcuguucacguaccaggca

SEQ ID NO: 3667399 - RNA, 21 nt, Salmonella enterica enterica serovar Typhi
ggcuuacuuuccaaaauccag

SEQ ID NO: 3667400 - RNA, 19 nt, Salmonella enterica enterica serovar Typhi
ggcuuagccgccgugauaa

SEQ ID NO: 3667401 - RNA, 18 nt, Salmonella enterica enterica serovar Typhi
ggcuucaaccguuucuuu

SEQ ID NO: 3667402 - RNA, 15 nt, Salmonella enterica enterica serovar Typhi
ggcuucaaccuccug

SEQ ID NO: 3667403 - RNA, 11 nt, Salmonella enterica enterica serovar Typhi
ggcuuccggca

SEQ ID NO: 3667404 - RNA, 14 nt, Salmonella enterica enterica serovar Typhi
ggcuuccucgccac

SEQ ID NO: 3667405 - RNA, 23 nt, Salmonella enterica enterica serovar Typhi
ggcuucggcaauuuccggcgacg

SEQ ID NO: 3667406 - RNA, 18 nt, Salmonella enterica enterica serovar Typhi
ggcuucuucaacauuguc

SEQ ID NO: 3667407 - RNA, 20 nt, Salmonella enterica enterica serovar Typhi
ggcuugaguuuuucucgcaa

SEQ ID NO: 3667408 - RNA, 22 nt, Salmonella enterica enterica serovar Typhi
ggcuugaucgcgcagcaaauca

SEQ ID NO: 3667409 - RNA, 17 nt, Salmonella enterica enterica serovar Typhi
ggcuugccagauagaca

SEQ ID NO: 3667410 - RNA, 14 nt, Salmonella enterica enterica serovar Typhi
ggcuugccagcaga

SEQ ID NO: 3667411 - RNA, 22 nt, Salmonella enterica enterica serovar Typhi
ggcuugguugacgugaaccguc

SEQ ID NO: 3667412 - RNA, 13 nt, Salmonella enterica enterica serovar Typhi
ggcuuuaaugcuu

SEQ ID NO: 3667413 - RNA, 20 nt, Salmonella enterica enterica serovar Typhi
ggcuuugccagcggcgcgau

SEQ ID NO: 3667414 - RNA, 14 nt, Salmonella enterica enterica serovar Typhi
ggcuuugcugcugc

SEQ ID NO: 3667415 - RNA, 14 nt, Salmonella enterica enterica serovar Typhi
ggcuuuguaucagc

SEQ ID NO: 3667416 - RNA, 14 nt, Salmonella enterica enterica serovar Typhi
ggcuuuuaucgaca

SEQ ID NO: 3667417 - RNA, 16 nt, Salmonella enterica enterica serovar Typhi
ggcuuuuugccgggcg

SEQ ID NO: 3667418 - RNA, 16 nt, Salmonella enterica enterica serovar Typhi
ggcuuuuuuucaacug

SEQ ID NO: 3667419 - RNA, 20 nt, Salmonella enterica enterica serovar Typhi
gggaaaaauguguugcggcc

SEQ ID NO: 3667420 - RNA, 13 nt, Salmonella enterica enterica serovar Typhi
gggaaaaccccac

SEQ ID NO: 3667421 - RNA, 19 nt, Salmonella enterica enterica serovar Typhi
gggaaaagcgguaucacgc

SEQ ID NO: 3667422 - RNA, 18 nt, Salmonella enterica enterica serovar Typhi
gggaaacggauucucuaa

SEQ ID NO: 3667423 - RNA, 12 nt, Salmonella enterica enterica serovar Typhi
gggaaagggggg

SEQ ID NO: 3667424 - RNA, 17 nt, Salmonella enterica enterica serovar Typhi
gggaaaugagaaaagga

SEQ ID NO: 3667425 - RNA, 12 nt, Salmonella enterica enterica serovar Typhi
gggaacacuaaa

SEQ ID NO: 3667426 - RNA, 14 nt, Salmonella enterica enterica serovar Typhi
gggaacacucuaaa

SEQ ID NO: 3667427 - RNA, 18 nt, Salmonella enterica enterica serovar Typhi
gggaagaugugccacucc

SEQ ID NO: 3667428 - RNA, 17 nt, Salmonella enterica enterica serovar Typhi
ggggcgacaaacagcgc

SEQ ID NO: 3667429 - RNA, 18 nt, Salmonella enterica enterica serovar Typhi
ggggcuuugugccgcaca

SEQ ID NO: 3667430 - RNA, 21 nt, Salmonella enterica enterica serovar Typhi
gggggaaaugagaaaaggaag

SEQ ID NO: 3667431 - RNA, 24 nt, Salmonella enterica enterica serovar Typhi
gggguaaacaccggggcauuucca

SEQ ID NO: 3667432 - RNA, 12 nt, Salmonella enterica enterica serovar Typhi
ggggugaaacag

SEQ ID NO: 3667433 - RNA, 16 nt, Salmonella enterica enterica serovar Typhi
gggguucagaccagaa

SEQ ID NO: 3667434 - RNA, 22 nt, Salmonella enterica enterica serovar Typhi
gggguugaugguuauuccuugu

SEQ ID NO: 3667435 - RNA, 21 nt, Salmonella enterica enterica serovar Typhi
gggguuuuggccggaccugcg

SEQ ID NO: 3667436 - RNA, 21 nt, Salmonella enterica enterica serovar Typhi
ggguaaacaccggggcauuuc

SEQ ID NO: 3667437 - RNA, 17 nt, Salmonella enterica enterica serovar Typhi
ggguaaacgcagcguca

SEQ ID NO: 3667438 - RNA, 14 nt, Salmonella enterica enterica serovar Typhi
ggguaaauccgcga

SEQ ID NO: 3667439 - RNA, 18 nt, Salmonella enterica enterica serovar Typhi
ggguaauagaugcgucgc

SEQ ID NO: 3667440 - RNA, 22 nt, Salmonella enterica enterica serovar Typhi
ggguaaugaucagcaaaauagu

SEQ ID NO: 3667441 - RNA, 15 nt, Salmonella enterica enterica serovar Typhi
ggguagaaaaaggua

SEQ ID NO: 3667442 - RNA, 18 nt, Salmonella enterica enterica serovar Typhi
ggguagaucacgccagcg

SEQ ID NO: 3667443 - RNA, 23 nt, Salmonella enterica enterica serovar Typhi
ggguaucccgacgcacgagaucc

SEQ ID NO: 3667444 - RNA, 13 nt, Salmonella enterica enterica serovar Typhi
ggguaugcagugg

SEQ ID NO: 3667445 - RNA, 16 nt, Salmonella enterica enterica serovar Typhi
ggguauugacgagcga

SEQ ID NO: 3667446 - RNA, 20 nt, Salmonella enterica enterica serovar Typhi
ggguauugcuucguggcaau

SEQ ID NO: 3667447 - RNA, 14 nt, Salmonella enterica enterica serovar Typhi
gggucaaaugcgaa

SEQ ID NO: 3667448 - RNA, 22 nt, Salmonella enterica enterica serovar Typhi
gggucacauccagacagccgac

SEQ ID NO: 3667449 - RNA, 22 nt, Salmonella enterica enterica serovar Typhi
gggucagcgggguucagaccag

SEQ ID NO: 3667450 - RNA, 15 nt, Salmonella enterica enterica serovar Typhi
gggucagcguaucca

SEQ ID NO: 3667451 - RNA, 20 nt, Salmonella enterica enterica serovar Typhi
gggucgacguuguccggcga

SEQ ID NO: 3667452 - RNA, 22 nt, Salmonella enterica enterica serovar Typhi
gggucgacguuguccggcgacc

SEQ ID NO: 3667453 - RNA, 21 nt, Salmonella enterica enterica serovar Typhi
gggucgugcaggauucgaacc

SEQ ID NO: 3667454 - RNA, 22 nt, Salmonella enterica enterica serovar Typhi
gggucuuauuucuccugcgcca

SEQ ID NO: 3667455 - RNA, 15 nt, Salmonella enterica enterica serovar Typhi
gggugagacgcagcc

SEQ ID NO: 3667456 - RNA, 20 nt, Salmonella enterica enterica serovar Typhi
gggugaugacgcgcaggccg

SEQ ID NO: 3667457 - RNA, 21 nt, Salmonella enterica enterica serovar Typhi
gggugaugacgggaucgaacc

SEQ ID NO: 3667458 - RNA, 22 nt, Salmonella enterica enterica serovar Typhi
gggugcaaauccaucucaggcc

SEQ ID NO: 3667459 - RNA, 17 nt, Salmonella enterica enterica serovar Typhi
gggugcagcgucaggaa

SEQ ID NO: 3667460 - RNA, 14 nt, Salmonella enterica enterica serovar Typhi
gggugcgcccagac

SEQ ID NO: 3667461 - RNA, 12 nt, Salmonella enterica enterica serovar Typhi
ggguggcgagca

SEQ ID NO: 3667462 - RNA, 15 nt, Salmonella enterica enterica serovar Typhi
ggguggcgcuagcgc

SEQ ID NO: 3667463 - RNA, 18 nt, Salmonella enterica enterica serovar Typhi
ggguggugugcguaucgc

SEQ ID NO: 3667464 - RNA, 14 nt, Salmonella enterica enterica serovar Typhi
ggguuaaagcccug

SEQ ID NO: 3667465 - RNA, 23 nt, Salmonella enterica enterica serovar Typhi
ggguuacucuguuucgccgcagg

SEQ ID NO: 3667466 - RNA, 19 nt, Salmonella enterica enterica serovar Typhi
ggguuaugauuucaggcau

SEQ ID NO: 3667467 - RNA, 17 nt, Salmonella enterica enterica serovar Typhi
ggguucaaguccccccc

SEQ ID NO: 3667468 - RNA, 24 nt, Salmonella enterica enterica serovar Typhi
ggguuccaggcggagaccacggua

SEQ ID NO: 3667469 - RNA, 14 nt, Salmonella enterica enterica serovar Typhi
ggguucgcccggca

SEQ ID NO: 3667470 - RNA, 15 nt, Salmonella enterica enterica serovar Typhi
ggguucguaauaagg

SEQ ID NO: 3667471 - RNA, 15 nt, Salmonella enterica enterica serovar Typhi
ggguugccggaaagg

SEQ ID NO: 3667472 - RNA, 13 nt, Salmonella enterica enterica serovar Typhi
gguaaaacgcugg

SEQ ID NO: 3667473 - RNA, 22 nt, Salmonella enterica enterica serovar Typhi
gguaaaauccaccacguuaccg

SEQ ID NO: 3667474 - RNA, 22 nt, Salmonella enterica enterica serovar Typhi
gguaaaauggacuuccgcacgc

SEQ ID NO: 3667475 - RNA, 22 nt, Salmonella enterica enterica serovar Typhi
gguaaagaaaccagaguccggc

SEQ ID NO: 3667476 - RNA, 15 nt, Salmonella enterica enterica serovar Typhi
gguaaagccgccauc

SEQ ID NO: 3667477 - RNA, 20 nt, Salmonella enterica enterica serovar Typhi
gguaaaggucguuaggccac

SEQ ID NO: 3667478 - RNA, 14 nt, Salmonella enterica enterica serovar Typhi
gguaaauaacuuuu

SEQ ID NO: 3667479 - RNA, 15 nt, Salmonella enterica enterica serovar Typhi
gguaaauccgccagu

SEQ ID NO: 3667480 - RNA, 20 nt, Salmonella enterica enterica serovar Typhi
gguaaauuuaugguuccuga

SEQ ID NO: 3667481 - RNA, 13 nt, Salmonella enterica enterica serovar Typhi
gguaacaccgcgg

SEQ ID NO: 3667482 - RNA, 18 nt, Salmonella enterica enterica serovar Typhi
gguaacaucgcccgcacc

SEQ ID NO: 3667483 - RNA, 12 nt, Salmonella enterica enterica serovar Typhi
gguaaccauuuc

SEQ ID NO: 3667484 - RNA, 19 nt, Salmonella enterica enterica serovar Typhi
gguaaccuuaauuugugau

SEQ ID NO: 3667485 - RNA, 15 nt, Salmonella enterica enterica serovar Typhi
gguaacgaacgcugu

SEQ ID NO: 3667486 - RNA, 16 nt, Salmonella enterica enterica serovar Typhi
gguaacgauaaaaugc

SEQ ID NO: 3667487 - RNA, 22 nt, Salmonella enterica enterica serovar Typhi
gguaacgcucuuaccgcuaaaa

SEQ ID NO: 3667488 - RNA, 21 nt, Salmonella enterica enterica serovar Typhi
gguaacguuacuugauggaaa

SEQ ID NO: 3667489 - RNA, 14 nt, Salmonella enterica enterica serovar Typhi
gguaagaauaauaa

SEQ ID NO: 3667490 - RNA, 23 nt, Salmonella enterica enterica serovar Typhi
gguaagagagccuuacaggcgca

SEQ ID NO: 3667491 - RNA, 20 nt, Salmonella enterica enterica serovar Typhi
gguaagagcguuacccagac

SEQ ID NO: 3667492 - RNA, 14 nt, Salmonella enterica enterica serovar Typhi
gguaagcaauaugg

SEQ ID NO: 3667493 - RNA, 22 nt, Salmonella enterica enterica serovar Typhi
gguaagcccauggcaggcagca

SEQ ID NO: 3667494 - RNA, 23 nt, Salmonella enterica enterica serovar Typhi
gguaagcccauggcaggcagcac

SEQ ID NO: 3667495 - RNA, 16 nt, Salmonella enterica enterica serovar Typhi
gguaagcgccugcugc

SEQ ID NO: 3667496 - RNA, 19 nt, Salmonella enterica enterica serovar Typhi
gguaaggcguagccgccac

SEQ ID NO: 3667497 - RNA, 14 nt, Salmonella enterica enterica serovar Typhi
gguaaguuuuucuc

SEQ ID NO: 3667498 - RNA, 17 nt, Salmonella enterica enterica serovar Typhi
gguaaguuuuucucuua

SEQ ID NO: 3667499 - RNA, 14 nt, Salmonella enterica enterica serovar Typhi
gguaauaacgguaa

SEQ ID NO: 3667500 - RNA, 21 nt, Salmonella enterica enterica serovar Typhi
gguaauaauuagcauccagca

SEQ ID NO: 3667501 - RNA, 22 nt, Salmonella enterica enterica serovar Typhi
gguaauacuaaucucacccaua

SEQ ID NO: 3667502 - RNA, 17 nt, Salmonella enterica enterica serovar Typhi
gguaauagcccucgccg

SEQ ID NO: 3667503 - RNA, 14 nt, Salmonella enterica enterica serovar Typhi
gguaauauggucgu

SEQ ID NO: 3667504 - RNA, 16 nt, Salmonella enterica enterica serovar Typhi
gguaaugacuuuuaaa

SEQ ID NO: 3667505 - RNA, 15 nt, Salmonella enterica enterica serovar Typhi
gguaaugcgugagca

SEQ ID NO: 3667506 - RNA, 15 nt, Salmonella enterica enterica serovar Typhi
gguaauggucagcau

SEQ ID NO: 3667507 - RNA, 22 nt, Salmonella enterica enterica serovar Typhi
gguaauuucaaagggcccgugg

SEQ ID NO: 3667508 - RNA, 15 nt, Salmonella enterica enterica serovar Typhi
gguaauuugcgccau

SEQ ID NO: 3667509 - RNA, 15 nt, Salmonella enterica enterica serovar Typhi
gguacagaugcugua

SEQ ID NO: 3667510 - RNA, 21 nt, Salmonella enterica enterica serovar Typhi
gguacccggucccuggcuggu

SEQ ID NO: 3667511 - RNA, 19 nt, Salmonella enterica enterica serovar Typhi
gguaccgggcugucaucga

SEQ ID NO: 3667512 - RNA, 15 nt, Salmonella enterica enterica serovar Typhi
gguacgacgcggcuc

SEQ ID NO: 3667513 - RNA, 13 nt, Salmonella enterica enterica serovar Typhi
ggucuugauggcg

SEQ ID NO: 3667514 - RNA, 13 nt, Salmonella enterica enterica serovar Typhi
ggucuuuuucgca

SEQ ID NO: 3667515 - RNA, 22 nt, Salmonella enterica enterica serovar Typhi
ggugaaacguucggugaagaaa

SEQ ID NO: 3667516 - RNA, 12 nt, Salmonella enterica enterica serovar Typhi
ggugaagacgcu

SEQ ID NO: 3667517 - RNA, 22 nt, Salmonella enterica enterica serovar Typhi
ggugaagcauccgggauauaaa

SEQ ID NO: 3667518 - RNA, 15 nt, Salmonella enterica enterica serovar Typhi
ggugaauaaauccuu

SEQ ID NO: 3667519 - RNA, 21 nt, Salmonella enterica enterica serovar Typhi
ggugaauagcauugccgucaa

SEQ ID NO: 3667520 - RNA, 18 nt, Salmonella enterica enterica serovar Typhi
ggugacaugaaaauauga

SEQ ID NO: 3667521 - RNA, 21 nt, Salmonella enterica enterica serovar Typhi
ggugaccaggcuucaucggau

SEQ ID NO: 3667522 - RNA, 19 nt, Salmonella enterica enterica serovar Typhi
ggugacgccaugcaaaaaa

SEQ ID NO: 3667523 - RNA, 16 nt, Salmonella enterica enterica serovar Typhi
ggugacggaaaccagc

SEQ ID NO: 3667524 - RNA, 20 nt, Salmonella enterica enterica serovar Typhi
ggugacggcaacggcgacaa

SEQ ID NO: 3667525 - RNA, 21 nt, Salmonella enterica enterica serovar Typhi
ggugagcucauccagcguuuc

SEQ ID NO: 3667526 - RNA, 19 nt, Salmonella enterica enterica serovar Typhi
ggugagcuccagcccgccg

SEQ ID NO: 3667527 - RNA, 22 nt, Salmonella enterica enterica serovar Typhi
ggugagcuccagcccgccgccc

SEQ ID NO: 3667528 - RNA, 23 nt, Salmonella enterica enterica serovar Typhi
ggugagcuccagcccgccgcccu

SEQ ID NO: 3667529 - RNA, 12 nt, Salmonella enterica enterica serovar Typhi
ggugagcucuuu

SEQ ID NO: 3667530 - RNA, 13 nt, Salmonella enterica enterica serovar Typhi
ggugauagcgcgc

SEQ ID NO: 3667531 - RNA, 22 nt, Salmonella enterica enterica serovar Typhi
ggugauauuuuagccaucccgg

SEQ ID NO: 3667532 - RNA, 15 nt, Salmonella enterica enterica serovar Typhi
ggugauggacgacga

SEQ ID NO: 3667533 - RNA, 17 nt, Salmonella enterica enterica serovar Typhi
ggugauuaacagcgcca

SEQ ID NO: 3667534 - RNA, 23 nt, Salmonella enterica enterica serovar Typhi
ggugauuucgcccgcauucgcgg

SEQ ID NO: 3667535 - RNA, 21 nt, Salmonella enterica enterica serovar Typhi
ggugcaaagaaacguucaucc

SEQ ID NO: 3667536 - RNA, 18 nt, Salmonella enterica enterica serovar Typhi
ggugcaagcaccuuaucc

SEQ ID NO: 3667537 - RNA, 23 nt, Salmonella enterica enterica serovar Typhi
ggugcaagcaccuuauccggccu

SEQ ID NO: 3667538 - RNA, 15 nt, Salmonella enterica enterica serovar Typhi
ggugcagaacaucaa

SEQ ID NO: 3667539 - RNA, 20 nt, Salmonella enterica enterica serovar Typhi
ggugcagaccucugcaaaca

SEQ ID NO: 3667540 - RNA, 15 nt, Salmonella enterica enterica serovar Typhi
ggugcauuccgcgca

SEQ ID NO: 3667541 - RNA, 17 nt, Salmonella enterica enterica serovar Typhi
ggugccaaauguauacu

SEQ ID NO: 3667542 - RNA, 23 nt, Salmonella enterica enterica serovar Typhi
ggugccauauuguucaguuucaa

SEQ ID NO: 3667543 - RNA, 14 nt, Salmonella enterica enterica serovar Typhi
ggugcccgcgugga

SEQ ID NO: 3667544 - RNA, 17 nt, Salmonella enterica enterica serovar Typhi
ggugccuguugcgggcc

SEQ ID NO: 3667545 - RNA, 21 nt, Salmonella enterica enterica serovar Typhi
ggugccuguugcgggccagca

SEQ ID NO: 3667546 - RNA, 15 nt, Salmonella enterica enterica serovar Typhi
ggugcgacaccacgc

SEQ ID NO: 3667547 - RNA, 20 nt, Salmonella enterica enterica serovar Typhi
ggugcgauucagcgcaggca

SEQ ID NO: 3667548 - RNA, 23 nt, Salmonella enterica enterica serovar Typhi
ggugcgcagccccagcgccagcc

SEQ ID NO: 3667549 - RNA, 21 nt, Salmonella enterica enterica serovar Typhi
ggugcgccccagcaugagcca

SEQ ID NO: 3667550 - RNA, 19 nt, Salmonella enterica enterica serovar Typhi
ggugcgguuacguccggca

SEQ ID NO: 3667551 - RNA, 14 nt, Salmonella enterica enterica serovar Typhi
ggugcguucugccg

SEQ ID NO: 3667552 - RNA, 22 nt, Salmonella enterica enterica serovar Typhi
ggugcuacgggcgcugucgccg

SEQ ID NO: 3667553 - RNA, 21 nt, Salmonella enterica enterica serovar Typhi
ggugcucucccagcugagcua

SEQ ID NO: 3667554 - RNA, 18 nt, Salmonella enterica enterica serovar Typhi
ggugcugaauauuaucgg

SEQ ID NO: 3667555 - RNA, 13 nt, Salmonella enterica enterica serovar Typhi
ggugcuguucuuc

SEQ ID NO: 3667556 - RNA, 15 nt, Salmonella enterica enterica serovar Typhi
gguggaaagugcuga

SEQ ID NO: 3667557 - RNA, 11 nt, Salmonella enterica enterica serovar Typhi
gguggccggag

SEQ ID NO: 3667558 - RNA, 20 nt, Salmonella enterica enterica serovar Typhi
gguggcgcaguuuacgcagc

SEQ ID NO: 3667559 - RNA, 17 nt, Salmonella enterica enterica serovar Typhi
gguggcgccacgccacc

SEQ ID NO: 3667560 - RNA, 22 nt, Salmonella enterica enterica serovar Typhi
gguggggauaucuucgauaaga

SEQ ID NO: 3667561 - RNA, 16 nt, Salmonella enterica enterica serovar Typhi
ggugggugaugacggg

SEQ ID NO: 3667562 - RNA, 17 nt, Salmonella enterica enterica serovar Typhi
gguggguuccagcgcca

SEQ ID NO: 3667563 - RNA, 22 nt, Salmonella enterica enterica serovar Typhi
gguggucaucgcggccagcaug

SEQ ID NO: 3667564 - RNA, 15 nt, Salmonella enterica enterica serovar Typhi
gguggucuggagccu

SEQ ID NO: 3667565 - RNA, 13 nt, Salmonella enterica enterica serovar Typhi
gguggugggcggc

SEQ ID NO: 3667566 - RNA, 17 nt, Salmonella enterica enterica serovar Typhi
gguggugggcggcacca

SEQ ID NO: 3667567 - RNA, 16 nt, Salmonella enterica enterica serovar Typhi
ggugguuucccugacc

SEQ ID NO: 3667568 - RNA, 20 nt, Salmonella enterica enterica serovar Typhi
gguguaaaccaggcauuuua

SEQ ID NO: 3667569 - RNA, 14 nt, Salmonella enterica enterica serovar Typhi
gguguaccccgccu

SEQ ID NO: 3667570 - RNA, 13 nt, Salmonella enterica enterica serovar Typhi
ggugugccgccau

SEQ ID NO: 3667571 - RNA, 23 nt, Salmonella enterica enterica serovar Typhi
ggugugguacggcuuucacaccg

SEQ ID NO: 3667572 - RNA, 17 nt, Salmonella enterica enterica serovar Typhi
gguuaaaaacagccagc

SEQ ID NO: 3667573 - RNA, 22 nt, Salmonella enterica enterica serovar Typhi
gguuaacgccguuaccagcauc

SEQ ID NO: 3667574 - RNA, 15 nt, Salmonella enterica enterica serovar Typhi
gguuaacgucagauu

SEQ ID NO: 3667575 - RNA, 18 nt, Salmonella enterica enterica serovar Typhi
gguuaacgucagauuuuc

SEQ ID NO: 3667576 - RNA, 19 nt, Salmonella enterica enterica serovar Typhi
gguuaauaacugcgccauc

SEQ ID NO: 3667577 - RNA, 16 nt, Salmonella enterica enterica serovar Typhi
gguuaaucagcacauu

SEQ ID NO: 3667578 - RNA, 20 nt, Salmonella enterica enterica serovar Typhi
gguuaaugaaaucgucgcca

SEQ ID NO: 3667579 - RNA, 23 nt, Salmonella enterica enterica serovar Typhi
gguuaccaaacccuuuggcaaaa

SEQ ID NO: 3667580 - RNA, 16 nt, Salmonella enterica enterica serovar Typhi
gguuacucacugccgc

SEQ ID NO: 3667581 - RNA, 14 nt, Salmonella enterica enterica serovar Typhi
gguuacucuuccac

SEQ ID NO: 3667582 - RNA, 19 nt, Salmonella enterica enterica serovar Typhi
gguuagccagugggcguca

SEQ ID NO: 3667583 - RNA, 14 nt, Salmonella enterica enterica serovar Typhi
gguuauaauaauaa

SEQ ID NO: 3667584 - RNA, 18 nt, Salmonella enterica enterica serovar Typhi
gguuauccaccagcgcca

SEQ ID NO: 3667585 - RNA, 12 nt, Salmonella enterica enterica serovar Typhi
gguuauccagca

SEQ ID NO: 3667586 - RNA, 16 nt, Salmonella enterica enterica serovar Typhi
gguuauccagcaacca

SEQ ID NO: 3667587 - RNA, 16 nt, Salmonella enterica enterica serovar Typhi
gguuaucgaauccagc

SEQ ID NO: 3667588 - RNA, 23 nt, Salmonella enterica enterica serovar Typhi
gguuaucgcuugguauggcgcua

SEQ ID NO: 3667589 - RNA, 22 nt, Salmonella enterica enterica serovar Typhi
gguuaucuggcgcaaccggcgu

SEQ ID NO: 3667590 - RNA, 19 nt, Salmonella enterica enterica serovar Typhi
gguuauucgccuuucacgc

SEQ ID NO: 3667591 - RNA, 22 nt, Salmonella enterica enterica serovar Typhi
gguuauucggucagauaaauaa

SEQ ID NO: 3667592 - RNA, 19 nt, Salmonella enterica enterica serovar Typhi
gguucaacgcgcugcagcu

SEQ ID NO: 3667593 - RNA, 15 nt, Salmonella enterica enterica serovar Typhi
gguucaagucccccc

SEQ ID NO: 3667594 - RNA, 16 nt, Salmonella enterica enterica serovar Typhi
gguucacaauacagaa

SEQ ID NO: 3667595 - RNA, 22 nt, Salmonella enterica enterica serovar Typhi
gguucaccagcgcgccgccgcc

SEQ ID NO: 3667596 - RNA, 22 nt, Salmonella enterica enterica serovar Typhi
gguucagcaacgugaacugcgc

SEQ ID NO: 3667597 - RNA, 15 nt, Salmonella enterica enterica serovar Typhi
gguucaucgccacau

SEQ ID NO: 3667598 - RNA, 15 nt, Salmonella enterica enterica serovar Typhi
guaaauauugauuaa

SEQ ID NO: 3667599 - RNA, 18 nt, Salmonella enterica enterica serovar Typhi
guaaauauugauuaaucg

SEQ ID NO: 3667600 - RNA, 20 nt, Salmonella enterica enterica serovar Typhi
guaaaucaggccaagcaaca

SEQ ID NO: 3667601 - RNA, 19 nt, Salmonella enterica enterica serovar Typhi
guaaaucauuuguacaaaa

SEQ ID NO: 3667602 - RNA, 16 nt, Salmonella enterica enterica serovar Typhi
guaaauccaauagacu

SEQ ID NO: 3667603 - RNA, 14 nt, Salmonella enterica enterica serovar Typhi
guaaauccgcgaug

SEQ ID NO: 3667604 - RNA, 13 nt, Salmonella enterica enterica serovar Typhi
guaaauccggcuc

SEQ ID NO: 3667605 - RNA, 19 nt, Salmonella enterica enterica serovar Typhi
guaaaucgcgcccgacaug

SEQ ID NO: 3667606 - RNA, 17 nt, Salmonella enterica enterica serovar Typhi
guaaaucugccgucauc

SEQ ID NO: 3667607 - RNA, 19 nt, Salmonella enterica enterica serovar Typhi
guaaaucugccgucaucga

SEQ ID NO: 3667608 - RNA, 19 nt, Salmonella enterica enterica serovar Typhi
guaaauuccgcaggcaaca

SEQ ID NO: 3667609 - RNA, 21 nt, Salmonella enterica enterica serovar Typhi
guaaauuccgcaggcaacaca

SEQ ID NO: 3667610 - RNA, 17 nt, Salmonella enterica enterica serovar Typhi
guaaauuccuuguuuua

SEQ ID NO: 3667611 - RNA, 22 nt, Salmonella enterica enterica serovar Typhi
guaaauucucuauacugcugac

SEQ ID NO: 3667612 - RNA, 23 nt, Salmonella enterica enterica serovar Typhi
guaaauugaguggacaucgccau

SEQ ID NO: 3667613 - RNA, 20 nt, Salmonella enterica enterica serovar Typhi
guaaauuuaucgaucuccau

SEQ ID NO: 3667614 - RNA, 13 nt, Salmonella enterica enterica serovar Typhi
guaacaaccagaa

SEQ ID NO: 3667615 - RNA, 22 nt, Salmonella enterica enterica serovar Typhi
guaacaccuguaacgucacauu

SEQ ID NO: 3667616 - RNA, 17 nt, Salmonella enterica enterica serovar Typhi
guaacagaauuaacgca

SEQ ID NO: 3667617 - RNA, 22 nt, Salmonella enterica enterica serovar Typhi
guaacagacgcaucuuuuuccc

SEQ ID NO: 3667618 - RNA, 13 nt, Salmonella enterica enterica serovar Typhi
guaacagcaacau

SEQ ID NO: 3667619 - RNA, 13 nt, Salmonella enterica enterica serovar Typhi
guaacagcaggac

SEQ ID NO: 3667620 - RNA, 17 nt, Salmonella enterica enterica serovar Typhi
guaacaucaaguacagc

SEQ ID NO: 3667621 - RNA, 13 nt, Salmonella enterica enterica serovar Typhi
guaacaucgaaug

SEQ ID NO: 3667622 - RNA, 22 nt, Salmonella enterica enterica serovar Typhi
guaaccaaagcaccauucuuca

SEQ ID NO: 3667623 - RNA, 23 nt, Salmonella enterica enterica serovar Typhi
guaaccccauacaguaguuuuca

SEQ ID NO: 3667624 - RNA, 17 nt, Salmonella enterica enterica serovar Typhi
guaaccccugcccgcga

SEQ ID NO: 3667625 - RNA, 15 nt, Salmonella enterica enterica serovar Typhi
guaacccgccgccau

SEQ ID NO: 3667626 - RNA, 16 nt, Salmonella enterica enterica serovar Typhi
guaaccuauuuuacaa

SEQ ID NO: 3667627 - RNA, 14 nt, Salmonella enterica enterica serovar Typhi
guaacgcacuuuuc

SEQ ID NO: 3667628 - RNA, 15 nt, Salmonella enterica enterica serovar Typhi
guaacgcauaagcgc

SEQ ID NO: 3667629 - RNA, 22 nt, Salmonella enterica enterica serovar Typhi
guaacgcauacggguaaaggca

SEQ ID NO: 3667630 - RNA, 23 nt, Salmonella enterica enterica serovar Typhi
guaacgccaaaguuuuuaaacaa

SEQ ID NO: 3667631 - RNA, 21 nt, Salmonella enterica enterica serovar Typhi
guaacgccuggcgcauuuuaa

SEQ ID NO: 3667632 - RNA, 16 nt, Salmonella enterica enterica serovar Typhi
guaacgccuucgcaaa

SEQ ID NO: 3667633 - RNA, 17 nt, Salmonella enterica enterica serovar Typhi
guaacggaaaagcauug

SEQ ID NO: 3667634 - RNA, 17 nt, Salmonella enterica enterica serovar Typhi
guaacggacauaaagga

SEQ ID NO: 3667635 - RNA, 17 nt, Salmonella enterica enterica serovar Typhi
guaacguuguccagcag

SEQ ID NO: 3667636 - RNA, 18 nt, Salmonella enterica enterica serovar Typhi
guaacguuguccagcaga

SEQ ID NO: 3667637 - RNA, 20 nt, Salmonella enterica enterica serovar Typhi
guaacuauuucuaucaggua

SEQ ID NO: 3667638 - RNA, 18 nt, Salmonella enterica enterica serovar Typhi
guaacucaauaucgacag

SEQ ID NO: 3667639 - RNA, 15 nt, Salmonella enterica enterica serovar Typhi
guaacucaucgccag

SEQ ID NO: 3667640 - RNA, 17 nt, Salmonella enterica enterica serovar Typhi
guaacuggcuccacggg

SEQ ID NO: 3667641 - RNA, 11 nt, Salmonella enterica enterica serovar Typhi
guaacuuacaa

SEQ ID NO: 3667642 - RNA, 13 nt, Salmonella enterica enterica serovar Typhi
guaacuuauccac

SEQ ID NO: 3667643 - RNA, 16 nt, Salmonella enterica enterica serovar Typhi
guaagagagccuuaca

SEQ ID NO: 3667644 - RNA, 23 nt, Salmonella enterica enterica serovar Typhi
guaagagcguuacccagacagca

SEQ ID NO: 3667645 - RNA, 16 nt, Salmonella enterica enterica serovar Typhi
guaagaggcauaaaaa

SEQ ID NO: 3667646 - RNA, 13 nt, Salmonella enterica enterica serovar Typhi
guaagagguaucc

SEQ ID NO: 3667647 - RNA, 15 nt, Salmonella enterica enterica serovar Typhi
guaagcgcagcgcca

SEQ ID NO: 3667648 - RNA, 18 nt, Salmonella enterica enterica serovar Typhi
guaagcgcagcgccaccg

SEQ ID NO: 3667649 - RNA, 16 nt, Salmonella enterica enterica serovar Typhi
guaagcgccaagcggc

SEQ ID NO: 3667650 - RNA, 15 nt, Salmonella enterica enterica serovar Typhi
guaagcgccagccgu

SEQ ID NO: 3667651 - RNA, 17 nt, Salmonella enterica enterica serovar Typhi
guaagcgcccguccaug

SEQ ID NO: 3667652 - RNA, 22 nt, Salmonella enterica enterica serovar Typhi
guaagcgcccguccaugaguag

SEQ ID NO: 3667653 - RNA, 21 nt, Salmonella enterica enterica serovar Typhi
guaagcgccugcugcgcaaca

SEQ ID NO: 3667654 - RNA, 18 nt, Salmonella enterica enterica serovar Typhi
guaagcggcggaccagcg

SEQ ID NO: 3667655 - RNA, 19 nt, Salmonella enterica enterica serovar Typhi
guaagcggcggaccagcgu

SEQ ID NO: 3667656 - RNA, 23 nt, Salmonella enterica enterica serovar Typhi
guaagcggguauacuuaacccug

SEQ ID NO: 3667657 - RNA, 15 nt, Salmonella enterica enterica serovar Typhi
guaaggcaaauaugc

SEQ ID NO: 3667658 - RNA, 22 nt, Salmonella enterica enterica serovar Typhi
guaagggaggugcucucccagc

SEQ ID NO: 3667659 - RNA, 21 nt, Salmonella enterica enterica serovar Typhi
guaagucgaccaguccuuccg

SEQ ID NO: 3667660 - RNA, 14 nt, Salmonella enterica enterica serovar Typhi
guaaguuuugcucc

SEQ ID NO: 3667661 - RNA, 15 nt, Salmonella enterica enterica serovar Typhi
guaaguuuugcuccc

SEQ ID NO: 3667662 - RNA, 17 nt, Salmonella enterica enterica serovar Typhi
guaauaaccguggcggc

SEQ ID NO: 3667663 - RNA, 13 nt, Salmonella enterica enterica serovar Typhi
guaauaauacuaa

SEQ ID NO: 3667664 - RNA, 22 nt, Salmonella enterica enterica serovar Typhi
guaauacgcgucugucgaaacu

SEQ ID NO: 3667665 - RNA, 18 nt, Salmonella enterica enterica serovar Typhi
guaauacggagcaaaaaa

SEQ ID NO: 3667666 - RNA, 19 nt, Salmonella enterica enterica serovar Typhi
guaauacggagcaaaaaau

SEQ ID NO: 3667667 - RNA, 11 nt, Salmonella enterica enterica serovar Typhi
guaauacuucc

SEQ ID NO: 3667668 - RNA, 14 nt, Salmonella enterica enterica serovar Typhi
guaauaguuucgac

SEQ ID NO: 3667669 - RNA, 22 nt, Salmonella enterica enterica serovar Typhi
guaauaugugcgccacgcagcg

SEQ ID NO: 3667670 - RNA, 12 nt, Salmonella enterica enterica serovar Typhi
guaauauuaaaa

SEQ ID NO: 3667671 - RNA, 18 nt, Salmonella enterica enterica serovar Typhi
guaaucaauagcguuaua

SEQ ID NO: 3667672 - RNA, 22 nt, Salmonella enterica enterica serovar Typhi
guaaucacaucauuaaagcgcu

SEQ ID NO: 3667673 - RNA, 22 nt, Salmonella enterica enterica serovar Typhi
guaaucacuaacugaccauaua

SEQ ID NO: 3667674 - RNA, 20 nt, Salmonella enterica enterica serovar Typhi
gccugcacggcgucauucac

SEQ ID NO: 3667675 - RNA, 12 nt, Salmonella enterica enterica serovar Typhi
gccugcagaccc

SEQ ID NO: 3667676 - RNA, 13 nt, Salmonella enterica enterica serovar Typhi
gccugcagaccca

SEQ ID NO: 3667677 - RNA, 18 nt, Salmonella enterica enterica serovar Typhi
gccugcauaauugcugac

SEQ ID NO: 3667678 - RNA, 20 nt, Salmonella enterica enterica serovar Typhi
gccugcaucaccucagaauu

SEQ ID NO: 3667679 - RNA, 21 nt, Salmonella enterica enterica serovar Typhi
gccugccagauccaacacauc

SEQ ID NO: 3667680 - RNA, 12 nt, Salmonella enterica enterica serovar Typhi
gccugcccaucu

SEQ ID NO: 3667681 - RNA, 16 nt, Salmonella enterica enterica serovar Typhi
gccugcccugcggcag

SEQ ID NO: 3667682 - RNA, 19 nt, Salmonella enterica enterica serovar Typhi
gccugcccugcggcaggca

SEQ ID NO: 3667683 - RNA, 16 nt, Salmonella enterica enterica serovar Typhi
gccugccgcaucugac

SEQ ID NO: 3667684 - RNA, 14 nt, Salmonella enterica enterica serovar Typhi
gccugccgcgcccg

SEQ ID NO: 3667685 - RNA, 16 nt, Salmonella enterica enterica serovar Typhi
gccugccgcgccgccg

SEQ ID NO: 3667686 - RNA, 19 nt, Salmonella enterica enterica serovar Typhi
gccugccgggccugcggcg

SEQ ID NO: 3667687 - RNA, 21 nt, Salmonella enterica enterica serovar Typhi
gccugccgggccugcggcgac

SEQ ID NO: 3667688 - RNA, 23 nt, Salmonella enterica enterica serovar Typhi
gccugccguaaacaggcaggccc

SEQ ID NO: 3667689 - RNA, 21 nt, Salmonella enterica enterica serovar Typhi
gccugccgucgcggcuuucag

SEQ ID NO: 3667690 - RNA, 15 nt, Salmonella enterica enterica serovar Typhi
gccugccguuuuuaa

SEQ ID NO: 3667691 - RNA, 15 nt, Salmonella enterica enterica serovar Typhi
gccugccugaagcgc

SEQ ID NO: 3667692 - RNA, 13 nt, Salmonella enterica enterica serovar Typhi
gccuuccaggcgg

SEQ ID NO: 3667693 - RNA, 22 nt, Salmonella enterica enterica serovar Typhi
gccuucccgauaaccgcguuca

SEQ ID NO: 3667694 - RNA, 21 nt, Salmonella enterica enterica serovar Typhi
gccuuccucgucggcaagaau

SEQ ID NO: 3667695 - RNA, 22 nt, Salmonella enterica enterica serovar Typhi
gccuuccuguggaaggcauuau

SEQ ID NO: 3667696 - RNA, 16 nt, Salmonella enterica enterica serovar Typhi
gccuucgacuuccgca

SEQ ID NO: 3667697 - RNA, 20 nt, Salmonella enterica enterica serovar Typhi
gccuucgacuuccgcaucaa

SEQ ID NO: 3667698 - RNA, 17 nt, Salmonella enterica enterica serovar Typhi
gccuucgauuaacgcau

SEQ ID NO: 3667699 - RNA, 24 nt, Salmonella enterica enterica serovar Typhi
gccuucggccugaaucagcaucuu

SEQ ID NO: 3667700 - RNA, 18 nt, Salmonella enterica enterica serovar Typhi
gccuucguuauaaggccu

SEQ ID NO: 3667701 - RNA, 20 nt, Salmonella enterica enterica serovar Typhi
gccuucguuauaaggccugc

SEQ ID NO: 3667702 - RNA, 14 nt, Salmonella enterica enterica serovar Typhi
gccuucuccccuuc

SEQ ID NO: 3667703 - RNA, 18 nt, Salmonella enterica enterica serovar Typhi
gccuucuucgcaaucucc

SEQ ID NO: 3667704 - RNA, 22 nt, Salmonella enterica enterica serovar Typhi
gccuucuuuggugcgacgccag

SEQ ID NO: 3667705 - RNA, 19 nt, Salmonella enterica enterica serovar Typhi
gccuugaaguuauccagcg

SEQ ID NO: 3667706 - RNA, 21 nt, Salmonella enterica enterica serovar Typhi
gccuugaaguuauccagcgcc

SEQ ID NO: 3667707 - RNA, 11 nt, Salmonella enterica enterica serovar Typhi
gccuugccagc

SEQ ID NO: 3667708 - RNA, 22 nt, Salmonella enterica enterica serovar Typhi
gccuugcccguauugaagcgau

SEQ ID NO: 3667709 - RNA, 15 nt, Salmonella enterica enterica serovar Typhi
gccuugcggcggcgu

SEQ ID NO: 3667710 - RNA, 15 nt, Salmonella enterica enterica serovar Typhi
gccuuuaccacccgu

SEQ ID NO: 3667711 - RNA, 13 nt, Salmonella enterica enterica serovar Typhi
gccuuuauccagc

SEQ ID NO: 3667712 - RNA, 14 nt, Salmonella enterica enterica serovar Typhi
gccuuuaugcaguu

SEQ ID NO: 3667713 - RNA, 18 nt, Salmonella enterica enterica serovar Typhi
gccuuuaugcaguuccgu

SEQ ID NO: 3667714 - RNA, 21 nt, Salmonella enterica enterica serovar Typhi
gccuuuaugggcuuugcaagc

SEQ ID NO: 3667715 - RNA, 17 nt, Salmonella enterica enterica serovar Typhi
gccuuucaccagcgccu

SEQ ID NO: 3667716 - RNA, 20 nt, Salmonella enterica enterica serovar Typhi
gccuuucacgcguucaauau

SEQ ID NO: 3667717 - RNA, 17 nt, Salmonella enterica enterica serovar Typhi
gccuuucagaucggcaa

SEQ ID NO: 3667718 - RNA, 13 nt, Salmonella enterica enterica serovar Typhi
gccuuuccgcaug

SEQ ID NO: 3667719 - RNA, 15 nt, Salmonella enterica enterica serovar Typhi
gccuuucgcgcgaua

SEQ ID NO: 3667720 - RNA, 22 nt, Salmonella enterica enterica serovar Typhi
gccuuucuuauuuuuuucaacg

SEQ ID NO: 3667721 - RNA, 14 nt, Salmonella enterica enterica serovar Typhi
gccuuugccuucgc

SEQ ID NO: 3667722 - RNA, 17 nt, Salmonella enterica enterica serovar Typhi
gccuuugcguaccgcaa

SEQ ID NO: 3667723 - RNA, 19 nt, Salmonella enterica enterica serovar Typhi
gccuuugcguaccgcaaug

SEQ ID NO: 3667724 - RNA, 22 nt, Salmonella enterica enterica serovar Typhi
gccuuuggcaaucauaccguca

SEQ ID NO: 3667725 - RNA, 20 nt, Salmonella enterica enterica serovar Typhi
gccuuugucgaaauugccgc

SEQ ID NO: 3667726 - RNA, 22 nt, Salmonella enterica enterica serovar Typhi
gccuuuuacaauaaccggcaga

SEQ ID NO: 3667727 - RNA, 21 nt, Salmonella enterica enterica serovar Typhi
gccuuuuaucaaugcacugac

SEQ ID NO: 3667728 - RNA, 18 nt, Salmonella enterica enterica serovar Typhi
gccuuuucccccagcauu

SEQ ID NO: 3667729 - RNA, 13 nt, Salmonella enterica enterica serovar Typhi
gccuuuuggcagc

SEQ ID NO: 3667730 - RNA, 22 nt, Salmonella enterica enterica serovar Typhi
gccuuuuucaacagcacccagg

SEQ ID NO: 3667731 - RNA, 15 nt, Salmonella enterica enterica serovar Typhi
gccuuuuuccgggau

SEQ ID NO: 3667732 - RNA, 18 nt, Salmonella enterica enterica serovar Typhi
gccuuuuuuaauccagga

SEQ ID NO: 3667733 - RNA, 20 nt, Salmonella enterica enterica serovar Typhi
gccuuuuuuaauccaggaau

SEQ ID NO: 3667734 - RNA, 15 nt, Salmonella enterica enterica serovar Typhi
gcgaaaacggcguag

SEQ ID NO: 3667735 - RNA, 23 nt, Salmonella enterica enterica serovar Typhi
gcgaaaacguugacuuaaaaagc

SEQ ID NO: 3667736 - RNA, 23 nt, Salmonella enterica enterica serovar Typhi
gcgaaaaucgguaacaucaagua

SEQ ID NO: 3667737 - RNA, 22 nt, Salmonella enterica enterica serovar Typhi
gcgaaaccggccgccaucgcaa

SEQ ID NO: 3667738 - RNA, 14 nt, Salmonella enterica enterica serovar Typhi
gcgaaacggcagcg

SEQ ID NO: 3667739 - RNA, 12 nt, Salmonella enterica enterica serovar Typhi
gcgaaagaaaau

SEQ ID NO: 3667740 - RNA, 14 nt, Salmonella enterica enterica serovar Typhi
gcgaaaguaccggc

SEQ ID NO: 3667741 - RNA, 19 nt, Salmonella enterica enterica serovar Typhi
gcgaaauaggccgcgauac

SEQ ID NO: 3667742 - RNA, 19 nt, Salmonella enterica enterica serovar Typhi
gcgaaauauuaucgccauc

SEQ ID NO: 3667743 - RNA, 14 nt, Salmonella enterica enterica serovar Typhi
gcgaaauugguaga

SEQ ID NO: 3667744 - RNA, 20 nt, Salmonella enterica enterica serovar Typhi
gcgaacagccccaccgccag

SEQ ID NO: 3667745 - RNA, 23 nt, Salmonella enterica enterica serovar Typhi
gcgaacagcccgcuauuucucgc

SEQ ID NO: 3667746 - RNA, 12 nt, Salmonella enterica enterica serovar Typhi
gcgaacagcgca

SEQ ID NO: 3667747 - RNA, 12 nt, Salmonella enterica enterica serovar Typhi
gcgaacagcgcu

SEQ ID NO: 3667748 - RNA, 22 nt, Salmonella enterica enterica serovar Typhi
gcgaacaggcucagcgccacgc

SEQ ID NO: 3667749 - RNA, 22 nt, Salmonella enterica enterica serovar Typhi
gcgaacaguacggucaggcuca

SEQ ID NO: 3667750 - RNA, 11 nt, Salmonella enterica enterica serovar Typhi
gcgaacauugg

SEQ ID NO: 3667751 - RNA, 17 nt, Salmonella enterica enterica serovar Typhi
gcgaacauuucagcgcc

SEQ ID NO: 3667752 - RNA, 18 nt, Salmonella enterica enterica serovar Typhi
gcgaacauuucagcgcca

SEQ ID NO: 3667753 - RNA, 14 nt, Salmonella enterica enterica serovar Typhi
gcgaaccaccagcc

SEQ ID NO: 3667754 - RNA, 17 nt, Salmonella enterica enterica serovar Typhi
gcgaaccggaccagcac

SEQ ID NO: 3667755 - RNA, 20 nt, Salmonella enterica enterica serovar Typhi
gcgaaccggaccagcacaaa

SEQ ID NO: 3667756 - RNA, 18 nt, Salmonella enterica enterica serovar Typhi
gcgaaccuuccaucgcau

SEQ ID NO: 3667757 - RNA, 21 nt, Salmonella enterica enterica serovar Typhi
gcgaacgacucacgcgcgcuu

SEQ ID NO: 3667758 - RNA, 20 nt, Salmonella enterica enterica serovar Typhi
gcgaacggcuuuccagcagc

SEQ ID NO: 3667759 - RNA, 21 nt, Salmonella enterica enterica serovar Typhi
gcgaacggcuuuccagcagcc

SEQ ID NO: 3667760 - RNA, 20 nt, Salmonella enterica enterica serovar Typhi
gcgaacguuacccggccagc

SEQ ID NO: 3667761 - RNA, 18 nt, Salmonella enterica enterica serovar Typhi
gcgaacguuugaccugca

SEQ ID NO: 3667762 - RNA, 21 nt, Salmonella enterica enterica serovar Typhi
gcgaacugguuauacaguuca

SEQ ID NO: 3667763 - RNA, 12 nt, Salmonella enterica enterica serovar Typhi
gcgaagccacuu

SEQ ID NO: 3667764 - RNA, 13 nt, Salmonella enterica enterica serovar Typhi
gcgaagcgccauc

SEQ ID NO: 3667765 - RNA, 15 nt, Salmonella enterica enterica serovar Typhi
gcgaagcggcgcuau

SEQ ID NO: 3667766 - RNA, 23 nt, Salmonella enterica enterica serovar Typhi
gcgaagcggcgcuauccggcauc

SEQ ID NO: 3667767 - RNA, 23 nt, Salmonella enterica enterica serovar Typhi
gcgaaguagauuacgaaugugca

SEQ ID NO: 3667768 - RNA, 16 nt, Salmonella enterica enterica serovar Typhi
gcgaagugcagcguuu

SEQ ID NO: 3667769 - RNA, 16 nt, Salmonella enterica enterica serovar Typhi
gcgaauaaaacugccg

SEQ ID NO: 3667770 - RNA, 20 nt, Salmonella enterica enterica serovar Typhi
gcgaauaaucccggcgccaa

SEQ ID NO: 3667771 - RNA, 15 nt, Salmonella enterica enterica serovar Typhi
gcgaauaaucuguuu

SEQ ID NO: 3667772 - RNA, 20 nt, Salmonella enterica enterica serovar Typhi
gcgaauaccuaacagccgcg

SEQ ID NO: 3667773 - RNA, 14 nt, Salmonella enterica enterica serovar Typhi
gcgaauaccuuccc

SEQ ID NO: 3667774 - RNA, 18 nt, Salmonella enterica enterica serovar Typhi
gcgaauaccuucccgcga

SEQ ID NO: 3667775 - RNA, 15 nt, Salmonella enterica enterica serovar Typhi
gcgaauacgggaucg

SEQ ID NO: 3667776 - RNA, 18 nt, Salmonella enterica enterica serovar Typhi
gcgaaucacauccgccag

SEQ ID NO: 3667777 - RNA, 20 nt, Salmonella enterica enterica serovar Typhi
gcgacuuucacgaaaccggc

SEQ ID NO: 3667778 - RNA, 22 nt, Salmonella enterica enterica serovar Typhi
gcgagaacggguaaaugcgcgc

SEQ ID NO: 3667779 - RNA, 13 nt, Salmonella enterica enterica serovar Typhi
gcgagaacugcug

SEQ ID NO: 3667780 - RNA, 16 nt, Salmonella enterica enterica serovar Typhi
gcgagaacuuccgcca

SEQ ID NO: 3667781 - RNA, 18 nt, Salmonella enterica enterica serovar Typhi
gcgagaagcugggcguca

SEQ ID NO: 3667782 - RNA, 14 nt, Salmonella enterica enterica serovar Typhi
gcgagaaguucuca

SEQ ID NO: 3667783 - RNA, 16 nt, Salmonella enterica enterica serovar Typhi
gcgagaauuuuaugga

SEQ ID NO: 3667784 - RNA, 17 nt, Salmonella enterica enterica serovar Typhi
gcgagaccauauugaag

SEQ ID NO: 3667785 - RNA, 16 nt, Salmonella enterica enterica serovar Typhi
gcgagagaauuaacag

SEQ ID NO: 3667786 - RNA, 23 nt, Salmonella enterica enterica serovar Typhi
gcgagagaauuaacagcgcgacc

SEQ ID NO: 3667787 - RNA, 18 nt, Salmonella enterica enterica serovar Typhi
gcgagaguaagcccaaag

SEQ ID NO: 3667788 - RNA, 16 nt, Salmonella enterica enterica serovar Typhi
gcgagaguuugugaug

SEQ ID NO: 3667789 - RNA, 19 nt, Salmonella enterica enterica serovar Typhi
gcgagauuacugcgugcug

SEQ ID NO: 3667790 - RNA, 16 nt, Salmonella enterica enterica serovar Typhi
gcgagcaggaauagcu

SEQ ID NO: 3667791 - RNA, 14 nt, Salmonella enterica enterica serovar Typhi
gcgagcgauagaga

SEQ ID NO: 3667792 - RNA, 19 nt, Salmonella enterica enterica serovar Typhi
gcgagcguuuugaugucca

SEQ ID NO: 3667793 - RNA, 20 nt, Salmonella enterica enterica serovar Typhi
gcgagcugccaguucauucc

SEQ ID NO: 3667794 - RNA, 15 nt, Salmonella enterica enterica serovar Typhi
gcgaggaacaucagc

SEQ ID NO: 3667795 - RNA, 12 nt, Salmonella enterica enterica serovar Typhi
gcgaggacugua

SEQ ID NO: 3667796 - RNA, 13 nt, Salmonella enterica enterica serovar Typhi
gcgaggcgcgcuc

SEQ ID NO: 3667797 - RNA, 15 nt, Salmonella enterica enterica serovar Typhi
gcgagggauuuccug

SEQ ID NO: 3667798 - RNA, 19 nt, Salmonella enterica enterica serovar Typhi
gcgagggauuuccuggcag

SEQ ID NO: 3667799 - RNA, 20 nt, Salmonella enterica enterica serovar Typhi
gcgaggucuggucagcgaug

SEQ ID NO: 3667800 - RNA, 15 nt, Salmonella enterica enterica serovar Typhi
gcgagguucccgccg

SEQ ID NO: 3667801 - RNA, 17 nt, Salmonella enterica enterica serovar Typhi
gcgagguucccgccgcc

SEQ ID NO: 3667802 - RNA, 16 nt, Salmonella enterica enterica serovar Typhi
gcgaguauucgcgccc

SEQ ID NO: 3667803 - RNA, 17 nt, Salmonella enterica enterica serovar Typhi
gcgagucagacaccagc

SEQ ID NO: 3667804 - RNA, 17 nt, Salmonella enterica enterica serovar Typhi
gcgauaaaccaacagcc

SEQ ID NO: 3667805 - RNA, 13 nt, Salmonella enterica enterica serovar Typhi
gcgauaaaccagc

SEQ ID NO: 3667806 - RNA, 14 nt, Salmonella enterica enterica serovar Typhi
gcgauaaaccagcc

SEQ ID NO: 3667807 - RNA, 13 nt, Salmonella enterica enterica serovar Typhi
gcgauaaaguaug

SEQ ID NO: 3667808 - RNA, 19 nt, Salmonella enterica enterica serovar Typhi
gcgauaaucaacucuccuu

SEQ ID NO: 3667809 - RNA, 20 nt, Salmonella enterica enterica serovar Typhi
gcgauaaugaagcauaaaaa

SEQ ID NO: 3667810 - RNA, 18 nt, Salmonella enterica enterica serovar Typhi
gcgauaccgugacugacc

SEQ ID NO: 3667811 - RNA, 22 nt, Salmonella enterica enterica serovar Typhi
gcgauacgcgcguucguugaug

SEQ ID NO: 3667812 - RNA, 14 nt, Salmonella enterica enterica serovar Typhi
gcgauacugccgcc

SEQ ID NO: 3667813 - RNA, 21 nt, Salmonella enterica enterica serovar Typhi
gcgauagagaccgcuuuagcc

SEQ ID NO: 3667814 - RNA, 20 nt, Salmonella enterica enterica serovar Typhi
gcgauagagaguuccuccug

SEQ ID NO: 3667815 - RNA, 16 nt, Salmonella enterica enterica serovar Typhi
gcgauagcccggcaug

SEQ ID NO: 3667816 - RNA, 22 nt, Salmonella enterica enterica serovar Typhi
gcgauaguguggucgucagccg

SEQ ID NO: 3667817 - RNA, 20 nt, Salmonella enterica enterica serovar Typhi
gcgauaucaacgucuugccg

SEQ ID NO: 3667818 - RNA, 21 nt, Salmonella enterica enterica serovar Typhi
gcgauaucaacgucuugccgu

SEQ ID NO: 3667819 - RNA, 14 nt, Salmonella enterica enterica serovar Typhi
gcgauaucauucuc

SEQ ID NO: 3667820 - RNA, 23 nt, Salmonella enterica enterica serovar Typhi
gcgauauuucuccgcccauccag

SEQ ID NO: 3667821 - RNA, 18 nt, Salmonella enterica enterica serovar Typhi
gcgaucaagacaaaagcu

SEQ ID NO: 3667822 - RNA, 22 nt, Salmonella enterica enterica serovar Typhi
gcgaucaagacaaaagcuggug

SEQ ID NO: 3667823 - RNA, 12 nt, Salmonella enterica enterica serovar Typhi
gcgaucaccacg

SEQ ID NO: 3667824 - RNA, 16 nt, Salmonella enterica enterica serovar Typhi
gcgaucacuaccgcca

SEQ ID NO: 3667825 - RNA, 18 nt, Salmonella enterica enterica serovar Typhi
gcgaucacuaccgccauc

SEQ ID NO: 3667826 - RNA, 14 nt, Salmonella enterica enterica serovar Typhi
gcgaucacuucgac

SEQ ID NO: 3667827 - RNA, 19 nt, Salmonella enterica enterica serovar Typhi
gcgaucagacgcugguugu

SEQ ID NO: 3667828 - RNA, 22 nt, Salmonella enterica enterica serovar Typhi
gcgaucagcucuucgcucugaa

SEQ ID NO: 3667829 - RNA, 20 nt, Salmonella enterica enterica serovar Typhi
gcgaucaguggcgccgcaau

SEQ ID NO: 3667830 - RNA, 15 nt, Salmonella enterica enterica serovar Typhi
gcgauccagaucggc

SEQ ID NO: 3667831 - RNA, 22 nt, Salmonella enterica enterica serovar Typhi
gcgauccagccccagcgccagc

SEQ ID NO: 3667832 - RNA, 20 nt, Salmonella enterica enterica serovar Typhi
gcgaucccaguugaucggcc

SEQ ID NO: 3667833 - RNA, 23 nt, Salmonella enterica enterica serovar Typhi
gcgaucccaguugaucggccagc

SEQ ID NO: 3667834 - RNA, 14 nt, Salmonella enterica enterica serovar Typhi
gcgaucccggccuu

SEQ ID NO: 3667835 - RNA, 22 nt, Salmonella enterica enterica serovar Typhi
gcgaucccggccuucgaacagc

SEQ ID NO: 3667836 - RNA, 19 nt, Salmonella enterica enterica serovar Typhi
gcgauccucauacagcccg

SEQ ID NO: 3667837 - RNA, 14 nt, Salmonella enterica enterica serovar Typhi
gcgauccugcggca

SEQ ID NO: 3667838 - RNA, 23 nt, Salmonella enterica enterica serovar Typhi
gcgaucgacuaauuuuaggaaga

SEQ ID NO: 3667839 - RNA, 11 nt, Salmonella enterica enterica serovar Typhi
gcgaucgccag

SEQ ID NO: 3667840 - RNA, 11 nt, Salmonella enterica enterica serovar Typhi
gcgaucgccgu

SEQ ID NO: 3667841 - RNA, 22 nt, Salmonella enterica enterica serovar Typhi
gcgaucgccgucguucagccag

SEQ ID NO: 3667842 - RNA, 20 nt, Salmonella enterica enterica serovar Typhi
gcgaucgcgccggucgccag

SEQ ID NO: 3667843 - RNA, 22 nt, Salmonella enterica enterica serovar Typhi
gcgaucgcgccggucgccagca

SEQ ID NO: 3667844 - RNA, 22 nt, Salmonella enterica enterica serovar Typhi
gcgaucugugucguccaggccu

SEQ ID NO: 3667845 - RNA, 23 nt, Salmonella enterica enterica serovar Typhi
gcgaucuuuuguuuaccccaggc

SEQ ID NO: 3667846 - RNA, 17 nt, Salmonella enterica enterica serovar Typhi
gcgaugaccaucaaaua

SEQ ID NO: 3667847 - RNA, 21 nt, Salmonella enterica enterica serovar Typhi
gcgaugaccaucaaauaauac

SEQ ID NO: 3667848 - RNA, 20 nt, Salmonella enterica enterica serovar Typhi
gcgaugacggcgcguuaucg

SEQ ID NO: 3667849 - RNA, 16 nt, Salmonella enterica enterica serovar Typhi
gcgaugagauccgggc

SEQ ID NO: 3667850 - RNA, 13 nt, Salmonella enterica enterica serovar Typhi
gcgaugagcgcca

SEQ ID NO: 3667851 - RNA, 13 nt, Salmonella enterica enterica serovar Typhi
gcgaugauagccg

SEQ ID NO: 3667852 - RNA, 20 nt, Salmonella enterica enterica serovar Typhi
gcgaugccaguagcucgccg

SEQ ID NO: 3667853 - RNA, 14 nt, Salmonella enterica enterica serovar Typhi
gcgaugccugccgg

SEQ ID NO: 3667854 - RNA, 19 nt, Salmonella enterica enterica serovar Typhi
gcgaugccuuauccggccu

SEQ ID NO: 3667855 - RNA, 19 nt, Salmonella enterica enterica serovar Typhi
gcgaugcgaccgcgccacg

SEQ ID NO: 3667856 - RNA, 11 nt, Salmonella enterica enterica serovar Typhi
gcgaugguagg

SEQ ID NO: 3667857 - RNA, 18 nt, Salmonella enterica enterica serovar Typhi
gcgauggugcggcgcacu

SEQ ID NO: 3667858 - RNA, 20 nt, Salmonella enterica enterica serovar Typhi
gcgauguauuuauccacgcc

SEQ ID NO: 3667859 - RNA, 15 nt, Salmonella enterica enterica serovar Typhi
gcgauguccgguccg

SEQ ID NO: 3667860 - RNA, 19 nt, Salmonella enterica enterica serovar Typhi
gcgaugucgggauaacgau

SEQ ID NO: 3667861 - RNA, 21 nt, Salmonella enterica enterica serovar Typhi
gcgauguucaugcgcggucau

SEQ ID NO: 3667862 - RNA, 11 nt, Salmonella enterica enterica serovar Typhi
gcgcauggcca

SEQ ID NO: 3667863 - RNA, 15 nt, Salmonella enterica enterica serovar Typhi
gcgcauggccauaga

SEQ ID NO: 3667864 - RNA, 15 nt, Salmonella enterica enterica serovar Typhi
gcgcauguuagcaaa

SEQ ID NO: 3667865 - RNA, 14 nt, Salmonella enterica enterica serovar Typhi
gcgcauuaacgcca

SEQ ID NO: 3667866 - RNA, 15 nt, Salmonella enterica enterica serovar Typhi
gcgcauucaccccag

SEQ ID NO: 3667867 - RNA, 19 nt, Salmonella enterica enterica serovar Typhi
gcgcauugcgcuauuacuc

SEQ ID NO: 3667868 - RNA, 17 nt, Salmonella enterica enterica serovar Typhi
gcgcauuucguggcgga

SEQ ID NO: 3667869 - RNA, 16 nt, Salmonella enterica enterica serovar Typhi
gcgcauuugcggcguc

SEQ ID NO: 3667870 - RNA, 17 nt, Salmonella enterica enterica serovar Typhi
gcgcauuuuacugccgu

SEQ ID NO: 3667871 - RNA, 17 nt, Salmonella enterica enterica serovar Typhi
gcgccaaaagaggcagc

SEQ ID NO: 3667872 - RNA, 18 nt, Salmonella enterica enterica serovar Typhi
gcgccaaaagaggcagca

SEQ ID NO: 3667873 - RNA, 18 nt, Salmonella enterica enterica serovar Typhi
gcgccaaacgggcaagcc

SEQ ID NO: 3667874 - RNA, 20 nt, Salmonella enterica enterica serovar Typhi
gcgccaaagcaaucgccagc

SEQ ID NO: 3667875 - RNA, 20 nt, Salmonella enterica enterica serovar Typhi
gcgccaacgccacugccaua

SEQ ID NO: 3667876 - RNA, 16 nt, Salmonella enterica enterica serovar Typhi
gcgccaagaccgccua

SEQ ID NO: 3667877 - RNA, 15 nt, Salmonella enterica enterica serovar Typhi
gcgccaagcggcaac

SEQ ID NO: 3667878 - RNA, 17 nt, Salmonella enterica enterica serovar Typhi
gcgccaaugcgaaaaua

SEQ ID NO: 3667879 - RNA, 20 nt, Salmonella enterica enterica serovar Typhi
gcgccaauggcgaucuuuug

SEQ ID NO: 3667880 - RNA, 13 nt, Salmonella enterica enterica serovar Typhi
gcgccaccacuga

SEQ ID NO: 3667881 - RNA, 22 nt, Salmonella enterica enterica serovar Typhi
gcgccaccgggcaacacacgcu

SEQ ID NO: 3667882 - RNA, 23 nt, Salmonella enterica enterica serovar Typhi
gcgccaccuuaaucgacuucaug

SEQ ID NO: 3667883 - RNA, 13 nt, Salmonella enterica enterica serovar Typhi
gcgccacgcagcg

SEQ ID NO: 3667884 - RNA, 19 nt, Salmonella enterica enterica serovar Typhi
gcgccacgccaccgggccg

SEQ ID NO: 3667885 - RNA, 18 nt, Salmonella enterica enterica serovar Typhi
gcgccacgcgccagccgu

SEQ ID NO: 3667886 - RNA, 16 nt, Salmonella enterica enterica serovar Typhi
gcgccacuuccagcgc

SEQ ID NO: 3667887 - RNA, 22 nt, Salmonella enterica enterica serovar Typhi
gcgccacuuccagcgcgccguc

SEQ ID NO: 3667888 - RNA, 17 nt, Salmonella enterica enterica serovar Typhi
gcgccacuuuuccggca

SEQ ID NO: 3667889 - RNA, 13 nt, Salmonella enterica enterica serovar Typhi
gcgccagaggcgu

SEQ ID NO: 3667890 - RNA, 11 nt, Salmonella enterica enterica serovar Typhi
gcgccagcaug

SEQ ID NO: 3667891 - RNA, 12 nt, Salmonella enterica enterica serovar Typhi
gcgccagccagc

SEQ ID NO: 3667892 - RNA, 19 nt, Salmonella enterica enterica serovar Typhi
gcgccagccagcgccacca

SEQ ID NO: 3667893 - RNA, 13 nt, Salmonella enterica enterica serovar Typhi
gcgccagccagcu

SEQ ID NO: 3667894 - RNA, 16 nt, Salmonella enterica enterica serovar Typhi
gcgccagccagucgcc

SEQ ID NO: 3667895 - RNA, 18 nt, Salmonella enterica enterica serovar Typhi
gcgccagccagucgccag

SEQ ID NO: 3667896 - RNA, 22 nt, Salmonella enterica enterica serovar Typhi
gcgccagccagucgccaggcaa

SEQ ID NO: 3667897 - RNA, 15 nt, Salmonella enterica enterica serovar Typhi
gcgccagcccggcga

SEQ ID NO: 3667898 - RNA, 17 nt, Salmonella enterica enterica serovar Typhi
gcgccagccgcgccauc

SEQ ID NO: 3667899 - RNA, 21 nt, Salmonella enterica enterica serovar Typhi
gcgccagccgcgccaucuccu

SEQ ID NO: 3667900 - RNA, 15 nt, Salmonella enterica enterica serovar Typhi
gcgccagccggauac

SEQ ID NO: 3667901 - RNA, 12 nt, Salmonella enterica enterica serovar Typhi
gcgccagccguu

SEQ ID NO: 3667902 - RNA, 13 nt, Salmonella enterica enterica serovar Typhi
gcgccagcgccac

SEQ ID NO: 3667903 - RNA, 18 nt, Salmonella enterica enterica serovar Typhi
gcgccagcgcuacccgcu

SEQ ID NO: 3667904 - RNA, 14 nt, Salmonella enterica enterica serovar Typhi
gcgccagcggcggc

SEQ ID NO: 3667905 - RNA, 19 nt, Salmonella enterica enterica serovar Typhi
gcgccagcguaaucggcag

SEQ ID NO: 3667906 - RNA, 17 nt, Salmonella enterica enterica serovar Typhi
gcgccagcgugcuaagc

SEQ ID NO: 3667907 - RNA, 22 nt, Salmonella enterica enterica serovar Typhi
gcgccagcuccauagaaaucag

SEQ ID NO: 3667908 - RNA, 22 nt, Salmonella enterica enterica serovar Typhi
gcgccagcugcgucaugucguu

SEQ ID NO: 3667909 - RNA, 12 nt, Salmonella enterica enterica serovar Typhi
gcgccaggccau

SEQ ID NO: 3667910 - RNA, 17 nt, Salmonella enterica enterica serovar Typhi
gcgccaggcccagccgc

SEQ ID NO: 3667911 - RNA, 16 nt, Salmonella enterica enterica serovar Typhi
gcgccaguaaucggcg

SEQ ID NO: 3667912 - RNA, 20 nt, Salmonella enterica enterica serovar Typhi
gcgccaguaaugccgugccg

SEQ ID NO: 3667913 - RNA, 16 nt, Salmonella enterica enterica serovar Typhi
gcgccagugacgccag

SEQ ID NO: 3667914 - RNA, 23 nt, Salmonella enterica enterica serovar Typhi
gcgccaguuggcguaccaucagc

SEQ ID NO: 3667915 - RNA, 14 nt, Salmonella enterica enterica serovar Typhi
gcgccaguuuuucc

SEQ ID NO: 3667916 - RNA, 16 nt, Salmonella enterica enterica serovar Typhi
gcgccauauccgcaga

SEQ ID NO: 3667917 - RNA, 21 nt, Salmonella enterica enterica serovar Typhi
gcgccauauugcuguauuuua

SEQ ID NO: 3667918 - RNA, 18 nt, Salmonella enterica enterica serovar Typhi
gcgccaucagacucucaa

SEQ ID NO: 3667919 - RNA, 13 nt, Salmonella enterica enterica serovar Typhi
gcgccaucaggca

SEQ ID NO: 3667920 - RNA, 14 nt, Salmonella enterica enterica serovar Typhi
gcgccaucaggcau

SEQ ID NO: 3667921 - RNA, 18 nt, Salmonella enterica enterica serovar Typhi
gcgccaucaggcaucuga

SEQ ID NO: 3667922 - RNA, 13 nt, Salmonella enterica enterica serovar Typhi
gcgccaucauccg

SEQ ID NO: 3667923 - RNA, 14 nt, Salmonella enterica enterica serovar Typhi
gcgccaucaugcag

SEQ ID NO: 3667924 - RNA, 20 nt, Salmonella enterica enterica serovar Typhi
gcgccauccaccaggcaugc

SEQ ID NO: 3667925 - RNA, 13 nt, Salmonella enterica enterica serovar Typhi
gcgccauccggca

SEQ ID NO: 3667926 - RNA, 16 nt, Salmonella enterica enterica serovar Typhi
gcgccauccggcacau

SEQ ID NO: 3667927 - RNA, 14 nt, Salmonella enterica enterica serovar Typhi
gcgccauccggcau

SEQ ID NO: 3667928 - RNA, 14 nt, Salmonella enterica enterica serovar Typhi
gcgccaucuccucc

SEQ ID NO: 3667929 - RNA, 17 nt, Salmonella enterica enterica serovar Typhi
gcgccaucuccuccuca

SEQ ID NO: 3667930 - RNA, 13 nt, Salmonella enterica enterica serovar Typhi
gcgccaugaagau

SEQ ID NO: 3667931 - RNA, 23 nt, Salmonella enterica enterica serovar Typhi
gcgccaugaucgauagcgacggc

SEQ ID NO: 3667932 - RNA, 20 nt, Salmonella enterica enterica serovar Typhi
gcgccauggcuucuccuuca

SEQ ID NO: 3667933 - RNA, 19 nt, Salmonella enterica enterica serovar Typhi
gcgccauguucauaaagug

SEQ ID NO: 3667934 - RNA, 21 nt, Salmonella enterica enterica serovar Typhi
gcgccauguucauaccggaua

SEQ ID NO: 3667935 - RNA, 18 nt, Salmonella enterica enterica serovar Typhi
gcgccauuaacgcgguga

SEQ ID NO: 3667936 - RNA, 19 nt, Salmonella enterica enterica serovar Typhi
gcgccauuccugccgccgc

SEQ ID NO: 3667937 - RNA, 20 nt, Salmonella enterica enterica serovar Typhi
gcgccauuccugccgccgca

SEQ ID NO: 3667938 - RNA, 16 nt, Salmonella enterica enterica serovar Typhi
gcgccauugagcauuc

SEQ ID NO: 3667939 - RNA, 16 nt, Salmonella enterica enterica serovar Typhi
gcgcccagccaaagcg

SEQ ID NO: 3667940 - RNA, 12 nt, Salmonella enterica enterica serovar Typhi
gcgcccagcgcc

SEQ ID NO: 3667941 - RNA, 12 nt, Salmonella enterica enterica serovar Typhi
gcgcccaggcca

SEQ ID NO: 3667942 - RNA, 13 nt, Salmonella enterica enterica serovar Typhi
gcgcccaggccaa

SEQ ID NO: 3667943 - RNA, 20 nt, Salmonella enterica enterica serovar Typhi
gcgcccauuccgccugccgc

SEQ ID NO: 3667944 - RNA, 23 nt, Salmonella enterica enterica serovar Typhi
gcgccccagcaugagccagcccu

SEQ ID NO: 3667945 - RNA, 12 nt, Salmonella enterica enterica serovar Typhi
gcgccccgccgc

SEQ ID NO: 3667946 - RNA, 18 nt, Salmonella enterica enterica serovar Typhi
gcgccccgccgcgcggcc

SEQ ID NO: 3667947 - RNA, 14 nt, Salmonella enterica enterica serovar Typhi
gcgccccggcggcg

SEQ ID NO: 3667948 - RNA, 18 nt, Salmonella enterica enterica serovar Typhi
gcgcgaauaaugcguccg

SEQ ID NO: 3667949 - RNA, 20 nt, Salmonella enterica enterica serovar Typhi
gcgcgaaucgacaauccgcc

SEQ ID NO: 3667950 - RNA, 22 nt, Salmonella enterica enterica serovar Typhi
gcgcgacaauauucacgcgaau

SEQ ID NO: 3667951 - RNA, 22 nt, Salmonella enterica enterica serovar Typhi
gcgcgacauccgcuuuugguuu

SEQ ID NO: 3667952 - RNA, 20 nt, Salmonella enterica enterica serovar Typhi
gcgcgacgacgccagccagc

SEQ ID NO: 3667953 - RNA, 21 nt, Salmonella enterica enterica serovar Typhi
gcgcgacgacgccagccagcc

SEQ ID NO: 3667954 - RNA, 12 nt, Salmonella enterica enterica serovar Typhi
gcgcgacgccga

SEQ ID NO: 3667955 - RNA, 15 nt, Salmonella enterica enterica serovar Typhi
gcgcgacgccgcaua

SEQ ID NO: 3667956 - RNA, 18 nt, Salmonella enterica enterica serovar Typhi
gcgcgacgguaaggcuau

SEQ ID NO: 3667957 - RNA, 21 nt, Salmonella enterica enterica serovar Typhi
gcgcgacuuuaaucaccugcc

SEQ ID NO: 3667958 - RNA, 21 nt, Salmonella enterica enterica serovar Typhi
gcgcgagaaguucucacccau

SEQ ID NO: 3667959 - RNA, 14 nt, Salmonella enterica enterica serovar Typhi
gcgcgagagucaag

SEQ ID NO: 3667960 - RNA, 14 nt, Salmonella enterica enterica serovar Typhi
gcgcgauacgcagc

SEQ ID NO: 3667961 - RNA, 17 nt, Salmonella enterica enterica serovar Typhi
gcgcgauacgcgacggc

SEQ ID NO: 3667962 - RNA, 17 nt, Salmonella enterica enterica serovar Typhi
gcgcgauauccaccuga

SEQ ID NO: 3667963 - RNA, 20 nt, Salmonella enterica enterica serovar Typhi
gcgcgaucucuuuggccagu

SEQ ID NO: 3667964 - RNA, 22 nt, Salmonella enterica enterica serovar Typhi
gcgcgcacaacgugcaaaacag

SEQ ID NO: 3667965 - RNA, 15 nt, Salmonella enterica enterica serovar Typhi
gcgcgcacgcgggcc

SEQ ID NO: 3667966 - RNA, 19 nt, Salmonella enterica enterica serovar Typhi
gcgcgcagaccacgaauca

SEQ ID NO: 3667967 - RNA, 21 nt, Salmonella enterica enterica serovar Typhi
gcgcgcagaccacgaaucagg

SEQ ID NO: 3667968 - RNA, 19 nt, Salmonella enterica enterica serovar Typhi
gcgcgcagaguguaggccu

SEQ ID NO: 3667969 - RNA, 19 nt, Salmonella enterica enterica serovar Typhi
gcgcgcaucgggccguccg

SEQ ID NO: 3667970 - RNA, 18 nt, Salmonella enterica enterica serovar Typhi
gcgcgccaaacggcagcu

SEQ ID NO: 3667971 - RNA, 23 nt, Salmonella enterica enterica serovar Typhi
gcgcgccaaaguuaaucagcgcc

SEQ ID NO: 3667972 - RNA, 22 nt, Salmonella enterica enterica serovar Typhi
gcgcgccagcgauuccgucagg

SEQ ID NO: 3667973 - RNA, 20 nt, Salmonella enterica enterica serovar Typhi
gcgcgccaguaaucggcgcg

SEQ ID NO: 3667974 - RNA, 15 nt, Salmonella enterica enterica serovar Typhi
gcgcgccaguuuggu

SEQ ID NO: 3667975 - RNA, 15 nt, Salmonella enterica enterica serovar Typhi
gcgcgcccgacgcgc

SEQ ID NO: 3667976 - RNA, 18 nt, Salmonella enterica enterica serovar Typhi
gcgcgcccgccaccagca

SEQ ID NO: 3667977 - RNA, 16 nt, Salmonella enterica enterica serovar Typhi
gcgcgcccugcgggcc

SEQ ID NO: 3667978 - RNA, 13 nt, Salmonella enterica enterica serovar Typhi
gcgcgccgacagg

SEQ ID NO: 3667979 - RNA, 12 nt, Salmonella enterica enterica serovar Typhi
gcgcgccgcagc

SEQ ID NO: 3667980 - RNA, 13 nt, Salmonella enterica enterica serovar Typhi
gcgcgccgccaac

SEQ ID NO: 3667981 - RNA, 14 nt, Salmonella enterica enterica serovar Typhi
gcgcgccgcccugc

SEQ ID NO: 3667982 - RNA, 12 nt, Salmonella enterica enterica serovar Typhi
gcgcgccgccug

SEQ ID NO: 3667983 - RNA, 11 nt, Salmonella enterica enterica serovar Typhi
gcgcgccgcgc

SEQ ID NO: 3667984 - RNA, 13 nt, Salmonella enterica enterica serovar Typhi
gcgcgccggugau

SEQ ID NO: 3667985 - RNA, 20 nt, Salmonella enterica enterica serovar Typhi
gcgcgccggugaucccacca

SEQ ID NO: 3667986 - RNA, 14 nt, Salmonella enterica enterica serovar Typhi
gcgcgccugccgcc

SEQ ID NO: 3667987 - RNA, 17 nt, Salmonella enterica enterica serovar Typhi
gcgcgccuuccagcaau

SEQ ID NO: 3667988 - RNA, 20 nt, Salmonella enterica enterica serovar Typhi
gcgcgccuucgaaccgggua

SEQ ID NO: 3667989 - RNA, 17 nt, Salmonella enterica enterica serovar Typhi
gcgcgcgaaaagaaacu

SEQ ID NO: 3667990 - RNA, 14 nt, Salmonella enterica enterica serovar Typhi
gcgcgcgaugcugc

SEQ ID NO: 3667991 - RNA, 18 nt, Salmonella enterica enterica serovar Typhi
gcgcgcgaugguaggccu

SEQ ID NO: 3667992 - RNA, 22 nt, Salmonella enterica enterica serovar Typhi
gcgcgcggaacuuuaucaccag

SEQ ID NO: 3667993 - RNA, 21 nt, Salmonella enterica enterica serovar Typhi
gcgcgcggauauggcggcggc

SEQ ID NO: 3667994 - RNA, 13 nt, Salmonella enterica enterica serovar Typhi
gcgcgcugagcgg

SEQ ID NO: 3667995 - RNA, 15 nt, Salmonella enterica enterica serovar Typhi
gcgcgcugccgcccu

SEQ ID NO: 3667996 - RNA, 16 nt, Salmonella enterica enterica serovar Typhi
gcgcgcugcgccugga

SEQ ID NO: 3667997 - RNA, 12 nt, Salmonella enterica enterica serovar Typhi
gcgcgcuggagg

SEQ ID NO: 3667998 - RNA, 13 nt, Salmonella enterica enterica serovar Typhi
gcgcgcuggcaag

SEQ ID NO: 3667999 - RNA, 16 nt, Salmonella enterica enterica serovar Typhi
gcgcgcuggugucgcc

SEQ ID NO: 3668000 - RNA, 19 nt, Salmonella enterica enterica serovar Typhi
gcgcgcuucguuuuccgca

SEQ ID NO: 3668001 - RNA, 15 nt, Salmonella enterica enterica serovar Typhi
gcgcgcuucuucaug

SEQ ID NO: 3668002 - RNA, 22 nt, Salmonella enterica enterica serovar Typhi
gcgcggaacuuuaucaccagcg

SEQ ID NO: 3668003 - RNA, 24 nt, Salmonella enterica enterica serovar Typhi
gcgcggaaggcgccucgcgcggcg

SEQ ID NO: 3668004 - RNA, 17 nt, Salmonella enterica enterica serovar Typhi
gcgcggauauggcggcg

SEQ ID NO: 3668005 - RNA, 19 nt, Salmonella enterica enterica serovar Typhi
gcgcggauauggcggcggc

SEQ ID NO: 3668006 - RNA, 23 nt, Salmonella enterica enterica serovar Typhi
gcgcggcacacaacacggcggcu

SEQ ID NO: 3668007 - RNA, 15 nt, Salmonella enterica enterica serovar Typhi
gcgcggcagaccggc

SEQ ID NO: 3668008 - RNA, 11 nt, Salmonella enterica enterica serovar Typhi
gcgcggcagca

SEQ ID NO: 3668009 - RNA, 13 nt, Salmonella enterica enterica serovar Typhi
gcgcggcagccgg

SEQ ID NO: 3668010 - RNA, 14 nt, Salmonella enterica enterica serovar Typhi
gcgcggcagcgcgc

SEQ ID NO: 3668011 - RNA, 16 nt, Salmonella enterica enterica serovar Typhi
gcgcggcagcgcgcac

SEQ ID NO: 3668012 - RNA, 20 nt, Salmonella enterica enterica serovar Typhi
gcgcggcaggccuuucggca

SEQ ID NO: 3668013 - RNA, 23 nt, Salmonella enterica enterica serovar Typhi
gcgcggcaggccuuucggcagcg

SEQ ID NO: 3668014 - RNA, 14 nt, Salmonella enterica enterica serovar Typhi
gcgcggcaucgccg

SEQ ID NO: 3668015 - RNA, 21 nt, Salmonella enterica enterica serovar Typhi
gcgcggcaucgccgcccagug

SEQ ID NO: 3668016 - RNA, 19 nt, Salmonella enterica enterica serovar Typhi
gcgcggcccauucaacggg

SEQ ID NO: 3668017 - RNA, 16 nt, Salmonella enterica enterica serovar Typhi
gcgcggccccaucagc

SEQ ID NO: 3668018 - RNA, 20 nt, Salmonella enterica enterica serovar Typhi
gcgcggccuuugccuucgcc

SEQ ID NO: 3668019 - RNA, 18 nt, Salmonella enterica enterica serovar Typhi
gcgcggcggguugaugau

SEQ ID NO: 3668020 - RNA, 17 nt, Salmonella enterica enterica serovar Typhi
gcgcggcguacacuuca

SEQ ID NO: 3668021 - RNA, 14 nt, Salmonella enterica enterica serovar Typhi
gcgcggcguucugc

SEQ ID NO: 3668022 - RNA, 19 nt, Salmonella enterica enterica serovar Typhi
gcgcggcuaccggacugcu

SEQ ID NO: 3668023 - RNA, 15 nt, Salmonella enterica enterica serovar Typhi
gcgcggggaacacac

SEQ ID NO: 3668024 - RNA, 12 nt, Salmonella enterica enterica serovar Typhi
gcgcggguugcc

SEQ ID NO: 3668025 - RNA, 20 nt, Salmonella enterica enterica serovar Typhi
gcgcgguauuucgccgccgc

SEQ ID NO: 3668026 - RNA, 20 nt, Salmonella enterica enterica serovar Typhi
gcgcggucauucguacguuu

SEQ ID NO: 3668027 - RNA, 18 nt, Salmonella enterica enterica serovar Typhi
gcgcggucgcuucgccuu

SEQ ID NO: 3668028 - RNA, 21 nt, Salmonella enterica enterica serovar Typhi
gcgcgguggcuuuuuccugcc

SEQ ID NO: 3668029 - RNA, 17 nt, Salmonella enterica enterica serovar Typhi
gcgcgguuuauccccgc

SEQ ID NO: 3668030 - RNA, 15 nt, Salmonella enterica enterica serovar Typhi
gcgcgguuuccggua

SEQ ID NO: 3668031 - RNA, 15 nt, Salmonella enterica enterica serovar Typhi
gcgcguaaauaccuu

SEQ ID NO: 3668032 - RNA, 21 nt, Salmonella enterica enterica serovar Typhi
gcgcguaaauccuccaucaug

SEQ ID NO: 3668033 - RNA, 15 nt, Salmonella enterica enterica serovar Typhi
gcgcguaauuccgca

SEQ ID NO: 3668034 - RNA, 15 nt, Salmonella enterica enterica serovar Typhi
gcgcuguacggacau

SEQ ID NO: 3668035 - RNA, 17 nt, Salmonella enterica enterica serovar Typhi
gcgcugucaccagcagc

SEQ ID NO: 3668036 - RNA, 16 nt, Salmonella enterica enterica serovar Typhi
gcgcugucagugaaaa

SEQ ID NO: 3668037 - RNA, 19 nt, Salmonella enterica enterica serovar Typhi
gcgcugugcuaucaggccu

SEQ ID NO: 3668038 - RNA, 18 nt, Salmonella enterica enterica serovar Typhi
gcgcuguguccgccugcu

SEQ ID NO: 3668039 - RNA, 19 nt, Salmonella enterica enterica serovar Typhi
gcgcuguguccgccugcug

SEQ ID NO: 3668040 - RNA, 17 nt, Salmonella enterica enterica serovar Typhi
gcgcuguucuugcugcu

SEQ ID NO: 3668041 - RNA, 22 nt, Salmonella enterica enterica serovar Typhi
gcgcuguucuugcugcugcuga

SEQ ID NO: 3668042 - RNA, 23 nt, Salmonella enterica enterica serovar Typhi
gcgcuguuuauccacaggcgacu

SEQ ID NO: 3668043 - RNA, 22 nt, Salmonella enterica enterica serovar Typhi
gcgcuuaccgggccgacaggcg

SEQ ID NO: 3668044 - RNA, 15 nt, Salmonella enterica enterica serovar Typhi
gcgcuuaucaggccu

SEQ ID NO: 3668045 - RNA, 19 nt, Salmonella enterica enterica serovar Typhi
gcgcuuaucaggccuacaa

SEQ ID NO: 3668046 - RNA, 22 nt, Salmonella enterica enterica serovar Typhi
gcgcuuaucaggccuaccagcc

SEQ ID NO: 3668047 - RNA, 14 nt, Salmonella enterica enterica serovar Typhi
gcgcuuauccggcc

SEQ ID NO: 3668048 - RNA, 22 nt, Salmonella enterica enterica serovar Typhi
gcgcuuaucgccguaaccgccu

SEQ ID NO: 3668049 - RNA, 17 nt, Salmonella enterica enterica serovar Typhi
gcgcuuccagacuacgg

SEQ ID NO: 3668050 - RNA, 16 nt, Salmonella enterica enterica serovar Typhi
gcgcuuccugcagugg

SEQ ID NO: 3668051 - RNA, 17 nt, Salmonella enterica enterica serovar Typhi
gcgcuuccugcagugga

SEQ ID NO: 3668052 - RNA, 16 nt, Salmonella enterica enterica serovar Typhi
gcgcuucgccugccgg

SEQ ID NO: 3668053 - RNA, 20 nt, Salmonella enterica enterica serovar Typhi
gcgcuucgcuuaucaggccu

SEQ ID NO: 3668054 - RNA, 19 nt, Salmonella enterica enterica serovar Typhi
gcgcuucgcuugcccggcc

SEQ ID NO: 3668055 - RNA, 17 nt, Salmonella enterica enterica serovar Typhi
gcgcuucugauuauuga

SEQ ID NO: 3668056 - RNA, 22 nt, Salmonella enterica enterica serovar Typhi
gcgcuugcauggcagccccggc

SEQ ID NO: 3668057 - RNA, 15 nt, Salmonella enterica enterica serovar Typhi
gcgcuugcauugcuc

SEQ ID NO: 3668058 - RNA, 16 nt, Salmonella enterica enterica serovar Typhi
gcgcuuguaaauugcg

SEQ ID NO: 3668059 - RNA, 21 nt, Salmonella enterica enterica serovar Typhi
gcgcuuuacugucgcuggaua

SEQ ID NO: 3668060 - RNA, 18 nt, Salmonella enterica enterica serovar Typhi
gcgcuuucaccgccucau

SEQ ID NO: 3668061 - RNA, 15 nt, Salmonella enterica enterica serovar Typhi
gcgcuuucuucuuca

SEQ ID NO: 3668062 - RNA, 18 nt, Salmonella enterica enterica serovar Typhi
gcgcuuugccgcugcugc

SEQ ID NO: 3668063 - RNA, 20 nt, Salmonella enterica enterica serovar Typhi
gcgcuuugcuuauccggccu

SEQ ID NO: 3668064 - RNA, 23 nt, Salmonella enterica enterica serovar Typhi
gcgcuuuuaauugcgcaucaagc

SEQ ID NO: 3668065 - RNA, 14 nt, Salmonella enterica enterica serovar Typhi
gcgcuuuuccagca

SEQ ID NO: 3668066 - RNA, 22 nt, Salmonella enterica enterica serovar Typhi
gcgcuuuuugcuucgccaucuc

SEQ ID NO: 3668067 - RNA, 20 nt, Salmonella enterica enterica serovar Typhi
gcgcuuuuuuuacgccugaa

SEQ ID NO: 3668068 - RNA, 14 nt, Salmonella enterica enterica serovar Typhi
gcggaaaaaagcag

SEQ ID NO: 3668069 - RNA, 21 nt, Salmonella enterica enterica serovar Typhi
gcggaaagcauucgcagcaga

SEQ ID NO: 3668070 - RNA, 22 nt, Salmonella enterica enterica serovar Typhi
gcggaaagcauucgcagcagac

SEQ ID NO: 3668071 - RNA, 21 nt, Salmonella enterica enterica serovar Typhi
gcggaaaggacguucuucucc

SEQ ID NO: 3668072 - RNA, 17 nt, Salmonella enterica enterica serovar Typhi
gcggaacaccagcgccg

SEQ ID NO: 3668073 - RNA, 23 nt, Salmonella enterica enterica serovar Typhi
gcggaaccauuuuccccagaauc

SEQ ID NO: 3668074 - RNA, 18 nt, Salmonella enterica enterica serovar Typhi
gcggaacggcgagcuuua

SEQ ID NO: 3668075 - RNA, 23 nt, Salmonella enterica enterica serovar Typhi
gcggaagaggcgccuggcaccau

SEQ ID NO: 3668076 - RNA, 21 nt, Salmonella enterica enterica serovar Typhi
gcggaagccacguucuuccag

SEQ ID NO: 3668077 - RNA, 15 nt, Salmonella enterica enterica serovar Typhi
gcggaagcgaccggc

SEQ ID NO: 3668078 - RNA, 22 nt, Salmonella enterica enterica serovar Typhi
gcggaaggcgccucgcgcggcg

SEQ ID NO: 3668079 - RNA, 18 nt, Salmonella enterica enterica serovar Typhi
gcggaauaucuucccgac

SEQ ID NO: 3668080 - RNA, 17 nt, Salmonella enterica enterica serovar Typhi
gcggaauccaucccccu

SEQ ID NO: 3668081 - RNA, 21 nt, Salmonella enterica enterica serovar Typhi
gcggaauccaucccccugccg

SEQ ID NO: 3668082 - RNA, 16 nt, Salmonella enterica enterica serovar Typhi
gcggaaucgcuuccug

SEQ ID NO: 3668083 - RNA, 17 nt, Salmonella enterica enterica serovar Typhi
gcggaaucuccggcgaa

SEQ ID NO: 3668084 - RNA, 20 nt, Salmonella enterica enterica serovar Typhi
gcggaaugaccugagcgugc

SEQ ID NO: 3668085 - RNA, 22 nt, Salmonella enterica enterica serovar Typhi
gcggaaugcugguuaacgccgc

SEQ ID NO: 3668086 - RNA, 19 nt, Salmonella enterica enterica serovar Typhi
gcggaauugguagacgcgc

SEQ ID NO: 3668087 - RNA, 16 nt, Salmonella enterica enterica serovar Typhi
gcggaauuucaggaag

SEQ ID NO: 3668088 - RNA, 15 nt, Salmonella enterica enterica serovar Typhi
gcggacacccgcagc

SEQ ID NO: 3668089 - RNA, 12 nt, Salmonella enterica enterica serovar Typhi
gcggacagcggc

SEQ ID NO: 3668090 - RNA, 17 nt, Salmonella enterica enterica serovar Typhi
gcggacauuaacgccgc

SEQ ID NO: 3668091 - RNA, 12 nt, Salmonella enterica enterica serovar Typhi
gcggacgcagcu

SEQ ID NO: 3668092 - RNA, 16 nt, Salmonella enterica enterica serovar Typhi
gcggacgcugacgcca

SEQ ID NO: 3668093 - RNA, 14 nt, Salmonella enterica enterica serovar Typhi
gcggacugggcuga

SEQ ID NO: 3668094 - RNA, 17 nt, Salmonella enterica enterica serovar Typhi
gcggagaagacgccgcc

SEQ ID NO: 3668095 - RNA, 21 nt, Salmonella enterica enterica serovar Typhi
gcggagagaucgacagcgcgc

SEQ ID NO: 3668096 - RNA, 23 nt, Salmonella enterica enterica serovar Typhi
gcggagagaucgacagcgcgcgc

SEQ ID NO: 3668097 - RNA, 17 nt, Salmonella enterica enterica serovar Typhi
gcggagaucgcucccgc

SEQ ID NO: 3668098 - RNA, 16 nt, Salmonella enterica enterica serovar Typhi
gcggagccucuuccug

SEQ ID NO: 3668099 - RNA, 18 nt, Salmonella enterica enterica serovar Typhi
gcggaguuauacagugcc

SEQ ID NO: 3668100 - RNA, 21 nt, Salmonella enterica enterica serovar Typhi
gcggauaaauagugacgccgc

SEQ ID NO: 3668101 - RNA, 18 nt, Salmonella enterica enterica serovar Typhi
gcggauaaccgacgccgg

SEQ ID NO: 3668102 - RNA, 21 nt, Salmonella enterica enterica serovar Typhi
gcggauaagauagcaggcgau

SEQ ID NO: 3668103 - RNA, 15 nt, Salmonella enterica enterica serovar Typhi
gcggauaagcccggc

SEQ ID NO: 3668104 - RNA, 19 nt, Salmonella enterica enterica serovar Typhi
gcggauaagcgcagcgcca

SEQ ID NO: 3668105 - RNA, 20 nt, Salmonella enterica enterica serovar Typhi
gcggauaagcgcagcgccau

SEQ ID NO: 3668106 - RNA, 19 nt, Salmonella enterica enterica serovar Typhi
gcggauacagcggcgcgcc

SEQ ID NO: 3668107 - RNA, 17 nt, Salmonella enterica enterica serovar Typhi
gcggauaccggcgcagc

SEQ ID NO: 3668108 - RNA, 16 nt, Salmonella enterica enterica serovar Typhi
gcggauaguccugcgc

SEQ ID NO: 3668109 - RNA, 22 nt, Salmonella enterica enterica serovar Typhi
gcggauauauggcgggaaauca

SEQ ID NO: 3668110 - RNA, 15 nt, Salmonella enterica enterica serovar Typhi
gcggauaugcagcag

SEQ ID NO: 3668111 - RNA, 16 nt, Salmonella enterica enterica serovar Typhi
gcggauaugcagcagc

SEQ ID NO: 3668112 - RNA, 20 nt, Salmonella enterica enterica serovar Typhi
gcggaucgauaacgaccaga

SEQ ID NO: 3668113 - RNA, 19 nt, Salmonella enterica enterica serovar Typhi
gcggaucgugaggauaauc

SEQ ID NO: 3668114 - RNA, 20 nt, Salmonella enterica enterica serovar Typhi
gcggaucgugauaacgcgau

SEQ ID NO: 3668115 - RNA, 16 nt, Salmonella enterica enterica serovar Typhi
gcggaucuucaccacg

SEQ ID NO: 3668116 - RNA, 17 nt, Salmonella enterica enterica serovar Typhi
gcggaugaucgccucuu

SEQ ID NO: 3668117 - RNA, 21 nt, Salmonella enterica enterica serovar Typhi
gcggaugcgccauccaccagg

SEQ ID NO: 3668118 - RNA, 22 nt, Salmonella enterica enterica serovar Typhi
gcggauggaauuuugcaccauc

SEQ ID NO: 3668119 - RNA, 14 nt, Salmonella enterica enterica serovar Typhi
gcggcguaaacgcc

SEQ ID NO: 3668120 - RNA, 23 nt, Salmonella enterica enterica serovar Typhi
gcggcguaaacgccuuauccgac

SEQ ID NO: 3668121 - RNA, 19 nt, Salmonella enterica enterica serovar Typhi
gcggcguacacuucauccg

SEQ ID NO: 3668122 - RNA, 21 nt, Salmonella enterica enterica serovar Typhi
gcggcguacacuucauccggc

SEQ ID NO: 3668123 - RNA, 14 nt, Salmonella enterica enterica serovar Typhi
gcggcguaccgcgc

SEQ ID NO: 3668124 - RNA, 17 nt, Salmonella enterica enterica serovar Typhi
gcggcgucugcaccggu

SEQ ID NO: 3668125 - RNA, 15 nt, Salmonella enterica enterica serovar Typhi
gcggcgugaacgccu

SEQ ID NO: 3668126 - RNA, 16 nt, Salmonella enterica enterica serovar Typhi
gcggcgugaccgccuu

SEQ ID NO: 3668127 - RNA, 17 nt, Salmonella enterica enterica serovar Typhi
gcggcgugaccgccuua

SEQ ID NO: 3668128 - RNA, 20 nt, Salmonella enterica enterica serovar Typhi
gcggcgugaugccagccaua

SEQ ID NO: 3668129 - RNA, 16 nt, Salmonella enterica enterica serovar Typhi
gcggcuaauacgccag

SEQ ID NO: 3668130 - RNA, 20 nt, Salmonella enterica enterica serovar Typhi
gcggcuaaucaccaccucaa

SEQ ID NO: 3668131 - RNA, 17 nt, Salmonella enterica enterica serovar Typhi
gcggcuaccggacugcu

SEQ ID NO: 3668132 - RNA, 19 nt, Salmonella enterica enterica serovar Typhi
gcggcuacgccugauaagc

SEQ ID NO: 3668133 - RNA, 20 nt, Salmonella enterica enterica serovar Typhi
gcggcuacgccuuacccgac

SEQ ID NO: 3668134 - RNA, 19 nt, Salmonella enterica enterica serovar Typhi
gcggcuagcgccuuauccg

SEQ ID NO: 3668135 - RNA, 16 nt, Salmonella enterica enterica serovar Typhi
gcggcugacacucauc

SEQ ID NO: 3668136 - RNA, 12 nt, Salmonella enterica enterica serovar Typhi
gcggcugaugca

SEQ ID NO: 3668137 - RNA, 12 nt, Salmonella enterica enterica serovar Typhi
gcggcugcgccu

SEQ ID NO: 3668138 - RNA, 21 nt, Salmonella enterica enterica serovar Typhi
gcggcugguaagagagccuua

SEQ ID NO: 3668139 - RNA, 14 nt, Salmonella enterica enterica serovar Typhi
gcggcuuacccuga

SEQ ID NO: 3668140 - RNA, 12 nt, Salmonella enterica enterica serovar Typhi
gcggcuuauccg

SEQ ID NO: 3668141 - RNA, 22 nt, Salmonella enterica enterica serovar Typhi
gcggcuugaguuuuccgccauu

SEQ ID NO: 3668142 - RNA, 22 nt, Salmonella enterica enterica serovar Typhi
gcggcuugucauccugcucauc

SEQ ID NO: 3668143 - RNA, 20 nt, Salmonella enterica enterica serovar Typhi
gcggcuuuaaugccgccgua

SEQ ID NO: 3668144 - RNA, 16 nt, Salmonella enterica enterica serovar Typhi
gcggcuuuacccggcg

SEQ ID NO: 3668145 - RNA, 13 nt, Salmonella enterica enterica serovar Typhi
gcggcuuuuucau

SEQ ID NO: 3668146 - RNA, 16 nt, Salmonella enterica enterica serovar Typhi
gcgggaaaagcguccg

SEQ ID NO: 3668147 - RNA, 20 nt, Salmonella enterica enterica serovar Typhi
gcgggaaauaccauccgcgc

SEQ ID NO: 3668148 - RNA, 15 nt, Salmonella enterica enterica serovar Typhi
gcgggaaaucguccg

SEQ ID NO: 3668149 - RNA, 14 nt, Salmonella enterica enterica serovar Typhi
gcgggaaugcgcgc

SEQ ID NO: 3668150 - RNA, 18 nt, Salmonella enterica enterica serovar Typhi
gcgggaaugcgcgcguga

SEQ ID NO: 3668151 - RNA, 21 nt, Salmonella enterica enterica serovar Typhi
gcgggagauggcguggccaag

SEQ ID NO: 3668152 - RNA, 17 nt, Salmonella enterica enterica serovar Typhi
gcgggauacucggcacc

SEQ ID NO: 3668153 - RNA, 22 nt, Salmonella enterica enterica serovar Typhi
gcgggauaucgcuggucggcug

SEQ ID NO: 3668154 - RNA, 19 nt, Salmonella enterica enterica serovar Typhi
gcgggaugcguaauccggc

SEQ ID NO: 3668155 - RNA, 21 nt, Salmonella enterica enterica serovar Typhi
gcgggaugcuauaccgcccgc

SEQ ID NO: 3668156 - RNA, 18 nt, Salmonella enterica enterica serovar Typhi
gcgggauggccgccgagc

SEQ ID NO: 3668157 - RNA, 17 nt, Salmonella enterica enterica serovar Typhi
gcgggcaauuccgguca

SEQ ID NO: 3668158 - RNA, 19 nt, Salmonella enterica enterica serovar Typhi
gcgggcagaaaaaucagca

SEQ ID NO: 3668159 - RNA, 18 nt, Salmonella enterica enterica serovar Typhi
gcgggcagccuucaaguu

SEQ ID NO: 3668160 - RNA, 21 nt, Salmonella enterica enterica serovar Typhi
gcgggcauauucuggcgacgg

SEQ ID NO: 3668161 - RNA, 13 nt, Salmonella enterica enterica serovar Typhi
gcgggccgucagg

SEQ ID NO: 3668162 - RNA, 19 nt, Salmonella enterica enterica serovar Typhi
gcgggcguauagccaggca

SEQ ID NO: 3668163 - RNA, 18 nt, Salmonella enterica enterica serovar Typhi
gcgggcuaugcugaagca

SEQ ID NO: 3668164 - RNA, 23 nt, Salmonella enterica enterica serovar Typhi
gcgggcugccccagacgcccuuc

SEQ ID NO: 3668165 - RNA, 16 nt, Salmonella enterica enterica serovar Typhi
gcgggcuuauccccau

SEQ ID NO: 3668166 - RNA, 13 nt, Salmonella enterica enterica serovar Typhi
gcggggaaacucu

SEQ ID NO: 3668167 - RNA, 14 nt, Salmonella enterica enterica serovar Typhi
gcggggaacaccca

SEQ ID NO: 3668168 - RNA, 17 nt, Salmonella enterica enterica serovar Typhi
gcggggauaaucagcag

SEQ ID NO: 3668169 - RNA, 13 nt, Salmonella enterica enterica serovar Typhi
gcggguaaacaga

SEQ ID NO: 3668170 - RNA, 19 nt, Salmonella enterica enterica serovar Typhi
gcggguaaacucacccagg

SEQ ID NO: 3668171 - RNA, 21 nt, Salmonella enterica enterica serovar Typhi
gcggguaaacucacccaggcg

SEQ ID NO: 3668172 - RNA, 21 nt, Salmonella enterica enterica serovar Typhi
gcggguaauuugcgccaucgc

SEQ ID NO: 3668173 - RNA, 16 nt, Salmonella enterica enterica serovar Typhi
gcggguagucccagga

SEQ ID NO: 3668174 - RNA, 23 nt, Salmonella enterica enterica serovar Typhi
gcgggucaacgccaagcgcggca

SEQ ID NO: 3668175 - RNA, 22 nt, Salmonella enterica enterica serovar Typhi
gcgggucuggucgcucugcgca

SEQ ID NO: 3668176 - RNA, 13 nt, Salmonella enterica enterica serovar Typhi
gcgggugcgcagc

SEQ ID NO: 3668177 - RNA, 14 nt, Salmonella enterica enterica serovar Typhi
gcgggugcgcagcc

SEQ ID NO: 3668178 - RNA, 19 nt, Salmonella enterica enterica serovar Typhi
gcgggugcgcagccccagc

SEQ ID NO: 3668179 - RNA, 15 nt, Salmonella enterica enterica serovar Typhi
gcggguucccccacu

SEQ ID NO: 3668180 - RNA, 19 nt, Salmonella enterica enterica serovar Typhi
gcgguaaacaccaccgguu

SEQ ID NO: 3668181 - RNA, 16 nt, Salmonella enterica enterica serovar Typhi
gcgguaaggcaccggu

SEQ ID NO: 3668182 - RNA, 18 nt, Salmonella enterica enterica serovar Typhi
gcgguaauaacugacaga

SEQ ID NO: 3668183 - RNA, 13 nt, Salmonella enterica enterica serovar Typhi
gcgguaaucgcgc

SEQ ID NO: 3668184 - RNA, 16 nt, Salmonella enterica enterica serovar Typhi
gcgguaaucugccagc

SEQ ID NO: 3668185 - RNA, 21 nt, Salmonella enterica enterica serovar Typhi
gcgguaccggcauuacccagu

SEQ ID NO: 3668186 - RNA, 16 nt, Salmonella enterica enterica serovar Typhi
gcgguacgaaucgccg

SEQ ID NO: 3668187 - RNA, 20 nt, Salmonella enterica enterica serovar Typhi
gcgguagaaaguacaucauu

SEQ ID NO: 3668188 - RNA, 18 nt, Salmonella enterica enterica serovar Typhi
gcgguagagaacagcauc

SEQ ID NO: 3668189 - RNA, 23 nt, Salmonella enterica enterica serovar Typhi
gcgguagagaacagcaucaccgg

SEQ ID NO: 3668190 - RNA, 17 nt, Salmonella enterica enterica serovar Typhi
gcgguauaucacgccau

SEQ ID NO: 3668191 - RNA, 15 nt, Salmonella enterica enterica serovar Typhi
gcgguaugauacagu

SEQ ID NO: 3668192 - RNA, 23 nt, Salmonella enterica enterica serovar Typhi
gcgguaugcaccucuuuaugcgg

SEQ ID NO: 3668193 - RNA, 16 nt, Salmonella enterica enterica serovar Typhi
gcggucacaggcauac

SEQ ID NO: 3668194 - RNA, 17 nt, Salmonella enterica enterica serovar Typhi
gcggucaccuucggucc

SEQ ID NO: 3668195 - RNA, 13 nt, Salmonella enterica enterica serovar Typhi
gcggucaggccag

SEQ ID NO: 3668196 - RNA, 15 nt, Salmonella enterica enterica serovar Typhi
gcggucagggcuuac

SEQ ID NO: 3668197 - RNA, 16 nt, Salmonella enterica enterica serovar Typhi
gcggucaucgcccauc

SEQ ID NO: 3668198 - RNA, 19 nt, Salmonella enterica enterica serovar Typhi
gcgguccaauaaacgccag

SEQ ID NO: 3668199 - RNA, 19 nt, Salmonella enterica enterica serovar Typhi
gcggucgacagccacacgc

SEQ ID NO: 3668200 - RNA, 23 nt, Salmonella enterica enterica serovar Typhi
gcggucgauuuugccuucaauuc

SEQ ID NO: 3668201 - RNA, 14 nt, Salmonella enterica enterica serovar Typhi
gcggucgccgcaug

SEQ ID NO: 3668202 - RNA, 16 nt, Salmonella enterica enterica serovar Typhi
gcggucgcugauaauc

SEQ ID NO: 3668203 - RNA, 19 nt, Salmonella enterica enterica serovar Typhi
gcggucgcuuuuugcgcca

SEQ ID NO: 3668204 - RNA, 15 nt, Salmonella enterica enterica serovar Typhi
gcccuucaucuucca

SEQ ID NO: 3668205 - RNA, 15 nt, Salmonella enterica enterica serovar Typhi
gcccuuccagcagcc

SEQ ID NO: 3668206 - RNA, 17 nt, Salmonella enterica enterica serovar Typhi
gcccuuccgucagcguc

SEQ ID NO: 3668207 - RNA, 21 nt, Salmonella enterica enterica serovar Typhi
gcccuugaucggguuuuccug

SEQ ID NO: 3668208 - RNA, 18 nt, Salmonella enterica enterica serovar Typhi
gcccuugccgcuuccagu

SEQ ID NO: 3668209 - RNA, 15 nt, Salmonella enterica enterica serovar Typhi
gcccuuucagagcgu

SEQ ID NO: 3668210 - RNA, 11 nt, Salmonella enterica enterica serovar Typhi
gcccuuucuua

SEQ ID NO: 3668211 - RNA, 11 nt, Salmonella enterica enterica serovar Typhi
gcccuuuuguu

SEQ ID NO: 3668212 - RNA, 22 nt, Salmonella enterica enterica serovar Typhi
gcccuuuuugcauucgcuccuc

SEQ ID NO: 3668213 - RNA, 18 nt, Salmonella enterica enterica serovar Typhi
gccgaaagcgaucacauu

SEQ ID NO: 3668214 - RNA, 16 nt, Salmonella enterica enterica serovar Typhi
gccgaacucuuccacc

SEQ ID NO: 3668215 - RNA, 16 nt, Salmonella enterica enterica serovar Typhi
gccgaacuuacgguaa

SEQ ID NO: 3668216 - RNA, 22 nt, Salmonella enterica enterica serovar Typhi
gccgaauagcugauaaacagcu

SEQ ID NO: 3668217 - RNA, 19 nt, Salmonella enterica enterica serovar Typhi
gccgaauauugcgccacgc

SEQ ID NO: 3668218 - RNA, 21 nt, Salmonella enterica enterica serovar Typhi
gccgaauucguuacccgauac

SEQ ID NO: 3668219 - RNA, 15 nt, Salmonella enterica enterica serovar Typhi
gccgacaaaugacgu

SEQ ID NO: 3668220 - RNA, 14 nt, Salmonella enterica enterica serovar Typhi
gccgacaaccagcg

SEQ ID NO: 3668221 - RNA, 23 nt, Salmonella enterica enterica serovar Typhi
gccgacaaccagcgaaaugacgg

SEQ ID NO: 3668222 - RNA, 19 nt, Salmonella enterica enterica serovar Typhi
gccgacaagguugaucagg

SEQ ID NO: 3668223 - RNA, 17 nt, Salmonella enterica enterica serovar Typhi
gccgacacaguaaaaaa

SEQ ID NO: 3668224 - RNA, 19 nt, Salmonella enterica enterica serovar Typhi
gccgacaccggccugccua

SEQ ID NO: 3668225 - RNA, 19 nt, Salmonella enterica enterica serovar Typhi
gccgacauagcugaacaau

SEQ ID NO: 3668226 - RNA, 21 nt, Salmonella enterica enterica serovar Typhi
gccgacaucacgcaaaugcag

SEQ ID NO: 3668227 - RNA, 13 nt, Salmonella enterica enterica serovar Typhi
gccgacaucgcca

SEQ ID NO: 3668228 - RNA, 17 nt, Salmonella enterica enterica serovar Typhi
gccgacaucgcucccgg

SEQ ID NO: 3668229 - RNA, 19 nt, Salmonella enterica enterica serovar Typhi
gccgacaugguuaaccacc

SEQ ID NO: 3668230 - RNA, 22 nt, Salmonella enterica enterica serovar Typhi
gccgacaugguuaaccaccagc

SEQ ID NO: 3668231 - RNA, 16 nt, Salmonella enterica enterica serovar Typhi
gccgaccaaugacgcu

SEQ ID NO: 3668232 - RNA, 15 nt, Salmonella enterica enterica serovar Typhi
gccgaccaccagcuu

SEQ ID NO: 3668233 - RNA, 17 nt, Salmonella enterica enterica serovar Typhi
gccgaccaccauccggc

SEQ ID NO: 3668234 - RNA, 17 nt, Salmonella enterica enterica serovar Typhi
gccgaccaccgcccugu

SEQ ID NO: 3668235 - RNA, 22 nt, Salmonella enterica enterica serovar Typhi
gccgaccacuucaacgccgcgc

SEQ ID NO: 3668236 - RNA, 14 nt, Salmonella enterica enterica serovar Typhi
gccgaccauccaga

SEQ ID NO: 3668237 - RNA, 22 nt, Salmonella enterica enterica serovar Typhi
gccgaccauuggcaccaccagg

SEQ ID NO: 3668238 - RNA, 22 nt, Salmonella enterica enterica serovar Typhi
gccgacccaccugacuguucac

SEQ ID NO: 3668239 - RNA, 17 nt, Salmonella enterica enterica serovar Typhi
gccgacccgcaucgccg

SEQ ID NO: 3668240 - RNA, 20 nt, Salmonella enterica enterica serovar Typhi
gccgacccgcaucgccgcgg

SEQ ID NO: 3668241 - RNA, 21 nt, Salmonella enterica enterica serovar Typhi
gccgacccgcaucgccgcggc

SEQ ID NO: 3668242 - RNA, 16 nt, Salmonella enterica enterica serovar Typhi
gccgaccgccagcaga

SEQ ID NO: 3668243 - RNA, 14 nt, Salmonella enterica enterica serovar Typhi
gccgaccggcgcgc

SEQ ID NO: 3668244 - RNA, 17 nt, Salmonella enterica enterica serovar Typhi
gccgaccgucggcgcaa

SEQ ID NO: 3668245 - RNA, 16 nt, Salmonella enterica enterica serovar Typhi
gccgaccgugauuuuu

SEQ ID NO: 3668246 - RNA, 16 nt, Salmonella enterica enterica serovar Typhi
gccgacgaccggcagc

SEQ ID NO: 3668247 - RNA, 14 nt, Salmonella enterica enterica serovar Typhi
gccgacgcauccgc

SEQ ID NO: 3668248 - RNA, 15 nt, Salmonella enterica enterica serovar Typhi
gccgacgcauccgcc

SEQ ID NO: 3668249 - RNA, 15 nt, Salmonella enterica enterica serovar Typhi
gccgacgccacccag

SEQ ID NO: 3668250 - RNA, 16 nt, Salmonella enterica enterica serovar Typhi
gccgacgccacccagc

SEQ ID NO: 3668251 - RNA, 16 nt, Salmonella enterica enterica serovar Typhi
gccgacgcucuuccuc

SEQ ID NO: 3668252 - RNA, 17 nt, Salmonella enterica enterica serovar Typhi
gccgacggagacgauuc

SEQ ID NO: 3668253 - RNA, 19 nt, Salmonella enterica enterica serovar Typhi
gccgacguuaucgccgaca

SEQ ID NO: 3668254 - RNA, 15 nt, Salmonella enterica enterica serovar Typhi
gccgacucgcgcaau

SEQ ID NO: 3668255 - RNA, 12 nt, Salmonella enterica enterica serovar Typhi
gccgacuuuacg

SEQ ID NO: 3668256 - RNA, 18 nt, Salmonella enterica enterica serovar Typhi
gccgagcauuuccgcagc

SEQ ID NO: 3668257 - RNA, 23 nt, Salmonella enterica enterica serovar Typhi
gccgagcgaaggggcgggcagca

SEQ ID NO: 3668258 - RNA, 21 nt, Salmonella enterica enterica serovar Typhi
gccgagcgguaagagccagac

SEQ ID NO: 3668259 - RNA, 19 nt, Salmonella enterica enterica serovar Typhi
gccgagggcauugaugguu

SEQ ID NO: 3668260 - RNA, 21 nt, Salmonella enterica enterica serovar Typhi
gccgaguagcugagcgucagg

SEQ ID NO: 3668261 - RNA, 23 nt, Salmonella enterica enterica serovar Typhi
gccgaguccgaggcgaaacggcg

SEQ ID NO: 3668262 - RNA, 17 nt, Salmonella enterica enterica serovar Typhi
gccgagucgaucgucgg

SEQ ID NO: 3668263 - RNA, 17 nt, Salmonella enterica enterica serovar Typhi
gccgauaaccagcgcgc

SEQ ID NO: 3668264 - RNA, 21 nt, Salmonella enterica enterica serovar Typhi
gccgauaaccagcgcgccgcc

SEQ ID NO: 3668265 - RNA, 21 nt, Salmonella enterica enterica serovar Typhi
gccgauaacucuucaucgcgc

SEQ ID NO: 3668266 - RNA, 23 nt, Salmonella enterica enterica serovar Typhi
gccgauaacucuucaucgcgccu

SEQ ID NO: 3668267 - RNA, 13 nt, Salmonella enterica enterica serovar Typhi
gccgauaagcgcu

SEQ ID NO: 3668268 - RNA, 15 nt, Salmonella enterica enterica serovar Typhi
gccgauaauacgcgc

SEQ ID NO: 3668269 - RNA, 14 nt, Salmonella enterica enterica serovar Typhi
gccgauaccggcaa

SEQ ID NO: 3668270 - RNA, 13 nt, Salmonella enterica enterica serovar Typhi
gccgauacugccc

SEQ ID NO: 3668271 - RNA, 14 nt, Salmonella enterica enterica serovar Typhi
gccgauacugccca

SEQ ID NO: 3668272 - RNA, 20 nt, Salmonella enterica enterica serovar Typhi
gccgauaguggucgccacgc

SEQ ID NO: 3668273 - RNA, 19 nt, Salmonella enterica enterica serovar Typhi
gccgauauggccguuuuca

SEQ ID NO: 3668274 - RNA, 22 nt, Salmonella enterica enterica serovar Typhi
gccgauauugcggccuuccuga

SEQ ID NO: 3668275 - RNA, 16 nt, Salmonella enterica enterica serovar Typhi
gccgaucaccagcgca

SEQ ID NO: 3668276 - RNA, 18 nt, Salmonella enterica enterica serovar Typhi
gccgaucaccagcgcauc

SEQ ID NO: 3668277 - RNA, 21 nt, Salmonella enterica enterica serovar Typhi
gccgaucagauugaucaucac

SEQ ID NO: 3668278 - RNA, 14 nt, Salmonella enterica enterica serovar Typhi
gccgaucagcacca

SEQ ID NO: 3668279 - RNA, 14 nt, Salmonella enterica enterica serovar Typhi
gccgaucagcgcca

SEQ ID NO: 3668280 - RNA, 12 nt, Salmonella enterica enterica serovar Typhi
gccgaucaggcc

SEQ ID NO: 3668281 - RNA, 13 nt, Salmonella enterica enterica serovar Typhi
gccgaucaggccg

SEQ ID NO: 3668282 - RNA, 16 nt, Salmonella enterica enterica serovar Typhi
gccgaucaggccgcag

SEQ ID NO: 3668283 - RNA, 17 nt, Salmonella enterica enterica serovar Typhi
gccgaucaggccgcaga

SEQ ID NO: 3668284 - RNA, 14 nt, Salmonella enterica enterica serovar Typhi
gccgaucaucccgc

SEQ ID NO: 3668285 - RNA, 19 nt, Salmonella enterica enterica serovar Typhi
gccgaucuuuaccucaggu

SEQ ID NO: 3668286 - RNA, 20 nt, Salmonella enterica enterica serovar Typhi
gccgaugaaagagcgcgcgc

SEQ ID NO: 3668287 - RNA, 21 nt, Salmonella enterica enterica serovar Typhi
gccgaugcugaauagccagcc

SEQ ID NO: 3668288 - RNA, 13 nt, Salmonella enterica enterica serovar Typhi
gccgauggcgcuc

SEQ ID NO: 3668289 - RNA, 13 nt, Salmonella enterica enterica serovar Typhi
gccgauuucacgc

SEQ ID NO: 3668290 - RNA, 16 nt, Salmonella enterica enterica serovar Typhi
gccgccuggcgcgacu

SEQ ID NO: 3668291 - RNA, 22 nt, Salmonella enterica enterica serovar Typhi
gccgcgaacguucaaaaucaaa

SEQ ID NO: 3668292 - RNA, 22 nt, Salmonella enterica enterica serovar Typhi
gccgcgaauaaaggcgcuguug

SEQ ID NO: 3668293 - RNA, 16 nt, Salmonella enterica enterica serovar Typhi
gccgcgaccagcagca

SEQ ID NO: 3668294 - RNA, 16 nt, Salmonella enterica enterica serovar Typhi
gccgcgacgcgcgagc

SEQ ID NO: 3668295 - RNA, 16 nt, Salmonella enterica enterica serovar Typhi
gccgcgacggcaggca

SEQ ID NO: 3668296 - RNA, 20 nt, Salmonella enterica enterica serovar Typhi
gccgcgagaacuuccgccac

SEQ ID NO: 3668297 - RNA, 23 nt, Salmonella enterica enterica serovar Typhi
gccgcgauacauugucgcagcgc

SEQ ID NO: 3668298 - RNA, 19 nt, Salmonella enterica enterica serovar Typhi
gccgcgauagaccacgcca

SEQ ID NO: 3668299 - RNA, 14 nt, Salmonella enterica enterica serovar Typhi
gccgcgaucgcggc

SEQ ID NO: 3668300 - RNA, 20 nt, Salmonella enterica enterica serovar Typhi
gccgcgauguuugcucgcca

SEQ ID NO: 3668301 - RNA, 13 nt, Salmonella enterica enterica serovar Typhi
gccgcgcccagca

SEQ ID NO: 3668302 - RNA, 16 nt, Salmonella enterica enterica serovar Typhi
gccgcgcccugcggaa

SEQ ID NO: 3668303 - RNA, 21 nt, Salmonella enterica enterica serovar Typhi
gccgcgccggacuccagcaac

SEQ ID NO: 3668304 - RNA, 18 nt, Salmonella enterica enterica serovar Typhi
gccgcgccuaccagcgcu

SEQ ID NO: 3668305 - RNA, 19 nt, Salmonella enterica enterica serovar Typhi
gccgcgccuaccagcgcua

SEQ ID NO: 3668306 - RNA, 15 nt, Salmonella enterica enterica serovar Typhi
gccgcgcgccgccuc

SEQ ID NO: 3668307 - RNA, 18 nt, Salmonella enterica enterica serovar Typhi
gccgcgcgccgccucuuc

SEQ ID NO: 3668308 - RNA, 12 nt, Salmonella enterica enterica serovar Typhi
gccgcgcugauc

SEQ ID NO: 3668309 - RNA, 16 nt, Salmonella enterica enterica serovar Typhi
gccgcgcuuucaguaa

SEQ ID NO: 3668310 - RNA, 18 nt, Salmonella enterica enterica serovar Typhi
gccgcgcuuucaguaaua

SEQ ID NO: 3668311 - RNA, 19 nt, Salmonella enterica enterica serovar Typhi
gccgcgcuuucaguaauaa

SEQ ID NO: 3668312 - RNA, 18 nt, Salmonella enterica enterica serovar Typhi
gccgcgcuuuuuuaacga

SEQ ID NO: 3668313 - RNA, 21 nt, Salmonella enterica enterica serovar Typhi
gccgcgggaaauaccaaauau

SEQ ID NO: 3668314 - RNA, 23 nt, Salmonella enterica enterica serovar Typhi
gccgcguaaucuucgcggcugcc

SEQ ID NO: 3668315 - RNA, 18 nt, Salmonella enterica enterica serovar Typhi
gccgcgucccgaccagga

SEQ ID NO: 3668316 - RNA, 13 nt, Salmonella enterica enterica serovar Typhi
gccgcgugcucgc

SEQ ID NO: 3668317 - RNA, 16 nt, Salmonella enterica enterica serovar Typhi
gccgcgugcucgcggc

SEQ ID NO: 3668318 - RNA, 17 nt, Salmonella enterica enterica serovar Typhi
gccgcgugcucgcggcg

SEQ ID NO: 3668319 - RNA, 16 nt, Salmonella enterica enterica serovar Typhi
gccgcguuucucgccg

SEQ ID NO: 3668320 - RNA, 15 nt, Salmonella enterica enterica serovar Typhi
gccgcguuuuagcaa

SEQ ID NO: 3668321 - RNA, 21 nt, Salmonella enterica enterica serovar Typhi
gccgcuacguaauucaugcaa

SEQ ID NO: 3668322 - RNA, 16 nt, Salmonella enterica enterica serovar Typhi
gccgcuagcggcggcc

SEQ ID NO: 3668323 - RNA, 22 nt, Salmonella enterica enterica serovar Typhi
gccgcuaucgaccagcaccugc

SEQ ID NO: 3668324 - RNA, 15 nt, Salmonella enterica enterica serovar Typhi
gccgcuaucugcucc

SEQ ID NO: 3668325 - RNA, 20 nt, Salmonella enterica enterica serovar Typhi
gccgcuaucugcuccgccag

SEQ ID NO: 3668326 - RNA, 19 nt, Salmonella enterica enterica serovar Typhi
gccgcuaugcaauuguucc

SEQ ID NO: 3668327 - RNA, 14 nt, Salmonella enterica enterica serovar Typhi
gccgcucacaaccg

SEQ ID NO: 3668328 - RNA, 13 nt, Salmonella enterica enterica serovar Typhi
gccgcucacguuc

SEQ ID NO: 3668329 - RNA, 14 nt, Salmonella enterica enterica serovar Typhi
gccgcuccacagca

SEQ ID NO: 3668330 - RNA, 14 nt, Salmonella enterica enterica serovar Typhi
gccgcucccgcaug

SEQ ID NO: 3668331 - RNA, 16 nt, Salmonella enterica enterica serovar Typhi
gccgcucccgcaugga

SEQ ID NO: 3668332 - RNA, 16 nt, Salmonella enterica enterica serovar Typhi
gccgcugauauucacc

SEQ ID NO: 3668333 - RNA, 14 nt, Salmonella enterica enterica serovar Typhi
gccgcugauccgcc

SEQ ID NO: 3668334 - RNA, 22 nt, Salmonella enterica enterica serovar Typhi
gccgcuggauaauugcucugcc

SEQ ID NO: 3668335 - RNA, 17 nt, Salmonella enterica enterica serovar Typhi
gccgcuggcgaccagcc

SEQ ID NO: 3668336 - RNA, 18 nt, Salmonella enterica enterica serovar Typhi
gccgcugucgccagaaug

SEQ ID NO: 3668337 - RNA, 14 nt, Salmonella enterica enterica serovar Typhi
gccgcuuauccggc

SEQ ID NO: 3668338 - RNA, 15 nt, Salmonella enterica enterica serovar Typhi
gccgcuucgccacuc

SEQ ID NO: 3668339 - RNA, 21 nt, Salmonella enterica enterica serovar Typhi
gccgcuuuaaucaccauggcg

SEQ ID NO: 3668340 - RNA, 15 nt, Salmonella enterica enterica serovar Typhi
gccgcuuucaccuua

SEQ ID NO: 3668341 - RNA, 16 nt, Salmonella enterica enterica serovar Typhi
gccgcuuuccgccgca

SEQ ID NO: 3668342 - RNA, 15 nt, Salmonella enterica enterica serovar Typhi
gccgcuuucugagcc

SEQ ID NO: 3668343 - RNA, 18 nt, Salmonella enterica enterica serovar Typhi
gccgcuuuuuucagcggc

SEQ ID NO: 3668344 - RNA, 22 nt, Salmonella enterica enterica serovar Typhi
gccgcuuuuuucagcggcagcu

SEQ ID NO: 3668345 - RNA, 20 nt, Salmonella enterica enterica serovar Typhi
gccggaaaaaaugggcugga

SEQ ID NO: 3668346 - RNA, 22 nt, Salmonella enterica enterica serovar Typhi
gccggaaaaaaugggcuggaaa

SEQ ID NO: 3668347 - RNA, 22 nt, Salmonella enterica enterica serovar Typhi
gccggaaaacauauagcaguuu

SEQ ID NO: 3668348 - RNA, 21 nt, Salmonella enterica enterica serovar Typhi
gccggaaaagcgcuggcuggc

SEQ ID NO: 3668349 - RNA, 22 nt, Salmonella enterica enterica serovar Typhi
gccggaaagaauaaucgccgcc

SEQ ID NO: 3668350 - RNA, 21 nt, Salmonella enterica enterica serovar Typhi
gccggaaagacggcagcgcca

SEQ ID NO: 3668351 - RNA, 23 nt, Salmonella enterica enterica serovar Typhi
gccggaaaggauauaagcgccau

SEQ ID NO: 3668352 - RNA, 22 nt, Salmonella enterica enterica serovar Typhi
gccggaaauagagagggccgca

SEQ ID NO: 3668353 - RNA, 16 nt, Salmonella enterica enterica serovar Typhi
gccggaaaucacccaa

SEQ ID NO: 3668354 - RNA, 16 nt, Salmonella enterica enterica serovar Typhi
gccggaaaucgcggcg

SEQ ID NO: 3668355 - RNA, 16 nt, Salmonella enterica enterica serovar Typhi
gccggaaccguucuca

SEQ ID NO: 3668356 - RNA, 23 nt, Salmonella enterica enterica serovar Typhi
gccggaagacguuuacaccgcca

SEQ ID NO: 3668357 - RNA, 15 nt, Salmonella enterica enterica serovar Typhi
gccggaagcgcgaau

SEQ ID NO: 3668358 - RNA, 22 nt, Salmonella enterica enterica serovar Typhi
gccggaaucgcgauccagcccc

SEQ ID NO: 3668359 - RNA, 23 nt, Salmonella enterica enterica serovar Typhi
gccggaaucgcgauccagcccca

SEQ ID NO: 3668360 - RNA, 13 nt, Salmonella enterica enterica serovar Typhi
gccggacagcagc

SEQ ID NO: 3668361 - RNA, 21 nt, Salmonella enterica enterica serovar Typhi
gccggacgcggcuuauccggc

SEQ ID NO: 3668362 - RNA, 13 nt, Salmonella enterica enterica serovar Typhi
gccggacuccagc

SEQ ID NO: 3668363 - RNA, 17 nt, Salmonella enterica enterica serovar Typhi
gccggacuguugaugau

SEQ ID NO: 3668364 - RNA, 21 nt, Salmonella enterica enterica serovar Typhi
gccggagaaaaagaccgacau

SEQ ID NO: 3668365 - RNA, 13 nt, Salmonella enterica enterica serovar Typhi
gccggagaccggc

SEQ ID NO: 3668366 - RNA, 22 nt, Salmonella enterica enterica serovar Typhi
gccggagagcggauaauccgcc

SEQ ID NO: 3668367 - RNA, 16 nt, Salmonella enterica enterica serovar Typhi
gccggagcugauacgg

SEQ ID NO: 3668368 - RNA, 21 nt, Salmonella enterica enterica serovar Typhi
gccggaggaggacucuccgag

SEQ ID NO: 3668369 - RNA, 17 nt, Salmonella enterica enterica serovar Typhi
gccggaggauauuuauu

SEQ ID NO: 3668370 - RNA, 15 nt, Salmonella enterica enterica serovar Typhi
gccggagucgacggc

SEQ ID NO: 3668371 - RNA, 15 nt, Salmonella enterica enterica serovar Typhi
gccggauaagacgcg

SEQ ID NO: 3668372 - RNA, 15 nt, Salmonella enterica enterica serovar Typhi
gccggauaagacgcu

SEQ ID NO: 3668373 - RNA, 14 nt, Salmonella enterica enterica serovar Typhi
gccggauaagcgca

SEQ ID NO: 3668374 - RNA, 20 nt, Salmonella enterica enterica serovar Typhi
gccggauaagcguagcgcca

SEQ ID NO: 3668375 - RNA, 17 nt, Salmonella enterica enterica serovar Typhi
gcaucguaagccgcauu

SEQ ID NO: 3668376 - RNA, 14 nt, Salmonella enterica enterica serovar Typhi
gcaucguacgggca

SEQ ID NO: 3668377 - RNA, 22 nt, Salmonella enterica enterica serovar Typhi
gcaucguacgggcaaaaucuuc

SEQ ID NO: 3668378 - RNA, 13 nt, Salmonella enterica enterica serovar Typhi
gcaucgucugcac

SEQ ID NO: 3668379 - RNA, 15 nt, Salmonella enterica enterica serovar Typhi
gcaucgugagcgcgu

SEQ ID NO: 3668380 - RNA, 22 nt, Salmonella enterica enterica serovar Typhi
gcaucgugguuaauacaucaac

SEQ ID NO: 3668381 - RNA, 22 nt, Salmonella enterica enterica serovar Typhi
gcaucuacccguacauuauugc

SEQ ID NO: 3668382 - RNA, 21 nt, Salmonella enterica enterica serovar Typhi
gcaucuccucgcacuggcgag

SEQ ID NO: 3668383 - RNA, 21 nt, Salmonella enterica enterica serovar Typhi
gcaucugauauaucuucaucg

SEQ ID NO: 3668384 - RNA, 21 nt, Salmonella enterica enterica serovar Typhi
gcaucugaucuacaaucgucu

SEQ ID NO: 3668385 - RNA, 19 nt, Salmonella enterica enterica serovar Typhi
gcaucugcauaauggcgac

SEQ ID NO: 3668386 - RNA, 13 nt, Salmonella enterica enterica serovar Typhi
gcaucugcgcaac

SEQ ID NO: 3668387 - RNA, 19 nt, Salmonella enterica enterica serovar Typhi
gcaucugcgcaacuggaag

SEQ ID NO: 3668388 - RNA, 13 nt, Salmonella enterica enterica serovar Typhi
gcaucugggcuga

SEQ ID NO: 3668389 - RNA, 21 nt, Salmonella enterica enterica serovar Typhi
gcaucugggcugagaaaaauu

SEQ ID NO: 3668390 - RNA, 16 nt, Salmonella enterica enterica serovar Typhi
gcaucugucaucgccg

SEQ ID NO: 3668391 - RNA, 15 nt, Salmonella enterica enterica serovar Typhi
gcaucuuauauuuug

SEQ ID NO: 3668392 - RNA, 13 nt, Salmonella enterica enterica serovar Typhi
gcaucuucagaca

SEQ ID NO: 3668393 - RNA, 18 nt, Salmonella enterica enterica serovar Typhi
gcaucuuccucugugccg

SEQ ID NO: 3668394 - RNA, 15 nt, Salmonella enterica enterica serovar Typhi
gcaucuuuccggaac

SEQ ID NO: 3668395 - RNA, 19 nt, Salmonella enterica enterica serovar Typhi
gcaucuuuccggaacgcgu

SEQ ID NO: 3668396 - RNA, 13 nt, Salmonella enterica enterica serovar Typhi
gcaucuuuguucu

SEQ ID NO: 3668397 - RNA, 14 nt, Salmonella enterica enterica serovar Typhi
gcaucuuuguucug

SEQ ID NO: 3668398 - RNA, 13 nt, Salmonella enterica enterica serovar Typhi
gcaucuuuugccg

SEQ ID NO: 3668399 - RNA, 18 nt, Salmonella enterica enterica serovar Typhi
gcaugaauaaccucccgc

SEQ ID NO: 3668400 - RNA, 20 nt, Salmonella enterica enterica serovar Typhi
gcaugaauaauuucuucuuu

SEQ ID NO: 3668401 - RNA, 13 nt, Salmonella enterica enterica serovar Typhi
gcaugaauaucaa

SEQ ID NO: 3668402 - RNA, 14 nt, Salmonella enterica enterica serovar Typhi
gcaugaauuucucg

SEQ ID NO: 3668403 - RNA, 14 nt, Salmonella enterica enterica serovar Typhi
gcaugacccaggca

SEQ ID NO: 3668404 - RNA, 18 nt, Salmonella enterica enterica serovar Typhi
gcaugagcacgcggaaga

SEQ ID NO: 3668405 - RNA, 13 nt, Salmonella enterica enterica serovar Typhi
gcaugagccagcc

SEQ ID NO: 3668406 - RNA, 21 nt, Salmonella enterica enterica serovar Typhi
gcaugaucauacugccgccgu

SEQ ID NO: 3668407 - RNA, 23 nt, Salmonella enterica enterica serovar Typhi
gcaugauccaccaucggcgcgua

SEQ ID NO: 3668408 - RNA, 19 nt, Salmonella enterica enterica serovar Typhi
gcaugauggcgaacagccc

SEQ ID NO: 3668409 - RNA, 22 nt, Salmonella enterica enterica serovar Typhi
gcaugaugggcgcacagcgcca

SEQ ID NO: 3668410 - RNA, 13 nt, Salmonella enterica enterica serovar Typhi
gcaugauuacaga

SEQ ID NO: 3668411 - RNA, 22 nt, Salmonella enterica enterica serovar Typhi
gcaugccccucgacaggaguau

SEQ ID NO: 3668412 - RNA, 14 nt, Salmonella enterica enterica serovar Typhi
gcaugcccgccagc

SEQ ID NO: 3668413 - RNA, 20 nt, Salmonella enterica enterica serovar Typhi
gcaugcccgccagcgggccg

SEQ ID NO: 3668414 - RNA, 20 nt, Salmonella enterica enterica serovar Typhi
gcauggaugcaugagcacgc

SEQ ID NO: 3668415 - RNA, 14 nt, Salmonella enterica enterica serovar Typhi
gcauggcaauuaaa

SEQ ID NO: 3668416 - RNA, 23 nt, Salmonella enterica enterica serovar Typhi
gcauggcagauaaaccacgccgu

SEQ ID NO: 3668417 - RNA, 21 nt, Salmonella enterica enterica serovar Typhi
gcaugggauacgccagcagac

SEQ ID NO: 3668418 - RNA, 19 nt, Salmonella enterica enterica serovar Typhi
gcaugggcagcuugccgcc

SEQ ID NO: 3668419 - RNA, 14 nt, Salmonella enterica enterica serovar Typhi
gcauggggagaccc

SEQ ID NO: 3668420 - RNA, 18 nt, Salmonella enterica enterica serovar Typhi
gcauggguaaagcccauc

SEQ ID NO: 3668421 - RNA, 19 nt, Salmonella enterica enterica serovar Typhi
gcauggguauaagcgugca

SEQ ID NO: 3668422 - RNA, 14 nt, Salmonella enterica enterica serovar Typhi
gcaugguccggugc

SEQ ID NO: 3668423 - RNA, 23 nt, Salmonella enterica enterica serovar Typhi
gcauggugacuccccacaauccc

SEQ ID NO: 3668424 - RNA, 19 nt, Salmonella enterica enterica serovar Typhi
gcauggugcagccgccauc

SEQ ID NO: 3668425 - RNA, 18 nt, Salmonella enterica enterica serovar Typhi
gcaugguguucagauggc

SEQ ID NO: 3668426 - RNA, 20 nt, Salmonella enterica enterica serovar Typhi
gcauguacaacuucaugagu

SEQ ID NO: 3668427 - RNA, 14 nt, Salmonella enterica enterica serovar Typhi
gcauguaguaagcc

SEQ ID NO: 3668428 - RNA, 17 nt, Salmonella enterica enterica serovar Typhi
gcauguuaugaauaguu

SEQ ID NO: 3668429 - RNA, 15 nt, Salmonella enterica enterica serovar Typhi
gcauuaacaaaucau

SEQ ID NO: 3668430 - RNA, 17 nt, Salmonella enterica enterica serovar Typhi
gcauuaacguccauacc

SEQ ID NO: 3668431 - RNA, 14 nt, Salmonella enterica enterica serovar Typhi
gcauuaagcugaua

SEQ ID NO: 3668432 - RNA, 18 nt, Salmonella enterica enterica serovar Typhi
gcauuaauaugcgcaauc

SEQ ID NO: 3668433 - RNA, 15 nt, Salmonella enterica enterica serovar Typhi
gcauuagcaugggcu

SEQ ID NO: 3668434 - RNA, 19 nt, Salmonella enterica enterica serovar Typhi
gcauuagcaugggcuaaag

SEQ ID NO: 3668435 - RNA, 17 nt, Salmonella enterica enterica serovar Typhi
gcauuagcgccaccgag

SEQ ID NO: 3668436 - RNA, 20 nt, Salmonella enterica enterica serovar Typhi
gcauuagcgcgauaaaacca

SEQ ID NO: 3668437 - RNA, 11 nt, Salmonella enterica enterica serovar Typhi
gcauuauaaau

SEQ ID NO: 3668438 - RNA, 20 nt, Salmonella enterica enterica serovar Typhi
gcauuauacgccuauuuucu

SEQ ID NO: 3668439 - RNA, 17 nt, Salmonella enterica enterica serovar Typhi
gcauuaucgaugcguau

SEQ ID NO: 3668440 - RNA, 12 nt, Salmonella enterica enterica serovar Typhi
gcauucacgcca

SEQ ID NO: 3668441 - RNA, 14 nt, Salmonella enterica enterica serovar Typhi
gcauucagccagcu

SEQ ID NO: 3668442 - RNA, 16 nt, Salmonella enterica enterica serovar Typhi
gcauuccccaucgcga

SEQ ID NO: 3668443 - RNA, 17 nt, Salmonella enterica enterica serovar Typhi
gcauucgaauccuccug

SEQ ID NO: 3668444 - RNA, 15 nt, Salmonella enterica enterica serovar Typhi
gcauucgcagcagac

SEQ ID NO: 3668445 - RNA, 18 nt, Salmonella enterica enterica serovar Typhi
gcauucgcagcagacguu

SEQ ID NO: 3668446 - RNA, 14 nt, Salmonella enterica enterica serovar Typhi
gcauucgcuccuca

SEQ ID NO: 3668447 - RNA, 16 nt, Salmonella enterica enterica serovar Typhi
gcauucgcuccucagc

SEQ ID NO: 3668448 - RNA, 14 nt, Salmonella enterica enterica serovar Typhi
gcauucuaaauccu

SEQ ID NO: 3668449 - RNA, 21 nt, Salmonella enterica enterica serovar Typhi
gcauucucugucgccgcccgu

SEQ ID NO: 3668450 - RNA, 20 nt, Salmonella enterica enterica serovar Typhi
gcauucuuugcuuuguaaag

SEQ ID NO: 3668451 - RNA, 23 nt, Salmonella enterica enterica serovar Typhi
gcauucuuugcuuuguaaagcgc

SEQ ID NO: 3668452 - RNA, 16 nt, Salmonella enterica enterica serovar Typhi
gcauugcucaacugga

SEQ ID NO: 3668453 - RNA, 17 nt, Salmonella enterica enterica serovar Typhi
gcauuggcaucugucau

SEQ ID NO: 3668454 - RNA, 17 nt, Salmonella enterica enterica serovar Typhi
gcauugggauggauaaa

SEQ ID NO: 3668455 - RNA, 18 nt, Salmonella enterica enterica serovar Typhi
gcauugugccggguagcg

SEQ ID NO: 3668456 - RNA, 19 nt, Salmonella enterica enterica serovar Typhi
gcauuguuaauccagagcg

SEQ ID NO: 3668457 - RNA, 18 nt, Salmonella enterica enterica serovar Typhi
gcauuguuccugcuggca

SEQ ID NO: 3668458 - RNA, 19 nt, Salmonella enterica enterica serovar Typhi
gcauuuaacggcuuacugc

SEQ ID NO: 3668459 - RNA, 14 nt, Salmonella enterica enterica serovar Typhi
gcauuuaggucuug

SEQ ID NO: 3668460 - RNA, 18 nt, Salmonella enterica enterica serovar Typhi
gcauuucaagcaggcgau

SEQ ID NO: 3668461 - RNA, 16 nt, Salmonella enterica enterica serovar Typhi
gcauuucaaucgccac

SEQ ID NO: 3668462 - RNA, 20 nt, Salmonella enterica enterica serovar Typhi
gcauuucgccaguuccauca

SEQ ID NO: 3668463 - RNA, 14 nt, Salmonella enterica enterica serovar Typhi
gcauuucgccgcca

SEQ ID NO: 3668464 - RNA, 15 nt, Salmonella enterica enterica serovar Typhi
gcauuucgccgccau

SEQ ID NO: 3668465 - RNA, 23 nt, Salmonella enterica enterica serovar Typhi
gcauuucgccgccauccggcacu

SEQ ID NO: 3668466 - RNA, 12 nt, Salmonella enterica enterica serovar Typhi
gcauuucuucaa

SEQ ID NO: 3668467 - RNA, 18 nt, Salmonella enterica enterica serovar Typhi
gcauuugcuuucaucaau

SEQ ID NO: 3668468 - RNA, 16 nt, Salmonella enterica enterica serovar Typhi
gcauuuucaaugucgc

SEQ ID NO: 3668469 - RNA, 13 nt, Salmonella enterica enterica serovar Typhi
gcauuuugcggcg

SEQ ID NO: 3668470 - RNA, 16 nt, Salmonella enterica enterica serovar Typhi
gcauuuuggccgggau

SEQ ID NO: 3668471 - RNA, 15 nt, Salmonella enterica enterica serovar Typhi
gcauuuuuucuucag

SEQ ID NO: 3668472 - RNA, 13 nt, Salmonella enterica enterica serovar Typhi
gccaaaaccacag

SEQ ID NO: 3668473 - RNA, 18 nt, Salmonella enterica enterica serovar Typhi
gccaaaaccacagugacc

SEQ ID NO: 3668474 - RNA, 19 nt, Salmonella enterica enterica serovar Typhi
gccaaaacccaccagcagg

SEQ ID NO: 3668475 - RNA, 22 nt, Salmonella enterica enterica serovar Typhi
gccaaaacccaccagcagggca

SEQ ID NO: 3668476 - RNA, 13 nt, Salmonella enterica enterica serovar Typhi
gccaaaaccgcuc

SEQ ID NO: 3668477 - RNA, 18 nt, Salmonella enterica enterica serovar Typhi
gccaaaacggucgguaau

SEQ ID NO: 3668478 - RNA, 16 nt, Salmonella enterica enterica serovar Typhi
gccaaaagaggcagca

SEQ ID NO: 3668479 - RNA, 18 nt, Salmonella enterica enterica serovar Typhi
gccaaaaucgauagcggu

SEQ ID NO: 3668480 - RNA, 22 nt, Salmonella enterica enterica serovar Typhi
gccaaacaucgcucgcgccacg

SEQ ID NO: 3668481 - RNA, 17 nt, Salmonella enterica enterica serovar Typhi
gccaaaccugccacagg

SEQ ID NO: 3668482 - RNA, 17 nt, Salmonella enterica enterica serovar Typhi
gccaaacuccaccugau

SEQ ID NO: 3668483 - RNA, 23 nt, Salmonella enterica enterica serovar Typhi
gccaaacuccaccugaucgccaa

SEQ ID NO: 3668484 - RNA, 21 nt, Salmonella enterica enterica serovar Typhi
gccaaacucuuuuucaauaaa

SEQ ID NO: 3668485 - RNA, 13 nt, Salmonella enterica enterica serovar Typhi
gccaaacugcugg

SEQ ID NO: 3668486 - RNA, 15 nt, Salmonella enterica enterica serovar Typhi
gccaaagaaacgcug

SEQ ID NO: 3668487 - RNA, 20 nt, Salmonella enterica enterica serovar Typhi
gccaaagaaacgcugaucua

SEQ ID NO: 3668488 - RNA, 12 nt, Salmonella enterica enterica serovar Typhi
gccaaagcgccc

SEQ ID NO: 3668489 - RNA, 22 nt, Salmonella enterica enterica serovar Typhi
gccaaagcuggauaucacgcgc

SEQ ID NO: 3668490 - RNA, 12 nt, Salmonella enterica enterica serovar Typhi
gccaaagggagc

SEQ ID NO: 3668491 - RNA, 11 nt, Salmonella enterica enterica serovar Typhi
gccaaauguau

SEQ ID NO: 3668492 - RNA, 19 nt, Salmonella enterica enterica serovar Typhi
gccaaauuuagugcucagc

SEQ ID NO: 3668493 - RNA, 14 nt, Salmonella enterica enterica serovar Typhi
gccaacaacaggcc

SEQ ID NO: 3668494 - RNA, 15 nt, Salmonella enterica enterica serovar Typhi
gccaacaacaggccg

SEQ ID NO: 3668495 - RNA, 19 nt, Salmonella enterica enterica serovar Typhi
gccaacaacaggccgccga

SEQ ID NO: 3668496 - RNA, 16 nt, Salmonella enterica enterica serovar Typhi
gccaacauagccacag

SEQ ID NO: 3668497 - RNA, 19 nt, Salmonella enterica enterica serovar Typhi
gccaacauagccacaggcu

SEQ ID NO: 3668498 - RNA, 22 nt, Salmonella enterica enterica serovar Typhi
gccaacauguaauuacggcaca

SEQ ID NO: 3668499 - RNA, 13 nt, Salmonella enterica enterica serovar Typhi
gccaaccagaccg

SEQ ID NO: 3668500 - RNA, 19 nt, Salmonella enterica enterica serovar Typhi
gccaaccgugagcgcgccg

SEQ ID NO: 3668501 - RNA, 21 nt, Salmonella enterica enterica serovar Typhi
gccaacgauacagcacggcag

SEQ ID NO: 3668502 - RNA, 12 nt, Salmonella enterica enterica serovar Typhi
gccaacgccaac

SEQ ID NO: 3668503 - RNA, 13 nt, Salmonella enterica enterica serovar Typhi
gccaacgccaaca

SEQ ID NO: 3668504 - RNA, 21 nt, Salmonella enterica enterica serovar Typhi
gccaacgccagcagcgcgaua

SEQ ID NO: 3668505 - RNA, 16 nt, Salmonella enterica enterica serovar Typhi
gccaacgccggcaaca

SEQ ID NO: 3668506 - RNA, 19 nt, Salmonella enterica enterica serovar Typhi
gccaacgucgacagacgca

SEQ ID NO: 3668507 - RNA, 19 nt, Salmonella enterica enterica serovar Typhi
gccaacuuuuugcgcaaua

SEQ ID NO: 3668508 - RNA, 19 nt, Salmonella enterica enterica serovar Typhi
gccaagaccgccuaacagc

SEQ ID NO: 3668509 - RNA, 20 nt, Salmonella enterica enterica serovar Typhi
gccaagaccgccuaacagcg

SEQ ID NO: 3668510 - RNA, 14 nt, Salmonella enterica enterica serovar Typhi
gccaagaucgccaa

SEQ ID NO: 3668511 - RNA, 15 nt, Salmonella enterica enterica serovar Typhi
gccaagcaacacggc

SEQ ID NO: 3668512 - RNA, 14 nt, Salmonella enterica enterica serovar Typhi
gccaagcagcgcca

SEQ ID NO: 3668513 - RNA, 17 nt, Salmonella enterica enterica serovar Typhi
gccaagcgcggacagca

SEQ ID NO: 3668514 - RNA, 12 nt, Salmonella enterica enterica serovar Typhi
gccaagcgcggc

SEQ ID NO: 3668515 - RNA, 16 nt, Salmonella enterica enterica serovar Typhi
gccaagcgcggcagca

SEQ ID NO: 3668516 - RNA, 16 nt, Salmonella enterica enterica serovar Typhi
gccaagcggcaacucu

SEQ ID NO: 3668517 - RNA, 13 nt, Salmonella enterica enterica serovar Typhi
gccaagcggcauc

SEQ ID NO: 3668518 - RNA, 19 nt, Salmonella enterica enterica serovar Typhi
gccaagcggcaucucgcca

SEQ ID NO: 3668519 - RNA, 22 nt, Salmonella enterica enterica serovar Typhi
gccaagcggcaucucgccaaac

SEQ ID NO: 3668520 - RNA, 14 nt, Salmonella enterica enterica serovar Typhi
gccaagcugcaaua

SEQ ID NO: 3668521 - RNA, 17 nt, Salmonella enterica enterica serovar Typhi
gccaaguaauaaagaga

SEQ ID NO: 3668522 - RNA, 21 nt, Salmonella enterica enterica serovar Typhi
gccaaguaauaaagagaacga

SEQ ID NO: 3668523 - RNA, 18 nt, Salmonella enterica enterica serovar Typhi
gccaauaaccaccuguuc

SEQ ID NO: 3668524 - RNA, 17 nt, Salmonella enterica enterica serovar Typhi
gccaauaauuuuagaaa

SEQ ID NO: 3668525 - RNA, 19 nt, Salmonella enterica enterica serovar Typhi
gccaauagggacuuuaccg

SEQ ID NO: 3668526 - RNA, 15 nt, Salmonella enterica enterica serovar Typhi
gccaauaggggcgga

SEQ ID NO: 3668527 - RNA, 17 nt, Salmonella enterica enterica serovar Typhi
gccaaucaacgccgcca

SEQ ID NO: 3668528 - RNA, 13 nt, Salmonella enterica enterica serovar Typhi
gccaaucacugcg

SEQ ID NO: 3668529 - RNA, 12 nt, Salmonella enterica enterica serovar Typhi
gccaauccugca

SEQ ID NO: 3668530 - RNA, 14 nt, Salmonella enterica enterica serovar Typhi
gccaauccugcacc

SEQ ID NO: 3668531 - RNA, 12 nt, Salmonella enterica enterica serovar Typhi
gccaaucgccgc

SEQ ID NO: 3668532 - RNA, 21 nt, Salmonella enterica enterica serovar Typhi
gccaaucggcgucuugccgca

SEQ ID NO: 3668533 - RNA, 11 nt, Salmonella enterica enterica serovar Typhi
gccaaugaacu

SEQ ID NO: 3668534 - RNA, 19 nt, Salmonella enterica enterica serovar Typhi
gccaaugccggacgccacc

SEQ ID NO: 3668535 - RNA, 22 nt, Salmonella enterica enterica serovar Typhi
gccaauggcucaacuccgccgg

SEQ ID NO: 3668536 - RNA, 19 nt, Salmonella enterica enterica serovar Typhi
gccaauguacguaaaacca

SEQ ID NO: 3668537 - RNA, 14 nt, Salmonella enterica enterica serovar Typhi
gccacaacgccuga

SEQ ID NO: 3668538 - RNA, 13 nt, Salmonella enterica enterica serovar Typhi
gccacaauauccg

SEQ ID NO: 3668539 - RNA, 21 nt, Salmonella enterica enterica serovar Typhi
gccacaaugggggcauaauac

SEQ ID NO: 3668540 - RNA, 14 nt, Salmonella enterica enterica serovar Typhi
gccacaauugccag

SEQ ID NO: 3668541 - RNA, 14 nt, Salmonella enterica enterica serovar Typhi
gccacacccauagc

SEQ ID NO: 3668542 - RNA, 12 nt, Salmonella enterica enterica serovar Typhi
gccacagcaaau

SEQ ID NO: 3668543 - RNA, 18 nt, Salmonella enterica enterica serovar Typhi
gccacagccauccgacgc

SEQ ID NO: 3668544 - RNA, 12 nt, Salmonella enterica enterica serovar Typhi
gccacagccgca

SEQ ID NO: 3668545 - RNA, 18 nt, Salmonella enterica enterica serovar Typhi
gccacagcgguuagcggc

SEQ ID NO: 3668546 - RNA, 21 nt, Salmonella enterica enterica serovar Typhi
gccacaggaaccgguagccag

SEQ ID NO: 3668547 - RNA, 18 nt, Salmonella enterica enterica serovar Typhi
gccacaggcggcaugggu

SEQ ID NO: 3668548 - RNA, 12 nt, Salmonella enterica enterica serovar Typhi
gccacauacugc

SEQ ID NO: 3668549 - RNA, 17 nt, Salmonella enterica enterica serovar Typhi
gccacauagcauccaga

SEQ ID NO: 3668550 - RNA, 16 nt, Salmonella enterica enterica serovar Typhi
gccacaugcggcaggc

SEQ ID NO: 3668551 - RNA, 12 nt, Salmonella enterica enterica serovar Typhi
gccacauugacc

SEQ ID NO: 3668552 - RNA, 22 nt, Salmonella enterica enterica serovar Typhi
gccacauuucccgagccggguu

SEQ ID NO: 3668553 - RNA, 12 nt, Salmonella enterica enterica serovar Typhi
gccaccaaaaac

SEQ ID NO: 3668554 - RNA, 23 nt, Salmonella enterica enterica serovar Typhi
gccaccaaaaacgcccccagaua

SEQ ID NO: 3668555 - RNA, 20 nt, Salmonella enterica enterica serovar Typhi
gccaccaaagccaggccgcc

SEQ ID NO: 3668556 - RNA, 23 nt, Salmonella enterica enterica serovar Typhi
gccaccaaagccaggccgccagc

SEQ ID NO: 3668557 - RNA, 13 nt, Salmonella enterica enterica serovar Typhi
gccaccacaaagc

SEQ ID NO: 3668558 - RNA, 14 nt, Salmonella enterica enterica serovar Typhi
gccaccacaaagcg

SEQ ID NO: 3668559 - RNA, 15 nt, Salmonella enterica enterica serovar Typhi
gccaccacgcccaac

SEQ ID NO: 3668560 - RNA, 17 nt, Salmonella enterica enterica serovar Typhi
gccaccacgccgagaaa

SEQ ID NO: 3668561 - RNA, 19 nt, Salmonella enterica enterica serovar Typhi
gccaccacgccgagaaaca

SEQ ID NO: 3668562 - RNA, 16 nt, Salmonella enterica enterica serovar Typhi
gccaccagaucuucaa

SEQ ID NO: 3668563 - RNA, 13 nt, Salmonella enterica enterica serovar Typhi
gccaccagcgcca

SEQ ID NO: 3668564 - RNA, 15 nt, Salmonella enterica enterica serovar Typhi
gccaccagcgccaua

SEQ ID NO: 3668565 - RNA, 19 nt, Salmonella enterica enterica serovar Typhi
gccaccaucgucgccagac

SEQ ID NO: 3668566 - RNA, 21 nt, Salmonella enterica enterica serovar Typhi
gccaccaugauuaccugaagc

SEQ ID NO: 3668567 - RNA, 17 nt, Salmonella enterica enterica serovar Typhi
gccaccaugcugguugg

SEQ ID NO: 3668568 - RNA, 16 nt, Salmonella enterica enterica serovar Typhi
gccaccgcauuuucag

SEQ ID NO: 3668569 - RNA, 12 nt, Salmonella enterica enterica serovar Typhi
gccaccgccagc

SEQ ID NO: 3668570 - RNA, 14 nt, Salmonella enterica enterica serovar Typhi
gccaccgccgccac

SEQ ID NO: 3668571 - RNA, 17 nt, Salmonella enterica enterica serovar Typhi
gccaccgcuccgcgcau

SEQ ID NO: 3668572 - RNA, 17 nt, Salmonella enterica enterica serovar Typhi
gccaccggauugccuuc

SEQ ID NO: 3668573 - RNA, 22 nt, Salmonella enterica enterica serovar Typhi
gccaccgggcagugcaacggcu

SEQ ID NO: 3668574 - RNA, 15 nt, Salmonella enterica enterica serovar Typhi
gccaccgggcauggc

SEQ ID NO: 3668575 - RNA, 21 nt, Salmonella enterica enterica serovar Typhi
gccaccggguuaaagcccuga

SEQ ID NO: 3668576 - RNA, 22 nt, Salmonella enterica enterica serovar Typhi
gccaccgguauuaaagcgcggg

SEQ ID NO: 3668577 - RNA, 20 nt, Salmonella enterica enterica serovar Typhi
gccacgagaaauccacauua

SEQ ID NO: 3668578 - RNA, 16 nt, Salmonella enterica enterica serovar Typhi
gccacgaucggcaaug

SEQ ID NO: 3668579 - RNA, 21 nt, Salmonella enterica enterica serovar Typhi
gccacgcagauaucuuccagc

SEQ ID NO: 3668580 - RNA, 16 nt, Salmonella enterica enterica serovar Typhi
gccacgcagcgcagac

SEQ ID NO: 3668581 - RNA, 17 nt, Salmonella enterica enterica serovar Typhi
gccacgccaccgggccg

SEQ ID NO: 3668582 - RNA, 17 nt, Salmonella enterica enterica serovar Typhi
gccacgccauacguccg

SEQ ID NO: 3668583 - RNA, 14 nt, Salmonella enterica enterica serovar Typhi
gccacgccauugcu

SEQ ID NO: 3668584 - RNA, 12 nt, Salmonella enterica enterica serovar Typhi
gccacgccgcca

SEQ ID NO: 3668585 - RNA, 16 nt, Salmonella enterica enterica serovar Typhi
gccacgccgccauccg

SEQ ID NO: 3668586 - RNA, 18 nt, Salmonella enterica enterica serovar Typhi
gccacgccgcuccacagc

SEQ ID NO: 3668587 - RNA, 22 nt, Salmonella enterica enterica serovar Typhi
gccacgccgcuccacagcaaau

SEQ ID NO: 3668588 - RNA, 14 nt, Salmonella enterica enterica serovar Typhi
gccacgcgacgcca

SEQ ID NO: 3668589 - RNA, 17 nt, Salmonella enterica enterica serovar Typhi
gccacgcucgcuggugc

SEQ ID NO: 3668590 - RNA, 15 nt, Salmonella enterica enterica serovar Typhi
gccacggauggccuc

SEQ ID NO: 3668591 - RNA, 14 nt, Salmonella enterica enterica serovar Typhi
gccacggcaacgcc

SEQ ID NO: 3668592 - RNA, 21 nt, Salmonella enterica enterica serovar Typhi
gccacggcguguugaaauccu

SEQ ID NO: 3668593 - RNA, 22 nt, Salmonella enterica enterica serovar Typhi
gccacggcguguugaaauccuc

SEQ ID NO: 3668594 - RNA, 24 nt, Salmonella enterica enterica serovar Typhi
gccacggcuuucacgccauuggca

SEQ ID NO: 3668595 - RNA, 17 nt, Salmonella enterica enterica serovar Typhi
gccacgguuggcccagc

SEQ ID NO: 3668596 - RNA, 14 nt, Salmonella enterica enterica serovar Typhi
gccacguugcgcgc

SEQ ID NO: 3668597 - RNA, 22 nt, Salmonella enterica enterica serovar Typhi
gccacuauuucggcacugacuc

SEQ ID NO: 3668598 - RNA, 15 nt, Salmonella enterica enterica serovar Typhi
gccacuccuuacggu

SEQ ID NO: 3668599 - RNA, 13 nt, Salmonella enterica enterica serovar Typhi
gccacugcgccau

SEQ ID NO: 3668600 - RNA, 17 nt, Salmonella enterica enterica serovar Typhi
gccacugcugaaagccg

SEQ ID NO: 3668601 - RNA, 21 nt, Salmonella enterica enterica serovar Typhi
gccacuuaccaaucgcggcga

SEQ ID NO: 3668602 - RNA, 18 nt, Salmonella enterica enterica serovar Typhi
gccacuucacuggcggca

SEQ ID NO: 3668603 - RNA, 22 nt, Salmonella enterica enterica serovar Typhi
gccacuucacuggcggcaagcu

SEQ ID NO: 3668604 - RNA, 16 nt, Salmonella enterica enterica serovar Typhi
gccacuuccagcgcgc

SEQ ID NO: 3668605 - RNA, 18 nt, Salmonella enterica enterica serovar Typhi
gccacuucuuccagcggc

SEQ ID NO: 3668606 - RNA, 16 nt, Salmonella enterica enterica serovar Typhi
gccacuuuuccggcac

SEQ ID NO: 3668607 - RNA, 18 nt, Salmonella enterica enterica serovar Typhi
gccagaaaaaaaagcgcc

SEQ ID NO: 3668608 - RNA, 16 nt, Salmonella enterica enterica serovar Typhi
gccagaacucaucuuc

SEQ ID NO: 3668609 - RNA, 20 nt, Salmonella enterica enterica serovar Typhi
gccagaauacaccgccuagc

SEQ ID NO: 3668610 - RNA, 21 nt, Salmonella enterica enterica serovar Typhi
gccagaauacaccgccuagcg

SEQ ID NO: 3668611 - RNA, 17 nt, Salmonella enterica enterica serovar Typhi
gccagaaugcccagcaa

SEQ ID NO: 3668612 - RNA, 19 nt, Salmonella enterica enterica serovar Typhi
gccagacagauaacaccag

SEQ ID NO: 3668613 - RNA, 22 nt, Salmonella enterica enterica serovar Typhi
gccagacagcauuuuucacagu

SEQ ID NO: 3668614 - RNA, 22 nt, Salmonella enterica enterica serovar Typhi
gccagacagcccuauaacagcg

SEQ ID NO: 3668615 - RNA, 16 nt, Salmonella enterica enterica serovar Typhi
gccagaccaauagaga

SEQ ID NO: 3668616 - RNA, 21 nt, Salmonella enterica enterica serovar Typhi
gccagaccccaguaauccggc

SEQ ID NO: 3668617 - RNA, 13 nt, Salmonella enterica enterica serovar Typhi
gccagacccgcgc

SEQ ID NO: 3668618 - RNA, 16 nt, Salmonella enterica enterica serovar Typhi
gccagaccgaaaagcc

SEQ ID NO: 3668619 - RNA, 18 nt, Salmonella enterica enterica serovar Typhi
gccagaccgcuuaacucc

SEQ ID NO: 3668620 - RNA, 18 nt, Salmonella enterica enterica serovar Typhi
gccagacgaacggccuga

SEQ ID NO: 3668621 - RNA, 23 nt, Salmonella enterica enterica serovar Typhi
gccagacgaugaauuccugcggc

SEQ ID NO: 3668622 - RNA, 17 nt, Salmonella enterica enterica serovar Typhi
gccagacgcuuauucgc

SEQ ID NO: 3668623 - RNA, 15 nt, Salmonella enterica enterica serovar Typhi
gccagacucagccag

SEQ ID NO: 3668624 - RNA, 17 nt, Salmonella enterica enterica serovar Typhi
gccagacucaucgccgc

SEQ ID NO: 3668625 - RNA, 18 nt, Salmonella enterica enterica serovar Typhi
gccagacucgcucccuuc

SEQ ID NO: 3668626 - RNA, 17 nt, Salmonella enterica enterica serovar Typhi
gccagacucgcuucacg

SEQ ID NO: 3668627 - RNA, 18 nt, Salmonella enterica enterica serovar Typhi
gccagagaucgcacuacc

SEQ ID NO: 3668628 - RNA, 13 nt, Salmonella enterica enterica serovar Typhi
gccagagcgcgcu

SEQ ID NO: 3668629 - RNA, 16 nt, Salmonella enterica enterica serovar Typhi
gccagaggcagcacau

SEQ ID NO: 3668630 - RNA, 19 nt, Salmonella enterica enterica serovar Typhi
gccagaggcagcacaucaa

SEQ ID NO: 3668631 - RNA, 14 nt, Salmonella enterica enterica serovar Typhi
gccagaggcgugca

SEQ ID NO: 3668632 - RNA, 19 nt, Salmonella enterica enterica serovar Typhi
gccagaggcgugcaugggc

SEQ ID NO: 3668633 - RNA, 19 nt, Salmonella enterica enterica serovar Typhi
gccagauaaagcagcgaca

SEQ ID NO: 3668634 - RNA, 15 nt, Salmonella enterica enterica serovar Typhi
gccagauaaauagcg

SEQ ID NO: 3668635 - RNA, 17 nt, Salmonella enterica enterica serovar Typhi
gccagauaaucgccgcc

SEQ ID NO: 3668636 - RNA, 15 nt, Salmonella enterica enterica serovar Typhi
gccagaugcagcggc

SEQ ID NO: 3668637 - RNA, 22 nt, Salmonella enterica enterica serovar Typhi
gccagauggaaaccggcgucuu

SEQ ID NO: 3668638 - RNA, 19 nt, Salmonella enterica enterica serovar Typhi
gccagauggauaaccugcc

SEQ ID NO: 3668639 - RNA, 21 nt, Salmonella enterica enterica serovar Typhi
gccagauggauaaccugccgg

SEQ ID NO: 3668640 - RNA, 23 nt, Salmonella enterica enterica serovar Typhi
gccagaugguaagcauagcgccu

SEQ ID NO: 3668641 - RNA, 15 nt, Salmonella enterica enterica serovar Typhi
gccagaugucggcgg

SEQ ID NO: 3668642 - RNA, 14 nt, Salmonella enterica enterica serovar Typhi
gccagauucaccac

SEQ ID NO: 3668643 - RNA, 13 nt, Salmonella enterica enterica serovar Typhi
gccagcaaacugg

SEQ ID NO: 3668644 - RNA, 14 nt, Salmonella enterica enterica serovar Typhi
gccagcaacagcgu

SEQ ID NO: 3668645 - RNA, 18 nt, Salmonella enterica enterica serovar Typhi
gccagcaacgcccagaua

SEQ ID NO: 3668646 - RNA, 16 nt, Salmonella enterica enterica serovar Typhi
gccagcaacgcgcuaa

SEQ ID NO: 3668647 - RNA, 17 nt, Salmonella enterica enterica serovar Typhi
gccagcaacguuaaggc

SEQ ID NO: 3668648 - RNA, 17 nt, Salmonella enterica enterica serovar Typhi
gccagcaaggcaagaaa

SEQ ID NO: 3668649 - RNA, 21 nt, Salmonella enterica enterica serovar Typhi
gccagcaaggcaagaaaguca

SEQ ID NO: 3668650 - RNA, 17 nt, Salmonella enterica enterica serovar Typhi
gccagcaauacccagaa

SEQ ID NO: 3668651 - RNA, 16 nt, Salmonella enterica enterica serovar Typhi
gccagcaaugccgccg

SEQ ID NO: 3668652 - RNA, 19 nt, Salmonella enterica enterica serovar Typhi
gccagcaaugccgccgcca

SEQ ID NO: 3668653 - RNA, 22 nt, Salmonella enterica enterica serovar Typhi
gccagcaaugccgccgccaggu

SEQ ID NO: 3668654 - RNA, 15 nt, Salmonella enterica enterica serovar Typhi
gccagcaccagcagc

SEQ ID NO: 3668655 - RNA, 16 nt, Salmonella enterica enterica serovar Typhi
gccagcaccagcauua

SEQ ID NO: 3668656 - RNA, 16 nt, Salmonella enterica enterica serovar Typhi
gccagcaccaggcucg

SEQ ID NO: 3668657 - RNA, 17 nt, Salmonella enterica enterica serovar Typhi
gccagcaccugauagug

SEQ ID NO: 3668658 - RNA, 21 nt, Salmonella enterica enterica serovar Typhi
gccagcacgaggguaauggcu

SEQ ID NO: 3668659 - RNA, 16 nt, Salmonella enterica enterica serovar Typhi
gccagcacggcuucac

SEQ ID NO: 3668660 - RNA, 17 nt, Salmonella enterica enterica serovar Typhi
gccagcagagcgaacag

SEQ ID NO: 3668661 - RNA, 17 nt, Salmonella enterica enterica serovar Typhi
gccagcagcagcgcaau

SEQ ID NO: 3668662 - RNA, 18 nt, Salmonella enterica enterica serovar Typhi
gccagcagcagcgcaaug

SEQ ID NO: 3668663 - RNA, 14 nt, Salmonella enterica enterica serovar Typhi
gccagcagcauaaa

SEQ ID NO: 3668664 - RNA, 13 nt, Salmonella enterica enterica serovar Typhi
gccagcagccauu

SEQ ID NO: 3668665 - RNA, 14 nt, Salmonella enterica enterica serovar Typhi
gccagcagccauuc

SEQ ID NO: 3668666 - RNA, 13 nt, Salmonella enterica enterica serovar Typhi
gccagcagcgcac

SEQ ID NO: 3668667 - RNA, 18 nt, Salmonella enterica enterica serovar Typhi
gccagcagcgcaucaucc

SEQ ID NO: 3668668 - RNA, 19 nt, Salmonella enterica enterica serovar Typhi
gccagcagcucaacggcag

SEQ ID NO: 3668669 - RNA, 15 nt, Salmonella enterica enterica serovar Typhi
gccagcagcucgccg

SEQ ID NO: 3668670 - RNA, 18 nt, Salmonella enterica enterica serovar Typhi
gccagcagggucaggaac

SEQ ID NO: 3668671 - RNA, 11 nt, Salmonella enterica enterica serovar Typhi
gccagcaguug

SEQ ID NO: 3668672 - RNA, 17 nt, Salmonella enterica enterica serovar Typhi
gccagcaguugcagcgu

SEQ ID NO: 3668673 - RNA, 23 nt, Salmonella enterica enterica serovar Typhi
gccagcaguuuuucaaucuuagc

SEQ ID NO: 3668674 - RNA, 15 nt, Salmonella enterica enterica serovar Typhi
gccagcauacagcuu

SEQ ID NO: 3668675 - RNA, 15 nt, Salmonella enterica enterica serovar Typhi
gccagcauaccgccc

SEQ ID NO: 3668676 - RNA, 16 nt, Salmonella enterica enterica serovar Typhi
gccagcauaccgccca

SEQ ID NO: 3668677 - RNA, 23 nt, Salmonella enterica enterica serovar Typhi
gccagcauaugcacacgcagcug

SEQ ID NO: 3668678 - RNA, 19 nt, Salmonella enterica enterica serovar Typhi
gccagcaucggcagcgcca

SEQ ID NO: 3668679 - RNA, 22 nt, Salmonella enterica enterica serovar Typhi
gccagcauuucaaucgcgcccg

SEQ ID NO: 3668680 - RNA, 22 nt, Salmonella enterica enterica serovar Typhi
gccagcauuuccagcugguuaa

SEQ ID NO: 3668681 - RNA, 16 nt, Salmonella enterica enterica serovar Typhi
gccagcauuuuuccac

SEQ ID NO: 3668682 - RNA, 18 nt, Salmonella enterica enterica serovar Typhi
gccagccaaauagcgcca

SEQ ID NO: 3668683 - RNA, 14 nt, Salmonella enterica enterica serovar Typhi
gccagccagcgcca

SEQ ID NO: 3668684 - RNA, 15 nt, Salmonella enterica enterica serovar Typhi
gccagccagcgccac

SEQ ID NO: 3668685 - RNA, 16 nt, Salmonella enterica enterica serovar Typhi
gccagccauggcccuu

SEQ ID NO: 3668686 - RNA, 16 nt, Salmonella enterica enterica serovar Typhi
gccagccauucaccac

SEQ ID NO: 3668687 - RNA, 20 nt, Salmonella enterica enterica serovar Typhi
gccagccauugaugcaggcg

SEQ ID NO: 3668688 - RNA, 14 nt, Salmonella enterica enterica serovar Typhi
gccagccccagaaa

SEQ ID NO: 3668689 - RNA, 20 nt, Salmonella enterica enterica serovar Typhi
gccagcccgaucaucuccug

SEQ ID NO: 3668690 - RNA, 22 nt, Salmonella enterica enterica serovar Typhi
gccagcccgaucaucuccugua

SEQ ID NO: 3668691 - RNA, 19 nt, Salmonella enterica enterica serovar Typhi
gccagccgauuuuucggca

SEQ ID NO: 3668692 - RNA, 21 nt, Salmonella enterica enterica serovar Typhi
gccagccgcucugcuguuccu

SEQ ID NO: 3668693 - RNA, 12 nt, Salmonella enterica enterica serovar Typhi
gccagccuuccc

SEQ ID NO: 3668694 - RNA, 20 nt, Salmonella enterica enterica serovar Typhi
gccagcgaaaaccagcgccg

SEQ ID NO: 3668695 - RNA, 15 nt, Salmonella enterica enterica serovar Typhi
gccagcgaaguaauc

SEQ ID NO: 3668696 - RNA, 19 nt, Salmonella enterica enterica serovar Typhi
gccagcgauggggcaagcu

SEQ ID NO: 3668697 - RNA, 17 nt, Salmonella enterica enterica serovar Typhi
gccagcgcaacgcgcau

SEQ ID NO: 3668698 - RNA, 15 nt, Salmonella enterica enterica serovar Typhi
gccagcgccagcagc

SEQ ID NO: 3668699 - RNA, 12 nt, Salmonella enterica enterica serovar Typhi
gccagcgccgcc

SEQ ID NO: 3668700 - RNA, 16 nt, Salmonella enterica enterica serovar Typhi
gccagcgccgccgcuu

SEQ ID NO: 3668701 - RNA, 18 nt, Salmonella enterica enterica serovar Typhi
gccagcgccguuguccgu

SEQ ID NO: 3668702 - RNA, 14 nt, Salmonella enterica enterica serovar Typhi
gccagcgccuuagg

SEQ ID NO: 3668703 - RNA, 14 nt, Salmonella enterica enterica serovar Typhi
gccagcgcgggcga

SEQ ID NO: 3668704 - RNA, 19 nt, Salmonella enterica enterica serovar Typhi
gccagcgcguuuuccauuu

SEQ ID NO: 3668705 - RNA, 23 nt, Salmonella enterica enterica serovar Typhi
gccagcgcuaauugugcgggggu

SEQ ID NO: 3668706 - RNA, 17 nt, Salmonella enterica enterica serovar Typhi
gccagcgcuacccgcug

SEQ ID NO: 3668707 - RNA, 24 nt, Salmonella enterica enterica serovar Typhi
gccagcgcuacccgcugacgcugc

SEQ ID NO: 3668708 - RNA, 14 nt, Salmonella enterica enterica serovar Typhi
gccagcggccagcc

SEQ ID NO: 3668709 - RNA, 15 nt, Salmonella enterica enterica serovar Typhi
gccagcggcgcgaug

SEQ ID NO: 3668710 - RNA, 19 nt, Salmonella enterica enterica serovar Typhi
gccagcggcugcuccccca

SEQ ID NO: 3668711 - RNA, 13 nt, Salmonella enterica enterica serovar Typhi
gccagcgggcgca

SEQ ID NO: 3668712 - RNA, 18 nt, Salmonella enterica enterica serovar Typhi
gccagcguaccagcguca

SEQ ID NO: 3668713 - RNA, 13 nt, Salmonella enterica enterica serovar Typhi
gccagcguauuuu

SEQ ID NO: 3668714 - RNA, 17 nt, Salmonella enterica enterica serovar Typhi
gccagcgucaucagauc

SEQ ID NO: 3668715 - RNA, 18 nt, Salmonella enterica enterica serovar Typhi
gccagcgucucagcaggc

SEQ ID NO: 3668716 - RNA, 16 nt, Salmonella enterica enterica serovar Typhi
gccagcgugacccaga

SEQ ID NO: 3668717 - RNA, 17 nt, Salmonella enterica enterica serovar Typhi
gccagcgugcgcagcgc

SEQ ID NO: 3668718 - RNA, 12 nt, Salmonella enterica enterica serovar Typhi
gccagcgugcuu

SEQ ID NO: 3668719 - RNA, 14 nt, Salmonella enterica enterica serovar Typhi
gccauauacgccac

SEQ ID NO: 3668720 - RNA, 20 nt, Salmonella enterica enterica serovar Typhi
gccauauauuuacugaauaa

SEQ ID NO: 3668721 - RNA, 15 nt, Salmonella enterica enterica serovar Typhi
gccauauccagccag

SEQ ID NO: 3668722 - RNA, 15 nt, Salmonella enterica enterica serovar Typhi
gccauaucgccgcca

SEQ ID NO: 3668723 - RNA, 18 nt, Salmonella enterica enterica serovar Typhi
gccauaucggcacugcuu

SEQ ID NO: 3668724 - RNA, 21 nt, Salmonella enterica enterica serovar Typhi
gccauauggcauucgcagagg

SEQ ID NO: 3668725 - RNA, 15 nt, Salmonella enterica enterica serovar Typhi
gccauauguuccacc

SEQ ID NO: 3668726 - RNA, 18 nt, Salmonella enterica enterica serovar Typhi
gccauauugccgcacaug

SEQ ID NO: 3668727 - RNA, 13 nt, Salmonella enterica enterica serovar Typhi
gccauauugcugu

SEQ ID NO: 3668728 - RNA, 22 nt, Salmonella enterica enterica serovar Typhi
gccaucagcaaaauaccggcag

SEQ ID NO: 3668729 - RNA, 14 nt, Salmonella enterica enterica serovar Typhi
gccaucagcaccuu

SEQ ID NO: 3668730 - RNA, 18 nt, Salmonella enterica enterica serovar Typhi
gccaucaggcaaucuuua

SEQ ID NO: 3668731 - RNA, 17 nt, Salmonella enterica enterica serovar Typhi
gccaucaggcaaugucu

SEQ ID NO: 3668732 - RNA, 12 nt, Salmonella enterica enterica serovar Typhi
gccaucaggcag

SEQ ID NO: 3668733 - RNA, 19 nt, Salmonella enterica enterica serovar Typhi
gccaucaggcagauuaauc

SEQ ID NO: 3668734 - RNA, 18 nt, Salmonella enterica enterica serovar Typhi
gccaucaggcaucugaaa

SEQ ID NO: 3668735 - RNA, 23 nt, Salmonella enterica enterica serovar Typhi
gccaucaggccccccuuguuauc

SEQ ID NO: 3668736 - RNA, 15 nt, Salmonella enterica enterica serovar Typhi
gccaucaucaguaac

SEQ ID NO: 3668737 - RNA, 14 nt, Salmonella enterica enterica serovar Typhi
gccaucaugcccac

SEQ ID NO: 3668738 - RNA, 21 nt, Salmonella enterica enterica serovar Typhi
gccaucaugcccacaggcagg

SEQ ID NO: 3668739 - RNA, 22 nt, Salmonella enterica enterica serovar Typhi
gccaucauuaauuuacugauaa

SEQ ID NO: 3668740 - RNA, 17 nt, Salmonella enterica enterica serovar Typhi
gccauccaccaggcaug

SEQ ID NO: 3668741 - RNA, 19 nt, Salmonella enterica enterica serovar Typhi
gccauccacggccccgggc

SEQ ID NO: 3668742 - RNA, 18 nt, Salmonella enterica enterica serovar Typhi
gccauccaucuccggcau

SEQ ID NO: 3668743 - RNA, 19 nt, Salmonella enterica enterica serovar Typhi
gccaucccgcugaucgccg

SEQ ID NO: 3668744 - RNA, 18 nt, Salmonella enterica enterica serovar Typhi
gccaucccggcgacagcg

SEQ ID NO: 3668745 - RNA, 16 nt, Salmonella enterica enterica serovar Typhi
gccaucccugacaaua

SEQ ID NO: 3668746 - RNA, 22 nt, Salmonella enterica enterica serovar Typhi
gccauccgacgccuuuaccacc

SEQ ID NO: 3668747 - RNA, 22 nt, Salmonella enterica enterica serovar Typhi
gccauccggcaaacucagcggc

SEQ ID NO: 3668748 - RNA, 16 nt, Salmonella enterica enterica serovar Typhi
gccauccggcaacaaa

SEQ ID NO: 3668749 - RNA, 17 nt, Salmonella enterica enterica serovar Typhi
gccauccggcacuacag

SEQ ID NO: 3668750 - RNA, 20 nt, Salmonella enterica enterica serovar Typhi
gccauccggcacuacagcgu

SEQ ID NO: 3668751 - RNA, 13 nt, Salmonella enterica enterica serovar Typhi
gccauccggcauu

SEQ ID NO: 3668752 - RNA, 11 nt, Salmonella enterica enterica serovar Typhi
gccauccggcc

SEQ ID NO: 3668753 - RNA, 15 nt, Salmonella enterica enterica serovar Typhi
gccauccggcgcuga

SEQ ID NO: 3668754 - RNA, 14 nt, Salmonella enterica enterica serovar Typhi
gccauccucacgca

SEQ ID NO: 3668755 - RNA, 18 nt, Salmonella enterica enterica serovar Typhi
gccauccugaguauaaaa

SEQ ID NO: 3668756 - RNA, 19 nt, Salmonella enterica enterica serovar Typhi
gccauccugccgcaccagu

SEQ ID NO: 3668757 - RNA, 23 nt, Salmonella enterica enterica serovar Typhi
gccauccugccgcaccagucggc

SEQ ID NO: 3668758 - RNA, 16 nt, Salmonella enterica enterica serovar Typhi
gccauccugcgugccg

SEQ ID NO: 3668759 - RNA, 22 nt, Salmonella enterica enterica serovar Typhi
gccauccuguucaagcaauaau

SEQ ID NO: 3668760 - RNA, 15 nt, Salmonella enterica enterica serovar Typhi
gccaucgacagcgcc

SEQ ID NO: 3668761 - RNA, 16 nt, Salmonella enterica enterica serovar Typhi
gccaucgacagcgcca

SEQ ID NO: 3668762 - RNA, 22 nt, Salmonella enterica enterica serovar Typhi
gccaucgacgcgcaucacaaug

SEQ ID NO: 3668763 - RNA, 14 nt, Salmonella enterica enterica serovar Typhi
gccaucgccucgau

SEQ ID NO: 3668764 - RNA, 16 nt, Salmonella enterica enterica serovar Typhi
gccaucgcggcgcaaa

SEQ ID NO: 3668765 - RNA, 20 nt, Salmonella enterica enterica serovar Typhi
gccaucguaggcgcaaaccg

SEQ ID NO: 3668766 - RNA, 14 nt, Salmonella enterica enterica serovar Typhi
gccaucgucacgca

SEQ ID NO: 3668767 - RNA, 17 nt, Salmonella enterica enterica serovar Typhi
gccaucucauucgccag

SEQ ID NO: 3668768 - RNA, 22 nt, Salmonella enterica enterica serovar Typhi
gccaucuccaucauuuccggcg

SEQ ID NO: 3668769 - RNA, 17 nt, Salmonella enterica enterica serovar Typhi
gccaucugugccagccc

SEQ ID NO: 3668770 - RNA, 18 nt, Salmonella enterica enterica serovar Typhi
gccaucuuccagcaucag

SEQ ID NO: 3668771 - RNA, 13 nt, Salmonella enterica enterica serovar Typhi
gccaucuuccuca

SEQ ID NO: 3668772 - RNA, 18 nt, Salmonella enterica enterica serovar Typhi
gccaucuuuacccugagc

SEQ ID NO: 3668773 - RNA, 19 nt, Salmonella enterica enterica serovar Typhi
gccaucuuuacccugagcc

SEQ ID NO: 3668774 - RNA, 14 nt, Salmonella enterica enterica serovar Typhi
gccaucuuugcacc

SEQ ID NO: 3668775 - RNA, 15 nt, Salmonella enterica enterica serovar Typhi
gccaucuuuuuucac

SEQ ID NO: 3668776 - RNA, 14 nt, Salmonella enterica enterica serovar Typhi
gccaugaaaaaaac

SEQ ID NO: 3668777 - RNA, 13 nt, Salmonella enterica enterica serovar Typhi
gccaugaauaauc

SEQ ID NO: 3668778 - RNA, 22 nt, Salmonella enterica enterica serovar Typhi
gccaugaccauucacacuccag

SEQ ID NO: 3668779 - RNA, 14 nt, Salmonella enterica enterica serovar Typhi
gccaugauccuggu

SEQ ID NO: 3668780 - RNA, 15 nt, Salmonella enterica enterica serovar Typhi
gccaugaucgccgcc

SEQ ID NO: 3668781 - RNA, 16 nt, Salmonella enterica enterica serovar Typhi
gccaugaucgccgcca

SEQ ID NO: 3668782 - RNA, 18 nt, Salmonella enterica enterica serovar Typhi
gccaugaucgccgccauc

SEQ ID NO: 3668783 - RNA, 16 nt, Salmonella enterica enterica serovar Typhi
gccaugaugagcgcca

SEQ ID NO: 3668784 - RNA, 18 nt, Salmonella enterica enterica serovar Typhi
gccaugaugagcgccaua

SEQ ID NO: 3668785 - RNA, 21 nt, Salmonella enterica enterica serovar Typhi
gccaugauucaucccgcugug

SEQ ID NO: 3668786 - RNA, 18 nt, Salmonella enterica enterica serovar Typhi
gccaugccuuugacucug

SEQ ID NO: 3668787 - RNA, 19 nt, Salmonella enterica enterica serovar Typhi
gccaugcucauccaacugc

SEQ ID NO: 3668788 - RNA, 19 nt, Salmonella enterica enterica serovar Typhi
gccaugcuggcucuugguu

SEQ ID NO: 3668789 - RNA, 21 nt, Salmonella enterica enterica serovar Typhi
gccaugcugugugaccagcag

SEQ ID NO: 3668790 - RNA, 12 nt, Salmonella enterica enterica serovar Typhi
gccauggagaaa

SEQ ID NO: 3668791 - RNA, 13 nt, Salmonella enterica enterica serovar Typhi
gccauggccgcag

SEQ ID NO: 3668792 - RNA, 21 nt, Salmonella enterica enterica serovar Typhi
gccaugguucacaauacagaa

SEQ ID NO: 3668793 - RNA, 14 nt, Salmonella enterica enterica serovar Typhi
gccaugucuucacu

SEQ ID NO: 3668794 - RNA, 16 nt, Salmonella enterica enterica serovar Typhi
gccaugucuucacucu

SEQ ID NO: 3668795 - RNA, 20 nt, Salmonella enterica enterica serovar Typhi
gccauguuaauaccagcgcc

SEQ ID NO: 3668796 - RNA, 19 nt, Salmonella enterica enterica serovar Typhi
gccauguugcguaaauaaa

SEQ ID NO: 3668797 - RNA, 13 nt, Salmonella enterica enterica serovar Typhi
gccauuaaccaga

SEQ ID NO: 3668798 - RNA, 20 nt, Salmonella enterica enterica serovar Typhi
gccauuaaugcaggcagcac

SEQ ID NO: 3668799 - RNA, 14 nt, Salmonella enterica enterica serovar Typhi
gccauuaucaccau

SEQ ID NO: 3668800 - RNA, 22 nt, Salmonella enterica enterica serovar Typhi
gccauuaucaccauucccagcg

SEQ ID NO: 3668801 - RNA, 20 nt, Salmonella enterica enterica serovar Typhi
gccauuaucgaucugagcgc

SEQ ID NO: 3668802 - RNA, 17 nt, Salmonella enterica enterica serovar Typhi
gccauuauuguguucuc

SEQ ID NO: 3668803 - RNA, 18 nt, Salmonella enterica enterica serovar Typhi
gccauuauuguguucuca

SEQ ID NO: 3668804 - RNA, 13 nt, Salmonella enterica enterica serovar Typhi
gccauucaccacu

SEQ ID NO: 3668805 - RNA, 21 nt, Salmonella enterica enterica serovar Typhi
gcccauucuucgucgucauca

SEQ ID NO: 3668806 - RNA, 15 nt, Salmonella enterica enterica serovar Typhi
gcccauugaaaucgc

SEQ ID NO: 3668807 - RNA, 21 nt, Salmonella enterica enterica serovar Typhi
gcccauuuggcuuaaauaauc

SEQ ID NO: 3668808 - RNA, 16 nt, Salmonella enterica enterica serovar Typhi
gcccauuuuccuccca

SEQ ID NO: 3668809 - RNA, 17 nt, Salmonella enterica enterica serovar Typhi
gccccacacggccacca

SEQ ID NO: 3668810 - RNA, 20 nt, Salmonella enterica enterica serovar Typhi
gccccacgauacgccccugc

SEQ ID NO: 3668811 - RNA, 17 nt, Salmonella enterica enterica serovar Typhi
gccccacuggcccccug

SEQ ID NO: 3668812 - RNA, 12 nt, Salmonella enterica enterica serovar Typhi
gccccagacgcc

SEQ ID NO: 3668813 - RNA, 13 nt, Salmonella enterica enterica serovar Typhi
gccccagacgccc

SEQ ID NO: 3668814 - RNA, 18 nt, Salmonella enterica enterica serovar Typhi
gccccagauacgcacggu

SEQ ID NO: 3668815 - RNA, 14 nt, Salmonella enterica enterica serovar Typhi
gccccagcacaauc

SEQ ID NO: 3668816 - RNA, 18 nt, Salmonella enterica enterica serovar Typhi
gccccagcaugagccagc

SEQ ID NO: 3668817 - RNA, 20 nt, Salmonella enterica enterica serovar Typhi
gccccagcaugagccagccc

SEQ ID NO: 3668818 - RNA, 21 nt, Salmonella enterica enterica serovar Typhi
gccccagcaugagccagcccu

SEQ ID NO: 3668819 - RNA, 11 nt, Salmonella enterica enterica serovar Typhi
gccccagcccu

SEQ ID NO: 3668820 - RNA, 17 nt, Salmonella enterica enterica serovar Typhi
gccccagcccugugccg

SEQ ID NO: 3668821 - RNA, 12 nt, Salmonella enterica enterica serovar Typhi
gccccagcgcca

SEQ ID NO: 3668822 - RNA, 17 nt, Salmonella enterica enterica serovar Typhi
gccccagcgccagccgc

SEQ ID NO: 3668823 - RNA, 21 nt, Salmonella enterica enterica serovar Typhi
gccccagcgccagcugcguca

SEQ ID NO: 3668824 - RNA, 23 nt, Salmonella enterica enterica serovar Typhi
gccccaggcuauccagcucaccg

SEQ ID NO: 3668825 - RNA, 23 nt, Salmonella enterica enterica serovar Typhi
gccccagguuugaggcuugcagc

SEQ ID NO: 3668826 - RNA, 16 nt, Salmonella enterica enterica serovar Typhi
gccccaucagcacaug

SEQ ID NO: 3668827 - RNA, 16 nt, Salmonella enterica enterica serovar Typhi
gccccauguggccagc

SEQ ID NO: 3668828 - RNA, 17 nt, Salmonella enterica enterica serovar Typhi
gcccccauacgcgcgcc

SEQ ID NO: 3668829 - RNA, 19 nt, Salmonella enterica enterica serovar Typhi
gcccccaugccgccugccg

SEQ ID NO: 3668830 - RNA, 15 nt, Salmonella enterica enterica serovar Typhi
gccccccgcacagca

SEQ ID NO: 3668831 - RNA, 17 nt, Salmonella enterica enterica serovar Typhi
gccccccuaccggaauc

SEQ ID NO: 3668832 - RNA, 17 nt, Salmonella enterica enterica serovar Typhi
gcccccgaucacggcga

SEQ ID NO: 3668833 - RNA, 17 nt, Salmonella enterica enterica serovar Typhi
gccccgacaaaacgggc

SEQ ID NO: 3668834 - RNA, 12 nt, Salmonella enterica enterica serovar Typhi
gccccgaccagg

SEQ ID NO: 3668835 - RNA, 23 nt, Salmonella enterica enterica serovar Typhi
gccccgccgcauugguaaagccg

SEQ ID NO: 3668836 - RNA, 20 nt, Salmonella enterica enterica serovar Typhi
gccccgccgcgcggccccau

SEQ ID NO: 3668837 - RNA, 23 nt, Salmonella enterica enterica serovar Typhi
gccccgguggcgguaccggcauu

SEQ ID NO: 3668838 - RNA, 23 nt, Salmonella enterica enterica serovar Typhi
gccccguggcgggaugccccacu

SEQ ID NO: 3668839 - RNA, 14 nt, Salmonella enterica enterica serovar Typhi
gccccuaaggcagc

SEQ ID NO: 3668840 - RNA, 11 nt, Salmonella enterica enterica serovar Typhi
gccccucccug

SEQ ID NO: 3668841 - RNA, 16 nt, Salmonella enterica enterica serovar Typhi
gccccucuugcagcaa

SEQ ID NO: 3668842 - RNA, 19 nt, Salmonella enterica enterica serovar Typhi
gccccugaaauaacagacu

SEQ ID NO: 3668843 - RNA, 19 nt, Salmonella enterica enterica serovar Typhi
gccccugagcaaucaguuc

SEQ ID NO: 3668844 - RNA, 14 nt, Salmonella enterica enterica serovar Typhi
gccccugcgccagc

SEQ ID NO: 3668845 - RNA, 20 nt, Salmonella enterica enterica serovar Typhi
gccccugcgucaccgugcca

SEQ ID NO: 3668846 - RNA, 15 nt, Salmonella enterica enterica serovar Typhi
gccccugggcgaaaa

SEQ ID NO: 3668847 - RNA, 18 nt, Salmonella enterica enterica serovar Typhi
gccccuguuucgcccgcu

SEQ ID NO: 3668848 - RNA, 14 nt, Salmonella enterica enterica serovar Typhi
gccccuuccgccac

SEQ ID NO: 3668849 - RNA, 17 nt, Salmonella enterica enterica serovar Typhi
gccccuuccgccacggc

SEQ ID NO: 3668850 - RNA, 16 nt, Salmonella enterica enterica serovar Typhi
gccccuuuacgcguga

SEQ ID NO: 3668851 - RNA, 23 nt, Salmonella enterica enterica serovar Typhi
gcccgacaggguuugccagcacc

SEQ ID NO: 3668852 - RNA, 19 nt, Salmonella enterica enterica serovar Typhi
gcccgauaagcaagcgcca

SEQ ID NO: 3668853 - RNA, 20 nt, Salmonella enterica enterica serovar Typhi
gcccgauaagcaagcgccau

SEQ ID NO: 3668854 - RNA, 18 nt, Salmonella enterica enterica serovar Typhi
gcccgauacccgcccaga

SEQ ID NO: 3668855 - RNA, 13 nt, Salmonella enterica enterica serovar Typhi
gcccgaucguccg

SEQ ID NO: 3668856 - RNA, 17 nt, Salmonella enterica enterica serovar Typhi
gcccgaugagcuugcac

SEQ ID NO: 3668857 - RNA, 14 nt, Salmonella enterica enterica serovar Typhi
gcccgauggcgcug

SEQ ID NO: 3668858 - RNA, 15 nt, Salmonella enterica enterica serovar Typhi
gcccgauggcgcugc

SEQ ID NO: 3668859 - RNA, 20 nt, Salmonella enterica enterica serovar Typhi
gcccgauggcgcugcgcgca

SEQ ID NO: 3668860 - RNA, 21 nt, Salmonella enterica enterica serovar Typhi
gcccgcaaacagagcgccggc

SEQ ID NO: 3668861 - RNA, 22 nt, Salmonella enterica enterica serovar Typhi
gcccgcaaaggaccaacaccag

SEQ ID NO: 3668862 - RNA, 23 nt, Salmonella enterica enterica serovar Typhi
gcccgccaccagcacagcccagu

SEQ ID NO: 3668863 - RNA, 16 nt, Salmonella enterica enterica serovar Typhi
gcccgccagcacagca

SEQ ID NO: 3668864 - RNA, 13 nt, Salmonella enterica enterica serovar Typhi
gcccgccagcacc

SEQ ID NO: 3668865 - RNA, 15 nt, Salmonella enterica enterica serovar Typhi
gcccgcccacaggcu

SEQ ID NO: 3668866 - RNA, 16 nt, Salmonella enterica enterica serovar Typhi
gcccgccgcaaaaaau

SEQ ID NO: 3668867 - RNA, 13 nt, Salmonella enterica enterica serovar Typhi
gcccgccgccaau

SEQ ID NO: 3668868 - RNA, 16 nt, Salmonella enterica enterica serovar Typhi
uuauauuacuggcuau

SEQ ID NO: 3668869 - RNA, 16 nt, Salmonella enterica enterica serovar Typhi
uuauauucuucgccca

SEQ ID NO: 3668870 - RNA, 24 nt, Salmonella enterica enterica serovar Typhi
uuauauugcguaaaaacccuuuca

SEQ ID NO: 3668871 - RNA, 15 nt, Salmonella enterica enterica serovar Typhi
uuauauuuaaaauuc

SEQ ID NO: 3668872 - RNA, 16 nt, Salmonella enterica enterica serovar Typhi
uuauauuuaaaauucc

SEQ ID NO: 3668873 - RNA, 11 nt, Salmonella enterica enterica serovar Typhi
uuauauuuauu

SEQ ID NO: 3668874 - RNA, 16 nt, Salmonella enterica enterica serovar Typhi
uuaucaaucugcuuuu

SEQ ID NO: 3668875 - RNA, 21 nt, Salmonella enterica enterica serovar Typhi
uuaucacccacaggagccagu

SEQ ID NO: 3668876 - RNA, 23 nt, Salmonella enterica enterica serovar Typhi
uuaucacugguuauaugaauaaa

SEQ ID NO: 3668877 - RNA, 21 nt, Salmonella enterica enterica serovar Typhi
uuaucaggccgacaaaugacg

SEQ ID NO: 3668878 - RNA, 21 nt, Salmonella enterica enterica serovar Typhi
uuaucauaaugucccugccac

SEQ ID NO: 3668879 - RNA, 16 nt, Salmonella enterica enterica serovar Typhi
uuaucaucguaaaauc

SEQ ID NO: 3668880 - RNA, 16 nt, Salmonella enterica enterica serovar Typhi
uuaucauucacuuuca

SEQ ID NO: 3668881 - RNA, 13 nt, Salmonella enterica enterica serovar Typhi
uuauccaacagcg

SEQ ID NO: 3668882 - RNA, 17 nt, Salmonella enterica enterica serovar Typhi
uuauccacaaacuccag

SEQ ID NO: 3668883 - RNA, 11 nt, Salmonella enterica enterica serovar Typhi
uuauccagcaa

SEQ ID NO: 3668884 - RNA, 13 nt, Salmonella enterica enterica serovar Typhi
uuauccaguaacg

SEQ ID NO: 3668885 - RNA, 18 nt, Salmonella enterica enterica serovar Typhi
uuauccagucccaccggg

SEQ ID NO: 3668886 - RNA, 17 nt, Salmonella enterica enterica serovar Typhi
uuauccauguuuguuua

SEQ ID NO: 3668887 - RNA, 17 nt, Salmonella enterica enterica serovar Typhi
uuaucccgcccgaucuc

SEQ ID NO: 3668888 - RNA, 18 nt, Salmonella enterica enterica serovar Typhi
uuauccgcagauccagca

SEQ ID NO: 3668889 - RNA, 18 nt, Salmonella enterica enterica serovar Typhi
uuauccggccuacgcguc

SEQ ID NO: 3668890 - RNA, 21 nt, Salmonella enterica enterica serovar Typhi
uuauccggccugcgaucugug

SEQ ID NO: 3668891 - RNA, 16 nt, Salmonella enterica enterica serovar Typhi
uuauccggcguguaaa

SEQ ID NO: 3668892 - RNA, 22 nt, Salmonella enterica enterica serovar Typhi
uuauccggcuuacggcuauucc

SEQ ID NO: 3668893 - RNA, 16 nt, Salmonella enterica enterica serovar Typhi
uuauccguuauuuaau

SEQ ID NO: 3668894 - RNA, 18 nt, Salmonella enterica enterica serovar Typhi
uuauccucacuugccgag

SEQ ID NO: 3668895 - RNA, 16 nt, Salmonella enterica enterica serovar Typhi
uuauccuccagccagc

SEQ ID NO: 3668896 - RNA, 16 nt, Salmonella enterica enterica serovar Typhi
uuauccugcaaauagc

SEQ ID NO: 3668897 - RNA, 13 nt, Salmonella enterica enterica serovar Typhi
uuauccugcacga

SEQ ID NO: 3668898 - RNA, 17 nt, Salmonella enterica enterica serovar Typhi
uuauccuguguuuggcc

SEQ ID NO: 3668899 - RNA, 13 nt, Salmonella enterica enterica serovar Typhi
uuaucgacgcuau

SEQ ID NO: 3668900 - RNA, 20 nt, Salmonella enterica enterica serovar Typhi
uuaucgccgaaagcgaucac

SEQ ID NO: 3668901 - RNA, 11 nt, Salmonella enterica enterica serovar Typhi
uuaucgccgau

SEQ ID NO: 3668902 - RNA, 17 nt, Salmonella enterica enterica serovar Typhi
uuaucgccgaucacaaa

SEQ ID NO: 3668903 - RNA, 13 nt, Salmonella enterica enterica serovar Typhi
uuaucgccugggg

SEQ ID NO: 3668904 - RNA, 13 nt, Salmonella enterica enterica serovar Typhi
uuaucguccggca

SEQ ID NO: 3668905 - RNA, 18 nt, Salmonella enterica enterica serovar Typhi
uuaucguccgucagaucc

SEQ ID NO: 3668906 - RNA, 20 nt, Salmonella enterica enterica serovar Typhi
uuaucuccccaauugcugcu

SEQ ID NO: 3668907 - RNA, 16 nt, Salmonella enterica enterica serovar Typhi
uuaucucuacuuuccu

SEQ ID NO: 3668908 - RNA, 17 nt, Salmonella enterica enterica serovar Typhi
uuaucucuacuuuccug

SEQ ID NO: 3668909 - RNA, 18 nt, Salmonella enterica enterica serovar Typhi
uuaucugacauauacaaa

SEQ ID NO: 3668910 - RNA, 12 nt, Salmonella enterica enterica serovar Typhi
uuaucuguugau

SEQ ID NO: 3668911 - RNA, 12 nt, Salmonella enterica enterica serovar Typhi
uuaucuucaagg

SEQ ID NO: 3668912 - RNA, 11 nt, Salmonella enterica enterica serovar Typhi
uuaucuuccac

SEQ ID NO: 3668913 - RNA, 17 nt, Salmonella enterica enterica serovar Typhi
uuaucuuccacgguaaa

SEQ ID NO: 3668914 - RNA, 20 nt, Salmonella enterica enterica serovar Typhi
uuaucuugagucaaaagauu

SEQ ID NO: 3668915 - RNA, 16 nt, Salmonella enterica enterica serovar Typhi
uuaucuuuaaauuuca

SEQ ID NO: 3668916 - RNA, 22 nt, Salmonella enterica enterica serovar Typhi
uuaucuuuaccagggaauauga

SEQ ID NO: 3668917 - RNA, 17 nt, Salmonella enterica enterica serovar Typhi
uuaucuuuuacgcuguc

SEQ ID NO: 3668918 - RNA, 14 nt, Salmonella enterica enterica serovar Typhi
uuaugaaugacagu

SEQ ID NO: 3668919 - RNA, 19 nt, Salmonella enterica enterica serovar Typhi
uuaugaccauacugcucaa

SEQ ID NO: 3668920 - RNA, 20 nt, Salmonella enterica enterica serovar Typhi
uuaugaccguauuacaagua

SEQ ID NO: 3668921 - RNA, 21 nt, Salmonella enterica enterica serovar Typhi
uuaugaccguauuacaaguaa

SEQ ID NO: 3668922 - RNA, 13 nt, Salmonella enterica enterica serovar Typhi
uuaugaucgccca

SEQ ID NO: 3668923 - RNA, 22 nt, Salmonella enterica enterica serovar Typhi
uuaugaucgcccagccacuccu

SEQ ID NO: 3668924 - RNA, 17 nt, Salmonella enterica enterica serovar Typhi
uuaugauuuuaacauca

SEQ ID NO: 3668925 - RNA, 13 nt, Salmonella enterica enterica serovar Typhi
uuaugcaguuccg

SEQ ID NO: 3668926 - RNA, 22 nt, Salmonella enterica enterica serovar Typhi
uuaugcaguuccguugcaauau

SEQ ID NO: 3668927 - RNA, 20 nt, Salmonella enterica enterica serovar Typhi
uuaugcaucuggucagguga

SEQ ID NO: 3668928 - RNA, 15 nt, Salmonella enterica enterica serovar Typhi
uuaugcauugccaug

SEQ ID NO: 3668929 - RNA, 17 nt, Salmonella enterica enterica serovar Typhi
uuaugccccauauaagg

SEQ ID NO: 3668930 - RNA, 20 nt, Salmonella enterica enterica serovar Typhi
uuaugcccggaugauuauca

SEQ ID NO: 3668931 - RNA, 22 nt, Salmonella enterica enterica serovar Typhi
uuaugccgaccaaugacgcuau

SEQ ID NO: 3668932 - RNA, 11 nt, Salmonella enterica enterica serovar Typhi
uuaugccucuu

SEQ ID NO: 3668933 - RNA, 18 nt, Salmonella enterica enterica serovar Typhi
uuaugcggcgcuuccaga

SEQ ID NO: 3668934 - RNA, 21 nt, Salmonella enterica enterica serovar Typhi
uuaugcgucaaaguugcauca

SEQ ID NO: 3668935 - RNA, 21 nt, Salmonella enterica enterica serovar Typhi
uuauggaggauauaaaaaaca

SEQ ID NO: 3668936 - RNA, 12 nt, Salmonella enterica enterica serovar Typhi
uucauaccacug

SEQ ID NO: 3668937 - RNA, 14 nt, Salmonella enterica enterica serovar Typhi
uucauagaaccacu

SEQ ID NO: 3668938 - RNA, 17 nt, Salmonella enterica enterica serovar Typhi
uucauagagaagucuga

SEQ ID NO: 3668939 - RNA, 15 nt, Salmonella enterica enterica serovar Typhi
uucauagccguggcu

SEQ ID NO: 3668940 - RNA, 20 nt, Salmonella enterica enterica serovar Typhi
uucauaugcgccaacugcau

SEQ ID NO: 3668941 - RNA, 23 nt, Salmonella enterica enterica serovar Typhi
uucauauuauuauauagacuccg

SEQ ID NO: 3668942 - RNA, 16 nt, Salmonella enterica enterica serovar Typhi
uucaucaaagaaaacc

SEQ ID NO: 3668943 - RNA, 16 nt, Salmonella enterica enterica serovar Typhi
uucaucaaagaaauac

SEQ ID NO: 3668944 - RNA, 11 nt, Salmonella enterica enterica serovar Typhi
uucaucaccau

SEQ ID NO: 3668945 - RNA, 18 nt, Salmonella enterica enterica serovar Typhi
uucaucaggcaauaaaca

SEQ ID NO: 3668946 - RNA, 17 nt, Salmonella enterica enterica serovar Typhi
uucaucaggcugacgaa

SEQ ID NO: 3668947 - RNA, 21 nt, Salmonella enterica enterica serovar Typhi
uucaucauacugaagauaaac

SEQ ID NO: 3668948 - RNA, 16 nt, Salmonella enterica enterica serovar Typhi
uucaucauaucuuccc

SEQ ID NO: 3668949 - RNA, 14 nt, Salmonella enterica enterica serovar Typhi
uucauccaccgccc

SEQ ID NO: 3668950 - RNA, 12 nt, Salmonella enterica enterica serovar Typhi
uucauccacgcc

SEQ ID NO: 3668951 - RNA, 22 nt, Salmonella enterica enterica serovar Typhi
uucauccauauaucugaauaga

SEQ ID NO: 3668952 - RNA, 13 nt, Salmonella enterica enterica serovar Typhi
uucauccaugcca

SEQ ID NO: 3668953 - RNA, 19 nt, Salmonella enterica enterica serovar Typhi
uucaucccacucaaucauu

SEQ ID NO: 3668954 - RNA, 13 nt, Salmonella enterica enterica serovar Typhi
uucauccggauaa

SEQ ID NO: 3668955 - RNA, 18 nt, Salmonella enterica enterica serovar Typhi
uucauccggcguugcgcc

SEQ ID NO: 3668956 - RNA, 20 nt, Salmonella enterica enterica serovar Typhi
uucaucgccacaugcggcag

SEQ ID NO: 3668957 - RNA, 14 nt, Salmonella enterica enterica serovar Typhi
uucaucgccgcgac

SEQ ID NO: 3668958 - RNA, 12 nt, Salmonella enterica enterica serovar Typhi
uucaucgcuuuu

SEQ ID NO: 3668959 - RNA, 15 nt, Salmonella enterica enterica serovar Typhi
uucaucggcucgacu

SEQ ID NO: 3668960 - RNA, 19 nt, Salmonella enterica enterica serovar Typhi
uucaucgguaauauuaagg

SEQ ID NO: 3668961 - RNA, 14 nt, Salmonella enterica enterica serovar Typhi
uucaucucaucaau

SEQ ID NO: 3668962 - RNA, 15 nt, Salmonella enterica enterica serovar Typhi
uucaucucaucaaug

SEQ ID NO: 3668963 - RNA, 17 nt, Salmonella enterica enterica serovar Typhi
uucaucuccgauaaaua

SEQ ID NO: 3668964 - RNA, 21 nt, Salmonella enterica enterica serovar Typhi
uucaucuccgauaaauaagaa

SEQ ID NO: 3668965 - RNA, 22 nt, Salmonella enterica enterica serovar Typhi
uucaucuucaccuuuccaguca

SEQ ID NO: 3668966 - RNA, 14 nt, Salmonella enterica enterica serovar Typhi
uucaucuucaguaa

SEQ ID NO: 3668967 - RNA, 12 nt, Salmonella enterica enterica serovar Typhi
uucaucuucuuu

SEQ ID NO: 3668968 - RNA, 18 nt, Salmonella enterica enterica serovar Typhi
uucaucuuuuaaaaucag

SEQ ID NO: 3668969 - RNA, 16 nt, Salmonella enterica enterica serovar Typhi
uucaugaucuuuccuu

SEQ ID NO: 3668970 - RNA, 18 nt, Salmonella enterica enterica serovar Typhi
uucaugaucuuuccuuuu

SEQ ID NO: 3668971 - RNA, 13 nt, Salmonella enterica enterica serovar Typhi
uucaugcaauaau

SEQ ID NO: 3668972 - RNA, 22 nt, Salmonella enterica enterica serovar Typhi
uucaugcacaaaacccgcagcc

SEQ ID NO: 3668973 - RNA, 18 nt, Salmonella enterica enterica serovar Typhi
uucaugcacgaugguauc

SEQ ID NO: 3668974 - RNA, 23 nt, Salmonella enterica enterica serovar Typhi
uucaugcaucauugaagcgaugu

SEQ ID NO: 3668975 - RNA, 12 nt, Salmonella enterica enterica serovar Typhi
uucaugcauuaa

SEQ ID NO: 3668976 - RNA, 13 nt, Salmonella enterica enterica serovar Typhi
uucaugcgcggcg

SEQ ID NO: 3668977 - RNA, 15 nt, Salmonella enterica enterica serovar Typhi
uucauguaaaugacg

SEQ ID NO: 3668978 - RNA, 19 nt, Salmonella enterica enterica serovar Typhi
uucauuacagguguuaauc

SEQ ID NO: 3668979 - RNA, 13 nt, Salmonella enterica enterica serovar Typhi
uucauuacgcuuc

SEQ ID NO: 3668980 - RNA, 20 nt, Salmonella enterica enterica serovar Typhi
uucauucacccaauaaauaa

SEQ ID NO: 3668981 - RNA, 21 nt, Salmonella enterica enterica serovar Typhi
uucauucacccaauaaauaau

SEQ ID NO: 3668982 - RNA, 16 nt, Salmonella enterica enterica serovar Typhi
uucauucgccaccagg

SEQ ID NO: 3668983 - RNA, 19 nt, Salmonella enterica enterica serovar Typhi
uucauucgccaccaggcuc

SEQ ID NO: 3668984 - RNA, 20 nt, Salmonella enterica enterica serovar Typhi
uucauucgucaaauucaccc

SEQ ID NO: 3668985 - RNA, 18 nt, Salmonella enterica enterica serovar Typhi
uucauugucucuguuuuu

SEQ ID NO: 3668986 - RNA, 17 nt, Salmonella enterica enterica serovar Typhi
uucauuucgaucuguuu

SEQ ID NO: 3668987 - RNA, 18 nt, Salmonella enterica enterica serovar Typhi
uucauuuuauagucccuc

SEQ ID NO: 3668988 - RNA, 22 nt, Salmonella enterica enterica serovar Typhi
uuccaauauuuauuuaauguuu

SEQ ID NO: 3668989 - RNA, 23 nt, Salmonella enterica enterica serovar Typhi
uuccaauauuuauuuaauguuuc

SEQ ID NO: 3668990 - RNA, 23 nt, Salmonella enterica enterica serovar Typhi
uuccacaaaaggauacagcgccg

SEQ ID NO: 3668991 - RNA, 20 nt, Salmonella enterica enterica serovar Typhi
uuccacaaucccggcaacug

SEQ ID NO: 3668992 - RNA, 17 nt, Salmonella enterica enterica serovar Typhi
uuccacacguccauccg

SEQ ID NO: 3668993 - RNA, 17 nt, Salmonella enterica enterica serovar Typhi
uuccaccaccuccugcu

SEQ ID NO: 3668994 - RNA, 18 nt, Salmonella enterica enterica serovar Typhi
uuccaccaccuccugcug

SEQ ID NO: 3668995 - RNA, 20 nt, Salmonella enterica enterica serovar Typhi
uuccaccagcuuaucugacc

SEQ ID NO: 3668996 - RNA, 13 nt, Salmonella enterica enterica serovar Typhi
uuccaccgccaau

SEQ ID NO: 3668997 - RNA, 16 nt, Salmonella enterica enterica serovar Typhi
uuccaccgccaauaaa

SEQ ID NO: 3668998 - RNA, 22 nt, Salmonella enterica enterica serovar Typhi
uuccacgauauuaauucccgcc

SEQ ID NO: 3668999 - RNA, 23 nt, Salmonella enterica enterica serovar Typhi
uuccacgcgcgcgccgauaaauu

SEQ ID NO: 3669000 - RNA, 23 nt, Salmonella enterica enterica serovar Typhi
uuccacgcguacgguuacaaccc

SEQ ID NO: 3669001 - RNA, 21 nt, Salmonella enterica enterica serovar Typhi
uuccacgcugacugcauaaug

SEQ ID NO: 3669002 - RNA, 17 nt, Salmonella enterica enterica serovar Typhi
uuccacucuucgggaau

SEQ ID NO: 3669003 - RNA, 16 nt, Salmonella enterica enterica serovar Typhi
uuccacugcggcauua

SEQ ID NO: 3669004 - RNA, 17 nt, Salmonella enterica enterica serovar Typhi
uuccacuucagcagcag

SEQ ID NO: 3669005 - RNA, 21 nt, Salmonella enterica enterica serovar Typhi
uuccagaagcgcuuugccaau

SEQ ID NO: 3669006 - RNA, 20 nt, Salmonella enterica enterica serovar Typhi
uuccagaauucguacguuuu

SEQ ID NO: 3669007 - RNA, 22 nt, Salmonella enterica enterica serovar Typhi
uuccagcagauccauuaaaugc

SEQ ID NO: 3669008 - RNA, 18 nt, Salmonella enterica enterica serovar Typhi
uuccagcagcgcaucaug

SEQ ID NO: 3669009 - RNA, 21 nt, Salmonella enterica enterica serovar Typhi
uuccagcaucgaccaggauuu

SEQ ID NO: 3669010 - RNA, 17 nt, Salmonella enterica enterica serovar Typhi
uuccagcauuucuucaa

SEQ ID NO: 3669011 - RNA, 19 nt, Salmonella enterica enterica serovar Typhi
uuccagcccguagauaagc

SEQ ID NO: 3669012 - RNA, 23 nt, Salmonella enterica enterica serovar Typhi
uuccagccgcccgcgauaaaaau

SEQ ID NO: 3669013 - RNA, 24 nt, Salmonella enterica enterica serovar Typhi
uuccagcgcgccgucaucgcucau

SEQ ID NO: 3669014 - RNA, 18 nt, Salmonella enterica enterica serovar Typhi
uuccagcgcguccagccc

SEQ ID NO: 3669015 - RNA, 21 nt, Salmonella enterica enterica serovar Typhi
uuccagcgugccgagcaacag

SEQ ID NO: 3669016 - RNA, 19 nt, Salmonella enterica enterica serovar Typhi
uuccagcuguaccaucacc

SEQ ID NO: 3669017 - RNA, 19 nt, Salmonella enterica enterica serovar Typhi
uuccaggucaugguaaaac

SEQ ID NO: 3669018 - RNA, 17 nt, Salmonella enterica enterica serovar Typhi
uuccagguugugacgaa

SEQ ID NO: 3669019 - RNA, 14 nt, Salmonella enterica enterica serovar Typhi
uuccaguaauuuca

SEQ ID NO: 3669020 - RNA, 13 nt, Salmonella enterica enterica serovar Typhi
uuccaguccacgu

SEQ ID NO: 3669021 - RNA, 12 nt, Salmonella enterica enterica serovar Typhi
uuccuuaucagc

SEQ ID NO: 3669022 - RNA, 23 nt, Salmonella enterica enterica serovar Typhi
uuccuuauuaaagccccuuccuc

SEQ ID NO: 3669023 - RNA, 16 nt, Salmonella enterica enterica serovar Typhi
uuccuucgcuuccugg

SEQ ID NO: 3669024 - RNA, 20 nt, Salmonella enterica enterica serovar Typhi
uuccuuguccgaugcagaca

SEQ ID NO: 3669025 - RNA, 12 nt, Salmonella enterica enterica serovar Typhi
uuccuuucugcg

SEQ ID NO: 3669026 - RNA, 12 nt, Salmonella enterica enterica serovar Typhi
uuccuuuuucag

SEQ ID NO: 3669027 - RNA, 12 nt, Salmonella enterica enterica serovar Typhi
uucgaaccugcg

SEQ ID NO: 3669028 - RNA, 16 nt, Salmonella enterica enterica serovar Typhi
uucgaaccugcgacca

SEQ ID NO: 3669029 - RNA, 22 nt, Salmonella enterica enterica serovar Typhi
uucgaacgaaaaaagcgccccu

SEQ ID NO: 3669030 - RNA, 20 nt, Salmonella enterica enterica serovar Typhi
uucgaacgacagaauaugca

SEQ ID NO: 3669031 - RNA, 18 nt, Salmonella enterica enterica serovar Typhi
uucgaacgccgacaucac

SEQ ID NO: 3669032 - RNA, 22 nt, Salmonella enterica enterica serovar Typhi
uucgaacgcuagcucaacgccc

SEQ ID NO: 3669033 - RNA, 14 nt, Salmonella enterica enterica serovar Typhi
uucgaauccuccug

SEQ ID NO: 3669034 - RNA, 17 nt, Salmonella enterica enterica serovar Typhi
uucgaauuacauaacca

SEQ ID NO: 3669035 - RNA, 21 nt, Salmonella enterica enterica serovar Typhi
uucgacaauguccgccagacu

SEQ ID NO: 3669036 - RNA, 12 nt, Salmonella enterica enterica serovar Typhi
uucgacaucuuc

SEQ ID NO: 3669037 - RNA, 15 nt, Salmonella enterica enterica serovar Typhi
uucgacgauaaaaaa

SEQ ID NO: 3669038 - RNA, 23 nt, Salmonella enterica enterica serovar Typhi
uucgacgggacgaauuuccagcg

SEQ ID NO: 3669039 - RNA, 13 nt, Salmonella enterica enterica serovar Typhi
uucgacuguuguu

SEQ ID NO: 3669040 - RNA, 20 nt, Salmonella enterica enterica serovar Typhi
uucgaguguaucuccugaaa

SEQ ID NO: 3669041 - RNA, 14 nt, Salmonella enterica enterica serovar Typhi
uucgauaaacucaa

SEQ ID NO: 3669042 - RNA, 17 nt, Salmonella enterica enterica serovar Typhi
uucgauaaccaccagcg

SEQ ID NO: 3669043 - RNA, 18 nt, Salmonella enterica enterica serovar Typhi
uucgauaaccaccagcgg

SEQ ID NO: 3669044 - RNA, 21 nt, Salmonella enterica enterica serovar Typhi
uucgauagcguuuuccagcuc

SEQ ID NO: 3669045 - RNA, 14 nt, Salmonella enterica enterica serovar Typhi
uucgaugaaaaaga

SEQ ID NO: 3669046 - RNA, 23 nt, Salmonella enterica enterica serovar Typhi
uucgaugaugagaugcaggccaa

SEQ ID NO: 3669047 - RNA, 14 nt, Salmonella enterica enterica serovar Typhi
uucgaugcgcucau

SEQ ID NO: 3669048 - RNA, 14 nt, Salmonella enterica enterica serovar Typhi
uucgauggccucau

SEQ ID NO: 3669049 - RNA, 11 nt, Salmonella enterica enterica serovar Typhi
uucgcagcaga

SEQ ID NO: 3669050 - RNA, 18 nt, Salmonella enterica enterica serovar Typhi
uucgcagcgauauuucuc

SEQ ID NO: 3669051 - RNA, 15 nt, Salmonella enterica enterica serovar Typhi
uucgccacgcucacu

SEQ ID NO: 3669052 - RNA, 19 nt, Salmonella enterica enterica serovar Typhi
uucgccagcgcaucgauau

SEQ ID NO: 3669053 - RNA, 13 nt, Salmonella enterica enterica serovar Typhi
uucgccagcggau

SEQ ID NO: 3669054 - RNA, 23 nt, Salmonella enterica enterica serovar Typhi
uucgcccaggcggggagggucag

SEQ ID NO: 3669055 - RNA, 13 nt, Salmonella enterica enterica serovar Typhi
uucgcccagucau

SEQ ID NO: 3669056 - RNA, 14 nt, Salmonella enterica enterica serovar Typhi
uucgcccagucauc

SEQ ID NO: 3669057 - RNA, 13 nt, Salmonella enterica enterica serovar Typhi
uucgcccauaucc

SEQ ID NO: 3669058 - RNA, 19 nt, Salmonella enterica enterica serovar Typhi
uucgcccauugccacccau

SEQ ID NO: 3669059 - RNA, 22 nt, Salmonella enterica enterica serovar Typhi
uucgccccacacggccaccaua

SEQ ID NO: 3669060 - RNA, 18 nt, Salmonella enterica enterica serovar Typhi
uucgcccguucugaccag

SEQ ID NO: 3669061 - RNA, 19 nt, Salmonella enterica enterica serovar Typhi
uucgccgcccaaccagccc

SEQ ID NO: 3669062 - RNA, 23 nt, Salmonella enterica enterica serovar Typhi
uucgccgccggcgaggauaauac

SEQ ID NO: 3669063 - RNA, 18 nt, Salmonella enterica enterica serovar Typhi
uucgccgcguaaucuucg

SEQ ID NO: 3669064 - RNA, 20 nt, Salmonella enterica enterica serovar Typhi
uucgccggauggcggcgaug

SEQ ID NO: 3669065 - RNA, 23 nt, Salmonella enterica enterica serovar Typhi
uucgccguguucuuacccacugu

SEQ ID NO: 3669066 - RNA, 17 nt, Salmonella enterica enterica serovar Typhi
uucgccucccucacccu

SEQ ID NO: 3669067 - RNA, 18 nt, Salmonella enterica enterica serovar Typhi
uucgcgaaucgcuucacg

SEQ ID NO: 3669068 - RNA, 12 nt, Salmonella enterica enterica serovar Typhi
uucgcgaucucc

SEQ ID NO: 3669069 - RNA, 14 nt, Salmonella enterica enterica serovar Typhi
uucgcgaugcagca

SEQ ID NO: 3669070 - RNA, 16 nt, Salmonella enterica enterica serovar Typhi
uucgcggaauuucagg

SEQ ID NO: 3669071 - RNA, 14 nt, Salmonella enterica enterica serovar Typhi
uucgcgguaaucgc

SEQ ID NO: 3669072 - RNA, 13 nt, Salmonella enterica enterica serovar Typhi
uucgcguagcgcc

SEQ ID NO: 3669073 - RNA, 22 nt, Salmonella enterica enterica serovar Typhi
uucgcgucaaaacuuauuuuau

SEQ ID NO: 3669074 - RNA, 21 nt, Salmonella enterica enterica serovar Typhi
uucgcuaauccccccuuuuuu

SEQ ID NO: 3669075 - RNA, 13 nt, Salmonella enterica enterica serovar Typhi
uucgcucgcuuug

SEQ ID NO: 3669076 - RNA, 15 nt, Salmonella enterica enterica serovar Typhi
uucgcuuaccaggcc

SEQ ID NO: 3669077 - RNA, 15 nt, Salmonella enterica enterica serovar Typhi
uucgcuucgaggaua

SEQ ID NO: 3669078 - RNA, 21 nt, Salmonella enterica enterica serovar Typhi
uucggagcgcuuuuuuuaugc

SEQ ID NO: 3669079 - RNA, 19 nt, Salmonella enterica enterica serovar Typhi
uucggauaaacgcugcgca

SEQ ID NO: 3669080 - RNA, 22 nt, Salmonella enterica enterica serovar Typhi
uucggcaaaacgccgcagaaaa

SEQ ID NO: 3669081 - RNA, 16 nt, Salmonella enterica enterica serovar Typhi
uucggcaauggccaga

SEQ ID NO: 3669082 - RNA, 18 nt, Salmonella enterica enterica serovar Typhi
uucggcagaaaaaguaga

SEQ ID NO: 3669083 - RNA, 11 nt, Salmonella enterica enterica serovar Typhi
uucggcagacu

SEQ ID NO: 3669084 - RNA, 15 nt, Salmonella enterica enterica serovar Typhi
uucggcgaaagaagc

SEQ ID NO: 3669085 - RNA, 17 nt, Salmonella enterica enterica serovar Typhi
uucggcgauuuccagcg

SEQ ID NO: 3669086 - RNA, 20 nt, Salmonella enterica enterica serovar Typhi
uucggcgauuuccagcgccg

SEQ ID NO: 3669087 - RNA, 21 nt, Salmonella enterica enterica serovar Typhi
uucggcuccagguugcucagg

SEQ ID NO: 3669088 - RNA, 13 nt, Salmonella enterica enterica serovar Typhi
uucggcuucaauu

SEQ ID NO: 3669089 - RNA, 17 nt, Salmonella enterica enterica serovar Typhi
uucggcuucaccgauuu

SEQ ID NO: 3669090 - RNA, 13 nt, Salmonella enterica enterica serovar Typhi
uucgggccgccgc

SEQ ID NO: 3669091 - RNA, 20 nt, Salmonella enterica enterica serovar Typhi
uucgggcgcaugucagugac

SEQ ID NO: 3669092 - RNA, 14 nt, Salmonella enterica enterica serovar Typhi
uucggguuuuccug

SEQ ID NO: 3669093 - RNA, 20 nt, Salmonella enterica enterica serovar Typhi
uucgguauuuaucaaaaaga

SEQ ID NO: 3669094 - RNA, 13 nt, Salmonella enterica enterica serovar Typhi
uucgguggaaacc

SEQ ID NO: 3669095 - RNA, 17 nt, Salmonella enterica enterica serovar Typhi
uucgucaggaggccuga

SEQ ID NO: 3669096 - RNA, 21 nt, Salmonella enterica enterica serovar Typhi
uucgucaggcggcugcgcaug

SEQ ID NO: 3669097 - RNA, 18 nt, Salmonella enterica enterica serovar Typhi
uucguccggcugccacuc

SEQ ID NO: 3669098 - RNA, 18 nt, Salmonella enterica enterica serovar Typhi
uucgucuuuauucaucau

SEQ ID NO: 3669099 - RNA, 17 nt, Salmonella enterica enterica serovar Typhi
uucguggcgcuguucuu

SEQ ID NO: 3669100 - RNA, 15 nt, Salmonella enterica enterica serovar Typhi
uucguuaacccggca

SEQ ID NO: 3669101 - RNA, 19 nt, Salmonella enterica enterica serovar Typhi
uucguuaccgccuuuuuuc

SEQ ID NO: 3669102 - RNA, 17 nt, Salmonella enterica enterica serovar Typhi
uucguuacuuucauaau

SEQ ID NO: 3669103 - RNA, 17 nt, Salmonella enterica enterica serovar Typhi
uucguuauaaggccugc

SEQ ID NO: 3669104 - RNA, 14 nt, Salmonella enterica enterica serovar Typhi
uucguuauuuuccu

SEQ ID NO: 3669105 - RNA, 15 nt, Salmonella enterica enterica serovar Typhi
uucguucagggugaa

SEQ ID NO: 3669106 - RNA, 21 nt, Salmonella enterica enterica serovar Typhi
uucguuccgcgauuuccugug

SEQ ID NO: 3669107 - RNA, 15 nt, Salmonella enterica enterica serovar Typhi
uucuucugccuuuuu

SEQ ID NO: 3669108 - RNA, 13 nt, Salmonella enterica enterica serovar Typhi
uucuucuggcugc

SEQ ID NO: 3669109 - RNA, 12 nt, Salmonella enterica enterica serovar Typhi
uucuucuucacg

SEQ ID NO: 3669110 - RNA, 15 nt, Salmonella enterica enterica serovar Typhi
uucuuuaaucagauu

SEQ ID NO: 3669111 - RNA, 17 nt, Salmonella enterica enterica serovar Typhi
uucuuuaauuugugcca

SEQ ID NO: 3669112 - RNA, 19 nt, Salmonella enterica enterica serovar Typhi
uucuuuacgcagcaagaac

SEQ ID NO: 3669113 - RNA, 14 nt, Salmonella enterica enterica serovar Typhi
uucuuuaugcgccu

SEQ ID NO: 3669114 - RNA, 13 nt, Salmonella enterica enterica serovar Typhi
uucuuucacuguc

SEQ ID NO: 3669115 - RNA, 16 nt, Salmonella enterica enterica serovar Typhi
uucuuucauuuuaccu

SEQ ID NO: 3669116 - RNA, 23 nt, Salmonella enterica enterica serovar Typhi
uucuuuccaguucuggcugcgcu

SEQ ID NO: 3669117 - RNA, 15 nt, Salmonella enterica enterica serovar Typhi
uucuuuccugcaaau

SEQ ID NO: 3669118 - RNA, 23 nt, Salmonella enterica enterica serovar Typhi
uucuuugacccacgccagcagcu

SEQ ID NO: 3669119 - RNA, 17 nt, Salmonella enterica enterica serovar Typhi
uucuuugcgccuuauuc

SEQ ID NO: 3669120 - RNA, 16 nt, Salmonella enterica enterica serovar Typhi
uucuuuucaauaaagc

SEQ ID NO: 3669121 - RNA, 12 nt, Salmonella enterica enterica serovar Typhi
uucuuuucaggc

SEQ ID NO: 3669122 - RNA, 15 nt, Salmonella enterica enterica serovar Typhi
uucuuuucaggucug

SEQ ID NO: 3669123 - RNA, 14 nt, Salmonella enterica enterica serovar Typhi
uucuuuucuuucag

SEQ ID NO: 3669124 - RNA, 20 nt, Salmonella enterica enterica serovar Typhi
uucuuuuucgaucagcauau

SEQ ID NO: 3669125 - RNA, 20 nt, Salmonella enterica enterica serovar Typhi
uugaaaaaaacaucgcugau

SEQ ID NO: 3669126 - RNA, 21 nt, Salmonella enterica enterica serovar Typhi
uugaaaaccacaaucacagcg

SEQ ID NO: 3669127 - RNA, 20 nt, Salmonella enterica enterica serovar Typhi
uugaacagcgucauccagug

SEQ ID NO: 3669128 - RNA, 16 nt, Salmonella enterica enterica serovar Typhi
uugaacauuuuuucag

SEQ ID NO: 3669129 - RNA, 15 nt, Salmonella enterica enterica serovar Typhi
uugaacucuuucaga

SEQ ID NO: 3669130 - RNA, 17 nt, Salmonella enterica enterica serovar Typhi
uugaacuuacccagcaa

SEQ ID NO: 3669131 - RNA, 13 nt, Salmonella enterica enterica serovar Typhi
uugaagaaaaacc

SEQ ID NO: 3669132 - RNA, 13 nt, Salmonella enterica enterica serovar Typhi
uugaaguuaucca

SEQ ID NO: 3669133 - RNA, 19 nt, Salmonella enterica enterica serovar Typhi
uugaaguuauccagcgccc

SEQ ID NO: 3669134 - RNA, 15 nt, Salmonella enterica enterica serovar Typhi
uugaauaucgcuuuu

SEQ ID NO: 3669135 - RNA, 22 nt, Salmonella enterica enterica serovar Typhi
uugaaucgccuggcuugccggc

SEQ ID NO: 3669136 - RNA, 13 nt, Salmonella enterica enterica serovar Typhi
uugaauuugacga

SEQ ID NO: 3669137 - RNA, 13 nt, Salmonella enterica enterica serovar Typhi
uugacaucaggau

SEQ ID NO: 3669138 - RNA, 13 nt, Salmonella enterica enterica serovar Typhi
uugacaugaaaaa

SEQ ID NO: 3669139 - RNA, 18 nt, Salmonella enterica enterica serovar Typhi
uugaccagauaaucaaac

SEQ ID NO: 3669140 - RNA, 14 nt, Salmonella enterica enterica serovar Typhi
uugaccaucgccag

SEQ ID NO: 3669141 - RNA, 17 nt, Salmonella enterica enterica serovar Typhi
uugaccauuaccauucc

SEQ ID NO: 3669142 - RNA, 21 nt, Salmonella enterica enterica serovar Typhi
uugaccggggcgcaauccgcg

SEQ ID NO: 3669143 - RNA, 16 nt, Salmonella enterica enterica serovar Typhi
uugaccucaucaccua

SEQ ID NO: 3669144 - RNA, 14 nt, Salmonella enterica enterica serovar Typhi
uugacgaaaagaua

SEQ ID NO: 3669145 - RNA, 12 nt, Salmonella enterica enterica serovar Typhi
uugacgaacgcu

SEQ ID NO: 3669146 - RNA, 17 nt, Salmonella enterica enterica serovar Typhi
uugacgagucggaucau

SEQ ID NO: 3669147 - RNA, 22 nt, Salmonella enterica enterica serovar Typhi
uugacgcaaacugccaggcaau

SEQ ID NO: 3669148 - RNA, 13 nt, Salmonella enterica enterica serovar Typhi
uugacgcuuugca

SEQ ID NO: 3669149 - RNA, 15 nt, Salmonella enterica enterica serovar Typhi
uugacgcuuugcauu

SEQ ID NO: 3669150 - RNA, 14 nt, Salmonella enterica enterica serovar Typhi
uugacggccaccau

SEQ ID NO: 3669151 - RNA, 22 nt, Salmonella enterica enterica serovar Typhi
uugacguaacgcuggugaccaa

SEQ ID NO: 3669152 - RNA, 16 nt, Salmonella enterica enterica serovar Typhi
uugacguuauccagua

SEQ ID NO: 3669153 - RNA, 20 nt, Salmonella enterica enterica serovar Typhi
uugacugaaauuacgccaua

SEQ ID NO: 3669154 - RNA, 18 nt, Salmonella enterica enterica serovar Typhi
uugacuggauuuuugacu

SEQ ID NO: 3669155 - RNA, 19 nt, Salmonella enterica enterica serovar Typhi
uugacuucaacgcaggcga

SEQ ID NO: 3669156 - RNA, 15 nt, Salmonella enterica enterica serovar Typhi
uugagacaugccgcc

SEQ ID NO: 3669157 - RNA, 13 nt, Salmonella enterica enterica serovar Typhi
uugagcaauaucg

SEQ ID NO: 3669158 - RNA, 13 nt, Salmonella enterica enterica serovar Typhi
uugagccauucca

SEQ ID NO: 3669159 - RNA, 23 nt, Salmonella enterica enterica serovar Typhi
uugagcgagucagacaccagccc

SEQ ID NO: 3669160 - RNA, 18 nt, Salmonella enterica enterica serovar Typhi
uugagcgcaaaacgcugc

SEQ ID NO: 3669161 - RNA, 16 nt, Salmonella enterica enterica serovar Typhi
uugagucgcauccagu

SEQ ID NO: 3669162 - RNA, 17 nt, Salmonella enterica enterica serovar Typhi
uugaguuccgcuucgua

SEQ ID NO: 3669163 - RNA, 15 nt, Salmonella enterica enterica serovar Typhi
uugaguuugcaaucc

SEQ ID NO: 3669164 - RNA, 16 nt, Salmonella enterica enterica serovar Typhi
uugaguuuuccgccau

SEQ ID NO: 3669165 - RNA, 18 nt, Salmonella enterica enterica serovar Typhi
uugauaaaacgaauacua

SEQ ID NO: 3669166 - RNA, 12 nt, Salmonella enterica enterica serovar Typhi
uugauaaagcgc

SEQ ID NO: 3669167 - RNA, 16 nt, Salmonella enterica enterica serovar Typhi
uugauaacggaaucac

SEQ ID NO: 3669168 - RNA, 14 nt, Salmonella enterica enterica serovar Typhi
uugauacauuuuuu

SEQ ID NO: 3669169 - RNA, 16 nt, Salmonella enterica enterica serovar Typhi
uugauaccuauuuaau

SEQ ID NO: 3669170 - RNA, 18 nt, Salmonella enterica enterica serovar Typhi
uugauaccuuuaaccucu

SEQ ID NO: 3669171 - RNA, 19 nt, Salmonella enterica enterica serovar Typhi
uugauauugugcauacuga

SEQ ID NO: 3669172 - RNA, 20 nt, Salmonella enterica enterica serovar Typhi
uugaucaggaaaucuuccag

SEQ ID NO: 3669173 - RNA, 22 nt, Salmonella enterica enterica serovar Typhi
uugaucaggcaaaaaucggccu

SEQ ID NO: 3669174 - RNA, 23 nt, Salmonella enterica enterica serovar Typhi
uugaucaucagggcgaacauucc

SEQ ID NO: 3669175 - RNA, 19 nt, Salmonella enterica enterica serovar Typhi
uugaucggguuuuccugaa

SEQ ID NO: 3669176 - RNA, 19 nt, Salmonella enterica enterica serovar Typhi
uugaucguccggcgaugcc

SEQ ID NO: 3669177 - RNA, 12 nt, Salmonella enterica enterica serovar Typhi
uugaucugcuug

SEQ ID NO: 3669178 - RNA, 13 nt, Salmonella enterica enterica serovar Typhi
uugaugaaccgcu

SEQ ID NO: 3669179 - RNA, 20 nt, Salmonella enterica enterica serovar Typhi
uugaugauaaccgccgccaa

SEQ ID NO: 3669180 - RNA, 18 nt, Salmonella enterica enterica serovar Typhi
uugaugaugccaggacca

SEQ ID NO: 3669181 - RNA, 12 nt, Salmonella enterica enterica serovar Typhi
uugaugccgacc

SEQ ID NO: 3669182 - RNA, 13 nt, Salmonella enterica enterica serovar Typhi
uugauggacgcga

SEQ ID NO: 3669183 - RNA, 12 nt, Salmonella enterica enterica serovar Typhi
uugauggccagc

SEQ ID NO: 3669184 - RNA, 21 nt, Salmonella enterica enterica serovar Typhi
uugaugucauccgguucaccc

SEQ ID NO: 3669185 - RNA, 17 nt, Salmonella enterica enterica serovar Typhi
uugauuaaucgucaucc

SEQ ID NO: 3669186 - RNA, 19 nt, Salmonella enterica enterica serovar Typhi
uugauuuuucugguaaacc

SEQ ID NO: 3669187 - RNA, 15 nt, Salmonella enterica enterica serovar Typhi
uugcaaagcccauaa

SEQ ID NO: 3669188 - RNA, 16 nt, Salmonella enterica enterica serovar Typhi
uugcaaagcccauaaa

SEQ ID NO: 3669189 - RNA, 19 nt, Salmonella enterica enterica serovar Typhi
uugcaaaucuuguaggccg

SEQ ID NO: 3669190 - RNA, 20 nt, Salmonella enterica enterica serovar Typhi
uugcaagaaauguccauaaa

SEQ ID NO: 3669191 - RNA, 11 nt, Salmonella enterica enterica serovar Typhi
uugcaaggcga

SEQ ID NO: 3669192 - RNA, 19 nt, Salmonella enterica enterica serovar Typhi
uugcaagucaccaucagua

SEQ ID NO: 3669193 - RNA, 14 nt, Salmonella enterica enterica serovar Typhi
uugcgucaccgggc

SEQ ID NO: 3669194 - RNA, 14 nt, Salmonella enterica enterica serovar Typhi
uugcguccauuaag

SEQ ID NO: 3669195 - RNA, 15 nt, Salmonella enterica enterica serovar Typhi
uugcgucguuccguc

SEQ ID NO: 3669196 - RNA, 14 nt, Salmonella enterica enterica serovar Typhi
uugcgucuguuuuu

SEQ ID NO: 3669197 - RNA, 15 nt, Salmonella enterica enterica serovar Typhi
uugcgugucaucaaa

SEQ ID NO: 3669198 - RNA, 19 nt, Salmonella enterica enterica serovar Typhi
uugcuaccccggaaauaac

SEQ ID NO: 3669199 - RNA, 20 nt, Salmonella enterica enterica serovar Typhi
uugcuaccccggaaauaacg

SEQ ID NO: 3669200 - RNA, 17 nt, Salmonella enterica enterica serovar Typhi
uugcuaggaacagugac

SEQ ID NO: 3669201 - RNA, 17 nt, Salmonella enterica enterica serovar Typhi
uugcuauagcccacgca

SEQ ID NO: 3669202 - RNA, 23 nt, Salmonella enterica enterica serovar Typhi
uugcucaacuggaugacugaauu

SEQ ID NO: 3669203 - RNA, 13 nt, Salmonella enterica enterica serovar Typhi
uugcucaauuuuu

SEQ ID NO: 3669204 - RNA, 24 nt, Salmonella enterica enterica serovar Typhi
uugcucacggcgauaccaguaaua

SEQ ID NO: 3669205 - RNA, 19 nt, Salmonella enterica enterica serovar Typhi
uugcucaggcgcgaauaau

SEQ ID NO: 3669206 - RNA, 17 nt, Salmonella enterica enterica serovar Typhi
uugcugaagauaaaauu

SEQ ID NO: 3669207 - RNA, 18 nt, Salmonella enterica enterica serovar Typhi
uugcugaaucugcggcug

SEQ ID NO: 3669208 - RNA, 22 nt, Salmonella enterica enterica serovar Typhi
uugcugacagcaucgauuccgc

SEQ ID NO: 3669209 - RNA, 14 nt, Salmonella enterica enterica serovar Typhi
uugcugacaucgcg

SEQ ID NO: 3669210 - RNA, 21 nt, Salmonella enterica enterica serovar Typhi
uugcugagccaucauuaccaa

SEQ ID NO: 3669211 - RNA, 21 nt, Salmonella enterica enterica serovar Typhi
uugcugaggaucaccccaaca

SEQ ID NO: 3669212 - RNA, 14 nt, Salmonella enterica enterica serovar Typhi
uugcugauaaucaa

SEQ ID NO: 3669213 - RNA, 15 nt, Salmonella enterica enterica serovar Typhi
uugcugauaaucaau

SEQ ID NO: 3669214 - RNA, 18 nt, Salmonella enterica enterica serovar Typhi
uugcugcggcacgaaaaa

SEQ ID NO: 3669215 - RNA, 15 nt, Salmonella enterica enterica serovar Typhi
uugcugcgucacgcg

SEQ ID NO: 3669216 - RNA, 14 nt, Salmonella enterica enterica serovar Typhi
uugcuggcgugaac

SEQ ID NO: 3669217 - RNA, 20 nt, Salmonella enterica enterica serovar Typhi
uugcuggcgugaaccgguaa

SEQ ID NO: 3669218 - RNA, 17 nt, Salmonella enterica enterica serovar Typhi
uugcugguagacaaaca

SEQ ID NO: 3669219 - RNA, 18 nt, Salmonella enterica enterica serovar Typhi
uugcuggugccuuccguc

SEQ ID NO: 3669220 - RNA, 17 nt, Salmonella enterica enterica serovar Typhi
uugcugucgcgcaauac

SEQ ID NO: 3669221 - RNA, 20 nt, Salmonella enterica enterica serovar Typhi
uugcuguuagaaucucugac

SEQ ID NO: 3669222 - RNA, 17 nt, Salmonella enterica enterica serovar Typhi
uugcuguuuuauuuccu

SEQ ID NO: 3669223 - RNA, 16 nt, Salmonella enterica enterica serovar Typhi
uugcuuaccuuguucu

SEQ ID NO: 3669224 - RNA, 16 nt, Salmonella enterica enterica serovar Typhi
uugcuuauccggccua

SEQ ID NO: 3669225 - RNA, 14 nt, Salmonella enterica enterica serovar Typhi
uugcuucgccaucu

SEQ ID NO: 3669226 - RNA, 22 nt, Salmonella enterica enterica serovar Typhi
uugcuugugacggcaaaguucc

SEQ ID NO: 3669227 - RNA, 17 nt, Salmonella enterica enterica serovar Typhi
uugcuuuucaucaccau

SEQ ID NO: 3669228 - RNA, 13 nt, Salmonella enterica enterica serovar Typhi
uugcuuuuuucca

SEQ ID NO: 3669229 - RNA, 22 nt, Salmonella enterica enterica serovar Typhi
uuggaaaaccccaucccggcaa

SEQ ID NO: 3669230 - RNA, 21 nt, Salmonella enterica enterica serovar Typhi
uuggaaacuaugcaaaacgua

SEQ ID NO: 3669231 - RNA, 17 nt, Salmonella enterica enterica serovar Typhi
uuggacggaaucucgca

SEQ ID NO: 3669232 - RNA, 13 nt, Salmonella enterica enterica serovar Typhi
uuggaggucauua

SEQ ID NO: 3669233 - RNA, 13 nt, Salmonella enterica enterica serovar Typhi
uuggaucggcaaa

SEQ ID NO: 3669234 - RNA, 19 nt, Salmonella enterica enterica serovar Typhi
uuggaugaaccauaucaaa

SEQ ID NO: 3669235 - RNA, 20 nt, Salmonella enterica enterica serovar Typhi
uuggcaaaaaaggccagacu

SEQ ID NO: 3669236 - RNA, 12 nt, Salmonella enterica enterica serovar Typhi
uuggcaaauccg

SEQ ID NO: 3669237 - RNA, 17 nt, Salmonella enterica enterica serovar Typhi
uuggcaacgucuugcca

SEQ ID NO: 3669238 - RNA, 15 nt, Salmonella enterica enterica serovar Typhi
uuggcaaucaaaucc

SEQ ID NO: 3669239 - RNA, 14 nt, Salmonella enterica enterica serovar Typhi
uuggcaaucacaag

SEQ ID NO: 3669240 - RNA, 17 nt, Salmonella enterica enterica serovar Typhi
uuggcaaucagcggcaa

SEQ ID NO: 3669241 - RNA, 12 nt, Salmonella enterica enterica serovar Typhi
uuggcaauuaaa

SEQ ID NO: 3669242 - RNA, 21 nt, Salmonella enterica enterica serovar Typhi
uuggcagccccugaaauaaca

SEQ ID NO: 3669243 - RNA, 22 nt, Salmonella enterica enterica serovar Typhi
uuggcagccccugaaauaacag

SEQ ID NO: 3669244 - RNA, 22 nt, Salmonella enterica enterica serovar Typhi
uuggcagcccggcguugaaauc

SEQ ID NO: 3669245 - RNA, 14 nt, Salmonella enterica enterica serovar Typhi
uuggcaucugucau

SEQ ID NO: 3669246 - RNA, 15 nt, Salmonella enterica enterica serovar Typhi
uuggccagcauggcg

SEQ ID NO: 3669247 - RNA, 18 nt, Salmonella enterica enterica serovar Typhi
uuggccggcuucuccacc

SEQ ID NO: 3669248 - RNA, 20 nt, Salmonella enterica enterica serovar Typhi
uuggccggcuucuccaccau

SEQ ID NO: 3669249 - RNA, 19 nt, Salmonella enterica enterica serovar Typhi
uuggccuaacagucgcgcc

SEQ ID NO: 3669250 - RNA, 18 nt, Salmonella enterica enterica serovar Typhi
uuggcgaauaaucaacca

SEQ ID NO: 3669251 - RNA, 18 nt, Salmonella enterica enterica serovar Typhi
uuggcgacgaacacggcg

SEQ ID NO: 3669252 - RNA, 22 nt, Salmonella enterica enterica serovar Typhi
uuggcgaggaacaucagccagc

SEQ ID NO: 3669253 - RNA, 14 nt, Salmonella enterica enterica serovar Typhi
uuggcgaucacaau

SEQ ID NO: 3669254 - RNA, 19 nt, Salmonella enterica enterica serovar Typhi
uuggcgaucacaauuacgc

SEQ ID NO: 3669255 - RNA, 17 nt, Salmonella enterica enterica serovar Typhi
uuggcgccaaaaccgcu

SEQ ID NO: 3669256 - RNA, 19 nt, Salmonella enterica enterica serovar Typhi
uuggcgcgcgguuuauccc

SEQ ID NO: 3669257 - RNA, 14 nt, Salmonella enterica enterica serovar Typhi
uuggcgcgucauca

SEQ ID NO: 3669258 - RNA, 15 nt, Salmonella enterica enterica serovar Typhi
uuggcgcucaauagc

SEQ ID NO: 3669259 - RNA, 13 nt, Salmonella enterica enterica serovar Typhi
uuggcgcugccgg

SEQ ID NO: 3669260 - RNA, 14 nt, Salmonella enterica enterica serovar Typhi
uuggcgugacggcg

SEQ ID NO: 3669261 - RNA, 13 nt, Salmonella enterica enterica serovar Typhi
uuggcuccaguac

SEQ ID NO: 3669262 - RNA, 22 nt, Salmonella enterica enterica serovar Typhi
uuggcuccaguaccgggcagga

SEQ ID NO: 3669263 - RNA, 21 nt, Salmonella enterica enterica serovar Typhi
uuggcuggguaaaaucagcgc

SEQ ID NO: 3669264 - RNA, 17 nt, Salmonella enterica enterica serovar Typhi
uuggcuuuguaaauauu

SEQ ID NO: 3669265 - RNA, 19 nt, Salmonella enterica enterica serovar Typhi
uugggcgcgacgccugggc

SEQ ID NO: 3669266 - RNA, 18 nt, Salmonella enterica enterica serovar Typhi
uugguaaguuuuucucuu

SEQ ID NO: 3669267 - RNA, 23 nt, Salmonella enterica enterica serovar Typhi
uuggucagguaagcuauuacaaa

SEQ ID NO: 3669268 - RNA, 21 nt, Salmonella enterica enterica serovar Typhi
uuggugauuaacagcgccauc

SEQ ID NO: 3669269 - RNA, 16 nt, Salmonella enterica enterica serovar Typhi
uuggugggugaugacg

SEQ ID NO: 3669270 - RNA, 22 nt, Salmonella enterica enterica serovar Typhi
uugguguaacagcaacaucuau

SEQ ID NO: 3669271 - RNA, 19 nt, Salmonella enterica enterica serovar Typhi
uugguuagggaucaucuuc

SEQ ID NO: 3669272 - RNA, 18 nt, Salmonella enterica enterica serovar Typhi
uugguuuaaacucugcaa

SEQ ID NO: 3669273 - RNA, 20 nt, Salmonella enterica enterica serovar Typhi
uugguuucgccuaagcccac

SEQ ID NO: 3669274 - RNA, 16 nt, Salmonella enterica enterica serovar Typhi
uugguuucggcguaag

SEQ ID NO: 3669275 - RNA, 19 nt, Salmonella enterica enterica serovar Typhi
uuguaaaaccgacuaucag

SEQ ID NO: 3669276 - RNA, 17 nt, Salmonella enterica enterica serovar Typhi
uuguacagcaauaaaag

SEQ ID NO: 3669277 - RNA, 20 nt, Salmonella enterica enterica serovar Typhi
uuguacagcaauaaaaggaa

SEQ ID NO: 3669278 - RNA, 15 nt, Salmonella enterica enterica serovar Typhi
uuguacagcuugccg

SEQ ID NO: 3669279 - RNA, 19 nt, Salmonella enterica enterica serovar Typhi
uuuaccggaugggcagaua

SEQ ID NO: 3669280 - RNA, 14 nt, Salmonella enterica enterica serovar Typhi
uuuaccuuuuccuc

SEQ ID NO: 3669281 - RNA, 20 nt, Salmonella enterica enterica serovar Typhi
uuuacgcagauaacuuccuu

SEQ ID NO: 3669282 - RNA, 13 nt, Salmonella enterica enterica serovar Typhi
uuuacgccgccau

SEQ ID NO: 3669283 - RNA, 13 nt, Salmonella enterica enterica serovar Typhi
uuuacgcugcucc

SEQ ID NO: 3669284 - RNA, 22 nt, Salmonella enterica enterica serovar Typhi
uuuacguaacugcgguaaauaa

SEQ ID NO: 3669285 - RNA, 18 nt, Salmonella enterica enterica serovar Typhi
uuuacuaaugaauuuaau

SEQ ID NO: 3669286 - RNA, 17 nt, Salmonella enterica enterica serovar Typhi
uuuacuauugccgauaa

SEQ ID NO: 3669287 - RNA, 18 nt, Salmonella enterica enterica serovar Typhi
uuuacuccauucccagcu

SEQ ID NO: 3669288 - RNA, 12 nt, Salmonella enterica enterica serovar Typhi
uuuacugaauaa

SEQ ID NO: 3669289 - RNA, 20 nt, Salmonella enterica enterica serovar Typhi
uuuacugcgaaggcuacugc

SEQ ID NO: 3669290 - RNA, 16 nt, Salmonella enterica enterica serovar Typhi
uuuacuucuucaggcu

SEQ ID NO: 3669291 - RNA, 18 nt, Salmonella enterica enterica serovar Typhi
uuuacuuuuuuaaauguu

SEQ ID NO: 3669292 - RNA, 12 nt, Salmonella enterica enterica serovar Typhi
uuuagaaaauau

SEQ ID NO: 3669293 - RNA, 16 nt, Salmonella enterica enterica serovar Typhi
uuuagaaccaauagua

SEQ ID NO: 3669294 - RNA, 13 nt, Salmonella enterica enterica serovar Typhi
uuuagaauuaucu

SEQ ID NO: 3669295 - RNA, 13 nt, Salmonella enterica enterica serovar Typhi
uuuagcauaacgu

SEQ ID NO: 3669296 - RNA, 19 nt, Salmonella enterica enterica serovar Typhi
uuuagcauaacguuuccuu

SEQ ID NO: 3669297 - RNA, 23 nt, Salmonella enterica enterica serovar Typhi
uuuagccugcgcguaaauuucac

SEQ ID NO: 3669298 - RNA, 17 nt, Salmonella enterica enterica serovar Typhi
uuuagcgccauuccugc

SEQ ID NO: 3669299 - RNA, 18 nt, Salmonella enterica enterica serovar Typhi
uuuagcuguucaaucacu

SEQ ID NO: 3669300 - RNA, 17 nt, Salmonella enterica enterica serovar Typhi
uuuaguuucuuuucguu

SEQ ID NO: 3669301 - RNA, 23 nt, Salmonella enterica enterica serovar Typhi
uuuauaacauaaauaguauuagu

SEQ ID NO: 3669302 - RNA, 19 nt, Salmonella enterica enterica serovar Typhi
uuuauaacuaaacucaucu

SEQ ID NO: 3669303 - RNA, 15 nt, Salmonella enterica enterica serovar Typhi
uuuauauuuuuaagg

SEQ ID NO: 3669304 - RNA, 20 nt, Salmonella enterica enterica serovar Typhi
uuuaucaacaaauuccggca

SEQ ID NO: 3669305 - RNA, 14 nt, Salmonella enterica enterica serovar Typhi
uuuaucagaccugu

SEQ ID NO: 3669306 - RNA, 12 nt, Salmonella enterica enterica serovar Typhi
uuuaucaggccu

SEQ ID NO: 3669307 - RNA, 11 nt, Salmonella enterica enterica serovar Typhi
uuuauccagua

SEQ ID NO: 3669308 - RNA, 22 nt, Salmonella enterica enterica serovar Typhi
uuuauccccgcuggcgcgggga

SEQ ID NO: 3669309 - RNA, 20 nt, Salmonella enterica enterica serovar Typhi
uuuauccggcacgguaaacc

SEQ ID NO: 3669310 - RNA, 15 nt, Salmonella enterica enterica serovar Typhi
uuuauccggcgccau

SEQ ID NO: 3669311 - RNA, 18 nt, Salmonella enterica enterica serovar Typhi
uuuauccggcgccauagu

SEQ ID NO: 3669312 - RNA, 17 nt, Salmonella enterica enterica serovar Typhi
uuuaucgaucuccaucu

SEQ ID NO: 3669313 - RNA, 24 nt, Salmonella enterica enterica serovar Typhi
uuuaucuauucagguuauuugccu

SEQ ID NO: 3669314 - RNA, 13 nt, Salmonella enterica enterica serovar Typhi
uuuaucuauuucu

SEQ ID NO: 3669315 - RNA, 15 nt, Salmonella enterica enterica serovar Typhi
uuuaucuauuucuua

SEQ ID NO: 3669316 - RNA, 17 nt, Salmonella enterica enterica serovar Typhi
uuuaucugcccuuucuu

SEQ ID NO: 3669317 - RNA, 21 nt, Salmonella enterica enterica serovar Typhi
uuuaucugcgugaugcaucag

SEQ ID NO: 3669318 - RNA, 22 nt, Salmonella enterica enterica serovar Typhi
uuuaucuucucuaucagcgccu

SEQ ID NO: 3669319 - RNA, 22 nt, Salmonella enterica enterica serovar Typhi
uuuaucuuuaaauuucagggcu

SEQ ID NO: 3669320 - RNA, 22 nt, Salmonella enterica enterica serovar Typhi
uuuaugcacgccgggaauuauu

SEQ ID NO: 3669321 - RNA, 19 nt, Salmonella enterica enterica serovar Typhi
uuuaugccggcuaauaguu

SEQ ID NO: 3669322 - RNA, 15 nt, Salmonella enterica enterica serovar Typhi
uuuauggcacaucag

SEQ ID NO: 3669323 - RNA, 13 nt, Salmonella enterica enterica serovar Typhi
uuuauuaacccuu

SEQ ID NO: 3669324 - RNA, 18 nt, Salmonella enterica enterica serovar Typhi
uuuauuaccugguauuau

SEQ ID NO: 3669325 - RNA, 22 nt, Salmonella enterica enterica serovar Typhi
uuuauuacgcgcucucauaagc

SEQ ID NO: 3669326 - RNA, 17 nt, Salmonella enterica enterica serovar Typhi
uuuauuaguaauaucag

SEQ ID NO: 3669327 - RNA, 12 nt, Salmonella enterica enterica serovar Typhi
uuuauuaucuga

SEQ ID NO: 3669328 - RNA, 13 nt, Salmonella enterica enterica serovar Typhi
uuuauuauuucca

SEQ ID NO: 3669329 - RNA, 22 nt, Salmonella enterica enterica serovar Typhi
uuuauugaagugcgaaauuuaa

SEQ ID NO: 3669330 - RNA, 18 nt, Salmonella enterica enterica serovar Typhi
uuuauugaugacauuaau

SEQ ID NO: 3669331 - RNA, 12 nt, Salmonella enterica enterica serovar Typhi
uuuauugccgcu

SEQ ID NO: 3669332 - RNA, 12 nt, Salmonella enterica enterica serovar Typhi
uuuauuuuucaa

SEQ ID NO: 3669333 - RNA, 21 nt, Salmonella enterica enterica serovar Typhi
uuuauuuuuuuacauuauucc

SEQ ID NO: 3669334 - RNA, 13 nt, Salmonella enterica enterica serovar Typhi
uuucaaauagcug

SEQ ID NO: 3669335 - RNA, 20 nt, Salmonella enterica enterica serovar Typhi
uuucaacagcacccaggcac

SEQ ID NO: 3669336 - RNA, 23 nt, Salmonella enterica enterica serovar Typhi
uuucaacauauuuuucacacaua

SEQ ID NO: 3669337 - RNA, 17 nt, Salmonella enterica enterica serovar Typhi
uuucaaccacggauaag

SEQ ID NO: 3669338 - RNA, 18 nt, Salmonella enterica enterica serovar Typhi
uuucaacccccucagcaa

SEQ ID NO: 3669339 - RNA, 23 nt, Salmonella enterica enterica serovar Typhi
uuucaacccccucagcaaugauu

SEQ ID NO: 3669340 - RNA, 22 nt, Salmonella enterica enterica serovar Typhi
uuucaaccgcgccaaagauaag

SEQ ID NO: 3669341 - RNA, 15 nt, Salmonella enterica enterica serovar Typhi
uuucaacugccccuu

SEQ ID NO: 3669342 - RNA, 21 nt, Salmonella enterica enterica serovar Typhi
uuucaauaaucccuucuuuua

SEQ ID NO: 3669343 - RNA, 23 nt, Salmonella enterica enterica serovar Typhi
uuucaauaauggcgcgaaaacag

SEQ ID NO: 3669344 - RNA, 18 nt, Salmonella enterica enterica serovar Typhi
uuucaauacuccacaguu

SEQ ID NO: 3669345 - RNA, 19 nt, Salmonella enterica enterica serovar Typhi
uuucaauauagccguggcu

SEQ ID NO: 3669346 - RNA, 18 nt, Salmonella enterica enterica serovar Typhi
uuucaauguaauuacccu

SEQ ID NO: 3669347 - RNA, 14 nt, Salmonella enterica enterica serovar Typhi
uuucaauuuccagu

SEQ ID NO: 3669348 - RNA, 18 nt, Salmonella enterica enterica serovar Typhi
uuucaauuugugagauaa

SEQ ID NO: 3669349 - RNA, 24 nt, Salmonella enterica enterica serovar Typhi
uuucaccgcgucguuacgcucguc

SEQ ID NO: 3669350 - RNA, 19 nt, Salmonella enterica enterica serovar Typhi
uuucaccguggcaucauca

SEQ ID NO: 3669351 - RNA, 19 nt, Salmonella enterica enterica serovar Typhi
uuucaccuggaugcugccu

SEQ ID NO: 3669352 - RNA, 12 nt, Salmonella enterica enterica serovar Typhi
uuucaccuucug

SEQ ID NO: 3669353 - RNA, 18 nt, Salmonella enterica enterica serovar Typhi
uuucacgccauugccagg

SEQ ID NO: 3669354 - RNA, 21 nt, Salmonella enterica enterica serovar Typhi
uuucacuaauccccauuuuuu

SEQ ID NO: 3669355 - RNA, 22 nt, Salmonella enterica enterica serovar Typhi
uuucacugcgugaugcugcagg

SEQ ID NO: 3669356 - RNA, 14 nt, Salmonella enterica enterica serovar Typhi
uuucacuuccaugc

SEQ ID NO: 3669357 - RNA, 18 nt, Salmonella enterica enterica serovar Typhi
uuucagaggucaggauuu

SEQ ID NO: 3669358 - RNA, 18 nt, Salmonella enterica enterica serovar Typhi
uuucagauaacgaaccau

SEQ ID NO: 3669359 - RNA, 13 nt, Salmonella enterica enterica serovar Typhi
uuucagaucggca

SEQ ID NO: 3669360 - RNA, 18 nt, Salmonella enterica enterica serovar Typhi
uuucagaucggcaaaagu

SEQ ID NO: 3669361 - RNA, 18 nt, Salmonella enterica enterica serovar Typhi
uuucagaucgguaaaagc

SEQ ID NO: 3669362 - RNA, 14 nt, Salmonella enterica enterica serovar Typhi
uuucagcagugcaa

SEQ ID NO: 3669363 - RNA, 15 nt, Salmonella enterica enterica serovar Typhi
uuucagcauccuccg

SEQ ID NO: 3669364 - RNA, 13 nt, Salmonella enterica enterica serovar Typhi
uuucucauuaaaa

SEQ ID NO: 3669365 - RNA, 18 nt, Salmonella enterica enterica serovar Typhi
uuucucauuaaaaaaccg

SEQ ID NO: 3669366 - RNA, 19 nt, Salmonella enterica enterica serovar Typhi
uuucucccgccagaugcag

SEQ ID NO: 3669367 - RNA, 16 nt, Salmonella enterica enterica serovar Typhi
uuucuccugauuaauc

SEQ ID NO: 3669368 - RNA, 23 nt, Salmonella enterica enterica serovar Typhi
uuucuccugcgccagccggauac

SEQ ID NO: 3669369 - RNA, 11 nt, Salmonella enterica enterica serovar Typhi
uuucucgccau

SEQ ID NO: 3669370 - RNA, 19 nt, Salmonella enterica enterica serovar Typhi
uuucucggcuuuccagcuc

SEQ ID NO: 3669371 - RNA, 12 nt, Salmonella enterica enterica serovar Typhi
uuucucuucuuu

SEQ ID NO: 3669372 - RNA, 20 nt, Salmonella enterica enterica serovar Typhi
uuucugauaacgcaggcgau

SEQ ID NO: 3669373 - RNA, 21 nt, Salmonella enterica enterica serovar Typhi
uuucugauagcccuauucgug

SEQ ID NO: 3669374 - RNA, 14 nt, Salmonella enterica enterica serovar Typhi
uuucugaugcgccu

SEQ ID NO: 3669375 - RNA, 12 nt, Salmonella enterica enterica serovar Typhi
uuucugcugcca

SEQ ID NO: 3669376 - RNA, 14 nt, Salmonella enterica enterica serovar Typhi
uuucugcugccagc

SEQ ID NO: 3669377 - RNA, 14 nt, Salmonella enterica enterica serovar Typhi
uuucuguuccgaaa

SEQ ID NO: 3669378 - RNA, 15 nt, Salmonella enterica enterica serovar Typhi
uuucuguuccgaaau

SEQ ID NO: 3669379 - RNA, 12 nt, Salmonella enterica enterica serovar Typhi
uuucuuaacccc

SEQ ID NO: 3669380 - RNA, 17 nt, Salmonella enterica enterica serovar Typhi
uuucuuauuacaagaaa

SEQ ID NO: 3669381 - RNA, 13 nt, Salmonella enterica enterica serovar Typhi
uuucuuauuuauu

SEQ ID NO: 3669382 - RNA, 13 nt, Salmonella enterica enterica serovar Typhi
uuucuucaucaaa

SEQ ID NO: 3669383 - RNA, 19 nt, Salmonella enterica enterica serovar Typhi
uuucuuccauuagcuguug

SEQ ID NO: 3669384 - RNA, 19 nt, Salmonella enterica enterica serovar Typhi
uuucuucuggccauuucau

SEQ ID NO: 3669385 - RNA, 14 nt, Salmonella enterica enterica serovar Typhi
uuucuucuuaacac

SEQ ID NO: 3669386 - RNA, 15 nt, Salmonella enterica enterica serovar Typhi
uuucuucuuaacacu

SEQ ID NO: 3669387 - RNA, 23 nt, Salmonella enterica enterica serovar Typhi
uuucuugccacuggccucccagu

SEQ ID NO: 3669388 - RNA, 19 nt, Salmonella enterica enterica serovar Typhi
uuucuuguuccugcacccg

SEQ ID NO: 3669389 - RNA, 17 nt, Salmonella enterica enterica serovar Typhi
uuucuuucagcucuuca

SEQ ID NO: 3669390 - RNA, 14 nt, Salmonella enterica enterica serovar Typhi
uuucuuucaucaaa

SEQ ID NO: 3669391 - RNA, 13 nt, Salmonella enterica enterica serovar Typhi
uuucuuucaucag

SEQ ID NO: 3669392 - RNA, 13 nt, Salmonella enterica enterica serovar Typhi
uuucuuuuccaga

SEQ ID NO: 3669393 - RNA, 13 nt, Salmonella enterica enterica serovar Typhi
uuugaaaaucaca

SEQ ID NO: 3669394 - RNA, 15 nt, Salmonella enterica enterica serovar Typhi
uuugaacucuuucag

SEQ ID NO: 3669395 - RNA, 14 nt, Salmonella enterica enterica serovar Typhi
uuugaaguguuccu

SEQ ID NO: 3669396 - RNA, 20 nt, Salmonella enterica enterica serovar Typhi
uuugacaaccucgcuucgcu

SEQ ID NO: 3669397 - RNA, 22 nt, Salmonella enterica enterica serovar Typhi
uuugaccauuaccauuccucac

SEQ ID NO: 3669398 - RNA, 20 nt, Salmonella enterica enterica serovar Typhi
uuugacgacaaacuccagcu

SEQ ID NO: 3669399 - RNA, 21 nt, Salmonella enterica enterica serovar Typhi
uuugacgacaaacuccagcuc

SEQ ID NO: 3669400 - RNA, 22 nt, Salmonella enterica enterica serovar Typhi
uuugacucgcuacgcucgcccu

SEQ ID NO: 3669401 - RNA, 15 nt, Salmonella enterica enterica serovar Typhi
uuugagcaacuucag

SEQ ID NO: 3669402 - RNA, 22 nt, Salmonella enterica enterica serovar Typhi
uuugagcaucaaacuuuuaaau

SEQ ID NO: 3669403 - RNA, 12 nt, Salmonella enterica enterica serovar Typhi
uuugaggaaacc

SEQ ID NO: 3669404 - RNA, 19 nt, Salmonella enterica enterica serovar Typhi
uuugagguaugucgaauau

SEQ ID NO: 3669405 - RNA, 17 nt, Salmonella enterica enterica serovar Typhi
uuugauaaacugcgcca

SEQ ID NO: 3669406 - RNA, 22 nt, Salmonella enterica enterica serovar Typhi
uuugauaaacugcgccauguuc

SEQ ID NO: 3669407 - RNA, 14 nt, Salmonella enterica enterica serovar Typhi
uuugauacucugcu

SEQ ID NO: 3669408 - RNA, 21 nt, Salmonella enterica enterica serovar Typhi
uuugauagacguaaugaucag

SEQ ID NO: 3669409 - RNA, 22 nt, Salmonella enterica enterica serovar Typhi
uuugauagacguaaugaucaga

SEQ ID NO: 3669410 - RNA, 17 nt, Salmonella enterica enterica serovar Typhi
uuugauauuuaaucgcu

SEQ ID NO: 3669411 - RNA, 18 nt, Salmonella enterica enterica serovar Typhi
uuugauccguuucagaaa

SEQ ID NO: 3669412 - RNA, 19 nt, Salmonella enterica enterica serovar Typhi
uuugauccguuucagaaag

SEQ ID NO: 3669413 - RNA, 14 nt, Salmonella enterica enterica serovar Typhi
uuugaucugcuuga

SEQ ID NO: 3669414 - RNA, 21 nt, Salmonella enterica enterica serovar Typhi
uuugaugcaaaugucagaucg

SEQ ID NO: 3669415 - RNA, 13 nt, Salmonella enterica enterica serovar Typhi
uuugauugccauc

SEQ ID NO: 3669416 - RNA, 23 nt, Salmonella enterica enterica serovar Typhi
uuugauuuauuuugaauuuuuau

SEQ ID NO: 3669417 - RNA, 20 nt, Salmonella enterica enterica serovar Typhi
uuugcaccgcuaaaaaacag

SEQ ID NO: 3669418 - RNA, 17 nt, Salmonella enterica enterica serovar Typhi
uuugcacguucugcugg

SEQ ID NO: 3669419 - RNA, 12 nt, Salmonella enterica enterica serovar Typhi
uuugcagauccu

SEQ ID NO: 3669420 - RNA, 18 nt, Salmonella enterica enterica serovar Typhi
uuugcagcaacugauuca

SEQ ID NO: 3669421 - RNA, 16 nt, Salmonella enterica enterica serovar Typhi
uuugcaggccggauaa

SEQ ID NO: 3669422 - RNA, 19 nt, Salmonella enterica enterica serovar Typhi
uuugcagguuacucacugc

SEQ ID NO: 3669423 - RNA, 21 nt, Salmonella enterica enterica serovar Typhi
uuugcagguuacucacugccg

SEQ ID NO: 3669424 - RNA, 21 nt, Salmonella enterica enterica serovar Typhi
uuugcaguuccgcaauccugg

SEQ ID NO: 3669425 - RNA, 14 nt, Salmonella enterica enterica serovar Typhi
uuugccagcaccag

SEQ ID NO: 3669426 - RNA, 12 nt, Salmonella enterica enterica serovar Typhi
uuugccauaucu

SEQ ID NO: 3669427 - RNA, 15 nt, Salmonella enterica enterica serovar Typhi
uuugcccagcgcugg

SEQ ID NO: 3669428 - RNA, 20 nt, Salmonella enterica enterica serovar Typhi
uuugccgcugucgccagaau

SEQ ID NO: 3669429 - RNA, 14 nt, Salmonella enterica enterica serovar Typhi
uuugccuuucuuau

SEQ ID NO: 3669430 - RNA, 15 nt, Salmonella enterica enterica serovar Typhi
uuugccuuucuuauu

SEQ ID NO: 3669431 - RNA, 21 nt, Salmonella enterica enterica serovar Typhi
uuugccuuuugacagcacaua

SEQ ID NO: 3669432 - RNA, 22 nt, Salmonella enterica enterica serovar Typhi
uuugcgcccgcucuuauugcuc

SEQ ID NO: 3669433 - RNA, 10 nt, Salmonella enterica enterica serovar Typhi
uuugcgcgcg

SEQ ID NO: 3669434 - RNA, 11 nt, Salmonella enterica enterica serovar Typhi
uuugcgcggcu

SEQ ID NO: 3669435 - RNA, 19 nt, Salmonella enterica enterica serovar Typhi
uuugcgcgguccacaggcc

SEQ ID NO: 3669436 - RNA, 22 nt, Salmonella enterica enterica serovar Typhi
uuugcggacuagacagccucuc

SEQ ID NO: 3669437 - RNA, 22 nt, Salmonella enterica enterica serovar Typhi
uuugcggcguccaguacuuucu

SEQ ID NO: 3669438 - RNA, 16 nt, Salmonella enterica enterica serovar Typhi
uuugcguaaaaaacau

SEQ ID NO: 3669439 - RNA, 18 nt, Salmonella enterica enterica serovar Typhi
uuugcguaaaaaacauca

SEQ ID NO: 3669440 - RNA, 18 nt, Salmonella enterica enterica serovar Typhi
uuugcgucguuaacugca

SEQ ID NO: 3669441 - RNA, 16 nt, Salmonella enterica enterica serovar Typhi
uuugcucaauuuuuuu

SEQ ID NO: 3669442 - RNA, 22 nt, Salmonella enterica enterica serovar Typhi
uuugcucaguucagcggucaua

SEQ ID NO: 3669443 - RNA, 12 nt, Salmonella enterica enterica serovar Typhi
uuugcucgccau

SEQ ID NO: 3669444 - RNA, 19 nt, Salmonella enterica enterica serovar Typhi
uuugcugcauuucuuguug

SEQ ID NO: 3669445 - RNA, 20 nt, Salmonella enterica enterica serovar Typhi
uuugcuggaaaaauaagagg

SEQ ID NO: 3669446 - RNA, 21 nt, Salmonella enterica enterica serovar Typhi
uuugcugguugucucaaaaaa

SEQ ID NO: 3669447 - RNA, 22 nt, Salmonella enterica enterica serovar Typhi
uuugcugguugucucaaaaaau

SEQ ID NO: 3669448 - RNA, 18 nt, Salmonella enterica enterica serovar Typhi
uuugcuguuuuauuuccu

SEQ ID NO: 3669449 - RNA, 17 nt, Salmonella enterica enterica serovar Typhi
uuugcuguuuuuuguug

SEQ ID NO: 3669450 - RNA, 23 nt, Salmonella enterica enterica serovar Typhi
uuuucccacucgcuuccuuuauu

SEQ ID NO: 3669451 - RNA, 14 nt, Salmonella enterica enterica serovar Typhi
uuuucccauaaaag

SEQ ID NO: 3669452 - RNA, 19 nt, Salmonella enterica enterica serovar Typhi
uuuuccugaaaaaauuccc

SEQ ID NO: 3669453 - RNA, 19 nt, Salmonella enterica enterica serovar Typhi
uuuuccugcugccaucgcu

SEQ ID NO: 3669454 - RNA, 20 nt, Salmonella enterica enterica serovar Typhi
uuuuccugcugguagagcau

SEQ ID NO: 3669455 - RNA, 15 nt, Salmonella enterica enterica serovar Typhi
uuuucgaucuucucc

SEQ ID NO: 3669456 - RNA, 22 nt, Salmonella enterica enterica serovar Typhi
uuuucgcagagucgcagcggcg

SEQ ID NO: 3669457 - RNA, 21 nt, Salmonella enterica enterica serovar Typhi
uuuucgccagguacaucgcgc

SEQ ID NO: 3669458 - RNA, 18 nt, Salmonella enterica enterica serovar Typhi
uuuucgcccccagcacga

SEQ ID NO: 3669459 - RNA, 21 nt, Salmonella enterica enterica serovar Typhi
uuuucggcacaucaauaaauc

SEQ ID NO: 3669460 - RNA, 14 nt, Salmonella enterica enterica serovar Typhi
uuuucguuccagag

SEQ ID NO: 3669461 - RNA, 13 nt, Salmonella enterica enterica serovar Typhi
uuuucuauuuucu

SEQ ID NO: 3669462 - RNA, 15 nt, Salmonella enterica enterica serovar Typhi
uuuucucaauacgau

SEQ ID NO: 3669463 - RNA, 23 nt, Salmonella enterica enterica serovar Typhi
uuuucucuucugcugacaucucu

SEQ ID NO: 3669464 - RNA, 13 nt, Salmonella enterica enterica serovar Typhi
uuuucugcuuucu

SEQ ID NO: 3669465 - RNA, 17 nt, Salmonella enterica enterica serovar Typhi
uuuucuguaauucuccc

SEQ ID NO: 3669466 - RNA, 20 nt, Salmonella enterica enterica serovar Typhi
uuuucugucguguccuugcc

SEQ ID NO: 3669467 - RNA, 11 nt, Salmonella enterica enterica serovar Typhi
uuuucuucaug

SEQ ID NO: 3669468 - RNA, 23 nt, Salmonella enterica enterica serovar Typhi
uuuucuucuggccauuucaucau

SEQ ID NO: 3669469 - RNA, 17 nt, Salmonella enterica enterica serovar Typhi
uuuugaacauaugaagg

SEQ ID NO: 3669470 - RNA, 12 nt, Salmonella enterica enterica serovar Typhi
uuuugaauuuuu

SEQ ID NO: 3669471 - RNA, 23 nt, Salmonella enterica enterica serovar Typhi
uuuugacugcgggggcaaaugcg

SEQ ID NO: 3669472 - RNA, 20 nt, Salmonella enterica enterica serovar Typhi
uuuugauacucaucauaauc

SEQ ID NO: 3669473 - RNA, 22 nt, Salmonella enterica enterica serovar Typhi
uuuugcacggcaucuuuguucu

SEQ ID NO: 3669474 - RNA, 10 nt, Salmonella enterica enterica serovar Typhi
uuuugccgcc

SEQ ID NO: 3669475 - RNA, 21 nt, Salmonella enterica enterica serovar Typhi
uuuugccgcccagucacggcu

SEQ ID NO: 3669476 - RNA, 17 nt, Salmonella enterica enterica serovar Typhi
uuuugccguugcuguuc

SEQ ID NO: 3669477 - RNA, 21 nt, Salmonella enterica enterica serovar Typhi
uuuugcuacgucgccuggcau

SEQ ID NO: 3669478 - RNA, 20 nt, Salmonella enterica enterica serovar Typhi
uuuuggcaacggcagccagc

SEQ ID NO: 3669479 - RNA, 11 nt, Salmonella enterica enterica serovar Typhi
uuuuggcagcc

SEQ ID NO: 3669480 - RNA, 16 nt, Salmonella enterica enterica serovar Typhi
uuuuggggaaaauacc

SEQ ID NO: 3669481 - RNA, 14 nt, Salmonella enterica enterica serovar Typhi
uuuugguaucuucu

SEQ ID NO: 3669482 - RNA, 15 nt, Salmonella enterica enterica serovar Typhi
uuuuggucagcucac

SEQ ID NO: 3669483 - RNA, 21 nt, Salmonella enterica enterica serovar Typhi
uuuuguauuccuucggugcca

SEQ ID NO: 3669484 - RNA, 19 nt, Salmonella enterica enterica serovar Typhi
uuuugucaucgucagcaac

SEQ ID NO: 3669485 - RNA, 17 nt, Salmonella enterica enterica serovar Typhi
uuuugucaugguaaaug

SEQ ID NO: 3669486 - RNA, 17 nt, Salmonella enterica enterica serovar Typhi
uuuugucggaauuuccg

SEQ ID NO: 3669487 - RNA, 20 nt, Salmonella enterica enterica serovar Typhi
uuuuguggccugcuuaaaca

SEQ ID NO: 3669488 - RNA, 18 nt, Salmonella enterica enterica serovar Typhi
uuuugugucaaaaaguug

SEQ ID NO: 3669489 - RNA, 15 nt, Salmonella enterica enterica serovar Typhi
uuuuguugauuuuau

SEQ ID NO: 3669490 - RNA, 13 nt, Salmonella enterica enterica serovar Typhi
uuuuuaaaaaacc

SEQ ID NO: 3669491 - RNA, 12 nt, Salmonella enterica enterica serovar Typhi
uuuuuaauaaua

SEQ ID NO: 3669492 - RNA, 16 nt, Salmonella enterica enterica serovar Typhi
uuuuuacgccugaacg

SEQ ID NO: 3669493 - RNA, 12 nt, Salmonella enterica enterica serovar Typhi
uuuuuacgcuua

SEQ ID NO: 3669494 - RNA, 20 nt, Salmonella enterica enterica serovar Typhi
uuuuuagccuguuauucaau

SEQ ID NO: 3669495 - RNA, 23 nt, Salmonella enterica enterica serovar Typhi
uuuuuaggcuauaaaaaucaucc

SEQ ID NO: 3669496 - RNA, 15 nt, Salmonella enterica enterica serovar Typhi
uuuuucaauuuccag

SEQ ID NO: 3669497 - RNA, 17 nt, Salmonella enterica enterica serovar Typhi
uuuuucagaauaucgcc

SEQ ID NO: 3669498 - RNA, 12 nt, Salmonella enterica enterica serovar Typhi
uuuuucagaucu

SEQ ID NO: 3669499 - RNA, 15 nt, Salmonella enterica enterica serovar Typhi
uuuuucagcaaauac

SEQ ID NO: 3669500 - RNA, 13 nt, Salmonella enterica enterica serovar Typhi
uuuuucagcggca

SEQ ID NO: 3669501 - RNA, 13 nt, Salmonella enterica enterica serovar Typhi
uuuuucauaucca

SEQ ID NO: 3669502 - RNA, 13 nt, Salmonella enterica enterica serovar Typhi
uuuuucaucauac

SEQ ID NO: 3669503 - RNA, 15 nt, Salmonella enterica enterica serovar Typhi
uuuuucaugcaauaa

SEQ ID NO: 3669504 - RNA, 11 nt, Salmonella enterica enterica serovar Typhi
uuuuuccagcg

SEQ ID NO: 3669505 - RNA, 20 nt, Salmonella enterica enterica serovar Typhi
uuuuucccgauaacguaaau

SEQ ID NO: 3669506 - RNA, 16 nt, Salmonella enterica enterica serovar Typhi
uuuuucgaucagcaua

SEQ ID NO: 3669507 - RNA, 15 nt, Salmonella enterica enterica serovar Typhi
uuuuugaccauucca

SEQ ID NO: 3669508 - RNA, 19 nt, Salmonella enterica enterica serovar Typhi
uuuuugaguuugucaucca

SEQ ID NO: 3669509 - RNA, 22 nt, Salmonella enterica enterica serovar Typhi
uuuuugcacggcaucuuuguuc

SEQ ID NO: 3669510 - RNA, 17 nt, Salmonella enterica enterica serovar Typhi
uuuuugccacauuuccc

SEQ ID NO: 3669511 - RNA, 21 nt, Salmonella enterica enterica serovar Typhi
uuuuugcgacacgcugcauau

SEQ ID NO: 3669512 - RNA, 16 nt, Salmonella enterica enterica serovar Typhi
uuuuuuauaacauaaa

SEQ ID NO: 3669513 - RNA, 13 nt, Salmonella enterica enterica serovar Typhi
uuuuuucaucucc

SEQ ID NO: 3669514 - RNA, 21 nt, Salmonella enterica enterica serovar Typhi
uuuuuucuguuauuuccgcaa

SEQ ID NO: 3669515 - RNA, 10 nt, Salmonella enterica enterica serovar Typhi
uuuuuuugca

SEQ ID NO: 3669516 - RNA, 11 nt, Salmonella enterica enterica serovar Typhi
uuuuuuugccc

SEQ ID NO: 3669517 - RNA, 16 nt, Salmonella enterica enterica serovar Typhi
uggcauuggcaucugu

SEQ ID NO: 3669518 - RNA, 17 nt, Salmonella enterica enterica serovar Typhi
uggcauuggcaucuguc

SEQ ID NO: 3669519 - RNA, 17 nt, Salmonella enterica enterica serovar Typhi
uggcauuuugcggcgug

SEQ ID NO: 3669520 - RNA, 15 nt, Salmonella enterica enterica serovar Typhi
uggccaagaugcuga

SEQ ID NO: 3669521 - RNA, 16 nt, Salmonella enterica enterica serovar Typhi
uggccaaucagcgggu

SEQ ID NO: 3669522 - RNA, 17 nt, Salmonella enterica enterica serovar Typhi
uggccacaucguuaccc

SEQ ID NO: 3669523 - RNA, 15 nt, Salmonella enterica enterica serovar Typhi
uggccaccuuuacgg

SEQ ID NO: 3669524 - RNA, 14 nt, Salmonella enterica enterica serovar Typhi
uggccagcacaaua

SEQ ID NO: 3669525 - RNA, 17 nt, Salmonella enterica enterica serovar Typhi
uggccagcaccagcauu

SEQ ID NO: 3669526 - RNA, 13 nt, Salmonella enterica enterica serovar Typhi
uggccagcauggc

SEQ ID NO: 3669527 - RNA, 18 nt, Salmonella enterica enterica serovar Typhi
uggccagcauggcgguca

SEQ ID NO: 3669528 - RNA, 15 nt, Salmonella enterica enterica serovar Typhi
uggccaggaauaaag

SEQ ID NO: 3669529 - RNA, 19 nt, Salmonella enterica enterica serovar Typhi
uggccaggaauaaagguca

SEQ ID NO: 3669530 - RNA, 13 nt, Salmonella enterica enterica serovar Typhi
uggccaguuucaa

SEQ ID NO: 3669531 - RNA, 24 nt, Salmonella enterica enterica serovar Typhi
uggccauagacuuuggcgcaguca

SEQ ID NO: 3669532 - RNA, 21 nt, Salmonella enterica enterica serovar Typhi
uggccauauuuuuucaggaag

SEQ ID NO: 3669533 - RNA, 21 nt, Salmonella enterica enterica serovar Typhi
uggccauuaucgaucugagcg

SEQ ID NO: 3669534 - RNA, 17 nt, Salmonella enterica enterica serovar Typhi
uggcccagcgcgguggc

SEQ ID NO: 3669535 - RNA, 14 nt, Salmonella enterica enterica serovar Typhi
uggccccugagcaa

SEQ ID NO: 3669536 - RNA, 21 nt, Salmonella enterica enterica serovar Typhi
uggcccgauacgcggaucggc

SEQ ID NO: 3669537 - RNA, 16 nt, Salmonella enterica enterica serovar Typhi
uggcccgcacugccga

SEQ ID NO: 3669538 - RNA, 19 nt, Salmonella enterica enterica serovar Typhi
uggcccgcccagcaugggc

SEQ ID NO: 3669539 - RNA, 15 nt, Salmonella enterica enterica serovar Typhi
uggcccugcaucagc

SEQ ID NO: 3669540 - RNA, 15 nt, Salmonella enterica enterica serovar Typhi
uggccgaauagcuga

SEQ ID NO: 3669541 - RNA, 16 nt, Salmonella enterica enterica serovar Typhi
uggccgacggcauaac

SEQ ID NO: 3669542 - RNA, 15 nt, Salmonella enterica enterica serovar Typhi
uggccgacuggcacc

SEQ ID NO: 3669543 - RNA, 22 nt, Salmonella enterica enterica serovar Typhi
uggccgauaugaauaauuucgg

SEQ ID NO: 3669544 - RNA, 23 nt, Salmonella enterica enterica serovar Typhi
uggccgauauugccuucacccag

SEQ ID NO: 3669545 - RNA, 22 nt, Salmonella enterica enterica serovar Typhi
uggccgaugucaauuacgcacc

SEQ ID NO: 3669546 - RNA, 20 nt, Salmonella enterica enterica serovar Typhi
uggccgcaaauuccaacaua

SEQ ID NO: 3669547 - RNA, 19 nt, Salmonella enterica enterica serovar Typhi
uggccgcgcaaggcguuca

SEQ ID NO: 3669548 - RNA, 15 nt, Salmonella enterica enterica serovar Typhi
uggccgcgugcucgc

SEQ ID NO: 3669549 - RNA, 18 nt, Salmonella enterica enterica serovar Typhi
uggccgcgugcucgcggc

SEQ ID NO: 3669550 - RNA, 19 nt, Salmonella enterica enterica serovar Typhi
uggccgcgugcucgcggcg

SEQ ID NO: 3669551 - RNA, 17 nt, Salmonella enterica enterica serovar Typhi
uggccgcugaccacggc

SEQ ID NO: 3669552 - RNA, 14 nt, Salmonella enterica enterica serovar Typhi
uggccguggugaag

SEQ ID NO: 3669553 - RNA, 15 nt, Salmonella enterica enterica serovar Typhi
uggccugcugcggua

SEQ ID NO: 3669554 - RNA, 15 nt, Salmonella enterica enterica serovar Typhi
uggccuucauaccgu

SEQ ID NO: 3669555 - RNA, 13 nt, Salmonella enterica enterica serovar Typhi
uggccuucuccac

SEQ ID NO: 3669556 - RNA, 13 nt, Salmonella enterica enterica serovar Typhi
uggcgaauacugu

SEQ ID NO: 3669557 - RNA, 22 nt, Salmonella enterica enterica serovar Typhi
uggcgaauacuguuccaggcga

SEQ ID NO: 3669558 - RNA, 22 nt, Salmonella enterica enterica serovar Typhi
uggcgaauccuaaacucaacug

SEQ ID NO: 3669559 - RNA, 17 nt, Salmonella enterica enterica serovar Typhi
uggcgaccggcagccgu

SEQ ID NO: 3669560 - RNA, 21 nt, Salmonella enterica enterica serovar Typhi
uggcgacgacgcuguuuaugc

SEQ ID NO: 3669561 - RNA, 13 nt, Salmonella enterica enterica serovar Typhi
uggcgagcaacuu

SEQ ID NO: 3669562 - RNA, 16 nt, Salmonella enterica enterica serovar Typhi
uggcgagcaacuuuuu

SEQ ID NO: 3669563 - RNA, 18 nt, Salmonella enterica enterica serovar Typhi
uggcgaggaacaucagcc

SEQ ID NO: 3669564 - RNA, 22 nt, Salmonella enterica enterica serovar Typhi
uggcgaggcuuuguccuuugcu

SEQ ID NO: 3669565 - RNA, 20 nt, Salmonella enterica enterica serovar Typhi
uggcgauaaaaauauccgcc

SEQ ID NO: 3669566 - RNA, 22 nt, Salmonella enterica enterica serovar Typhi
uggcgauaauagaaccgaauaa

SEQ ID NO: 3669567 - RNA, 17 nt, Salmonella enterica enterica serovar Typhi
uggcgauauccgugccg

SEQ ID NO: 3669568 - RNA, 20 nt, Salmonella enterica enterica serovar Typhi
uggcgaucagcgccaccaca

SEQ ID NO: 3669569 - RNA, 21 nt, Salmonella enterica enterica serovar Typhi
uggcgaugcuaucgguagugu

SEQ ID NO: 3669570 - RNA, 13 nt, Salmonella enterica enterica serovar Typhi
uggcgauuuccag

SEQ ID NO: 3669571 - RNA, 14 nt, Salmonella enterica enterica serovar Typhi
uggcgauuuccagc

SEQ ID NO: 3669572 - RNA, 16 nt, Salmonella enterica enterica serovar Typhi
uggcgauuucggugac

SEQ ID NO: 3669573 - RNA, 15 nt, Salmonella enterica enterica serovar Typhi
uggcgcaaugucccu

SEQ ID NO: 3669574 - RNA, 20 nt, Salmonella enterica enterica serovar Typhi
uggcgcacaguacgcgaccg

SEQ ID NO: 3669575 - RNA, 18 nt, Salmonella enterica enterica serovar Typhi
uggcgcacaucgugcgcc

SEQ ID NO: 3669576 - RNA, 16 nt, Salmonella enterica enterica serovar Typhi
uggcgcagcaaaccau

SEQ ID NO: 3669577 - RNA, 19 nt, Salmonella enterica enterica serovar Typhi
uggcgcagcauacgcugca

SEQ ID NO: 3669578 - RNA, 18 nt, Salmonella enterica enterica serovar Typhi
uggcgcaguggcgggugc

SEQ ID NO: 3669579 - RNA, 14 nt, Salmonella enterica enterica serovar Typhi
uggcgcauuccaga

SEQ ID NO: 3669580 - RNA, 22 nt, Salmonella enterica enterica serovar Typhi
uggcgccaaaaccgcucacggu

SEQ ID NO: 3669581 - RNA, 16 nt, Salmonella enterica enterica serovar Typhi
uggcgccaugagccug

SEQ ID NO: 3669582 - RNA, 18 nt, Salmonella enterica enterica serovar Typhi
uggcgccgcaaaccagac

SEQ ID NO: 3669583 - RNA, 18 nt, Salmonella enterica enterica serovar Typhi
uggcgccuuuuggcagca

SEQ ID NO: 3669584 - RNA, 14 nt, Salmonella enterica enterica serovar Typhi
uggcgcgaaaacag

SEQ ID NO: 3669585 - RNA, 20 nt, Salmonella enterica enterica serovar Typhi
uggcgcgaagugccagguuu

SEQ ID NO: 3669586 - RNA, 15 nt, Salmonella enterica enterica serovar Typhi
uggcgcgccacuucu

SEQ ID NO: 3669587 - RNA, 21 nt, Salmonella enterica enterica serovar Typhi
uggcgcggggaacacuaaaac

SEQ ID NO: 3669588 - RNA, 17 nt, Salmonella enterica enterica serovar Typhi
uggcgcgucacaacagc

SEQ ID NO: 3669589 - RNA, 14 nt, Salmonella enterica enterica serovar Typhi
uggcgcgugcccag

SEQ ID NO: 3669590 - RNA, 16 nt, Salmonella enterica enterica serovar Typhi
uggcgcugcgcuuacc

SEQ ID NO: 3669591 - RNA, 20 nt, Salmonella enterica enterica serovar Typhi
uggcgcugcgcuuaccgggc

SEQ ID NO: 3669592 - RNA, 17 nt, Salmonella enterica enterica serovar Typhi
uggcgcugucgcuuacc

SEQ ID NO: 3669593 - RNA, 18 nt, Salmonella enterica enterica serovar Typhi
uggcgcuguucuugcugc

SEQ ID NO: 3669594 - RNA, 13 nt, Salmonella enterica enterica serovar Typhi
uggcgcuuuucca

SEQ ID NO: 3669595 - RNA, 16 nt, Salmonella enterica enterica serovar Typhi
uggcgcuuuuccagca

SEQ ID NO: 3669596 - RNA, 19 nt, Salmonella enterica enterica serovar Typhi
uggcggaauaucgcggaaa

SEQ ID NO: 3669597 - RNA, 20 nt, Salmonella enterica enterica serovar Typhi
uggcggaauccaucccccug

SEQ ID NO: 3669598 - RNA, 13 nt, Salmonella enterica enterica serovar Typhi
uggcggaaugacc

SEQ ID NO: 3669599 - RNA, 22 nt, Salmonella enterica enterica serovar Typhi
uggcggacccaaaagaaguggc

SEQ ID NO: 3669600 - RNA, 18 nt, Salmonella enterica enterica serovar Typhi
uggcggagaucuccagau

SEQ ID NO: 3669601 - RNA, 12 nt, Salmonella enterica enterica serovar Typhi
uggcggcaaaaa

SEQ ID NO: 3669602 - RNA, 22 nt, Salmonella enterica enterica serovar Typhi
uggcggcaaggcgacucaaaac

SEQ ID NO: 3669603 - RNA, 23 nt, Salmonella enterica enterica serovar Typhi
uggcggggagguuauugcucuuu

SEQ ID NO: 3669604 - RNA, 15 nt, Salmonella enterica enterica serovar Typhi
uggcgguaaucgcgc

SEQ ID NO: 3669605 - RNA, 17 nt, Salmonella enterica enterica serovar Typhi
uggcgguauaacugccu

SEQ ID NO: 3669606 - RNA, 23 nt, Salmonella enterica enterica serovar Typhi
uggcgguauaacugccuuauccg

SEQ ID NO: 3669607 - RNA, 15 nt, Salmonella enterica enterica serovar Typhi
uggcggugacgucaa

SEQ ID NO: 3669608 - RNA, 17 nt, Salmonella enterica enterica serovar Typhi
uggcguaaauauucguu

SEQ ID NO: 3669609 - RNA, 21 nt, Salmonella enterica enterica serovar Typhi
uggcguaaaugugcgccagcc

SEQ ID NO: 3669610 - RNA, 20 nt, Salmonella enterica enterica serovar Typhi
uggcguaauuaaccgcgccg

SEQ ID NO: 3669611 - RNA, 23 nt, Salmonella enterica enterica serovar Typhi
uggcguacgcagaucguauccag

SEQ ID NO: 3669612 - RNA, 17 nt, Salmonella enterica enterica serovar Typhi
uggcguacgcauccgcg

SEQ ID NO: 3669613 - RNA, 23 nt, Salmonella enterica enterica serovar Typhi
uggcguacgcauccgcguuaccc

SEQ ID NO: 3669614 - RNA, 18 nt, Salmonella enterica enterica serovar Typhi
uggcguagaagcuuacca

SEQ ID NO: 3669615 - RNA, 16 nt, Salmonella enterica enterica serovar Typhi
uggcguagucucccuc

SEQ ID NO: 3669616 - RNA, 22 nt, Salmonella enterica enterica serovar Typhi
uggcguccggccacuauuucgg

SEQ ID NO: 3669617 - RNA, 20 nt, Salmonella enterica enterica serovar Typhi
uggcgucgacgugucuaugc

SEQ ID NO: 3669618 - RNA, 20 nt, Salmonella enterica enterica serovar Typhi
uggcgucuguccggcgcuca

SEQ ID NO: 3669619 - RNA, 17 nt, Salmonella enterica enterica serovar Typhi
uggcgugaaccgguaaa

SEQ ID NO: 3669620 - RNA, 15 nt, Salmonella enterica enterica serovar Typhi
uggcguggccaagau

SEQ ID NO: 3669621 - RNA, 14 nt, Salmonella enterica enterica serovar Typhi
uggcguuaccggca

SEQ ID NO: 3669622 - RNA, 20 nt, Salmonella enterica enterica serovar Typhi
uggcguuaccggcaggcugg

SEQ ID NO: 3669623 - RNA, 16 nt, Salmonella enterica enterica serovar Typhi
uggcguuccacccagu

SEQ ID NO: 3669624 - RNA, 19 nt, Salmonella enterica enterica serovar Typhi
uggcguuccacccaguuca

SEQ ID NO: 3669625 - RNA, 22 nt, Salmonella enterica enterica serovar Typhi
uggcuaaagcgcugguggccgg

SEQ ID NO: 3669626 - RNA, 17 nt, Salmonella enterica enterica serovar Typhi
uggcuaaucgccacgac

SEQ ID NO: 3669627 - RNA, 14 nt, Salmonella enterica enterica serovar Typhi
uggcuagggaaacg

SEQ ID NO: 3669628 - RNA, 17 nt, Salmonella enterica enterica serovar Typhi
uggcuauacgcggcgua

SEQ ID NO: 3669629 - RNA, 20 nt, Salmonella enterica enterica serovar Typhi
uggcuauagcucaguuggua

SEQ ID NO: 3669630 - RNA, 20 nt, Salmonella enterica enterica serovar Typhi
uggcucaagauucaguucca

SEQ ID NO: 3669631 - RNA, 16 nt, Salmonella enterica enterica serovar Typhi
uggcucaauccaggug

SEQ ID NO: 3669632 - RNA, 17 nt, Salmonella enterica enterica serovar Typhi
uggcucaauccaggugg

SEQ ID NO: 3669633 - RNA, 21 nt, Salmonella enterica enterica serovar Typhi
uggcucccgaacgauaauucg

SEQ ID NO: 3669634 - RNA, 15 nt, Salmonella enterica enterica serovar Typhi
uggcucccgcagcca

SEQ ID NO: 3669635 - RNA, 16 nt, Salmonella enterica enterica serovar Typhi
uggcucggcgucaucc

SEQ ID NO: 3669636 - RNA, 14 nt, Salmonella enterica enterica serovar Typhi
uggcugagaaaaau

SEQ ID NO: 3669637 - RNA, 17 nt, Salmonella enterica enterica serovar Typhi
uggcugagaaaaauacg

SEQ ID NO: 3669638 - RNA, 17 nt, Salmonella enterica enterica serovar Typhi
uggcugccaucggcauu

SEQ ID NO: 3669639 - RNA, 12 nt, Salmonella enterica enterica serovar Typhi
uggcugccgaca

SEQ ID NO: 3669640 - RNA, 16 nt, Salmonella enterica enterica serovar Typhi
uggcugcgauaaugaa

SEQ ID NO: 3669641 - RNA, 14 nt, Salmonella enterica enterica serovar Typhi
uggcuggcauauug

SEQ ID NO: 3669642 - RNA, 15 nt, Salmonella enterica enterica serovar Typhi
uggcuggccagggca

SEQ ID NO: 3669643 - RNA, 14 nt, Salmonella enterica enterica serovar Typhi
uggcuggcgucccg

SEQ ID NO: 3669644 - RNA, 15 nt, Salmonella enterica enterica serovar Typhi
uggcugucguuucau

SEQ ID NO: 3669645 - RNA, 19 nt, Salmonella enterica enterica serovar Typhi
uggcugucguuucauguaa

SEQ ID NO: 3669646 - RNA, 12 nt, Salmonella enterica enterica serovar Typhi
uggcuguuuccc

SEQ ID NO: 3669647 - RNA, 14 nt, Salmonella enterica enterica serovar Typhi
uggcuuaacucacc

SEQ ID NO: 3669648 - RNA, 18 nt, Salmonella enterica enterica serovar Typhi
uggcuuaaucauugcuca

SEQ ID NO: 3669649 - RNA, 17 nt, Salmonella enterica enterica serovar Typhi
uggcuuaccguaugcaa

SEQ ID NO: 3669650 - RNA, 23 nt, Salmonella enterica enterica serovar Typhi
uggcuuaccguaugcaaaaggca

SEQ ID NO: 3669651 - RNA, 16 nt, Salmonella enterica enterica serovar Typhi
uggcuuaccugcucug

SEQ ID NO: 3669652 - RNA, 16 nt, Salmonella enterica enterica serovar Typhi
uggcuuccguccccag

SEQ ID NO: 3669653 - RNA, 18 nt, Salmonella enterica enterica serovar Typhi
uggcuucuucaacauugu

SEQ ID NO: 3669654 - RNA, 15 nt, Salmonella enterica enterica serovar Typhi
uggcuugaucaacgc

SEQ ID NO: 3669655 - RNA, 16 nt, Salmonella enterica enterica serovar Typhi
uggcuuuacgaccgca

SEQ ID NO: 3669656 - RNA, 13 nt, Salmonella enterica enterica serovar Typhi
uggcuuucaccgu

SEQ ID NO: 3669657 - RNA, 21 nt, Salmonella enterica enterica serovar Typhi
uggcuuuccugaucaaucaac

SEQ ID NO: 3669658 - RNA, 16 nt, Salmonella enterica enterica serovar Typhi
uggcuuucuacuacaa

SEQ ID NO: 3669659 - RNA, 18 nt, Salmonella enterica enterica serovar Typhi
uggcuuuguuaaacguaa

SEQ ID NO: 3669660 - RNA, 17 nt, Salmonella enterica enterica serovar Typhi
uggcuuuuuccugccau

SEQ ID NO: 3669661 - RNA, 21 nt, Salmonella enterica enterica serovar Typhi
ugggaaaauuaaucccaaccc

SEQ ID NO: 3669662 - RNA, 19 nt, Salmonella enterica enterica serovar Typhi
ugggaaauaacguuacauu

SEQ ID NO: 3669663 - RNA, 16 nt, Salmonella enterica enterica serovar Typhi
ugggaauuagcgaauc

SEQ ID NO: 3669664 - RNA, 22 nt, Salmonella enterica enterica serovar Typhi
ugggauaggcucuuauucaauc

SEQ ID NO: 3669665 - RNA, 18 nt, Salmonella enterica enterica serovar Typhi
ugggauauuacagaucuu

SEQ ID NO: 3669666 - RNA, 20 nt, Salmonella enterica enterica serovar Typhi
ugggaucgacucauccagca

SEQ ID NO: 3669667 - RNA, 16 nt, Salmonella enterica enterica serovar Typhi
ugggcacucgaagaua

SEQ ID NO: 3669668 - RNA, 12 nt, Salmonella enterica enterica serovar Typhi
ugggcagaaacg

SEQ ID NO: 3669669 - RNA, 17 nt, Salmonella enterica enterica serovar Typhi
ugggcaggaacagauac

SEQ ID NO: 3669670 - RNA, 22 nt, Salmonella enterica enterica serovar Typhi
ugggcaggagaugaccugccca

SEQ ID NO: 3669671 - RNA, 19 nt, Salmonella enterica enterica serovar Typhi
ugggcagugcucgccaaaa

SEQ ID NO: 3669672 - RNA, 20 nt, Salmonella enterica enterica serovar Typhi
ugggcagugcucgccaaaac

SEQ ID NO: 3669673 - RNA, 17 nt, Salmonella enterica enterica serovar Typhi
ugggccagcagcgcauc

SEQ ID NO: 3669674 - RNA, 14 nt, Salmonella enterica enterica serovar Typhi
ugggcgcaacaguc

SEQ ID NO: 3669675 - RNA, 14 nt, Salmonella enterica enterica serovar Typhi
ugggcggcaccagc

SEQ ID NO: 3669676 - RNA, 15 nt, Salmonella enterica enterica serovar Typhi
ugggcguaagaaaag

SEQ ID NO: 3669677 - RNA, 16 nt, Salmonella enterica enterica serovar Typhi
ugggcguaagaaaagu

SEQ ID NO: 3669678 - RNA, 23 nt, Salmonella enterica enterica serovar Typhi
ugggcgucaucgggcuguuauuc

SEQ ID NO: 3669679 - RNA, 22 nt, Salmonella enterica enterica serovar Typhi
ugggcgucuuaaugcucuccag

SEQ ID NO: 3669680 - RNA, 16 nt, Salmonella enterica enterica serovar Typhi
ugggcuaugaagagaa

SEQ ID NO: 3669681 - RNA, 17 nt, Salmonella enterica enterica serovar Typhi
ugggcucaucaaacagc

SEQ ID NO: 3669682 - RNA, 14 nt, Salmonella enterica enterica serovar Typhi
ugggcuuaaugcgc

SEQ ID NO: 3669683 - RNA, 21 nt, Salmonella enterica enterica serovar Typhi
ugggcuuuuaaccaugcaauc

SEQ ID NO: 3669684 - RNA, 18 nt, Salmonella enterica enterica serovar Typhi
uggggaaaauaccgguaa

SEQ ID NO: 3669685 - RNA, 13 nt, Salmonella enterica enterica serovar Typhi
uggggaaccuggc

SEQ ID NO: 3669686 - RNA, 17 nt, Salmonella enterica enterica serovar Typhi
uggggaaccuggcagaa

SEQ ID NO: 3669687 - RNA, 18 nt, Salmonella enterica enterica serovar Typhi
uggggaucgggcagacuu

SEQ ID NO: 3669688 - RNA, 16 nt, Salmonella enterica enterica serovar Typhi
uggggauuaagcgagc

SEQ ID NO: 3669689 - RNA, 22 nt, Salmonella enterica enterica serovar Typhi
uggguaacgcucuuaccgcuaa

SEQ ID NO: 3669690 - RNA, 15 nt, Salmonella enterica enterica serovar Typhi
uggguagaguaaccc

SEQ ID NO: 3669691 - RNA, 15 nt, Salmonella enterica enterica serovar Typhi
uggguaggccggaua

SEQ ID NO: 3669692 - RNA, 18 nt, Salmonella enterica enterica serovar Typhi
uggguauccacgccuggc

SEQ ID NO: 3669693 - RNA, 14 nt, Salmonella enterica enterica serovar Typhi
uggguaucuucauc

SEQ ID NO: 3669694 - RNA, 13 nt, Salmonella enterica enterica serovar Typhi
uggguuccaggcg

SEQ ID NO: 3669695 - RNA, 23 nt, Salmonella enterica enterica serovar Typhi
uggguuggucacaaaggccagca

SEQ ID NO: 3669696 - RNA, 19 nt, Salmonella enterica enterica serovar Typhi
uggguuuauguaggguggc

SEQ ID NO: 3669697 - RNA, 15 nt, Salmonella enterica enterica serovar Typhi
uggguuuauuuggua

SEQ ID NO: 3669698 - RNA, 22 nt, Salmonella enterica enterica serovar Typhi
uggguuugugucguaguggcau

SEQ ID NO: 3669699 - RNA, 15 nt, Salmonella enterica enterica serovar Typhi
ugguaaaacgcuggc

SEQ ID NO: 3669700 - RNA, 13 nt, Salmonella enterica enterica serovar Typhi
ugguaaaauccuu

SEQ ID NO: 3669701 - RNA, 23 nt, Salmonella enterica enterica serovar Typhi
ugguaaaauuauugugagaaaag

SEQ ID NO: 3669702 - RNA, 22 nt, Salmonella enterica enterica serovar Typhi
ugguaaccuguuccucacugag

SEQ ID NO: 3669703 - RNA, 19 nt, Salmonella enterica enterica serovar Typhi
ugguaacgccgugacggcg

SEQ ID NO: 3669704 - RNA, 15 nt, Salmonella enterica enterica serovar Typhi
ugguaacugcggcua

SEQ ID NO: 3669705 - RNA, 14 nt, Salmonella enterica enterica serovar Typhi
ugguaaggcaaaua

SEQ ID NO: 3669706 - RNA, 21 nt, Salmonella enterica enterica serovar Typhi
ugguaaggcaaauaugcuguc

SEQ ID NO: 3669707 - RNA, 18 nt, Salmonella enterica enterica serovar Typhi
ugguaauggcgaagcccg

SEQ ID NO: 3669708 - RNA, 18 nt, Salmonella enterica enterica serovar Typhi
ugguaauuaaaggcagcg

SEQ ID NO: 3669709 - RNA, 22 nt, Salmonella enterica enterica serovar Typhi
ugguaccggauuuagcggcagc

SEQ ID NO: 3669710 - RNA, 21 nt, Salmonella enterica enterica serovar Typhi
ugguacgauuucauuacgccu

SEQ ID NO: 3669711 - RNA, 14 nt, Salmonella enterica enterica serovar Typhi
ugguacucaacauc

SEQ ID NO: 3669712 - RNA, 19 nt, Salmonella enterica enterica serovar Typhi
ugguagacaaacagcgcgc

SEQ ID NO: 3669713 - RNA, 15 nt, Salmonella enterica enterica serovar Typhi
ugguagacaggcugg

SEQ ID NO: 3669714 - RNA, 22 nt, Salmonella enterica enterica serovar Typhi
ugguagagaucgacaaaccacu

SEQ ID NO: 3669715 - RNA, 18 nt, Salmonella enterica enterica serovar Typhi
ugguagagcaucgcggca

SEQ ID NO: 3669716 - RNA, 15 nt, Salmonella enterica enterica serovar Typhi
ugguagcccucgcaa

SEQ ID NO: 3669717 - RNA, 19 nt, Salmonella enterica enterica serovar Typhi
ugguaggccugauaagcga

SEQ ID NO: 3669718 - RNA, 21 nt, Salmonella enterica enterica serovar Typhi
ugguagucguuauaauccuga

SEQ ID NO: 3669719 - RNA, 17 nt, Salmonella enterica enterica serovar Typhi
ugguauaggccaggcua

SEQ ID NO: 3669720 - RNA, 22 nt, Salmonella enterica enterica serovar Typhi
ugguaucaaaaagcgcagaccc

SEQ ID NO: 3669721 - RNA, 18 nt, Salmonella enterica enterica serovar Typhi
ugguauuucagaccgugc

SEQ ID NO: 3669722 - RNA, 15 nt, Salmonella enterica enterica serovar Typhi
uggucacaaaggcca

SEQ ID NO: 3669723 - RNA, 18 nt, Salmonella enterica enterica serovar Typhi
uggucacaaaggccagca

SEQ ID NO: 3669724 - RNA, 20 nt, Salmonella enterica enterica serovar Typhi
uggucacaaaggccagcagc

SEQ ID NO: 3669725 - RNA, 22 nt, Salmonella enterica enterica serovar Typhi
uggucagacgcucagccuuaua

SEQ ID NO: 3669726 - RNA, 14 nt, Salmonella enterica enterica serovar Typhi
uggucagcauaaua

SEQ ID NO: 3669727 - RNA, 20 nt, Salmonella enterica enterica serovar Typhi
uggucagcucacgcgccagc

SEQ ID NO: 3669728 - RNA, 22 nt, Salmonella enterica enterica serovar Typhi
uggucagcucacgcgccagcac

SEQ ID NO: 3669729 - RNA, 14 nt, Salmonella enterica enterica serovar Typhi
uggucaucgaaggc

SEQ ID NO: 3669730 - RNA, 14 nt, Salmonella enterica enterica serovar Typhi
uggucgaaaauauc

SEQ ID NO: 3669731 - RNA, 13 nt, Salmonella enterica enterica serovar Typhi
uggucgcggcuca

SEQ ID NO: 3669732 - RNA, 19 nt, Salmonella enterica enterica serovar Typhi
uggucggacgggcccuggc

SEQ ID NO: 3669733 - RNA, 21 nt, Salmonella enterica enterica serovar Typhi
uggucggcaaucaccugcauc

SEQ ID NO: 3669734 - RNA, 13 nt, Salmonella enterica enterica serovar Typhi
uggucggcgacca

SEQ ID NO: 3669735 - RNA, 14 nt, Salmonella enterica enterica serovar Typhi
uggucgguauuauc

SEQ ID NO: 3669736 - RNA, 15 nt, Salmonella enterica enterica serovar Typhi
uggucgguguucaua

SEQ ID NO: 3669737 - RNA, 21 nt, Salmonella enterica enterica serovar Typhi
uggucguuagccagauggcug

SEQ ID NO: 3669738 - RNA, 18 nt, Salmonella enterica enterica serovar Typhi
uggucuccgccuggaacc

SEQ ID NO: 3669739 - RNA, 16 nt, Salmonella enterica enterica serovar Typhi
uggucugacccgcgaa

SEQ ID NO: 3669740 - RNA, 21 nt, Salmonella enterica enterica serovar Typhi
uggucuguagauagcuaucca

SEQ ID NO: 3669741 - RNA, 23 nt, Salmonella enterica enterica serovar Typhi
uggucuuaaugcugcgguugagc

SEQ ID NO: 3669742 - RNA, 18 nt, Salmonella enterica enterica serovar Typhi
uggugaaaaaucauuauc

SEQ ID NO: 3669743 - RNA, 24 nt, Salmonella enterica enterica serovar Typhi
uggugaaaaucgugguuagacauc

SEQ ID NO: 3669744 - RNA, 22 nt, Salmonella enterica enterica serovar Typhi
uggugaaacguucggugaagaa

SEQ ID NO: 3669745 - RNA, 20 nt, Salmonella enterica enterica serovar Typhi
uggugacguuuuuuggcaga

SEQ ID NO: 3669746 - RNA, 18 nt, Salmonella enterica enterica serovar Typhi
uggugagcuccagcccgc

SEQ ID NO: 3669747 - RNA, 19 nt, Salmonella enterica enterica serovar Typhi
uggugagguugagauccug

SEQ ID NO: 3669748 - RNA, 20 nt, Salmonella enterica enterica serovar Typhi
uggugauagcgcgccagcac

SEQ ID NO: 3669749 - RNA, 17 nt, Salmonella enterica enterica serovar Typhi
uggugauccagcguagc

SEQ ID NO: 3669750 - RNA, 23 nt, Salmonella enterica enterica serovar Typhi
uggugaucuggccaauuuuucac

SEQ ID NO: 3669751 - RNA, 21 nt, Salmonella enterica enterica serovar Typhi
uggugaugaacaugcccggau

SEQ ID NO: 3669752 - RNA, 15 nt, Salmonella enterica enterica serovar Typhi
uggugcagccgccau

SEQ ID NO: 3669753 - RNA, 12 nt, Salmonella enterica enterica serovar Typhi
uggugcaucugg

SEQ ID NO: 3669754 - RNA, 17 nt, Salmonella enterica enterica serovar Typhi
uggugccguuacuguuu

SEQ ID NO: 3669755 - RNA, 23 nt, Salmonella enterica enterica serovar Typhi
uggugcggcgcacugccugaugg

SEQ ID NO: 3669756 - RNA, 15 nt, Salmonella enterica enterica serovar Typhi
uggugcguccgguag

SEQ ID NO: 3669757 - RNA, 22 nt, Salmonella enterica enterica serovar Typhi
uggugcucaggaucaauucuga

SEQ ID NO: 3669758 - RNA, 21 nt, Salmonella enterica enterica serovar Typhi
uggugcugugccugccugugg

SEQ ID NO: 3669759 - RNA, 23 nt, Salmonella enterica enterica serovar Typhi
ugguggauauccagcauaauaug

SEQ ID NO: 3669760 - RNA, 19 nt, Salmonella enterica enterica serovar Typhi
ugguggcuauagcucaguu

SEQ ID NO: 3669761 - RNA, 21 nt, Salmonella enterica enterica serovar Typhi
uggugggacuguucagcugac

SEQ ID NO: 3669762 - RNA, 19 nt, Salmonella enterica enterica serovar Typhi
ugguggggccuaaugagcc

SEQ ID NO: 3669763 - RNA, 22 nt, Salmonella enterica enterica serovar Typhi
ugguggucggcaaucaccugca

SEQ ID NO: 3669764 - RNA, 14 nt, Salmonella enterica enterica serovar Typhi
ugguggucuauggu

SEQ ID NO: 3669765 - RNA, 22 nt, Salmonella enterica enterica serovar Typhi
ugguggugccguuacuguuuua

SEQ ID NO: 3669766 - RNA, 18 nt, Salmonella enterica enterica serovar Typhi
ugguguaauugcgccagg

SEQ ID NO: 3669767 - RNA, 19 nt, Salmonella enterica enterica serovar Typhi
uggugucaaucgccugcug

SEQ ID NO: 3669768 - RNA, 18 nt, Salmonella enterica enterica serovar Typhi
uggugucucgucgccagg

SEQ ID NO: 3669769 - RNA, 15 nt, Salmonella enterica enterica serovar Typhi
uggugugaacaucac

SEQ ID NO: 3669770 - RNA, 15 nt, Salmonella enterica enterica serovar Typhi
uggugugcauggugu

SEQ ID NO: 3669771 - RNA, 19 nt, Salmonella enterica enterica serovar Typhi
ugguuaaacacauccggcg

SEQ ID NO: 3669772 - RNA, 22 nt, Salmonella enterica enterica serovar Typhi
ugguuaaauucauauuuaaaua

SEQ ID NO: 3669773 - RNA, 16 nt, Salmonella enterica enterica serovar Typhi
ugguuaaccaccagcg

SEQ ID NO: 3669774 - RNA, 18 nt, Salmonella enterica enterica serovar Typhi
ugguuaaccaccucauua

SEQ ID NO: 3669775 - RNA, 21 nt, Salmonella enterica enterica serovar Typhi
ugguuaacgccguuaccagca

SEQ ID NO: 3669776 - RNA, 15 nt, Salmonella enterica enterica serovar Typhi
ugguuaaugaccugc

SEQ ID NO: 3669777 - RNA, 14 nt, Salmonella enterica enterica serovar Typhi
ugguuaauucaaaa

SEQ ID NO: 3669778 - RNA, 15 nt, Salmonella enterica enterica serovar Typhi
ugguuaauuccgcau

SEQ ID NO: 3669779 - RNA, 18 nt, Salmonella enterica enterica serovar Typhi
ugguuagaauaccugccu

SEQ ID NO: 3669780 - RNA, 16 nt, Salmonella enterica enterica serovar Typhi
ugguuagccauuucgc

SEQ ID NO: 3669781 - RNA, 14 nt, Salmonella enterica enterica serovar Typhi
ugguuauccagcaa

SEQ ID NO: 3669782 - RNA, 15 nt, Salmonella enterica enterica serovar Typhi
ugguuauccagcaac

SEQ ID NO: 3669783 - RNA, 18 nt, Salmonella enterica enterica serovar Typhi
ugguucaacaucagcgcu

SEQ ID NO: 3669784 - RNA, 23 nt, Salmonella enterica enterica serovar Typhi
ugguuccaggcgcgcaccguugc

SEQ ID NO: 3669785 - RNA, 16 nt, Salmonella enterica enterica serovar Typhi
ugguucgcauaauauc

SEQ ID NO: 3669786 - RNA, 18 nt, Salmonella enterica enterica serovar Typhi
ugguugaaccgacggugc

SEQ ID NO: 3669787 - RNA, 16 nt, Salmonella enterica enterica serovar Typhi
ugguugagauccauaa

SEQ ID NO: 3669788 - RNA, 21 nt, Salmonella enterica enterica serovar Typhi
ugguugccgcaaaugaccaga

SEQ ID NO: 3669789 - RNA, 17 nt, Salmonella enterica enterica serovar Typhi
ugguugucagaucgccc

SEQ ID NO: 3669790 - RNA, 18 nt, Salmonella enterica enterica serovar Typhi
ugguuuaaacucugcaaa

SEQ ID NO: 3669791 - RNA, 21 nt, Salmonella enterica enterica serovar Typhi
ugguuuaucgccgauugaggg

SEQ ID NO: 3669792 - RNA, 22 nt, Salmonella enterica enterica serovar Typhi
ugguuuaucgccgauugagggg

SEQ ID NO: 3669793 - RNA, 20 nt, Salmonella enterica enterica serovar Typhi
ugguuucaugcaucauugaa

SEQ ID NO: 3669794 - RNA, 16 nt, Salmonella enterica enterica serovar Typhi
ugguuucccugccuca

SEQ ID NO: 3669795 - RNA, 14 nt, Salmonella enterica enterica serovar Typhi
ugguuucgcgguga

SEQ ID NO: 3669796 - RNA, 16 nt, Salmonella enterica enterica serovar Typhi
ugguuucgcggugaaa

SEQ ID NO: 3669797 - RNA, 19 nt, Salmonella enterica enterica serovar Typhi
ugguuucggcaugccacug

SEQ ID NO: 3669798 - RNA, 12 nt, Salmonella enterica enterica serovar Typhi
ugguuucuuuua

SEQ ID NO: 3669799 - RNA, 13 nt, Salmonella enterica enterica serovar Typhi
ugguuugacgcug

SEQ ID NO: 3669800 - RNA, 20 nt, Salmonella enterica enterica serovar Typhi
ugguuuuaucuguaauuaua

SEQ ID NO: 3669801 - RNA, 11 nt, Salmonella enterica enterica serovar Typhi
uguaaaaaaau

SEQ ID NO: 3669802 - RNA, 21 nt, Salmonella enterica enterica serovar Typhi
uguaaaaaaauaaaaaaggca

SEQ ID NO: 3669803 - RNA, 16 nt, Salmonella enterica enterica serovar Typhi
uguaaaaaauccagcg

SEQ ID NO: 3669804 - RNA, 17 nt, Salmonella enterica enterica serovar Typhi
uguaaaaaauccagcgu

SEQ ID NO: 3669805 - RNA, 13 nt, Salmonella enterica enterica serovar Typhi
uguaaaaaugccu

SEQ ID NO: 3669806 - RNA, 12 nt, Salmonella enterica enterica serovar Typhi
uguaaaaaugcu

SEQ ID NO: 3669807 - RNA, 12 nt, Salmonella enterica enterica serovar Typhi
uguaaaagccag

SEQ ID NO: 3669808 - RNA, 22 nt, Salmonella enterica enterica serovar Typhi
uguaaaagggauacgguuuuuu

SEQ ID NO: 3669809 - RNA, 21 nt, Salmonella enterica enterica serovar Typhi
uguaaaccaggcauuuuauua

SEQ ID NO: 3669810 - RNA, 16 nt, Salmonella enterica enterica serovar Typhi
uguaaaccguuuuucc

SEQ ID NO: 3669811 - RNA, 16 nt, Salmonella enterica enterica serovar Typhi
uguaaacguuccugcc

SEQ ID NO: 3669812 - RNA, 23 nt, Salmonella enterica enterica serovar Typhi
uguaaagaaugaaaaaaaaauua

SEQ ID NO: 3669813 - RNA, 18 nt, Salmonella enterica enterica serovar Typhi
uguaaaggugagcucuuu

SEQ ID NO: 3669814 - RNA, 22 nt, Salmonella enterica enterica serovar Typhi
uguaaagucggccauuuuuuua

SEQ ID NO: 3669815 - RNA, 20 nt, Salmonella enterica enterica serovar Typhi
uguaacaaugccucgauggc

SEQ ID NO: 3669816 - RNA, 20 nt, Salmonella enterica enterica serovar Typhi
uguaacagcaggacccgaga

SEQ ID NO: 3669817 - RNA, 15 nt, Salmonella enterica enterica serovar Typhi
uguaacccgccgcca

SEQ ID NO: 3669818 - RNA, 16 nt, Salmonella enterica enterica serovar Typhi
uguaaccuuaaaaggc

SEQ ID NO: 3669819 - RNA, 15 nt, Salmonella enterica enterica serovar Typhi
uguaacucauagacg

SEQ ID NO: 3669820 - RNA, 23 nt, Salmonella enterica enterica serovar Typhi
uguaagaggcauaaaaaaaagcc

SEQ ID NO: 3669821 - RNA, 18 nt, Salmonella enterica enterica serovar Typhi
uguaagagguauccugaa

SEQ ID NO: 3669822 - RNA, 20 nt, Salmonella enterica enterica serovar Typhi
uguaagcaauuaauauuuaa

SEQ ID NO: 3669823 - RNA, 21 nt, Salmonella enterica enterica serovar Typhi
uguaagggaggugcucuccca

SEQ ID NO: 3669824 - RNA, 22 nt, Salmonella enterica enterica serovar Typhi
uguaagggaggugcucucccag

SEQ ID NO: 3669825 - RNA, 19 nt, Salmonella enterica enterica serovar Typhi
uguaaugaaagaaaucacc

SEQ ID NO: 3669826 - RNA, 15 nt, Salmonella enterica enterica serovar Typhi
uguaauggugggaca

SEQ ID NO: 3669827 - RNA, 20 nt, Salmonella enterica enterica serovar Typhi
uguaauguuuucugccagca

SEQ ID NO: 3669828 - RNA, 22 nt, Salmonella enterica enterica serovar Typhi
uguaauuaaggauugccgccuu

SEQ ID NO: 3669829 - RNA, 15 nt, Salmonella enterica enterica serovar Typhi
uguaauuauaaauau

SEQ ID NO: 3669830 - RNA, 22 nt, Salmonella enterica enterica serovar Typhi
uguaauucucacagaaucauca

SEQ ID NO: 3669831 - RNA, 21 nt, Salmonella enterica enterica serovar Typhi
uguaauucucccaaauuuuuu

SEQ ID NO: 3669832 - RNA, 14 nt, Salmonella enterica enterica serovar Typhi
uguaauugacaugg

SEQ ID NO: 3669833 - RNA, 17 nt, Salmonella enterica enterica serovar Typhi
uguaauugcgccaggcc

SEQ ID NO: 3669834 - RNA, 14 nt, Salmonella enterica enterica serovar Typhi
uguaauuuauaaag

SEQ ID NO: 3669835 - RNA, 17 nt, Salmonella enterica enterica serovar Typhi
uguaauuuauaaaguaa

SEQ ID NO: 3669836 - RNA, 17 nt, Salmonella enterica enterica serovar Typhi
uguaauuucauaauauu

SEQ ID NO: 3669837 - RNA, 15 nt, Salmonella enterica enterica serovar Typhi
uguacaagaagggua

SEQ ID NO: 3669838 - RNA, 19 nt, Salmonella enterica enterica serovar Typhi
uguacagcaauaaaaggaa

SEQ ID NO: 3669839 - RNA, 17 nt, Salmonella enterica enterica serovar Typhi
uguaccagcagcgccag

SEQ ID NO: 3669840 - RNA, 11 nt, Salmonella enterica enterica serovar Typhi
uguaccaggcc

SEQ ID NO: 3669841 - RNA, 17 nt, Salmonella enterica enterica serovar Typhi
uguaccauugucaaaaa

SEQ ID NO: 3669842 - RNA, 20 nt, Salmonella enterica enterica serovar Typhi
uguaccggcaggugauggcg

SEQ ID NO: 3669843 - RNA, 16 nt, Salmonella enterica enterica serovar Typhi
uguacgaccgucaaac

SEQ ID NO: 3669844 - RNA, 18 nt, Salmonella enterica enterica serovar Typhi
uguacggacauugaccgc

SEQ ID NO: 3669845 - RNA, 15 nt, Salmonella enterica enterica serovar Typhi
uguacgugaagggaa

SEQ ID NO: 3669846 - RNA, 15 nt, Salmonella enterica enterica serovar Typhi
uguacuuuugcuucc

SEQ ID NO: 3669847 - RNA, 16 nt, Salmonella enterica enterica serovar Typhi
uguacuuuugcuucca

SEQ ID NO: 3669848 - RNA, 13 nt, Salmonella enterica enterica serovar Typhi
uguagcaaauuuc

SEQ ID NO: 3669849 - RNA, 13 nt, Salmonella enterica enterica serovar Typhi
uguagcgcuuugg

SEQ ID NO: 3669850 - RNA, 21 nt, Salmonella enterica enterica serovar Typhi
uguaggcccgguaagcgcuag

SEQ ID NO: 3669851 - RNA, 13 nt, Salmonella enterica enterica serovar Typhi
uguaggccggaua

SEQ ID NO: 3669852 - RNA, 20 nt, Salmonella enterica enterica serovar Typhi
uguaggccggguaagcguaa

SEQ ID NO: 3669853 - RNA, 20 nt, Salmonella enterica enterica serovar Typhi
uguaggccugauaagcgaag

SEQ ID NO: 3669854 - RNA, 20 nt, Salmonella enterica enterica serovar Typhi
uguaggccugauaagcgcag

SEQ ID NO: 3669855 - RNA, 17 nt, Salmonella enterica enterica serovar Typhi
uguaggguacagcgcga

SEQ ID NO: 3669856 - RNA, 12 nt, Salmonella enterica enterica serovar Typhi
uguagugguugu

SEQ ID NO: 3669857 - RNA, 19 nt, Salmonella enterica enterica serovar Typhi
uguaguuagagauauacca

SEQ ID NO: 3669858 - RNA, 12 nt, Salmonella enterica enterica serovar Typhi
uguaguuaucgc

SEQ ID NO: 3669859 - RNA, 14 nt, Salmonella enterica enterica serovar Typhi
uguauaaaauauuu

SEQ ID NO: 3669860 - RNA, 20 nt, Salmonella enterica enterica serovar Typhi
uguauagcaacuuaauaaua

SEQ ID NO: 3669861 - RNA, 19 nt, Salmonella enterica enterica serovar Typhi
uguaucacgacuuauugca

SEQ ID NO: 3669862 - RNA, 13 nt, Salmonella enterica enterica serovar Typhi
uguauccacccgg

SEQ ID NO: 3669863 - RNA, 20 nt, Salmonella enterica enterica serovar Typhi
uguaucgcgcggauuccgcc

SEQ ID NO: 3669864 - RNA, 23 nt, Salmonella enterica enterica serovar Typhi
uguaucugcugacacccucugcg

SEQ ID NO: 3669865 - RNA, 23 nt, Salmonella enterica enterica serovar Typhi
uguaucugguggaaaagaaaaca

SEQ ID NO: 3669866 - RNA, 21 nt, Salmonella enterica enterica serovar Typhi
uguaucuucgccguauucuua

SEQ ID NO: 3669867 - RNA, 13 nt, Salmonella enterica enterica serovar Typhi
uguaucuugcuuu

SEQ ID NO: 3669868 - RNA, 13 nt, Salmonella enterica enterica serovar Typhi
uguauuaaaggau

SEQ ID NO: 3669869 - RNA, 20 nt, Salmonella enterica enterica serovar Typhi
uguauuaucgaugcgccagu

SEQ ID NO: 3669870 - RNA, 18 nt, Salmonella enterica enterica serovar Typhi
uguauuugaauuuuagau

SEQ ID NO: 3669871 - RNA, 21 nt, Salmonella enterica enterica serovar Typhi
uguauuugaauuuuagauccc

SEQ ID NO: 3669872 - RNA, 22 nt, Salmonella enterica enterica serovar Typhi
ugucaaaaaaaggccagucgac

SEQ ID NO: 3669873 - RNA, 19 nt, Salmonella enterica enterica serovar Typhi
ugucaacaacuucaaaaua

SEQ ID NO: 3669874 - RNA, 16 nt, Salmonella enterica enterica serovar Typhi
ugucaaucgccugcug

SEQ ID NO: 3669875 - RNA, 13 nt, Salmonella enterica enterica serovar Typhi
ugucacaccggcg

SEQ ID NO: 3669876 - RNA, 11 nt, Salmonella enterica enterica serovar Typhi
ugucaccagca

SEQ ID NO: 3669877 - RNA, 18 nt, Salmonella enterica enterica serovar Typhi
ugucaccaucaucgauau

SEQ ID NO: 3669878 - RNA, 22 nt, Salmonella enterica enterica serovar Typhi
ugucacgccguguucgucgcca

SEQ ID NO: 3669879 - RNA, 19 nt, Salmonella enterica enterica serovar Typhi
ugucagaucgcccggauca

SEQ ID NO: 3669880 - RNA, 21 nt, Salmonella enterica enterica serovar Typhi
ugucagaucguaugcgccugu

SEQ ID NO: 3669881 - RNA, 16 nt, Salmonella enterica enterica serovar Typhi
ugucauauuugugagc

SEQ ID NO: 3669882 - RNA, 14 nt, Salmonella enterica enterica serovar Typhi
ugucaucagaucau

SEQ ID NO: 3669883 - RNA, 21 nt, Salmonella enterica enterica serovar Typhi
ugucauccugcgcacagcaua

SEQ ID NO: 3669884 - RNA, 12 nt, Salmonella enterica enterica serovar Typhi
ugucauccugcu

SEQ ID NO: 3669885 - RNA, 17 nt, Salmonella enterica enterica serovar Typhi
ugucaucgccauccugc

SEQ ID NO: 3669886 - RNA, 15 nt, Salmonella enterica enterica serovar Typhi
ugucaucgccgcuaa

SEQ ID NO: 3669887 - RNA, 20 nt, Salmonella enterica enterica serovar Typhi
ugucaugcuaaaacagauaa

SEQ ID NO: 3669888 - RNA, 21 nt, Salmonella enterica enterica serovar Typhi
ugucauggcgccaccagcgau

SEQ ID NO: 3669889 - RNA, 17 nt, Salmonella enterica enterica serovar Typhi
uguccaccgauuucauc

SEQ ID NO: 3669890 - RNA, 12 nt, Salmonella enterica enterica serovar Typhi
uguccagcagug

SEQ ID NO: 3669891 - RNA, 16 nt, Salmonella enterica enterica serovar Typhi
uguccagcagugucug

SEQ ID NO: 3669892 - RNA, 14 nt, Salmonella enterica enterica serovar Typhi
uguccagcggccau

SEQ ID NO: 3669893 - RNA, 20 nt, Salmonella enterica enterica serovar Typhi
uguccaguuuuugcauuaua

SEQ ID NO: 3669894 - RNA, 17 nt, Salmonella enterica enterica serovar Typhi
uguccaguuuuuuacuu

SEQ ID NO: 3669895 - RNA, 13 nt, Salmonella enterica enterica serovar Typhi
uguccauaaaaug

SEQ ID NO: 3669896 - RNA, 20 nt, Salmonella enterica enterica serovar Typhi
uguccaugacgaccacagcc

SEQ ID NO: 3669897 - RNA, 23 nt, Salmonella enterica enterica serovar Typhi
uguccauguuuuauacucaaaaa

SEQ ID NO: 3669898 - RNA, 20 nt, Salmonella enterica enterica serovar Typhi
ugucccagugucaacugcgc

SEQ ID NO: 3669899 - RNA, 17 nt, Salmonella enterica enterica serovar Typhi
ugucccugccagcguaa

SEQ ID NO: 3669900 - RNA, 13 nt, Salmonella enterica enterica serovar Typhi
uguccgacgacaa

SEQ ID NO: 3669901 - RNA, 15 nt, Salmonella enterica enterica serovar Typhi
uguccgaugcagaca

SEQ ID NO: 3669902 - RNA, 22 nt, Salmonella enterica enterica serovar Typhi
uguccgcauucuugccgcaucu

SEQ ID NO: 3669903 - RNA, 20 nt, Salmonella enterica enterica serovar Typhi
uguccgcccaguaccagcac

SEQ ID NO: 3669904 - RNA, 13 nt, Salmonella enterica enterica serovar Typhi
uguccgcugcugu

SEQ ID NO: 3669905 - RNA, 15 nt, Salmonella enterica enterica serovar Typhi
uguccggaauaacuc

SEQ ID NO: 3669906 - RNA, 23 nt, Salmonella enterica enterica serovar Typhi
uguccggcgcaaucuuugccgca

SEQ ID NO: 3669907 - RNA, 19 nt, Salmonella enterica enterica serovar Typhi
uguccggcgcguucaugcg

SEQ ID NO: 3669908 - RNA, 16 nt, Salmonella enterica enterica serovar Typhi
uguccgguguccauca

SEQ ID NO: 3669909 - RNA, 18 nt, Salmonella enterica enterica serovar Typhi
uguccgucauuuacugcg

SEQ ID NO: 3669910 - RNA, 18 nt, Salmonella enterica enterica serovar Typhi
uguccgucuuuucugucg

SEQ ID NO: 3669911 - RNA, 15 nt, Salmonella enterica enterica serovar Typhi
uguccguuccugccg

SEQ ID NO: 3669912 - RNA, 16 nt, Salmonella enterica enterica serovar Typhi
uguccuauugcaacgc

SEQ ID NO: 3669913 - RNA, 15 nt, Salmonella enterica enterica serovar Typhi
uguccugaaggacaa

SEQ ID NO: 3669914 - RNA, 15 nt, Salmonella enterica enterica serovar Typhi
uguccugcagcgcca

SEQ ID NO: 3669915 - RNA, 15 nt, Salmonella enterica enterica serovar Typhi
uguccuuuacugcgc

SEQ ID NO: 3669916 - RNA, 23 nt, Salmonella enterica enterica serovar Typhi
uguccuuuacugcgccagccugc

SEQ ID NO: 3669917 - RNA, 21 nt, Salmonella enterica enterica serovar Typhi
uguccuuuaucugcccuuucu

SEQ ID NO: 3669918 - RNA, 15 nt, Salmonella enterica enterica serovar Typhi
uguccuuucugcugc

SEQ ID NO: 3669919 - RNA, 18 nt, Salmonella enterica enterica serovar Typhi
uguccuuucugcugccgc

SEQ ID NO: 3669920 - RNA, 22 nt, Salmonella enterica enterica serovar Typhi
uguccuuugcuacaccccuucu

SEQ ID NO: 3669921 - RNA, 16 nt, Salmonella enterica enterica serovar Typhi
ugucgaaaccagcaua

SEQ ID NO: 3669922 - RNA, 19 nt, Salmonella enterica enterica serovar Typhi
ugucgaaauugccgcccgu

SEQ ID NO: 3669923 - RNA, 17 nt, Salmonella enterica enterica serovar Typhi
ugucgacaauaaauugc

SEQ ID NO: 3669924 - RNA, 17 nt, Salmonella enterica enterica serovar Typhi
ugucgaccgcuccacuc

SEQ ID NO: 3669925 - RNA, 15 nt, Salmonella enterica enterica serovar Typhi
ugucgauaacagcau

SEQ ID NO: 3669926 - RNA, 21 nt, Salmonella enterica enterica serovar Typhi
ugucgaucaucagacccgcau

SEQ ID NO: 3669927 - RNA, 20 nt, Salmonella enterica enterica serovar Typhi
ugucgauuuccgguuccagc

SEQ ID NO: 3669928 - RNA, 16 nt, Salmonella enterica enterica serovar Typhi
ugucgcaaaccaccgg

SEQ ID NO: 3669929 - RNA, 23 nt, Salmonella enterica enterica serovar Typhi
ugucgcaaccgacacauucaggc

SEQ ID NO: 3669930 - RNA, 17 nt, Salmonella enterica enterica serovar Typhi
ugucgccggggcgcugg

SEQ ID NO: 3669931 - RNA, 14 nt, Salmonella enterica enterica serovar Typhi
ugucgccguggaac

SEQ ID NO: 3669932 - RNA, 22 nt, Salmonella enterica enterica serovar Typhi
ugucgcgaaagcacucggcgcc

SEQ ID NO: 3669933 - RNA, 18 nt, Salmonella enterica enterica serovar Typhi
ugucgcgcaauaccugua

SEQ ID NO: 3669934 - RNA, 16 nt, Salmonella enterica enterica serovar Typhi
ugucgcggauaugcag

SEQ ID NO: 3669935 - RNA, 17 nt, Salmonella enterica enterica serovar Typhi
ugucgcggcggcaaaag

SEQ ID NO: 3669936 - RNA, 22 nt, Salmonella enterica enterica serovar Typhi
ugucgcugaguacgcaccagcc

SEQ ID NO: 3669937 - RNA, 14 nt, Salmonella enterica enterica serovar Typhi
ugucgcuggauagc

SEQ ID NO: 3669938 - RNA, 23 nt, Salmonella enterica enterica serovar Typhi
ugucggauggcggcguaaacgcc

SEQ ID NO: 3669939 - RNA, 21 nt, Salmonella enterica enterica serovar Typhi
ugucggcagcgaguuacguug

SEQ ID NO: 3669940 - RNA, 19 nt, Salmonella enterica enterica serovar Typhi
ugucgggcaaaaugcgucg

SEQ ID NO: 3669941 - RNA, 22 nt, Salmonella enterica enterica serovar Typhi
ugucgggccaaucggagugaau

SEQ ID NO: 3669942 - RNA, 19 nt, Salmonella enterica enterica serovar Typhi
ugucgggccuacagaugaa

SEQ ID NO: 3669943 - RNA, 17 nt, Salmonella enterica enterica serovar Typhi
ugucggguggcgcuagc

SEQ ID NO: 3669944 - RNA, 17 nt, Salmonella enterica enterica serovar Typhi
ugucggucaggcugcgg

SEQ ID NO: 3669945 - RNA, 21 nt, Salmonella enterica enterica serovar Typhi
ugucggucggguaagcgcuag

SEQ ID NO: 3669946 - RNA, 13 nt, Salmonella enterica enterica serovar Typhi
ugucguauuuauu

SEQ ID NO: 3669947 - RNA, 15 nt, Salmonella enterica enterica serovar Typhi
ugucgucgauuuucu

SEQ ID NO: 3669948 - RNA, 22 nt, Salmonella enterica enterica serovar Typhi
ugucguuccacacguccauccg

SEQ ID NO: 3669949 - RNA, 14 nt, Salmonella enterica enterica serovar Typhi
ugucuauuuauuga

SEQ ID NO: 3669950 - RNA, 15 nt, Salmonella enterica enterica serovar Typhi
ugucugaauauuaaa

SEQ ID NO: 3669951 - RNA, 22 nt, Salmonella enterica enterica serovar Typhi
ugucugccucggguggcaucug

SEQ ID NO: 3669952 - RNA, 23 nt, Salmonella enterica enterica serovar Typhi
ugucugccucggguggcaucuga

SEQ ID NO: 3669953 - RNA, 23 nt, Salmonella enterica enterica serovar Typhi
ugucugcgcaacgcuuccaccuc

SEQ ID NO: 3669954 - RNA, 13 nt, Salmonella enterica enterica serovar Typhi
ugucuuaaauaug

SEQ ID NO: 3669955 - RNA, 20 nt, Salmonella enterica enterica serovar Typhi
ugucuucccugaccagcgac

SEQ ID NO: 3669956 - RNA, 18 nt, Salmonella enterica enterica serovar Typhi
ugucuucgcacugcccuu

SEQ ID NO: 3669957 - RNA, 18 nt, Salmonella enterica enterica serovar Typhi
ugucuucgucaaugcugc

SEQ ID NO: 3669958 - RNA, 18 nt, Salmonella enterica enterica serovar Typhi
ugucuuugcugccgguug

SEQ ID NO: 3669959 - RNA, 12 nt, Salmonella enterica enterica serovar Typhi
ugucuuuuucuc

SEQ ID NO: 3669960 - RNA, 12 nt, Salmonella enterica enterica serovar Typhi
ugugaaacgcga

SEQ ID NO: 3669961 - RNA, 22 nt, Salmonella enterica enterica serovar Typhi
ugugaacaucacguccucccgu

SEQ ID NO: 3669962 - RNA, 14 nt, Salmonella enterica enterica serovar Typhi
ugugaauaaaggau

SEQ ID NO: 3669963 - RNA, 19 nt, Salmonella enterica enterica serovar Typhi
ugugaauaugaucugcaca

SEQ ID NO: 3669964 - RNA, 16 nt, Salmonella enterica enterica serovar Typhi
ugugaauccaggccag

SEQ ID NO: 3669965 - RNA, 17 nt, Salmonella enterica enterica serovar Typhi
ugugacaaucacucucu

SEQ ID NO: 3669966 - RNA, 16 nt, Salmonella enterica enterica serovar Typhi
ugugaccaacaucauu

SEQ ID NO: 3669967 - RNA, 12 nt, Salmonella enterica enterica serovar Typhi
ugugagccauaa

SEQ ID NO: 3669968 - RNA, 15 nt, Salmonella enterica enterica serovar Typhi
ugugaguaaagagau

SEQ ID NO: 3669969 - RNA, 20 nt, Salmonella enterica enterica serovar Typhi
ugugaucugguuugguaaag

SEQ ID NO: 3669970 - RNA, 19 nt, Salmonella enterica enterica serovar Typhi
ugugcagugacagaggaau

SEQ ID NO: 3669971 - RNA, 18 nt, Salmonella enterica enterica serovar Typhi
ugugcauaucuggcgagg

SEQ ID NO: 3669972 - RNA, 21 nt, Salmonella enterica enterica serovar Typhi
ugugccagcucguuauuuccg

SEQ ID NO: 3669973 - RNA, 17 nt, Salmonella enterica enterica serovar Typhi
ugugccaguaaucccgg

SEQ ID NO: 3669974 - RNA, 20 nt, Salmonella enterica enterica serovar Typhi
ugugccaguaccgccgccgg

SEQ ID NO: 3669975 - RNA, 21 nt, Salmonella enterica enterica serovar Typhi
ugugccgguaagaagaaccag

SEQ ID NO: 3669976 - RNA, 23 nt, Salmonella enterica enterica serovar Typhi
ugugcgacaacaaugaaacgguu

SEQ ID NO: 3669977 - RNA, 14 nt, Salmonella enterica enterica serovar Typhi
ugugcgugaugggc

SEQ ID NO: 3669978 - RNA, 18 nt, Salmonella enterica enterica serovar Typhi
ugugcuaucaggccuaca

SEQ ID NO: 3669979 - RNA, 16 nt, Salmonella enterica enterica serovar Typhi
ugugcucgauauauuu

SEQ ID NO: 3669980 - RNA, 19 nt, Salmonella enterica enterica serovar Typhi
ugugcucgauauauuuucc

SEQ ID NO: 3669981 - RNA, 12 nt, Salmonella enterica enterica serovar Typhi
ugugcugguuga

SEQ ID NO: 3669982 - RNA, 15 nt, Salmonella enterica enterica serovar Typhi
ugugcuuaccgggcc

SEQ ID NO: 3669983 - RNA, 21 nt, Salmonella enterica enterica serovar Typhi
ugugcuuuuuauuuuucuggc

SEQ ID NO: 3669984 - RNA, 17 nt, Salmonella enterica enterica serovar Typhi
uguggaaacuccagcgg

SEQ ID NO: 3669985 - RNA, 18 nt, Salmonella enterica enterica serovar Typhi
uguggccaggcacguuaa

SEQ ID NO: 3669986 - RNA, 17 nt, Salmonella enterica enterica serovar Typhi
uguggccugcucuacuc

SEQ ID NO: 3669987 - RNA, 13 nt, Salmonella enterica enterica serovar Typhi
uguggccugcuua

SEQ ID NO: 3669988 - RNA, 18 nt, Salmonella enterica enterica serovar Typhi
uguggcuguguucauccc

SEQ ID NO: 3669989 - RNA, 22 nt, Salmonella enterica enterica serovar Typhi
uguggggggaacggcagacagc

SEQ ID NO: 3669990 - RNA, 16 nt, Salmonella enterica enterica serovar Typhi
ugugguccaaucguau

SEQ ID NO: 3669991 - RNA, 20 nt, Salmonella enterica enterica serovar Typhi
uguggucgcggcucaccagc

SEQ ID NO: 3669992 - RNA, 15 nt, Salmonella enterica enterica serovar Typhi
uguguacaaccauca

SEQ ID NO: 3669993 - RNA, 14 nt, Salmonella enterica enterica serovar Typhi
uguguaccagcagc

SEQ ID NO: 3669994 - RNA, 15 nt, Salmonella enterica enterica serovar Typhi
ugugugaccagcagu

SEQ ID NO: 3669995 - RNA, 20 nt, Salmonella enterica enterica serovar Typhi
ugugugagcgcccgccgcga

SEQ ID NO: 3669996 - RNA, 18 nt, Salmonella enterica enterica serovar Typhi
uguguggagguuucuuca

SEQ ID NO: 3669997 - RNA, 24 nt, Salmonella enterica enterica serovar Typhi
uguguugcucaaaaaagaguaaag

SEQ ID NO: 3669998 - RNA, 14 nt, Salmonella enterica enterica serovar Typhi
uguguuucagcagc

SEQ ID NO: 3669999 - RNA, 15 nt, Salmonella enterica enterica serovar Typhi
uguuaaaaccggcug

SEQ ID NO: 3670000 - RNA, 15 nt, Salmonella enterica enterica serovar Typhi
uguuaauaagcagaa

SEQ ID NO: 3670001 - RNA, 23 nt, Salmonella enterica enterica serovar Typhi
uguuaauccagagcggauaaaua

SEQ ID NO: 3670002 - RNA, 16 nt, Salmonella enterica enterica serovar Typhi
uguuaauuucccgcug

SEQ ID NO: 3670003 - RNA, 21 nt, Salmonella enterica enterica serovar Typhi
uguuaauuugcaucaggccaa

SEQ ID NO: 3670004 - RNA, 12 nt, Salmonella enterica enterica serovar Typhi
uguuaccaaugc

SEQ ID NO: 3670005 - RNA, 12 nt, Salmonella enterica enterica serovar Typhi
uguuacccagcc

SEQ ID NO: 3670006 - RNA, 15 nt, Salmonella enterica enterica serovar Typhi
uguuacgccaauaau

SEQ ID NO: 3670007 - RNA, 18 nt, Salmonella enterica enterica serovar Typhi
uguuacgcugguuugugu

SEQ ID NO: 3670008 - RNA, 17 nt, Salmonella enterica enterica serovar Typhi
uguuacucaauaaaagu

SEQ ID NO: 3670009 - RNA, 15 nt, Salmonella enterica enterica serovar Typhi
uguuaguguccuuac

SEQ ID NO: 3670010 - RNA, 21 nt, Salmonella enterica enterica serovar Typhi
uguuaucaugugaucuauaua

SEQ ID NO: 3670011 - RNA, 17 nt, Salmonella enterica enterica serovar Typhi
uguuaucuacaguguaa

SEQ ID NO: 3670012 - RNA, 21 nt, Salmonella enterica enterica serovar Typhi
uguuauuuacaaggaaagucu

SEQ ID NO: 3670013 - RNA, 18 nt, Salmonella enterica enterica serovar Typhi
uguuauuuucaaaaacaa

SEQ ID NO: 3670014 - RNA, 14 nt, Salmonella enterica enterica serovar Typhi
uguucaagcaauaa

SEQ ID NO: 3670015 - RNA, 13 nt, Salmonella enterica enterica serovar Typhi
uguucacaauugu

SEQ ID NO: 3670016 - RNA, 15 nt, Salmonella enterica enterica serovar Typhi
uguucacauccagcc

SEQ ID NO: 3670017 - RNA, 20 nt, Salmonella enterica enterica serovar Typhi
uguucacguaccaggcagcg

SEQ ID NO: 3670018 - RNA, 18 nt, Salmonella enterica enterica serovar Typhi
uguucagauggccaauga

SEQ ID NO: 3670019 - RNA, 14 nt, Salmonella enterica enterica serovar Typhi
uguucagccagcaa

SEQ ID NO: 3670020 - RNA, 14 nt, Salmonella enterica enterica serovar Typhi
uguucagcgcagaa

SEQ ID NO: 3670021 - RNA, 20 nt, Salmonella enterica enterica serovar Typhi
uguucagcuacuucaggcug

SEQ ID NO: 3670022 - RNA, 20 nt, Salmonella enterica enterica serovar Typhi
uguucagguacagguaauga

SEQ ID NO: 3670023 - RNA, 22 nt, Salmonella enterica enterica serovar Typhi
uguucaguaggacaaaaaugga

SEQ ID NO: 3670024 - RNA, 20 nt, Salmonella enterica enterica serovar Typhi
uguucagugccauccauauu

SEQ ID NO: 3670025 - RNA, 18 nt, Salmonella enterica enterica serovar Typhi
uguucauaaagugccagg

SEQ ID NO: 3670026 - RNA, 23 nt, Salmonella enterica enterica serovar Typhi
uguucauaucgaagaccuggccg

SEQ ID NO: 3670027 - RNA, 15 nt, Salmonella enterica enterica serovar Typhi
uguucauccauauau

SEQ ID NO: 3670028 - RNA, 21 nt, Salmonella enterica enterica serovar Typhi
uguuccagauaauccagcguc

SEQ ID NO: 3670029 - RNA, 16 nt, Salmonella enterica enterica serovar Typhi
uguuccagggcuucca

SEQ ID NO: 3670030 - RNA, 10 nt, Salmonella enterica enterica serovar Typhi
uguuccggcg

SEQ ID NO: 3670031 - RNA, 22 nt, Salmonella enterica enterica serovar Typhi
uguuccggcgaggacuguacaa

SEQ ID NO: 3670032 - RNA, 12 nt, Salmonella enterica enterica serovar Typhi
uguuccucuuuc

SEQ ID NO: 3670033 - RNA, 14 nt, Salmonella enterica enterica serovar Typhi
uguuccugagcaga

SEQ ID NO: 3670034 - RNA, 16 nt, Salmonella enterica enterica serovar Typhi
uguuccugcgggaaca

SEQ ID NO: 3670035 - RNA, 22 nt, Salmonella enterica enterica serovar Typhi
uguuccuggacguggguuucaa

SEQ ID NO: 3670036 - RNA, 20 nt, Salmonella enterica enterica serovar Typhi
uguucgagggcgauuuugac

SEQ ID NO: 3670037 - RNA, 15 nt, Salmonella enterica enterica serovar Typhi
uguucgcuucuucua

SEQ ID NO: 3670038 - RNA, 23 nt, Salmonella enterica enterica serovar Typhi
uguucuaaaaaguucauguaagu

SEQ ID NO: 3670039 - RNA, 17 nt, Salmonella enterica enterica serovar Typhi
uguucuacuacagaaag

SEQ ID NO: 3670040 - RNA, 13 nt, Salmonella enterica enterica serovar Typhi
uguucucccugcu

SEQ ID NO: 3670041 - RNA, 13 nt, Salmonella enterica enterica serovar Typhi
uguucuuccauug

SEQ ID NO: 3670042 - RNA, 14 nt, Salmonella enterica enterica serovar Typhi
uguucuuuucuuuc

SEQ ID NO: 3670043 - RNA, 17 nt, Salmonella enterica enterica serovar Typhi
uguugaaagccccggcu

SEQ ID NO: 3670044 - RNA, 14 nt, Salmonella enterica enterica serovar Typhi
uguugaccaacaau

SEQ ID NO: 3670045 - RNA, 13 nt, Salmonella enterica enterica serovar Typhi
uguugaccagguc

SEQ ID NO: 3670046 - RNA, 12 nt, Salmonella enterica enterica serovar Typhi
uguugacugcgc

SEQ ID NO: 3670047 - RNA, 14 nt, Salmonella enterica enterica serovar Typhi
uguugacugcgcuc

SEQ ID NO: 3670048 - RNA, 14 nt, Salmonella enterica enterica serovar Typhi
uguugagacgguga

SEQ ID NO: 3670049 - RNA, 22 nt, Salmonella enterica enterica serovar Typhi
uguugaugauggcuccuguugg

SEQ ID NO: 3670050 - RNA, 20 nt, Salmonella enterica enterica serovar Typhi
uguugauugaaacucgccau

SEQ ID NO: 3670051 - RNA, 21 nt, Salmonella enterica enterica serovar Typhi
uguugcaccuguuucugcugg

SEQ ID NO: 3670052 - RNA, 23 nt, Salmonella enterica enterica serovar Typhi
uguugccgcccguuuuuuccagc

SEQ ID NO: 3670053 - RNA, 16 nt, Salmonella enterica enterica serovar Typhi
uguugcgcaagcacug

SEQ ID NO: 3670054 - RNA, 20 nt, Salmonella enterica enterica serovar Typhi
uguugcgccauggcuucucc

SEQ ID NO: 3670055 - RNA, 15 nt, Salmonella enterica enterica serovar Typhi
uguugcgggccagca

SEQ ID NO: 3670056 - RNA, 21 nt, Salmonella enterica enterica serovar Typhi
uguugcgggccagcagccagg

SEQ ID NO: 3670057 - RNA, 22 nt, Salmonella enterica enterica serovar Typhi
uguugcgggccagcagccaggc

SEQ ID NO: 3670058 - RNA, 16 nt, Salmonella enterica enterica serovar Typhi
uguugcucaaaaaaga

SEQ ID NO: 3670059 - RNA, 16 nt, Salmonella enterica enterica serovar Typhi
uguugcuccagcauca

SEQ ID NO: 3670060 - RNA, 23 nt, Salmonella enterica enterica serovar Typhi
uguuggaaaugcguggcauuaac

SEQ ID NO: 3670061 - RNA, 18 nt, Salmonella enterica enterica serovar Typhi
uguuggucacgauccgca

SEQ ID NO: 3670062 - RNA, 22 nt, Salmonella enterica enterica serovar Typhi
uguuggugaguggccugucugg

SEQ ID NO: 3670063 - RNA, 13 nt, Salmonella enterica enterica serovar Typhi
uguugguuuaaac

SEQ ID NO: 3670064 - RNA, 22 nt, Salmonella enterica enterica serovar Typhi
uguuguacagcaauaaaaggaa

SEQ ID NO: 3670065 - RNA, 21 nt, Salmonella enterica enterica serovar Typhi
uguugugugccgcgcuggugg

SEQ ID NO: 3670066 - RNA, 20 nt, Salmonella enterica enterica serovar Typhi
uguuguguuuagcccucugg

SEQ ID NO: 3670067 - RNA, 23 nt, Salmonella enterica enterica serovar Typhi
uguuguguuuagcccucuggcaa

SEQ ID NO: 3670068 - RNA, 20 nt, Salmonella enterica enterica serovar Typhi
uguuguucuuuucuuucagc

SEQ ID NO: 3670069 - RNA, 19 nt, Salmonella enterica enterica serovar Typhi
uguuuaagcgccuccacaa

SEQ ID NO: 3670070 - RNA, 18 nt, Salmonella enterica enterica serovar Typhi
uguuuaauggcagaauaa

SEQ ID NO: 3670071 - RNA, 19 nt, Salmonella enterica enterica serovar Typhi
uguuuaccaagcaccgcca

SEQ ID NO: 3670072 - RNA, 14 nt, Salmonella enterica enterica serovar Typhi
uguuuaccuuuacg

SEQ ID NO: 3670073 - RNA, 14 nt, Salmonella enterica enterica serovar Typhi
uguuuacgccgcca

SEQ ID NO: 3670074 - RNA, 16 nt, Salmonella enterica enterica serovar Typhi
uguuuagacacauuga

SEQ ID NO: 3670075 - RNA, 19 nt, Salmonella enterica enterica serovar Typhi
uguuuaguacgcaaggaaa

SEQ ID NO: 3670076 - RNA, 19 nt, Salmonella enterica enterica serovar Typhi
uguuuauccccgcuggcgc

SEQ ID NO: 3670077 - RNA, 23 nt, Salmonella enterica enterica serovar Typhi
uguuuaucugaugccugaaggcg

SEQ ID NO: 3670078 - RNA, 14 nt, Salmonella enterica enterica serovar Typhi
uguuucaccguggc

SEQ ID NO: 3670079 - RNA, 12 nt, Salmonella enterica enterica serovar Typhi
uguuucagcagc

SEQ ID NO: 3670080 - RNA, 16 nt, Salmonella enterica enterica serovar Typhi
uguuucaucucaucaa

SEQ ID NO: 3670081 - RNA, 15 nt, Salmonella enterica enterica serovar Typhi
uguuucauggagauc

SEQ ID NO: 3670082 - RNA, 14 nt, Salmonella enterica enterica serovar Typhi
uguuucccaacaau

SEQ ID NO: 3670083 - RNA, 21 nt, Salmonella enterica enterica serovar Typhi
uguuucgaccgccugcaucac

SEQ ID NO: 3670084 - RNA, 12 nt, Salmonella enterica enterica serovar Typhi
uguuucgaugua

SEQ ID NO: 3670085 - RNA, 15 nt, Salmonella enterica enterica serovar Typhi
uguuucggauaauuc

SEQ ID NO: 3670086 - RNA, 16 nt, Salmonella enterica enterica serovar Typhi
uguuucggauaauucu

SEQ ID NO: 3670087 - RNA, 17 nt, Salmonella enterica enterica serovar Typhi
uguuucucuuccgccag

SEQ ID NO: 3670088 - RNA, 10 nt, Salmonella enterica enterica serovar Typhi
uguuucugcg

SEQ ID NO: 3670089 - RNA, 17 nt, Salmonella enterica enterica serovar Typhi
uguuugagaaaaacauc

SEQ ID NO: 3670090 - RNA, 12 nt, Salmonella enterica enterica serovar Typhi
uguuugaugagg

SEQ ID NO: 3670091 - RNA, 22 nt, Salmonella enterica enterica serovar Typhi
uguuugcccaccguaauaguuu

SEQ ID NO: 3670092 - RNA, 16 nt, Salmonella enterica enterica serovar Typhi
uguuugcccagcucau

SEQ ID NO: 3670093 - RNA, 22 nt, Salmonella enterica enterica serovar Typhi
uguuuguuuaacugaacuuccg

SEQ ID NO: 3670094 - RNA, 13 nt, Salmonella enterica enterica serovar Typhi
uguuuuaacggaa

SEQ ID NO: 3670095 - RNA, 19 nt, Salmonella enterica enterica serovar Typhi
uguuuuaccaaaucaauag

SEQ ID NO: 3670096 - RNA, 14 nt, Salmonella enterica enterica serovar Typhi
uguuuuaccuguuu

SEQ ID NO: 3670097 - RNA, 18 nt, Salmonella enterica enterica serovar Typhi
uguuuuacuuuuuuaaau

SEQ ID NO: 3670098 - RNA, 21 nt, Salmonella enterica enterica serovar Typhi
uguuuuacuuuuuuaaauguu

SEQ ID NO: 3670099 - RNA, 20 nt, Salmonella enterica enterica serovar Typhi
uguuuuagcagaguaugcug

SEQ ID NO: 3670100 - RNA, 15 nt, Salmonella enterica enterica serovar Typhi
uguuuuuauacaucc

SEQ ID NO: 3670101 - RNA, 16 nt, Salmonella enterica enterica serovar Typhi
uguuuuuauuuuucuu

SEQ ID NO: 3670102 - RNA, 15 nt, Salmonella enterica enterica serovar Typhi
uguuuuugaaaaugu

SEQ ID NO: 3670103 - RNA, 12 nt, Salmonella enterica enterica serovar Typhi
uguuuuugcuuu

SEQ ID NO: 3670104 - RNA, 18 nt, Salmonella enterica enterica serovar Typhi
uguuuuugcuuuaauauu

SEQ ID NO: 3670105 - RNA, 11 nt, Salmonella enterica enterica serovar Typhi
uguuuuuucau

SEQ ID NO: 3670106 - RNA, 22 nt, Salmonella enterica enterica serovar Typhi
uguuuuuuguugauuuuaugau

SEQ ID NO: 3670107 - RNA, 18 nt, Salmonella enterica enterica serovar Typhi
uuaaaaaaggcagaagaa

SEQ ID NO: 3670108 - RNA, 21 nt, Salmonella enterica enterica serovar Typhi
uuaaaaaaggccgcuuaauaa

SEQ ID NO: 3670109 - RNA, 13 nt, Salmonella enterica enterica serovar Typhi
uuaaaaaauccug

SEQ ID NO: 3670110 - RNA, 13 nt, Salmonella enterica enterica serovar Typhi
uuaaaaacaucau

SEQ ID NO: 3670111 - RNA, 22 nt, Salmonella enterica enterica serovar Typhi
uuaaaaagcgcgggcuggccgg

SEQ ID NO: 3670112 - RNA, 13 nt, Salmonella enterica enterica serovar Typhi
uuaaaaagcugca

SEQ ID NO: 3670113 - RNA, 21 nt, Salmonella enterica enterica serovar Typhi
uuaaaagcgccuuaaaccguc

SEQ ID NO: 3670114 - RNA, 22 nt, Salmonella enterica enterica serovar Typhi
uuaaaaucggggucuuccagca

SEQ ID NO: 3670115 - RNA, 20 nt, Salmonella enterica enterica serovar Typhi
uuaaaauuccaauauuuauu

SEQ ID NO: 3670116 - RNA, 16 nt, Salmonella enterica enterica serovar Typhi
uuaaaauugaacggac

SEQ ID NO: 3670117 - RNA, 11 nt, Salmonella enterica enterica serovar Typhi
uuaaacaacau

SEQ ID NO: 3670118 - RNA, 13 nt, Salmonella enterica enterica serovar Typhi
uuaaacaacauau

SEQ ID NO: 3670119 - RNA, 18 nt, Salmonella enterica enterica serovar Typhi
uuaaacaacgccauaaua

SEQ ID NO: 3670120 - RNA, 12 nt, Salmonella enterica enterica serovar Typhi
uuaaacacaucc

SEQ ID NO: 3670121 - RNA, 14 nt, Salmonella enterica enterica serovar Typhi
uuaaacaguauuua

SEQ ID NO: 3670122 - RNA, 13 nt, Salmonella enterica enterica serovar Typhi
uuaaaccacaccu

SEQ ID NO: 3670123 - RNA, 19 nt, Salmonella enterica enterica serovar Typhi
uuaaacgccggauuccaga

SEQ ID NO: 3670124 - RNA, 17 nt, Salmonella enterica enterica serovar Typhi
uuaaacgccugaucauc

SEQ ID NO: 3670125 - RNA, 13 nt, Salmonella enterica enterica serovar Typhi
uuaaacugccuuc

SEQ ID NO: 3670126 - RNA, 22 nt, Salmonella enterica enterica serovar Typhi
uuaaacuggccccgcauuuuac

SEQ ID NO: 3670127 - RNA, 14 nt, Salmonella enterica enterica serovar Typhi
uuaaagaaaaagaa

SEQ ID NO: 3670128 - RNA, 22 nt, Salmonella enterica enterica serovar Typhi
uuaaagacgccguuaccaaucu

SEQ ID NO: 3670129 - RNA, 15 nt, Salmonella enterica enterica serovar Typhi
uuaaagcacaagaac

SEQ ID NO: 3670130 - RNA, 19 nt, Salmonella enterica enterica serovar Typhi
uuaaagccaauccagaaua

SEQ ID NO: 3670131 - RNA, 11 nt, Salmonella enterica enterica serovar Typhi
uuaaagccacg

SEQ ID NO: 3670132 - RNA, 17 nt, Salmonella enterica enterica serovar Typhi
uuaaagcccugacagaa

SEQ ID NO: 3670133 - RNA, 22 nt, Salmonella enterica enterica serovar Typhi
uuaaagcgcucaagcggcacca

SEQ ID NO: 3670134 - RNA, 14 nt, Salmonella enterica enterica serovar Typhi
uuaaauaaacaaaa

SEQ ID NO: 3670135 - RNA, 23 nt, Salmonella enterica enterica serovar Typhi
uuaaauaaauaguaaauagaaaa

SEQ ID NO: 3670136 - RNA, 15 nt, Salmonella enterica enterica serovar Typhi
uuaaauaacaaauga

SEQ ID NO: 3670137 - RNA, 18 nt, Salmonella enterica enterica serovar Typhi
uuaaauaacuuuuaauuu

SEQ ID NO: 3670138 - RNA, 16 nt, Salmonella enterica enterica serovar Typhi
uuaaauagcaggcaau

SEQ ID NO: 3670139 - RNA, 17 nt, Salmonella enterica enterica serovar Typhi
uuaaaucaucauaauca

SEQ ID NO: 3670140 - RNA, 19 nt, Salmonella enterica enterica serovar Typhi
uuaaaucgcgcaaauauua

SEQ ID NO: 3670141 - RNA, 17 nt, Salmonella enterica enterica serovar Typhi
uuaaaucgcuaagcaga

SEQ ID NO: 3670142 - RNA, 23 nt, Salmonella enterica enterica serovar Typhi
uuaaauguuuuuucaucuccgau

SEQ ID NO: 3670143 - RNA, 19 nt, Salmonella enterica enterica serovar Typhi
uuaaauuaaugauuaaaau

SEQ ID NO: 3670144 - RNA, 19 nt, Salmonella enterica enterica serovar Typhi
uuaaauucauauuuaaaua

SEQ ID NO: 3670145 - RNA, 22 nt, Salmonella enterica enterica serovar Typhi
uuaaauucccagcguacaucuu

SEQ ID NO: 3670146 - RNA, 17 nt, Salmonella enterica enterica serovar Typhi
uuaaauugguuauauua

SEQ ID NO: 3670147 - RNA, 17 nt, Salmonella enterica enterica serovar Typhi
uuaaauuguuauaccgc

SEQ ID NO: 3670148 - RNA, 21 nt, Salmonella enterica enterica serovar Typhi
uuaacaaacgccaggcgcugc

SEQ ID NO: 3670149 - RNA, 15 nt, Salmonella enterica enterica serovar Typhi
uuaacacgauaaaac

SEQ ID NO: 3670150 - RNA, 12 nt, Salmonella enterica enterica serovar Typhi
uuaacagaauug

SEQ ID NO: 3670151 - RNA, 19 nt, Salmonella enterica enterica serovar Typhi
uuaacagagagggaaaaaa

SEQ ID NO: 3670152 - RNA, 16 nt, Salmonella enterica enterica serovar Typhi
uuaacagauaauuaau

SEQ ID NO: 3670153 - RNA, 20 nt, Salmonella enterica enterica serovar Typhi
uuaacagcgccaucaggaaa

SEQ ID NO: 3670154 - RNA, 20 nt, Salmonella enterica enterica serovar Typhi
uuaacagcgcgaccaggaaa

SEQ ID NO: 3670155 - RNA, 22 nt, Salmonella enterica enterica serovar Typhi
uuaacccgcuuacaauuuaucu

SEQ ID NO: 3670156 - RNA, 21 nt, Salmonella enterica enterica serovar Typhi
uuaaccgucugcucagaaaua

SEQ ID NO: 3670157 - RNA, 16 nt, Salmonella enterica enterica serovar Typhi
uuaaccguucuuccug

SEQ ID NO: 3670158 - RNA, 19 nt, Salmonella enterica enterica serovar Typhi
uuaaccugagaauauuaac

SEQ ID NO: 3670159 - RNA, 16 nt, Salmonella enterica enterica serovar Typhi
uuaacgauaauguugg

SEQ ID NO: 3670160 - RNA, 17 nt, Salmonella enterica enterica serovar Typhi
uuaacgauaauguuggu

SEQ ID NO: 3670161 - RNA, 16 nt, Salmonella enterica enterica serovar Typhi
uuaacgauuuccccug

SEQ ID NO: 3670162 - RNA, 13 nt, Salmonella enterica enterica serovar Typhi
uuaacgcagaaua

SEQ ID NO: 3670163 - RNA, 19 nt, Salmonella enterica enterica serovar Typhi
uuaacgcauguuccgcuac

SEQ ID NO: 3670164 - RNA, 19 nt, Salmonella enterica enterica serovar Typhi
uuaacgccaugcucaucca

SEQ ID NO: 3670165 - RNA, 17 nt, Salmonella enterica enterica serovar Typhi
uuaacgccggcaaauag

SEQ ID NO: 3670166 - RNA, 22 nt, Salmonella enterica enterica serovar Typhi
uuaacgcgaaauaaucagguga

SEQ ID NO: 3670167 - RNA, 22 nt, Salmonella enterica enterica serovar Typhi
uuaacgcgaauccgccauagcc

SEQ ID NO: 3670168 - RNA, 17 nt, Salmonella enterica enterica serovar Typhi
uuaacgcgccaucuuuc

SEQ ID NO: 3670169 - RNA, 17 nt, Salmonella enterica enterica serovar Typhi
uuaacgcggccguaaua

SEQ ID NO: 3670170 - RNA, 23 nt, Salmonella enterica enterica serovar Typhi
uuaacggcccaggcaucgacgcc

SEQ ID NO: 3670171 - RNA, 19 nt, Salmonella enterica enterica serovar Typhi
uuaacguaggccggauaag

SEQ ID NO: 3670172 - RNA, 19 nt, Salmonella enterica enterica serovar Typhi
uuaacguccauaccgguug

SEQ ID NO: 3670173 - RNA, 15 nt, Salmonella enterica enterica serovar Typhi
uuaacucaucacagc

SEQ ID NO: 3670174 - RNA, 22 nt, Salmonella enterica enterica serovar Typhi
uuaacuccuucuaauuccagga

SEQ ID NO: 3670175 - RNA, 22 nt, Salmonella enterica enterica serovar Typhi
uuaacucuuuuucagcaaauac

SEQ ID NO: 3670176 - RNA, 14 nt, Salmonella enterica enterica serovar Typhi
uuaacugcugcgcu

SEQ ID NO: 3670177 - RNA, 22 nt, Salmonella enterica enterica serovar Typhi
uuaacuggcgacgacuucaccc

SEQ ID NO: 3670178 - RNA, 16 nt, Salmonella enterica enterica serovar Typhi
uuaacuucuccgccau

SEQ ID NO: 3670179 - RNA, 18 nt, Salmonella enterica enterica serovar Typhi
uuaacuucugcagggaaa

SEQ ID NO: 3670180 - RNA, 12 nt, Salmonella enterica enterica serovar Typhi
uuaagaaaguag

SEQ ID NO: 3670181 - RNA, 13 nt, Salmonella enterica enterica serovar Typhi
uuaagaagucugu

SEQ ID NO: 3670182 - RNA, 19 nt, Salmonella enterica enterica serovar Typhi
uuaagacagguaacugcac

SEQ ID NO: 3670183 - RNA, 23 nt, Salmonella enterica enterica serovar Typhi
uuaagcaacugauuaaucugccg

SEQ ID NO: 3670184 - RNA, 21 nt, Salmonella enterica enterica serovar Typhi
uuaagcauuaccccguggugg

SEQ ID NO: 3670185 - RNA, 22 nt, Salmonella enterica enterica serovar Typhi
uuaagccccucgcuaaugcccg

SEQ ID NO: 3670186 - RNA, 12 nt, Salmonella enterica enterica serovar Typhi
uuaagcgaaccu

SEQ ID NO: 3670187 - RNA, 22 nt, Salmonella enterica enterica serovar Typhi
uuaagcggugugauaauuagcu

SEQ ID NO: 3670188 - RNA, 17 nt, Salmonella enterica enterica serovar Typhi
uuaaggaugaacucuau

SEQ ID NO: 3670189 - RNA, 15 nt, Salmonella enterica enterica serovar Typhi
uuaaggauugccgcc

SEQ ID NO: 3670190 - RNA, 17 nt, Salmonella enterica enterica serovar Typhi
uuaaggcggcaaagaua

SEQ ID NO: 3670191 - RNA, 14 nt, Salmonella enterica enterica serovar Typhi
uuaagucauaccug

SEQ ID NO: 3670192 - RNA, 15 nt, Salmonella enterica enterica serovar Typhi
uuaauaaacaaugca

SEQ ID NO: 3670193 - RNA, 23 nt, Salmonella enterica enterica serovar Typhi
uuaauaaugugccgguaagaaga

SEQ ID NO: 3670194 - RNA, 15 nt, Salmonella enterica enterica serovar Typhi
uuaauacccauagua

SEQ ID NO: 3670195 - RNA, 14 nt, Salmonella enterica enterica serovar Typhi
uuaauaccugguaa

SEQ ID NO: 3670196 - RNA, 14 nt, Salmonella enterica enterica serovar Typhi
uuaauacgcugucg

SEQ ID NO: 3670197 - RNA, 17 nt, Salmonella enterica enterica serovar Typhi
uuaauauauucaucuuu

SEQ ID NO: 3670198 - RNA, 17 nt, Salmonella enterica enterica serovar Typhi
uuaauaucaauauaauu

SEQ ID NO: 3670199 - RNA, 18 nt, Salmonella enterica enterica serovar Typhi
uuaaucaagcccagcuca

SEQ ID NO: 3670200 - RNA, 15 nt, Salmonella enterica enterica serovar Typhi
uuaaucaggcauuca

SEQ ID NO: 3670201 - RNA, 20 nt, Salmonella enterica enterica serovar Typhi
uuaauccgcggauagacgau

SEQ ID NO: 3670202 - RNA, 14 nt, Salmonella enterica enterica serovar Typhi
ucuuuaauacgcgu

SEQ ID NO: 3670203 - RNA, 14 nt, Salmonella enterica enterica serovar Typhi
ucuuuacacucgcg

SEQ ID NO: 3670204 - RNA, 18 nt, Salmonella enterica enterica serovar Typhi
ucuuuacgcuaucgggcg

SEQ ID NO: 3670205 - RNA, 16 nt, Salmonella enterica enterica serovar Typhi
ucuuuauccugaagau

SEQ ID NO: 3670206 - RNA, 12 nt, Salmonella enterica enterica serovar Typhi
ucuuuaucuucu

SEQ ID NO: 3670207 - RNA, 21 nt, Salmonella enterica enterica serovar Typhi
ucuuuaucuucugcugcuccc

SEQ ID NO: 3670208 - RNA, 13 nt, Salmonella enterica enterica serovar Typhi
ucuuuaugcguca

SEQ ID NO: 3670209 - RNA, 22 nt, Salmonella enterica enterica serovar Typhi
ucuuucagcaaacguucaauga

SEQ ID NO: 3670210 - RNA, 23 nt, Salmonella enterica enterica serovar Typhi
ucuuucagccgacuaucuucuuc

SEQ ID NO: 3670211 - RNA, 13 nt, Salmonella enterica enterica serovar Typhi
ucuuucaucaaac

SEQ ID NO: 3670212 - RNA, 17 nt, Salmonella enterica enterica serovar Typhi
ucuuucauuucugccug

SEQ ID NO: 3670213 - RNA, 14 nt, Salmonella enterica enterica serovar Typhi
ucuuucauuuuacc

SEQ ID NO: 3670214 - RNA, 14 nt, Salmonella enterica enterica serovar Typhi
ucuuucccaggccc

SEQ ID NO: 3670215 - RNA, 13 nt, Salmonella enterica enterica serovar Typhi
ucuuucccggcaa

SEQ ID NO: 3670216 - RNA, 22 nt, Salmonella enterica enterica serovar Typhi
ucuuucccggcaauuaccgcca

SEQ ID NO: 3670217 - RNA, 13 nt, Salmonella enterica enterica serovar Typhi
ucuuucccuuuuu

SEQ ID NO: 3670218 - RNA, 12 nt, Salmonella enterica enterica serovar Typhi
ucuuuccuuuuu

SEQ ID NO: 3670219 - RNA, 21 nt, Salmonella enterica enterica serovar Typhi
ucuuucugaaacggaucaaaa

SEQ ID NO: 3670220 - RNA, 20 nt, Salmonella enterica enterica serovar Typhi
ucuuugaccagcgacgauga

SEQ ID NO: 3670221 - RNA, 19 nt, Salmonella enterica enterica serovar Typhi
ucuuugcaccgcuaaaaaa

SEQ ID NO: 3670222 - RNA, 17 nt, Salmonella enterica enterica serovar Typhi
ucuuugccaaacugcug

SEQ ID NO: 3670223 - RNA, 14 nt, Salmonella enterica enterica serovar Typhi
ucuuugcugccguc

SEQ ID NO: 3670224 - RNA, 22 nt, Salmonella enterica enterica serovar Typhi
ucuuuggccaguaucgcgccgc

SEQ ID NO: 3670225 - RNA, 17 nt, Salmonella enterica enterica serovar Typhi
ucuuuggcuuaaucauu

SEQ ID NO: 3670226 - RNA, 17 nt, Salmonella enterica enterica serovar Typhi
ucuuuguccugaaggac

SEQ ID NO: 3670227 - RNA, 13 nt, Salmonella enterica enterica serovar Typhi
ucuuuuaacauaa

SEQ ID NO: 3670228 - RNA, 22 nt, Salmonella enterica enterica serovar Typhi
ucuuuuaaggcggcaaagauaa

SEQ ID NO: 3670229 - RNA, 15 nt, Salmonella enterica enterica serovar Typhi
ucuuuuaauuuucug

SEQ ID NO: 3670230 - RNA, 12 nt, Salmonella enterica enterica serovar Typhi
ucuuuugcaaua

SEQ ID NO: 3670231 - RNA, 16 nt, Salmonella enterica enterica serovar Typhi
ucuuuugcgccuucca

SEQ ID NO: 3670232 - RNA, 15 nt, Salmonella enterica enterica serovar Typhi
ucuuuuuauggcggg

SEQ ID NO: 3670233 - RNA, 22 nt, Salmonella enterica enterica serovar Typhi
ugaaaaacgguauuuccauuuu

SEQ ID NO: 3670234 - RNA, 13 nt, Salmonella enterica enterica serovar Typhi
ugaaaaacuggaa

SEQ ID NO: 3670235 - RNA, 14 nt, Salmonella enterica enterica serovar Typhi
ugaaaaacuggaaa

SEQ ID NO: 3670236 - RNA, 16 nt, Salmonella enterica enterica serovar Typhi
ugaaaaauauaaaaag

SEQ ID NO: 3670237 - RNA, 12 nt, Salmonella enterica enterica serovar Typhi
ugaaaaaucauu

SEQ ID NO: 3670238 - RNA, 23 nt, Salmonella enterica enterica serovar Typhi
ugaaaacaggccugcggaaaaag

SEQ ID NO: 3670239 - RNA, 24 nt, Salmonella enterica enterica serovar Typhi
ugaaaaccacaaucacagcgcaga

SEQ ID NO: 3670240 - RNA, 14 nt, Salmonella enterica enterica serovar Typhi
ugaaaacgaaucuc

SEQ ID NO: 3670241 - RNA, 19 nt, Salmonella enterica enterica serovar Typhi
ugaaaacucggcgggguuu

SEQ ID NO: 3670242 - RNA, 22 nt, Salmonella enterica enterica serovar Typhi
ugaaaacucggcgggguuuuuu

SEQ ID NO: 3670243 - RNA, 13 nt, Salmonella enterica enterica serovar Typhi
ugaaaagauaaag

SEQ ID NO: 3670244 - RNA, 12 nt, Salmonella enterica enterica serovar Typhi
ugaaaagcuuag

SEQ ID NO: 3670245 - RNA, 19 nt, Salmonella enterica enterica serovar Typhi
ugaaaagcuuagaacucac

SEQ ID NO: 3670246 - RNA, 14 nt, Salmonella enterica enterica serovar Typhi
ugaaaauaauuuuu

SEQ ID NO: 3670247 - RNA, 18 nt, Salmonella enterica enterica serovar Typhi
ugaaaauguaucagacgu

SEQ ID NO: 3670248 - RNA, 23 nt, Salmonella enterica enterica serovar Typhi
ugaaaaugugguauuaacccaga

SEQ ID NO: 3670249 - RNA, 15 nt, Salmonella enterica enterica serovar Typhi
ugaaaauuuguacuu

SEQ ID NO: 3670250 - RNA, 22 nt, Salmonella enterica enterica serovar Typhi
ugaaacaguccggcgaaaaaag

SEQ ID NO: 3670251 - RNA, 20 nt, Salmonella enterica enterica serovar Typhi
ugaaacauauauauccgcua

SEQ ID NO: 3670252 - RNA, 12 nt, Salmonella enterica enterica serovar Typhi
ugaaacccgcca

SEQ ID NO: 3670253 - RNA, 19 nt, Salmonella enterica enterica serovar Typhi
ugaaacccgccaccgccag

SEQ ID NO: 3670254 - RNA, 22 nt, Salmonella enterica enterica serovar Typhi
ugaaaccggcgcgccuuccagc

SEQ ID NO: 3670255 - RNA, 17 nt, Salmonella enterica enterica serovar Typhi
ugaaacgcccuucccag

SEQ ID NO: 3670256 - RNA, 21 nt, Salmonella enterica enterica serovar Typhi
ugaaacgccguuuguuuauug

SEQ ID NO: 3670257 - RNA, 18 nt, Salmonella enterica enterica serovar Typhi
ugaaacguguuuaucccc

SEQ ID NO: 3670258 - RNA, 19 nt, Salmonella enterica enterica serovar Typhi
ugaaacguucggugaagaa

SEQ ID NO: 3670259 - RNA, 12 nt, Salmonella enterica enterica serovar Typhi
ugaaacucgcca

SEQ ID NO: 3670260 - RNA, 18 nt, Salmonella enterica enterica serovar Typhi
ugaaacugaaccaacagc

SEQ ID NO: 3670261 - RNA, 15 nt, Salmonella enterica enterica serovar Typhi
ugaaagaaaucaccg

SEQ ID NO: 3670262 - RNA, 14 nt, Salmonella enterica enterica serovar Typhi
ugaaagauuauuuu

SEQ ID NO: 3670263 - RNA, 20 nt, Salmonella enterica enterica serovar Typhi
ugaaagauuauuuuaucauc

SEQ ID NO: 3670264 - RNA, 23 nt, Salmonella enterica enterica serovar Typhi
ugaaagauuauuuuaucaucagc

SEQ ID NO: 3670265 - RNA, 12 nt, Salmonella enterica enterica serovar Typhi
ugaaagcgcaaa

SEQ ID NO: 3670266 - RNA, 14 nt, Salmonella enterica enterica serovar Typhi
ugaaaggccuaaac

SEQ ID NO: 3670267 - RNA, 12 nt, Salmonella enterica enterica serovar Typhi
ugaaaggguggg

SEQ ID NO: 3670268 - RNA, 21 nt, Salmonella enterica enterica serovar Typhi
ugaaagucuucccgcaaacug

SEQ ID NO: 3670269 - RNA, 16 nt, Salmonella enterica enterica serovar Typhi
ugaaaguuucaggaua

SEQ ID NO: 3670270 - RNA, 20 nt, Salmonella enterica enterica serovar Typhi
ugaaauaauagauugcgcca

SEQ ID NO: 3670271 - RNA, 20 nt, Salmonella enterica enterica serovar Typhi
ugaaauaauuguguaaucuu

SEQ ID NO: 3670272 - RNA, 21 nt, Salmonella enterica enterica serovar Typhi
ugaaauaauuguguaaucuuu

SEQ ID NO: 3670273 - RNA, 18 nt, Salmonella enterica enterica serovar Typhi
ugaaauacagccagguug

SEQ ID NO: 3670274 - RNA, 18 nt, Salmonella enterica enterica serovar Typhi
ugaaauauuugaucacau

SEQ ID NO: 3670275 - RNA, 14 nt, Salmonella enterica enterica serovar Typhi
ugaaaucgguaauc

SEQ ID NO: 3670276 - RNA, 22 nt, Salmonella enterica enterica serovar Typhi
ugaaauuauuccuuaucacauu

SEQ ID NO: 3670277 - RNA, 22 nt, Salmonella enterica enterica serovar Typhi
ugaaugccccagcgcugcugua

SEQ ID NO: 3670278 - RNA, 17 nt, Salmonella enterica enterica serovar Typhi
ugaaugcccuuuuccag

SEQ ID NO: 3670279 - RNA, 18 nt, Salmonella enterica enterica serovar Typhi
ugaaugcccuuuuccaga

SEQ ID NO: 3670280 - RNA, 20 nt, Salmonella enterica enterica serovar Typhi
ugaaugcucucauauuccag

SEQ ID NO: 3670281 - RNA, 18 nt, Salmonella enterica enterica serovar Typhi
ugaauggcggagaucucc

SEQ ID NO: 3670282 - RNA, 19 nt, Salmonella enterica enterica serovar Typhi
ugaauguugcucgcggcgu

SEQ ID NO: 3670283 - RNA, 17 nt, Salmonella enterica enterica serovar Typhi
ugaauuauaauaaaggg

SEQ ID NO: 3670284 - RNA, 18 nt, Salmonella enterica enterica serovar Typhi
ugaauugauuagcuuuaa

SEQ ID NO: 3670285 - RNA, 18 nt, Salmonella enterica enterica serovar Typhi
ugaauugcgguuuauccc

SEQ ID NO: 3670286 - RNA, 15 nt, Salmonella enterica enterica serovar Typhi
ugaauuuaaauacuu

SEQ ID NO: 3670287 - RNA, 14 nt, Salmonella enterica enterica serovar Typhi
ugaauuucucgcca

SEQ ID NO: 3670288 - RNA, 14 nt, Salmonella enterica enterica serovar Typhi
ugaauuucugcugc

SEQ ID NO: 3670289 - RNA, 22 nt, Salmonella enterica enterica serovar Typhi
ugaauuuuagauccccaaacug

SEQ ID NO: 3670290 - RNA, 23 nt, Salmonella enterica enterica serovar Typhi
ugaauuuuagauccccaaacugc

SEQ ID NO: 3670291 - RNA, 15 nt, Salmonella enterica enterica serovar Typhi
ugaauuuuauuagua

SEQ ID NO: 3670292 - RNA, 23 nt, Salmonella enterica enterica serovar Typhi
ugacaaacucacguuccccagca

SEQ ID NO: 3670293 - RNA, 22 nt, Salmonella enterica enterica serovar Typhi
ugacaaauuguuuaaaaacagg

SEQ ID NO: 3670294 - RNA, 14 nt, Salmonella enterica enterica serovar Typhi
ugacaacaaaaaga

SEQ ID NO: 3670295 - RNA, 17 nt, Salmonella enterica enterica serovar Typhi
ugacaacuauugcugcc

SEQ ID NO: 3670296 - RNA, 15 nt, Salmonella enterica enterica serovar Typhi
ugacaagcagcggaa

SEQ ID NO: 3670297 - RNA, 13 nt, Salmonella enterica enterica serovar Typhi
ugacaauacugca

SEQ ID NO: 3670298 - RNA, 23 nt, Salmonella enterica enterica serovar Typhi
ugacaauauugccauaaauacaa

SEQ ID NO: 3670299 - RNA, 17 nt, Salmonella enterica enterica serovar Typhi
ugacaaucagcacacua

SEQ ID NO: 3670300 - RNA, 16 nt, Salmonella enterica enterica serovar Typhi
ugacaaucucaauacc

SEQ ID NO: 3670301 - RNA, 14 nt, Salmonella enterica enterica serovar Typhi
ugacaaugacgcaa

SEQ ID NO: 3670302 - RNA, 11 nt, Salmonella enterica enterica serovar Typhi
ugacacagcgu

SEQ ID NO: 3670303 - RNA, 19 nt, Salmonella enterica enterica serovar Typhi
ugacacagcguacaauggc

SEQ ID NO: 3670304 - RNA, 15 nt, Salmonella enterica enterica serovar Typhi
ugacacggucagcgg

SEQ ID NO: 3670305 - RNA, 21 nt, Salmonella enterica enterica serovar Typhi
ugacacuauauugcgaauaaa

SEQ ID NO: 3670306 - RNA, 13 nt, Salmonella enterica enterica serovar Typhi
ugacacucaucca

SEQ ID NO: 3670307 - RNA, 14 nt, Salmonella enterica enterica serovar Typhi
ugacacucauccag

SEQ ID NO: 3670308 - RNA, 18 nt, Salmonella enterica enterica serovar Typhi
ugacagcacauagccuaa

SEQ ID NO: 3670309 - RNA, 19 nt, Salmonella enterica enterica serovar Typhi
ugacagccaaacugcugua

SEQ ID NO: 3670310 - RNA, 22 nt, Salmonella enterica enterica serovar Typhi
ugacaucaagcccacacaucac

SEQ ID NO: 3670311 - RNA, 18 nt, Salmonella enterica enterica serovar Typhi
ugacaucccccucuugcc

SEQ ID NO: 3670312 - RNA, 18 nt, Salmonella enterica enterica serovar Typhi
ugacaucgcaaugccacc

SEQ ID NO: 3670313 - RNA, 20 nt, Salmonella enterica enterica serovar Typhi
ugacaugaaaauaugagguu

SEQ ID NO: 3670314 - RNA, 15 nt, Salmonella enterica enterica serovar Typhi
ugacauuauucaccu

SEQ ID NO: 3670315 - RNA, 19 nt, Salmonella enterica enterica serovar Typhi
ugacauucugacggcccuu

SEQ ID NO: 3670316 - RNA, 19 nt, Salmonella enterica enterica serovar Typhi
ugacauuugcaucaaacuu

SEQ ID NO: 3670317 - RNA, 17 nt, Salmonella enterica enterica serovar Typhi
ugaccaacaacagauau

SEQ ID NO: 3670318 - RNA, 20 nt, Salmonella enterica enterica serovar Typhi
ugaccaacaucauuauuccc

SEQ ID NO: 3670319 - RNA, 21 nt, Salmonella enterica enterica serovar Typhi
ugaccaacaucauuauucccc

SEQ ID NO: 3670320 - RNA, 15 nt, Salmonella enterica enterica serovar Typhi
ugaccacauuuucuc

SEQ ID NO: 3670321 - RNA, 15 nt, Salmonella enterica enterica serovar Typhi
ugaccaccagcgcga

SEQ ID NO: 3670322 - RNA, 17 nt, Salmonella enterica enterica serovar Typhi
ugaccaccauauucgcc

SEQ ID NO: 3670323 - RNA, 14 nt, Salmonella enterica enterica serovar Typhi
ugaccacgccgccg

SEQ ID NO: 3670324 - RNA, 15 nt, Salmonella enterica enterica serovar Typhi
ugaccacggcgucaa

SEQ ID NO: 3670325 - RNA, 12 nt, Salmonella enterica enterica serovar Typhi
ugaccagcaguu

SEQ ID NO: 3670326 - RNA, 15 nt, Salmonella enterica enterica serovar Typhi
ugaccagcaguuccg

SEQ ID NO: 3670327 - RNA, 18 nt, Salmonella enterica enterica serovar Typhi
ugaccagccuaccugccg

SEQ ID NO: 3670328 - RNA, 12 nt, Salmonella enterica enterica serovar Typhi
ugaccagcgccc

SEQ ID NO: 3670329 - RNA, 18 nt, Salmonella enterica enterica serovar Typhi
ugaccagcgcccacacca

SEQ ID NO: 3670330 - RNA, 21 nt, Salmonella enterica enterica serovar Typhi
ugaccagcugacgacgccagc

SEQ ID NO: 3670331 - RNA, 19 nt, Salmonella enterica enterica serovar Typhi
ugaccaguggcguaacgau

SEQ ID NO: 3670332 - RNA, 17 nt, Salmonella enterica enterica serovar Typhi
ugaccauauaugaaauc

SEQ ID NO: 3670333 - RNA, 17 nt, Salmonella enterica enterica serovar Typhi
ugaccaucaaauaauac

SEQ ID NO: 3670334 - RNA, 17 nt, Salmonella enterica enterica serovar Typhi
ugaccauccgcagguua

SEQ ID NO: 3670335 - RNA, 14 nt, Salmonella enterica enterica serovar Typhi
ugaccaucgccagc

SEQ ID NO: 3670336 - RNA, 16 nt, Salmonella enterica enterica serovar Typhi
ugaccaucgccagcca

SEQ ID NO: 3670337 - RNA, 16 nt, Salmonella enterica enterica serovar Typhi
ugaccaugcauauaag

SEQ ID NO: 3670338 - RNA, 19 nt, Salmonella enterica enterica serovar Typhi
ugaccauuaccauuccuca

SEQ ID NO: 3670339 - RNA, 16 nt, Salmonella enterica enterica serovar Typhi
ugacccacgccagcag

SEQ ID NO: 3670340 - RNA, 13 nt, Salmonella enterica enterica serovar Typhi
ugacccagacaaa

SEQ ID NO: 3670341 - RNA, 13 nt, Salmonella enterica enterica serovar Typhi
ugacccgcagcaa

SEQ ID NO: 3670342 - RNA, 14 nt, Salmonella enterica enterica serovar Typhi
ugacccgcagcaau

SEQ ID NO: 3670343 - RNA, 14 nt, Salmonella enterica enterica serovar Typhi
ugacccucccugcg

SEQ ID NO: 3670344 - RNA, 16 nt, Salmonella enterica enterica serovar Typhi
ugaccgaucacggcuu

SEQ ID NO: 3670345 - RNA, 17 nt, Salmonella enterica enterica serovar Typhi
ugaccgauuuguggcgu

SEQ ID NO: 3670346 - RNA, 19 nt, Salmonella enterica enterica serovar Typhi
ugaccgauuuguggcguua

SEQ ID NO: 3670347 - RNA, 21 nt, Salmonella enterica enterica serovar Typhi
ugaccgccgcgcgucagcacg

SEQ ID NO: 3670348 - RNA, 15 nt, Salmonella enterica enterica serovar Typhi
ugaccgucagccccg

SEQ ID NO: 3670349 - RNA, 13 nt, Salmonella enterica enterica serovar Typhi
ugaccuacaggcc

SEQ ID NO: 3670350 - RNA, 14 nt, Salmonella enterica enterica serovar Typhi
ugaccuacaggccg

SEQ ID NO: 3670351 - RNA, 13 nt, Salmonella enterica enterica serovar Typhi
ugaccucauccau

SEQ ID NO: 3670352 - RNA, 12 nt, Salmonella enterica enterica serovar Typhi
ugaccucgccua

SEQ ID NO: 3670353 - RNA, 15 nt, Salmonella enterica enterica serovar Typhi
ugaccugcccauccu

SEQ ID NO: 3670354 - RNA, 17 nt, Salmonella enterica enterica serovar Typhi
ugaccugggcgccagag

SEQ ID NO: 3670355 - RNA, 15 nt, Salmonella enterica enterica serovar Typhi
ugacgacccgcuucc

SEQ ID NO: 3670356 - RNA, 16 nt, Salmonella enterica enterica serovar Typhi
ugacgaggccuguccc

SEQ ID NO: 3670357 - RNA, 17 nt, Salmonella enterica enterica serovar Typhi
ugacgagggaaggggau

SEQ ID NO: 3670358 - RNA, 19 nt, Salmonella enterica enterica serovar Typhi
ugacgauacgucauaucau

SEQ ID NO: 3670359 - RNA, 19 nt, Salmonella enterica enterica serovar Typhi
ugacgaucaugccgcccag

SEQ ID NO: 3670360 - RNA, 21 nt, Salmonella enterica enterica serovar Typhi
ugacgcaguaauacgccgccg

SEQ ID NO: 3670361 - RNA, 20 nt, Salmonella enterica enterica serovar Typhi
ugacgccaguucccacagcu

SEQ ID NO: 3670362 - RNA, 21 nt, Salmonella enterica enterica serovar Typhi
ugacgccaguucccacagcuu

SEQ ID NO: 3670363 - RNA, 12 nt, Salmonella enterica enterica serovar Typhi
ucuguuaucugg

SEQ ID NO: 3670364 - RNA, 15 nt, Salmonella enterica enterica serovar Typhi
ucuguucaacuuuuc

SEQ ID NO: 3670365 - RNA, 22 nt, Salmonella enterica enterica serovar Typhi
ucuguuucaguucggagaucag

SEQ ID NO: 3670366 - RNA, 21 nt, Salmonella enterica enterica serovar Typhi
ucuguuucauggagauccagu

SEQ ID NO: 3670367 - RNA, 19 nt, Salmonella enterica enterica serovar Typhi
ucuuaauuccucagaaucc

SEQ ID NO: 3670368 - RNA, 17 nt, Salmonella enterica enterica serovar Typhi
ucuuacacuuagcacaa

SEQ ID NO: 3670369 - RNA, 16 nt, Salmonella enterica enterica serovar Typhi
ucuuacagggcgaugc

SEQ ID NO: 3670370 - RNA, 18 nt, Salmonella enterica enterica serovar Typhi
ucuuaccgcuaaaauacc

SEQ ID NO: 3670371 - RNA, 21 nt, Salmonella enterica enterica serovar Typhi
ucuuaccggugcgauucagcg

SEQ ID NO: 3670372 - RNA, 14 nt, Salmonella enterica enterica serovar Typhi
ucuuaccucuccug

SEQ ID NO: 3670373 - RNA, 16 nt, Salmonella enterica enterica serovar Typhi
ucuuacgagaggcuuu

SEQ ID NO: 3670374 - RNA, 16 nt, Salmonella enterica enterica serovar Typhi
ucuuacggauaaaaac

SEQ ID NO: 3670375 - RNA, 22 nt, Salmonella enterica enterica serovar Typhi
ucuuacguugcauuuaucaauc

SEQ ID NO: 3670376 - RNA, 19 nt, Salmonella enterica enterica serovar Typhi
ucuuacuaauaaauauuca

SEQ ID NO: 3670377 - RNA, 22 nt, Salmonella enterica enterica serovar Typhi
ucuuaucaggccuacacucugc

SEQ ID NO: 3670378 - RNA, 18 nt, Salmonella enterica enterica serovar Typhi
ucuuauccggccugcaug

SEQ ID NO: 3670379 - RNA, 15 nt, Salmonella enterica enterica serovar Typhi
ucuuaugccgcuuuu

SEQ ID NO: 3670380 - RNA, 14 nt, Salmonella enterica enterica serovar Typhi
ucuuauuacaagaa

SEQ ID NO: 3670381 - RNA, 18 nt, Salmonella enterica enterica serovar Typhi
ucuuauuagcgauuuaau

SEQ ID NO: 3670382 - RNA, 11 nt, Salmonella enterica enterica serovar Typhi
ucuuauuuucc

SEQ ID NO: 3670383 - RNA, 12 nt, Salmonella enterica enterica serovar Typhi
ucuuauuuuccg

SEQ ID NO: 3670384 - RNA, 12 nt, Salmonella enterica enterica serovar Typhi
ucuucaaagcca

SEQ ID NO: 3670385 - RNA, 22 nt, Salmonella enterica enterica serovar Typhi
ucuucaacauugucgaacugca

SEQ ID NO: 3670386 - RNA, 13 nt, Salmonella enterica enterica serovar Typhi
ucuucaacgugca

SEQ ID NO: 3670387 - RNA, 14 nt, Salmonella enterica enterica serovar Typhi
ucuucaacgugcau

SEQ ID NO: 3670388 - RNA, 15 nt, Salmonella enterica enterica serovar Typhi
ucuucaccuugcugc

SEQ ID NO: 3670389 - RNA, 19 nt, Salmonella enterica enterica serovar Typhi
ucuucaccuuuccagucaa

SEQ ID NO: 3670390 - RNA, 22 nt, Salmonella enterica enterica serovar Typhi
ucuucacgcagucguuccagac

SEQ ID NO: 3670391 - RNA, 15 nt, Salmonella enterica enterica serovar Typhi
ucuucacuaaaaaca

SEQ ID NO: 3670392 - RNA, 16 nt, Salmonella enterica enterica serovar Typhi
ucuucacuaaaaacag

SEQ ID NO: 3670393 - RNA, 14 nt, Salmonella enterica enterica serovar Typhi
ucuucaguaaccag

SEQ ID NO: 3670394 - RNA, 18 nt, Salmonella enterica enterica serovar Typhi
ucuucaguaaccagggag

SEQ ID NO: 3670395 - RNA, 16 nt, Salmonella enterica enterica serovar Typhi
ucuucaguaauuucga

SEQ ID NO: 3670396 - RNA, 22 nt, Salmonella enterica enterica serovar Typhi
ucuucaguaauuucgaugauga

SEQ ID NO: 3670397 - RNA, 21 nt, Salmonella enterica enterica serovar Typhi
ucuucauaaauagccagcauc

SEQ ID NO: 3670398 - RNA, 13 nt, Salmonella enterica enterica serovar Typhi
ucuucaucagcca

SEQ ID NO: 3670399 - RNA, 16 nt, Salmonella enterica enterica serovar Typhi
ucuucaucagccagca

SEQ ID NO: 3670400 - RNA, 23 nt, Salmonella enterica enterica serovar Typhi
ucuucauggucggacgggcccug

SEQ ID NO: 3670401 - RNA, 23 nt, Salmonella enterica enterica serovar Typhi
ucuuccaccacggcaaaaauaug

SEQ ID NO: 3670402 - RNA, 23 nt, Salmonella enterica enterica serovar Typhi
ucuuccagcacgauauccagcac

SEQ ID NO: 3670403 - RNA, 14 nt, Salmonella enterica enterica serovar Typhi
ucuuccagcaucag

SEQ ID NO: 3670404 - RNA, 19 nt, Salmonella enterica enterica serovar Typhi
ucuuccagcgucuccagac

SEQ ID NO: 3670405 - RNA, 23 nt, Salmonella enterica enterica serovar Typhi
ucuuccaguuguaacgccuggcg

SEQ ID NO: 3670406 - RNA, 18 nt, Salmonella enterica enterica serovar Typhi
ucuuccauugcuuuuuug

SEQ ID NO: 3670407 - RNA, 21 nt, Salmonella enterica enterica serovar Typhi
ucuucccagguuucaaugccg

SEQ ID NO: 3670408 - RNA, 12 nt, Salmonella enterica enterica serovar Typhi
ucuucccauauu

SEQ ID NO: 3670409 - RNA, 17 nt, Salmonella enterica enterica serovar Typhi
ucuuccccgaucagaaa

SEQ ID NO: 3670410 - RNA, 18 nt, Salmonella enterica enterica serovar Typhi
ucuuccccgaucagaaaa

SEQ ID NO: 3670411 - RNA, 15 nt, Salmonella enterica enterica serovar Typhi
ucuucccgcagauau

SEQ ID NO: 3670412 - RNA, 12 nt, Salmonella enterica enterica serovar Typhi
ucuucccggcag

SEQ ID NO: 3670413 - RNA, 14 nt, Salmonella enterica enterica serovar Typhi
ucuuccgccagguc

SEQ ID NO: 3670414 - RNA, 12 nt, Salmonella enterica enterica serovar Typhi
ucuuccggcguc

SEQ ID NO: 3670415 - RNA, 16 nt, Salmonella enterica enterica serovar Typhi
ucuuccgggucaguuu

SEQ ID NO: 3670416 - RNA, 16 nt, Salmonella enterica enterica serovar Typhi
ucuuccugcugcgcca

SEQ ID NO: 3670417 - RNA, 20 nt, Salmonella enterica enterica serovar Typhi
ucuuccugcugcgccagcgc

SEQ ID NO: 3670418 - RNA, 18 nt, Salmonella enterica enterica serovar Typhi
ucuucgacacauuucagc

SEQ ID NO: 3670419 - RNA, 16 nt, Salmonella enterica enterica serovar Typhi
ucuucgacauauuuac

SEQ ID NO: 3670420 - RNA, 15 nt, Salmonella enterica enterica serovar Typhi
ucuucgcaaccggua

SEQ ID NO: 3670421 - RNA, 21 nt, Salmonella enterica enterica serovar Typhi
ucuucgcccauugccacccau

SEQ ID NO: 3670422 - RNA, 22 nt, Salmonella enterica enterica serovar Typhi
ucuucgccgaagugugccagca

SEQ ID NO: 3670423 - RNA, 16 nt, Salmonella enterica enterica serovar Typhi
ucuucggcaaaauauu

SEQ ID NO: 3670424 - RNA, 15 nt, Salmonella enterica enterica serovar Typhi
ucuucggcauaacgu

SEQ ID NO: 3670425 - RNA, 15 nt, Salmonella enterica enterica serovar Typhi
ucuucggcuucaccg

SEQ ID NO: 3670426 - RNA, 18 nt, Salmonella enterica enterica serovar Typhi
ucuucggucgagcuuuug

SEQ ID NO: 3670427 - RNA, 14 nt, Salmonella enterica enterica serovar Typhi
ucuucuacaaugcg

SEQ ID NO: 3670428 - RNA, 16 nt, Salmonella enterica enterica serovar Typhi
ucuucuaccaccuuau

SEQ ID NO: 3670429 - RNA, 14 nt, Salmonella enterica enterica serovar Typhi
ucuucuccgccugc

SEQ ID NO: 3670430 - RNA, 20 nt, Salmonella enterica enterica serovar Typhi
ucuucuccgccugcgguuua

SEQ ID NO: 3670431 - RNA, 15 nt, Salmonella enterica enterica serovar Typhi
ucuucucuucuucaa

SEQ ID NO: 3670432 - RNA, 17 nt, Salmonella enterica enterica serovar Typhi
ucuucugccuuuuuuaa

SEQ ID NO: 3670433 - RNA, 16 nt, Salmonella enterica enterica serovar Typhi
ucuucugugauuaucc

SEQ ID NO: 3670434 - RNA, 19 nt, Salmonella enterica enterica serovar Typhi
ucuucuucgcguuuuucga

SEQ ID NO: 3670435 - RNA, 15 nt, Salmonella enterica enterica serovar Typhi
ucuugauaucaucau

SEQ ID NO: 3670436 - RNA, 14 nt, Salmonella enterica enterica serovar Typhi
ucuugccacuggcc

SEQ ID NO: 3670437 - RNA, 15 nt, Salmonella enterica enterica serovar Typhi
ucuugccacuggccu

SEQ ID NO: 3670438 - RNA, 11 nt, Salmonella enterica enterica serovar Typhi
ucuugcuauca

SEQ ID NO: 3670439 - RNA, 15 nt, Salmonella enterica enterica serovar Typhi
ucuuggagagcauca

SEQ ID NO: 3670440 - RNA, 17 nt, Salmonella enterica enterica serovar Typhi
ucuuggaugauuuucuu

SEQ ID NO: 3670441 - RNA, 21 nt, Salmonella enterica enterica serovar Typhi
ucuugguuuuaucuguaauua

SEQ ID NO: 3670442 - RNA, 22 nt, Salmonella enterica enterica serovar Typhi
ucuuguagugugauccaucccu

SEQ ID NO: 3670443 - RNA, 18 nt, Salmonella enterica enterica serovar Typhi
ucuugugaguaauaauca

SEQ ID NO: 3670444 - RNA, 20 nt, Salmonella enterica enterica serovar Typhi
ucuuuaaaaucgcgcauggc

SEQ ID NO: 3670445 - RNA, 20 nt, Salmonella enterica enterica serovar Typhi
ucuuuaaaaugacucaggac

SEQ ID NO: 3670446 - RNA, 14 nt, Salmonella enterica enterica serovar Typhi
ucuuuaaauuucag

SEQ ID NO: 3670447 - RNA, 16 nt, Salmonella enterica enterica serovar Typhi
ucuuuaaauuucaggg

SEQ ID NO: 3670448 - RNA, 22 nt, Salmonella enterica enterica serovar Typhi
ucuuuaacuaauggcaauaaua

SEQ ID NO: 3670449 - RNA, 22 nt, Salmonella enterica enterica serovar Typhi
ucugacggguaguaucgcucua

SEQ ID NO: 3670450 - RNA, 17 nt, Salmonella enterica enterica serovar Typhi
ucugacugcgugagugu

SEQ ID NO: 3670451 - RNA, 23 nt, Salmonella enterica enterica serovar Typhi
ucugagaauuuggguuuauguag

SEQ ID NO: 3670452 - RNA, 14 nt, Salmonella enterica enterica serovar Typhi
ucugagaucaaaca

SEQ ID NO: 3670453 - RNA, 16 nt, Salmonella enterica enterica serovar Typhi
ucugagcgcaaacauc

SEQ ID NO: 3670454 - RNA, 15 nt, Salmonella enterica enterica serovar Typhi
ucugaguauguuagg

SEQ ID NO: 3670455 - RNA, 18 nt, Salmonella enterica enterica serovar Typhi
ucugauacugcuccggcg

SEQ ID NO: 3670456 - RNA, 19 nt, Salmonella enterica enterica serovar Typhi
ucugauacugcuccggcgc

SEQ ID NO: 3670457 - RNA, 20 nt, Salmonella enterica enterica serovar Typhi
ucugauagcccuauucguga

SEQ ID NO: 3670458 - RNA, 21 nt, Salmonella enterica enterica serovar Typhi
ucugauagggacacauuucuu

SEQ ID NO: 3670459 - RNA, 14 nt, Salmonella enterica enterica serovar Typhi
ucugaugccugaag

SEQ ID NO: 3670460 - RNA, 15 nt, Salmonella enterica enterica serovar Typhi
ucugauucaguaaga

SEQ ID NO: 3670461 - RNA, 20 nt, Salmonella enterica enterica serovar Typhi
ucugauuucgacgauaaaaa

SEQ ID NO: 3670462 - RNA, 17 nt, Salmonella enterica enterica serovar Typhi
ucugcaaaauauauaau

SEQ ID NO: 3670463 - RNA, 16 nt, Salmonella enterica enterica serovar Typhi
ucugcaagagaaauaa

SEQ ID NO: 3670464 - RNA, 17 nt, Salmonella enterica enterica serovar Typhi
ucugcaguauuaccgaa

SEQ ID NO: 3670465 - RNA, 22 nt, Salmonella enterica enterica serovar Typhi
ucugccagcgcccuauccagcg

SEQ ID NO: 3670466 - RNA, 17 nt, Salmonella enterica enterica serovar Typhi
ucugccaguagcugcuc

SEQ ID NO: 3670467 - RNA, 16 nt, Salmonella enterica enterica serovar Typhi
ucugccauuucugcuc

SEQ ID NO: 3670468 - RNA, 22 nt, Salmonella enterica enterica serovar Typhi
ucugccucagcaagaaguuccg

SEQ ID NO: 3670469 - RNA, 15 nt, Salmonella enterica enterica serovar Typhi
ucugccugcagaccc

SEQ ID NO: 3670470 - RNA, 16 nt, Salmonella enterica enterica serovar Typhi
ucugccuuuaacaaau

SEQ ID NO: 3670471 - RNA, 15 nt, Salmonella enterica enterica serovar Typhi
ucugcgcaacuggaa

SEQ ID NO: 3670472 - RNA, 14 nt, Salmonella enterica enterica serovar Typhi
ucugcgccaccagc

SEQ ID NO: 3670473 - RNA, 22 nt, Salmonella enterica enterica serovar Typhi
ucugcgccagccagcucaccag

SEQ ID NO: 3670474 - RNA, 18 nt, Salmonella enterica enterica serovar Typhi
ucugcgccgcuugugccg

SEQ ID NO: 3670475 - RNA, 20 nt, Salmonella enterica enterica serovar Typhi
ucugcgcgccgcaggccgga

SEQ ID NO: 3670476 - RNA, 14 nt, Salmonella enterica enterica serovar Typhi
ucugcgcuaagcgu

SEQ ID NO: 3670477 - RNA, 18 nt, Salmonella enterica enterica serovar Typhi
ucugcgggacgcaucauc

SEQ ID NO: 3670478 - RNA, 13 nt, Salmonella enterica enterica serovar Typhi
ucugcgugaagac

SEQ ID NO: 3670479 - RNA, 21 nt, Salmonella enterica enterica serovar Typhi
ucugcgugacgccaagcagcg

SEQ ID NO: 3670480 - RNA, 19 nt, Salmonella enterica enterica serovar Typhi
ucugcgugaugcaucagaa

SEQ ID NO: 3670481 - RNA, 13 nt, Salmonella enterica enterica serovar Typhi
ucugcguugcgcg

SEQ ID NO: 3670482 - RNA, 13 nt, Salmonella enterica enterica serovar Typhi
ucugcuccgccag

SEQ ID NO: 3670483 - RNA, 14 nt, Salmonella enterica enterica serovar Typhi
ucugcuccgccagc

SEQ ID NO: 3670484 - RNA, 15 nt, Salmonella enterica enterica serovar Typhi
ucugcuccgccagca

SEQ ID NO: 3670485 - RNA, 22 nt, Salmonella enterica enterica serovar Typhi
ucugcuccgcgccgaaauuuuc

SEQ ID NO: 3670486 - RNA, 16 nt, Salmonella enterica enterica serovar Typhi
ucugcugaaaugccug

SEQ ID NO: 3670487 - RNA, 15 nt, Salmonella enterica enterica serovar Typhi
ucugcugauaauacu

SEQ ID NO: 3670488 - RNA, 14 nt, Salmonella enterica enterica serovar Typhi
ucugcugccagcgc

SEQ ID NO: 3670489 - RNA, 16 nt, Salmonella enterica enterica serovar Typhi
ucugcuguuccuucag

SEQ ID NO: 3670490 - RNA, 20 nt, Salmonella enterica enterica serovar Typhi
ucugcuuaugaucgcccagc

SEQ ID NO: 3670491 - RNA, 14 nt, Salmonella enterica enterica serovar Typhi
ucugcuuccagaau

SEQ ID NO: 3670492 - RNA, 18 nt, Salmonella enterica enterica serovar Typhi
ucugcuugagcaggcaga

SEQ ID NO: 3670493 - RNA, 19 nt, Salmonella enterica enterica serovar Typhi
ucuggaaagcgccucgcaa

SEQ ID NO: 3670494 - RNA, 19 nt, Salmonella enterica enterica serovar Typhi
ucuggaaucaauuucccuu

SEQ ID NO: 3670495 - RNA, 13 nt, Salmonella enterica enterica serovar Typhi
ucuggacaugucc

SEQ ID NO: 3670496 - RNA, 19 nt, Salmonella enterica enterica serovar Typhi
ucuggacgggccgccaucu

SEQ ID NO: 3670497 - RNA, 18 nt, Salmonella enterica enterica serovar Typhi
ucuggauagcgguuugca

SEQ ID NO: 3670498 - RNA, 13 nt, Salmonella enterica enterica serovar Typhi
ucuggcaauaagg

SEQ ID NO: 3670499 - RNA, 15 nt, Salmonella enterica enterica serovar Typhi
ucuggcacagggcaa

SEQ ID NO: 3670500 - RNA, 22 nt, Salmonella enterica enterica serovar Typhi
ucuggcccugacgaaauucgcc

SEQ ID NO: 3670501 - RNA, 17 nt, Salmonella enterica enterica serovar Typhi
ucuggccgucuggcgug

SEQ ID NO: 3670502 - RNA, 15 nt, Salmonella enterica enterica serovar Typhi
ucuggccucuuauca

SEQ ID NO: 3670503 - RNA, 20 nt, Salmonella enterica enterica serovar Typhi
ucuggcgaacgacucacgcg

SEQ ID NO: 3670504 - RNA, 18 nt, Salmonella enterica enterica serovar Typhi
ucuggcgacuaaccagcg

SEQ ID NO: 3670505 - RNA, 14 nt, Salmonella enterica enterica serovar Typhi
ucuggcgagaacac

SEQ ID NO: 3670506 - RNA, 20 nt, Salmonella enterica enterica serovar Typhi
ucuggcgugccgggcuggcg

SEQ ID NO: 3670507 - RNA, 13 nt, Salmonella enterica enterica serovar Typhi
ucuggcucccgca

SEQ ID NO: 3670508 - RNA, 13 nt, Salmonella enterica enterica serovar Typhi
ucuggcugcugau

SEQ ID NO: 3670509 - RNA, 17 nt, Salmonella enterica enterica serovar Typhi
ucuggguuugcagcaga

SEQ ID NO: 3670510 - RNA, 16 nt, Salmonella enterica enterica serovar Typhi
ucugguacauacuguu

SEQ ID NO: 3670511 - RNA, 15 nt, Salmonella enterica enterica serovar Typhi
ucugguaucgagugg

SEQ ID NO: 3670512 - RNA, 14 nt, Salmonella enterica enterica serovar Typhi
ucuggucaaguauu

SEQ ID NO: 3670513 - RNA, 22 nt, Salmonella enterica enterica serovar Typhi
ucuggucauggcuuagcgccag

SEQ ID NO: 3670514 - RNA, 21 nt, Salmonella enterica enterica serovar Typhi
ucuggugcuguuuagccgucu

SEQ ID NO: 3670515 - RNA, 14 nt, Salmonella enterica enterica serovar Typhi
ucugguuauccacc

SEQ ID NO: 3670516 - RNA, 15 nt, Salmonella enterica enterica serovar Typhi
ucuguaccaccagaa

SEQ ID NO: 3670517 - RNA, 13 nt, Salmonella enterica enterica serovar Typhi
ucuguaggccgga

SEQ ID NO: 3670518 - RNA, 20 nt, Salmonella enterica enterica serovar Typhi
ucuguaggccggauaagcgg

SEQ ID NO: 3670519 - RNA, 21 nt, Salmonella enterica enterica serovar Typhi
ucuguaggucggauaaggcgu

SEQ ID NO: 3670520 - RNA, 17 nt, Salmonella enterica enterica serovar Typhi
ucuguaugacaacauaa

SEQ ID NO: 3670521 - RNA, 18 nt, Salmonella enterica enterica serovar Typhi
ucugucgccaugaccugg

SEQ ID NO: 3670522 - RNA, 18 nt, Salmonella enterica enterica serovar Typhi
ucugucucaauaaaaugu

SEQ ID NO: 3670523 - RNA, 14 nt, Salmonella enterica enterica serovar Typhi
ucugucugacgacc

SEQ ID NO: 3670524 - RNA, 16 nt, Salmonella enterica enterica serovar Typhi
ucugugaaaguuucag

SEQ ID NO: 3670525 - RNA, 18 nt, Salmonella enterica enterica serovar Typhi
ucugugaaaguuucagga

SEQ ID NO: 3670526 - RNA, 19 nt, Salmonella enterica enterica serovar Typhi
ucugugaaaguuucaggau

SEQ ID NO: 3670527 - RNA, 16 nt, Salmonella enterica enterica serovar Typhi
ucugugagugcgccag

SEQ ID NO: 3670528 - RNA, 13 nt, Salmonella enterica enterica serovar Typhi
ucugugaugaugc

SEQ ID NO: 3670529 - RNA, 15 nt, Salmonella enterica enterica serovar Typhi
ucugugauuauccca

SEQ ID NO: 3670530 - RNA, 17 nt, Salmonella enterica enterica serovar Typhi
ucugugccagcccaaua

SEQ ID NO: 3670531 - RNA, 23 nt, Salmonella enterica enterica serovar Typhi
ucuguggccgcgcauguuugccu

SEQ ID NO: 3670532 - RNA, 22 nt, Salmonella enterica enterica serovar Typhi
ucuguuaaaaaauuuauaacgu

SEQ ID NO: 3670533 - RNA, 14 nt, Salmonella enterica enterica serovar Typhi
ucuguuauauauuu

SEQ ID NO: 3670534 - RNA, 23 nt, Salmonella enterica enterica serovar Typhi
ucuguuaucaggcguagagaggc

SEQ ID NO: 3670535 - RNA, 18 nt, Salmonella enterica enterica serovar Typhi
ucuauucguucucugaau

SEQ ID NO: 3670536 - RNA, 15 nt, Salmonella enterica enterica serovar Typhi
ucuauuucauaauaa

SEQ ID NO: 3670537 - RNA, 17 nt, Salmonella enterica enterica serovar Typhi
ucucaaacacuucuaaa

SEQ ID NO: 3670538 - RNA, 16 nt, Salmonella enterica enterica serovar Typhi
ucucaaaggccugcau

SEQ ID NO: 3670539 - RNA, 16 nt, Salmonella enterica enterica serovar Typhi
ucucaccgaccugccu

SEQ ID NO: 3670540 - RNA, 14 nt, Salmonella enterica enterica serovar Typhi
ucucagauaauagc

SEQ ID NO: 3670541 - RNA, 18 nt, Salmonella enterica enterica serovar Typhi
ucucagauggaaaaaaag

SEQ ID NO: 3670542 - RNA, 16 nt, Salmonella enterica enterica serovar Typhi
ucucagguucgaaucc

SEQ ID NO: 3670543 - RNA, 19 nt, Salmonella enterica enterica serovar Typhi
ucucauaaaacauuccuga

SEQ ID NO: 3670544 - RNA, 22 nt, Salmonella enterica enterica serovar Typhi
ucucauaaaacauuccugacau

SEQ ID NO: 3670545 - RNA, 18 nt, Salmonella enterica enterica serovar Typhi
ucucauaaacgccuggag

SEQ ID NO: 3670546 - RNA, 12 nt, Salmonella enterica enterica serovar Typhi
ucucaucaaaaa

SEQ ID NO: 3670547 - RNA, 13 nt, Salmonella enterica enterica serovar Typhi
ucucauccgccaa

SEQ ID NO: 3670548 - RNA, 16 nt, Salmonella enterica enterica serovar Typhi
ucucauccgccaaaac

SEQ ID NO: 3670549 - RNA, 16 nt, Salmonella enterica enterica serovar Typhi
ucucaucugaugauua

SEQ ID NO: 3670550 - RNA, 22 nt, Salmonella enterica enterica serovar Typhi
ucucaucugcaaaauauauaau

SEQ ID NO: 3670551 - RNA, 16 nt, Salmonella enterica enterica serovar Typhi
ucucaugcaacuggca

SEQ ID NO: 3670552 - RNA, 18 nt, Salmonella enterica enterica serovar Typhi
ucucauuuucuuuacgcu

SEQ ID NO: 3670553 - RNA, 22 nt, Salmonella enterica enterica serovar Typhi
ucuccagggcaacggccagcgc

SEQ ID NO: 3670554 - RNA, 15 nt, Salmonella enterica enterica serovar Typhi
ucuccaguaucagcg

SEQ ID NO: 3670555 - RNA, 17 nt, Salmonella enterica enterica serovar Typhi
ucucccaaaugaaaaau

SEQ ID NO: 3670556 - RNA, 20 nt, Salmonella enterica enterica serovar Typhi
ucucccagccgggcaggaaa

SEQ ID NO: 3670557 - RNA, 15 nt, Salmonella enterica enterica serovar Typhi
ucucccagcugagcu

SEQ ID NO: 3670558 - RNA, 22 nt, Salmonella enterica enterica serovar Typhi
ucuccccaucugaacucuucca

SEQ ID NO: 3670559 - RNA, 23 nt, Salmonella enterica enterica serovar Typhi
ucucccgacaccagccguucacc

SEQ ID NO: 3670560 - RNA, 18 nt, Salmonella enterica enterica serovar Typhi
ucucccgaucuucugaug

SEQ ID NO: 3670561 - RNA, 13 nt, Salmonella enterica enterica serovar Typhi
ucucccgggccgc

SEQ ID NO: 3670562 - RNA, 20 nt, Salmonella enterica enterica serovar Typhi
ucucccguuuguauaaauua

SEQ ID NO: 3670563 - RNA, 19 nt, Salmonella enterica enterica serovar Typhi
ucuccgacauuguucuaaa

SEQ ID NO: 3670564 - RNA, 21 nt, Salmonella enterica enterica serovar Typhi
ucuccggcacauucaccacgc

SEQ ID NO: 3670565 - RNA, 23 nt, Salmonella enterica enterica serovar Typhi
ucuccggcagcguauugagcugg

SEQ ID NO: 3670566 - RNA, 14 nt, Salmonella enterica enterica serovar Typhi
ucuccggcaucuca

SEQ ID NO: 3670567 - RNA, 20 nt, Salmonella enterica enterica serovar Typhi
ucuccgggauagcaaucucg

SEQ ID NO: 3670568 - RNA, 15 nt, Salmonella enterica enterica serovar Typhi
ucuccgguaaucacc

SEQ ID NO: 3670569 - RNA, 18 nt, Salmonella enterica enterica serovar Typhi
ucuccgucucucauuuuc

SEQ ID NO: 3670570 - RNA, 17 nt, Salmonella enterica enterica serovar Typhi
ucuccucgccagcuacc

SEQ ID NO: 3670571 - RNA, 17 nt, Salmonella enterica enterica serovar Typhi
ucuccucuucaguaagc

SEQ ID NO: 3670572 - RNA, 17 nt, Salmonella enterica enterica serovar Typhi
ucuccugaacgcccggc

SEQ ID NO: 3670573 - RNA, 18 nt, Salmonella enterica enterica serovar Typhi
ucuccugaagccagugcc

SEQ ID NO: 3670574 - RNA, 14 nt, Salmonella enterica enterica serovar Typhi
ucuccugccagcga

SEQ ID NO: 3670575 - RNA, 21 nt, Salmonella enterica enterica serovar Typhi
ucuccugcgauagcugcugac

SEQ ID NO: 3670576 - RNA, 15 nt, Salmonella enterica enterica serovar Typhi
ucuccugcgccagcc

SEQ ID NO: 3670577 - RNA, 16 nt, Salmonella enterica enterica serovar Typhi
ucuccuguaaugaggc

SEQ ID NO: 3670578 - RNA, 21 nt, Salmonella enterica enterica serovar Typhi
ucuccuguaaugaggcaaauc

SEQ ID NO: 3670579 - RNA, 18 nt, Salmonella enterica enterica serovar Typhi
ucuccuugagugguuuau

SEQ ID NO: 3670580 - RNA, 13 nt, Salmonella enterica enterica serovar Typhi
ucucgcacaucau

SEQ ID NO: 3670581 - RNA, 21 nt, Salmonella enterica enterica serovar Typhi
ucucgcuauauacccccugca

SEQ ID NO: 3670582 - RNA, 14 nt, Salmonella enterica enterica serovar Typhi
ucucgcucuuccag

SEQ ID NO: 3670583 - RNA, 12 nt, Salmonella enterica enterica serovar Typhi
ucucgucaaggu

SEQ ID NO: 3670584 - RNA, 21 nt, Salmonella enterica enterica serovar Typhi
ucucgugccaguaacguucuu

SEQ ID NO: 3670585 - RNA, 21 nt, Salmonella enterica enterica serovar Typhi
ucucguuuuugucuccucaug

SEQ ID NO: 3670586 - RNA, 14 nt, Salmonella enterica enterica serovar Typhi
ucucuacgccggcg

SEQ ID NO: 3670587 - RNA, 12 nt, Salmonella enterica enterica serovar Typhi
ucucuauugauu

SEQ ID NO: 3670588 - RNA, 14 nt, Salmonella enterica enterica serovar Typhi
ucucucauccgcca

SEQ ID NO: 3670589 - RNA, 15 nt, Salmonella enterica enterica serovar Typhi
ucucucauuuucuuu

SEQ ID NO: 3670590 - RNA, 14 nt, Salmonella enterica enterica serovar Typhi
ucucucccuggcag

SEQ ID NO: 3670591 - RNA, 20 nt, Salmonella enterica enterica serovar Typhi
ucucucucguucccgccugc

SEQ ID NO: 3670592 - RNA, 20 nt, Salmonella enterica enterica serovar Typhi
ucucugaaaagaguagucuu

SEQ ID NO: 3670593 - RNA, 15 nt, Salmonella enterica enterica serovar Typhi
ucucugacaggaaug

SEQ ID NO: 3670594 - RNA, 15 nt, Salmonella enterica enterica serovar Typhi
ucucugagaucaaac

SEQ ID NO: 3670595 - RNA, 15 nt, Salmonella enterica enterica serovar Typhi
ucucugccaucaucc

SEQ ID NO: 3670596 - RNA, 20 nt, Salmonella enterica enterica serovar Typhi
ucucuggcgcgggcuucacg

SEQ ID NO: 3670597 - RNA, 19 nt, Salmonella enterica enterica serovar Typhi
ucucuguccggaauaacuc

SEQ ID NO: 3670598 - RNA, 19 nt, Salmonella enterica enterica serovar Typhi
ucucuuacguugcauuuau

SEQ ID NO: 3670599 - RNA, 16 nt, Salmonella enterica enterica serovar Typhi
ucucuucaauaacgaa

SEQ ID NO: 3670600 - RNA, 21 nt, Salmonella enterica enterica serovar Typhi
ucucuucaugcauaaccgcgc

SEQ ID NO: 3670601 - RNA, 16 nt, Salmonella enterica enterica serovar Typhi
ucucuuccgcccagau

SEQ ID NO: 3670602 - RNA, 14 nt, Salmonella enterica enterica serovar Typhi
ucucuuccgcgguc

SEQ ID NO: 3670603 - RNA, 17 nt, Salmonella enterica enterica serovar Typhi
ucucuucgacaucuuca

SEQ ID NO: 3670604 - RNA, 14 nt, Salmonella enterica enterica serovar Typhi
ucucuucuuuuaca

SEQ ID NO: 3670605 - RNA, 20 nt, Salmonella enterica enterica serovar Typhi
ucucuugcagacagcgccug

SEQ ID NO: 3670606 - RNA, 17 nt, Salmonella enterica enterica serovar Typhi
ucucuugcauaauaucc

SEQ ID NO: 3670607 - RNA, 14 nt, Salmonella enterica enterica serovar Typhi
ucucuugccagcgc

SEQ ID NO: 3670608 - RNA, 12 nt, Salmonella enterica enterica serovar Typhi
ucucuugccugc

SEQ ID NO: 3670609 - RNA, 15 nt, Salmonella enterica enterica serovar Typhi
ucucuugugcuucca

SEQ ID NO: 3670610 - RNA, 14 nt, Salmonella enterica enterica serovar Typhi
ucucuuuagcgcua

SEQ ID NO: 3670611 - RNA, 12 nt, Salmonella enterica enterica serovar Typhi
ucucuuuauuga

SEQ ID NO: 3670612 - RNA, 13 nt, Salmonella enterica enterica serovar Typhi
ucucuuuauugaa

SEQ ID NO: 3670613 - RNA, 13 nt, Salmonella enterica enterica serovar Typhi
ucucuuuuaauuu

SEQ ID NO: 3670614 - RNA, 18 nt, Salmonella enterica enterica serovar Typhi
ucucuuuuugcagcagcg

SEQ ID NO: 3670615 - RNA, 13 nt, Salmonella enterica enterica serovar Typhi
ucugaaacgcuuc

SEQ ID NO: 3670616 - RNA, 22 nt, Salmonella enterica enterica serovar Typhi
ucugaaaguaagcuauuccugu

SEQ ID NO: 3670617 - RNA, 12 nt, Salmonella enterica enterica serovar Typhi
ucugaaaugcuc

SEQ ID NO: 3670618 - RNA, 16 nt, Salmonella enterica enterica serovar Typhi
ucugaaucucuuccca

SEQ ID NO: 3670619 - RNA, 13 nt, Salmonella enterica enterica serovar Typhi
ucugaaugguucc

SEQ ID NO: 3670620 - RNA, 17 nt, Salmonella enterica enterica serovar Typhi
ucugacaggucggcguu

SEQ ID NO: 3670621 - RNA, 22 nt, Salmonella enterica enterica serovar Typhi
gcguagucucccuccugcucca

SEQ ID NO: 3670622 - RNA, 15 nt, Salmonella enterica enterica serovar Typhi
gcguauagccaggca

SEQ ID NO: 3670623 - RNA, 17 nt, Salmonella enterica enterica serovar Typhi
gcguauagccaggcaga

SEQ ID NO: 3670624 - RNA, 23 nt, Salmonella enterica enterica serovar Typhi
gcguauccauucucaucagaccg

SEQ ID NO: 3670625 - RNA, 19 nt, Salmonella enterica enterica serovar Typhi
gcguaucucauugaugguc

SEQ ID NO: 3670626 - RNA, 23 nt, Salmonella enterica enterica serovar Typhi
gcguaucucgcgguugacgcugc

SEQ ID NO: 3670627 - RNA, 18 nt, Salmonella enterica enterica serovar Typhi
gcguauucucaaccagcc

SEQ ID NO: 3670628 - RNA, 22 nt, Salmonella enterica enterica serovar Typhi
gcguauucucaaccagccgauc

SEQ ID NO: 3670629 - RNA, 12 nt, Salmonella enterica enterica serovar Typhi
gcguauuucacc

SEQ ID NO: 3670630 - RNA, 22 nt, Salmonella enterica enterica serovar Typhi
gcgucaaaaauaaaaaccgccu

SEQ ID NO: 3670631 - RNA, 14 nt, Salmonella enterica enterica serovar Typhi
gcgucaaaacuuau

SEQ ID NO: 3670632 - RNA, 20 nt, Salmonella enterica enterica serovar Typhi
gcgucaaaaucccggcuggg

SEQ ID NO: 3670633 - RNA, 17 nt, Salmonella enterica enterica serovar Typhi
gcgucaaaguugcauca

SEQ ID NO: 3670634 - RNA, 15 nt, Salmonella enterica enterica serovar Typhi
ucguccaguaaaauc

SEQ ID NO: 3670635 - RNA, 19 nt, Salmonella enterica enterica serovar Typhi
ucgucccaggccagaugcg

SEQ ID NO: 3670636 - RNA, 12 nt, Salmonella enterica enterica serovar Typhi
ucguccggugau

SEQ ID NO: 3670637 - RNA, 13 nt, Salmonella enterica enterica serovar Typhi
ucguccguugcca

SEQ ID NO: 3670638 - RNA, 23 nt, Salmonella enterica enterica serovar Typhi
ucguccguuucccaagucacgcc

SEQ ID NO: 3670639 - RNA, 12 nt, Salmonella enterica enterica serovar Typhi
ucguccugcaau

SEQ ID NO: 3670640 - RNA, 23 nt, Salmonella enterica enterica serovar Typhi
ucgucgccaccaugcugguuggg

SEQ ID NO: 3670641 - RNA, 17 nt, Salmonella enterica enterica serovar Typhi
ucgucgccuuccagcga

SEQ ID NO: 3670642 - RNA, 11 nt, Salmonella enterica enterica serovar Typhi
ucgucgcgcca

SEQ ID NO: 3670643 - RNA, 15 nt, Salmonella enterica enterica serovar Typhi
ucgucggcaagaauu

SEQ ID NO: 3670644 - RNA, 22 nt, Salmonella enterica enterica serovar Typhi
ucgucggcaagaauuucaauca

SEQ ID NO: 3670645 - RNA, 20 nt, Salmonella enterica enterica serovar Typhi
ucgucugguaucugucaugc

SEQ ID NO: 3670646 - RNA, 22 nt, Salmonella enterica enterica serovar Typhi
ucgucuguuauuugugauuuuc

SEQ ID NO: 3670647 - RNA, 20 nt, Salmonella enterica enterica serovar Typhi
ucgucuuccggauaacgcgc

SEQ ID NO: 3670648 - RNA, 23 nt, Salmonella enterica enterica serovar Typhi
ucgucuuguguggagguuucuuc

SEQ ID NO: 3670649 - RNA, 23 nt, Salmonella enterica enterica serovar Typhi
ucgugacaucaagcccacacauc

SEQ ID NO: 3670650 - RNA, 15 nt, Salmonella enterica enterica serovar Typhi
ucgugacccacacau

SEQ ID NO: 3670651 - RNA, 17 nt, Salmonella enterica enterica serovar Typhi
ucgugacccgccagcau

SEQ ID NO: 3670652 - RNA, 17 nt, Salmonella enterica enterica serovar Typhi
ucgugaggauaauccau

SEQ ID NO: 3670653 - RNA, 14 nt, Salmonella enterica enterica serovar Typhi
ucgugauagacggc

SEQ ID NO: 3670654 - RNA, 18 nt, Salmonella enterica enterica serovar Typhi
ucgugaucgccaaagcgu

SEQ ID NO: 3670655 - RNA, 23 nt, Salmonella enterica enterica serovar Typhi
ucgugcauccggacgccagugcg

SEQ ID NO: 3670656 - RNA, 23 nt, Salmonella enterica enterica serovar Typhi
ucgugccaaggcaucugcgcaac

SEQ ID NO: 3670657 - RNA, 19 nt, Salmonella enterica enterica serovar Typhi
ucgugccagugaugcgcgg

SEQ ID NO: 3670658 - RNA, 14 nt, Salmonella enterica enterica serovar Typhi
ucgugcgccccagg

SEQ ID NO: 3670659 - RNA, 19 nt, Salmonella enterica enterica serovar Typhi
ucguggcgcuguucuugcu

SEQ ID NO: 3670660 - RNA, 16 nt, Salmonella enterica enterica serovar Typhi
ucguggguucgaaucc

SEQ ID NO: 3670661 - RNA, 21 nt, Salmonella enterica enterica serovar Typhi
ucgugugcgguauagaucaga

SEQ ID NO: 3670662 - RNA, 20 nt, Salmonella enterica enterica serovar Typhi
ucguguggcggaaugaccug

SEQ ID NO: 3670663 - RNA, 19 nt, Salmonella enterica enterica serovar Typhi
ucguguuauuuucaaaaac

SEQ ID NO: 3670664 - RNA, 16 nt, Salmonella enterica enterica serovar Typhi
ucguuaaccagcggcg

SEQ ID NO: 3670665 - RNA, 14 nt, Salmonella enterica enterica serovar Typhi
ucguuaccagcauc

SEQ ID NO: 3670666 - RNA, 14 nt, Salmonella enterica enterica serovar Typhi
ucguuaccgcuuca

SEQ ID NO: 3670667 - RNA, 23 nt, Salmonella enterica enterica serovar Typhi
ucguuaccggcuccggcaaauuc

SEQ ID NO: 3670668 - RNA, 16 nt, Salmonella enterica enterica serovar Typhi
ucguuagcaaauugcu

SEQ ID NO: 3670669 - RNA, 16 nt, Salmonella enterica enterica serovar Typhi
ucguuagccagauggc

SEQ ID NO: 3670670 - RNA, 23 nt, Salmonella enterica enterica serovar Typhi
ucguuagugauacgcggcugaug

SEQ ID NO: 3670671 - RNA, 15 nt, Salmonella enterica enterica serovar Typhi
ucguuauccagcagc

SEQ ID NO: 3670672 - RNA, 13 nt, Salmonella enterica enterica serovar Typhi
ucguuauuuccga

SEQ ID NO: 3670673 - RNA, 20 nt, Salmonella enterica enterica serovar Typhi
ucguuauuuccgagaucgcc

SEQ ID NO: 3670674 - RNA, 19 nt, Salmonella enterica enterica serovar Typhi
ucguuauuuuccugaaaaa

SEQ ID NO: 3670675 - RNA, 21 nt, Salmonella enterica enterica serovar Typhi
ucguucaacggcaaaucgcgg

SEQ ID NO: 3670676 - RNA, 15 nt, Salmonella enterica enterica serovar Typhi
ucguucauccgucug

SEQ ID NO: 3670677 - RNA, 16 nt, Salmonella enterica enterica serovar Typhi
ucguucauugcuuucu

SEQ ID NO: 3670678 - RNA, 15 nt, Salmonella enterica enterica serovar Typhi
ucguucccgccugcu

SEQ ID NO: 3670679 - RNA, 16 nt, Salmonella enterica enterica serovar Typhi
ucguucccgccugcug

SEQ ID NO: 3670680 - RNA, 15 nt, Salmonella enterica enterica serovar Typhi
ucguuccgccaggcg

SEQ ID NO: 3670681 - RNA, 17 nt, Salmonella enterica enterica serovar Typhi
ucguuccgguucuuccc

SEQ ID NO: 3670682 - RNA, 22 nt, Salmonella enterica enterica serovar Typhi
ucguucgauagcguuuuccagc

SEQ ID NO: 3670683 - RNA, 14 nt, Salmonella enterica enterica serovar Typhi
ucguucgcccuuca

SEQ ID NO: 3670684 - RNA, 19 nt, Salmonella enterica enterica serovar Typhi
ucguucggucaggauacua

SEQ ID NO: 3670685 - RNA, 14 nt, Salmonella enterica enterica serovar Typhi
ucguugccagcggc

SEQ ID NO: 3670686 - RNA, 12 nt, Salmonella enterica enterica serovar Typhi
ucguugcgcgca

SEQ ID NO: 3670687 - RNA, 14 nt, Salmonella enterica enterica serovar Typhi
ucguuguccggcug

SEQ ID NO: 3670688 - RNA, 18 nt, Salmonella enterica enterica serovar Typhi
ucguuucccucauauuug

SEQ ID NO: 3670689 - RNA, 13 nt, Salmonella enterica enterica serovar Typhi
ucguuucuacaau

SEQ ID NO: 3670690 - RNA, 22 nt, Salmonella enterica enterica serovar Typhi
ucguuugcgcgcacguugggca

SEQ ID NO: 3670691 - RNA, 17 nt, Salmonella enterica enterica serovar Typhi
ucguuugcgcuacgcug

SEQ ID NO: 3670692 - RNA, 17 nt, Salmonella enterica enterica serovar Typhi
ucguuuuugucuccuca

SEQ ID NO: 3670693 - RNA, 17 nt, Salmonella enterica enterica serovar Typhi
ucguuuuuguuuaaaaa

SEQ ID NO: 3670694 - RNA, 11 nt, Salmonella enterica enterica serovar Typhi
ucuaaaaagga

SEQ ID NO: 3670695 - RNA, 23 nt, Salmonella enterica enterica serovar Typhi
ucuaaaaaggaaagggacgauga

SEQ ID NO: 3670696 - RNA, 23 nt, Salmonella enterica enterica serovar Typhi
ucuaaagagacagaaucaggcca

SEQ ID NO: 3670697 - RNA, 17 nt, Salmonella enterica enterica serovar Typhi
ucuaaaucauaccagcg

SEQ ID NO: 3670698 - RNA, 23 nt, Salmonella enterica enterica serovar Typhi
ucuaaaucuacccaauugaauuu

SEQ ID NO: 3670699 - RNA, 20 nt, Salmonella enterica enterica serovar Typhi
ucuaaaugggcaggagauga

SEQ ID NO: 3670700 - RNA, 15 nt, Salmonella enterica enterica serovar Typhi
ucuaacauaaugaau

SEQ ID NO: 3670701 - RNA, 15 nt, Salmonella enterica enterica serovar Typhi
ucuaaucgggagcag

SEQ ID NO: 3670702 - RNA, 21 nt, Salmonella enterica enterica serovar Typhi
ucuaauugacggccaccauga

SEQ ID NO: 3670703 - RNA, 20 nt, Salmonella enterica enterica serovar Typhi
ucuacaguuugucaucaguc

SEQ ID NO: 3670704 - RNA, 15 nt, Salmonella enterica enterica serovar Typhi
ucuacaucaagagaa

SEQ ID NO: 3670705 - RNA, 20 nt, Salmonella enterica enterica serovar Typhi
ucuacaugcccuucuuuaau

SEQ ID NO: 3670706 - RNA, 18 nt, Salmonella enterica enterica serovar Typhi
ucuaccacgcugccgccg

SEQ ID NO: 3670707 - RNA, 19 nt, Salmonella enterica enterica serovar Typhi
ucuaccauugauaccaaua

SEQ ID NO: 3670708 - RNA, 19 nt, Salmonella enterica enterica serovar Typhi
ucuaccgcuucgcgcgcca

SEQ ID NO: 3670709 - RNA, 22 nt, Salmonella enterica enterica serovar Typhi
ucuaccguaggccggauaagcg

SEQ ID NO: 3670710 - RNA, 14 nt, Salmonella enterica enterica serovar Typhi
ucuacggaucccuu

SEQ ID NO: 3670711 - RNA, 16 nt, Salmonella enterica enterica serovar Typhi
ucuacggccacaaaac

SEQ ID NO: 3670712 - RNA, 14 nt, Salmonella enterica enterica serovar Typhi
ucuacgguaucugc

SEQ ID NO: 3670713 - RNA, 16 nt, Salmonella enterica enterica serovar Typhi
ucuacugguuaaggau

SEQ ID NO: 3670714 - RNA, 15 nt, Salmonella enterica enterica serovar Typhi
ucuacuguuauugac

SEQ ID NO: 3670715 - RNA, 14 nt, Salmonella enterica enterica serovar Typhi
ucuacuuuccugaa

SEQ ID NO: 3670716 - RNA, 15 nt, Salmonella enterica enterica serovar Typhi
ucuacuuuccugaag

SEQ ID NO: 3670717 - RNA, 19 nt, Salmonella enterica enterica serovar Typhi
ucuagaugaugauuuauga

SEQ ID NO: 3670718 - RNA, 13 nt, Salmonella enterica enterica serovar Typhi
ucuagucgccggu

SEQ ID NO: 3670719 - RNA, 13 nt, Salmonella enterica enterica serovar Typhi
ucuauauauucuu

SEQ ID NO: 3670720 - RNA, 15 nt, Salmonella enterica enterica serovar Typhi
uagccuuuuucuuuc

SEQ ID NO: 3670721 - RNA, 20 nt, Salmonella enterica enterica serovar Typhi
uagccuuuuucuuucagacc

SEQ ID NO: 3670722 - RNA, 19 nt, Salmonella enterica enterica serovar Typhi
uagcgaaacugccuaaauu

SEQ ID NO: 3670723 - RNA, 20 nt, Salmonella enterica enterica serovar Typhi
uagcgaaacugccuaaauug

SEQ ID NO: 3670724 - RNA, 22 nt, Salmonella enterica enterica serovar Typhi
uagcgaccagcgucagccagaa

SEQ ID NO: 3670725 - RNA, 14 nt, Salmonella enterica enterica serovar Typhi
uagcgacugauaag

SEQ ID NO: 3670726 - RNA, 21 nt, Salmonella enterica enterica serovar Typhi
uagcgagucccuaauagcgcc

SEQ ID NO: 3670727 - RNA, 18 nt, Salmonella enterica enterica serovar Typhi
uagcgaucgagauaagau

SEQ ID NO: 3670728 - RNA, 13 nt, Salmonella enterica enterica serovar Typhi
uagcgaucgcgcc

SEQ ID NO: 3670729 - RNA, 17 nt, Salmonella enterica enterica serovar Typhi
uagcgcaaaagcgcgcc

SEQ ID NO: 3670730 - RNA, 20 nt, Salmonella enterica enterica serovar Typhi
uagcgcaggggggaaaugag

SEQ ID NO: 3670731 - RNA, 20 nt, Salmonella enterica enterica serovar Typhi
uagcgcauuuuuaucaggcc

SEQ ID NO: 3670732 - RNA, 15 nt, Salmonella enterica enterica serovar Typhi
uagcgccagacagau

SEQ ID NO: 3670733 - RNA, 14 nt, Salmonella enterica enterica serovar Typhi
uagcgccagcagca

SEQ ID NO: 3670734 - RNA, 16 nt, Salmonella enterica enterica serovar Typhi
uagcgccagcagcaua

SEQ ID NO: 3670735 - RNA, 14 nt, Salmonella enterica enterica serovar Typhi
uagcgccauauaaa

SEQ ID NO: 3670736 - RNA, 15 nt, Salmonella enterica enterica serovar Typhi
uagcgccaucaggca

SEQ ID NO: 3670737 - RNA, 23 nt, Salmonella enterica enterica serovar Typhi
uagcgccccggugcuuucuccug

SEQ ID NO: 3670738 - RNA, 17 nt, Salmonella enterica enterica serovar Typhi
uagcgcccuggucagca

SEQ ID NO: 3670739 - RNA, 14 nt, Salmonella enterica enterica serovar Typhi
uagcgcccuuuuuu

SEQ ID NO: 3670740 - RNA, 16 nt, Salmonella enterica enterica serovar Typhi
uagcgccuaugcuguc

SEQ ID NO: 3670741 - RNA, 22 nt, Salmonella enterica enterica serovar Typhi
uagcgccuccccuaaucgagga

SEQ ID NO: 3670742 - RNA, 12 nt, Salmonella enterica enterica serovar Typhi
uagcgccugcuc

SEQ ID NO: 3670743 - RNA, 22 nt, Salmonella enterica enterica serovar Typhi
uagcgcgaaugauuuuacgguc

SEQ ID NO: 3670744 - RNA, 23 nt, Salmonella enterica enterica serovar Typhi
uagcgcgacgccaaaccugccac

SEQ ID NO: 3670745 - RNA, 12 nt, Salmonella enterica enterica serovar Typhi
uagcgcgcugcu

SEQ ID NO: 3670746 - RNA, 15 nt, Salmonella enterica enterica serovar Typhi
uagcgcgcuuccugc

SEQ ID NO: 3670747 - RNA, 16 nt, Salmonella enterica enterica serovar Typhi
uagcgcggcagcgcgc

SEQ ID NO: 3670748 - RNA, 20 nt, Salmonella enterica enterica serovar Typhi
uagcgcuccuuuaauucguu

SEQ ID NO: 3670749 - RNA, 18 nt, Salmonella enterica enterica serovar Typhi
uagcgcugaggcgcuggc

SEQ ID NO: 3670750 - RNA, 15 nt, Salmonella enterica enterica serovar Typhi
uagcgcugaugcguu

SEQ ID NO: 3670751 - RNA, 13 nt, Salmonella enterica enterica serovar Typhi
uagcgcugcgcca

SEQ ID NO: 3670752 - RNA, 20 nt, Salmonella enterica enterica serovar Typhi
uagcgcuuacccgaccgaca

SEQ ID NO: 3670753 - RNA, 14 nt, Salmonella enterica enterica serovar Typhi
uagcgcuuuccugc

SEQ ID NO: 3670754 - RNA, 21 nt, Salmonella enterica enterica serovar Typhi
uagcggcagccaugcuauuca

SEQ ID NO: 3670755 - RNA, 18 nt, Salmonella enterica enterica serovar Typhi
uagcggcaugucugucua

SEQ ID NO: 3670756 - RNA, 13 nt, Salmonella enterica enterica serovar Typhi
uagcggcgcagac

SEQ ID NO: 3670757 - RNA, 21 nt, Salmonella enterica enterica serovar Typhi
uagcggcgccuuguccggcgu

SEQ ID NO: 3670758 - RNA, 19 nt, Salmonella enterica enterica serovar Typhi
uagcggcuaaucaccaccu

SEQ ID NO: 3670759 - RNA, 20 nt, Salmonella enterica enterica serovar Typhi
uagcggcuaaucaccaccuc

SEQ ID NO: 3670760 - RNA, 18 nt, Salmonella enterica enterica serovar Typhi
uagcgggcaaugccacca

SEQ ID NO: 3670761 - RNA, 21 nt, Salmonella enterica enterica serovar Typhi
uagcgggcuguuuuccagcgg

SEQ ID NO: 3670762 - RNA, 16 nt, Salmonella enterica enterica serovar Typhi
uagcgguaagagcguu

SEQ ID NO: 3670763 - RNA, 18 nt, Salmonella enterica enterica serovar Typhi
uagcguaaagaaaaugag

SEQ ID NO: 3670764 - RNA, 22 nt, Salmonella enterica enterica serovar Typhi
uagcguacuuucaaauagcugg

SEQ ID NO: 3670765 - RNA, 13 nt, Salmonella enterica enterica serovar Typhi
uagcgucaacgcu

SEQ ID NO: 3670766 - RNA, 18 nt, Salmonella enterica enterica serovar Typhi
uagcgucaacgcuuuuau

SEQ ID NO: 3670767 - RNA, 12 nt, Salmonella enterica enterica serovar Typhi
uagcgugccauu

SEQ ID NO: 3670768 - RNA, 13 nt, Salmonella enterica enterica serovar Typhi
uagcguucugguu

SEQ ID NO: 3670769 - RNA, 19 nt, Salmonella enterica enterica serovar Typhi
uagcguuuaaaaagcugca

SEQ ID NO: 3670770 - RNA, 16 nt, Salmonella enterica enterica serovar Typhi
uagcguuucgaacucu

SEQ ID NO: 3670771 - RNA, 23 nt, Salmonella enterica enterica serovar Typhi
uagcguuucgaacucuucgcaac

SEQ ID NO: 3670772 - RNA, 16 nt, Salmonella enterica enterica serovar Typhi
uagcguuuuauccguu

SEQ ID NO: 3670773 - RNA, 13 nt, Salmonella enterica enterica serovar Typhi
uagcguuuuccag

SEQ ID NO: 3670774 - RNA, 14 nt, Salmonella enterica enterica serovar Typhi
uagcguuuuccagc

SEQ ID NO: 3670775 - RNA, 13 nt, Salmonella enterica enterica serovar Typhi
uagcuaauggcuu

SEQ ID NO: 3670776 - RNA, 19 nt, Salmonella enterica enterica serovar Typhi
uagcuaucacacauaucgc

SEQ ID NO: 3670777 - RNA, 12 nt, Salmonella enterica enterica serovar Typhi
uagcuaugguca

SEQ ID NO: 3670778 - RNA, 13 nt, Salmonella enterica enterica serovar Typhi
uagcucagcgcgg

SEQ ID NO: 3670779 - RNA, 22 nt, Salmonella enterica enterica serovar Typhi
uagcucaguugguagagcccug

SEQ ID NO: 3670780 - RNA, 20 nt, Salmonella enterica enterica serovar Typhi
uagcuccgaauaauccuucc

SEQ ID NO: 3670781 - RNA, 16 nt, Salmonella enterica enterica serovar Typhi
uagcucgucuguuuug

SEQ ID NO: 3670782 - RNA, 21 nt, Salmonella enterica enterica serovar Typhi
uagcucuuucauuucugccug

SEQ ID NO: 3670783 - RNA, 22 nt, Salmonella enterica enterica serovar Typhi
uagcucuuucauuucugccugc

SEQ ID NO: 3670784 - RNA, 16 nt, Salmonella enterica enterica serovar Typhi
uagcugcggcucgcca

SEQ ID NO: 3670785 - RNA, 21 nt, Salmonella enterica enterica serovar Typhi
uagcugcuguaaguuuccguc

SEQ ID NO: 3670786 - RNA, 20 nt, Salmonella enterica enterica serovar Typhi
uagcuguaauucaugcugua

SEQ ID NO: 3670787 - RNA, 21 nt, Salmonella enterica enterica serovar Typhi
uagcuguaccagaucgccugc

SEQ ID NO: 3670788 - RNA, 12 nt, Salmonella enterica enterica serovar Typhi
uagcuguucaau

SEQ ID NO: 3670789 - RNA, 22 nt, Salmonella enterica enterica serovar Typhi
uagcuguuguuuaauggcuaac

SEQ ID NO: 3670790 - RNA, 16 nt, Salmonella enterica enterica serovar Typhi
uagcuuacuuucagau

SEQ ID NO: 3670791 - RNA, 15 nt, Salmonella enterica enterica serovar Typhi
uagcuuagcugcgca

SEQ ID NO: 3670792 - RNA, 20 nt, Salmonella enterica enterica serovar Typhi
uagcuuaucgccaaagauau

SEQ ID NO: 3670793 - RNA, 18 nt, Salmonella enterica enterica serovar Typhi
uagcuuaucgggccuacc

SEQ ID NO: 3670794 - RNA, 14 nt, Salmonella enterica enterica serovar Typhi
uagcuucagcggcg

SEQ ID NO: 3670795 - RNA, 14 nt, Salmonella enterica enterica serovar Typhi
uagcuucugucugc

SEQ ID NO: 3670796 - RNA, 17 nt, Salmonella enterica enterica serovar Typhi
uagcuuuuccgcuggaa

SEQ ID NO: 3670797 - RNA, 13 nt, Salmonella enterica enterica serovar Typhi
uagcuuuuuuaug

SEQ ID NO: 3670798 - RNA, 12 nt, Salmonella enterica enterica serovar Typhi
uaggauaaaauc

SEQ ID NO: 3670799 - RNA, 15 nt, Salmonella enterica enterica serovar Typhi
uaggauaaaaucgcg

SEQ ID NO: 3670800 - RNA, 13 nt, Salmonella enterica enterica serovar Typhi
uaggccaaacuua

SEQ ID NO: 3670801 - RNA, 17 nt, Salmonella enterica enterica serovar Typhi
uaggccagccgacgcuc

SEQ ID NO: 3670802 - RNA, 21 nt, Salmonella enterica enterica serovar Typhi
uaggccagccgacgcucuucc

SEQ ID NO: 3670803 - RNA, 19 nt, Salmonella enterica enterica serovar Typhi
uaggcccgguaagcgcagc

SEQ ID NO: 3670804 - RNA, 22 nt, Salmonella enterica enterica serovar Typhi
uaggcccgguaagcgcagcgcc

SEQ ID NO: 3670805 - RNA, 20 nt, Salmonella enterica enterica serovar Typhi
uaggcccgguaagcgcuagc

SEQ ID NO: 3670806 - RNA, 12 nt, Salmonella enterica enterica serovar Typhi
uauaaaucaaua

SEQ ID NO: 3670807 - RNA, 22 nt, Salmonella enterica enterica serovar Typhi
uauaaauuuauuuuuugcuggg

SEQ ID NO: 3670808 - RNA, 15 nt, Salmonella enterica enterica serovar Typhi
uauaaccacgaaaau

SEQ ID NO: 3670809 - RNA, 21 nt, Salmonella enterica enterica serovar Typhi
uauaacccugucugcgcaacg

SEQ ID NO: 3670810 - RNA, 19 nt, Salmonella enterica enterica serovar Typhi
uauaacgaugauuauuguu

SEQ ID NO: 3670811 - RNA, 20 nt, Salmonella enterica enterica serovar Typhi
uauaacuaaacucaucuuua

SEQ ID NO: 3670812 - RNA, 19 nt, Salmonella enterica enterica serovar Typhi
uauaacucuuaauuauaaa

SEQ ID NO: 3670813 - RNA, 13 nt, Salmonella enterica enterica serovar Typhi
uauaacuugcaaa

SEQ ID NO: 3670814 - RNA, 15 nt, Salmonella enterica enterica serovar Typhi
uauaacuuucaauau

SEQ ID NO: 3670815 - RNA, 19 nt, Salmonella enterica enterica serovar Typhi
uauaagcgguauucagguu

SEQ ID NO: 3670816 - RNA, 17 nt, Salmonella enterica enterica serovar Typhi
uauaagcugccucuuug

SEQ ID NO: 3670817 - RNA, 20 nt, Salmonella enterica enterica serovar Typhi
uauaauuaacauuuaagaaa

SEQ ID NO: 3670818 - RNA, 18 nt, Salmonella enterica enterica serovar Typhi
uauaauuaagaccauacu

SEQ ID NO: 3670819 - RNA, 14 nt, Salmonella enterica enterica serovar Typhi
uauaauuauuuguu

SEQ ID NO: 3670820 - RNA, 19 nt, Salmonella enterica enterica serovar Typhi
uauaauucgucaauaccua

SEQ ID NO: 3670821 - RNA, 17 nt, Salmonella enterica enterica serovar Typhi
uauaauuuuauuauauu

SEQ ID NO: 3670822 - RNA, 16 nt, Salmonella enterica enterica serovar Typhi
uauacacucaaccauc

SEQ ID NO: 3670823 - RNA, 13 nt, Salmonella enterica enterica serovar Typhi
uauacauucauuu

SEQ ID NO: 3670824 - RNA, 16 nt, Salmonella enterica enterica serovar Typhi
uauacauucauuuuau

SEQ ID NO: 3670825 - RNA, 21 nt, Salmonella enterica enterica serovar Typhi
uauaccaugcugccauuuuau

SEQ ID NO: 3670826 - RNA, 18 nt, Salmonella enterica enterica serovar Typhi
uauaccgcuuuaugcgcu

SEQ ID NO: 3670827 - RNA, 23 nt, Salmonella enterica enterica serovar Typhi
uauaccgucaguaccagcgagau

SEQ ID NO: 3670828 - RNA, 15 nt, Salmonella enterica enterica serovar Typhi
uauaccguuuggcga

SEQ ID NO: 3670829 - RNA, 14 nt, Salmonella enterica enterica serovar Typhi
uauacuccagcaga

SEQ ID NO: 3670830 - RNA, 13 nt, Salmonella enterica enterica serovar Typhi
uauacugauaaac

SEQ ID NO: 3670831 - RNA, 11 nt, Salmonella enterica enterica serovar Typhi
uauacugucuu

SEQ ID NO: 3670832 - RNA, 13 nt, Salmonella enterica enterica serovar Typhi
uauacugugacga

SEQ ID NO: 3670833 - RNA, 15 nt, Salmonella enterica enterica serovar Typhi
uauacuuauugaucc

SEQ ID NO: 3670834 - RNA, 13 nt, Salmonella enterica enterica serovar Typhi
uauacuucaucag

SEQ ID NO: 3670835 - RNA, 16 nt, Salmonella enterica enterica serovar Typhi
uauagaauacuuccug

SEQ ID NO: 3670836 - RNA, 15 nt, Salmonella enterica enterica serovar Typhi
uauagacaccuuaua

SEQ ID NO: 3670837 - RNA, 21 nt, Salmonella enterica enterica serovar Typhi
uauagacgccggucaugccau

SEQ ID NO: 3670838 - RNA, 18 nt, Salmonella enterica enterica serovar Typhi
uauagaugucagauccuu

SEQ ID NO: 3670839 - RNA, 14 nt, Salmonella enterica enterica serovar Typhi
uauagcaaacccuc

SEQ ID NO: 3670840 - RNA, 16 nt, Salmonella enterica enterica serovar Typhi
uauagcaacuuaauaa

SEQ ID NO: 3670841 - RNA, 22 nt, Salmonella enterica enterica serovar Typhi
uauagcagucaggaagaccguu

SEQ ID NO: 3670842 - RNA, 13 nt, Salmonella enterica enterica serovar Typhi
uauagccaggcag

SEQ ID NO: 3670843 - RNA, 15 nt, Salmonella enterica enterica serovar Typhi
uauagccauuuuuug

SEQ ID NO: 3670844 - RNA, 13 nt, Salmonella enterica enterica serovar Typhi
uauagcccacgca

SEQ ID NO: 3670845 - RNA, 15 nt, Salmonella enterica enterica serovar Typhi
uauaggcauguuccu

SEQ ID NO: 3670846 - RNA, 12 nt, Salmonella enterica enterica serovar Typhi
uauaggccaggc

SEQ ID NO: 3670847 - RNA, 20 nt, Salmonella enterica enterica serovar Typhi
uauaggccugauaaacguag

SEQ ID NO: 3670848 - RNA, 14 nt, Salmonella enterica enterica serovar Typhi
uauaggggccaagc

SEQ ID NO: 3670849 - RNA, 21 nt, Salmonella enterica enterica serovar Typhi
uauaguacgauagcaauuaau

SEQ ID NO: 3670850 - RNA, 19 nt, Salmonella enterica enterica serovar Typhi
uauaguccacuuucuguaa

SEQ ID NO: 3670851 - RNA, 14 nt, Salmonella enterica enterica serovar Typhi
uauagucuuaauuu

SEQ ID NO: 3670852 - RNA, 22 nt, Salmonella enterica enterica serovar Typhi
uauaguucgcauagaauuucag

SEQ ID NO: 3670853 - RNA, 12 nt, Salmonella enterica enterica serovar Typhi
uauauaaaaaua

SEQ ID NO: 3670854 - RNA, 12 nt, Salmonella enterica enterica serovar Typhi
uauauaauucau

SEQ ID NO: 3670855 - RNA, 15 nt, Salmonella enterica enterica serovar Typhi
uauauauuuucucaa

SEQ ID NO: 3670856 - RNA, 18 nt, Salmonella enterica enterica serovar Typhi
uauaucaugggaaaucac

SEQ ID NO: 3670857 - RNA, 21 nt, Salmonella enterica enterica serovar Typhi
uauaugaaaucgccuguuaau

SEQ ID NO: 3670858 - RNA, 16 nt, Salmonella enterica enterica serovar Typhi
uauaugacaacacuca

SEQ ID NO: 3670859 - RNA, 14 nt, Salmonella enterica enterica serovar Typhi
uauaugagcgggcc

SEQ ID NO: 3670860 - RNA, 17 nt, Salmonella enterica enterica serovar Typhi
uauaugcaaaacuguag

SEQ ID NO: 3670861 - RNA, 19 nt, Salmonella enterica enterica serovar Typhi
uauaugcaggcauaaaaaa

SEQ ID NO: 3670862 - RNA, 22 nt, Salmonella enterica enterica serovar Typhi
uauaugcgacagaaauugaauu

SEQ ID NO: 3670863 - RNA, 21 nt, Salmonella enterica enterica serovar Typhi
uauauguccuuuacugcgcca

SEQ ID NO: 3670864 - RNA, 14 nt, Salmonella enterica enterica serovar Typhi
uauauguugaauau

SEQ ID NO: 3670865 - RNA, 13 nt, Salmonella enterica enterica serovar Typhi
uauauuacuggcu

SEQ ID NO: 3670866 - RNA, 13 nt, Salmonella enterica enterica serovar Typhi
uauauuaguguua

SEQ ID NO: 3670867 - RNA, 18 nt, Salmonella enterica enterica serovar Typhi
uauauuaguguuauauaa

SEQ ID NO: 3670868 - RNA, 18 nt, Salmonella enterica enterica serovar Typhi
uauauucagcaaaugcgc

SEQ ID NO: 3670869 - RNA, 15 nt, Salmonella enterica enterica serovar Typhi
uauauucaugauagu

SEQ ID NO: 3670870 - RNA, 15 nt, Salmonella enterica enterica serovar Typhi
uauauuccagccagg

SEQ ID NO: 3670871 - RNA, 13 nt, Salmonella enterica enterica serovar Typhi
uauauuccgccuc

SEQ ID NO: 3670872 - RNA, 21 nt, Salmonella enterica enterica serovar Typhi
uauauucgcgaugcucaacca

SEQ ID NO: 3670873 - RNA, 15 nt, Salmonella enterica enterica serovar Typhi
uauauugaaaaggga

SEQ ID NO: 3670874 - RNA, 13 nt, Salmonella enterica enterica serovar Typhi
uauauuuaaaauu

SEQ ID NO: 3670875 - RNA, 21 nt, Salmonella enterica enterica serovar Typhi
uauauuuacugaauaaauagu

SEQ ID NO: 3670876 - RNA, 13 nt, Salmonella enterica enterica serovar Typhi
uauauuuuucccu

SEQ ID NO: 3670877 - RNA, 22 nt, Salmonella enterica enterica serovar Typhi
uaucaaaaagacuccggcagca

SEQ ID NO: 3670878 - RNA, 13 nt, Salmonella enterica enterica serovar Typhi
uaucaaaccagcu

SEQ ID NO: 3670879 - RNA, 23 nt, Salmonella enterica enterica serovar Typhi
uaucaaacugaaaaucaaauaag

SEQ ID NO: 3670880 - RNA, 18 nt, Salmonella enterica enterica serovar Typhi
uaucaaaucuucauuuca

SEQ ID NO: 3670881 - RNA, 12 nt, Salmonella enterica enterica serovar Typhi
uaucaagccuac

SEQ ID NO: 3670882 - RNA, 20 nt, Salmonella enterica enterica serovar Typhi
uaucaauaaugcgcugcaca

SEQ ID NO: 3670883 - RNA, 17 nt, Salmonella enterica enterica serovar Typhi
uaucaauaguuaauuaa

SEQ ID NO: 3670884 - RNA, 17 nt, Salmonella enterica enterica serovar Typhi
uaucaaucaccucuucc

SEQ ID NO: 3670885 - RNA, 19 nt, Salmonella enterica enterica serovar Typhi
uaucaauguauuguucaug

SEQ ID NO: 3670886 - RNA, 18 nt, Salmonella enterica enterica serovar Typhi
uaucaauguuuaaaagcg

SEQ ID NO: 3670887 - RNA, 16 nt, Salmonella enterica enterica serovar Typhi
uaucaauuucauauua

SEQ ID NO: 3670888 - RNA, 18 nt, Salmonella enterica enterica serovar Typhi
uaucacacauaucgccag

SEQ ID NO: 3670889 - RNA, 11 nt, Salmonella enterica enterica serovar Typhi
uaucacacccg

SEQ ID NO: 3670890 - RNA, 12 nt, Salmonella enterica enterica serovar Typhi
uaucaccaucuu

SEQ ID NO: 3670891 - RNA, 22 nt, Salmonella enterica enterica serovar Typhi
uaucaccgccgcccguccgcua

SEQ ID NO: 3670892 - RNA, 21 nt, Salmonella enterica enterica serovar Typhi
uaugugccgaugaacgacgcu

SEQ ID NO: 3670893 - RNA, 18 nt, Salmonella enterica enterica serovar Typhi
uauguuaggguagaaaaa

SEQ ID NO: 3670894 - RNA, 15 nt, Salmonella enterica enterica serovar Typhi
uauuaaaaagccagc

SEQ ID NO: 3670895 - RNA, 23 nt, Salmonella enterica enterica serovar Typhi
uauuaaagcacaagaacuuaaau

SEQ ID NO: 3670896 - RNA, 14 nt, Salmonella enterica enterica serovar Typhi
uauuaaaucagaua

SEQ ID NO: 3670897 - RNA, 18 nt, Salmonella enterica enterica serovar Typhi
uauuaacagcuucuucuu

SEQ ID NO: 3670898 - RNA, 12 nt, Salmonella enterica enterica serovar Typhi
uauuaacgcuuu

SEQ ID NO: 3670899 - RNA, 12 nt, Salmonella enterica enterica serovar Typhi
uauuacaaaaau

SEQ ID NO: 3670900 - RNA, 16 nt, Salmonella enterica enterica serovar Typhi
uauuacaacauguccu

SEQ ID NO: 3670901 - RNA, 19 nt, Salmonella enterica enterica serovar Typhi
uauuacaugccguuaauaa

SEQ ID NO: 3670902 - RNA, 18 nt, Salmonella enterica enterica serovar Typhi
uauuacccaacaccagac

SEQ ID NO: 3670903 - RNA, 22 nt, Salmonella enterica enterica serovar Typhi
uauuaccugguauuauugucuu

SEQ ID NO: 3670904 - RNA, 22 nt, Salmonella enterica enterica serovar Typhi
uauuacgcaagaucacauacaa

SEQ ID NO: 3670905 - RNA, 19 nt, Salmonella enterica enterica serovar Typhi
uauuacgcaucauauaacc

SEQ ID NO: 3670906 - RNA, 18 nt, Salmonella enterica enterica serovar Typhi
uauuacuaauaaaauuca

SEQ ID NO: 3670907 - RNA, 16 nt, Salmonella enterica enterica serovar Typhi
uauuacugauaaaguu

SEQ ID NO: 3670908 - RNA, 21 nt, Salmonella enterica enterica serovar Typhi
uauuagcgguacucuuuuucc

SEQ ID NO: 3670909 - RNA, 12 nt, Salmonella enterica enterica serovar Typhi
uauuauaaaaua

SEQ ID NO: 3670910 - RNA, 20 nt, Salmonella enterica enterica serovar Typhi
uauuauauagacuccgucaa

SEQ ID NO: 3670911 - RNA, 19 nt, Salmonella enterica enterica serovar Typhi
uauuaugcguuuuuaucuu

SEQ ID NO: 3670912 - RNA, 20 nt, Salmonella enterica enterica serovar Typhi
uauuaugcguuuuuaucuuu

SEQ ID NO: 3670913 - RNA, 13 nt, Salmonella enterica enterica serovar Typhi
uauuaugcugcuc

SEQ ID NO: 3670914 - RNA, 15 nt, Salmonella enterica enterica serovar Typhi
uauuaugcuggccug

SEQ ID NO: 3670915 - RNA, 13 nt, Salmonella enterica enterica serovar Typhi
uauuauuauuacg

SEQ ID NO: 3670916 - RNA, 19 nt, Salmonella enterica enterica serovar Typhi
uauuauugcccuuuuguuu

SEQ ID NO: 3670917 - RNA, 13 nt, Salmonella enterica enterica serovar Typhi
uauuauugucuua

SEQ ID NO: 3670918 - RNA, 22 nt, Salmonella enterica enterica serovar Typhi
uauuauuuugauacucaucaua

SEQ ID NO: 3670919 - RNA, 22 nt, Salmonella enterica enterica serovar Typhi
uauucaacgccaucuuccucac

SEQ ID NO: 3670920 - RNA, 16 nt, Salmonella enterica enterica serovar Typhi
uauucaccucccugca

SEQ ID NO: 3670921 - RNA, 18 nt, Salmonella enterica enterica serovar Typhi
uauucagaauaugccagg

SEQ ID NO: 3670922 - RNA, 17 nt, Salmonella enterica enterica serovar Typhi
uauucagcacaucagcc

SEQ ID NO: 3670923 - RNA, 18 nt, Salmonella enterica enterica serovar Typhi
uauucagcaguucauucg

SEQ ID NO: 3670924 - RNA, 15 nt, Salmonella enterica enterica serovar Typhi
uauucaggccuccug

SEQ ID NO: 3670925 - RNA, 12 nt, Salmonella enterica enterica serovar Typhi
uauucaggugga

SEQ ID NO: 3670926 - RNA, 16 nt, Salmonella enterica enterica serovar Typhi
uauucaucaaaaugca

SEQ ID NO: 3670927 - RNA, 14 nt, Salmonella enterica enterica serovar Typhi
uauucaucgauacg

SEQ ID NO: 3670928 - RNA, 19 nt, Salmonella enterica enterica serovar Typhi
uauucauucacccaauaaa

SEQ ID NO: 3670929 - RNA, 22 nt, Salmonella enterica enterica serovar Typhi
uauucauucacccaauaaauaa

SEQ ID NO: 3670930 - RNA, 16 nt, Salmonella enterica enterica serovar Typhi
uauucauuucaaugua

SEQ ID NO: 3670931 - RNA, 15 nt, Salmonella enterica enterica serovar Typhi
uauuccaaaauaaua

SEQ ID NO: 3670932 - RNA, 17 nt, Salmonella enterica enterica serovar Typhi
uauuccagaaaggaugc

SEQ ID NO: 3670933 - RNA, 19 nt, Salmonella enterica enterica serovar Typhi
uauuccagggcauuuuuuc

SEQ ID NO: 3670934 - RNA, 20 nt, Salmonella enterica enterica serovar Typhi
uauuccagucgcuccaccac

SEQ ID NO: 3670935 - RNA, 17 nt, Salmonella enterica enterica serovar Typhi
uauucccauuccugcaa

SEQ ID NO: 3670936 - RNA, 20 nt, Salmonella enterica enterica serovar Typhi
uauuccccccggcagcuuua

SEQ ID NO: 3670937 - RNA, 13 nt, Salmonella enterica enterica serovar Typhi
uauuccgcaaacg

SEQ ID NO: 3670938 - RNA, 16 nt, Salmonella enterica enterica serovar Typhi
uauuccggcgacgcuu

SEQ ID NO: 3670939 - RNA, 16 nt, Salmonella enterica enterica serovar Typhi
uauuccucuuccucga

SEQ ID NO: 3670940 - RNA, 22 nt, Salmonella enterica enterica serovar Typhi
uauuccuguauaauuauuuguu

SEQ ID NO: 3670941 - RNA, 19 nt, Salmonella enterica enterica serovar Typhi
uauucgcgaugcucaacca

SEQ ID NO: 3670942 - RNA, 15 nt, Salmonella enterica enterica serovar Typhi
uauucgcuaucagaa

SEQ ID NO: 3670943 - RNA, 19 nt, Salmonella enterica enterica serovar Typhi
uauucgcugacaucgugua

SEQ ID NO: 3670944 - RNA, 13 nt, Salmonella enterica enterica serovar Typhi
uauucgcuuguuu

SEQ ID NO: 3670945 - RNA, 14 nt, Salmonella enterica enterica serovar Typhi
uauucggauuggcc

SEQ ID NO: 3670946 - RNA, 14 nt, Salmonella enterica enterica serovar Typhi
uauucguuccgauc

SEQ ID NO: 3670947 - RNA, 23 nt, Salmonella enterica enterica serovar Typhi
uauucugcacgcacgacagugcu

SEQ ID NO: 3670948 - RNA, 17 nt, Salmonella enterica enterica serovar Typhi
uauugaacauuuuuuca

SEQ ID NO: 3670949 - RNA, 17 nt, Salmonella enterica enterica serovar Typhi
uauugaccgcuuuuucc

SEQ ID NO: 3670950 - RNA, 11 nt, Salmonella enterica enterica serovar Typhi
uauugauuuuu

SEQ ID NO: 3670951 - RNA, 15 nt, Salmonella enterica enterica serovar Typhi
uauugauuuuuaaaa

SEQ ID NO: 3670952 - RNA, 19 nt, Salmonella enterica enterica serovar Typhi
uauugcaacuauuaauucu

SEQ ID NO: 3670953 - RNA, 24 nt, Salmonella enterica enterica serovar Typhi
uauugcaccugggaaucgugcaau

SEQ ID NO: 3670954 - RNA, 14 nt, Salmonella enterica enterica serovar Typhi
uauugcauggcaau

SEQ ID NO: 3670955 - RNA, 22 nt, Salmonella enterica enterica serovar Typhi
uauugcauggcaauuaaauuag

SEQ ID NO: 3670956 - RNA, 20 nt, Salmonella enterica enterica serovar Typhi
uauugccacaauaucaucgu

SEQ ID NO: 3670957 - RNA, 12 nt, Salmonella enterica enterica serovar Typhi
uauugccauaaa

SEQ ID NO: 3670958 - RNA, 19 nt, Salmonella enterica enterica serovar Typhi
uauugccuaagauggcgcc

SEQ ID NO: 3670959 - RNA, 17 nt, Salmonella enterica enterica serovar Typhi
uauugcggaucagcaaa

SEQ ID NO: 3670960 - RNA, 23 nt, Salmonella enterica enterica serovar Typhi
uauugcucuuccggcauaaaaag

SEQ ID NO: 3670961 - RNA, 20 nt, Salmonella enterica enterica serovar Typhi
uauugcugugcuaugauaag

SEQ ID NO: 3670962 - RNA, 13 nt, Salmonella enterica enterica serovar Typhi
uauuggaaucgcu

SEQ ID NO: 3670963 - RNA, 15 nt, Salmonella enterica enterica serovar Typhi
uauuggcaggaugua

SEQ ID NO: 3670964 - RNA, 18 nt, Salmonella enterica enterica serovar Typhi
uauugguaaguuuuucuc

SEQ ID NO: 3670965 - RNA, 19 nt, Salmonella enterica enterica serovar Typhi
uauugucgcccugcaauuc

SEQ ID NO: 3670966 - RNA, 20 nt, Salmonella enterica enterica serovar Typhi
uauugugaaccauggcaaca

SEQ ID NO: 3670967 - RNA, 13 nt, Salmonella enterica enterica serovar Typhi
uauugugucacca

SEQ ID NO: 3670968 - RNA, 13 nt, Salmonella enterica enterica serovar Typhi
uauuguuaaaaag

SEQ ID NO: 3670969 - RNA, 15 nt, Salmonella enterica enterica serovar Typhi
uauuguucaugcaau

SEQ ID NO: 3670970 - RNA, 12 nt, Salmonella enterica enterica serovar Typhi
uauuguuuucua

SEQ ID NO: 3670971 - RNA, 14 nt, Salmonella enterica enterica serovar Typhi
uauuuaaaauucca

SEQ ID NO: 3670972 - RNA, 22 nt, Salmonella enterica enterica serovar Typhi
uauuuaacagagagggaaaaaa

SEQ ID NO: 3670973 - RNA, 13 nt, Salmonella enterica enterica serovar Typhi
uauuuaacgccag

SEQ ID NO: 3670974 - RNA, 18 nt, Salmonella enterica enterica serovar Typhi
uauuuaauaagcauauau

SEQ ID NO: 3670975 - RNA, 15 nt, Salmonella enterica enterica serovar Typhi
uauuuaauacaucag

SEQ ID NO: 3670976 - RNA, 15 nt, Salmonella enterica enterica serovar Typhi
uauuuaccgccgcuu

SEQ ID NO: 3670977 - RNA, 19 nt, Salmonella enterica enterica serovar Typhi
uauuuagccguucaugcac

SEQ ID NO: 3670978 - RNA, 14 nt, Salmonella enterica enterica serovar Typhi
ucaaauauauugaa

SEQ ID NO: 3670979 - RNA, 22 nt, Salmonella enterica enterica serovar Typhi
ucaaaucagacgcuucauuggu

SEQ ID NO: 3670980 - RNA, 23 nt, Salmonella enterica enterica serovar Typhi
ucaaauccagcucaguuuccagc

SEQ ID NO: 3670981 - RNA, 17 nt, Salmonella enterica enterica serovar Typhi
ucaaaucgugugcggua

SEQ ID NO: 3670982 - RNA, 22 nt, Salmonella enterica enterica serovar Typhi
ucaaaucuucauuucauugcgu

SEQ ID NO: 3670983 - RNA, 13 nt, Salmonella enterica enterica serovar Typhi
ucaaaugaucguu

SEQ ID NO: 3670984 - RNA, 14 nt, Salmonella enterica enterica serovar Typhi
ucaaaugcgaaaaa

SEQ ID NO: 3670985 - RNA, 21 nt, Salmonella enterica enterica serovar Typhi
ucaaaugggaucuucaaugaa

SEQ ID NO: 3670986 - RNA, 20 nt, Salmonella enterica enterica serovar Typhi
ucaaauguuguuugaaaagu

SEQ ID NO: 3670987 - RNA, 14 nt, Salmonella enterica enterica serovar Typhi
ucaaauuucaauuu

SEQ ID NO: 3670988 - RNA, 17 nt, Salmonella enterica enterica serovar Typhi
ucaacaaauuccggcac

SEQ ID NO: 3670989 - RNA, 18 nt, Salmonella enterica enterica serovar Typhi
ucaacaacuucaaaauag

SEQ ID NO: 3670990 - RNA, 14 nt, Salmonella enterica enterica serovar Typhi
ucaacaaucguuaa

SEQ ID NO: 3670991 - RNA, 19 nt, Salmonella enterica enterica serovar Typhi
ucaacaaucguuaauucau

SEQ ID NO: 3670992 - RNA, 14 nt, Salmonella enterica enterica serovar Typhi
ucaacaaugucgcc

SEQ ID NO: 3670993 - RNA, 12 nt, Salmonella enterica enterica serovar Typhi
ucaacaauuacg

SEQ ID NO: 3670994 - RNA, 16 nt, Salmonella enterica enterica serovar Typhi
ucaacacgcagaccca

SEQ ID NO: 3670995 - RNA, 16 nt, Salmonella enterica enterica serovar Typhi
ucaacacuuagaacgc

SEQ ID NO: 3670996 - RNA, 18 nt, Salmonella enterica enterica serovar Typhi
ucaacacuuagaacgcgg

SEQ ID NO: 3670997 - RNA, 21 nt, Salmonella enterica enterica serovar Typhi
ucaacacuuagaacgcggaag

SEQ ID NO: 3670998 - RNA, 14 nt, Salmonella enterica enterica serovar Typhi
ucaacagcaaaacg

SEQ ID NO: 3670999 - RNA, 22 nt, Salmonella enterica enterica serovar Typhi
ucaacagcacccaggcacgggu

SEQ ID NO: 3671000 - RNA, 18 nt, Salmonella enterica enterica serovar Typhi
ucaacagcggcggcaguu

SEQ ID NO: 3671001 - RNA, 16 nt, Salmonella enterica enterica serovar Typhi
ucaacauacgccgcca

SEQ ID NO: 3671002 - RNA, 21 nt, Salmonella enterica enterica serovar Typhi
ucaacauacgccgccagccac

SEQ ID NO: 3671003 - RNA, 21 nt, Salmonella enterica enterica serovar Typhi
ucaacauauuuuucacacaua

SEQ ID NO: 3671004 - RNA, 21 nt, Salmonella enterica enterica serovar Typhi
ucaacaucagcgcuaccagcg

SEQ ID NO: 3671005 - RNA, 22 nt, Salmonella enterica enterica serovar Typhi
ucaacaucagcgcuaccagcgc

SEQ ID NO: 3671006 - RNA, 12 nt, Salmonella enterica enterica serovar Typhi
ucaacaucaucc

SEQ ID NO: 3671007 - RNA, 15 nt, Salmonella enterica enterica serovar Typhi
ucaacaucaucggau

SEQ ID NO: 3671008 - RNA, 13 nt, Salmonella enterica enterica serovar Typhi
ucaacaucauuaa

SEQ ID NO: 3671009 - RNA, 14 nt, Salmonella enterica enterica serovar Typhi
ucaacauuauuaaa

SEQ ID NO: 3671010 - RNA, 15 nt, Salmonella enterica enterica serovar Typhi
ucaacauuauuaaaa

SEQ ID NO: 3671011 - RNA, 16 nt, Salmonella enterica enterica serovar Typhi
ucaaccaaugcaacgc

SEQ ID NO: 3671012 - RNA, 19 nt, Salmonella enterica enterica serovar Typhi
ucaaccaccaaaaagccac

SEQ ID NO: 3671013 - RNA, 20 nt, Salmonella enterica enterica serovar Typhi
ucaaccaccaccgauaaacg

SEQ ID NO: 3671014 - RNA, 21 nt, Salmonella enterica enterica serovar Typhi
ucaaccagccgaucaucacga

SEQ ID NO: 3671015 - RNA, 21 nt, Salmonella enterica enterica serovar Typhi
ucaaccagggucaauacgccg

SEQ ID NO: 3671016 - RNA, 21 nt, Salmonella enterica enterica serovar Typhi
ucaacccgcuaccgcaauacg

SEQ ID NO: 3671017 - RNA, 20 nt, Salmonella enterica enterica serovar Typhi
ucaaccguuucuuuuucgau

SEQ ID NO: 3671018 - RNA, 18 nt, Salmonella enterica enterica serovar Typhi
ucaacgaaugccugcaua

SEQ ID NO: 3671019 - RNA, 18 nt, Salmonella enterica enterica serovar Typhi
ucaacgaggugaauaaau

SEQ ID NO: 3671020 - RNA, 21 nt, Salmonella enterica enterica serovar Typhi
ucaacgaggugaauaaauccu

SEQ ID NO: 3671021 - RNA, 19 nt, Salmonella enterica enterica serovar Typhi
ucaacgauagagugaaggc

SEQ ID NO: 3671022 - RNA, 20 nt, Salmonella enterica enterica serovar Typhi
ucaacgcaggcuggagagcg

SEQ ID NO: 3671023 - RNA, 18 nt, Salmonella enterica enterica serovar Typhi
ucaacgcaucaaauaccu

SEQ ID NO: 3671024 - RNA, 16 nt, Salmonella enterica enterica serovar Typhi
ucaacgccaagcgcgg

SEQ ID NO: 3671025 - RNA, 20 nt, Salmonella enterica enterica serovar Typhi
ucaacgcccgcuuucaccau

SEQ ID NO: 3671026 - RNA, 17 nt, Salmonella enterica enterica serovar Typhi
ucaacgccuccaggcua

SEQ ID NO: 3671027 - RNA, 18 nt, Salmonella enterica enterica serovar Typhi
ucaacgcgaccggauaac

SEQ ID NO: 3671028 - RNA, 14 nt, Salmonella enterica enterica serovar Typhi
ucaacgcgccgcca

SEQ ID NO: 3671029 - RNA, 13 nt, Salmonella enterica enterica serovar Typhi
ucaacguaaauag

SEQ ID NO: 3671030 - RNA, 22 nt, Salmonella enterica enterica serovar Typhi
ucaacguccccguuugcagucc

SEQ ID NO: 3671031 - RNA, 15 nt, Salmonella enterica enterica serovar Typhi
ucaacgugcaucucc

SEQ ID NO: 3671032 - RNA, 19 nt, Salmonella enterica enterica serovar Typhi
ucaacguuccuucaggaga

SEQ ID NO: 3671033 - RNA, 16 nt, Salmonella enterica enterica serovar Typhi
ucaacguuucgcuauc

SEQ ID NO: 3671034 - RNA, 13 nt, Salmonella enterica enterica serovar Typhi
ucaacuauuaaag

SEQ ID NO: 3671035 - RNA, 23 nt, Salmonella enterica enterica serovar Typhi
ucaacuccauaauuugaaucgcc

SEQ ID NO: 3671036 - RNA, 14 nt, Salmonella enterica enterica serovar Typhi
ucaacucuccuuuc

SEQ ID NO: 3671037 - RNA, 17 nt, Salmonella enterica enterica serovar Typhi
ucaacucuuucaggcga

SEQ ID NO: 3671038 - RNA, 20 nt, Salmonella enterica enterica serovar Typhi
ucaacugcucuaccaacuga

SEQ ID NO: 3671039 - RNA, 21 nt, Salmonella enterica enterica serovar Typhi
ucaacugcucuaccaacugag

SEQ ID NO: 3671040 - RNA, 23 nt, Salmonella enterica enterica serovar Typhi
ucaacugggcgagggaggcaauc

SEQ ID NO: 3671041 - RNA, 22 nt, Salmonella enterica enterica serovar Typhi
ucaacuuccaccaccuccugcu

SEQ ID NO: 3671042 - RNA, 21 nt, Salmonella enterica enterica serovar Typhi
ucaagaaucaauauaucaggc

SEQ ID NO: 3671043 - RNA, 16 nt, Salmonella enterica enterica serovar Typhi
ucaagaaugaccagcc

SEQ ID NO: 3671044 - RNA, 15 nt, Salmonella enterica enterica serovar Typhi
ucaagagaugcagac

SEQ ID NO: 3671045 - RNA, 20 nt, Salmonella enterica enterica serovar Typhi
ucaagauaaaaagacagaua

SEQ ID NO: 3671046 - RNA, 16 nt, Salmonella enterica enterica serovar Typhi
ucaagaucgcgcagca

SEQ ID NO: 3671047 - RNA, 21 nt, Salmonella enterica enterica serovar Typhi
ucaagaucgcgcagcaggcca

SEQ ID NO: 3671048 - RNA, 14 nt, Salmonella enterica enterica serovar Typhi
ucaagcaacuguag

SEQ ID NO: 3671049 - RNA, 17 nt, Salmonella enterica enterica serovar Typhi
ucaagcaacuguagaau

SEQ ID NO: 3671050 - RNA, 14 nt, Salmonella enterica enterica serovar Typhi
ucaagcaguuccag

SEQ ID NO: 3671051 - RNA, 16 nt, Salmonella enterica enterica serovar Typhi
ucaagcaguuccagca

SEQ ID NO: 3671052 - RNA, 19 nt, Salmonella enterica enterica serovar Typhi
ucaagcauaucaaacugaa

SEQ ID NO: 3671053 - RNA, 14 nt, Salmonella enterica enterica serovar Typhi
ucaagcccagcuca

SEQ ID NO: 3671054 - RNA, 22 nt, Salmonella enterica enterica serovar Typhi
ucaagcccauguucaugaacca

SEQ ID NO: 3671055 - RNA, 21 nt, Salmonella enterica enterica serovar Typhi
ucaagccgggcggcugugucc

SEQ ID NO: 3671056 - RNA, 16 nt, Salmonella enterica enterica serovar Typhi
ucaagcggcaccacau

SEQ ID NO: 3671057 - RNA, 13 nt, Salmonella enterica enterica serovar Typhi
ucaagcgguagcg

SEQ ID NO: 3671058 - RNA, 20 nt, Salmonella enterica enterica serovar Typhi
ucaagcugauugauuuugua

SEQ ID NO: 3671059 - RNA, 22 nt, Salmonella enterica enterica serovar Typhi
ucaagcugauugauuuuguaau

SEQ ID NO: 3671060 - RNA, 16 nt, Salmonella enterica enterica serovar Typhi
ucaagcuggugcuuua

SEQ ID NO: 3671061 - RNA, 14 nt, Salmonella enterica enterica serovar Typhi
ucaagcuugccgcu

SEQ ID NO: 3671062 - RNA, 17 nt, Salmonella enterica enterica serovar Typhi
ucaagcuuuuugcgcca

SEQ ID NO: 3671063 - RNA, 13 nt, Salmonella enterica enterica serovar Typhi
ucaaggcaauaga

SEQ ID NO: 3671064 - RNA, 16 nt, Salmonella enterica enterica serovar Typhi
ucaaggcauccagcag

SEQ ID NO: 3671065 - RNA, 19 nt, Salmonella enterica enterica serovar Typhi
ucaaggcauccagcagucg

SEQ ID NO: 3671066 - RNA, 21 nt, Salmonella enterica enterica serovar Typhi
ucacauggcgaaaaucacuau

SEQ ID NO: 3671067 - RNA, 21 nt, Salmonella enterica enterica serovar Typhi
ucacauuggcaaaccccugcu

SEQ ID NO: 3671068 - RNA, 14 nt, Salmonella enterica enterica serovar Typhi
ucaccaacugcuga

SEQ ID NO: 3671069 - RNA, 17 nt, Salmonella enterica enterica serovar Typhi
ucaccaccgcaggcagc

SEQ ID NO: 3671070 - RNA, 15 nt, Salmonella enterica enterica serovar Typhi
ucaccaccugcuguu

SEQ ID NO: 3671071 - RNA, 22 nt, Salmonella enterica enterica serovar Typhi
ucaccacgccauagcgcuaugc

SEQ ID NO: 3671072 - RNA, 23 nt, Salmonella enterica enterica serovar Typhi
ucaccacgccuaaugaagcgcgu

SEQ ID NO: 3671073 - RNA, 19 nt, Salmonella enterica enterica serovar Typhi
ucaccacgggguuggcccu

SEQ ID NO: 3671074 - RNA, 21 nt, Salmonella enterica enterica serovar Typhi
ucaccagcccuuccaccaguu

SEQ ID NO: 3671075 - RNA, 12 nt, Salmonella enterica enterica serovar Typhi
ucaccagcgcgc

SEQ ID NO: 3671076 - RNA, 18 nt, Salmonella enterica enterica serovar Typhi
ucaccagcugacgcagca

SEQ ID NO: 3671077 - RNA, 20 nt, Salmonella enterica enterica serovar Typhi
ucaccagcugacgcagcagu

SEQ ID NO: 3671078 - RNA, 12 nt, Salmonella enterica enterica serovar Typhi
ucaccaggaugc

SEQ ID NO: 3671079 - RNA, 18 nt, Salmonella enterica enterica serovar Typhi
ucaccaguagcgcgacgc

SEQ ID NO: 3671080 - RNA, 15 nt, Salmonella enterica enterica serovar Typhi
ucaccagugauuggc

SEQ ID NO: 3671081 - RNA, 20 nt, Salmonella enterica enterica serovar Typhi
ucaccauaauuaccggcaca

SEQ ID NO: 3671082 - RNA, 23 nt, Salmonella enterica enterica serovar Typhi
ucaccauaccgacgaccauaauu

SEQ ID NO: 3671083 - RNA, 15 nt, Salmonella enterica enterica serovar Typhi
ucaccaucccaugau

SEQ ID NO: 3671084 - RNA, 16 nt, Salmonella enterica enterica serovar Typhi
ucaccaucccaugaug

SEQ ID NO: 3671085 - RNA, 19 nt, Salmonella enterica enterica serovar Typhi
ucaccaucguugccagcgg

SEQ ID NO: 3671086 - RNA, 15 nt, Salmonella enterica enterica serovar Typhi
ucaccauuaacauca

SEQ ID NO: 3671087 - RNA, 17 nt, Salmonella enterica enterica serovar Typhi
ucaccauuaacaucaga

SEQ ID NO: 3671088 - RNA, 19 nt, Salmonella enterica enterica serovar Typhi
ucaccauuacuaacacguu

SEQ ID NO: 3671089 - RNA, 15 nt, Salmonella enterica enterica serovar Typhi
ucaccauucauguuu

SEQ ID NO: 3671090 - RNA, 14 nt, Salmonella enterica enterica serovar Typhi
ucaccauucccagc

SEQ ID NO: 3671091 - RNA, 15 nt, Salmonella enterica enterica serovar Typhi
ucacccacuuguagc

SEQ ID NO: 3671092 - RNA, 22 nt, Salmonella enterica enterica serovar Typhi
ucacccagaauacggccuucuu

SEQ ID NO: 3671093 - RNA, 16 nt, Salmonella enterica enterica serovar Typhi
ucacccagacugugau

SEQ ID NO: 3671094 - RNA, 20 nt, Salmonella enterica enterica serovar Typhi
ucacccagacugugauggcg

SEQ ID NO: 3671095 - RNA, 19 nt, Salmonella enterica enterica serovar Typhi
ucacccaggcgaugcgcgg

SEQ ID NO: 3671096 - RNA, 15 nt, Salmonella enterica enterica serovar Typhi
ucacccauuuuaucc

SEQ ID NO: 3671097 - RNA, 22 nt, Salmonella enterica enterica serovar Typhi
ucaccccagcgguaaaaucugu

SEQ ID NO: 3671098 - RNA, 21 nt, Salmonella enterica enterica serovar Typhi
ucaccccgucauauuacauag

SEQ ID NO: 3671099 - RNA, 19 nt, Salmonella enterica enterica serovar Typhi
ucacccgcauaugcggcga

SEQ ID NO: 3671100 - RNA, 18 nt, Salmonella enterica enterica serovar Typhi
ucacccgcgccagcaggu

SEQ ID NO: 3671101 - RNA, 19 nt, Salmonella enterica enterica serovar Typhi
ucacccggauacgcggcac

SEQ ID NO: 3671102 - RNA, 23 nt, Salmonella enterica enterica serovar Typhi
ucacccguuauucauucacccaa

SEQ ID NO: 3671103 - RNA, 14 nt, Salmonella enterica enterica serovar Typhi
ucacccugaauuuc

SEQ ID NO: 3671104 - RNA, 20 nt, Salmonella enterica enterica serovar Typhi
ucacccugaauuucaauaau

SEQ ID NO: 3671105 - RNA, 15 nt, Salmonella enterica enterica serovar Typhi
ucaccgaccugccuu

SEQ ID NO: 3671106 - RNA, 17 nt, Salmonella enterica enterica serovar Typhi
ucaccgaugacauuacc

SEQ ID NO: 3671107 - RNA, 19 nt, Salmonella enterica enterica serovar Typhi
ucaccgcaaauucgucgcc

SEQ ID NO: 3671108 - RNA, 15 nt, Salmonella enterica enterica serovar Typhi
ucaccgcaugacaau

SEQ ID NO: 3671109 - RNA, 23 nt, Salmonella enterica enterica serovar Typhi
ucaccgcauuaaggguuaaggca

SEQ ID NO: 3671110 - RNA, 16 nt, Salmonella enterica enterica serovar Typhi
ucaccgccagcaacgc

SEQ ID NO: 3671111 - RNA, 14 nt, Salmonella enterica enterica serovar Typhi
ucaccgccaguccc

SEQ ID NO: 3671112 - RNA, 20 nt, Salmonella enterica enterica serovar Typhi
ucaccgccgcccguccgcua

SEQ ID NO: 3671113 - RNA, 15 nt, Salmonella enterica enterica serovar Typhi
ucaccgccucaucgg

SEQ ID NO: 3671114 - RNA, 17 nt, Salmonella enterica enterica serovar Typhi
ucaccgcugacugaacu

SEQ ID NO: 3671115 - RNA, 22 nt, Salmonella enterica enterica serovar Typhi
ucaccggcauuucaccgucaau

SEQ ID NO: 3671116 - RNA, 15 nt, Salmonella enterica enterica serovar Typhi
ucaccggcgugcgcu

SEQ ID NO: 3671117 - RNA, 13 nt, Salmonella enterica enterica serovar Typhi
ucaccgggcgcug

SEQ ID NO: 3671118 - RNA, 20 nt, Salmonella enterica enterica serovar Typhi
ucaccgucacugaaccugcc

SEQ ID NO: 3671119 - RNA, 13 nt, Salmonella enterica enterica serovar Typhi
ucaccgucggacu

SEQ ID NO: 3671120 - RNA, 17 nt, Salmonella enterica enterica serovar Typhi
ucaccguggcaucauca

SEQ ID NO: 3671121 - RNA, 21 nt, Salmonella enterica enterica serovar Typhi
ucaccguugugcuccagcgug

SEQ ID NO: 3671122 - RNA, 18 nt, Salmonella enterica enterica serovar Typhi
ucaccguuuaaaaacauc

SEQ ID NO: 3671123 - RNA, 21 nt, Salmonella enterica enterica serovar Typhi
ucaccguuuaaaaacaucauu

SEQ ID NO: 3671124 - RNA, 18 nt, Salmonella enterica enterica serovar Typhi
ucaccucacuccagaccu

SEQ ID NO: 3671125 - RNA, 12 nt, Salmonella enterica enterica serovar Typhi
ucaccuccagca

SEQ ID NO: 3671126 - RNA, 13 nt, Salmonella enterica enterica serovar Typhi
ucaccucccugca

SEQ ID NO: 3671127 - RNA, 12 nt, Salmonella enterica enterica serovar Typhi
ucaccuccgcca

SEQ ID NO: 3671128 - RNA, 13 nt, Salmonella enterica enterica serovar Typhi
ucaccuccgccac

SEQ ID NO: 3671129 - RNA, 16 nt, Salmonella enterica enterica serovar Typhi
ucaccuccgcuuuuau

SEQ ID NO: 3671130 - RNA, 21 nt, Salmonella enterica enterica serovar Typhi
ucaccucuucgcuguuaaccu

SEQ ID NO: 3671131 - RNA, 16 nt, Salmonella enterica enterica serovar Typhi
ucaccuggaugcugcc

SEQ ID NO: 3671132 - RNA, 21 nt, Salmonella enterica enterica serovar Typhi
ucaccuucggugaaaucacga

SEQ ID NO: 3671133 - RNA, 18 nt, Salmonella enterica enterica serovar Typhi
ucaccuucugcgcaggag

SEQ ID NO: 3671134 - RNA, 13 nt, Salmonella enterica enterica serovar Typhi
ucaccuugcugcg

SEQ ID NO: 3671135 - RNA, 21 nt, Salmonella enterica enterica serovar Typhi
ucaccuugcugcgcaggggcu

SEQ ID NO: 3671136 - RNA, 22 nt, Salmonella enterica enterica serovar Typhi
ucaccuugucgagcgcggcauu

SEQ ID NO: 3671137 - RNA, 12 nt, Salmonella enterica enterica serovar Typhi
ucaccuuucugc

SEQ ID NO: 3671138 - RNA, 21 nt, Salmonella enterica enterica serovar Typhi
ucaccuuuuuauuuacugccg

SEQ ID NO: 3671139 - RNA, 17 nt, Salmonella enterica enterica serovar Typhi
ucacgaaauaacgcacu

SEQ ID NO: 3671140 - RNA, 13 nt, Salmonella enterica enterica serovar Typhi
ucacgauagcgcc

SEQ ID NO: 3671141 - RNA, 18 nt, Salmonella enterica enterica serovar Typhi
ucacgcagugcgcgaccg

SEQ ID NO: 3671142 - RNA, 18 nt, Salmonella enterica enterica serovar Typhi
ucacgccaucagggacga

SEQ ID NO: 3671143 - RNA, 11 nt, Salmonella enterica enterica serovar Typhi
ucacgccaucg

SEQ ID NO: 3671144 - RNA, 18 nt, Salmonella enterica enterica serovar Typhi
ucacgcccagcgcggccc

SEQ ID NO: 3671145 - RNA, 18 nt, Salmonella enterica enterica serovar Typhi
ucacgccgauaaugcguu

SEQ ID NO: 3671146 - RNA, 23 nt, Salmonella enterica enterica serovar Typhi
ucacgccgugaauuucugcugcc

SEQ ID NO: 3671147 - RNA, 12 nt, Salmonella enterica enterica serovar Typhi
ucacgcgcagac

SEQ ID NO: 3671148 - RNA, 16 nt, Salmonella enterica enterica serovar Typhi
ucacgcgccagcacca

SEQ ID NO: 3671149 - RNA, 18 nt, Salmonella enterica enterica serovar Typhi
ucacgcggauugccgccc

SEQ ID NO: 3671150 - RNA, 21 nt, Salmonella enterica enterica serovar Typhi
ucacgcucuucgccaaucgcc

SEQ ID NO: 3671151 - RNA, 21 nt, Salmonella enterica enterica serovar Typhi
ucacgcuggugcgcgggagau

SEQ ID NO: 3671152 - RNA, 22 nt, Salmonella enterica enterica serovar Typhi
ucagcacaucagccguaucuuc

SEQ ID NO: 3671153 - RNA, 20 nt, Salmonella enterica enterica serovar Typhi
ucagcaccucaucgcuaccu

SEQ ID NO: 3671154 - RNA, 13 nt, Salmonella enterica enterica serovar Typhi
ucagcaccuccag

SEQ ID NO: 3671155 - RNA, 15 nt, Salmonella enterica enterica serovar Typhi
ucagcaccuccagcg

SEQ ID NO: 3671156 - RNA, 13 nt, Salmonella enterica enterica serovar Typhi
ucagcagaacaaa

SEQ ID NO: 3671157 - RNA, 22 nt, Salmonella enterica enterica serovar Typhi
ucagcagaguguccauaaagug

SEQ ID NO: 3671158 - RNA, 14 nt, Salmonella enterica enterica serovar Typhi
ucagcagcaccacu

SEQ ID NO: 3671159 - RNA, 15 nt, Salmonella enterica enterica serovar Typhi
ucagcagccgggcca

SEQ ID NO: 3671160 - RNA, 19 nt, Salmonella enterica enterica serovar Typhi
ucagcagccgggccagacg

SEQ ID NO: 3671161 - RNA, 16 nt, Salmonella enterica enterica serovar Typhi
ucagcagcgaauagcg

SEQ ID NO: 3671162 - RNA, 16 nt, Salmonella enterica enterica serovar Typhi
ucagcagcgauagacu

SEQ ID NO: 3671163 - RNA, 11 nt, Salmonella enterica enterica serovar Typhi
ucagcaggagc

SEQ ID NO: 3671164 - RNA, 14 nt, Salmonella enterica enterica serovar Typhi
ucagcaggcgggcu

SEQ ID NO: 3671165 - RNA, 17 nt, Salmonella enterica enterica serovar Typhi
ucagcagugcaaaggcc

SEQ ID NO: 3671166 - RNA, 12 nt, Salmonella enterica enterica serovar Typhi
ucagcaguucau

SEQ ID NO: 3671167 - RNA, 17 nt, Salmonella enterica enterica serovar Typhi
ucagcauaaagccucuc

SEQ ID NO: 3671168 - RNA, 20 nt, Salmonella enterica enterica serovar Typhi
ucagcauauccagcgccugc

SEQ ID NO: 3671169 - RNA, 15 nt, Salmonella enterica enterica serovar Typhi
ucagcaucuuaugcg

SEQ ID NO: 3671170 - RNA, 12 nt, Salmonella enterica enterica serovar Typhi
ucagcauggugu

SEQ ID NO: 3671171 - RNA, 13 nt, Salmonella enterica enterica serovar Typhi
ucagcauggugug

SEQ ID NO: 3671172 - RNA, 18 nt, Salmonella enterica enterica serovar Typhi
ucagccaaacuccucacu

SEQ ID NO: 3671173 - RNA, 16 nt, Salmonella enterica enterica serovar Typhi
ucagccacuucuucca

SEQ ID NO: 3671174 - RNA, 19 nt, Salmonella enterica enterica serovar Typhi
ucagccacuucuuccagcg

SEQ ID NO: 3671175 - RNA, 14 nt, Salmonella enterica enterica serovar Typhi
ucagccagaacgaa

SEQ ID NO: 3671176 - RNA, 16 nt, Salmonella enterica enterica serovar Typhi
ucagccagcagcucaa

SEQ ID NO: 3671177 - RNA, 21 nt, Salmonella enterica enterica serovar Typhi
ucagccauuaaccagauuacc

SEQ ID NO: 3671178 - RNA, 23 nt, Salmonella enterica enterica serovar Typhi
ucagcccccaguuuuugaacaua

SEQ ID NO: 3671179 - RNA, 17 nt, Salmonella enterica enterica serovar Typhi
ucagcccgcaaaggacc

SEQ ID NO: 3671180 - RNA, 15 nt, Salmonella enterica enterica serovar Typhi
ucagcccuacaaagg

SEQ ID NO: 3671181 - RNA, 21 nt, Salmonella enterica enterica serovar Typhi
ucagcccuaucgcugcgcugc

SEQ ID NO: 3671182 - RNA, 16 nt, Salmonella enterica enterica serovar Typhi
ucagccgauaagaacu

SEQ ID NO: 3671183 - RNA, 21 nt, Salmonella enterica enterica serovar Typhi
ucagccgauaagaacuccaaa

SEQ ID NO: 3671184 - RNA, 12 nt, Salmonella enterica enterica serovar Typhi
ucagccugugca

SEQ ID NO: 3671185 - RNA, 16 nt, Salmonella enterica enterica serovar Typhi
ucagccuuaaucaacu

SEQ ID NO: 3671186 - RNA, 15 nt, Salmonella enterica enterica serovar Typhi
ucagcgaccaguugu

SEQ ID NO: 3671187 - RNA, 22 nt, Salmonella enterica enterica serovar Typhi
ucagcgauauuacuuuccagca

SEQ ID NO: 3671188 - RNA, 21 nt, Salmonella enterica enterica serovar Typhi
ucagcgaucugucgccgcgua

SEQ ID NO: 3671189 - RNA, 15 nt, Salmonella enterica enterica serovar Typhi
ucagcgccaccacaa

SEQ ID NO: 3671190 - RNA, 22 nt, Salmonella enterica enterica serovar Typhi
ucagcgccacgcccaacauaaa

SEQ ID NO: 3671191 - RNA, 18 nt, Salmonella enterica enterica serovar Typhi
ucagcgccauugcuagga

SEQ ID NO: 3671192 - RNA, 19 nt, Salmonella enterica enterica serovar Typhi
ucagcgcgagcgugaucuc

SEQ ID NO: 3671193 - RNA, 17 nt, Salmonella enterica enterica serovar Typhi
ucagcgcgccaauggcc

SEQ ID NO: 3671194 - RNA, 12 nt, Salmonella enterica enterica serovar Typhi
ucagcgcgcucc

SEQ ID NO: 3671195 - RNA, 17 nt, Salmonella enterica enterica serovar Typhi
ucagcgcgcuccagacc

SEQ ID NO: 3671196 - RNA, 22 nt, Salmonella enterica enterica serovar Typhi
ucagcgcguccuccaacgugca

SEQ ID NO: 3671197 - RNA, 14 nt, Salmonella enterica enterica serovar Typhi
ucagcggcaacucg

SEQ ID NO: 3671198 - RNA, 14 nt, Salmonella enterica enterica serovar Typhi
ucagcggcaauagc

SEQ ID NO: 3671199 - RNA, 15 nt, Salmonella enterica enterica serovar Typhi
ucagcggcagcucug

SEQ ID NO: 3671200 - RNA, 16 nt, Salmonella enterica enterica serovar Typhi
ucagcggcagcucugc

SEQ ID NO: 3671201 - RNA, 21 nt, Salmonella enterica enterica serovar Typhi
ucagcggcuugucauccugcu

SEQ ID NO: 3671202 - RNA, 13 nt, Salmonella enterica enterica serovar Typhi
ucagcgguuguuc

SEQ ID NO: 3671203 - RNA, 15 nt, Salmonella enterica enterica serovar Typhi
ucagcgucuauagau

SEQ ID NO: 3671204 - RNA, 20 nt, Salmonella enterica enterica serovar Typhi
ucagcgugaugcgauccagc

SEQ ID NO: 3671205 - RNA, 13 nt, Salmonella enterica enterica serovar Typhi
ucagcgugccggu

SEQ ID NO: 3671206 - RNA, 18 nt, Salmonella enterica enterica serovar Typhi
ucagcguugucccgccuu

SEQ ID NO: 3671207 - RNA, 18 nt, Salmonella enterica enterica serovar Typhi
ucagcuauuagcguuuuu

SEQ ID NO: 3671208 - RNA, 16 nt, Salmonella enterica enterica serovar Typhi
ucagcucgauccggca

SEQ ID NO: 3671209 - RNA, 13 nt, Salmonella enterica enterica serovar Typhi
ucagcucuucaau

SEQ ID NO: 3671210 - RNA, 20 nt, Salmonella enterica enterica serovar Typhi
ucagcucuucaauuuccauc

SEQ ID NO: 3671211 - RNA, 20 nt, Salmonella enterica enterica serovar Typhi
ucagcugaacagucccacca

SEQ ID NO: 3671212 - RNA, 21 nt, Salmonella enterica enterica serovar Typhi
ucaggaaaaagggaauaauac

SEQ ID NO: 3671213 - RNA, 15 nt, Salmonella enterica enterica serovar Typhi
ucaggaaaacaaauu

SEQ ID NO: 3671214 - RNA, 18 nt, Salmonella enterica enterica serovar Typhi
ucaggaaccacauccacc

SEQ ID NO: 3671215 - RNA, 23 nt, Salmonella enterica enterica serovar Typhi
ucaggaacgcggcgccgaagcag

SEQ ID NO: 3671216 - RNA, 18 nt, Salmonella enterica enterica serovar Typhi
ucaggaagcccugaaacu

SEQ ID NO: 3671217 - RNA, 15 nt, Salmonella enterica enterica serovar Typhi
ucaggaaugccacga

SEQ ID NO: 3671218 - RNA, 17 nt, Salmonella enterica enterica serovar Typhi
ucaggaaugccacgauc

SEQ ID NO: 3671219 - RNA, 22 nt, Salmonella enterica enterica serovar Typhi
ucaggaauuuaucaacaaauuc

SEQ ID NO: 3671220 - RNA, 13 nt, Salmonella enterica enterica serovar Typhi
ucaggacaucaaa

SEQ ID NO: 3671221 - RNA, 21 nt, Salmonella enterica enterica serovar Typhi
ucaggacuagcgcgauuuucu

SEQ ID NO: 3671222 - RNA, 19 nt, Salmonella enterica enterica serovar Typhi
ucaggagcaugguccggug

SEQ ID NO: 3671223 - RNA, 21 nt, Salmonella enterica enterica serovar Typhi
ucaggaguaaauaacaaaagc

SEQ ID NO: 3671224 - RNA, 16 nt, Salmonella enterica enterica serovar Typhi
ucaggaucgccggauu

SEQ ID NO: 3671225 - RNA, 22 nt, Salmonella enterica enterica serovar Typhi
ucaggcaaagcauaggccacga

SEQ ID NO: 3671226 - RNA, 22 nt, Salmonella enterica enterica serovar Typhi
ucaggcaauaaaaaaggcagag

SEQ ID NO: 3671227 - RNA, 20 nt, Salmonella enterica enterica serovar Typhi
ucaggcaauaaacaucagcc

SEQ ID NO: 3671228 - RNA, 16 nt, Salmonella enterica enterica serovar Typhi
ucaggcacgugcauaa

SEQ ID NO: 3671229 - RNA, 15 nt, Salmonella enterica enterica serovar Typhi
ucaggcacuggcuua

SEQ ID NO: 3671230 - RNA, 14 nt, Salmonella enterica enterica serovar Typhi
ucaggcagaaauaa

SEQ ID NO: 3671231 - RNA, 13 nt, Salmonella enterica enterica serovar Typhi
ucaggcaguagcc

SEQ ID NO: 3671232 - RNA, 14 nt, Salmonella enterica enterica serovar Typhi
ucaggcauccugcc

SEQ ID NO: 3671233 - RNA, 17 nt, Salmonella enterica enterica serovar Typhi
ucaggcauccugcccug

SEQ ID NO: 3671234 - RNA, 16 nt, Salmonella enterica enterica serovar Typhi
ucaggcaucugaaaug

SEQ ID NO: 3671235 - RNA, 19 nt, Salmonella enterica enterica serovar Typhi
ucaggcaucugaaaugcuc

SEQ ID NO: 3671236 - RNA, 21 nt, Salmonella enterica enterica serovar Typhi
ucaggcauguugcgcaaucac

SEQ ID NO: 3671237 - RNA, 22 nt, Salmonella enterica enterica serovar Typhi
ucaggcauguugcgcaaucacg

SEQ ID NO: 3671238 - RNA, 15 nt, Salmonella enterica enterica serovar Typhi
ucauauaagaaauag

SEQ ID NO: 3671239 - RNA, 21 nt, Salmonella enterica enterica serovar Typhi
ucauaucccggcugacauaau

SEQ ID NO: 3671240 - RNA, 13 nt, Salmonella enterica enterica serovar Typhi
ucauauuccagcc

SEQ ID NO: 3671241 - RNA, 17 nt, Salmonella enterica enterica serovar Typhi
ucauauugcccaucgcg

SEQ ID NO: 3671242 - RNA, 22 nt, Salmonella enterica enterica serovar Typhi
ucauauuugcuggcuugcucag

SEQ ID NO: 3671243 - RNA, 13 nt, Salmonella enterica enterica serovar Typhi
ucaucaaaaaggc

SEQ ID NO: 3671244 - RNA, 20 nt, Salmonella enterica enterica serovar Typhi
ucaucaaaaucaucgccacg

SEQ ID NO: 3671245 - RNA, 14 nt, Salmonella enterica enterica serovar Typhi
ucaucaaaaugcac

SEQ ID NO: 3671246 - RNA, 15 nt, Salmonella enterica enterica serovar Typhi
ucaucaaacgauacc

SEQ ID NO: 3671247 - RNA, 14 nt, Salmonella enterica enterica serovar Typhi
ucaucaaauuucaa

SEQ ID NO: 3671248 - RNA, 13 nt, Salmonella enterica enterica serovar Typhi
ucaucaaguaccg

SEQ ID NO: 3671249 - RNA, 17 nt, Salmonella enterica enterica serovar Typhi
ucaucaauaucuuuuug

SEQ ID NO: 3671250 - RNA, 16 nt, Salmonella enterica enterica serovar Typhi
ucaucaccagcagcag

SEQ ID NO: 3671251 - RNA, 13 nt, Salmonella enterica enterica serovar Typhi
ucaucacccaguc

SEQ ID NO: 3671252 - RNA, 17 nt, Salmonella enterica enterica serovar Typhi
ucaucacguucaggcag

SEQ ID NO: 3671253 - RNA, 18 nt, Salmonella enterica enterica serovar Typhi
ucaucagacccgcauaca

SEQ ID NO: 3671254 - RNA, 18 nt, Salmonella enterica enterica serovar Typhi
ucaucagaucaugaggau

SEQ ID NO: 3671255 - RNA, 23 nt, Salmonella enterica enterica serovar Typhi
ucaucagaucaugaggaugagcg

SEQ ID NO: 3671256 - RNA, 15 nt, Salmonella enterica enterica serovar Typhi
ucaucagcacaaaau

SEQ ID NO: 3671257 - RNA, 19 nt, Salmonella enterica enterica serovar Typhi
ucaucagcacaaaauccca

SEQ ID NO: 3671258 - RNA, 19 nt, Salmonella enterica enterica serovar Typhi
ucaucaggcaauaaacauc

SEQ ID NO: 3671259 - RNA, 15 nt, Salmonella enterica enterica serovar Typhi
ucaucaggccugcaa

SEQ ID NO: 3671260 - RNA, 15 nt, Salmonella enterica enterica serovar Typhi
ucaucaggccugggc

SEQ ID NO: 3671261 - RNA, 14 nt, Salmonella enterica enterica serovar Typhi
ucaucaggcgugcc

SEQ ID NO: 3671262 - RNA, 20 nt, Salmonella enterica enterica serovar Typhi
ucaucagggcguaagcgcgu

SEQ ID NO: 3671263 - RNA, 21 nt, Salmonella enterica enterica serovar Typhi
ucaucagggcguaagcgcguu

SEQ ID NO: 3671264 - RNA, 16 nt, Salmonella enterica enterica serovar Typhi
ucaucaguaacacccg

SEQ ID NO: 3671265 - RNA, 15 nt, Salmonella enterica enterica serovar Typhi
ucaucaguuuaaccg

SEQ ID NO: 3671266 - RNA, 18 nt, Salmonella enterica enterica serovar Typhi
ucaucaguuugcgauaag

SEQ ID NO: 3671267 - RNA, 13 nt, Salmonella enterica enterica serovar Typhi
ucaucauaaucaa

SEQ ID NO: 3671268 - RNA, 21 nt, Salmonella enterica enterica serovar Typhi
ucaucaucucugucgaccauc

SEQ ID NO: 3671269 - RNA, 22 nt, Salmonella enterica enterica serovar Typhi
ucaucaucuuguccucaucauu

SEQ ID NO: 3671270 - RNA, 22 nt, Salmonella enterica enterica serovar Typhi
ucaucaugcugcugauccuguu

SEQ ID NO: 3671271 - RNA, 19 nt, Salmonella enterica enterica serovar Typhi
ucaucauggacagauuucc

SEQ ID NO: 3671272 - RNA, 16 nt, Salmonella enterica enterica serovar Typhi
ucaucauuacaggcga

SEQ ID NO: 3671273 - RNA, 19 nt, Salmonella enterica enterica serovar Typhi
ucaucauugcgccaagacc

SEQ ID NO: 3671274 - RNA, 14 nt, Salmonella enterica enterica serovar Typhi
ucauccagaaaaug

SEQ ID NO: 3671275 - RNA, 13 nt, Salmonella enterica enterica serovar Typhi
ucauccagcagca

SEQ ID NO: 3671276 - RNA, 24 nt, Salmonella enterica enterica serovar Typhi
ucauccagcgaaccuuccaucgca

SEQ ID NO: 3671277 - RNA, 11 nt, Salmonella enterica enterica serovar Typhi
ucauccagcgg

SEQ ID NO: 3671278 - RNA, 19 nt, Salmonella enterica enterica serovar Typhi
ucauccagcguuucaugaa

SEQ ID NO: 3671279 - RNA, 17 nt, Salmonella enterica enterica serovar Typhi
ucaucccacgucgccuu

SEQ ID NO: 3671280 - RNA, 17 nt, Salmonella enterica enterica serovar Typhi
ucauccccagcaucaug

SEQ ID NO: 3671281 - RNA, 15 nt, Salmonella enterica enterica serovar Typhi
ucauccggcaagcgc

SEQ ID NO: 3671282 - RNA, 19 nt, Salmonella enterica enterica serovar Typhi
ucauccggguuaaaccagc

SEQ ID NO: 3671283 - RNA, 21 nt, Salmonella enterica enterica serovar Typhi
ucauccgguucauaauccgga

SEQ ID NO: 3671284 - RNA, 16 nt, Salmonella enterica enterica serovar Typhi
ucauccugcaggcggc

SEQ ID NO: 3671285 - RNA, 12 nt, Salmonella enterica enterica serovar Typhi
ucauccuucccc

SEQ ID NO: 3671286 - RNA, 16 nt, Salmonella enterica enterica serovar Typhi
ucaucgaacgccgccu

SEQ ID NO: 3671287 - RNA, 22 nt, Salmonella enterica enterica serovar Typhi
ucaucgacauuaacaaugccuu

SEQ ID NO: 3671288 - RNA, 17 nt, Salmonella enterica enterica serovar Typhi
ucaucgcaaauucugua

SEQ ID NO: 3671289 - RNA, 16 nt, Salmonella enterica enterica serovar Typhi
ucaucgccacaugcgg

SEQ ID NO: 3671290 - RNA, 13 nt, Salmonella enterica enterica serovar Typhi
ucaucgccagccc

SEQ ID NO: 3671291 - RNA, 18 nt, Salmonella enterica enterica serovar Typhi
ucaucgccuuaacucuua

SEQ ID NO: 3671292 - RNA, 14 nt, Salmonella enterica enterica serovar Typhi
ucaucgcgccuccc

SEQ ID NO: 3671293 - RNA, 23 nt, Salmonella enterica enterica serovar Typhi
ucaucgcuuaacggcccaggcau

SEQ ID NO: 3671294 - RNA, 17 nt, Salmonella enterica enterica serovar Typhi
ucaucgcuugcccagca

SEQ ID NO: 3671295 - RNA, 18 nt, Salmonella enterica enterica serovar Typhi
ucaucggucaguuugccc

SEQ ID NO: 3671296 - RNA, 17 nt, Salmonella enterica enterica serovar Typhi
ucaucgguuacuccuua

SEQ ID NO: 3671297 - RNA, 23 nt, Salmonella enterica enterica serovar Typhi
ucaucguaaaaucaacagcaaaa

SEQ ID NO: 3671298 - RNA, 14 nt, Salmonella enterica enterica serovar Typhi
ucaucguaccaaua

SEQ ID NO: 3671299 - RNA, 18 nt, Salmonella enterica enterica serovar Typhi
ucaucgugaaauuauucc

SEQ ID NO: 3671300 - RNA, 22 nt, Salmonella enterica enterica serovar Typhi
ucaucguuugcgcuacgcugcg

SEQ ID NO: 3671301 - RNA, 13 nt, Salmonella enterica enterica serovar Typhi
ucaucuacacgca

SEQ ID NO: 3671302 - RNA, 14 nt, Salmonella enterica enterica serovar Typhi
ucaucuaucugcuu

SEQ ID NO: 3671303 - RNA, 17 nt, Salmonella enterica enterica serovar Typhi
ucaucuccgauaaauaa

SEQ ID NO: 3671304 - RNA, 13 nt, Salmonella enterica enterica serovar Typhi
ucaucugacugcg

SEQ ID NO: 3671305 - RNA, 11 nt, Salmonella enterica enterica serovar Typhi
ucaucugcuuc

SEQ ID NO: 3671306 - RNA, 17 nt, Salmonella enterica enterica serovar Typhi
ucaucuguggcaauuuu

SEQ ID NO: 3671307 - RNA, 17 nt, Salmonella enterica enterica serovar Typhi
ucaucuucaccuuucca

SEQ ID NO: 3671308 - RNA, 18 nt, Salmonella enterica enterica serovar Typhi
ucaucuucaccuuuccag

SEQ ID NO: 3671309 - RNA, 14 nt, Salmonella enterica enterica serovar Typhi
ucaucuucccgaau

SEQ ID NO: 3671310 - RNA, 11 nt, Salmonella enterica enterica serovar Typhi
ucaucuucuuu

SEQ ID NO: 3671311 - RNA, 17 nt, Salmonella enterica enterica serovar Typhi
ucaucuuguccucauca

SEQ ID NO: 3671312 - RNA, 14 nt, Salmonella enterica enterica serovar Typhi
ucaucuuuuaaaau

SEQ ID NO: 3671313 - RNA, 16 nt, Salmonella enterica enterica serovar Typhi
ucaugaaguuaccaga

SEQ ID NO: 3671314 - RNA, 23 nt, Salmonella enterica enterica serovar Typhi
ucaugaaugccccagcgcugcug

SEQ ID NO: 3671315 - RNA, 20 nt, Salmonella enterica enterica serovar Typhi
ucaugacauagcauaauaau

SEQ ID NO: 3671316 - RNA, 17 nt, Salmonella enterica enterica serovar Typhi
ucaugaccgaaaucuuc

SEQ ID NO: 3671317 - RNA, 18 nt, Salmonella enterica enterica serovar Typhi
ucaugacugguuuuucgc

SEQ ID NO: 3671318 - RNA, 19 nt, Salmonella enterica enterica serovar Typhi
ucaugaguaaaugaacguu

SEQ ID NO: 3671319 - RNA, 19 nt, Salmonella enterica enterica serovar Typhi
ucaugaucuuuccuuuuuc

SEQ ID NO: 3671320 - RNA, 23 nt, Salmonella enterica enterica serovar Typhi
ucaugaucuuuccuuuuucaggc

SEQ ID NO: 3671321 - RNA, 13 nt, Salmonella enterica enterica serovar Typhi
ucaugauguuugu

SEQ ID NO: 3671322 - RNA, 21 nt, Salmonella enterica enterica serovar Typhi
ucaugauuucuugagcggcau

SEQ ID NO: 3671323 - RNA, 21 nt, Salmonella enterica enterica serovar Typhi
ucaugcaacuucaccucaguc

SEQ ID NO: 3671324 - RNA, 21 nt, Salmonella enterica enterica serovar Typhi
uccaauauuuauuuaauguuu

SEQ ID NO: 3671325 - RNA, 17 nt, Salmonella enterica enterica serovar Typhi
uccaaucucuuuugcgg

SEQ ID NO: 3671326 - RNA, 21 nt, Salmonella enterica enterica serovar Typhi
uccacaaacuccagacgauga

SEQ ID NO: 3671327 - RNA, 13 nt, Salmonella enterica enterica serovar Typhi
uccacaaccggcu

SEQ ID NO: 3671328 - RNA, 13 nt, Salmonella enterica enterica serovar Typhi
uccacaaucaauu

SEQ ID NO: 3671329 - RNA, 15 nt, Salmonella enterica enterica serovar Typhi
uccacaaucccggca

SEQ ID NO: 3671330 - RNA, 21 nt, Salmonella enterica enterica serovar Typhi
uccacaccguuacgaccccau

SEQ ID NO: 3671331 - RNA, 20 nt, Salmonella enterica enterica serovar Typhi
uccacacguccauccgggua

SEQ ID NO: 3671332 - RNA, 16 nt, Salmonella enterica enterica serovar Typhi
uccacagcgaauuccg

SEQ ID NO: 3671333 - RNA, 17 nt, Salmonella enterica enterica serovar Typhi
uccacaguaaccccaua

SEQ ID NO: 3671334 - RNA, 21 nt, Salmonella enterica enterica serovar Typhi
uccacauccagcgccagcgcc

SEQ ID NO: 3671335 - RNA, 14 nt, Salmonella enterica enterica serovar Typhi
uccacauuccagac

SEQ ID NO: 3671336 - RNA, 12 nt, Salmonella enterica enterica serovar Typhi
uccaccagaacc

SEQ ID NO: 3671337 - RNA, 24 nt, Salmonella enterica enterica serovar Typhi
uccaccagacccgggacuucaggc

SEQ ID NO: 3671338 - RNA, 22 nt, Salmonella enterica enterica serovar Typhi
uccaccagauuucgcagcagca

SEQ ID NO: 3671339 - RNA, 14 nt, Salmonella enterica enterica serovar Typhi
uccaccagcuucau

SEQ ID NO: 3671340 - RNA, 18 nt, Salmonella enterica enterica serovar Typhi
uccaccaggcaugcagcu

SEQ ID NO: 3671341 - RNA, 14 nt, Salmonella enterica enterica serovar Typhi
uccacccaguucau

SEQ ID NO: 3671342 - RNA, 15 nt, Salmonella enterica enterica serovar Typhi
uccaccucuucugca

SEQ ID NO: 3671343 - RNA, 18 nt, Salmonella enterica enterica serovar Typhi
uccaccuggcccugcauc

SEQ ID NO: 3671344 - RNA, 22 nt, Salmonella enterica enterica serovar Typhi
uccaccuggcccugcaucagcu

SEQ ID NO: 3671345 - RNA, 20 nt, Salmonella enterica enterica serovar Typhi
uccaccuuaucaagcgauac

SEQ ID NO: 3671346 - RNA, 19 nt, Salmonella enterica enterica serovar Typhi
uccaccuucucuuuaugcg

SEQ ID NO: 3671347 - RNA, 14 nt, Salmonella enterica enterica serovar Typhi
uccacgcagacgcc

SEQ ID NO: 3671348 - RNA, 23 nt, Salmonella enterica enterica serovar Typhi
uccacgccgucgaugauggcggc

SEQ ID NO: 3671349 - RNA, 21 nt, Salmonella enterica enterica serovar Typhi
uccacggcgcuccugucaggc

SEQ ID NO: 3671350 - RNA, 17 nt, Salmonella enterica enterica serovar Typhi
uccacgguucucaccgu

SEQ ID NO: 3671351 - RNA, 19 nt, Salmonella enterica enterica serovar Typhi
uccacgucgcacgccauca

SEQ ID NO: 3671352 - RNA, 15 nt, Salmonella enterica enterica serovar Typhi
uccacucacccggca

SEQ ID NO: 3671353 - RNA, 18 nt, Salmonella enterica enterica serovar Typhi
uccacucgcucauuugcg

SEQ ID NO: 3671354 - RNA, 16 nt, Salmonella enterica enterica serovar Typhi
uccacugagcgcgcca

SEQ ID NO: 3671355 - RNA, 20 nt, Salmonella enterica enterica serovar Typhi
uccacugagcuucaccgcca

SEQ ID NO: 3671356 - RNA, 14 nt, Salmonella enterica enterica serovar Typhi
uccacuucagcagc

SEQ ID NO: 3671357 - RNA, 17 nt, Salmonella enterica enterica serovar Typhi
uccacuuucucggcuuu

SEQ ID NO: 3671358 - RNA, 21 nt, Salmonella enterica enterica serovar Typhi
uccacuuucucggcuuuccag

SEQ ID NO: 3671359 - RNA, 19 nt, Salmonella enterica enterica serovar Typhi
uccagaacugcgaaaucac

SEQ ID NO: 3671360 - RNA, 12 nt, Salmonella enterica enterica serovar Typhi
uccagaagaucu

SEQ ID NO: 3671361 - RNA, 17 nt, Salmonella enterica enterica serovar Typhi
uccagaauacgccgccg

SEQ ID NO: 3671362 - RNA, 16 nt, Salmonella enterica enterica serovar Typhi
uccagacaauccgcgg

SEQ ID NO: 3671363 - RNA, 14 nt, Salmonella enterica enterica serovar Typhi
uccagaccaccagc

SEQ ID NO: 3671364 - RNA, 19 nt, Salmonella enterica enterica serovar Typhi
uccagaccaccagcgacau

SEQ ID NO: 3671365 - RNA, 15 nt, Salmonella enterica enterica serovar Typhi
uccagacccacagcc

SEQ ID NO: 3671366 - RNA, 17 nt, Salmonella enterica enterica serovar Typhi
uccagacccacagccgg

SEQ ID NO: 3671367 - RNA, 18 nt, Salmonella enterica enterica serovar Typhi
uccagacccagacaaccg

SEQ ID NO: 3671368 - RNA, 19 nt, Salmonella enterica enterica serovar Typhi
uccagacggcgcuguuguu

SEQ ID NO: 3671369 - RNA, 15 nt, Salmonella enterica enterica serovar Typhi
uccagacguugcucu

SEQ ID NO: 3671370 - RNA, 15 nt, Salmonella enterica enterica serovar Typhi
uccagaguacauucu

SEQ ID NO: 3671371 - RNA, 16 nt, Salmonella enterica enterica serovar Typhi
uccagauagcgcugcg

SEQ ID NO: 3671372 - RNA, 16 nt, Salmonella enterica enterica serovar Typhi
uccagauauggcaaac

SEQ ID NO: 3671373 - RNA, 13 nt, Salmonella enterica enterica serovar Typhi
uccagaucgccac

SEQ ID NO: 3671374 - RNA, 21 nt, Salmonella enterica enterica serovar Typhi
uccagaugcgccagauucaug

SEQ ID NO: 3671375 - RNA, 22 nt, Salmonella enterica enterica serovar Typhi
uccagauuacuaugaggauuau

SEQ ID NO: 3671376 - RNA, 16 nt, Salmonella enterica enterica serovar Typhi
uccagauugagacaaa

SEQ ID NO: 3671377 - RNA, 21 nt, Salmonella enterica enterica serovar Typhi
uccagcaacagugggcuauga

SEQ ID NO: 3671378 - RNA, 17 nt, Salmonella enterica enterica serovar Typhi
uccagcaauaacaccgg

SEQ ID NO: 3671379 - RNA, 16 nt, Salmonella enterica enterica serovar Typhi
uccagcaaugauuuua

SEQ ID NO: 3671380 - RNA, 16 nt, Salmonella enterica enterica serovar Typhi
uccagcacauccucaa

SEQ ID NO: 3671381 - RNA, 17 nt, Salmonella enterica enterica serovar Typhi
uccagcacauccucaau

SEQ ID NO: 3671382 - RNA, 13 nt, Salmonella enterica enterica serovar Typhi
uccagcacgaccu

SEQ ID NO: 3671383 - RNA, 20 nt, Salmonella enterica enterica serovar Typhi
uccagcacgagcgccagccc

SEQ ID NO: 3671384 - RNA, 14 nt, Salmonella enterica enterica serovar Typhi
uccagcacggccuu

SEQ ID NO: 3671385 - RNA, 20 nt, Salmonella enterica enterica serovar Typhi
uccagcagcagagccggaac

SEQ ID NO: 3671386 - RNA, 19 nt, Salmonella enterica enterica serovar Typhi
uccagcagcagcaccggcu

SEQ ID NO: 3671387 - RNA, 22 nt, Salmonella enterica enterica serovar Typhi
uccagcagcagcaccggcuguu

SEQ ID NO: 3671388 - RNA, 11 nt, Salmonella enterica enterica serovar Typhi
uccagcagcca

SEQ ID NO: 3671389 - RNA, 16 nt, Salmonella enterica enterica serovar Typhi
uccagcagccagccgu

SEQ ID NO: 3671390 - RNA, 20 nt, Salmonella enterica enterica serovar Typhi
uccagcagguaacguuucag

SEQ ID NO: 3671391 - RNA, 20 nt, Salmonella enterica enterica serovar Typhi
uccagcagguggaucugaau

SEQ ID NO: 3671392 - RNA, 15 nt, Salmonella enterica enterica serovar Typhi
uccagcaucagcaau

SEQ ID NO: 3671393 - RNA, 15 nt, Salmonella enterica enterica serovar Typhi
uccagcauccaugcc

SEQ ID NO: 3671394 - RNA, 12 nt, Salmonella enterica enterica serovar Typhi
uccagccaaagu

SEQ ID NO: 3671395 - RNA, 15 nt, Salmonella enterica enterica serovar Typhi
uccagcccgccgccc

SEQ ID NO: 3671396 - RNA, 23 nt, Salmonella enterica enterica serovar Typhi
uccagccgcccgcgauaaaaauc

SEQ ID NO: 3671397 - RNA, 22 nt, Salmonella enterica enterica serovar Typhi
uccagccgcccuucuccgguaa

SEQ ID NO: 3671398 - RNA, 18 nt, Salmonella enterica enterica serovar Typhi
uccagccgcuuuucgcuu

SEQ ID NO: 3671399 - RNA, 17 nt, Salmonella enterica enterica serovar Typhi
uccagccgguguuaacc

SEQ ID NO: 3671400 - RNA, 18 nt, Salmonella enterica enterica serovar Typhi
uccagccguaccacccgg

SEQ ID NO: 3671401 - RNA, 17 nt, Salmonella enterica enterica serovar Typhi
uccagcgaaccuuccau

SEQ ID NO: 3671402 - RNA, 17 nt, Salmonella enterica enterica serovar Typhi
uccagcgagcaggaaua

SEQ ID NO: 3671403 - RNA, 14 nt, Salmonella enterica enterica serovar Typhi
uccagcgcaaaggg

SEQ ID NO: 3671404 - RNA, 15 nt, Salmonella enterica enterica serovar Typhi
uccagcgccagcgcc

SEQ ID NO: 3671405 - RNA, 23 nt, Salmonella enterica enterica serovar Typhi
uccagcgccugcuguaaaauauc

SEQ ID NO: 3671406 - RNA, 17 nt, Salmonella enterica enterica serovar Typhi
uccagcgcgccgucauc

SEQ ID NO: 3671407 - RNA, 12 nt, Salmonella enterica enterica serovar Typhi
uccagcgcgucc

SEQ ID NO: 3671408 - RNA, 16 nt, Salmonella enterica enterica serovar Typhi
uccagcgcguccuuau

SEQ ID NO: 3671409 - RNA, 22 nt, Salmonella enterica enterica serovar Typhi
uccagcgcguccuuauaaugcu

SEQ ID NO: 3671410 - RNA, 13 nt, Salmonella enterica enterica serovar Typhi
ucccaauucgugu

SEQ ID NO: 3671411 - RNA, 12 nt, Salmonella enterica enterica serovar Typhi
ucccaccagcag

SEQ ID NO: 3671412 - RNA, 14 nt, Salmonella enterica enterica serovar Typhi
ucccacucuuccag

SEQ ID NO: 3671413 - RNA, 20 nt, Salmonella enterica enterica serovar Typhi
ucccacuuaggcagccaggc

SEQ ID NO: 3671414 - RNA, 16 nt, Salmonella enterica enterica serovar Typhi
ucccacuuugcucacc

SEQ ID NO: 3671415 - RNA, 13 nt, Salmonella enterica enterica serovar Typhi
ucccagaaaauga

SEQ ID NO: 3671416 - RNA, 12 nt, Salmonella enterica enterica serovar Typhi
ucccagaagaaa

SEQ ID NO: 3671417 - RNA, 13 nt, Salmonella enterica enterica serovar Typhi
ucccagaccauuc

SEQ ID NO: 3671418 - RNA, 15 nt, Salmonella enterica enterica serovar Typhi
ucccagaugcgccag

SEQ ID NO: 3671419 - RNA, 17 nt, Salmonella enterica enterica serovar Typhi
ucccagauuaaaucauc

SEQ ID NO: 3671420 - RNA, 23 nt, Salmonella enterica enterica serovar Typhi
ucccagccgggcaggaaaagcug

SEQ ID NO: 3671421 - RNA, 19 nt, Salmonella enterica enterica serovar Typhi
ucccaggcgcgcagcugcc

SEQ ID NO: 3671422 - RNA, 18 nt, Salmonella enterica enterica serovar Typhi
ucccagucauccgguuca

SEQ ID NO: 3671423 - RNA, 16 nt, Salmonella enterica enterica serovar Typhi
ucccagugucaacugc

SEQ ID NO: 3671424 - RNA, 21 nt, Salmonella enterica enterica serovar Typhi
ucccauaccuguaucaaacca

SEQ ID NO: 3671425 - RNA, 23 nt, Salmonella enterica enterica serovar Typhi
ucccauaccuguaucaaaccaac

SEQ ID NO: 3671426 - RNA, 16 nt, Salmonella enterica enterica serovar Typhi
ucccauacugcccagc

SEQ ID NO: 3671427 - RNA, 22 nt, Salmonella enterica enterica serovar Typhi
ucccauacugcccagccgccag

SEQ ID NO: 3671428 - RNA, 14 nt, Salmonella enterica enterica serovar Typhi
ucccauccgggcca

SEQ ID NO: 3671429 - RNA, 17 nt, Salmonella enterica enterica serovar Typhi
ucccaucguaacgccgu

SEQ ID NO: 3671430 - RNA, 19 nt, Salmonella enterica enterica serovar Typhi
ucccaugacgacagguuua

SEQ ID NO: 3671431 - RNA, 14 nt, Salmonella enterica enterica serovar Typhi
ucccauguugcgcc

SEQ ID NO: 3671432 - RNA, 15 nt, Salmonella enterica enterica serovar Typhi
ucccauucacguagc

SEQ ID NO: 3671433 - RNA, 16 nt, Salmonella enterica enterica serovar Typhi
ucccauuccugcaaga

SEQ ID NO: 3671434 - RNA, 19 nt, Salmonella enterica enterica serovar Typhi
ucccauugggccagcagcg

SEQ ID NO: 3671435 - RNA, 13 nt, Salmonella enterica enterica serovar Typhi
uccccaaacugcu

SEQ ID NO: 3671436 - RNA, 16 nt, Salmonella enterica enterica serovar Typhi
uccccaacagcgacca

SEQ ID NO: 3671437 - RNA, 16 nt, Salmonella enterica enterica serovar Typhi
uccccaaccgccagcc

SEQ ID NO: 3671438 - RNA, 22 nt, Salmonella enterica enterica serovar Typhi
uccccaacgacagcacuacgcu

SEQ ID NO: 3671439 - RNA, 17 nt, Salmonella enterica enterica serovar Typhi
uccccacaaucccgcca

SEQ ID NO: 3671440 - RNA, 18 nt, Salmonella enterica enterica serovar Typhi
uccccacaaucccgccag

SEQ ID NO: 3671441 - RNA, 18 nt, Salmonella enterica enterica serovar Typhi
uccccaccgcugauggcg

SEQ ID NO: 3671442 - RNA, 22 nt, Salmonella enterica enterica serovar Typhi
uccccaccugacuauacccaaa

SEQ ID NO: 3671443 - RNA, 21 nt, Salmonella enterica enterica serovar Typhi
uccccacgccgaccaccagcu

SEQ ID NO: 3671444 - RNA, 17 nt, Salmonella enterica enterica serovar Typhi
uccccagaaugauaaug

SEQ ID NO: 3671445 - RNA, 12 nt, Salmonella enterica enterica serovar Typhi
uccccagcaccg

SEQ ID NO: 3671446 - RNA, 16 nt, Salmonella enterica enterica serovar Typhi
uccccagccagagauc

SEQ ID NO: 3671447 - RNA, 18 nt, Salmonella enterica enterica serovar Typhi
uccccagcguaccacgcc

SEQ ID NO: 3671448 - RNA, 23 nt, Salmonella enterica enterica serovar Typhi
uccccagcguaccacgccgcaca

SEQ ID NO: 3671449 - RNA, 19 nt, Salmonella enterica enterica serovar Typhi
uccccagcuaaaaacgcca

SEQ ID NO: 3671450 - RNA, 19 nt, Salmonella enterica enterica serovar Typhi
uccccaggcgcuauuccca

SEQ ID NO: 3671451 - RNA, 13 nt, Salmonella enterica enterica serovar Typhi
uccccauaucccg

SEQ ID NO: 3671452 - RNA, 19 nt, Salmonella enterica enterica serovar Typhi
uccccauauuccagaaagg

SEQ ID NO: 3671453 - RNA, 19 nt, Salmonella enterica enterica serovar Typhi
uccccaucaggaacaggcg

SEQ ID NO: 3671454 - RNA, 15 nt, Salmonella enterica enterica serovar Typhi
uccccaucccagacc

SEQ ID NO: 3671455 - RNA, 13 nt, Salmonella enterica enterica serovar Typhi
uccccaucgcgac

SEQ ID NO: 3671456 - RNA, 23 nt, Salmonella enterica enterica serovar Typhi
uccccaucugaacucuuccagau

SEQ ID NO: 3671457 - RNA, 18 nt, Salmonella enterica enterica serovar Typhi
uccccauguugaacggca

SEQ ID NO: 3671458 - RNA, 17 nt, Salmonella enterica enterica serovar Typhi
uccccccuuuuuugcug

SEQ ID NO: 3671459 - RNA, 21 nt, Salmonella enterica enterica serovar Typhi
ucccccggcaccacgcacagu

SEQ ID NO: 3671460 - RNA, 21 nt, Salmonella enterica enterica serovar Typhi
ucccccuggccugcucaucag

SEQ ID NO: 3671461 - RNA, 20 nt, Salmonella enterica enterica serovar Typhi
uccccgacaaaaccguucug

SEQ ID NO: 3671462 - RNA, 23 nt, Salmonella enterica enterica serovar Typhi
uccccgacggccucuucacgcag

SEQ ID NO: 3671463 - RNA, 20 nt, Salmonella enterica enterica serovar Typhi
uccccgccgagaaaauaccg

SEQ ID NO: 3671464 - RNA, 20 nt, Salmonella enterica enterica serovar Typhi
uccccgcuggcgcggggaac

SEQ ID NO: 3671465 - RNA, 11 nt, Salmonella enterica enterica serovar Typhi
uccccggcaac

SEQ ID NO: 3671466 - RNA, 22 nt, Salmonella enterica enterica serovar Typhi
uccccggcaaccuuaaacaucg

SEQ ID NO: 3671467 - RNA, 17 nt, Salmonella enterica enterica serovar Typhi
uccccggcgaaagaaaa

SEQ ID NO: 3671468 - RNA, 12 nt, Salmonella enterica enterica serovar Typhi
uccccgggaaca

SEQ ID NO: 3671469 - RNA, 21 nt, Salmonella enterica enterica serovar Typhi
uccccggggugcagaacauca

SEQ ID NO: 3671470 - RNA, 16 nt, Salmonella enterica enterica serovar Typhi
uccccguuccaccgcc

SEQ ID NO: 3671471 - RNA, 17 nt, Salmonella enterica enterica serovar Typhi
uccccguuugcaguccg

SEQ ID NO: 3671472 - RNA, 17 nt, Salmonella enterica enterica serovar Typhi
uccccuauacgccaucu

SEQ ID NO: 3671473 - RNA, 16 nt, Salmonella enterica enterica serovar Typhi
uccccucuuccaucag

SEQ ID NO: 3671474 - RNA, 20 nt, Salmonella enterica enterica serovar Typhi
uccccugcgguuucuaccac

SEQ ID NO: 3671475 - RNA, 12 nt, Salmonella enterica enterica serovar Typhi
uccccugcuccu

SEQ ID NO: 3671476 - RNA, 15 nt, Salmonella enterica enterica serovar Typhi
uccccugcuccugcc

SEQ ID NO: 3671477 - RNA, 19 nt, Salmonella enterica enterica serovar Typhi
uccccugcuccugccagau

SEQ ID NO: 3671478 - RNA, 16 nt, Salmonella enterica enterica serovar Typhi
uccccuuuuuucuguu

SEQ ID NO: 3671479 - RNA, 21 nt, Salmonella enterica enterica serovar Typhi
ucccgaacugucugaaucagu

SEQ ID NO: 3671480 - RNA, 20 nt, Salmonella enterica enterica serovar Typhi
ucccgacuuuacaccccacu

SEQ ID NO: 3671481 - RNA, 22 nt, Salmonella enterica enterica serovar Typhi
ucccgagccggguuauagccuu

SEQ ID NO: 3671482 - RNA, 14 nt, Salmonella enterica enterica serovar Typhi
ucccgauaaugacc

SEQ ID NO: 3671483 - RNA, 15 nt, Salmonella enterica enterica serovar Typhi
ucccgauauaaaggu

SEQ ID NO: 3671484 - RNA, 13 nt, Salmonella enterica enterica serovar Typhi
ucccgaucuucau

SEQ ID NO: 3671485 - RNA, 15 nt, Salmonella enterica enterica serovar Typhi
ucccgaugccagcaa

SEQ ID NO: 3671486 - RNA, 17 nt, Salmonella enterica enterica serovar Typhi
ucccgaugguggcgucg

SEQ ID NO: 3671487 - RNA, 20 nt, Salmonella enterica enterica serovar Typhi
ucccgcaaacuggccacagc

SEQ ID NO: 3671488 - RNA, 23 nt, Salmonella enterica enterica serovar Typhi
ucccgcacccgggaaagcggauc

SEQ ID NO: 3671489 - RNA, 13 nt, Salmonella enterica enterica serovar Typhi
ucccgcacgcugg

SEQ ID NO: 3671490 - RNA, 13 nt, Salmonella enterica enterica serovar Typhi
ucccgcagccacu

SEQ ID NO: 3671491 - RNA, 13 nt, Salmonella enterica enterica serovar Typhi
ucccgccagcugc

SEQ ID NO: 3671492 - RNA, 14 nt, Salmonella enterica enterica serovar Typhi
ucccgcccagcaac

SEQ ID NO: 3671493 - RNA, 13 nt, Salmonella enterica enterica serovar Typhi
ucccgcccgcgua

SEQ ID NO: 3671494 - RNA, 11 nt, Salmonella enterica enterica serovar Typhi
ucccgccgcca

SEQ ID NO: 3671495 - RNA, 12 nt, Salmonella enterica enterica serovar Typhi
ucccgccgcgau

SEQ ID NO: 3671496 - RNA, 18 nt, Salmonella enterica enterica serovar Typhi
uccggcugccugccggau

SEQ ID NO: 3671497 - RNA, 22 nt, Salmonella enterica enterica serovar Typhi
uccggcuuaaugcauggcagau

SEQ ID NO: 3671498 - RNA, 20 nt, Salmonella enterica enterica serovar Typhi
uccgggaaggacgccaccgg

SEQ ID NO: 3671499 - RNA, 16 nt, Salmonella enterica enterica serovar Typhi
uccgggauauaaaauu

SEQ ID NO: 3671500 - RNA, 19 nt, Salmonella enterica enterica serovar Typhi
uccgggauguuaauuucau

SEQ ID NO: 3671501 - RNA, 19 nt, Salmonella enterica enterica serovar Typhi
uccgggcgcaccaguuccc

SEQ ID NO: 3671502 - RNA, 16 nt, Salmonella enterica enterica serovar Typhi
uccggggaucguucug

SEQ ID NO: 3671503 - RNA, 13 nt, Salmonella enterica enterica serovar Typhi
uccggguaauuuu

SEQ ID NO: 3671504 - RNA, 19 nt, Salmonella enterica enterica serovar Typhi
uccgggucaguuuuuugac

SEQ ID NO: 3671505 - RNA, 13 nt, Salmonella enterica enterica serovar Typhi
uccgguacaccaa

SEQ ID NO: 3671506 - RNA, 17 nt, Salmonella enterica enterica serovar Typhi
uccgguacaccaacuac

SEQ ID NO: 3671507 - RNA, 15 nt, Salmonella enterica enterica serovar Typhi
uccgguacgccuaaa

SEQ ID NO: 3671508 - RNA, 15 nt, Salmonella enterica enterica serovar Typhi
uccgguagcgccugu

SEQ ID NO: 3671509 - RNA, 22 nt, Salmonella enterica enterica serovar Typhi
uccgguagguuuaaaccacucc

SEQ ID NO: 3671510 - RNA, 14 nt, Salmonella enterica enterica serovar Typhi
uccgguaucgccgg

SEQ ID NO: 3671511 - RNA, 14 nt, Salmonella enterica enterica serovar Typhi
uccggucaucgcgg

SEQ ID NO: 3671512 - RNA, 16 nt, Salmonella enterica enterica serovar Typhi
uccggugugaccagcg

SEQ ID NO: 3671513 - RNA, 19 nt, Salmonella enterica enterica serovar Typhi
uccggugugaccagcgcgu

SEQ ID NO: 3671514 - RNA, 14 nt, Salmonella enterica enterica serovar Typhi
uccgguuccagcgg

SEQ ID NO: 3671515 - RNA, 11 nt, Salmonella enterica enterica serovar Typhi
uccgguuuuug

SEQ ID NO: 3671516 - RNA, 18 nt, Salmonella enterica enterica serovar Typhi
uccguaaucgcuuucauu

SEQ ID NO: 3671517 - RNA, 22 nt, Salmonella enterica enterica serovar Typhi
uccguagcggauugccgcgcuc

SEQ ID NO: 3671518 - RNA, 22 nt, Salmonella enterica enterica serovar Typhi
uccguaggcggcuaccgccgua

SEQ ID NO: 3671519 - RNA, 19 nt, Salmonella enterica enterica serovar Typhi
uccguauucggaauaaugu

SEQ ID NO: 3671520 - RNA, 16 nt, Salmonella enterica enterica serovar Typhi
uccguauugcaaugcg

SEQ ID NO: 3671521 - RNA, 20 nt, Salmonella enterica enterica serovar Typhi
uccgucaggguaugucggua

SEQ ID NO: 3671522 - RNA, 22 nt, Salmonella enterica enterica serovar Typhi
uccgucauguagcaaauuucau

SEQ ID NO: 3671523 - RNA, 13 nt, Salmonella enterica enterica serovar Typhi
uccguccucuuuc

SEQ ID NO: 3671524 - RNA, 20 nt, Salmonella enterica enterica serovar Typhi
uccgucguuaaucagcgcgg

SEQ ID NO: 3671525 - RNA, 19 nt, Salmonella enterica enterica serovar Typhi
uccgucucuuuauugaaaa

SEQ ID NO: 3671526 - RNA, 21 nt, Salmonella enterica enterica serovar Typhi
uccgugaaugccaagcgcaua

SEQ ID NO: 3671527 - RNA, 19 nt, Salmonella enterica enterica serovar Typhi
uccguuaccccuuuuucaa

SEQ ID NO: 3671528 - RNA, 14 nt, Salmonella enterica enterica serovar Typhi
uccguuagcuggca

SEQ ID NO: 3671529 - RNA, 13 nt, Salmonella enterica enterica serovar Typhi
uccguuauuucac

SEQ ID NO: 3671530 - RNA, 17 nt, Salmonella enterica enterica serovar Typhi
uccguuauuucacagca

SEQ ID NO: 3671531 - RNA, 17 nt, Salmonella enterica enterica serovar Typhi
uccguucaucggcauac

SEQ ID NO: 3671532 - RNA, 18 nt, Salmonella enterica enterica serovar Typhi
uccguucaucggcauaca

SEQ ID NO: 3671533 - RNA, 16 nt, Salmonella enterica enterica serovar Typhi
uccguucccaaugcuu

SEQ ID NO: 3671534 - RNA, 21 nt, Salmonella enterica enterica serovar Typhi
uccguugccacccaaugaucc

SEQ ID NO: 3671535 - RNA, 18 nt, Salmonella enterica enterica serovar Typhi
uccguuuguaacauauuu

SEQ ID NO: 3671536 - RNA, 23 nt, Salmonella enterica enterica serovar Typhi
uccguuuucgacaugguuggcca

SEQ ID NO: 3671537 - RNA, 22 nt, Salmonella enterica enterica serovar Typhi
uccuauuugcuugugacggcaa

SEQ ID NO: 3671538 - RNA, 17 nt, Salmonella enterica enterica serovar Typhi
uccucaacagacauauc

SEQ ID NO: 3671539 - RNA, 16 nt, Salmonella enterica enterica serovar Typhi
uccucaacucguuccc

SEQ ID NO: 3671540 - RNA, 20 nt, Salmonella enterica enterica serovar Typhi
uccucaauauugucuucguc

SEQ ID NO: 3671541 - RNA, 22 nt, Salmonella enterica enterica serovar Typhi
uccucaccguagcuccagaccu

SEQ ID NO: 3671542 - RNA, 20 nt, Salmonella enterica enterica serovar Typhi
uccucagcgaauaucucuau

SEQ ID NO: 3671543 - RNA, 13 nt, Salmonella enterica enterica serovar Typhi
uccucauacagcc

SEQ ID NO: 3671544 - RNA, 14 nt, Salmonella enterica enterica serovar Typhi
uccucauucagcgg

SEQ ID NO: 3671545 - RNA, 19 nt, Salmonella enterica enterica serovar Typhi
uccucauuuuguugcucca

SEQ ID NO: 3671546 - RNA, 21 nt, Salmonella enterica enterica serovar Typhi
uccucauuuuguugcuccagc

SEQ ID NO: 3671547 - RNA, 16 nt, Salmonella enterica enterica serovar Typhi
uccuccaacgugcaga

SEQ ID NO: 3671548 - RNA, 17 nt, Salmonella enterica enterica serovar Typhi
uccuccaacgugcagau

SEQ ID NO: 3671549 - RNA, 20 nt, Salmonella enterica enterica serovar Typhi
uccuccgccgauaagcgcug

SEQ ID NO: 3671550 - RNA, 16 nt, Salmonella enterica enterica serovar Typhi
uccuccggcugaagcc

SEQ ID NO: 3671551 - RNA, 14 nt, Salmonella enterica enterica serovar Typhi
uccucgaucgccug

SEQ ID NO: 3671552 - RNA, 14 nt, Salmonella enterica enterica serovar Typhi
uccucgcauccucc

SEQ ID NO: 3671553 - RNA, 20 nt, Salmonella enterica enterica serovar Typhi
uccucgcggguggccugcag

SEQ ID NO: 3671554 - RNA, 16 nt, Salmonella enterica enterica serovar Typhi
uccucuugucaggcag

SEQ ID NO: 3671555 - RNA, 14 nt, Salmonella enterica enterica serovar Typhi
uccucuuucaaccu

SEQ ID NO: 3671556 - RNA, 13 nt, Salmonella enterica enterica serovar Typhi
uccucuuucccuu

SEQ ID NO: 3671557 - RNA, 11 nt, Salmonella enterica enterica serovar Typhi
uccugaaaaaa

SEQ ID NO: 3671558 - RNA, 18 nt, Salmonella enterica enterica serovar Typhi
uccugaauugcaaggcga

SEQ ID NO: 3671559 - RNA, 20 nt, Salmonella enterica enterica serovar Typhi
uccugaccaccggcccgguu

SEQ ID NO: 3671560 - RNA, 21 nt, Salmonella enterica enterica serovar Typhi
uccugaccaugccacaacaga

SEQ ID NO: 3671561 - RNA, 23 nt, Salmonella enterica enterica serovar Typhi
uccugaccgggcucacgcuggug

SEQ ID NO: 3671562 - RNA, 19 nt, Salmonella enterica enterica serovar Typhi
uccugagcagacauauuuu

SEQ ID NO: 3671563 - RNA, 13 nt, Salmonella enterica enterica serovar Typhi
uccugagcgaaug

SEQ ID NO: 3671564 - RNA, 22 nt, Salmonella enterica enterica serovar Typhi
uccugagcgaauguauaaucca

SEQ ID NO: 3671565 - RNA, 22 nt, Salmonella enterica enterica serovar Typhi
uccugaguaaagccugcccugc

SEQ ID NO: 3671566 - RNA, 19 nt, Salmonella enterica enterica serovar Typhi
uccugauagcaaucauccu

SEQ ID NO: 3671567 - RNA, 22 nt, Salmonella enterica enterica serovar Typhi
uccugauauucccguuccagcu

SEQ ID NO: 3671568 - RNA, 22 nt, Salmonella enterica enterica serovar Typhi
uccugauccgccuuacgcaguu

SEQ ID NO: 3671569 - RNA, 15 nt, Salmonella enterica enterica serovar Typhi
uccugauccggcugu

SEQ ID NO: 3671570 - RNA, 15 nt, Salmonella enterica enterica serovar Typhi
uccugcaaaauaccg

SEQ ID NO: 3671571 - RNA, 19 nt, Salmonella enterica enterica serovar Typhi
uccugcaaauagcgcugau

SEQ ID NO: 3671572 - RNA, 14 nt, Salmonella enterica enterica serovar Typhi
uccugcaacagaag

SEQ ID NO: 3671573 - RNA, 16 nt, Salmonella enterica enterica serovar Typhi
uccugcaacagaagag

SEQ ID NO: 3671574 - RNA, 17 nt, Salmonella enterica enterica serovar Typhi
uccugcaccgccugcgg

SEQ ID NO: 3671575 - RNA, 18 nt, Salmonella enterica enterica serovar Typhi
uccugcagcgccagaaag

SEQ ID NO: 3671576 - RNA, 20 nt, Salmonella enterica enterica serovar Typhi
uccugcaucgacauccgauu

SEQ ID NO: 3671577 - RNA, 18 nt, Salmonella enterica enterica serovar Typhi
uccugcauuugcgcauau

SEQ ID NO: 3671578 - RNA, 16 nt, Salmonella enterica enterica serovar Typhi
uccugccgacaggcag

SEQ ID NO: 3671579 - RNA, 22 nt, Salmonella enterica enterica serovar Typhi
uccugccgacaggcagguugcc

SEQ ID NO: 3671580 - RNA, 22 nt, Salmonella enterica enterica serovar Typhi
uccugccgccgcaccacugcug

SEQ ID NO: 3671581 - RNA, 22 nt, Salmonella enterica enterica serovar Typhi
ucgacccgcaaugugcagcagg

SEQ ID NO: 3671582 - RNA, 11 nt, Salmonella enterica enterica serovar Typhi
ucgaccgcaga

SEQ ID NO: 3671583 - RNA, 20 nt, Salmonella enterica enterica serovar Typhi
ucgaccucuucguucauccg

SEQ ID NO: 3671584 - RNA, 21 nt, Salmonella enterica enterica serovar Typhi
ucgaccugcguuaacggcuuc

SEQ ID NO: 3671585 - RNA, 16 nt, Salmonella enterica enterica serovar Typhi
ucgacgaaauggugug

SEQ ID NO: 3671586 - RNA, 17 nt, Salmonella enterica enterica serovar Typhi
ucgacgauaaaaaaagu

SEQ ID NO: 3671587 - RNA, 13 nt, Salmonella enterica enterica serovar Typhi
ucgacgccagcgg

SEQ ID NO: 3671588 - RNA, 21 nt, Salmonella enterica enterica serovar Typhi
ucgacgcgcaucacaaugacc

SEQ ID NO: 3671589 - RNA, 19 nt, Salmonella enterica enterica serovar Typhi
ucgacgcuauuuuucaggg

SEQ ID NO: 3671590 - RNA, 13 nt, Salmonella enterica enterica serovar Typhi
ucgacggcaaccu

SEQ ID NO: 3671591 - RNA, 22 nt, Salmonella enterica enterica serovar Typhi
ucgacgggacgaauuuccagcg

SEQ ID NO: 3671592 - RNA, 16 nt, Salmonella enterica enterica serovar Typhi
ucgacguccagcgcgu

SEQ ID NO: 3671593 - RNA, 20 nt, Salmonella enterica enterica serovar Typhi
ucgacguucagcauauccag

SEQ ID NO: 3671594 - RNA, 20 nt, Salmonella enterica enterica serovar Typhi
ucgacguugaucgccaucgc

SEQ ID NO: 3671595 - RNA, 19 nt, Salmonella enterica enterica serovar Typhi
ucgacuaauuuuaggaaga

SEQ ID NO: 3671596 - RNA, 18 nt, Salmonella enterica enterica serovar Typhi
ucgacuguuguucuucau

SEQ ID NO: 3671597 - RNA, 19 nt, Salmonella enterica enterica serovar Typhi
ucgagauuuuucugcgcca

SEQ ID NO: 3671598 - RNA, 11 nt, Salmonella enterica enterica serovar Typhi
ucgagcgcgga

SEQ ID NO: 3671599 - RNA, 18 nt, Salmonella enterica enterica serovar Typhi
ucgagcguaauuccggcc

SEQ ID NO: 3671600 - RNA, 18 nt, Salmonella enterica enterica serovar Typhi
ucgagcgugucagugcca

SEQ ID NO: 3671601 - RNA, 19 nt, Salmonella enterica enterica serovar Typhi
ucgagcuuuugcugcgcca

SEQ ID NO: 3671602 - RNA, 22 nt, Salmonella enterica enterica serovar Typhi
ucgaggaacuguucagccagca

SEQ ID NO: 3671603 - RNA, 15 nt, Salmonella enterica enterica serovar Typhi
ucgaggacggccuga

SEQ ID NO: 3671604 - RNA, 14 nt, Salmonella enterica enterica serovar Typhi
ucgagugaaccgga

SEQ ID NO: 3671605 - RNA, 19 nt, Salmonella enterica enterica serovar Typhi
ucgagugucaauaagccag

SEQ ID NO: 3671606 - RNA, 22 nt, Salmonella enterica enterica serovar Typhi
ucgaguucuugcgacaucgcau

SEQ ID NO: 3671607 - RNA, 14 nt, Salmonella enterica enterica serovar Typhi
ucgauaaacucaug

SEQ ID NO: 3671608 - RNA, 21 nt, Salmonella enterica enterica serovar Typhi
ucgauaaagcgguuaucggca

SEQ ID NO: 3671609 - RNA, 16 nt, Salmonella enterica enterica serovar Typhi
ucgauaaccaccagcg

SEQ ID NO: 3671610 - RNA, 14 nt, Salmonella enterica enterica serovar Typhi
ucgauaaccgccga

SEQ ID NO: 3671611 - RNA, 16 nt, Salmonella enterica enterica serovar Typhi
ucgauaagccagcgau

SEQ ID NO: 3671612 - RNA, 16 nt, Salmonella enterica enterica serovar Typhi
ucgauaaucgcgcgcu

SEQ ID NO: 3671613 - RNA, 23 nt, Salmonella enterica enterica serovar Typhi
ucgauaaucgguagcacuuuaaa

SEQ ID NO: 3671614 - RNA, 22 nt, Salmonella enterica enterica serovar Typhi
ucgauacgauugcgcguguuac

SEQ ID NO: 3671615 - RNA, 18 nt, Salmonella enterica enterica serovar Typhi
ucgauacgcugaagcuug

SEQ ID NO: 3671616 - RNA, 17 nt, Salmonella enterica enterica serovar Typhi
ucgauacuauaacgcuu

SEQ ID NO: 3671617 - RNA, 22 nt, Salmonella enterica enterica serovar Typhi
ucgauacucacgacuuucacca

SEQ ID NO: 3671618 - RNA, 13 nt, Salmonella enterica enterica serovar Typhi
ucgauagcaggca

SEQ ID NO: 3671619 - RNA, 16 nt, Salmonella enterica enterica serovar Typhi
ucgauagcgccgcauc

SEQ ID NO: 3671620 - RNA, 16 nt, Salmonella enterica enterica serovar Typhi
ucgauauaauuuuauu

SEQ ID NO: 3671621 - RNA, 17 nt, Salmonella enterica enterica serovar Typhi
ucgauauacuccgcgac

SEQ ID NO: 3671622 - RNA, 19 nt, Salmonella enterica enterica serovar Typhi
ucgauaucgauaaucaaca

SEQ ID NO: 3671623 - RNA, 17 nt, Salmonella enterica enterica serovar Typhi
ucgaucagcgcguagau

SEQ ID NO: 3671624 - RNA, 17 nt, Salmonella enterica enterica serovar Typhi
ucgauccccucuuccau

SEQ ID NO: 3671625 - RNA, 22 nt, Salmonella enterica enterica serovar Typhi
ucgauccccucuuccaucagcc

SEQ ID NO: 3671626 - RNA, 14 nt, Salmonella enterica enterica serovar Typhi
ucgaucccggcaaa

SEQ ID NO: 3671627 - RNA, 23 nt, Salmonella enterica enterica serovar Typhi
ucgauccgguuacucgcaucgaa

SEQ ID NO: 3671628 - RNA, 22 nt, Salmonella enterica enterica serovar Typhi
ucgaucucgauauucacacgcu

SEQ ID NO: 3671629 - RNA, 21 nt, Salmonella enterica enterica serovar Typhi
ucgaucucggccacguccguu

SEQ ID NO: 3671630 - RNA, 15 nt, Salmonella enterica enterica serovar Typhi
ucgaugaaaaagagg

SEQ ID NO: 3671631 - RNA, 22 nt, Salmonella enterica enterica serovar Typhi
ucgaugcggauccggcgcagac

SEQ ID NO: 3671632 - RNA, 21 nt, Salmonella enterica enterica serovar Typhi
ucgaugcuggugaagacgcug

SEQ ID NO: 3671633 - RNA, 12 nt, Salmonella enterica enterica serovar Typhi
ucgauggcagug

SEQ ID NO: 3671634 - RNA, 13 nt, Salmonella enterica enterica serovar Typhi
ucgauggccucau

SEQ ID NO: 3671635 - RNA, 16 nt, Salmonella enterica enterica serovar Typhi
ucgauggccucaucau

SEQ ID NO: 3671636 - RNA, 14 nt, Salmonella enterica enterica serovar Typhi
ucgaugucgucgau

SEQ ID NO: 3671637 - RNA, 12 nt, Salmonella enterica enterica serovar Typhi
ucgauuaaacgc

SEQ ID NO: 3671638 - RNA, 17 nt, Salmonella enterica enterica serovar Typhi
ucgauuaaacgccuggg

SEQ ID NO: 3671639 - RNA, 21 nt, Salmonella enterica enterica serovar Typhi
ucgauuuccgguuccagcggc

SEQ ID NO: 3671640 - RNA, 16 nt, Salmonella enterica enterica serovar Typhi
ucgauuuuagcgcauc

SEQ ID NO: 3671641 - RNA, 22 nt, Salmonella enterica enterica serovar Typhi
ucgauuuucugcucaauauuau

SEQ ID NO: 3671642 - RNA, 21 nt, Salmonella enterica enterica serovar Typhi
ucgauuuuguuaugcgcauag

SEQ ID NO: 3671643 - RNA, 20 nt, Salmonella enterica enterica serovar Typhi
ucgcaaaauagcgguucaau

SEQ ID NO: 3671644 - RNA, 13 nt, Salmonella enterica enterica serovar Typhi
ucgcaaaauuccg

SEQ ID NO: 3671645 - RNA, 17 nt, Salmonella enterica enterica serovar Typhi
ucgcaaacggaauaaac

SEQ ID NO: 3671646 - RNA, 15 nt, Salmonella enterica enterica serovar Typhi
ucgcaaacugcgcgc

SEQ ID NO: 3671647 - RNA, 21 nt, Salmonella enterica enterica serovar Typhi
ucgcaaagaaaucaacgaauu

SEQ ID NO: 3671648 - RNA, 14 nt, Salmonella enterica enterica serovar Typhi
ucgcaaauaaucuu

SEQ ID NO: 3671649 - RNA, 20 nt, Salmonella enterica enterica serovar Typhi
ucgcaacgccccgucaccag

SEQ ID NO: 3671650 - RNA, 22 nt, Salmonella enterica enterica serovar Typhi
ucgcaacgcuuaucagucccca

SEQ ID NO: 3671651 - RNA, 20 nt, Salmonella enterica enterica serovar Typhi
ucgcaauauacugauauugc

SEQ ID NO: 3671652 - RNA, 17 nt, Salmonella enterica enterica serovar Typhi
ucgcaaucuggcgcaau

SEQ ID NO: 3671653 - RNA, 14 nt, Salmonella enterica enterica serovar Typhi
ucgcacauaucgca

SEQ ID NO: 3671654 - RNA, 23 nt, Salmonella enterica enterica serovar Typhi
ucgcacaucaugaugaucuucag

SEQ ID NO: 3671655 - RNA, 15 nt, Salmonella enterica enterica serovar Typhi
ucgcaccaccggacu

SEQ ID NO: 3671656 - RNA, 13 nt, Salmonella enterica enterica serovar Typhi
ucgcaccauagca

SEQ ID NO: 3671657 - RNA, 21 nt, Salmonella enterica enterica serovar Typhi
ucgcacgucgucguuuguagg

SEQ ID NO: 3671658 - RNA, 15 nt, Salmonella enterica enterica serovar Typhi
ucgcagacauggcaa

SEQ ID NO: 3671659 - RNA, 18 nt, Salmonella enterica enterica serovar Typhi
ucgcagagucgcagcggc

SEQ ID NO: 3671660 - RNA, 21 nt, Salmonella enterica enterica serovar Typhi
ucgcagccacccuggcauaug

SEQ ID NO: 3671661 - RNA, 24 nt, Salmonella enterica enterica serovar Typhi
ucgcagcgcuuugccgcugcugcc

SEQ ID NO: 3671662 - RNA, 12 nt, Salmonella enterica enterica serovar Typhi
ucgcagcggcug

SEQ ID NO: 3671663 - RNA, 13 nt, Salmonella enterica enterica serovar Typhi
ucgcaggccauaa

SEQ ID NO: 3671664 - RNA, 20 nt, Salmonella enterica enterica serovar Typhi
ucgcagggcugcuggugcgc

SEQ ID NO: 3671665 - RNA, 23 nt, Salmonella enterica enterica serovar Typhi
ucgcauucauaucgccugcggca

SEQ ID NO: 3671666 - RNA, 13 nt, Salmonella enterica enterica serovar Typhi
ucgccucccgcac

SEQ ID NO: 3671667 - RNA, 14 nt, Salmonella enterica enterica serovar Typhi
ucgccucccugccu

SEQ ID NO: 3671668 - RNA, 15 nt, Salmonella enterica enterica serovar Typhi
ucgccucccugccua

SEQ ID NO: 3671669 - RNA, 18 nt, Salmonella enterica enterica serovar Typhi
ucgccugaucgcgcagac

SEQ ID NO: 3671670 - RNA, 22 nt, Salmonella enterica enterica serovar Typhi
ucgccugauucaccaacugcug

SEQ ID NO: 3671671 - RNA, 15 nt, Salmonella enterica enterica serovar Typhi
ucgccugccagcgcu

SEQ ID NO: 3671672 - RNA, 20 nt, Salmonella enterica enterica serovar Typhi
ucgccugccagcgcucugca

SEQ ID NO: 3671673 - RNA, 22 nt, Salmonella enterica enterica serovar Typhi
ucgccuggugugaacaucacgu

SEQ ID NO: 3671674 - RNA, 14 nt, Salmonella enterica enterica serovar Typhi
guaguaucauccau

SEQ ID NO: 3671675 - RNA, 18 nt, Salmonella enterica enterica serovar Typhi
guagucaaauuccagcaa

SEQ ID NO: 3671676 - RNA, 14 nt, Salmonella enterica enterica serovar Typhi
guaguccaaauaag

SEQ ID NO: 3671677 - RNA, 14 nt, Salmonella enterica enterica serovar Typhi
guaguccuguaucu

SEQ ID NO: 3671678 - RNA, 19 nt, Salmonella enterica enterica serovar Typhi
guagucucccuccugcucc

SEQ ID NO: 3671679 - RNA, 18 nt, Salmonella enterica enterica serovar Typhi
guagugcuucucuucaaa

SEQ ID NO: 3671680 - RNA, 17 nt, Salmonella enterica enterica serovar Typhi
guaguggaucagcagau

SEQ ID NO: 3671681 - RNA, 15 nt, Salmonella enterica enterica serovar Typhi
guaguguaauaccac

SEQ ID NO: 3671682 - RNA, 13 nt, Salmonella enterica enterica serovar Typhi
guaguuagagaua

SEQ ID NO: 3671683 - RNA, 16 nt, Salmonella enterica enterica serovar Typhi
guuuacgcugcuaucc

SEQ ID NO: 3671684 - RNA, 18 nt, Salmonella enterica enterica serovar Typhi
guuuacuaaaacgguuuu

SEQ ID NO: 3671685 - RNA, 19 nt, Salmonella enterica enterica serovar Typhi
guuuacuccauucccagcu

SEQ ID NO: 3671686 - RNA, 18 nt, Salmonella enterica enterica serovar Typhi
guuuagaaaaaauuaaaa

SEQ ID NO: 3671687 - RNA, 14 nt, Salmonella enterica enterica serovar Typhi
guuuagcgccagca

SEQ ID NO: 3671688 - RNA, 17 nt, Salmonella enterica enterica serovar Typhi
guuuagcuguucaauca

SEQ ID NO: 3671689 - RNA, 22 nt, Salmonella enterica enterica serovar Typhi
guuuauaugcguguagcagaua

SEQ ID NO: 3671690 - RNA, 10 nt, Salmonella enterica enterica serovar Typhi
guuuauccgg

SEQ ID NO: 3671691 - RNA, 17 nt, Salmonella enterica enterica serovar Typhi
guuuaucugaugccuga

SEQ ID NO: 3671692 - RNA, 14 nt, Salmonella enterica enterica serovar Typhi
guuuauguuugcug

SEQ ID NO: 3671693 - RNA, 15 nt, Salmonella enterica enterica serovar Typhi
guuuauuauaaacac

SEQ ID NO: 3671694 - RNA, 15 nt, Salmonella enterica enterica serovar Typhi
guuuauucagaaaau

SEQ ID NO: 3671695 - RNA, 13 nt, Salmonella enterica enterica serovar Typhi
guuuauucaucuc

SEQ ID NO: 3671696 - RNA, 22 nt, Salmonella enterica enterica serovar Typhi
guuuauugaaauuaaucaggca

SEQ ID NO: 3671697 - RNA, 20 nt, Salmonella enterica enterica serovar Typhi
guuuauugagauaauuuaug

SEQ ID NO: 3671698 - RNA, 21 nt, Salmonella enterica enterica serovar Typhi
guuuauugccgcuucuuuauu

SEQ ID NO: 3671699 - RNA, 22 nt, Salmonella enterica enterica serovar Typhi
guuuauuuaacguguuacguuu

SEQ ID NO: 3671700 - RNA, 15 nt, Salmonella enterica enterica serovar Typhi
guuucaacuuccacc

SEQ ID NO: 3671701 - RNA, 15 nt, Salmonella enterica enterica serovar Typhi
guuucaauccaugua

SEQ ID NO: 3671702 - RNA, 18 nt, Salmonella enterica enterica serovar Typhi
guuucacaucgccaguua

SEQ ID NO: 3671703 - RNA, 14 nt, Salmonella enterica enterica serovar Typhi
guuucaccguuuuc

SEQ ID NO: 3671704 - RNA, 17 nt, Salmonella enterica enterica serovar Typhi
guuucacguccugguua

SEQ ID NO: 3671705 - RNA, 19 nt, Salmonella enterica enterica serovar Typhi
guuucagcaccuccagcgc

SEQ ID NO: 3671706 - RNA, 18 nt, Salmonella enterica enterica serovar Typhi
guuucaguaaaucccgca

SEQ ID NO: 3671707 - RNA, 16 nt, Salmonella enterica enterica serovar Typhi
guuucaguagcgguac

SEQ ID NO: 3671708 - RNA, 15 nt, Salmonella enterica enterica serovar Typhi
guuucauauccgaca

SEQ ID NO: 3671709 - RNA, 17 nt, Salmonella enterica enterica serovar Typhi
guuucaugccauacucc

SEQ ID NO: 3671710 - RNA, 20 nt, Salmonella enterica enterica serovar Typhi
guuuccacugagcuucaccg

SEQ ID NO: 3671711 - RNA, 21 nt, Salmonella enterica enterica serovar Typhi
guuucccaacaaugccacgcc

SEQ ID NO: 3671712 - RNA, 13 nt, Salmonella enterica enterica serovar Typhi
guuucccagguuu

SEQ ID NO: 3671713 - RNA, 20 nt, Salmonella enterica enterica serovar Typhi
guuucccauugggccagcag

SEQ ID NO: 3671714 - RNA, 22 nt, Salmonella enterica enterica serovar Typhi
guuucccauugggccagcagcg

SEQ ID NO: 3671715 - RNA, 15 nt, Salmonella enterica enterica serovar Typhi
guuuccgcguuauca

SEQ ID NO: 3671716 - RNA, 17 nt, Salmonella enterica enterica serovar Typhi
guuuccgcuagggcauc

SEQ ID NO: 3671717 - RNA, 14 nt, Salmonella enterica enterica serovar Typhi
guuuccggcgggag

SEQ ID NO: 3671718 - RNA, 22 nt, Salmonella enterica enterica serovar Typhi
guuuccguuuguaacauauuuu

SEQ ID NO: 3671719 - RNA, 18 nt, Salmonella enterica enterica serovar Typhi
guuucgacaguuucuucu

SEQ ID NO: 3671720 - RNA, 16 nt, Salmonella enterica enterica serovar Typhi
guuucgauagcaggca

SEQ ID NO: 3671721 - RNA, 15 nt, Salmonella enterica enterica serovar Typhi
guuucgccgcagggu

SEQ ID NO: 3671722 - RNA, 17 nt, Salmonella enterica enterica serovar Typhi
guuucgccuaagcccac

SEQ ID NO: 3671723 - RNA, 18 nt, Salmonella enterica enterica serovar Typhi
guuucguuuagcgccugc

SEQ ID NO: 3671724 - RNA, 14 nt, Salmonella enterica enterica serovar Typhi
guuucuacggccac

SEQ ID NO: 3671725 - RNA, 18 nt, Salmonella enterica enterica serovar Typhi
guuucuagaugaugauuu

SEQ ID NO: 3671726 - RNA, 21 nt, Salmonella enterica enterica serovar Typhi
guuucucgccgguagccagcc

SEQ ID NO: 3671727 - RNA, 19 nt, Salmonella enterica enterica serovar Typhi
guuucucuuccgccagcgc

SEQ ID NO: 3671728 - RNA, 22 nt, Salmonella enterica enterica serovar Typhi
guuucucuugugcuuccagcuc

SEQ ID NO: 3671729 - RNA, 13 nt, Salmonella enterica enterica serovar Typhi
guuucugauagcc

SEQ ID NO: 3671730 - RNA, 20 nt, Salmonella enterica enterica serovar Typhi
guuucuuuuaaggcggcaaa

SEQ ID NO: 3671731 - RNA, 17 nt, Salmonella enterica enterica serovar Typhi
guuucuuuucguuucuu

SEQ ID NO: 3671732 - RNA, 22 nt, Salmonella enterica enterica serovar Typhi
guuugaggaaaccuuucuucuc

SEQ ID NO: 3671733 - RNA, 23 nt, Salmonella enterica enterica serovar Typhi
guuugaggaaaccuuucuucucu

SEQ ID NO: 3671734 - RNA, 19 nt, Salmonella enterica enterica serovar Typhi
guuugaggcuugcagcauu

SEQ ID NO: 3671735 - RNA, 15 nt, Salmonella enterica enterica serovar Typhi
guuugaucauggcuc

SEQ ID NO: 3671736 - RNA, 13 nt, Salmonella enterica enterica serovar Typhi
guuugcagccaga

SEQ ID NO: 3671737 - RNA, 19 nt, Salmonella enterica enterica serovar Typhi
guuugccccauuguucuuu

SEQ ID NO: 3671738 - RNA, 12 nt, Salmonella enterica enterica serovar Typhi
guuugcgcgucg

SEQ ID NO: 3671739 - RNA, 18 nt, Salmonella enterica enterica serovar Typhi
guuugcggauuggauaaa

SEQ ID NO: 3671740 - RNA, 18 nt, Salmonella enterica enterica serovar Typhi
guuugcucgccauaaauc

SEQ ID NO: 3671741 - RNA, 18 nt, Salmonella enterica enterica serovar Typhi
guuuggacuaccgguaaa

SEQ ID NO: 3671742 - RNA, 15 nt, Salmonella enterica enterica serovar Typhi
guuuguaggccggau

SEQ ID NO: 3671743 - RNA, 13 nt, Salmonella enterica enterica serovar Typhi
guuuuaaaaauaa

SEQ ID NO: 3671744 - RNA, 14 nt, Salmonella enterica enterica serovar Typhi
guuuuaaaaauaac

SEQ ID NO: 3671745 - RNA, 19 nt, Salmonella enterica enterica serovar Typhi
guuuuaaucuuuuauaugu

SEQ ID NO: 3671746 - RNA, 13 nt, Salmonella enterica enterica serovar Typhi
guuuuaccggcag

SEQ ID NO: 3671747 - RNA, 19 nt, Salmonella enterica enterica serovar Typhi
guuuuacgaugguugugug

SEQ ID NO: 3671748 - RNA, 20 nt, Salmonella enterica enterica serovar Typhi
guuuuagcagaguaugcugc

SEQ ID NO: 3671749 - RNA, 11 nt, Salmonella enterica enterica serovar Typhi
guuuuaucaug

SEQ ID NO: 3671750 - RNA, 17 nt, Salmonella enterica enterica serovar Typhi
guuuuauccccuucagg

SEQ ID NO: 3671751 - RNA, 14 nt, Salmonella enterica enterica serovar Typhi
guuuuauccguuuc

SEQ ID NO: 3671752 - RNA, 20 nt, Salmonella enterica enterica serovar Typhi
guuuuauugcuucagccaga

SEQ ID NO: 3671753 - RNA, 22 nt, Salmonella enterica enterica serovar Typhi
guuuucaggccgcguaauuuuu

SEQ ID NO: 3671754 - RNA, 14 nt, Salmonella enterica enterica serovar Typhi
guuuucaggucaua

SEQ ID NO: 3671755 - RNA, 17 nt, Salmonella enterica enterica serovar Typhi
guuuucauuagccgcca

SEQ ID NO: 3671756 - RNA, 13 nt, Salmonella enterica enterica serovar Typhi
guuuuccagcauc

SEQ ID NO: 3671757 - RNA, 12 nt, Salmonella enterica enterica serovar Typhi
guuuuccagcuc

SEQ ID NO: 3671758 - RNA, 22 nt, Salmonella enterica enterica serovar Typhi
guuuuccgguauuuauccagca

SEQ ID NO: 3671759 - RNA, 14 nt, Salmonella enterica enterica serovar Typhi
guuuucgccuuugc

SEQ ID NO: 3671760 - RNA, 19 nt, Salmonella enterica enterica serovar Typhi
guuuucgucccagcgcacc

SEQ ID NO: 3671761 - RNA, 23 nt, Salmonella enterica enterica serovar Typhi
guuuucuauuuucuccggcaguc

SEQ ID NO: 3671762 - RNA, 22 nt, Salmonella enterica enterica serovar Typhi
guuuucugcauuggcgacgaua

SEQ ID NO: 3671763 - RNA, 15 nt, Salmonella enterica enterica serovar Typhi
guuuugauguccaga

SEQ ID NO: 3671764 - RNA, 22 nt, Salmonella enterica enterica serovar Typhi
guuuugcaggaaaaacuguccc

SEQ ID NO: 3671765 - RNA, 18 nt, Salmonella enterica enterica serovar Typhi
guuuugccaguuucucaa

SEQ ID NO: 3671766 - RNA, 14 nt, Salmonella enterica enterica serovar Typhi
guuuugcccauuuc

SEQ ID NO: 3671767 - RNA, 15 nt, Salmonella enterica enterica serovar Typhi
guuuugcucaguaac

SEQ ID NO: 3671768 - RNA, 18 nt, Salmonella enterica enterica serovar Typhi
guuuugcugauaugaaac

SEQ ID NO: 3671769 - RNA, 21 nt, Salmonella enterica enterica serovar Typhi
uaaacacucuccaccaaaucc

SEQ ID NO: 3671770 - RNA, 17 nt, Salmonella enterica enterica serovar Typhi
uaaacagcagcgcggca

SEQ ID NO: 3671771 - RNA, 12 nt, Salmonella enterica enterica serovar Typhi
uaaacaggcagg

SEQ ID NO: 3671772 - RNA, 15 nt, Salmonella enterica enterica serovar Typhi
uaaacaggcaggccc

SEQ ID NO: 3671773 - RNA, 16 nt, Salmonella enterica enterica serovar Typhi
uaaacagguaaaacaa

SEQ ID NO: 3671774 - RNA, 13 nt, Salmonella enterica enterica serovar Typhi
uaaaccaaagcag

SEQ ID NO: 3671775 - RNA, 21 nt, Salmonella enterica enterica serovar Typhi
uaaaccacaugaccagcgccg

SEQ ID NO: 3671776 - RNA, 17 nt, Salmonella enterica enterica serovar Typhi
uaaaccaccggauggcg

SEQ ID NO: 3671777 - RNA, 13 nt, Salmonella enterica enterica serovar Typhi
uaaaccaggccag

SEQ ID NO: 3671778 - RNA, 19 nt, Salmonella enterica enterica serovar Typhi
uaaacccgauucugccagu

SEQ ID NO: 3671779 - RNA, 23 nt, Salmonella enterica enterica serovar Typhi
uaaaccgcugccacacucucucc

SEQ ID NO: 3671780 - RNA, 21 nt, Salmonella enterica enterica serovar Typhi
uaaaccggucucuuaaugcca

SEQ ID NO: 3671781 - RNA, 19 nt, Salmonella enterica enterica serovar Typhi
uaaaccgucauuuaccagu

SEQ ID NO: 3671782 - RNA, 15 nt, Salmonella enterica enterica serovar Typhi
uaaaccguuuuuccg

SEQ ID NO: 3671783 - RNA, 19 nt, Salmonella enterica enterica serovar Typhi
uaaacgaucgguuaucacg

SEQ ID NO: 3671784 - RNA, 15 nt, Salmonella enterica enterica serovar Typhi
uaaacgcaacaccau

SEQ ID NO: 3671785 - RNA, 14 nt, Salmonella enterica enterica serovar Typhi
uaaacgccagugga

SEQ ID NO: 3671786 - RNA, 15 nt, Salmonella enterica enterica serovar Typhi
uaaacgccugcacca

SEQ ID NO: 3671787 - RNA, 19 nt, Salmonella enterica enterica serovar Typhi
uaaacgcgccaaguaaauu

SEQ ID NO: 3671788 - RNA, 15 nt, Salmonella enterica enterica serovar Typhi
uaaacgcucaagcaa

SEQ ID NO: 3671789 - RNA, 23 nt, Salmonella enterica enterica serovar Typhi
uaaacgcuccggcaggcaaaucu

SEQ ID NO: 3671790 - RNA, 16 nt, Salmonella enterica enterica serovar Typhi
uaaacggcagccgcca

SEQ ID NO: 3671791 - RNA, 22 nt, Salmonella enterica enterica serovar Typhi
uaaacggcucugcaucauuccu

SEQ ID NO: 3671792 - RNA, 18 nt, Salmonella enterica enterica serovar Typhi
uaaacgggcagagucgau

SEQ ID NO: 3671793 - RNA, 22 nt, Salmonella enterica enterica serovar Typhi
uaaacgggguaaacuucacguc

SEQ ID NO: 3671794 - RNA, 14 nt, Salmonella enterica enterica serovar Typhi
uaaacggucaggau

SEQ ID NO: 3671795 - RNA, 20 nt, Salmonella enterica enterica serovar Typhi
uaaacgguucagucagcgcg

SEQ ID NO: 3671796 - RNA, 16 nt, Salmonella enterica enterica serovar Typhi
uaaacguaggccgggc

SEQ ID NO: 3671797 - RNA, 12 nt, Salmonella enterica enterica serovar Typhi
uaaacgucccug

SEQ ID NO: 3671798 - RNA, 15 nt, Salmonella enterica enterica serovar Typhi
uaaacgugccacagu

SEQ ID NO: 3671799 - RNA, 13 nt, Salmonella enterica enterica serovar Typhi
uaaacguuccugc

SEQ ID NO: 3671800 - RNA, 14 nt, Salmonella enterica enterica serovar Typhi
uaaacguuccugcc

SEQ ID NO: 3671801 - RNA, 19 nt, Salmonella enterica enterica serovar Typhi
uaaacuaaguaaggaggaa

SEQ ID NO: 3671802 - RNA, 17 nt, Salmonella enterica enterica serovar Typhi
uaaacucaaucaggcua

SEQ ID NO: 3671803 - RNA, 17 nt, Salmonella enterica enterica serovar Typhi
uaaacuccauuaaauua

SEQ ID NO: 3671804 - RNA, 19 nt, Salmonella enterica enterica serovar Typhi
uaaacucuguguuaugaau

SEQ ID NO: 3671805 - RNA, 13 nt, Salmonella enterica enterica serovar Typhi
uaaacugccuucg

SEQ ID NO: 3671806 - RNA, 18 nt, Salmonella enterica enterica serovar Typhi
uaaacugcgcgauaucug

SEQ ID NO: 3671807 - RNA, 15 nt, Salmonella enterica enterica serovar Typhi
uaaacuguuuccagu

SEQ ID NO: 3671808 - RNA, 16 nt, Salmonella enterica enterica serovar Typhi
uaaacuguuuccaguu

SEQ ID NO: 3671809 - RNA, 22 nt, Salmonella enterica enterica serovar Typhi
uaaacuucacgucgcucacauu

SEQ ID NO: 3671810 - RNA, 15 nt, Salmonella enterica enterica serovar Typhi
uaaagaaauuuaaag

SEQ ID NO: 3671811 - RNA, 21 nt, Salmonella enterica enterica serovar Typhi
uaaagaacggccucccaaacu

SEQ ID NO: 3671812 - RNA, 15 nt, Salmonella enterica enterica serovar Typhi
uaaagaccggcacaa

SEQ ID NO: 3671813 - RNA, 18 nt, Salmonella enterica enterica serovar Typhi
uaaagacgguaaucagac

SEQ ID NO: 3671814 - RNA, 13 nt, Salmonella enterica enterica serovar Typhi
uaaagauaagcac

SEQ ID NO: 3671815 - RNA, 13 nt, Salmonella enterica enterica serovar Typhi
uaaagaucugaug

SEQ ID NO: 3671816 - RNA, 18 nt, Salmonella enterica enterica serovar Typhi
uaaagauuggcaucugca

SEQ ID NO: 3671817 - RNA, 15 nt, Salmonella enterica enterica serovar Typhi
uaaagauuguuucgg

SEQ ID NO: 3671818 - RNA, 19 nt, Salmonella enterica enterica serovar Typhi
uaaagcauagcgucaucaa

SEQ ID NO: 3671819 - RNA, 23 nt, Salmonella enterica enterica serovar Typhi
uaaagcauagcgucaucaacaua

SEQ ID NO: 3671820 - RNA, 14 nt, Salmonella enterica enterica serovar Typhi
uaaagcaucagacu

SEQ ID NO: 3671821 - RNA, 15 nt, Salmonella enterica enterica serovar Typhi
uaaagccaauccaga

SEQ ID NO: 3671822 - RNA, 21 nt, Salmonella enterica enterica serovar Typhi
uaaagccauccaucuccggca

SEQ ID NO: 3671823 - RNA, 19 nt, Salmonella enterica enterica serovar Typhi
uaaagcccgguucaccguu

SEQ ID NO: 3671824 - RNA, 21 nt, Salmonella enterica enterica serovar Typhi
uaaagcccgucccuuccgcca

SEQ ID NO: 3671825 - RNA, 15 nt, Salmonella enterica enterica serovar Typhi
uaaagcccugacaga

SEQ ID NO: 3671826 - RNA, 15 nt, Salmonella enterica enterica serovar Typhi
uaaagcccuguuauu

SEQ ID NO: 3671827 - RNA, 15 nt, Salmonella enterica enterica serovar Typhi
uaaagccuucaugcu

SEQ ID NO: 3671828 - RNA, 13 nt, Salmonella enterica enterica serovar Typhi
uaaagcgaauacu

SEQ ID NO: 3671829 - RNA, 15 nt, Salmonella enterica enterica serovar Typhi
uaaagcgcaaaauag

SEQ ID NO: 3671830 - RNA, 16 nt, Salmonella enterica enterica serovar Typhi
uaaagcguaucgccca

SEQ ID NO: 3671831 - RNA, 18 nt, Salmonella enterica enterica serovar Typhi
uaaagcguugcaggcgau

SEQ ID NO: 3671832 - RNA, 19 nt, Salmonella enterica enterica serovar Typhi
uaaagcguugcaggcgauu

SEQ ID NO: 3671833 - RNA, 23 nt, Salmonella enterica enterica serovar Typhi
uaaaggacaggugcgcugugguc

SEQ ID NO: 3671834 - RNA, 16 nt, Salmonella enterica enterica serovar Typhi
uaaaggauaauagugu

SEQ ID NO: 3671835 - RNA, 20 nt, Salmonella enterica enterica serovar Typhi
uaaaggggagcccaguagcc

SEQ ID NO: 3671836 - RNA, 22 nt, Salmonella enterica enterica serovar Typhi
uaaaggucaaacaccugaacca

SEQ ID NO: 3671837 - RNA, 23 nt, Salmonella enterica enterica serovar Typhi
uaaaggucggcugcccugcggua

SEQ ID NO: 3671838 - RNA, 13 nt, Salmonella enterica enterica serovar Typhi
uaaagucagcaag

SEQ ID NO: 3671839 - RNA, 13 nt, Salmonella enterica enterica serovar Typhi
uaaagucaugacg

SEQ ID NO: 3671840 - RNA, 13 nt, Salmonella enterica enterica serovar Typhi
uaaagucucaggg

SEQ ID NO: 3671841 - RNA, 19 nt, Salmonella enterica enterica serovar Typhi
uaaagugaguguuacucuu

SEQ ID NO: 3671842 - RNA, 15 nt, Salmonella enterica enterica serovar Typhi
uaaauaaaaauuccc

SEQ ID NO: 3671843 - RNA, 20 nt, Salmonella enterica enterica serovar Typhi
uaaauaacauuucagucuaa

SEQ ID NO: 3671844 - RNA, 21 nt, Salmonella enterica enterica serovar Typhi
uaaauaagaagguuaauauac

SEQ ID NO: 3671845 - RNA, 13 nt, Salmonella enterica enterica serovar Typhi
uaaauacacgagg

SEQ ID NO: 3671846 - RNA, 22 nt, Salmonella enterica enterica serovar Typhi
uaaauacccaggccaucagaau

SEQ ID NO: 3671847 - RNA, 15 nt, Salmonella enterica enterica serovar Typhi
uaaauaccuuauuca

SEQ ID NO: 3671848 - RNA, 16 nt, Salmonella enterica enterica serovar Typhi
uaaauacuuuuuuagc

SEQ ID NO: 3671849 - RNA, 21 nt, Salmonella enterica enterica serovar Typhi
uaaauacuuuuuuagcgcaca

SEQ ID NO: 3671850 - RNA, 14 nt, Salmonella enterica enterica serovar Typhi
uaaauagaaaauaa

SEQ ID NO: 3671851 - RNA, 15 nt, Salmonella enterica enterica serovar Typhi
uaaauagaaaauaau

SEQ ID NO: 3671852 - RNA, 18 nt, Salmonella enterica enterica serovar Typhi
uaaauagacuguugaaag

SEQ ID NO: 3671853 - RNA, 16 nt, Salmonella enterica enterica serovar Typhi
uaaauagagaaaucaa

SEQ ID NO: 3671854 - RNA, 17 nt, Salmonella enterica enterica serovar Typhi
uaaauagcaauuauauu

SEQ ID NO: 3671855 - RNA, 18 nt, Salmonella enterica enterica serovar Typhi
uaacauuugccgggccaa

SEQ ID NO: 3671856 - RNA, 18 nt, Salmonella enterica enterica serovar Typhi
uaaccaacaggaggaucg

SEQ ID NO: 3671857 - RNA, 23 nt, Salmonella enterica enterica serovar Typhi
uaaccaccggcgcgccagcgcau

SEQ ID NO: 3671858 - RNA, 22 nt, Salmonella enterica enterica serovar Typhi
uaaccacgaaaauuauuuucga

SEQ ID NO: 3671859 - RNA, 16 nt, Salmonella enterica enterica serovar Typhi
uaaccagaucggcuau

SEQ ID NO: 3671860 - RNA, 12 nt, Salmonella enterica enterica serovar Typhi
uaaccagcaguc

SEQ ID NO: 3671861 - RNA, 18 nt, Salmonella enterica enterica serovar Typhi
uaaccagcgcgccgccaa

SEQ ID NO: 3671862 - RNA, 20 nt, Salmonella enterica enterica serovar Typhi
uaaccagcgcgccgccaacg

SEQ ID NO: 3671863 - RNA, 17 nt, Salmonella enterica enterica serovar Typhi
uaaccagcucgcugauc

SEQ ID NO: 3671864 - RNA, 21 nt, Salmonella enterica enterica serovar Typhi
uaaccauacugacuuaauaac

SEQ ID NO: 3671865 - RNA, 16 nt, Salmonella enterica enterica serovar Typhi
uaacccacaagaaaug

SEQ ID NO: 3671866 - RNA, 14 nt, Salmonella enterica enterica serovar Typhi
uaacccagugcaau

SEQ ID NO: 3671867 - RNA, 18 nt, Salmonella enterica enterica serovar Typhi
uaaccccugcgcggccug

SEQ ID NO: 3671868 - RNA, 22 nt, Salmonella enterica enterica serovar Typhi
uaacccgcuuacaauuuaucug

SEQ ID NO: 3671869 - RNA, 18 nt, Salmonella enterica enterica serovar Typhi
uaaccgauaacgcggccc

SEQ ID NO: 3671870 - RNA, 16 nt, Salmonella enterica enterica serovar Typhi
uaaccgccuccgacaa

SEQ ID NO: 3671871 - RNA, 19 nt, Salmonella enterica enterica serovar Typhi
uaaccgcgccgcuggcguc

SEQ ID NO: 3671872 - RNA, 23 nt, Salmonella enterica enterica serovar Typhi
uaaccgcuaaacagcaaaucggg

SEQ ID NO: 3671873 - RNA, 16 nt, Salmonella enterica enterica serovar Typhi
uaaccggaucggccau

SEQ ID NO: 3671874 - RNA, 19 nt, Salmonella enterica enterica serovar Typhi
uaaccguaacgcuccugga

SEQ ID NO: 3671875 - RNA, 17 nt, Salmonella enterica enterica serovar Typhi
uaaccguggcggcagug

SEQ ID NO: 3671876 - RNA, 14 nt, Salmonella enterica enterica serovar Typhi
uaaccuauuuugca

SEQ ID NO: 3671877 - RNA, 13 nt, Salmonella enterica enterica serovar Typhi
uaaccucuuuuuc

SEQ ID NO: 3671878 - RNA, 18 nt, Salmonella enterica enterica serovar Typhi
uaaccugguaugauaucg

SEQ ID NO: 3671879 - RNA, 21 nt, Salmonella enterica enterica serovar Typhi
uaaccuucuucguuaugaaug

SEQ ID NO: 3671880 - RNA, 15 nt, Salmonella enterica enterica serovar Typhi
uaaccuuucaccuua

SEQ ID NO: 3671881 - RNA, 20 nt, Salmonella enterica enterica serovar Typhi
uaacgaaccaucauuaauau

SEQ ID NO: 3671882 - RNA, 17 nt, Salmonella enterica enterica serovar Typhi
uaacgaauuaagcggau

SEQ ID NO: 3671883 - RNA, 17 nt, Salmonella enterica enterica serovar Typhi
uaacgacaaaaauacca

SEQ ID NO: 3671884 - RNA, 19 nt, Salmonella enterica enterica serovar Typhi
uaacgaggccaccaucacu

SEQ ID NO: 3671885 - RNA, 12 nt, Salmonella enterica enterica serovar Typhi
uaacgauaaaau

SEQ ID NO: 3671886 - RNA, 20 nt, Salmonella enterica enterica serovar Typhi
uaacgauacccaccagcgug

SEQ ID NO: 3671887 - RNA, 15 nt, Salmonella enterica enterica serovar Typhi
uaacgaugaugaaaa

SEQ ID NO: 3671888 - RNA, 16 nt, Salmonella enterica enterica serovar Typhi
uaacgaugaugaaaaa

SEQ ID NO: 3671889 - RNA, 15 nt, Salmonella enterica enterica serovar Typhi
uaacgauuuccccug

SEQ ID NO: 3671890 - RNA, 20 nt, Salmonella enterica enterica serovar Typhi
uaacgauuuccccuguacac

SEQ ID NO: 3671891 - RNA, 12 nt, Salmonella enterica enterica serovar Typhi
uaacgcaaccgu

SEQ ID NO: 3671892 - RNA, 22 nt, Salmonella enterica enterica serovar Typhi
uaacgcaacggaaggaaauaac

SEQ ID NO: 3671893 - RNA, 22 nt, Salmonella enterica enterica serovar Typhi
uaacgcacuaccagaaacaaca

SEQ ID NO: 3671894 - RNA, 16 nt, Salmonella enterica enterica serovar Typhi
uaacgcacuuuuccag

SEQ ID NO: 3671895 - RNA, 18 nt, Salmonella enterica enterica serovar Typhi
uaacgcacuuuuccagcc

SEQ ID NO: 3671896 - RNA, 19 nt, Salmonella enterica enterica serovar Typhi
uaacgcagaagacagaagc

SEQ ID NO: 3671897 - RNA, 22 nt, Salmonella enterica enterica serovar Typhi
uaacgcagaauauuuuucucag

SEQ ID NO: 3671898 - RNA, 17 nt, Salmonella enterica enterica serovar Typhi
uaacgcagcaucgccau

SEQ ID NO: 3671899 - RNA, 23 nt, Salmonella enterica enterica serovar Typhi
uaacgcaggcgauagccccagua

SEQ ID NO: 3671900 - RNA, 17 nt, Salmonella enterica enterica serovar Typhi
uaacgcauguuccgcua

SEQ ID NO: 3671901 - RNA, 22 nt, Salmonella enterica enterica serovar Typhi
uaacgccgaacacgcauaauug

SEQ ID NO: 3671902 - RNA, 15 nt, Salmonella enterica enterica serovar Typhi
uaacgccgauuaaug

SEQ ID NO: 3671903 - RNA, 18 nt, Salmonella enterica enterica serovar Typhi
uaacgccgauuaaugcuc

SEQ ID NO: 3671904 - RNA, 15 nt, Salmonella enterica enterica serovar Typhi
uaacgccgcauagcg

SEQ ID NO: 3671905 - RNA, 17 nt, Salmonella enterica enterica serovar Typhi
uaacgccggcaaauagc

SEQ ID NO: 3671906 - RNA, 16 nt, Salmonella enterica enterica serovar Typhi
uaacgcgaaaaaagau

SEQ ID NO: 3671907 - RNA, 15 nt, Salmonella enterica enterica serovar Typhi
uaacgcgagaagaag

SEQ ID NO: 3671908 - RNA, 21 nt, Salmonella enterica enterica serovar Typhi
uaacgcgagugucauccugcg

SEQ ID NO: 3671909 - RNA, 13 nt, Salmonella enterica enterica serovar Typhi
uaacgcgccaucu

SEQ ID NO: 3671910 - RNA, 16 nt, Salmonella enterica enterica serovar Typhi
uaacgcgccaucuuuc

SEQ ID NO: 3671911 - RNA, 23 nt, Salmonella enterica enterica serovar Typhi
uaacgcgccaucuuucacccauu

SEQ ID NO: 3671912 - RNA, 24 nt, Salmonella enterica enterica serovar Typhi
uaacgcgcuggcggaauaucgcgg

SEQ ID NO: 3671913 - RNA, 14 nt, Salmonella enterica enterica serovar Typhi
uaacgcuaugcuua

SEQ ID NO: 3671914 - RNA, 14 nt, Salmonella enterica enterica serovar Typhi
uaacgcugcaaagu

SEQ ID NO: 3671915 - RNA, 17 nt, Salmonella enterica enterica serovar Typhi
uaacgcugcaaaguuau

SEQ ID NO: 3671916 - RNA, 21 nt, Salmonella enterica enterica serovar Typhi
uaacgcuguaccggcagguga

SEQ ID NO: 3671917 - RNA, 16 nt, Salmonella enterica enterica serovar Typhi
uaacgcuuauccggcc

SEQ ID NO: 3671918 - RNA, 20 nt, Salmonella enterica enterica serovar Typhi
uaacgcuuaugcugccuaca

SEQ ID NO: 3671919 - RNA, 16 nt, Salmonella enterica enterica serovar Typhi
uaacggacucaggccu

SEQ ID NO: 3671920 - RNA, 15 nt, Salmonella enterica enterica serovar Typhi
uaacggccagaaacc

SEQ ID NO: 3671921 - RNA, 18 nt, Salmonella enterica enterica serovar Typhi
uaacggcgcgaaagcgcc

SEQ ID NO: 3671922 - RNA, 18 nt, Salmonella enterica enterica serovar Typhi
uaacggcgucauccugca

SEQ ID NO: 3671923 - RNA, 23 nt, Salmonella enterica enterica serovar Typhi
uaacggcugacgcccaucagcau

SEQ ID NO: 3671924 - RNA, 14 nt, Salmonella enterica enterica serovar Typhi
uaacgggacacugc

SEQ ID NO: 3671925 - RNA, 15 nt, Salmonella enterica enterica serovar Typhi
uaacgggacacugcc

SEQ ID NO: 3671926 - RNA, 22 nt, Salmonella enterica enterica serovar Typhi
uaacggguuugauugccaucgc

SEQ ID NO: 3671927 - RNA, 16 nt, Salmonella enterica enterica serovar Typhi
uaacgguaacggacau

SEQ ID NO: 3671928 - RNA, 16 nt, Salmonella enterica enterica serovar Typhi
uaacguaaauacccag

SEQ ID NO: 3671929 - RNA, 15 nt, Salmonella enterica enterica serovar Typhi
uaacguuaaggaaac

SEQ ID NO: 3671930 - RNA, 15 nt, Salmonella enterica enterica serovar Typhi
uaacguuacauuuuc

SEQ ID NO: 3671931 - RNA, 21 nt, Salmonella enterica enterica serovar Typhi
uaacguuuaaacucccggcua

SEQ ID NO: 3671932 - RNA, 22 nt, Salmonella enterica enterica serovar Typhi
uaacguuuggcaucaaaguuau

SEQ ID NO: 3671933 - RNA, 15 nt, Salmonella enterica enterica serovar Typhi
uaacguuuuacgcug

SEQ ID NO: 3671934 - RNA, 17 nt, Salmonella enterica enterica serovar Typhi
uaacguuuuacgcugcc

SEQ ID NO: 3671935 - RNA, 15 nt, Salmonella enterica enterica serovar Typhi
uaacuaaacucaucu

SEQ ID NO: 3671936 - RNA, 21 nt, Salmonella enterica enterica serovar Typhi
uaacuaauggcaauaauacag

SEQ ID NO: 3671937 - RNA, 23 nt, Salmonella enterica enterica serovar Typhi
uaacuaauuguuuguagaaagug

SEQ ID NO: 3671938 - RNA, 13 nt, Salmonella enterica enterica serovar Typhi
uaacuauuucuau

SEQ ID NO: 3671939 - RNA, 23 nt, Salmonella enterica enterica serovar Typhi
uaacuauuucuaucagguaacau

SEQ ID NO: 3671940 - RNA, 16 nt, Salmonella enterica enterica serovar Typhi
uaagcuauguuuuuau

SEQ ID NO: 3671941 - RNA, 19 nt, Salmonella enterica enterica serovar Typhi
uaagcuauuccuguauaau

SEQ ID NO: 3671942 - RNA, 18 nt, Salmonella enterica enterica serovar Typhi
uaagcugagccuucaccg

SEQ ID NO: 3671943 - RNA, 23 nt, Salmonella enterica enterica serovar Typhi
uaagcuggcguuaaauauaucug

SEQ ID NO: 3671944 - RNA, 17 nt, Salmonella enterica enterica serovar Typhi
uaagcuuugcaccacuu

SEQ ID NO: 3671945 - RNA, 20 nt, Salmonella enterica enterica serovar Typhi
uaaggacuuuaucuuuacca

SEQ ID NO: 3671946 - RNA, 22 nt, Salmonella enterica enterica serovar Typhi
uaaggauaucuugaugauucac

SEQ ID NO: 3671947 - RNA, 14 nt, Salmonella enterica enterica serovar Typhi
uaaggaucggaaga

SEQ ID NO: 3671948 - RNA, 23 nt, Salmonella enterica enterica serovar Typhi
uaaggaucggaagacuggcgcag

SEQ ID NO: 3671949 - RNA, 23 nt, Salmonella enterica enterica serovar Typhi
uaaggaugaacucuaugcaaaag

SEQ ID NO: 3671950 - RNA, 21 nt, Salmonella enterica enterica serovar Typhi
uaaggcaaguucuuguuucau

SEQ ID NO: 3671951 - RNA, 12 nt, Salmonella enterica enterica serovar Typhi
uaaggcagccau

SEQ ID NO: 3671952 - RNA, 13 nt, Salmonella enterica enterica serovar Typhi
uaaggcaggcaaa

SEQ ID NO: 3671953 - RNA, 18 nt, Salmonella enterica enterica serovar Typhi
uaaggcaugaugccacga

SEQ ID NO: 3671954 - RNA, 12 nt, Salmonella enterica enterica serovar Typhi
uaaggcguucac

SEQ ID NO: 3671955 - RNA, 15 nt, Salmonella enterica enterica serovar Typhi
uaaggcguucacgcc

SEQ ID NO: 3671956 - RNA, 20 nt, Salmonella enterica enterica serovar Typhi
uaaggcucucuuaccagccg

SEQ ID NO: 3671957 - RNA, 14 nt, Salmonella enterica enterica serovar Typhi
uaagggccuucauu

SEQ ID NO: 3671958 - RNA, 19 nt, Salmonella enterica enterica serovar Typhi
uaagguauccuaaugccac

SEQ ID NO: 3671959 - RNA, 21 nt, Salmonella enterica enterica serovar Typhi
uaaggucgcuauccagcagua

SEQ ID NO: 3671960 - RNA, 21 nt, Salmonella enterica enterica serovar Typhi
uaagguucuggcauuggcauc

SEQ ID NO: 3671961 - RNA, 12 nt, Salmonella enterica enterica serovar Typhi
uaagguugucaa

SEQ ID NO: 3671962 - RNA, 16 nt, Salmonella enterica enterica serovar Typhi
uaaguaaggaggaauc

SEQ ID NO: 3671963 - RNA, 14 nt, Salmonella enterica enterica serovar Typhi
uaaguaaguugauc

SEQ ID NO: 3671964 - RNA, 19 nt, Salmonella enterica enterica serovar Typhi
uaaguaauuuugcgauggc

SEQ ID NO: 3671965 - RNA, 13 nt, Salmonella enterica enterica serovar Typhi
uaaguagccguca

SEQ ID NO: 3671966 - RNA, 22 nt, Salmonella enterica enterica serovar Typhi
uaaguagccgucagguccgaca

SEQ ID NO: 3671967 - RNA, 20 nt, Salmonella enterica enterica serovar Typhi
uaaguaucagcgcgcuuuuu

SEQ ID NO: 3671968 - RNA, 18 nt, Salmonella enterica enterica serovar Typhi
uaagucaaccaugaucac

SEQ ID NO: 3671969 - RNA, 20 nt, Salmonella enterica enterica serovar Typhi
uaagucaucuguucaacuuu

SEQ ID NO: 3671970 - RNA, 22 nt, Salmonella enterica enterica serovar Typhi
uaaguccgcgggcaaaagggcc

SEQ ID NO: 3671971 - RNA, 14 nt, Salmonella enterica enterica serovar Typhi
uaagugcaggcuga

SEQ ID NO: 3671972 - RNA, 16 nt, Salmonella enterica enterica serovar Typhi
uaaguucaaacucauu

SEQ ID NO: 3671973 - RNA, 16 nt, Salmonella enterica enterica serovar Typhi
uaaguugaaaggaaag

SEQ ID NO: 3671974 - RNA, 17 nt, Salmonella enterica enterica serovar Typhi
uaaguuggacaaggcac

SEQ ID NO: 3671975 - RNA, 16 nt, Salmonella enterica enterica serovar Typhi
uaaguuuuucucuuau

SEQ ID NO: 3671976 - RNA, 13 nt, Salmonella enterica enterica serovar Typhi
uaauaaaauaacu

SEQ ID NO: 3671977 - RNA, 18 nt, Salmonella enterica enterica serovar Typhi
uaauaaaaucuaagagcc

SEQ ID NO: 3671978 - RNA, 14 nt, Salmonella enterica enterica serovar Typhi
uaauaaaauucacu

SEQ ID NO: 3671979 - RNA, 11 nt, Salmonella enterica enterica serovar Typhi
uaauaaauauu

SEQ ID NO: 3671980 - RNA, 19 nt, Salmonella enterica enterica serovar Typhi
uaauaacgaacugauggcg

SEQ ID NO: 3671981 - RNA, 9 nt, Salmonella enterica enterica serovar Typhi
uaauaacgg

SEQ ID NO: 3671982 - RNA, 16 nt, Salmonella enterica enterica serovar Typhi
uaauaagacgccaguu

SEQ ID NO: 3671983 - RNA, 21 nt, Salmonella enterica enterica serovar Typhi
uaauaaguccgcgggcaaaag

SEQ ID NO: 3671984 - RNA, 22 nt, Salmonella enterica enterica serovar Typhi
uaauaauacaccgccauauauu

SEQ ID NO: 3671985 - RNA, 13 nt, Salmonella enterica enterica serovar Typhi
uaauaaucauaua

SEQ ID NO: 3671986 - RNA, 19 nt, Salmonella enterica enterica serovar Typhi
uaauaauuagcauccagca

SEQ ID NO: 3671987 - RNA, 21 nt, Salmonella enterica enterica serovar Typhi
uaauaauugcgguggcgcaaa

SEQ ID NO: 3671988 - RNA, 12 nt, Salmonella enterica enterica serovar Typhi
uaauacaggcca

SEQ ID NO: 3671989 - RNA, 16 nt, Salmonella enterica enterica serovar Typhi
uaauacaggccagcau

SEQ ID NO: 3671990 - RNA, 13 nt, Salmonella enterica enterica serovar Typhi
uaauacaggguuu

SEQ ID NO: 3671991 - RNA, 15 nt, Salmonella enterica enterica serovar Typhi
uaauacauaucauuu

SEQ ID NO: 3671992 - RNA, 19 nt, Salmonella enterica enterica serovar Typhi
uaauacaucacuuuaugac

SEQ ID NO: 3671993 - RNA, 16 nt, Salmonella enterica enterica serovar Typhi
uaauaccgaaauccgc

SEQ ID NO: 3671994 - RNA, 18 nt, Salmonella enterica enterica serovar Typhi
uaauacggagcaaaaaau

SEQ ID NO: 3671995 - RNA, 23 nt, Salmonella enterica enterica serovar Typhi
uaauacgucgugacccacacaua

SEQ ID NO: 3671996 - RNA, 22 nt, Salmonella enterica enterica serovar Typhi
uaauacuggcgccuuuuggcag

SEQ ID NO: 3671997 - RNA, 16 nt, Salmonella enterica enterica serovar Typhi
uaauagaugcgucgca

SEQ ID NO: 3671998 - RNA, 19 nt, Salmonella enterica enterica serovar Typhi
uaauagccucauccccagc

SEQ ID NO: 3671999 - RNA, 15 nt, Salmonella enterica enterica serovar Typhi
uaauauacauucauu

SEQ ID NO: 3672000 - RNA, 16 nt, Salmonella enterica enterica serovar Typhi
uaauauagaguuguga

SEQ ID NO: 3672001 - RNA, 13 nt, Salmonella enterica enterica serovar Typhi
uaauaucauccgg

SEQ ID NO: 3672002 - RNA, 15 nt, Salmonella enterica enterica serovar Typhi
uaauauccaggagca

SEQ ID NO: 3672003 - RNA, 20 nt, Salmonella enterica enterica serovar Typhi
uaauauccaggagcauugga

SEQ ID NO: 3672004 - RNA, 21 nt, Salmonella enterica enterica serovar Typhi
uaauauccaguugcgccagcg

SEQ ID NO: 3672005 - RNA, 13 nt, Salmonella enterica enterica serovar Typhi
uaauaugccaggc

SEQ ID NO: 3672006 - RNA, 24 nt, Salmonella enterica enterica serovar Typhi
uaauaugccaggcuuccugcgcug

SEQ ID NO: 3672007 - RNA, 14 nt, Salmonella enterica enterica serovar Typhi
uaauauuaagcagc

SEQ ID NO: 3672008 - RNA, 22 nt, Salmonella enterica enterica serovar Typhi
uaauauuauccuuuaauuaauc

SEQ ID NO: 3672009 - RNA, 13 nt, Salmonella enterica enterica serovar Typhi
uaauauuauugac

SEQ ID NO: 3672010 - RNA, 16 nt, Salmonella enterica enterica serovar Typhi
uaauauucauaacgcc

SEQ ID NO: 3672011 - RNA, 15 nt, Salmonella enterica enterica serovar Typhi
uaauauucauucugu

SEQ ID NO: 3672012 - RNA, 17 nt, Salmonella enterica enterica serovar Typhi
uaauauugaacgcacuu

SEQ ID NO: 3672013 - RNA, 21 nt, Salmonella enterica enterica serovar Typhi
uaauauugaccgcuuuuucca

SEQ ID NO: 3672014 - RNA, 16 nt, Salmonella enterica enterica serovar Typhi
uaauauuuaacacauu

SEQ ID NO: 3672015 - RNA, 13 nt, Salmonella enterica enterica serovar Typhi
uaauauuuauuau

SEQ ID NO: 3672016 - RNA, 16 nt, Salmonella enterica enterica serovar Typhi
uaaucaaacccuuccg

SEQ ID NO: 3672017 - RNA, 12 nt, Salmonella enterica enterica serovar Typhi
uaaucaauaagu

SEQ ID NO: 3672018 - RNA, 13 nt, Salmonella enterica enterica serovar Typhi
uaaucaauaaguu

SEQ ID NO: 3672019 - RNA, 19 nt, Salmonella enterica enterica serovar Typhi
uaaucaauguauuuaaguc

SEQ ID NO: 3672020 - RNA, 15 nt, Salmonella enterica enterica serovar Typhi
uaaucaccaccucaa

SEQ ID NO: 3672021 - RNA, 14 nt, Salmonella enterica enterica serovar Typhi
uaaucaccagcccg

SEQ ID NO: 3672022 - RNA, 12 nt, Salmonella enterica enterica serovar Typhi
uaaucaccagcg

SEQ ID NO: 3672023 - RNA, 17 nt, Salmonella enterica enterica serovar Typhi
uaaucaccugccagggu

SEQ ID NO: 3672024 - RNA, 22 nt, Salmonella enterica enterica serovar Typhi
uaaucacuaacugaccauauau

SEQ ID NO: 3672025 - RNA, 12 nt, Salmonella enterica enterica serovar Typhi
uaaucagcagcg

SEQ ID NO: 3672026 - RNA, 17 nt, Salmonella enterica enterica serovar Typhi
uaaugucaugcgccacg

SEQ ID NO: 3672027 - RNA, 16 nt, Salmonella enterica enterica serovar Typhi
uaaugucuggugcagc

SEQ ID NO: 3672028 - RNA, 13 nt, Salmonella enterica enterica serovar Typhi
uaaugugaaaaac

SEQ ID NO: 3672029 - RNA, 17 nt, Salmonella enterica enterica serovar Typhi
uaaugugccgguaagaa

SEQ ID NO: 3672030 - RNA, 17 nt, Salmonella enterica enterica serovar Typhi
uaauguuaggaguaaau

SEQ ID NO: 3672031 - RNA, 19 nt, Salmonella enterica enterica serovar Typhi
uaauguugaaccgucauca

SEQ ID NO: 3672032 - RNA, 15 nt, Salmonella enterica enterica serovar Typhi
uaauguugccguggc

SEQ ID NO: 3672033 - RNA, 20 nt, Salmonella enterica enterica serovar Typhi
uaauguugguaaauuuaugg

SEQ ID NO: 3672034 - RNA, 18 nt, Salmonella enterica enterica serovar Typhi
uaauguuucacguagcaa

SEQ ID NO: 3672035 - RNA, 13 nt, Salmonella enterica enterica serovar Typhi
uaauuaaccgcgc

SEQ ID NO: 3672036 - RNA, 19 nt, Salmonella enterica enterica serovar Typhi
uaauuaacgccgcgaggau

SEQ ID NO: 3672037 - RNA, 22 nt, Salmonella enterica enterica serovar Typhi
uaauuaauucuaaauugggaug

SEQ ID NO: 3672038 - RNA, 21 nt, Salmonella enterica enterica serovar Typhi
uaauuacuccguuuuaaucuu

SEQ ID NO: 3672039 - RNA, 22 nt, Salmonella enterica enterica serovar Typhi
uaauuacuccguuuuaaucuuu

SEQ ID NO: 3672040 - RNA, 16 nt, Salmonella enterica enterica serovar Typhi
uaauuagcauccagca

SEQ ID NO: 3672041 - RNA, 21 nt, Salmonella enterica enterica serovar Typhi
uaauuauaaagcauaaauaca

SEQ ID NO: 3672042 - RNA, 14 nt, Salmonella enterica enterica serovar Typhi
uaauuauaaauauu

SEQ ID NO: 3672043 - RNA, 19 nt, Salmonella enterica enterica serovar Typhi
uaauuaucugccagccgau

SEQ ID NO: 3672044 - RNA, 22 nt, Salmonella enterica enterica serovar Typhi
uaauuauuacuggaucauacau

SEQ ID NO: 3672045 - RNA, 19 nt, Salmonella enterica enterica serovar Typhi
uaauuauuuuucaaaugau

SEQ ID NO: 3672046 - RNA, 16 nt, Salmonella enterica enterica serovar Typhi
uaauuccgaauauuua

SEQ ID NO: 3672047 - RNA, 15 nt, Salmonella enterica enterica serovar Typhi
uaauuccgcaucauu

SEQ ID NO: 3672048 - RNA, 16 nt, Salmonella enterica enterica serovar Typhi
uaauugcugaagauaa

SEQ ID NO: 3672049 - RNA, 18 nt, Salmonella enterica enterica serovar Typhi
uaauugcuuuuuuccaca

SEQ ID NO: 3672050 - RNA, 19 nt, Salmonella enterica enterica serovar Typhi
uaauuguggaaauaagagu

SEQ ID NO: 3672051 - RNA, 15 nt, Salmonella enterica enterica serovar Typhi
uaauuuauagccauu

SEQ ID NO: 3672052 - RNA, 17 nt, Salmonella enterica enterica serovar Typhi
uaauuuauauugugccu

SEQ ID NO: 3672053 - RNA, 15 nt, Salmonella enterica enterica serovar Typhi
uaauuuauccaguaa

SEQ ID NO: 3672054 - RNA, 17 nt, Salmonella enterica enterica serovar Typhi
uaauuucaauuuugccg

SEQ ID NO: 3672055 - RNA, 14 nt, Salmonella enterica enterica serovar Typhi
uaauuucagugaau

SEQ ID NO: 3672056 - RNA, 11 nt, Salmonella enterica enterica serovar Typhi
uaauuugauuu

SEQ ID NO: 3672057 - RNA, 15 nt, Salmonella enterica enterica serovar Typhi
uaauuugauuuauuu

SEQ ID NO: 3672058 - RNA, 17 nt, Salmonella enterica enterica serovar Typhi
uaauuugcaaaccauga

SEQ ID NO: 3672059 - RNA, 15 nt, Salmonella enterica enterica serovar Typhi
uaauuugcgccaucg

SEQ ID NO: 3672060 - RNA, 15 nt, Salmonella enterica enterica serovar Typhi
uaauuugcuccagaa

SEQ ID NO: 3672061 - RNA, 16 nt, Salmonella enterica enterica serovar Typhi
uaauuuuacuuucauu

SEQ ID NO: 3672062 - RNA, 18 nt, Salmonella enterica enterica serovar Typhi
uaauuuuacuuucauucc

SEQ ID NO: 3672063 - RNA, 11 nt, Salmonella enterica enterica serovar Typhi
uaauuuuagaa

SEQ ID NO: 3672064 - RNA, 17 nt, Salmonella enterica enterica serovar Typhi
uaauuuuagaaauagaa

SEQ ID NO: 3672065 - RNA, 22 nt, Salmonella enterica enterica serovar Typhi
uaauuuuauuauauuuaaaauu

SEQ ID NO: 3672066 - RNA, 17 nt, Salmonella enterica enterica serovar Typhi
uaauuuucaccuccggg

SEQ ID NO: 3672067 - RNA, 19 nt, Salmonella enterica enterica serovar Typhi
uaauuuucccaguucaucc

SEQ ID NO: 3672068 - RNA, 20 nt, Salmonella enterica enterica serovar Typhi
uaauuuucccaguucaucca

SEQ ID NO: 3672069 - RNA, 23 nt, Salmonella enterica enterica serovar Typhi
uaauuuucuucuggccauuucau

SEQ ID NO: 3672070 - RNA, 16 nt, Salmonella enterica enterica serovar Typhi
uaauuuugccaucgcg

SEQ ID NO: 3672071 - RNA, 13 nt, Salmonella enterica enterica serovar Typhi
uaauuuugcgaug

SEQ ID NO: 3672072 - RNA, 20 nt, Salmonella enterica enterica serovar Typhi
uaauuuuuaugucauuuauu

SEQ ID NO: 3672073 - RNA, 22 nt, Salmonella enterica enterica serovar Typhi
uaauuuuuccagcauuucuuca

SEQ ID NO: 3672074 - RNA, 15 nt, Salmonella enterica enterica serovar Typhi
uacaaaaaagauaac

SEQ ID NO: 3672075 - RNA, 12 nt, Salmonella enterica enterica serovar Typhi
uacaaaaaauac

SEQ ID NO: 3672076 - RNA, 23 nt, Salmonella enterica enterica serovar Typhi
uacaaaaaaugugagccauaaca

SEQ ID NO: 3672077 - RNA, 18 nt, Salmonella enterica enterica serovar Typhi
uacaaaacccauaucccc

SEQ ID NO: 3672078 - RNA, 18 nt, Salmonella enterica enterica serovar Typhi
uacaaacaaauaaaucca

SEQ ID NO: 3672079 - RNA, 23 nt, Salmonella enterica enterica serovar Typhi
uacaaacaguuuuuccuuucugc

SEQ ID NO: 3672080 - RNA, 17 nt, Salmonella enterica enterica serovar Typhi
uacaaaccaccaccaug

SEQ ID NO: 3672081 - RNA, 19 nt, Salmonella enterica enterica serovar Typhi
uacaaaccccacccacuga

SEQ ID NO: 3672082 - RNA, 15 nt, Salmonella enterica enterica serovar Typhi
uacaaacgcaccgcc

SEQ ID NO: 3672083 - RNA, 13 nt, Salmonella enterica enterica serovar Typhi
uacaaaucacugg

SEQ ID NO: 3672084 - RNA, 17 nt, Salmonella enterica enterica serovar Typhi
uacaaaucucagggugu

SEQ ID NO: 3672085 - RNA, 15 nt, Salmonella enterica enterica serovar Typhi
uacaaauuuaaacau

SEQ ID NO: 3672086 - RNA, 21 nt, Salmonella enterica enterica serovar Typhi
uacaaccguggcguuuucauu

SEQ ID NO: 3672087 - RNA, 22 nt, Salmonella enterica enterica serovar Typhi
uacaaccguggcguuuucauua

SEQ ID NO: 3672088 - RNA, 19 nt, Salmonella enterica enterica serovar Typhi
uacaacgacuacguucauc

SEQ ID NO: 3672089 - RNA, 22 nt, Salmonella enterica enterica serovar Typhi
uacaacgacuacguucaucagg

SEQ ID NO: 3672090 - RNA, 16 nt, Salmonella enterica enterica serovar Typhi
uacaacucauccaccu

SEQ ID NO: 3672091 - RNA, 12 nt, Salmonella enterica enterica serovar Typhi
uacaacugucgu

SEQ ID NO: 3672092 - RNA, 19 nt, Salmonella enterica enterica serovar Typhi
uacaagaaaguaccugcac

SEQ ID NO: 3672093 - RNA, 20 nt, Salmonella enterica enterica serovar Typhi
uacaagaaaguaccugcacc

SEQ ID NO: 3672094 - RNA, 20 nt, Salmonella enterica enterica serovar Typhi
uacaagaauuuaucgcaaua

SEQ ID NO: 3672095 - RNA, 23 nt, Salmonella enterica enterica serovar Typhi
uacaagcguuuaauuccaucggc

SEQ ID NO: 3672096 - RNA, 16 nt, Salmonella enterica enterica serovar Typhi
uacaagguauccgcca

SEQ ID NO: 3672097 - RNA, 17 nt, Salmonella enterica enterica serovar Typhi
uacaagguauccgccau

SEQ ID NO: 3672098 - RNA, 14 nt, Salmonella enterica enterica serovar Typhi
uacaaguaauaaaa

SEQ ID NO: 3672099 - RNA, 15 nt, Salmonella enterica enterica serovar Typhi
uacaaguaauaaaau

SEQ ID NO: 3672100 - RNA, 17 nt, Salmonella enterica enterica serovar Typhi
uacaaguaauaaaauaa

SEQ ID NO: 3672101 - RNA, 19 nt, Salmonella enterica enterica serovar Typhi
uacaaguaauaaaauaaua

SEQ ID NO: 3672102 - RNA, 21 nt, Salmonella enterica enterica serovar Typhi
uacaauccaggacgucuugca

SEQ ID NO: 3672103 - RNA, 21 nt, Salmonella enterica enterica serovar Typhi
uacaauuauugcguugcuuua

SEQ ID NO: 3672104 - RNA, 15 nt, Salmonella enterica enterica serovar Typhi
uacaauuuaucugcg

SEQ ID NO: 3672105 - RNA, 10 nt, Salmonella enterica enterica serovar Typhi
uacaauuucg

SEQ ID NO: 3672106 - RNA, 19 nt, Salmonella enterica enterica serovar Typhi
uacaauuucuggccccuga

SEQ ID NO: 3672107 - RNA, 22 nt, Salmonella enterica enterica serovar Typhi
uacacaaagacgaauaaggaau

SEQ ID NO: 3672108 - RNA, 12 nt, Salmonella enterica enterica serovar Typhi
uacacagcacaa

SEQ ID NO: 3672109 - RNA, 20 nt, Salmonella enterica enterica serovar Typhi
uacacauaugggaagacauu

SEQ ID NO: 3672110 - RNA, 17 nt, Salmonella enterica enterica serovar Typhi
uacaccaacggcgacgc

SEQ ID NO: 3672111 - RNA, 17 nt, Salmonella enterica enterica serovar Typhi
uacaccaacuaccaaca

SEQ ID NO: 3672112 - RNA, 18 nt, Salmonella enterica enterica serovar Typhi
uaccacgccgcacacagc

SEQ ID NO: 3672113 - RNA, 22 nt, Salmonella enterica enterica serovar Typhi
uaccacgccguagcugcgcgcc

SEQ ID NO: 3672114 - RNA, 16 nt, Salmonella enterica enterica serovar Typhi
uaccacuucggcagaa

SEQ ID NO: 3672115 - RNA, 21 nt, Salmonella enterica enterica serovar Typhi
uaccacuuucuugaugucauc

SEQ ID NO: 3672116 - RNA, 14 nt, Salmonella enterica enterica serovar Typhi
uaccagaaccacuu

SEQ ID NO: 3672117 - RNA, 18 nt, Salmonella enterica enterica serovar Typhi
uaccagaaccacuugaac

SEQ ID NO: 3672118 - RNA, 21 nt, Salmonella enterica enterica serovar Typhi
uaccagacgcgccugcauacu

SEQ ID NO: 3672119 - RNA, 17 nt, Salmonella enterica enterica serovar Typhi
uaccagauuaauaauag

SEQ ID NO: 3672120 - RNA, 11 nt, Salmonella enterica enterica serovar Typhi
uaccagcaccu

SEQ ID NO: 3672121 - RNA, 22 nt, Salmonella enterica enterica serovar Typhi
uaccagccgagugcuuauguag

SEQ ID NO: 3672122 - RNA, 17 nt, Salmonella enterica enterica serovar Typhi
uaccagcgauaguuguu

SEQ ID NO: 3672123 - RNA, 19 nt, Salmonella enterica enterica serovar Typhi
uaccagcgcgaacauuaca

SEQ ID NO: 3672124 - RNA, 23 nt, Salmonella enterica enterica serovar Typhi
uaccagcgcgaacauuacauccu

SEQ ID NO: 3672125 - RNA, 15 nt, Salmonella enterica enterica serovar Typhi
uaccagcgcggcgcc

SEQ ID NO: 3672126 - RNA, 20 nt, Salmonella enterica enterica serovar Typhi
uaccagcggcagcuucagcc

SEQ ID NO: 3672127 - RNA, 17 nt, Salmonella enterica enterica serovar Typhi
uaccagcgucaucggau

SEQ ID NO: 3672128 - RNA, 10 nt, Salmonella enterica enterica serovar Typhi
uaccaggcac

SEQ ID NO: 3672129 - RNA, 15 nt, Salmonella enterica enterica serovar Typhi
uaccaggcagcgcgc

SEQ ID NO: 3672130 - RNA, 22 nt, Salmonella enterica enterica serovar Typhi
uaccaggcagcgcgccagcgcu

SEQ ID NO: 3672131 - RNA, 19 nt, Salmonella enterica enterica serovar Typhi
uaccaggcggcuuuuucau

SEQ ID NO: 3672132 - RNA, 23 nt, Salmonella enterica enterica serovar Typhi
uaccaggcggcuuuuucaucauc

SEQ ID NO: 3672133 - RNA, 22 nt, Salmonella enterica enterica serovar Typhi
uaccagggaauaugauuuaaaa

SEQ ID NO: 3672134 - RNA, 17 nt, Salmonella enterica enterica serovar Typhi
uaccagugcuaaaauua

SEQ ID NO: 3672135 - RNA, 21 nt, Salmonella enterica enterica serovar Typhi
uaccagugcuaaaauuauaca

SEQ ID NO: 3672136 - RNA, 22 nt, Salmonella enterica enterica serovar Typhi
uaccaucuggccuacgcgcuca

SEQ ID NO: 3672137 - RNA, 14 nt, Salmonella enterica enterica serovar Typhi
uaccauuccucacg

SEQ ID NO: 3672138 - RNA, 13 nt, Salmonella enterica enterica serovar Typhi
uacccaaauuaau

SEQ ID NO: 3672139 - RNA, 18 nt, Salmonella enterica enterica serovar Typhi
uacccaaauuaauuuauu

SEQ ID NO: 3672140 - RNA, 16 nt, Salmonella enterica enterica serovar Typhi
uacccaacgcaaugcg

SEQ ID NO: 3672141 - RNA, 19 nt, Salmonella enterica enterica serovar Typhi
uacccaccguaucgacaua

SEQ ID NO: 3672142 - RNA, 19 nt, Salmonella enterica enterica serovar Typhi
uacccacuucuuccagcgu

SEQ ID NO: 3672143 - RNA, 21 nt, Salmonella enterica enterica serovar Typhi
uacccagcgccaacgccacug

SEQ ID NO: 3672144 - RNA, 22 nt, Salmonella enterica enterica serovar Typhi
uacccaguagcagacagccgau

SEQ ID NO: 3672145 - RNA, 18 nt, Salmonella enterica enterica serovar Typhi
uacccauaguagcuaaug

SEQ ID NO: 3672146 - RNA, 14 nt, Salmonella enterica enterica serovar Typhi
uacccauaucgcgg

SEQ ID NO: 3672147 - RNA, 17 nt, Salmonella enterica enterica serovar Typhi
uaccccacgccauaaug

SEQ ID NO: 3672148 - RNA, 13 nt, Salmonella enterica enterica serovar Typhi
uaccccagcgcgc

SEQ ID NO: 3672149 - RNA, 18 nt, Salmonella enterica enterica serovar Typhi
uaccccaggggcauauau

SEQ ID NO: 3672150 - RNA, 16 nt, Salmonella enterica enterica serovar Typhi
uaccccgccaccgccg

SEQ ID NO: 3672151 - RNA, 17 nt, Salmonella enterica enterica serovar Typhi
uaccccggcgcggcgcg

SEQ ID NO: 3672152 - RNA, 14 nt, Salmonella enterica enterica serovar Typhi
uaccccgugguggg

SEQ ID NO: 3672153 - RNA, 23 nt, Salmonella enterica enterica serovar Typhi
uaccccuguucaaaauagcuuuc

SEQ ID NO: 3672154 - RNA, 19 nt, Salmonella enterica enterica serovar Typhi
uacccgauaccgccagccc

SEQ ID NO: 3672155 - RNA, 19 nt, Salmonella enterica enterica serovar Typhi
uacccgcgcaucccacacc

SEQ ID NO: 3672156 - RNA, 16 nt, Salmonella enterica enterica serovar Typhi
uacccgcugcuucacg

SEQ ID NO: 3672157 - RNA, 20 nt, Salmonella enterica enterica serovar Typhi
uacccggcgcaaacuucaca

SEQ ID NO: 3672158 - RNA, 13 nt, Salmonella enterica enterica serovar Typhi
uacccgguaauac

SEQ ID NO: 3672159 - RNA, 15 nt, Salmonella enterica enterica serovar Typhi
uacccgguaauacuu

SEQ ID NO: 3672160 - RNA, 20 nt, Salmonella enterica enterica serovar Typhi
uacccuauuuacagagcaau

SEQ ID NO: 3672161 - RNA, 16 nt, Salmonella enterica enterica serovar Typhi
uacccucugcaccaga

SEQ ID NO: 3672162 - RNA, 13 nt, Salmonella enterica enterica serovar Typhi
uacccucugcguc

SEQ ID NO: 3672163 - RNA, 14 nt, Salmonella enterica enterica serovar Typhi
uacccuucagauau

SEQ ID NO: 3672164 - RNA, 14 nt, Salmonella enterica enterica serovar Typhi
uacccuucaugcag

SEQ ID NO: 3672165 - RNA, 21 nt, Salmonella enterica enterica serovar Typhi
uacccuuccccggcagccuca

SEQ ID NO: 3672166 - RNA, 19 nt, Salmonella enterica enterica serovar Typhi
uaccgaaauaguaccuccg

SEQ ID NO: 3672167 - RNA, 15 nt, Salmonella enterica enterica serovar Typhi
uaccgaacagccagg

SEQ ID NO: 3672168 - RNA, 17 nt, Salmonella enterica enterica serovar Typhi
uaccgaacagccaggcu

SEQ ID NO: 3672169 - RNA, 20 nt, Salmonella enterica enterica serovar Typhi
uaccgacaaaucaaacucac

SEQ ID NO: 3672170 - RNA, 16 nt, Salmonella enterica enterica serovar Typhi
uaccgacacaucaucg

SEQ ID NO: 3672171 - RNA, 22 nt, Salmonella enterica enterica serovar Typhi
uaccgacguuaaaugucugaau

SEQ ID NO: 3672172 - RNA, 14 nt, Salmonella enterica enterica serovar Typhi
uaccgauagcgcgg

SEQ ID NO: 3672173 - RNA, 15 nt, Salmonella enterica enterica serovar Typhi
uaccgauagcgcgga

SEQ ID NO: 3672174 - RNA, 17 nt, Salmonella enterica enterica serovar Typhi
uaccgauagcgcggaau

SEQ ID NO: 3672175 - RNA, 18 nt, Salmonella enterica enterica serovar Typhi
uaccgcaauaaacacgau

SEQ ID NO: 3672176 - RNA, 21 nt, Salmonella enterica enterica serovar Typhi
uaccgcaauaaacacgauggc

SEQ ID NO: 3672177 - RNA, 18 nt, Salmonella enterica enterica serovar Typhi
uaccgcagcgaaugugcu

SEQ ID NO: 3672178 - RNA, 13 nt, Salmonella enterica enterica serovar Typhi
uaccgcagcgcgg

SEQ ID NO: 3672179 - RNA, 21 nt, Salmonella enterica enterica serovar Typhi
uaccgccaccuuucugcucca

SEQ ID NO: 3672180 - RNA, 18 nt, Salmonella enterica enterica serovar Typhi
uaccgccacuuugcuuug

SEQ ID NO: 3672181 - RNA, 17 nt, Salmonella enterica enterica serovar Typhi
uaccgccaucaaacgca

SEQ ID NO: 3672182 - RNA, 18 nt, Salmonella enterica enterica serovar Typhi
uaccgccgcaaccggagu

SEQ ID NO: 3672183 - RNA, 15 nt, Salmonella enterica enterica serovar Typhi
uaccgccgcgaaccu

SEQ ID NO: 3672184 - RNA, 22 nt, Salmonella enterica enterica serovar Typhi
uaccgccgcuuuucaggggucc

SEQ ID NO: 3672185 - RNA, 13 nt, Salmonella enterica enterica serovar Typhi
uaccgccgguaau

SEQ ID NO: 3672186 - RNA, 14 nt, Salmonella enterica enterica serovar Typhi
uaccgccguagaaa

SEQ ID NO: 3672187 - RNA, 22 nt, Salmonella enterica enterica serovar Typhi
uaccgcgcaguucaauauucac

SEQ ID NO: 3672188 - RNA, 13 nt, Salmonella enterica enterica serovar Typhi
uaccgcgccagcg

SEQ ID NO: 3672189 - RNA, 15 nt, Salmonella enterica enterica serovar Typhi
uaccgcgcgaaccau

SEQ ID NO: 3672190 - RNA, 15 nt, Salmonella enterica enterica serovar Typhi
uaccgcgucaucaaa

SEQ ID NO: 3672191 - RNA, 17 nt, Salmonella enterica enterica serovar Typhi
uaccgcguuuaacgcag

SEQ ID NO: 3672192 - RNA, 16 nt, Salmonella enterica enterica serovar Typhi
uaccgcuaaaauaccc

SEQ ID NO: 3672193 - RNA, 23 nt, Salmonella enterica enterica serovar Typhi
uaccgcugggaugaccugaaauc

SEQ ID NO: 3672194 - RNA, 14 nt, Salmonella enterica enterica serovar Typhi
uaccgcuuuaucau

SEQ ID NO: 3672195 - RNA, 17 nt, Salmonella enterica enterica serovar Typhi
uaccgcuuugccgcgcu

SEQ ID NO: 3672196 - RNA, 22 nt, Salmonella enterica enterica serovar Typhi
uaccggacgacuguagauaccu

SEQ ID NO: 3672197 - RNA, 18 nt, Salmonella enterica enterica serovar Typhi
uacgcgccacgccauugc

SEQ ID NO: 3672198 - RNA, 17 nt, Salmonella enterica enterica serovar Typhi
uacgcgcugcaaauacu

SEQ ID NO: 3672199 - RNA, 23 nt, Salmonella enterica enterica serovar Typhi
uacgcggccaaaacccaccagca

SEQ ID NO: 3672200 - RNA, 20 nt, Salmonella enterica enterica serovar Typhi
uacgcggcgcgccguaaaca

SEQ ID NO: 3672201 - RNA, 22 nt, Salmonella enterica enterica serovar Typhi
uacgcggcgcgccguaaacaau

SEQ ID NO: 3672202 - RNA, 16 nt, Salmonella enterica enterica serovar Typhi
uacgcgggguaaaaug

SEQ ID NO: 3672203 - RNA, 14 nt, Salmonella enterica enterica serovar Typhi
uacgcgucaauuac

SEQ ID NO: 3672204 - RNA, 15 nt, Salmonella enterica enterica serovar Typhi
uacgcgucaauuacc

SEQ ID NO: 3672205 - RNA, 17 nt, Salmonella enterica enterica serovar Typhi
uacgcuacugagcguca

SEQ ID NO: 3672206 - RNA, 17 nt, Salmonella enterica enterica serovar Typhi
uacgcuauaaaguuccc

SEQ ID NO: 3672207 - RNA, 19 nt, Salmonella enterica enterica serovar Typhi
uacgcuauaggcgaccgaa

SEQ ID NO: 3672208 - RNA, 20 nt, Salmonella enterica enterica serovar Typhi
uacgcugaagauuuuuauuc

SEQ ID NO: 3672209 - RNA, 14 nt, Salmonella enterica enterica serovar Typhi
uacgcuguaacccg

SEQ ID NO: 3672210 - RNA, 18 nt, Salmonella enterica enterica serovar Typhi
uacgcuguagcuggcugc

SEQ ID NO: 3672211 - RNA, 14 nt, Salmonella enterica enterica serovar Typhi
uacgcuuacccggc

SEQ ID NO: 3672212 - RNA, 23 nt, Salmonella enterica enterica serovar Typhi
uacgcuuauagguguaaaccguu

SEQ ID NO: 3672213 - RNA, 14 nt, Salmonella enterica enterica serovar Typhi
uacgcuuauugaug

SEQ ID NO: 3672214 - RNA, 12 nt, Salmonella enterica enterica serovar Typhi
uacggaaaaaug

SEQ ID NO: 3672215 - RNA, 21 nt, Salmonella enterica enterica serovar Typhi
uacggaguuggaaccaaacac

SEQ ID NO: 3672216 - RNA, 16 nt, Salmonella enterica enterica serovar Typhi
uacggaugcgcggaug

SEQ ID NO: 3672217 - RNA, 16 nt, Salmonella enterica enterica serovar Typhi
uacggcaaacgcuggu

SEQ ID NO: 3672218 - RNA, 20 nt, Salmonella enterica enterica serovar Typhi
uacggcaacgggacggcggc

SEQ ID NO: 3672219 - RNA, 11 nt, Salmonella enterica enterica serovar Typhi
uacggcaggcc

SEQ ID NO: 3672220 - RNA, 14 nt, Salmonella enterica enterica serovar Typhi
uacggcaucggaac

SEQ ID NO: 3672221 - RNA, 14 nt, Salmonella enterica enterica serovar Typhi
uacggcauggcguc

SEQ ID NO: 3672222 - RNA, 20 nt, Salmonella enterica enterica serovar Typhi
uacggccacaaaacaggauu

SEQ ID NO: 3672223 - RNA, 16 nt, Salmonella enterica enterica serovar Typhi
uacggccauggaacau

SEQ ID NO: 3672224 - RNA, 20 nt, Salmonella enterica enterica serovar Typhi
uacggccugcgcgauggaug

SEQ ID NO: 3672225 - RNA, 12 nt, Salmonella enterica enterica serovar Typhi
uacggcgugaug

SEQ ID NO: 3672226 - RNA, 23 nt, Salmonella enterica enterica serovar Typhi
uacggcugaaaaauccccccucc

SEQ ID NO: 3672227 - RNA, 20 nt, Salmonella enterica enterica serovar Typhi
uacggcuuucacaccguuau

SEQ ID NO: 3672228 - RNA, 17 nt, Salmonella enterica enterica serovar Typhi
uacgggcaaagcgacgc

SEQ ID NO: 3672229 - RNA, 22 nt, Salmonella enterica enterica serovar Typhi
uacggguuaggcaagcugguaa

SEQ ID NO: 3672230 - RNA, 13 nt, Salmonella enterica enterica serovar Typhi
uacgguaaaccag

SEQ ID NO: 3672231 - RNA, 14 nt, Salmonella enterica enterica serovar Typhi
uacgguaauaacuc

SEQ ID NO: 3672232 - RNA, 21 nt, Salmonella enterica enterica serovar Typhi
uacgguccguuuucgccccca

SEQ ID NO: 3672233 - RNA, 22 nt, Salmonella enterica enterica serovar Typhi
uacggugaauauuugcgcuagu

SEQ ID NO: 3672234 - RNA, 16 nt, Salmonella enterica enterica serovar Typhi
uacgguuggccagcau

SEQ ID NO: 3672235 - RNA, 21 nt, Salmonella enterica enterica serovar Typhi
uacguaacugcgguaaauaau

SEQ ID NO: 3672236 - RNA, 17 nt, Salmonella enterica enterica serovar Typhi
uacgucauaucauccag

SEQ ID NO: 3672237 - RNA, 12 nt, Salmonella enterica enterica serovar Typhi
uacguccauccg

SEQ ID NO: 3672238 - RNA, 23 nt, Salmonella enterica enterica serovar Typhi
uacgucgcacggaucaucuaccc

SEQ ID NO: 3672239 - RNA, 19 nt, Salmonella enterica enterica serovar Typhi
uacgucgcauacuuccuca

SEQ ID NO: 3672240 - RNA, 19 nt, Salmonella enterica enterica serovar Typhi
uacgucgcccucuuuggcg

SEQ ID NO: 3672241 - RNA, 16 nt, Salmonella enterica enterica serovar Typhi
uacgucgugacccaca

SEQ ID NO: 3672242 - RNA, 19 nt, Salmonella enterica enterica serovar Typhi
uacgucucgaguaaucacu

SEQ ID NO: 3672243 - RNA, 16 nt, Salmonella enterica enterica serovar Typhi
uacgugaaacugauag

SEQ ID NO: 3672244 - RNA, 16 nt, Salmonella enterica enterica serovar Typhi
uacgugcucucaccau

SEQ ID NO: 3672245 - RNA, 13 nt, Salmonella enterica enterica serovar Typhi
uacguuccagcag

SEQ ID NO: 3672246 - RNA, 12 nt, Salmonella enterica enterica serovar Typhi
uacguucggacu

SEQ ID NO: 3672247 - RNA, 18 nt, Salmonella enterica enterica serovar Typhi
uacguugauuaucaccca

SEQ ID NO: 3672248 - RNA, 12 nt, Salmonella enterica enterica serovar Typhi
uacguuuauucu

SEQ ID NO: 3672249 - RNA, 16 nt, Salmonella enterica enterica serovar Typhi
uacguuuauucuuuuc

SEQ ID NO: 3672250 - RNA, 13 nt, Salmonella enterica enterica serovar Typhi
uacguuuuuauua

SEQ ID NO: 3672251 - RNA, 19 nt, Salmonella enterica enterica serovar Typhi
uacuaacggcgucauccug

SEQ ID NO: 3672252 - RNA, 17 nt, Salmonella enterica enterica serovar Typhi
uacuaauaaaauucacu

SEQ ID NO: 3672253 - RNA, 13 nt, Salmonella enterica enterica serovar Typhi
uacuaauaaauau

SEQ ID NO: 3672254 - RNA, 21 nt, Salmonella enterica enterica serovar Typhi
uacuaaucucacccauagaua

SEQ ID NO: 3672255 - RNA, 13 nt, Salmonella enterica enterica serovar Typhi
uacuacaacuguc

SEQ ID NO: 3672256 - RNA, 15 nt, Salmonella enterica enterica serovar Typhi
uacuacagaaagcca

SEQ ID NO: 3672257 - RNA, 21 nt, Salmonella enterica enterica serovar Typhi
uacuacugguggaauaaauau

SEQ ID NO: 3672258 - RNA, 13 nt, Salmonella enterica enterica serovar Typhi
uacuauuuuucac

SEQ ID NO: 3672259 - RNA, 17 nt, Salmonella enterica enterica serovar Typhi
uacuauuuuucacccua

SEQ ID NO: 3672260 - RNA, 16 nt, Salmonella enterica enterica serovar Typhi
uacucacauucauaaa

SEQ ID NO: 3672261 - RNA, 20 nt, Salmonella enterica enterica serovar Typhi
uacucacauucauaaaagau

SEQ ID NO: 3672262 - RNA, 24 nt, Salmonella enterica enterica serovar Typhi
uacucaccaguccggcagaaagca

SEQ ID NO: 3672263 - RNA, 19 nt, Salmonella enterica enterica serovar Typhi
uacucacgacuuucaccag

SEQ ID NO: 3672264 - RNA, 20 nt, Salmonella enterica enterica serovar Typhi
uacucacgacuuucaccaga

SEQ ID NO: 3672265 - RNA, 20 nt, Salmonella enterica enterica serovar Typhi
uacucagcacauucagagcg

SEQ ID NO: 3672266 - RNA, 14 nt, Salmonella enterica enterica serovar Typhi
uacucagggcaaaa

SEQ ID NO: 3672267 - RNA, 14 nt, Salmonella enterica enterica serovar Typhi
uacuccacaguuca

SEQ ID NO: 3672268 - RNA, 22 nt, Salmonella enterica enterica serovar Typhi
uacuccagcagaccggcaaaaa

SEQ ID NO: 3672269 - RNA, 12 nt, Salmonella enterica enterica serovar Typhi
uacuccagccca

SEQ ID NO: 3672270 - RNA, 21 nt, Salmonella enterica enterica serovar Typhi
uacuccagcccaucagucccc

SEQ ID NO: 3672271 - RNA, 14 nt, Salmonella enterica enterica serovar Typhi
uacuccguuuuaau

SEQ ID NO: 3672272 - RNA, 15 nt, Salmonella enterica enterica serovar Typhi
uacuccguuuuaauc

SEQ ID NO: 3672273 - RNA, 17 nt, Salmonella enterica enterica serovar Typhi
uacuccguuuuaaucuu

SEQ ID NO: 3672274 - RNA, 18 nt, Salmonella enterica enterica serovar Typhi
uacuccguuuuaaucuuu

SEQ ID NO: 3672275 - RNA, 20 nt, Salmonella enterica enterica serovar Typhi
uacucgacgcacuccagaug

SEQ ID NO: 3672276 - RNA, 22 nt, Salmonella enterica enterica serovar Typhi
uacucgccaauauccccagccc

SEQ ID NO: 3672277 - RNA, 22 nt, Salmonella enterica enterica serovar Typhi
uacucgggccagcucuuuucug

SEQ ID NO: 3672278 - RNA, 21 nt, Salmonella enterica enterica serovar Typhi
uacucguaaucuaaaauuauu

SEQ ID NO: 3672279 - RNA, 16 nt, Salmonella enterica enterica serovar Typhi
uacucugcggagcaag

SEQ ID NO: 3672280 - RNA, 13 nt, Salmonella enterica enterica serovar Typhi
uacucugcuuuuu

SEQ ID NO: 3672281 - RNA, 13 nt, Salmonella enterica enterica serovar Typhi
uacucuuccacca

SEQ ID NO: 3672282 - RNA, 12 nt, Salmonella enterica enterica serovar Typhi
uacucuuccucc

SEQ ID NO: 3672283 - RNA, 19 nt, Salmonella enterica enterica serovar Typhi
uuaauggcagaauaaaaca

SEQ ID NO: 3672284 - RNA, 19 nt, Salmonella enterica enterica serovar Typhi
uuaauggcgcaaugucccu

SEQ ID NO: 3672285 - RNA, 14 nt, Salmonella enterica enterica serovar Typhi
uuaaugucaucauc

SEQ ID NO: 3672286 - RNA, 14 nt, Salmonella enterica enterica serovar Typhi
uuaauguccagcag

SEQ ID NO: 3672287 - RNA, 20 nt, Salmonella enterica enterica serovar Typhi
uuaauguuaggaguaaauaa

SEQ ID NO: 3672288 - RNA, 21 nt, Salmonella enterica enterica serovar Typhi
uuaauguuuagucuuuuagua

SEQ ID NO: 3672289 - RNA, 19 nt, Salmonella enterica enterica serovar Typhi
uuaauuaaaugcuugcuuu

SEQ ID NO: 3672290 - RNA, 13 nt, Salmonella enterica enterica serovar Typhi
uuaauuaauccau

SEQ ID NO: 3672291 - RNA, 19 nt, Salmonella enterica enterica serovar Typhi
uuaauuacgcacuacggca

SEQ ID NO: 3672292 - RNA, 14 nt, Salmonella enterica enterica serovar Typhi
uuaauuauacuguc

SEQ ID NO: 3672293 - RNA, 21 nt, Salmonella enterica enterica serovar Typhi
uuaauuccgcaucauucaucu

SEQ ID NO: 3672294 - RNA, 20 nt, Salmonella enterica enterica serovar Typhi
uuaauuccuggcguaugcuu

SEQ ID NO: 3672295 - RNA, 13 nt, Salmonella enterica enterica serovar Typhi
uuaauucuuuuaa

SEQ ID NO: 3672296 - RNA, 21 nt, Salmonella enterica enterica serovar Typhi
uuaauugcugaagauaaaauu

SEQ ID NO: 3672297 - RNA, 18 nt, Salmonella enterica enterica serovar Typhi
uuaauuugcaucaggcca

SEQ ID NO: 3672298 - RNA, 20 nt, Salmonella enterica enterica serovar Typhi
uuaauuugcuccagaagauc

SEQ ID NO: 3672299 - RNA, 15 nt, Salmonella enterica enterica serovar Typhi
uuaauuugugccagc

SEQ ID NO: 3672300 - RNA, 22 nt, Salmonella enterica enterica serovar Typhi
uuacaaacaggcuuuauacagu

SEQ ID NO: 3672301 - RNA, 20 nt, Salmonella enterica enterica serovar Typhi
uuacaaauuuaaacauguca

SEQ ID NO: 3672302 - RNA, 15 nt, Salmonella enterica enterica serovar Typhi
uuacaaccgcaccgg

SEQ ID NO: 3672303 - RNA, 18 nt, Salmonella enterica enterica serovar Typhi
uuacaaguaauaaaauaa

SEQ ID NO: 3672304 - RNA, 16 nt, Salmonella enterica enterica serovar Typhi
uuacacgaucauuuca

SEQ ID NO: 3672305 - RNA, 14 nt, Salmonella enterica enterica serovar Typhi
uuacacguuccaug

SEQ ID NO: 3672306 - RNA, 15 nt, Salmonella enterica enterica serovar Typhi
uuacacguuccaugg

SEQ ID NO: 3672307 - RNA, 19 nt, Salmonella enterica enterica serovar Typhi
uuacacuuagcacaaagaa

SEQ ID NO: 3672308 - RNA, 16 nt, Salmonella enterica enterica serovar Typhi
uuacagauauccaccg

SEQ ID NO: 3672309 - RNA, 14 nt, Salmonella enterica enterica serovar Typhi
uuacaggacagaug

SEQ ID NO: 3672310 - RNA, 22 nt, Salmonella enterica enterica serovar Typhi
uuacaggcauccgugaccugcu

SEQ ID NO: 3672311 - RNA, 19 nt, Salmonella enterica enterica serovar Typhi
uuacaggcaucuuccagcg

SEQ ID NO: 3672312 - RNA, 19 nt, Salmonella enterica enterica serovar Typhi
uuacaggccggacaggcga

SEQ ID NO: 3672313 - RNA, 13 nt, Salmonella enterica enterica serovar Typhi
uuacaggcgcauc

SEQ ID NO: 3672314 - RNA, 21 nt, Salmonella enterica enterica serovar Typhi
uuacaggcgcaucagaaaaac

SEQ ID NO: 3672315 - RNA, 22 nt, Salmonella enterica enterica serovar Typhi
uuacaggcgcaucagaaaaacc

SEQ ID NO: 3672316 - RNA, 23 nt, Salmonella enterica enterica serovar Typhi
uuacaggugccuggguuccaggc

SEQ ID NO: 3672317 - RNA, 17 nt, Salmonella enterica enterica serovar Typhi
uuacauagaaaauauau

SEQ ID NO: 3672318 - RNA, 14 nt, Salmonella enterica enterica serovar Typhi
uuacaucagauaaa

SEQ ID NO: 3672319 - RNA, 15 nt, Salmonella enterica enterica serovar Typhi
uuacaucagauaaac

SEQ ID NO: 3672320 - RNA, 12 nt, Salmonella enterica enterica serovar Typhi
uuaccaaaucaa

SEQ ID NO: 3672321 - RNA, 11 nt, Salmonella enterica enterica serovar Typhi
uuaccaacccc

SEQ ID NO: 3672322 - RNA, 14 nt, Salmonella enterica enterica serovar Typhi
uuaccaaucugcgu

SEQ ID NO: 3672323 - RNA, 23 nt, Salmonella enterica enterica serovar Typhi
uuaccaaugccaaaaaaacuaau

SEQ ID NO: 3672324 - RNA, 19 nt, Salmonella enterica enterica serovar Typhi
uuaccacuuugcgcuccug

SEQ ID NO: 3672325 - RNA, 15 nt, Salmonella enterica enterica serovar Typhi
uuaccagcaucaaua

SEQ ID NO: 3672326 - RNA, 19 nt, Salmonella enterica enterica serovar Typhi
uuaccagcaucaauagcag

SEQ ID NO: 3672327 - RNA, 18 nt, Salmonella enterica enterica serovar Typhi
uuaccagccgcgcccuaa

SEQ ID NO: 3672328 - RNA, 21 nt, Salmonella enterica enterica serovar Typhi
uuaccaguugaccaaacagca

SEQ ID NO: 3672329 - RNA, 15 nt, Salmonella enterica enterica serovar Typhi
uuaccauccauuaaa

SEQ ID NO: 3672330 - RNA, 13 nt, Salmonella enterica enterica serovar Typhi
uuacccagccuga

SEQ ID NO: 3672331 - RNA, 20 nt, Salmonella enterica enterica serovar Typhi
uuacccauacaguacagacu

SEQ ID NO: 3672332 - RNA, 13 nt, Salmonella enterica enterica serovar Typhi
uuacccggccagu

SEQ ID NO: 3672333 - RNA, 18 nt, Salmonella enterica enterica serovar Typhi
uuacccuucaugcagccc

SEQ ID NO: 3672334 - RNA, 14 nt, Salmonella enterica enterica serovar Typhi
uuaccgcaucgccc

SEQ ID NO: 3672335 - RNA, 20 nt, Salmonella enterica enterica serovar Typhi
uuaccgccagauggcgucac

SEQ ID NO: 3672336 - RNA, 15 nt, Salmonella enterica enterica serovar Typhi
uuaccgccagcggcg

SEQ ID NO: 3672337 - RNA, 21 nt, Salmonella enterica enterica serovar Typhi
uuaccggacggucggcguaau

SEQ ID NO: 3672338 - RNA, 16 nt, Salmonella enterica enterica serovar Typhi
uuaccggcugccgaua

SEQ ID NO: 3672339 - RNA, 15 nt, Salmonella enterica enterica serovar Typhi
uuaccggcuggaagc

SEQ ID NO: 3672340 - RNA, 21 nt, Salmonella enterica enterica serovar Typhi
uuaccggugcgauucagcgca

SEQ ID NO: 3672341 - RNA, 13 nt, Salmonella enterica enterica serovar Typhi
uuaccguaaaaug

SEQ ID NO: 3672342 - RNA, 21 nt, Salmonella enterica enterica serovar Typhi
uuaccguaaaaugcuggugca

SEQ ID NO: 3672343 - RNA, 13 nt, Salmonella enterica enterica serovar Typhi
uuaccuaccaguu

SEQ ID NO: 3672344 - RNA, 17 nt, Salmonella enterica enterica serovar Typhi
uuaccuggguagcuucu

SEQ ID NO: 3672345 - RNA, 22 nt, Salmonella enterica enterica serovar Typhi
uuaccuggguagcuucugucug

SEQ ID NO: 3672346 - RNA, 16 nt, Salmonella enterica enterica serovar Typhi
uuaccuuguucuucca

SEQ ID NO: 3672347 - RNA, 19 nt, Salmonella enterica enterica serovar Typhi
uuacgaucguuugcccauu

SEQ ID NO: 3672348 - RNA, 20 nt, Salmonella enterica enterica serovar Typhi
uuacgcacgccagauaaauc

SEQ ID NO: 3672349 - RNA, 18 nt, Salmonella enterica enterica serovar Typhi
uuacgcagcaagaacaga

SEQ ID NO: 3672350 - RNA, 13 nt, Salmonella enterica enterica serovar Typhi
uuacgcaggcuug

SEQ ID NO: 3672351 - RNA, 21 nt, Salmonella enterica enterica serovar Typhi
uuacgccgcaaucacuucaua

SEQ ID NO: 3672352 - RNA, 19 nt, Salmonella enterica enterica serovar Typhi
uuacgcguuacgcccugug

SEQ ID NO: 3672353 - RNA, 18 nt, Salmonella enterica enterica serovar Typhi
uuacgcucgcugauggcg

SEQ ID NO: 3672354 - RNA, 21 nt, Salmonella enterica enterica serovar Typhi
uuacgcucgucaaacaguuca

SEQ ID NO: 3672355 - RNA, 11 nt, Salmonella enterica enterica serovar Typhi
uuacgcugccg

SEQ ID NO: 3672356 - RNA, 19 nt, Salmonella enterica enterica serovar Typhi
uuacgcugguuugugugca

SEQ ID NO: 3672357 - RNA, 18 nt, Salmonella enterica enterica serovar Typhi
uuacgcuuuauucugucg

SEQ ID NO: 3672358 - RNA, 22 nt, Salmonella enterica enterica serovar Typhi
uuacggaaaaaauacugauaaa

SEQ ID NO: 3672359 - RNA, 16 nt, Salmonella enterica enterica serovar Typhi
uuacggaaaaaugucg

SEQ ID NO: 3672360 - RNA, 14 nt, Salmonella enterica enterica serovar Typhi
uuacggacugcggc

SEQ ID NO: 3672361 - RNA, 16 nt, Salmonella enterica enterica serovar Typhi
uuacgguuggccagca

SEQ ID NO: 3672362 - RNA, 12 nt, Salmonella enterica enterica serovar Typhi
uuacuauuuuuc

SEQ ID NO: 3672363 - RNA, 13 nt, Salmonella enterica enterica serovar Typhi
uuacuauuuuuca

SEQ ID NO: 3672364 - RNA, 15 nt, Salmonella enterica enterica serovar Typhi
uuacucacugccgcc

SEQ ID NO: 3672365 - RNA, 15 nt, Salmonella enterica enterica serovar Typhi
uuacuccaaaaauaa

SEQ ID NO: 3672366 - RNA, 12 nt, Salmonella enterica enterica serovar Typhi
uuacucccgucg

SEQ ID NO: 3672367 - RNA, 11 nt, Salmonella enterica enterica serovar Typhi
uuacucuucca

SEQ ID NO: 3672368 - RNA, 14 nt, Salmonella enterica enterica serovar Typhi
uuacucuuccugcu

SEQ ID NO: 3672369 - RNA, 12 nt, Salmonella enterica enterica serovar Typhi
uuacugaauaaa

SEQ ID NO: 3672370 - RNA, 20 nt, Salmonella enterica enterica serovar Typhi
uuacugacgccauucauucc

SEQ ID NO: 3672371 - RNA, 16 nt, Salmonella enterica enterica serovar Typhi
uuacugaugccagccg

SEQ ID NO: 3672372 - RNA, 18 nt, Salmonella enterica enterica serovar Typhi
uuacugcucguagcguuu

SEQ ID NO: 3672373 - RNA, 19 nt, Salmonella enterica enterica serovar Typhi
uuacugucgcccgcaacca

SEQ ID NO: 3672374 - RNA, 16 nt, Salmonella enterica enterica serovar Typhi
uuacuguuuuaucagg

SEQ ID NO: 3672375 - RNA, 15 nt, Salmonella enterica enterica serovar Typhi
uuacuucacguaauc

SEQ ID NO: 3672376 - RNA, 14 nt, Salmonella enterica enterica serovar Typhi
uuacuuguaggccu

SEQ ID NO: 3672377 - RNA, 18 nt, Salmonella enterica enterica serovar Typhi
uuacuuucaaaauacugg

SEQ ID NO: 3672378 - RNA, 13 nt, Salmonella enterica enterica serovar Typhi
uuacuuucauucc

SEQ ID NO: 3672379 - RNA, 13 nt, Salmonella enterica enterica serovar Typhi
uuacuuugcgccc

SEQ ID NO: 3672380 - RNA, 13 nt, Salmonella enterica enterica serovar Typhi
uuacuuuuuuaaa

SEQ ID NO: 3672381 - RNA, 17 nt, Salmonella enterica enterica serovar Typhi
uuacuuuuuuaaauguu

SEQ ID NO: 3672382 - RNA, 12 nt, Salmonella enterica enterica serovar Typhi
uuagaaaaagaa

SEQ ID NO: 3672383 - RNA, 13 nt, Salmonella enterica enterica serovar Typhi
uuagaaaaagaaa

SEQ ID NO: 3672384 - RNA, 20 nt, Salmonella enterica enterica serovar Typhi
uuagaaaauauauuggccuu

SEQ ID NO: 3672385 - RNA, 16 nt, Salmonella enterica enterica serovar Typhi
uuagaaaguggcauau

SEQ ID NO: 3672386 - RNA, 21 nt, Salmonella enterica enterica serovar Typhi
uuagaauauaguuagaaaaua

SEQ ID NO: 3672387 - RNA, 13 nt, Salmonella enterica enterica serovar Typhi
uuagacucagcga

SEQ ID NO: 3672388 - RNA, 17 nt, Salmonella enterica enterica serovar Typhi
uuagacuucuuccauac

SEQ ID NO: 3672389 - RNA, 16 nt, Salmonella enterica enterica serovar Typhi
uuagagaguaaaaccg

SEQ ID NO: 3672390 - RNA, 21 nt, Salmonella enterica enterica serovar Typhi
uuagagcacaucacucauaau

SEQ ID NO: 3672391 - RNA, 14 nt, Salmonella enterica enterica serovar Typhi
uuagauuaaucacu

SEQ ID NO: 3672392 - RNA, 14 nt, Salmonella enterica enterica serovar Typhi
uuagcaaaaaugcc

SEQ ID NO: 3672393 - RNA, 19 nt, Salmonella enterica enterica serovar Typhi
uuagcaauugccauaaaaa

SEQ ID NO: 3672394 - RNA, 16 nt, Salmonella enterica enterica serovar Typhi
uuagcacagcucuaau

SEQ ID NO: 3672395 - RNA, 19 nt, Salmonella enterica enterica serovar Typhi
uuagcagccacacacuguu

SEQ ID NO: 3672396 - RNA, 21 nt, Salmonella enterica enterica serovar Typhi
uuagccaaacucugaaaaaau

SEQ ID NO: 3672397 - RNA, 15 nt, Salmonella enterica enterica serovar Typhi
uuagccagauggcug

SEQ ID NO: 3672398 - RNA, 19 nt, Salmonella enterica enterica serovar Typhi
uuagccaggugacuuugcc

SEQ ID NO: 3672399 - RNA, 14 nt, Salmonella enterica enterica serovar Typhi
uuagccaucccggc

SEQ ID NO: 3672400 - RNA, 17 nt, Salmonella enterica enterica serovar Typhi
uuagccccugacgcugc

SEQ ID NO: 3672401 - RNA, 18 nt, Salmonella enterica enterica serovar Typhi
uuagccuguuauucaauu

SEQ ID NO: 3672402 - RNA, 13 nt, Salmonella enterica enterica serovar Typhi
uuagcgaaacagu

SEQ ID NO: 3672403 - RNA, 23 nt, Salmonella enterica enterica serovar Typhi
uuagcgcuaauuccuguccauug

SEQ ID NO: 3672404 - RNA, 16 nt, Salmonella enterica enterica serovar Typhi
uuagcguuucaaccgc

SEQ ID NO: 3672405 - RNA, 23 nt, Salmonella enterica enterica serovar Typhi
uuagcucaacgcaucgcugcgcu

SEQ ID NO: 3672406 - RNA, 23 nt, Salmonella enterica enterica serovar Typhi
uuagcugcgcaagaaacaucauc

SEQ ID NO: 3672407 - RNA, 18 nt, Salmonella enterica enterica serovar Typhi
uuagcuggccaaucagcg

SEQ ID NO: 3672408 - RNA, 20 nt, Salmonella enterica enterica serovar Typhi
uuagcuuuuuuaugcuguag

SEQ ID NO: 3672409 - RNA, 14 nt, Salmonella enterica enterica serovar Typhi
uuaggaaacauaag

SEQ ID NO: 3672410 - RNA, 19 nt, Salmonella enterica enterica serovar Typhi
uuaggccaaacuuacgcag

SEQ ID NO: 3672411 - RNA, 15 nt, Salmonella enterica enterica serovar Typhi
uuaggcguaauuauu

SEQ ID NO: 3672412 - RNA, 13 nt, Salmonella enterica enterica serovar Typhi
uuagggcgcggcu

SEQ ID NO: 3672413 - RNA, 15 nt, Salmonella enterica enterica serovar Typhi
uuagggcgcggcugg

SEQ ID NO: 3672414 - RNA, 22 nt, Salmonella enterica enterica serovar Typhi
uuagggcuauuuuacuugccau

SEQ ID NO: 3672415 - RNA, 19 nt, Salmonella enterica enterica serovar Typhi
uuaggguagaaaaagguaa

SEQ ID NO: 3672416 - RNA, 18 nt, Salmonella enterica enterica serovar Typhi
uuaggguaucauuuccac

SEQ ID NO: 3672417 - RNA, 16 nt, Salmonella enterica enterica serovar Typhi
uuagguucuucaaugc

SEQ ID NO: 3672418 - RNA, 17 nt, Salmonella enterica enterica serovar Typhi
uuaguaauaaagcguag

SEQ ID NO: 3672419 - RNA, 20 nt, Salmonella enterica enterica serovar Typhi
uuaguaccgaacagccaggc

SEQ ID NO: 3672420 - RNA, 21 nt, Salmonella enterica enterica serovar Typhi
uuaguacgcaaggaaauauua

SEQ ID NO: 3672421 - RNA, 20 nt, Salmonella enterica enterica serovar Typhi
uuaguccgucggggauggcg

SEQ ID NO: 3672422 - RNA, 21 nt, Salmonella enterica enterica serovar Typhi
uuagucuccugccaaugaaau

SEQ ID NO: 3672423 - RNA, 16 nt, Salmonella enterica enterica serovar Typhi
uuagugacguuaucug

SEQ ID NO: 3672424 - RNA, 20 nt, Salmonella enterica enterica serovar Typhi
uuagugacguuaucugucag

SEQ ID NO: 3672425 - RNA, 12 nt, Salmonella enterica enterica serovar Typhi
uuagugccgcca

SEQ ID NO: 3672426 - RNA, 15 nt, Salmonella enterica enterica serovar Typhi
uuagugcucagcuug

SEQ ID NO: 3672427 - RNA, 14 nt, Salmonella enterica enterica serovar Typhi
uuaguguuauauaa

SEQ ID NO: 3672428 - RNA, 21 nt, Salmonella enterica enterica serovar Typhi
uuaguuacgcacgccagauaa

SEQ ID NO: 3672429 - RNA, 12 nt, Salmonella enterica enterica serovar Typhi
uuaguucaaguu

SEQ ID NO: 3672430 - RNA, 20 nt, Salmonella enterica enterica serovar Typhi
uuaguucaaguuuagaaaaa

SEQ ID NO: 3672431 - RNA, 23 nt, Salmonella enterica enterica serovar Typhi
uuauaaauaaaguguuaucaugu

SEQ ID NO: 3672432 - RNA, 21 nt, Salmonella enterica enterica serovar Typhi
uuauaaauauuaaugaauaaa

SEQ ID NO: 3672433 - RNA, 22 nt, Salmonella enterica enterica serovar Typhi
uuauaacccugucugcgcaacg

SEQ ID NO: 3672434 - RNA, 15 nt, Salmonella enterica enterica serovar Typhi
uuauaacguaucguu

SEQ ID NO: 3672435 - RNA, 15 nt, Salmonella enterica enterica serovar Typhi
uuauaagaaccaucu

SEQ ID NO: 3672436 - RNA, 13 nt, Salmonella enterica enterica serovar Typhi
uuauaagcgccaa

SEQ ID NO: 3672437 - RNA, 22 nt, Salmonella enterica enterica serovar Typhi
uuauaaggccugccguccugau

SEQ ID NO: 3672438 - RNA, 19 nt, Salmonella enterica enterica serovar Typhi
ugcgccagaauugccugau

SEQ ID NO: 3672439 - RNA, 12 nt, Salmonella enterica enterica serovar Typhi
ugcgccagauca

SEQ ID NO: 3672440 - RNA, 13 nt, Salmonella enterica enterica serovar Typhi
ugcgccagauuca

SEQ ID NO: 3672441 - RNA, 23 nt, Salmonella enterica enterica serovar Typhi
ugcgccagccagucgccaggcaa

SEQ ID NO: 3672442 - RNA, 15 nt, Salmonella enterica enterica serovar Typhi
ugcgccaggcagcac

SEQ ID NO: 3672443 - RNA, 19 nt, Salmonella enterica enterica serovar Typhi
ugcgccaggcccagccgcu

SEQ ID NO: 3672444 - RNA, 22 nt, Salmonella enterica enterica serovar Typhi
ugcgccauauaggcauguuccu

SEQ ID NO: 3672445 - RNA, 19 nt, Salmonella enterica enterica serovar Typhi
ugcgccaucauccggcaac

SEQ ID NO: 3672446 - RNA, 18 nt, Salmonella enterica enterica serovar Typhi
ugcgccauccaccaggca

SEQ ID NO: 3672447 - RNA, 22 nt, Salmonella enterica enterica serovar Typhi
ugcgccauccaccaggcaugca

SEQ ID NO: 3672448 - RNA, 11 nt, Salmonella enterica enterica serovar Typhi
ugcgccauccg

SEQ ID NO: 3672449 - RNA, 21 nt, Salmonella enterica enterica serovar Typhi
ugcgccaucggcgcugauugc

SEQ ID NO: 3672450 - RNA, 20 nt, Salmonella enterica enterica serovar Typhi
ugcgccauucuuucgcguaa

SEQ ID NO: 3672451 - RNA, 14 nt, Salmonella enterica enterica serovar Typhi
ugcgccauuuccag

SEQ ID NO: 3672452 - RNA, 15 nt, Salmonella enterica enterica serovar Typhi
ugcgcccaucaucau

SEQ ID NO: 3672453 - RNA, 21 nt, Salmonella enterica enterica serovar Typhi
ugcgcccaucaucaucggcac

SEQ ID NO: 3672454 - RNA, 21 nt, Salmonella enterica enterica serovar Typhi
ugcgccccggcggcguacagc

SEQ ID NO: 3672455 - RNA, 17 nt, Salmonella enterica enterica serovar Typhi
ugcgcccuuccgucagc

SEQ ID NO: 3672456 - RNA, 23 nt, Salmonella enterica enterica serovar Typhi
ugcgccgacaucgccaccgcaug

SEQ ID NO: 3672457 - RNA, 16 nt, Salmonella enterica enterica serovar Typhi
ugcgccgccagcgaca

SEQ ID NO: 3672458 - RNA, 14 nt, Salmonella enterica enterica serovar Typhi
ugcgccgccaggca

SEQ ID NO: 3672459 - RNA, 23 nt, Salmonella enterica enterica serovar Typhi
ugcgccgccauccggccuguaag

SEQ ID NO: 3672460 - RNA, 15 nt, Salmonella enterica enterica serovar Typhi
ugcgccggcugcgcu

SEQ ID NO: 3672461 - RNA, 21 nt, Salmonella enterica enterica serovar Typhi
ugcgccggcugcgcugccagc

SEQ ID NO: 3672462 - RNA, 21 nt, Salmonella enterica enterica serovar Typhi
ugcgccgugaaauauccuccg

SEQ ID NO: 3672463 - RNA, 18 nt, Salmonella enterica enterica serovar Typhi
ugcgccgugccuggcgcu

SEQ ID NO: 3672464 - RNA, 16 nt, Salmonella enterica enterica serovar Typhi
ugcgccuaccgacaaa

SEQ ID NO: 3672465 - RNA, 20 nt, Salmonella enterica enterica serovar Typhi
ugcgccuggaaaaaagcgcc

SEQ ID NO: 3672466 - RNA, 18 nt, Salmonella enterica enterica serovar Typhi
ugcgccugucuccagcgc

SEQ ID NO: 3672467 - RNA, 21 nt, Salmonella enterica enterica serovar Typhi
ugcgccuguuagggcgcggcu

SEQ ID NO: 3672468 - RNA, 15 nt, Salmonella enterica enterica serovar Typhi
ugcgccuuaucaagc

SEQ ID NO: 3672469 - RNA, 18 nt, Salmonella enterica enterica serovar Typhi
ugcgccuuauccggcgug

SEQ ID NO: 3672470 - RNA, 20 nt, Salmonella enterica enterica serovar Typhi
ugcgccuuauccggcgugua

SEQ ID NO: 3672471 - RNA, 19 nt, Salmonella enterica enterica serovar Typhi
ugcgcgacgacgccagcca

SEQ ID NO: 3672472 - RNA, 22 nt, Salmonella enterica enterica serovar Typhi
ugcgcgacgacgccagccagcc

SEQ ID NO: 3672473 - RNA, 14 nt, Salmonella enterica enterica serovar Typhi
ugcgcgauguucau

SEQ ID NO: 3672474 - RNA, 16 nt, Salmonella enterica enterica serovar Typhi
ugcgcgcaucgggccg

SEQ ID NO: 3672475 - RNA, 23 nt, Salmonella enterica enterica serovar Typhi
ugcgcgccauacuuacugcuguc

SEQ ID NO: 3672476 - RNA, 16 nt, Salmonella enterica enterica serovar Typhi
ugcgcgccgacaggcu

SEQ ID NO: 3672477 - RNA, 20 nt, Salmonella enterica enterica serovar Typhi
ugcgcgccgcccugcaucau

SEQ ID NO: 3672478 - RNA, 14 nt, Salmonella enterica enterica serovar Typhi
ugcgcgccuucgaa

SEQ ID NO: 3672479 - RNA, 17 nt, Salmonella enterica enterica serovar Typhi
ugcgcgcgaugcugcuc

SEQ ID NO: 3672480 - RNA, 22 nt, Salmonella enterica enterica serovar Typhi
ugcgcgcgugaccccaggcaua

SEQ ID NO: 3672481 - RNA, 21 nt, Salmonella enterica enterica serovar Typhi
ugcgcgcuucuucaugggcgu

SEQ ID NO: 3672482 - RNA, 21 nt, Salmonella enterica enterica serovar Typhi
ugcgcggauuaagcgaaucca

SEQ ID NO: 3672483 - RNA, 19 nt, Salmonella enterica enterica serovar Typhi
ugcgcggcaauuuccgcug

SEQ ID NO: 3672484 - RNA, 20 nt, Salmonella enterica enterica serovar Typhi
ugcgcgggcguauagccagg

SEQ ID NO: 3672485 - RNA, 15 nt, Salmonella enterica enterica serovar Typhi
ugcgcgucccucucc

SEQ ID NO: 3672486 - RNA, 20 nt, Salmonella enterica enterica serovar Typhi
ugcgcgucccucuccagggc

SEQ ID NO: 3672487 - RNA, 21 nt, Salmonella enterica enterica serovar Typhi
ugcgcgucccucuccagggca

SEQ ID NO: 3672488 - RNA, 21 nt, Salmonella enterica enterica serovar Typhi
ugcgcgugcgguuuuccugau

SEQ ID NO: 3672489 - RNA, 16 nt, Salmonella enterica enterica serovar Typhi
ugcgcguucugcucca

SEQ ID NO: 3672490 - RNA, 17 nt, Salmonella enterica enterica serovar Typhi
ugcgcguuuagcgccag

SEQ ID NO: 3672491 - RNA, 18 nt, Salmonella enterica enterica serovar Typhi
ugcgcguuuagcgccagc

SEQ ID NO: 3672492 - RNA, 21 nt, Salmonella enterica enterica serovar Typhi
ugcgcguuuagcgccagcagc

SEQ ID NO: 3672493 - RNA, 14 nt, Salmonella enterica enterica serovar Typhi
ugcgcguuuucauc

SEQ ID NO: 3672494 - RNA, 17 nt, Salmonella enterica enterica serovar Typhi
ugcgcguuuuccaccag

SEQ ID NO: 3672495 - RNA, 12 nt, Salmonella enterica enterica serovar Typhi
ugcgcuaagcgu

SEQ ID NO: 3672496 - RNA, 15 nt, Salmonella enterica enterica serovar Typhi
ugcgcuauccgcgcu

SEQ ID NO: 3672497 - RNA, 20 nt, Salmonella enterica enterica serovar Typhi
ugcgcuauccgcgcucgcca

SEQ ID NO: 3672498 - RNA, 23 nt, Salmonella enterica enterica serovar Typhi
ugcgcuauguaagguucccugcg

SEQ ID NO: 3672499 - RNA, 15 nt, Salmonella enterica enterica serovar Typhi
ugcgcuauuacucuu

SEQ ID NO: 3672500 - RNA, 14 nt, Salmonella enterica enterica serovar Typhi
ugcgcucaggguca

SEQ ID NO: 3672501 - RNA, 14 nt, Salmonella enterica enterica serovar Typhi
ugcgcuccggcgcu

SEQ ID NO: 3672502 - RNA, 17 nt, Salmonella enterica enterica serovar Typhi
ugcgcucuaucaccgcc

SEQ ID NO: 3672503 - RNA, 22 nt, Salmonella enterica enterica serovar Typhi
ugcgcugaauagcgcugcggcu

SEQ ID NO: 3672504 - RNA, 14 nt, Salmonella enterica enterica serovar Typhi
ugcgcugcaaaaag

SEQ ID NO: 3672505 - RNA, 15 nt, Salmonella enterica enterica serovar Typhi
ugcgcugcgcgcgau

SEQ ID NO: 3672506 - RNA, 20 nt, Salmonella enterica enterica serovar Typhi
ugcgcuuaccgggccuacag

SEQ ID NO: 3672507 - RNA, 19 nt, Salmonella enterica enterica serovar Typhi
ugcgcuuaucaggccuacg

SEQ ID NO: 3672508 - RNA, 19 nt, Salmonella enterica enterica serovar Typhi
ugcgcuuauccggccuacg

SEQ ID NO: 3672509 - RNA, 22 nt, Salmonella enterica enterica serovar Typhi
ugacggaggcgggcgcgcaguu

SEQ ID NO: 3672510 - RNA, 15 nt, Salmonella enterica enterica serovar Typhi
ugacggccaccagcg

SEQ ID NO: 3672511 - RNA, 21 nt, Salmonella enterica enterica serovar Typhi
ugacggcggaagaggcgccug

SEQ ID NO: 3672512 - RNA, 18 nt, Salmonella enterica enterica serovar Typhi
ugacgggaaaucucccug

SEQ ID NO: 3672513 - RNA, 20 nt, Salmonella enterica enterica serovar Typhi
ugacgggaaaucucccuggc

SEQ ID NO: 3672514 - RNA, 21 nt, Salmonella enterica enterica serovar Typhi
ugacgggcauuguuaauccag

SEQ ID NO: 3672515 - RNA, 22 nt, Salmonella enterica enterica serovar Typhi
ugacgguaaaguaauuuccaua

SEQ ID NO: 3672516 - RNA, 22 nt, Salmonella enterica enterica serovar Typhi
ugacgguauucccggucaagcg

SEQ ID NO: 3672517 - RNA, 13 nt, Salmonella enterica enterica serovar Typhi
ugacguccaggcc

SEQ ID NO: 3672518 - RNA, 18 nt, Salmonella enterica enterica serovar Typhi
ugacguuaacgcagcauc

SEQ ID NO: 3672519 - RNA, 16 nt, Salmonella enterica enterica serovar Typhi
ugacguuauccaguau

SEQ ID NO: 3672520 - RNA, 17 nt, Salmonella enterica enterica serovar Typhi
ugacguuaucugucagc

SEQ ID NO: 3672521 - RNA, 15 nt, Salmonella enterica enterica serovar Typhi
ugacuaaaucagcau

SEQ ID NO: 3672522 - RNA, 21 nt, Salmonella enterica enterica serovar Typhi
ugacuauacccaaaauaauuc

SEQ ID NO: 3672523 - RNA, 15 nt, Salmonella enterica enterica serovar Typhi
ugacuauccacagcg

SEQ ID NO: 3672524 - RNA, 19 nt, Salmonella enterica enterica serovar Typhi
ugacuaucuggauacgaua

SEQ ID NO: 3672525 - RNA, 21 nt, Salmonella enterica enterica serovar Typhi
ugacucacauaacaaaaccag

SEQ ID NO: 3672526 - RNA, 15 nt, Salmonella enterica enterica serovar Typhi
ugacucauuaaaaaa

SEQ ID NO: 3672527 - RNA, 19 nt, Salmonella enterica enterica serovar Typhi
ugacucauuaaaaaaacau

SEQ ID NO: 3672528 - RNA, 12 nt, Salmonella enterica enterica serovar Typhi
ugacucugccuc

SEQ ID NO: 3672529 - RNA, 22 nt, Salmonella enterica enterica serovar Typhi
ugacucuuguuucucguauuau

SEQ ID NO: 3672530 - RNA, 23 nt, Salmonella enterica enterica serovar Typhi
ugacugaaauuacgccauaaaaa

SEQ ID NO: 3672531 - RNA, 15 nt, Salmonella enterica enterica serovar Typhi
ugacugaacucauca

SEQ ID NO: 3672532 - RNA, 17 nt, Salmonella enterica enterica serovar Typhi
ugacugaauuuucagcc

SEQ ID NO: 3672533 - RNA, 22 nt, Salmonella enterica enterica serovar Typhi
ugacugacacccaucgcgacau

SEQ ID NO: 3672534 - RNA, 22 nt, Salmonella enterica enterica serovar Typhi
ugacugagccacugcugaaagc

SEQ ID NO: 3672535 - RNA, 17 nt, Salmonella enterica enterica serovar Typhi
ugacugaucgauccacu

SEQ ID NO: 3672536 - RNA, 19 nt, Salmonella enterica enterica serovar Typhi
ugacugcaaaucugccguc

SEQ ID NO: 3672537 - RNA, 20 nt, Salmonella enterica enterica serovar Typhi
ugacugcgggggcaaaugcg

SEQ ID NO: 3672538 - RNA, 13 nt, Salmonella enterica enterica serovar Typhi
ugacugcugucau

SEQ ID NO: 3672539 - RNA, 19 nt, Salmonella enterica enterica serovar Typhi
ugacugguuuguugcgucu

SEQ ID NO: 3672540 - RNA, 19 nt, Salmonella enterica enterica serovar Typhi
ugacuguaauaauacuaac

SEQ ID NO: 3672541 - RNA, 14 nt, Salmonella enterica enterica serovar Typhi
ugacuuacaggcug

SEQ ID NO: 3672542 - RNA, 16 nt, Salmonella enterica enterica serovar Typhi
ugacuucacacugugg

SEQ ID NO: 3672543 - RNA, 17 nt, Salmonella enterica enterica serovar Typhi
ugacuuguuccagucca

SEQ ID NO: 3672544 - RNA, 12 nt, Salmonella enterica enterica serovar Typhi
ugacuuugcucu

SEQ ID NO: 3672545 - RNA, 12 nt, Salmonella enterica enterica serovar Typhi
ugacuuuuacgc

SEQ ID NO: 3672546 - RNA, 17 nt, Salmonella enterica enterica serovar Typhi
ugagaaaaccauauaaa

SEQ ID NO: 3672547 - RNA, 12 nt, Salmonella enterica enterica serovar Typhi
ugagaaaaggaa

SEQ ID NO: 3672548 - RNA, 15 nt, Salmonella enterica enterica serovar Typhi
ugagaaaaggaagaa

SEQ ID NO: 3672549 - RNA, 15 nt, Salmonella enterica enterica serovar Typhi
ugagaaaauuacgcc

SEQ ID NO: 3672550 - RNA, 23 nt, Salmonella enterica enterica serovar Typhi
ugagaaaauuacgcccaucagcc

SEQ ID NO: 3672551 - RNA, 14 nt, Salmonella enterica enterica serovar Typhi
ugagaagggcagau

SEQ ID NO: 3672552 - RNA, 20 nt, Salmonella enterica enterica serovar Typhi
ugagaaggucaguccaccug

SEQ ID NO: 3672553 - RNA, 15 nt, Salmonella enterica enterica serovar Typhi
ugagaauucugcgcg

SEQ ID NO: 3672554 - RNA, 18 nt, Salmonella enterica enterica serovar Typhi
ugagaauuuccaguucaa

SEQ ID NO: 3672555 - RNA, 19 nt, Salmonella enterica enterica serovar Typhi
ugagaauuuccaguucaau

SEQ ID NO: 3672556 - RNA, 17 nt, Salmonella enterica enterica serovar Typhi
ugagagacggagaaaaa

SEQ ID NO: 3672557 - RNA, 22 nt, Salmonella enterica enterica serovar Typhi
ugagagucgauacucacgacuu

SEQ ID NO: 3672558 - RNA, 17 nt, Salmonella enterica enterica serovar Typhi
ugagauaauaaaugccg

SEQ ID NO: 3672559 - RNA, 20 nt, Salmonella enterica enterica serovar Typhi
ugagauaauuuaugauuuua

SEQ ID NO: 3672560 - RNA, 21 nt, Salmonella enterica enterica serovar Typhi
ugagaugcaggccaagcagcg

SEQ ID NO: 3672561 - RNA, 18 nt, Salmonella enterica enterica serovar Typhi
ugagcacgcggaagaaau

SEQ ID NO: 3672562 - RNA, 19 nt, Salmonella enterica enterica serovar Typhi
ugagcagacauauuuucaa

SEQ ID NO: 3672563 - RNA, 16 nt, Salmonella enterica enterica serovar Typhi
ugagcagaucagcacg

SEQ ID NO: 3672564 - RNA, 20 nt, Salmonella enterica enterica serovar Typhi
ugagcagaucagcacgcgcc

SEQ ID NO: 3672565 - RNA, 14 nt, Salmonella enterica enterica serovar Typhi
ugagcauugcgcuc

SEQ ID NO: 3672566 - RNA, 15 nt, Salmonella enterica enterica serovar Typhi
ugagcauugcgcuca

SEQ ID NO: 3672567 - RNA, 19 nt, Salmonella enterica enterica serovar Typhi
ugagccacgguaguuucaa

SEQ ID NO: 3672568 - RNA, 14 nt, Salmonella enterica enterica serovar Typhi
ugagcccuccucca

SEQ ID NO: 3672569 - RNA, 19 nt, Salmonella enterica enterica serovar Typhi
ugagccgaaauccaccagc

SEQ ID NO: 3672570 - RNA, 20 nt, Salmonella enterica enterica serovar Typhi
ugagccgaaauccaccagcg

SEQ ID NO: 3672571 - RNA, 21 nt, Salmonella enterica enterica serovar Typhi
ugagccuaaaacauuaaucgc

SEQ ID NO: 3672572 - RNA, 22 nt, Salmonella enterica enterica serovar Typhi
ugagccuaaaacauuaaucgcc

SEQ ID NO: 3672573 - RNA, 21 nt, Salmonella enterica enterica serovar Typhi
ugagcgaauccccgggaacau

SEQ ID NO: 3672574 - RNA, 16 nt, Salmonella enterica enterica serovar Typhi
ugagcgagaauuuuau

SEQ ID NO: 3672575 - RNA, 13 nt, Salmonella enterica enterica serovar Typhi
ugagcgcaaugcu

SEQ ID NO: 3672576 - RNA, 18 nt, Salmonella enterica enterica serovar Typhi
ugagcgcagugaccagca

SEQ ID NO: 3672577 - RNA, 23 nt, Salmonella enterica enterica serovar Typhi
ugagcgcgaggcauaccgcccag

SEQ ID NO: 3672578 - RNA, 20 nt, Salmonella enterica enterica serovar Typhi
ugagcgcuugauccagcucg

SEQ ID NO: 3672579 - RNA, 18 nt, Salmonella enterica enterica serovar Typhi
ugagcgcuugcugcguaa

SEQ ID NO: 3672580 - RNA, 16 nt, Salmonella enterica enterica serovar Typhi
ugagcggauucgacug

SEQ ID NO: 3672581 - RNA, 18 nt, Salmonella enterica enterica serovar Typhi
ugagcguagaccgcccag

SEQ ID NO: 3672582 - RNA, 18 nt, Salmonella enterica enterica serovar Typhi
aaaaaaacaucgcugaua

SEQ ID NO: 3672583 - RNA, 13 nt, Salmonella enterica enterica serovar Typhi
aaaaaaacgcauu

SEQ ID NO: 3672584 - RNA, 13 nt, Salmonella enterica enterica serovar Typhi
aaaaaaacgccgc

SEQ ID NO: 3672585 - RNA, 13 nt, Salmonella enterica enterica serovar Typhi
aaaaaacaccugu

SEQ ID NO: 3672586 - RNA, 15 nt, Salmonella enterica enterica serovar Typhi
aaaaaacauauaauu

SEQ ID NO: 3672587 - RNA, 12 nt, Salmonella enterica enterica serovar Typhi
aaaaaacaucau

SEQ ID NO: 3672588 - RNA, 13 nt, Salmonella enterica enterica serovar Typhi
aaaaaacaucaug

SEQ ID NO: 3672589 - RNA, 11 nt, Salmonella enterica enterica serovar Typhi
aaaaaaccaga

SEQ ID NO: 3672590 - RNA, 19 nt, Salmonella enterica enterica serovar Typhi
aaaaaaccggcaacucgcc

SEQ ID NO: 3672591 - RNA, 13 nt, Salmonella enterica enterica serovar Typhi
aaaaaagagaagc

SEQ ID NO: 3672592 - RNA, 11 nt, Salmonella enterica enterica serovar Typhi
aaaaaagaggg

SEQ ID NO: 3672593 - RNA, 20 nt, Salmonella enterica enterica serovar Typhi
aaaaaagccguauuuuauuu

SEQ ID NO: 3672594 - RNA, 22 nt, Salmonella enterica enterica serovar Typhi
aaaaaagcugcgaucaaguuuu

SEQ ID NO: 3672595 - RNA, 17 nt, Salmonella enterica enterica serovar Typhi
aaaaaagugauccccca

SEQ ID NO: 3672596 - RNA, 18 nt, Salmonella enterica enterica serovar Typhi
aaaaaaguuauuuuuucu

SEQ ID NO: 3672597 - RNA, 16 nt, Salmonella enterica enterica serovar Typhi
aaaaaaugagaacacc

SEQ ID NO: 3672598 - RNA, 12 nt, Salmonella enterica enterica serovar Typhi
aaaaaauuacga

SEQ ID NO: 3672599 - RNA, 11 nt, Salmonella enterica enterica serovar Typhi
aaaaacaaggg

SEQ ID NO: 3672600 - RNA, 21 nt, Salmonella enterica enterica serovar Typhi
aaaaacaggcgcaggcauuaa

SEQ ID NO: 3672601 - RNA, 16 nt, Salmonella enterica enterica serovar Typhi
aaaaacaucgcugaua

SEQ ID NO: 3672602 - RNA, 15 nt, Salmonella enterica enterica serovar Typhi
aaaaaccagaauuuc

SEQ ID NO: 3672603 - RNA, 14 nt, Salmonella enterica enterica serovar Typhi
aaaaaccgggaaau

SEQ ID NO: 3672604 - RNA, 16 nt, Salmonella enterica enterica serovar Typhi
aaaaaccuccggcuau

SEQ ID NO: 3672605 - RNA, 21 nt, Salmonella enterica enterica serovar Typhi
aaaaaccucuaccuacacauu

SEQ ID NO: 3672606 - RNA, 13 nt, Salmonella enterica enterica serovar Typhi
aaaaaccugcucu

SEQ ID NO: 3672607 - RNA, 16 nt, Salmonella enterica enterica serovar Typhi
aaaaacucaaagcguu

SEQ ID NO: 3672608 - RNA, 18 nt, Salmonella enterica enterica serovar Typhi
aaaaacucaggaaaucgu

SEQ ID NO: 3672609 - RNA, 22 nt, Salmonella enterica enterica serovar Typhi
aaaaacuuauuucuaucgcuau

SEQ ID NO: 3672610 - RNA, 11 nt, Salmonella enterica enterica serovar Typhi
aaaaagagaag

SEQ ID NO: 3672611 - RNA, 15 nt, Salmonella enterica enterica serovar Typhi
aaaaagauaaccauu

SEQ ID NO: 3672612 - RNA, 15 nt, Salmonella enterica enterica serovar Typhi
aaaaagcaaagaggu

SEQ ID NO: 3672613 - RNA, 18 nt, Salmonella enterica enterica serovar Typhi
aaaaagccaaaaggcgcc

SEQ ID NO: 3672614 - RNA, 19 nt, Salmonella enterica enterica serovar Typhi
aaaaagccaagcacaaaaa

SEQ ID NO: 3672615 - RNA, 19 nt, Salmonella enterica enterica serovar Typhi
aaaaagccacgcaagcagc

SEQ ID NO: 3672616 - RNA, 20 nt, Salmonella enterica enterica serovar Typhi
aaaaagccacgcaagcagca

SEQ ID NO: 3672617 - RNA, 21 nt, Salmonella enterica enterica serovar Typhi
aaaaagccacgcaagcagcac

SEQ ID NO: 3672618 - RNA, 20 nt, Salmonella enterica enterica serovar Typhi
aaaaagccggcggaaaaaag

SEQ ID NO: 3672619 - RNA, 21 nt, Salmonella enterica enterica serovar Typhi
aaaaagccggcggaaaaaagc

SEQ ID NO: 3672620 - RNA, 24 nt, Salmonella enterica enterica serovar Typhi
aaaaagccugcacauugcaggcuu

SEQ ID NO: 3672621 - RNA, 23 nt, Salmonella enterica enterica serovar Typhi
aaaaagcuccggacgcaccagcc

SEQ ID NO: 3672622 - RNA, 21 nt, Salmonella enterica enterica serovar Typhi
aaaaaggccgcuuaauaauaa

SEQ ID NO: 3672623 - RNA, 22 nt, Salmonella enterica enterica serovar Typhi
aaaaaggguaacgggacacugc

SEQ ID NO: 3672624 - RNA, 11 nt, Salmonella enterica enterica serovar Typhi
aaaaauaaaaa

SEQ ID NO: 3672625 - RNA, 17 nt, Salmonella enterica enterica serovar Typhi
aaaaauacugauaaaaa

SEQ ID NO: 3672626 - RNA, 20 nt, Salmonella enterica enterica serovar Typhi
aaaaauacugauaaaaaaca

SEQ ID NO: 3672627 - RNA, 13 nt, Salmonella enterica enterica serovar Typhi
aaaaauauaaaaa

SEQ ID NO: 3672628 - RNA, 13 nt, Salmonella enterica enterica serovar Typhi
aaaaauauagcca

SEQ ID NO: 3672629 - RNA, 13 nt, Salmonella enterica enterica serovar Typhi
aaaaaucagcaau

SEQ ID NO: 3672630 - RNA, 23 nt, Salmonella enterica enterica serovar Typhi
aaaaaucagcccggacaucaucc

SEQ ID NO: 3672631 - RNA, 16 nt, Salmonella enterica enterica serovar Typhi
aaaaaucagucacaag

SEQ ID NO: 3672632 - RNA, 20 nt, Salmonella enterica enterica serovar Typhi
aaaaaucagucacaaguaag

SEQ ID NO: 3672633 - RNA, 12 nt, Salmonella enterica enterica serovar Typhi
aaaaaucauuau

SEQ ID NO: 3672634 - RNA, 12 nt, Salmonella enterica enterica serovar Typhi
aaaaauccagua

SEQ ID NO: 3672635 - RNA, 15 nt, Salmonella enterica enterica serovar Typhi
aaaaauccccccucc

SEQ ID NO: 3672636 - RNA, 14 nt, Salmonella enterica enterica serovar Typhi
aaaaauccggauca

SEQ ID NO: 3672637 - RNA, 14 nt, Salmonella enterica enterica serovar Typhi
aaaaauuaaaaaua

SEQ ID NO: 3672638 - RNA, 16 nt, Salmonella enterica enterica serovar Typhi
aaaaauuaaaaauacc

SEQ ID NO: 3672639 - RNA, 19 nt, Salmonella enterica enterica serovar Typhi
aaaaauuucugccgacaag

SEQ ID NO: 3672640 - RNA, 12 nt, Salmonella enterica enterica serovar Typhi
aaaacaagcagu

SEQ ID NO: 3672641 - RNA, 20 nt, Salmonella enterica enterica serovar Typhi
aaaacaagugcagaagcaau

SEQ ID NO: 3672642 - RNA, 20 nt, Salmonella enterica enterica serovar Typhi
aaaacaccuaacccaccaua

SEQ ID NO: 3672643 - RNA, 17 nt, Salmonella enterica enterica serovar Typhi
aaaacacgucuggaaac

SEQ ID NO: 3672644 - RNA, 18 nt, Salmonella enterica enterica serovar Typhi
aaaacagcauaauaaagc

SEQ ID NO: 3672645 - RNA, 11 nt, Salmonella enterica enterica serovar Typhi
aaaacagccag

SEQ ID NO: 3672646 - RNA, 18 nt, Salmonella enterica enterica serovar Typhi
aaaacagccgccauggcg

SEQ ID NO: 3672647 - RNA, 20 nt, Salmonella enterica enterica serovar Typhi
aaaacaucgcugauauuguu

SEQ ID NO: 3672648 - RNA, 23 nt, Salmonella enterica enterica serovar Typhi
aaaacauggggaguaaagcagcu

SEQ ID NO: 3672649 - RNA, 17 nt, Salmonella enterica enterica serovar Typhi
aaaacauuccugacauu

SEQ ID NO: 3672650 - RNA, 15 nt, Salmonella enterica enterica serovar Typhi
aaaaccaccuacgcc

SEQ ID NO: 3672651 - RNA, 18 nt, Salmonella enterica enterica serovar Typhi
aaaaccagaauuuccaga

SEQ ID NO: 3672652 - RNA, 22 nt, Salmonella enterica enterica serovar Typhi
aaaaccagcaucaaccaccaaa

SEQ ID NO: 3672653 - RNA, 12 nt, Salmonella enterica enterica serovar Typhi
aaaaccagcgcc

SEQ ID NO: 3672654 - RNA, 14 nt, Salmonella enterica enterica serovar Typhi
aaaaccagcgccgc

SEQ ID NO: 3672655 - RNA, 21 nt, Salmonella enterica enterica serovar Typhi
aaaaccagcgcggauaaaaaa

SEQ ID NO: 3672656 - RNA, 12 nt, Salmonella enterica enterica serovar Typhi
aaaaccauauaa

SEQ ID NO: 3672657 - RNA, 12 nt, Salmonella enterica enterica serovar Typhi
aaaccaguucac

SEQ ID NO: 3672658 - RNA, 17 nt, Salmonella enterica enterica serovar Typhi
aaaccaguugccagggu

SEQ ID NO: 3672659 - RNA, 18 nt, Salmonella enterica enterica serovar Typhi
aaaccauaaacaaaacaa

SEQ ID NO: 3672660 - RNA, 16 nt, Salmonella enterica enterica serovar Typhi
aaaccaucuugcguua

SEQ ID NO: 3672661 - RNA, 15 nt, Salmonella enterica enterica serovar Typhi
aaaccaugaucguca

SEQ ID NO: 3672662 - RNA, 21 nt, Salmonella enterica enterica serovar Typhi
aaaccauucaaauucaauaaa

SEQ ID NO: 3672663 - RNA, 22 nt, Salmonella enterica enterica serovar Typhi
aaacccacccgguaauaccgau

SEQ ID NO: 3672664 - RNA, 16 nt, Salmonella enterica enterica serovar Typhi
aaacccauauuccugc

SEQ ID NO: 3672665 - RNA, 18 nt, Salmonella enterica enterica serovar Typhi
aaaccccagauuacugcc

SEQ ID NO: 3672666 - RNA, 18 nt, Salmonella enterica enterica serovar Typhi
aaacccgcagccggauag

SEQ ID NO: 3672667 - RNA, 13 nt, Salmonella enterica enterica serovar Typhi
aaacccgccaccg

SEQ ID NO: 3672668 - RNA, 17 nt, Salmonella enterica enterica serovar Typhi
aaaccgauaaucaccag

SEQ ID NO: 3672669 - RNA, 15 nt, Salmonella enterica enterica serovar Typhi
aaaccgcagaaaaag

SEQ ID NO: 3672670 - RNA, 19 nt, Salmonella enterica enterica serovar Typhi
aaaccgccgcuuugauuug

SEQ ID NO: 3672671 - RNA, 17 nt, Salmonella enterica enterica serovar Typhi
aaaccgccucaauugcc

SEQ ID NO: 3672672 - RNA, 17 nt, Salmonella enterica enterica serovar Typhi
aaaccggaauuuguugg

SEQ ID NO: 3672673 - RNA, 20 nt, Salmonella enterica enterica serovar Typhi
aaaccgguaaugauaccaau

SEQ ID NO: 3672674 - RNA, 16 nt, Salmonella enterica enterica serovar Typhi
aaaccgucauuuacca

SEQ ID NO: 3672675 - RNA, 21 nt, Salmonella enterica enterica serovar Typhi
aaaccgucauuuaccagugcu

SEQ ID NO: 3672676 - RNA, 17 nt, Salmonella enterica enterica serovar Typhi
aaaccguccacauccag

SEQ ID NO: 3672677 - RNA, 19 nt, Salmonella enterica enterica serovar Typhi
aaaccugguauuacaacgu

SEQ ID NO: 3672678 - RNA, 15 nt, Salmonella enterica enterica serovar Typhi
aaaccuguuuguuua

SEQ ID NO: 3672679 - RNA, 17 nt, Salmonella enterica enterica serovar Typhi
aaaccuuccgccaggcg

SEQ ID NO: 3672680 - RNA, 15 nt, Salmonella enterica enterica serovar Typhi
aaaccuuucuucucu

SEQ ID NO: 3672681 - RNA, 21 nt, Salmonella enterica enterica serovar Typhi
aaacgaaucaccucgcuuccc

SEQ ID NO: 3672682 - RNA, 15 nt, Salmonella enterica enterica serovar Typhi
aaacgaauuuaaaua

SEQ ID NO: 3672683 - RNA, 14 nt, Salmonella enterica enterica serovar Typhi
aaacgacauaaccg

SEQ ID NO: 3672684 - RNA, 21 nt, Salmonella enterica enterica serovar Typhi
aaacgaccaggaucagaccga

SEQ ID NO: 3672685 - RNA, 15 nt, Salmonella enterica enterica serovar Typhi
aaacgacucaucagu

SEQ ID NO: 3672686 - RNA, 21 nt, Salmonella enterica enterica serovar Typhi
aaacgagucagcguuacuggc

SEQ ID NO: 3672687 - RNA, 20 nt, Salmonella enterica enterica serovar Typhi
aaacgaugaccauaaaugaa

SEQ ID NO: 3672688 - RNA, 22 nt, Salmonella enterica enterica serovar Typhi
aaacgcauaggggcgcaaagca

SEQ ID NO: 3672689 - RNA, 21 nt, Salmonella enterica enterica serovar Typhi
aaacgcaucugggcugagaaa

SEQ ID NO: 3672690 - RNA, 18 nt, Salmonella enterica enterica serovar Typhi
aaacgccaggcgcugcgu

SEQ ID NO: 3672691 - RNA, 17 nt, Salmonella enterica enterica serovar Typhi
aaacgcccccagauaga

SEQ ID NO: 3672692 - RNA, 19 nt, Salmonella enterica enterica serovar Typhi
aaacgcccccagauagaac

SEQ ID NO: 3672693 - RNA, 22 nt, Salmonella enterica enterica serovar Typhi
aaacgcccgccgcgaccagcag

SEQ ID NO: 3672694 - RNA, 15 nt, Salmonella enterica enterica serovar Typhi
aaacgccgaagccag

SEQ ID NO: 3672695 - RNA, 22 nt, Salmonella enterica enterica serovar Typhi
aaacgccgauggcgccagauac

SEQ ID NO: 3672696 - RNA, 14 nt, Salmonella enterica enterica serovar Typhi
aaacgccucauccg

SEQ ID NO: 3672697 - RNA, 17 nt, Salmonella enterica enterica serovar Typhi
aaacgccugaauaaucg

SEQ ID NO: 3672698 - RNA, 23 nt, Salmonella enterica enterica serovar Typhi
aaacgccugcccgguuaaggggc

SEQ ID NO: 3672699 - RNA, 12 nt, Salmonella enterica enterica serovar Typhi
aaacgccuguaa

SEQ ID NO: 3672700 - RNA, 14 nt, Salmonella enterica enterica serovar Typhi
aaacgcgcaaaacu

SEQ ID NO: 3672701 - RNA, 17 nt, Salmonella enterica enterica serovar Typhi
aaacgcggacauauuuu

SEQ ID NO: 3672702 - RNA, 17 nt, Salmonella enterica enterica serovar Typhi
aaacgcuccggcaggca

SEQ ID NO: 3672703 - RNA, 13 nt, Salmonella enterica enterica serovar Typhi
aaacgcugcgcaa

SEQ ID NO: 3672704 - RNA, 12 nt, Salmonella enterica enterica serovar Typhi
aaacgcuuuuuu

SEQ ID NO: 3672705 - RNA, 15 nt, Salmonella enterica enterica serovar Typhi
aaacggaucuuccac

SEQ ID NO: 3672706 - RNA, 23 nt, Salmonella enterica enterica serovar Typhi
aaacggcagccgccaccacaaag

SEQ ID NO: 3672707 - RNA, 14 nt, Salmonella enterica enterica serovar Typhi
aaacggcccggcgu

SEQ ID NO: 3672708 - RNA, 17 nt, Salmonella enterica enterica serovar Typhi
aaacggccugcgcugga

SEQ ID NO: 3672709 - RNA, 18 nt, Salmonella enterica enterica serovar Typhi
aaacgggugagacauguu

SEQ ID NO: 3672710 - RNA, 21 nt, Salmonella enterica enterica serovar Typhi
aaacguagcgucaucaggcgu

SEQ ID NO: 3672711 - RNA, 13 nt, Salmonella enterica enterica serovar Typhi
aaacgucaugcug

SEQ ID NO: 3672712 - RNA, 14 nt, Salmonella enterica enterica serovar Typhi
aaacgucgaacaua

SEQ ID NO: 3672713 - RNA, 16 nt, Salmonella enterica enterica serovar Typhi
aaacgucguaaaaccu

SEQ ID NO: 3672714 - RNA, 21 nt, Salmonella enterica enterica serovar Typhi
aaacgugcggcggccucuuug

SEQ ID NO: 3672715 - RNA, 16 nt, Salmonella enterica enterica serovar Typhi
aaacguucauccgacc

SEQ ID NO: 3672716 - RNA, 17 nt, Salmonella enterica enterica serovar Typhi
aaacguucggugaagaa

SEQ ID NO: 3672717 - RNA, 22 nt, Salmonella enterica enterica serovar Typhi
aaacguucggugaagaaaaaga

SEQ ID NO: 3672718 - RNA, 22 nt, Salmonella enterica enterica serovar Typhi
aaacguugcuggacauauucca

SEQ ID NO: 3672719 - RNA, 19 nt, Salmonella enterica enterica serovar Typhi
aaacuaauggcgcagcggu

SEQ ID NO: 3672720 - RNA, 23 nt, Salmonella enterica enterica serovar Typhi
aaacuauuucaacccggcauuuc

SEQ ID NO: 3672721 - RNA, 13 nt, Salmonella enterica enterica serovar Typhi
aaacucaacuggg

SEQ ID NO: 3672722 - RNA, 15 nt, Salmonella enterica enterica serovar Typhi
aaacucacccaggcg

SEQ ID NO: 3672723 - RNA, 13 nt, Salmonella enterica enterica serovar Typhi
aaacucagcaaua

SEQ ID NO: 3672724 - RNA, 13 nt, Salmonella enterica enterica serovar Typhi
aaacucaucuuua

SEQ ID NO: 3672725 - RNA, 22 nt, Salmonella enterica enterica serovar Typhi
aaacuccauuaaauuacuuguu

SEQ ID NO: 3672726 - RNA, 22 nt, Salmonella enterica enterica serovar Typhi
aaacucccgcacgcuggcauca

SEQ ID NO: 3672727 - RNA, 22 nt, Salmonella enterica enterica serovar Typhi
aaacucuuccccgaucagaaaa

SEQ ID NO: 3672728 - RNA, 21 nt, Salmonella enterica enterica serovar Typhi
aaacucuuuuucaauaaacgg

SEQ ID NO: 3672729 - RNA, 14 nt, Salmonella enterica enterica serovar Typhi
aaacugauacugga

SEQ ID NO: 3672730 - RNA, 14 nt, Salmonella enterica enterica serovar Typhi
aaacugcugacaau

SEQ ID NO: 3672731 - RNA, 15 nt, Salmonella enterica enterica serovar Typhi
aaacugcugccgcag

SEQ ID NO: 3672732 - RNA, 16 nt, Salmonella enterica enterica serovar Typhi
aaacuggaaaacaagu

SEQ ID NO: 3672733 - RNA, 14 nt, Salmonella enterica enterica serovar Typhi
aaacuggaagaaga

SEQ ID NO: 3672734 - RNA, 22 nt, Salmonella enterica enterica serovar Typhi
aaacuggagcacgcggugccga

SEQ ID NO: 3672735 - RNA, 15 nt, Salmonella enterica enterica serovar Typhi
aaacuggcaaauaaa

SEQ ID NO: 3672736 - RNA, 23 nt, Salmonella enterica enterica serovar Typhi
aaacuggcacgccguuugccaua

SEQ ID NO: 3672737 - RNA, 15 nt, Salmonella enterica enterica serovar Typhi
aaacuggccacagca

SEQ ID NO: 3672738 - RNA, 16 nt, Salmonella enterica enterica serovar Typhi
aaacuggcgcuggcag

SEQ ID NO: 3672739 - RNA, 15 nt, Salmonella enterica enterica serovar Typhi
aaacuguucagcggu

SEQ ID NO: 3672740 - RNA, 17 nt, Salmonella enterica enterica serovar Typhi
aaacuuauacugauaaa

SEQ ID NO: 3672741 - RNA, 20 nt, Salmonella enterica enterica serovar Typhi
aaacuuauuucuaucgcuau

SEQ ID NO: 3672742 - RNA, 22 nt, Salmonella enterica enterica serovar Typhi
aaacuuccacacggcauucacg

SEQ ID NO: 3672743 - RNA, 16 nt, Salmonella enterica enterica serovar Typhi
aaagggaaaagccauu

SEQ ID NO: 3672744 - RNA, 18 nt, Salmonella enterica enterica serovar Typhi
aaaggggagcccaguagc

SEQ ID NO: 3672745 - RNA, 22 nt, Salmonella enterica enterica serovar Typhi
aaaggggccugcacaauaccaa

SEQ ID NO: 3672746 - RNA, 19 nt, Salmonella enterica enterica serovar Typhi
aaaggggggcuagcugugg

SEQ ID NO: 3672747 - RNA, 21 nt, Salmonella enterica enterica serovar Typhi
aaagguauuaagugaauagca

SEQ ID NO: 3672748 - RNA, 18 nt, Salmonella enterica enterica serovar Typhi
aaaggucaaacaccugaa

SEQ ID NO: 3672749 - RNA, 23 nt, Salmonella enterica enterica serovar Typhi
aaaguaccagcgcgaacauuaca

SEQ ID NO: 3672750 - RNA, 18 nt, Salmonella enterica enterica serovar Typhi
aaaguacuucacaaucag

SEQ ID NO: 3672751 - RNA, 22 nt, Salmonella enterica enterica serovar Typhi
aaaguacuucacaaucagcgca

SEQ ID NO: 3672752 - RNA, 17 nt, Salmonella enterica enterica serovar Typhi
aaaguauguuuugaaug

SEQ ID NO: 3672753 - RNA, 19 nt, Salmonella enterica enterica serovar Typhi
aaagucaacugcucuacca

SEQ ID NO: 3672754 - RNA, 20 nt, Salmonella enterica enterica serovar Typhi
aaagucacuuacuuucuugc

SEQ ID NO: 3672755 - RNA, 15 nt, Salmonella enterica enterica serovar Typhi
aaaguccugcgucgc

SEQ ID NO: 3672756 - RNA, 17 nt, Salmonella enterica enterica serovar Typhi
aaagucggccauuuuuu

SEQ ID NO: 3672757 - RNA, 22 nt, Salmonella enterica enterica serovar Typhi
aaagucggggcguaaaaauuuu

SEQ ID NO: 3672758 - RNA, 18 nt, Salmonella enterica enterica serovar Typhi
aaagugaaggccagacuu

SEQ ID NO: 3672759 - RNA, 19 nt, Salmonella enterica enterica serovar Typhi
aaagugaaggccagacuua

SEQ ID NO: 3672760 - RNA, 22 nt, Salmonella enterica enterica serovar Typhi
aaagugccagggcggaagcaga

SEQ ID NO: 3672761 - RNA, 23 nt, Salmonella enterica enterica serovar Typhi
aaagugccagggcggaagcagau

SEQ ID NO: 3672762 - RNA, 15 nt, Salmonella enterica enterica serovar Typhi
aaagugcugaacaau

SEQ ID NO: 3672763 - RNA, 19 nt, Salmonella enterica enterica serovar Typhi
aaaguggcauccgaagaac

SEQ ID NO: 3672764 - RNA, 18 nt, Salmonella enterica enterica serovar Typhi
aaaguguguaccagcagc

SEQ ID NO: 3672765 - RNA, 14 nt, Salmonella enterica enterica serovar Typhi
aaaguuaaucagcg

SEQ ID NO: 3672766 - RNA, 16 nt, Salmonella enterica enterica serovar Typhi
aaaguuacuuuccaua

SEQ ID NO: 3672767 - RNA, 19 nt, Salmonella enterica enterica serovar Typhi
aaaguuagccccuuaucaa

SEQ ID NO: 3672768 - RNA, 12 nt, Salmonella enterica enterica serovar Typhi
aaaguuauuaca

SEQ ID NO: 3672769 - RNA, 15 nt, Salmonella enterica enterica serovar Typhi
aaaguuucaggauaa

SEQ ID NO: 3672770 - RNA, 13 nt, Salmonella enterica enterica serovar Typhi
aaaguuuuucaua

SEQ ID NO: 3672771 - RNA, 13 nt, Salmonella enterica enterica serovar Typhi
aaauaaaaaaacc

SEQ ID NO: 3672772 - RNA, 23 nt, Salmonella enterica enterica serovar Typhi
aaauaaaaaccgccucaggcgca

SEQ ID NO: 3672773 - RNA, 14 nt, Salmonella enterica enterica serovar Typhi
aaauaaaaauuccc

SEQ ID NO: 3672774 - RNA, 22 nt, Salmonella enterica enterica serovar Typhi
aaauaaaauacgcucaauauac

SEQ ID NO: 3672775 - RNA, 12 nt, Salmonella enterica enterica serovar Typhi
aaauaaaauuau

SEQ ID NO: 3672776 - RNA, 13 nt, Salmonella enterica enterica serovar Typhi
aaauaaaauuaua

SEQ ID NO: 3672777 - RNA, 13 nt, Salmonella enterica enterica serovar Typhi
aaauaaacagcgc

SEQ ID NO: 3672778 - RNA, 21 nt, Salmonella enterica enterica serovar Typhi
aaauaaacgcuugacucugaa

SEQ ID NO: 3672779 - RNA, 17 nt, Salmonella enterica enterica serovar Typhi
aaauaaagguucauauu

SEQ ID NO: 3672780 - RNA, 19 nt, Salmonella enterica enterica serovar Typhi
aaauaaagugcugaacaau

SEQ ID NO: 3672781 - RNA, 18 nt, Salmonella enterica enterica serovar Typhi
aaauaaaguguuaucaug

SEQ ID NO: 3672782 - RNA, 11 nt, Salmonella enterica enterica serovar Typhi
aaauaaauaaa

SEQ ID NO: 3672783 - RNA, 22 nt, Salmonella enterica enterica serovar Typhi
aaauaaauaguaaauagaaaau

SEQ ID NO: 3672784 - RNA, 18 nt, Salmonella enterica enterica serovar Typhi
aaauaaauauguuauuua

SEQ ID NO: 3672785 - RNA, 21 nt, Salmonella enterica enterica serovar Typhi
aaauaaauauguuauuuacaa

SEQ ID NO: 3672786 - RNA, 18 nt, Salmonella enterica enterica serovar Typhi
aaauaaaugauauuuaaa

SEQ ID NO: 3672787 - RNA, 13 nt, Salmonella enterica enterica serovar Typhi
aaauaacagacga

SEQ ID NO: 3672788 - RNA, 17 nt, Salmonella enterica enterica serovar Typhi
aaauaacccgccuggcg

SEQ ID NO: 3672789 - RNA, 19 nt, Salmonella enterica enterica serovar Typhi
aaauaacgcgauaaucccc

SEQ ID NO: 3672790 - RNA, 18 nt, Salmonella enterica enterica serovar Typhi
aaauaacucuggaucagu

SEQ ID NO: 3672791 - RNA, 21 nt, Salmonella enterica enterica serovar Typhi
aaauaacucuggaucaguucc

SEQ ID NO: 3672792 - RNA, 16 nt, Salmonella enterica enterica serovar Typhi
aaauaacuuuuaauuu

SEQ ID NO: 3672793 - RNA, 18 nt, Salmonella enterica enterica serovar Typhi
aaauaacuuuuaauuuuu

SEQ ID NO: 3672794 - RNA, 19 nt, Salmonella enterica enterica serovar Typhi
aaauaacuuuuaauuuuua

SEQ ID NO: 3672795 - RNA, 20 nt, Salmonella enterica enterica serovar Typhi
aaauaacuuuuaauuuuuau

SEQ ID NO: 3672796 - RNA, 12 nt, Salmonella enterica enterica serovar Typhi
aaauaagaguca

SEQ ID NO: 3672797 - RNA, 19 nt, Salmonella enterica enterica serovar Typhi
aaauaagccguacagccua

SEQ ID NO: 3672798 - RNA, 15 nt, Salmonella enterica enterica serovar Typhi
aaauaaggcugcgcg

SEQ ID NO: 3672799 - RNA, 21 nt, Salmonella enterica enterica serovar Typhi
aaauaaggcugcgcguuuuca

SEQ ID NO: 3672800 - RNA, 19 nt, Salmonella enterica enterica serovar Typhi
aaauaauaaucguuuuaug

SEQ ID NO: 3672801 - RNA, 12 nt, Salmonella enterica enterica serovar Typhi
aaauaauaccac

SEQ ID NO: 3672802 - RNA, 22 nt, Salmonella enterica enterica serovar Typhi
aaauaauagguacggggcaucu

SEQ ID NO: 3672803 - RNA, 13 nt, Salmonella enterica enterica serovar Typhi
aaauaauugauaa

SEQ ID NO: 3672804 - RNA, 14 nt, Salmonella enterica enterica serovar Typhi
aaauaauuguguaa

SEQ ID NO: 3672805 - RNA, 17 nt, Salmonella enterica enterica serovar Typhi
aaauaauuuuguuaaag

SEQ ID NO: 3672806 - RNA, 12 nt, Salmonella enterica enterica serovar Typhi
aaauaauuuuua

SEQ ID NO: 3672807 - RNA, 22 nt, Salmonella enterica enterica serovar Typhi
aaauacaccaaacgaauuuaaa

SEQ ID NO: 3672808 - RNA, 13 nt, Salmonella enterica enterica serovar Typhi
aaauacaucgcca

SEQ ID NO: 3672809 - RNA, 12 nt, Salmonella enterica enterica serovar Typhi
aaauaccacauc

SEQ ID NO: 3672810 - RNA, 16 nt, Salmonella enterica enterica serovar Typhi
aaauaccagcaccuga

SEQ ID NO: 3672811 - RNA, 15 nt, Salmonella enterica enterica serovar Typhi
aaauacccucaguuc

SEQ ID NO: 3672812 - RNA, 13 nt, Salmonella enterica enterica serovar Typhi
aaauaccgcacau

SEQ ID NO: 3672813 - RNA, 15 nt, Salmonella enterica enterica serovar Typhi
aaauacgccagauaa

SEQ ID NO: 3672814 - RNA, 15 nt, Salmonella enterica enterica serovar Typhi
aaauacgcugcggcc

SEQ ID NO: 3672815 - RNA, 17 nt, Salmonella enterica enterica serovar Typhi
aaauacggaccuggcgu

SEQ ID NO: 3672816 - RNA, 22 nt, Salmonella enterica enterica serovar Typhi
aaauacggcuuccacugcggca

SEQ ID NO: 3672817 - RNA, 22 nt, Salmonella enterica enterica serovar Typhi
aaauagaacagcuggugcggca

SEQ ID NO: 3672818 - RNA, 21 nt, Salmonella enterica enterica serovar Typhi
aaauagacgagcgaaaaacug

SEQ ID NO: 3672819 - RNA, 13 nt, Salmonella enterica enterica serovar Typhi
aaauagagaaaau

SEQ ID NO: 3672820 - RNA, 14 nt, Salmonella enterica enterica serovar Typhi
aaauagagaaaaua

SEQ ID NO: 3672821 - RNA, 18 nt, Salmonella enterica enterica serovar Typhi
aaauagcaagagaugagc

SEQ ID NO: 3672822 - RNA, 22 nt, Salmonella enterica enterica serovar Typhi
aaauagccccggucaacgcgcc

SEQ ID NO: 3672823 - RNA, 20 nt, Salmonella enterica enterica serovar Typhi
aaauagccgaaacuuauacu

SEQ ID NO: 3672824 - RNA, 14 nt, Salmonella enterica enterica serovar Typhi
aaauagcguccagc

SEQ ID NO: 3672825 - RNA, 14 nt, Salmonella enterica enterica serovar Typhi
aaauagcuggcugu

SEQ ID NO: 3672826 - RNA, 14 nt, Salmonella enterica enterica serovar Typhi
aaauaggagaugca

SEQ ID NO: 3672827 - RNA, 19 nt, Salmonella enterica enterica serovar Typhi
aaauagucaguuaacgcgu

SEQ ID NO: 3672828 - RNA, 22 nt, Salmonella enterica enterica serovar Typhi
aaauaguucaucgugaaauuau

SEQ ID NO: 3672829 - RNA, 13 nt, Salmonella enterica enterica serovar Typhi
aaaugaucacuuc

SEQ ID NO: 3672830 - RNA, 16 nt, Salmonella enterica enterica serovar Typhi
aaaugaucagacgcau

SEQ ID NO: 3672831 - RNA, 19 nt, Salmonella enterica enterica serovar Typhi
aaaugaugacucauuaaaa

SEQ ID NO: 3672832 - RNA, 13 nt, Salmonella enterica enterica serovar Typhi
aaaugauguguuu

SEQ ID NO: 3672833 - RNA, 17 nt, Salmonella enterica enterica serovar Typhi
aaaugauguguuucagc

SEQ ID NO: 3672834 - RNA, 21 nt, Salmonella enterica enterica serovar Typhi
aaaugcacugcaauuucugcu

SEQ ID NO: 3672835 - RNA, 20 nt, Salmonella enterica enterica serovar Typhi
aaaugcccauaaagaaauau

SEQ ID NO: 3672836 - RNA, 16 nt, Salmonella enterica enterica serovar Typhi
aaaugcccgucucauu

SEQ ID NO: 3672837 - RNA, 22 nt, Salmonella enterica enterica serovar Typhi
aaaugccugccguuuuuaacgc

SEQ ID NO: 3672838 - RNA, 16 nt, Salmonella enterica enterica serovar Typhi
aaaugcgaugaacauc

SEQ ID NO: 3672839 - RNA, 16 nt, Salmonella enterica enterica serovar Typhi
aaaugcgcaaagcaua

SEQ ID NO: 3672840 - RNA, 16 nt, Salmonella enterica enterica serovar Typhi
aaaugcgcuuugauag

SEQ ID NO: 3672841 - RNA, 17 nt, Salmonella enterica enterica serovar Typhi
aaaugcggguccugauc

SEQ ID NO: 3672842 - RNA, 19 nt, Salmonella enterica enterica serovar Typhi
aaaugcgucggcaccauuc

SEQ ID NO: 3672843 - RNA, 19 nt, Salmonella enterica enterica serovar Typhi
aaaugcguggcauuaacaa

SEQ ID NO: 3672844 - RNA, 20 nt, Salmonella enterica enterica serovar Typhi
aaaugcguggcauuaacaaa

SEQ ID NO: 3672845 - RNA, 22 nt, Salmonella enterica enterica serovar Typhi
aaaugcucaauuauacgcuggu

SEQ ID NO: 3672846 - RNA, 15 nt, Salmonella enterica enterica serovar Typhi
aaaugcuuaucugau

SEQ ID NO: 3672847 - RNA, 22 nt, Salmonella enterica enterica serovar Typhi
aaaugcuuccgaccgcagcaga

SEQ ID NO: 3672848 - RNA, 18 nt, Salmonella enterica enterica serovar Typhi
aaaugcuugcuuuagcuu

SEQ ID NO: 3672849 - RNA, 22 nt, Salmonella enterica enterica serovar Typhi
aaauggaaaauaauaaucguuu

SEQ ID NO: 3672850 - RNA, 21 nt, Salmonella enterica enterica serovar Typhi
aaauggcaaguaaaauagccc

SEQ ID NO: 3672851 - RNA, 12 nt, Salmonella enterica enterica serovar Typhi
aaauggcgcugu

SEQ ID NO: 3672852 - RNA, 15 nt, Salmonella enterica enterica serovar Typhi
aaauggguaucuuca

SEQ ID NO: 3672853 - RNA, 23 nt, Salmonella enterica enterica serovar Typhi
aaauggucagccauaaccuccuu

SEQ ID NO: 3672854 - RNA, 19 nt, Salmonella enterica enterica serovar Typhi
aaauggucccugauauaca

SEQ ID NO: 3672855 - RNA, 16 nt, Salmonella enterica enterica serovar Typhi
aaaugguuuugcccau

SEQ ID NO: 3672856 - RNA, 17 nt, Salmonella enterica enterica serovar Typhi
aaauguaggccggauaa

SEQ ID NO: 3672857 - RNA, 17 nt, Salmonella enterica enterica serovar Typhi
aaauguauacuccccuu

SEQ ID NO: 3672858 - RNA, 18 nt, Salmonella enterica enterica serovar Typhi
aaaugucccgauauuggu

SEQ ID NO: 3672859 - RNA, 19 nt, Salmonella enterica enterica serovar Typhi
aaauguuguuugaaaagug

SEQ ID NO: 3672860 - RNA, 9 nt, Salmonella enterica enterica serovar Typhi
aaauguuuu

SEQ ID NO: 3672861 - RNA, 12 nt, Salmonella enterica enterica serovar Typhi
aaauguuuuugu

SEQ ID NO: 3672862 - RNA, 13 nt, Salmonella enterica enterica serovar Typhi
aaauguuuuuguu

SEQ ID NO: 3672863 - RNA, 13 nt, Salmonella enterica enterica serovar Typhi
aaauuaaaaauac

SEQ ID NO: 3672864 - RNA, 19 nt, Salmonella enterica enterica serovar Typhi
aaauuaaauaacaaaugaa

SEQ ID NO: 3672865 - RNA, 12 nt, Salmonella enterica enterica serovar Typhi
aaauuaaucagg

SEQ ID NO: 3672866 - RNA, 13 nt, Salmonella enterica enterica serovar Typhi
aaauuaaucgcca

SEQ ID NO: 3672867 - RNA, 18 nt, Salmonella enterica enterica serovar Typhi
aaauuaaucgccagcagc

SEQ ID NO: 3672868 - RNA, 15 nt, Salmonella enterica enterica serovar Typhi
aaauuaaugauuaaa

SEQ ID NO: 3672869 - RNA, 18 nt, Salmonella enterica enterica serovar Typhi
aaauuaaugauuaaaaua

SEQ ID NO: 3672870 - RNA, 19 nt, Salmonella enterica enterica serovar Typhi
aaauuaaugauuaaaauaa

SEQ ID NO: 3672871 - RNA, 11 nt, Salmonella enterica enterica serovar Typhi
aaauuaccgcc

SEQ ID NO: 3672872 - RNA, 18 nt, Salmonella enterica enterica serovar Typhi
aaauuacgccauaaaaag

SEQ ID NO: 3672873 - RNA, 17 nt, Salmonella enterica enterica serovar Typhi
aaauuacuuaugauaua

SEQ ID NO: 3672874 - RNA, 18 nt, Salmonella enterica enterica serovar Typhi
aaauuagccaguucgccu

SEQ ID NO: 3672875 - RNA, 20 nt, Salmonella enterica enterica serovar Typhi
aaauuaucuguugauaaaac

SEQ ID NO: 3672876 - RNA, 23 nt, Salmonella enterica enterica serovar Typhi
aaauuauugugagaaaagcagag

SEQ ID NO: 3672877 - RNA, 14 nt, Salmonella enterica enterica serovar Typhi
aaauuauuuuaaau

SEQ ID NO: 3672878 - RNA, 15 nt, Salmonella enterica enterica serovar Typhi
aaauuauuuuaaauu

SEQ ID NO: 3672879 - RNA, 21 nt, Salmonella enterica enterica serovar Typhi
aaauuauuuuuacuuaaaauu

SEQ ID NO: 3672880 - RNA, 18 nt, Salmonella enterica enterica serovar Typhi
aaauucaaaaaagcagua

SEQ ID NO: 3672881 - RNA, 23 nt, Salmonella enterica enterica serovar Typhi
aaauucaagccauacgccgcggu

SEQ ID NO: 3672882 - RNA, 21 nt, Salmonella enterica enterica serovar Typhi
aaauucacccguuauucauuc

SEQ ID NO: 3672883 - RNA, 21 nt, Salmonella enterica enterica serovar Typhi
aaauucacuuccgucauguag

SEQ ID NO: 3672884 - RNA, 14 nt, Salmonella enterica enterica serovar Typhi
aaauucaggguugu

SEQ ID NO: 3672885 - RNA, 16 nt, Salmonella enterica enterica serovar Typhi
aaauuccaauauuuau

SEQ ID NO: 3672886 - RNA, 16 nt, Salmonella enterica enterica serovar Typhi
aaauuccuggauuaaa

SEQ ID NO: 3672887 - RNA, 17 nt, Salmonella enterica enterica serovar Typhi
aaauuccuuguuuuaac

SEQ ID NO: 3672888 - RNA, 21 nt, Salmonella enterica enterica serovar Typhi
aaauucggcguuacccgucug

SEQ ID NO: 3672889 - RNA, 20 nt, Salmonella enterica enterica serovar Typhi
aaauucuuuacgcagcaaga

SEQ ID NO: 3672890 - RNA, 22 nt, Salmonella enterica enterica serovar Typhi
aaauugaauuaagcaauccauu

SEQ ID NO: 3672891 - RNA, 14 nt, Salmonella enterica enterica serovar Typhi
aaauugagaauuau

SEQ ID NO: 3672892 - RNA, 15 nt, Salmonella enterica enterica serovar Typhi
aaauugaucacaaaa

SEQ ID NO: 3672893 - RNA, 20 nt, Salmonella enterica enterica serovar Typhi
aaauugccgcgcccugcgga

SEQ ID NO: 3672894 - RNA, 21 nt, Salmonella enterica enterica serovar Typhi
aaauugccgcgcccugcggaa

SEQ ID NO: 3672895 - RNA, 18 nt, Salmonella enterica enterica serovar Typhi
aaauugccugauggcgcu

SEQ ID NO: 3672896 - RNA, 13 nt, Salmonella enterica enterica serovar Typhi
aaauugcugaugu

SEQ ID NO: 3672897 - RNA, 22 nt, Salmonella enterica enterica serovar Typhi
aaauuggguaguaauauuaaaa

SEQ ID NO: 3672898 - RNA, 15 nt, Salmonella enterica enterica serovar Typhi
aaauuggugauauaa

SEQ ID NO: 3672899 - RNA, 19 nt, Salmonella enterica enterica serovar Typhi
aaauuggugauauaaacgg

SEQ ID NO: 3672900 - RNA, 18 nt, Salmonella enterica enterica serovar Typhi
aaauugguuauauuacug

SEQ ID NO: 3672901 - RNA, 18 nt, Salmonella enterica enterica serovar Typhi
aaauuguuuaaaaacagg

SEQ ID NO: 3672902 - RNA, 14 nt, Salmonella enterica enterica serovar Typhi
aaauuuaauauaug

SEQ ID NO: 3672903 - RNA, 13 nt, Salmonella enterica enterica serovar Typhi
aaauuuagcuauu

SEQ ID NO: 3672904 - RNA, 22 nt, Salmonella enterica enterica serovar Typhi
aaauuuagcuauuccaaaauaa

SEQ ID NO: 3672905 - RNA, 20 nt, Salmonella enterica enterica serovar Typhi
aaauuuauuuuuugcuggga

SEQ ID NO: 3672906 - RNA, 20 nt, Salmonella enterica enterica serovar Typhi
aaauuucaucguagucguag

SEQ ID NO: 3672907 - RNA, 20 nt, Salmonella enterica enterica serovar Typhi
aaauuuccgcagccagaauc

SEQ ID NO: 3672908 - RNA, 12 nt, Salmonella enterica enterica serovar Typhi
aaauuuccucuu

SEQ ID NO: 3672909 - RNA, 14 nt, Salmonella enterica enterica serovar Typhi
aaauuucugaugug

SEQ ID NO: 3672910 - RNA, 14 nt, Salmonella enterica enterica serovar Typhi
aaauuucuuuucca

SEQ ID NO: 3672911 - RNA, 16 nt, Salmonella enterica enterica serovar Typhi
aaauuugcagcgcugu

SEQ ID NO: 3672912 - RNA, 23 nt, Salmonella enterica enterica serovar Typhi
aacaaaaaccugcucucgggcag

SEQ ID NO: 3672913 - RNA, 15 nt, Salmonella enterica enterica serovar Typhi
aacaaaaccagcauc

SEQ ID NO: 3672914 - RNA, 14 nt, Salmonella enterica enterica serovar Typhi
aacaaaagaaagca

SEQ ID NO: 3672915 - RNA, 18 nt, Salmonella enterica enterica serovar Typhi
aacaggguuucucgggag

SEQ ID NO: 3672916 - RNA, 19 nt, Salmonella enterica enterica serovar Typhi
aacagguuaaucagcacau

SEQ ID NO: 3672917 - RNA, 17 nt, Salmonella enterica enterica serovar Typhi
aacagguugcguaacgc

SEQ ID NO: 3672918 - RNA, 15 nt, Salmonella enterica enterica serovar Typhi
aacaguacggucagg

SEQ ID NO: 3672919 - RNA, 14 nt, Salmonella enterica enterica serovar Typhi
aacaguacuggucg

SEQ ID NO: 3672920 - RNA, 17 nt, Salmonella enterica enterica serovar Typhi
aacagucgcgccgugcc

SEQ ID NO: 3672921 - RNA, 22 nt, Salmonella enterica enterica serovar Typhi
aacagucgcgccgugcccagca

SEQ ID NO: 3672922 - RNA, 16 nt, Salmonella enterica enterica serovar Typhi
aacagugacaaacuca

SEQ ID NO: 3672923 - RNA, 19 nt, Salmonella enterica enterica serovar Typhi
aacagugggcuaugaagag

SEQ ID NO: 3672924 - RNA, 17 nt, Salmonella enterica enterica serovar Typhi
aacaguuuuuccuuucu

SEQ ID NO: 3672925 - RNA, 13 nt, Salmonella enterica enterica serovar Typhi
aacauaaacaaug

SEQ ID NO: 3672926 - RNA, 14 nt, Salmonella enterica enterica serovar Typhi
aacauaaccggaau

SEQ ID NO: 3672927 - RNA, 19 nt, Salmonella enterica enterica serovar Typhi
aacauagcggcaaggaaaa

SEQ ID NO: 3672928 - RNA, 21 nt, Salmonella enterica enterica serovar Typhi
aacauagcuaaauaaaaauaa

SEQ ID NO: 3672929 - RNA, 18 nt, Salmonella enterica enterica serovar Typhi
aacauagcuuacuuuuag

SEQ ID NO: 3672930 - RNA, 20 nt, Salmonella enterica enterica serovar Typhi
aacauauagcagcagucucu

SEQ ID NO: 3672931 - RNA, 12 nt, Salmonella enterica enterica serovar Typhi
aacauauauauc

SEQ ID NO: 3672932 - RNA, 22 nt, Salmonella enterica enterica serovar Typhi
aacauauuuuuaugcacgcuau

SEQ ID NO: 3672933 - RNA, 15 nt, Salmonella enterica enterica serovar Typhi
aacauauuuuucaca

SEQ ID NO: 3672934 - RNA, 23 nt, Salmonella enterica enterica serovar Typhi
aacauauuuuucacacauaagca

SEQ ID NO: 3672935 - RNA, 15 nt, Salmonella enterica enterica serovar Typhi
aacaucaaguacagc

SEQ ID NO: 3672936 - RNA, 19 nt, Salmonella enterica enterica serovar Typhi
aacaucagaaaaaagccaa

SEQ ID NO: 3672937 - RNA, 22 nt, Salmonella enterica enterica serovar Typhi
aacaucagaaaaaagccaagca

SEQ ID NO: 3672938 - RNA, 16 nt, Salmonella enterica enterica serovar Typhi
aacaucagccagcagc

SEQ ID NO: 3672939 - RNA, 22 nt, Salmonella enterica enterica serovar Typhi
aacaucagcccuaucgcugcgc

SEQ ID NO: 3672940 - RNA, 23 nt, Salmonella enterica enterica serovar Typhi
aacaucagcccuaucgcugcgcu

SEQ ID NO: 3672941 - RNA, 12 nt, Salmonella enterica enterica serovar Typhi
aacaucauaaua

SEQ ID NO: 3672942 - RNA, 13 nt, Salmonella enterica enterica serovar Typhi
aacaucaucguuu

SEQ ID NO: 3672943 - RNA, 24 nt, Salmonella enterica enterica serovar Typhi
aacaucauggcuuaaaacgauuug

SEQ ID NO: 3672944 - RNA, 12 nt, Salmonella enterica enterica serovar Typhi
aacaucauuauu

SEQ ID NO: 3672945 - RNA, 18 nt, Salmonella enterica enterica serovar Typhi
aacaucauuauuccccuc

SEQ ID NO: 3672946 - RNA, 16 nt, Salmonella enterica enterica serovar Typhi
aacaucccagaaaaug

SEQ ID NO: 3672947 - RNA, 15 nt, Salmonella enterica enterica serovar Typhi
aacaucgcuccggca

SEQ ID NO: 3672948 - RNA, 19 nt, Salmonella enterica enterica serovar Typhi
aacaucgguuuguucauau

SEQ ID NO: 3672949 - RNA, 19 nt, Salmonella enterica enterica serovar Typhi
aacaucguaaaucaaauga

SEQ ID NO: 3672950 - RNA, 20 nt, Salmonella enterica enterica serovar Typhi
aacaucguguccuggguaac

SEQ ID NO: 3672951 - RNA, 16 nt, Salmonella enterica enterica serovar Typhi
aacaucuuugccacgu

SEQ ID NO: 3672952 - RNA, 17 nt, Salmonella enterica enterica serovar Typhi
aacaucuuuuaccugug

SEQ ID NO: 3672953 - RNA, 19 nt, Salmonella enterica enterica serovar Typhi
aacaugacgccgaaauaaa

SEQ ID NO: 3672954 - RNA, 21 nt, Salmonella enterica enterica serovar Typhi
aacaugccugauggcgcugcg

SEQ ID NO: 3672955 - RNA, 22 nt, Salmonella enterica enterica serovar Typhi
aacaugccugauggcgcugcgc

SEQ ID NO: 3672956 - RNA, 16 nt, Salmonella enterica enterica serovar Typhi
aacauggguuucuugc

SEQ ID NO: 3672957 - RNA, 20 nt, Salmonella enterica enterica serovar Typhi
aacauggguuugacccauuu

SEQ ID NO: 3672958 - RNA, 19 nt, Salmonella enterica enterica serovar Typhi
aacauguccuacacucaau

SEQ ID NO: 3672959 - RNA, 20 nt, Salmonella enterica enterica serovar Typhi
aacauuaaucgccauugcaa

SEQ ID NO: 3672960 - RNA, 17 nt, Salmonella enterica enterica serovar Typhi
aacauuaucaaaaguga

SEQ ID NO: 3672961 - RNA, 19 nt, Salmonella enterica enterica serovar Typhi
aacauuauuaaaaugucuu

SEQ ID NO: 3672962 - RNA, 17 nt, Salmonella enterica enterica serovar Typhi
aacauucaaaccuucaa

SEQ ID NO: 3672963 - RNA, 13 nt, Salmonella enterica enterica serovar Typhi
aacauucagguuc

SEQ ID NO: 3672964 - RNA, 19 nt, Salmonella enterica enterica serovar Typhi
aacauuccgcccaagaaca

SEQ ID NO: 3672965 - RNA, 20 nt, Salmonella enterica enterica serovar Typhi
aacauuccgcccaagaacau

SEQ ID NO: 3672966 - RNA, 22 nt, Salmonella enterica enterica serovar Typhi
aacauuccgcccaagaacauga

SEQ ID NO: 3672967 - RNA, 22 nt, Salmonella enterica enterica serovar Typhi
aacauugaggcuacccagacaa

SEQ ID NO: 3672968 - RNA, 14 nt, Salmonella enterica enterica serovar Typhi
aacauugcaggucu

SEQ ID NO: 3672969 - RNA, 15 nt, Salmonella enterica enterica serovar Typhi
aacauuuaagauuua

SEQ ID NO: 3672970 - RNA, 14 nt, Salmonella enterica enterica serovar Typhi
aacauuucagcgcc

SEQ ID NO: 3672971 - RNA, 15 nt, Salmonella enterica enterica serovar Typhi
aaccaaagcagaggu

SEQ ID NO: 3672972 - RNA, 17 nt, Salmonella enterica enterica serovar Typhi
aaccaaagguauugccu

SEQ ID NO: 3672973 - RNA, 14 nt, Salmonella enterica enterica serovar Typhi
aaccaaaugcccag

SEQ ID NO: 3672974 - RNA, 15 nt, Salmonella enterica enterica serovar Typhi
aaccaauaguaucca

SEQ ID NO: 3672975 - RNA, 20 nt, Salmonella enterica enterica serovar Typhi
aaccaauuuaaaauccggcu

SEQ ID NO: 3672976 - RNA, 20 nt, Salmonella enterica enterica serovar Typhi
aaccacaaguuuauccggca

SEQ ID NO: 3672977 - RNA, 14 nt, Salmonella enterica enterica serovar Typhi
aaccaccaaaaagc

SEQ ID NO: 3672978 - RNA, 21 nt, Salmonella enterica enterica serovar Typhi
aaccaccggcgcgccagcgca

SEQ ID NO: 3672979 - RNA, 13 nt, Salmonella enterica enterica serovar Typhi
aaccacgaaaauu

SEQ ID NO: 3672980 - RNA, 17 nt, Salmonella enterica enterica serovar Typhi
aaccacgccaaccaucg

SEQ ID NO: 3672981 - RNA, 13 nt, Salmonella enterica enterica serovar Typhi
aaccacuucugac

SEQ ID NO: 3672982 - RNA, 22 nt, Salmonella enterica enterica serovar Typhi
aaccagaaaaccgacagcaaua

SEQ ID NO: 3672983 - RNA, 21 nt, Salmonella enterica enterica serovar Typhi
aaccagacccguugcgucacg

SEQ ID NO: 3672984 - RNA, 15 nt, Salmonella enterica enterica serovar Typhi
aaccagcaguccugc

SEQ ID NO: 3672985 - RNA, 17 nt, Salmonella enterica enterica serovar Typhi
aaccagcauaauauuca

SEQ ID NO: 3672986 - RNA, 15 nt, Salmonella enterica enterica serovar Typhi
aaccagccaugccau

SEQ ID NO: 3672987 - RNA, 22 nt, Salmonella enterica enterica serovar Typhi
aaccagcgccgccagauaaagc

SEQ ID NO: 3672988 - RNA, 21 nt, Salmonella enterica enterica serovar Typhi
aaccagcgcuucgccugccgg

SEQ ID NO: 3672989 - RNA, 16 nt, Salmonella enterica enterica serovar Typhi
aaccagcggcgacaca

SEQ ID NO: 3672990 - RNA, 23 nt, Salmonella enterica enterica serovar Typhi
aaccagcggcgacacaacggcac

SEQ ID NO: 3672991 - RNA, 23 nt, Salmonella enterica enterica serovar Typhi
aaccaggauucaacgcgugaucc

SEQ ID NO: 3672992 - RNA, 16 nt, Salmonella enterica enterica serovar Typhi
aaccaggcaaaaauag

SEQ ID NO: 3672993 - RNA, 18 nt, Salmonella enterica enterica serovar Typhi
aaccaggcaaaccagcac

SEQ ID NO: 3672994 - RNA, 14 nt, Salmonella enterica enterica serovar Typhi
aaccaggcauuuua

SEQ ID NO: 3672995 - RNA, 20 nt, Salmonella enterica enterica serovar Typhi
aaccaggcgaaccccaugcc

SEQ ID NO: 3672996 - RNA, 16 nt, Salmonella enterica enterica serovar Typhi
aaccagggaggacgca

SEQ ID NO: 3672997 - RNA, 15 nt, Salmonella enterica enterica serovar Typhi
aaccaguucacgcgu

SEQ ID NO: 3672998 - RNA, 17 nt, Salmonella enterica enterica serovar Typhi
aaccauaaacaaaacaa

SEQ ID NO: 3672999 - RNA, 14 nt, Salmonella enterica enterica serovar Typhi
aaccauaauaaaua

SEQ ID NO: 3673000 - RNA, 19 nt, Salmonella enterica enterica serovar Typhi
aaccucaauagguguaucc

SEQ ID NO: 3673001 - RNA, 19 nt, Salmonella enterica enterica serovar Typhi
aaccucaccguccgccagg

SEQ ID NO: 3673002 - RNA, 20 nt, Salmonella enterica enterica serovar Typhi
aaccucaucccggcuuaaau

SEQ ID NO: 3673003 - RNA, 13 nt, Salmonella enterica enterica serovar Typhi
aaccucccgccgg

SEQ ID NO: 3673004 - RNA, 20 nt, Salmonella enterica enterica serovar Typhi
aaccuccggcuaugccggag

SEQ ID NO: 3673005 - RNA, 20 nt, Salmonella enterica enterica serovar Typhi
aaccucggcuugcuucaucu

SEQ ID NO: 3673006 - RNA, 17 nt, Salmonella enterica enterica serovar Typhi
aaccucuauaguaaauu

SEQ ID NO: 3673007 - RNA, 14 nt, Salmonella enterica enterica serovar Typhi
aaccugagaauauu

SEQ ID NO: 3673008 - RNA, 15 nt, Salmonella enterica enterica serovar Typhi
aaccugagaauauua

SEQ ID NO: 3673009 - RNA, 13 nt, Salmonella enterica enterica serovar Typhi
aaccugccacagg

SEQ ID NO: 3673010 - RNA, 21 nt, Salmonella enterica enterica serovar Typhi
aaccugcguuacggucgauuu

SEQ ID NO: 3673011 - RNA, 21 nt, Salmonella enterica enterica serovar Typhi
aaccuggcagaaaggugaaaa

SEQ ID NO: 3673012 - RNA, 13 nt, Salmonella enterica enterica serovar Typhi
aaccuguccuuua

SEQ ID NO: 3673013 - RNA, 21 nt, Salmonella enterica enterica serovar Typhi
aaccuguucagccguuucaac

SEQ ID NO: 3673014 - RNA, 14 nt, Salmonella enterica enterica serovar Typhi
aaccuuacggcuca

SEQ ID NO: 3673015 - RNA, 17 nt, Salmonella enterica enterica serovar Typhi
aaccuucaagaaucaau

SEQ ID NO: 3673016 - RNA, 15 nt, Salmonella enterica enterica serovar Typhi
aaccuucauaaauac

SEQ ID NO: 3673017 - RNA, 20 nt, Salmonella enterica enterica serovar Typhi
aaccuuccaucgcauccucg

SEQ ID NO: 3673018 - RNA, 14 nt, Salmonella enterica enterica serovar Typhi
aaccuuccgccagg

SEQ ID NO: 3673019 - RNA, 12 nt, Salmonella enterica enterica serovar Typhi
aaccuugcgccu

SEQ ID NO: 3673020 - RNA, 12 nt, Salmonella enterica enterica serovar Typhi
aacgaaacucag

SEQ ID NO: 3673021 - RNA, 20 nt, Salmonella enterica enterica serovar Typhi
aacgaaagcucaggcgggga

SEQ ID NO: 3673022 - RNA, 17 nt, Salmonella enterica enterica serovar Typhi
aacgaacgcggaucaga

SEQ ID NO: 3673023 - RNA, 20 nt, Salmonella enterica enterica serovar Typhi
aacgaacgcggaucagacgg

SEQ ID NO: 3673024 - RNA, 14 nt, Salmonella enterica enterica serovar Typhi
aacgaaucgaaucg

SEQ ID NO: 3673025 - RNA, 20 nt, Salmonella enterica enterica serovar Typhi
aacgaauuuaaauagcaauu

SEQ ID NO: 3673026 - RNA, 17 nt, Salmonella enterica enterica serovar Typhi
aacgacaaaucugccgg

SEQ ID NO: 3673027 - RNA, 20 nt, Salmonella enterica enterica serovar Typhi
aacgacaaaucugccgggag

SEQ ID NO: 3673028 - RNA, 14 nt, Salmonella enterica enterica serovar Typhi
aacgaccagaauca

SEQ ID NO: 3673029 - RNA, 14 nt, Salmonella enterica enterica serovar Typhi
aacgaccagauacu

SEQ ID NO: 3673030 - RNA, 15 nt, Salmonella enterica enterica serovar Typhi
aacgacccaucaaua

SEQ ID NO: 3673031 - RNA, 22 nt, Salmonella enterica enterica serovar Typhi
aacgacgacgcagcuucgccgc

SEQ ID NO: 3673032 - RNA, 16 nt, Salmonella enterica enterica serovar Typhi
aacgauaauucgccgg

SEQ ID NO: 3673033 - RNA, 14 nt, Salmonella enterica enterica serovar Typhi
aacgaucauugacg

SEQ ID NO: 3673034 - RNA, 23 nt, Salmonella enterica enterica serovar Typhi
aacgaugaccauaaaugaaaugc

SEQ ID NO: 3673035 - RNA, 17 nt, Salmonella enterica enterica serovar Typhi
aacgaugaugaaaaaga

SEQ ID NO: 3673036 - RNA, 19 nt, Salmonella enterica enterica serovar Typhi
aacgaugaugaaaaagaau

SEQ ID NO: 3673037 - RNA, 20 nt, Salmonella enterica enterica serovar Typhi
aacgaugaugaaaaagaaug

SEQ ID NO: 3673038 - RNA, 18 nt, Salmonella enterica enterica serovar Typhi
aacgaugauuauuguuaa

SEQ ID NO: 3673039 - RNA, 16 nt, Salmonella enterica enterica serovar Typhi
aacgauguaucgcgcg

SEQ ID NO: 3673040 - RNA, 18 nt, Salmonella enterica enterica serovar Typhi
aacgauucguaaauugac

SEQ ID NO: 3673041 - RNA, 19 nt, Salmonella enterica enterica serovar Typhi
aacgcaacaccaucccgcu

SEQ ID NO: 3673042 - RNA, 18 nt, Salmonella enterica enterica serovar Typhi
aacgcacgcagccaacgc

SEQ ID NO: 3673043 - RNA, 14 nt, Salmonella enterica enterica serovar Typhi
aacgcacuaccaga

SEQ ID NO: 3673044 - RNA, 16 nt, Salmonella enterica enterica serovar Typhi
aacgcacuuuuccagc

SEQ ID NO: 3673045 - RNA, 19 nt, Salmonella enterica enterica serovar Typhi
aacgcagaagacagaagcu

SEQ ID NO: 3673046 - RNA, 14 nt, Salmonella enterica enterica serovar Typhi
aacgcagcaucgcc

SEQ ID NO: 3673047 - RNA, 18 nt, Salmonella enterica enterica serovar Typhi
aacgcagcgcgcguagca

SEQ ID NO: 3673048 - RNA, 23 nt, Salmonella enterica enterica serovar Typhi
aacgcaggcaguuugcgaaaagc

SEQ ID NO: 3673049 - RNA, 22 nt, Salmonella enterica enterica serovar Typhi
aacgcaggcgaaaucaaaaggc

SEQ ID NO: 3673050 - RNA, 21 nt, Salmonella enterica enterica serovar Typhi
aacgcaggcgauagccccagu

SEQ ID NO: 3673051 - RNA, 15 nt, Salmonella enterica enterica serovar Typhi
aacgcauaaaaacgu

SEQ ID NO: 3673052 - RNA, 15 nt, Salmonella enterica enterica serovar Typhi
aacgcauauccagca

SEQ ID NO: 3673053 - RNA, 18 nt, Salmonella enterica enterica serovar Typhi
aacgcaucaaauaccuuu

SEQ ID NO: 3673054 - RNA, 22 nt, Salmonella enterica enterica serovar Typhi
aacgcaucaaauaccuuuucau

SEQ ID NO: 3673055 - RNA, 18 nt, Salmonella enterica enterica serovar Typhi
aacgcauccagccacgua

SEQ ID NO: 3673056 - RNA, 13 nt, Salmonella enterica enterica serovar Typhi
aacgcauccagcg

SEQ ID NO: 3673057 - RNA, 15 nt, Salmonella enterica enterica serovar Typhi
aacgcauccagcgca

SEQ ID NO: 3673058 - RNA, 16 nt, Salmonella enterica enterica serovar Typhi
aacgcauccagcguca

SEQ ID NO: 3673059 - RNA, 14 nt, Salmonella enterica enterica serovar Typhi
aacgcaucgcugcg

SEQ ID NO: 3673060 - RNA, 20 nt, Salmonella enterica enterica serovar Typhi
aacgcaucugggcugagaaa

SEQ ID NO: 3673061 - RNA, 11 nt, Salmonella enterica enterica serovar Typhi
aacgcauucac

SEQ ID NO: 3673062 - RNA, 23 nt, Salmonella enterica enterica serovar Typhi
aacgccaaaguuuuuaaacaaca

SEQ ID NO: 3673063 - RNA, 15 nt, Salmonella enterica enterica serovar Typhi
aacgccaacgcccgg

SEQ ID NO: 3673064 - RNA, 21 nt, Salmonella enterica enterica serovar Typhi
aacgccaagcgcggcagcagc

SEQ ID NO: 3673065 - RNA, 21 nt, Salmonella enterica enterica serovar Typhi
aacgccaccgccaccugcccu

SEQ ID NO: 3673066 - RNA, 14 nt, Salmonella enterica enterica serovar Typhi
aacgccacugccau

SEQ ID NO: 3673067 - RNA, 21 nt, Salmonella enterica enterica serovar Typhi
aacgccagaccgacgccaacc

SEQ ID NO: 3673068 - RNA, 14 nt, Salmonella enterica enterica serovar Typhi
aacgccagcagcgc

SEQ ID NO: 3673069 - RNA, 13 nt, Salmonella enterica enterica serovar Typhi
aacgccaucagcc

SEQ ID NO: 3673070 - RNA, 22 nt, Salmonella enterica enterica serovar Typhi
aacgcccccugccagcgcugag

SEQ ID NO: 3673071 - RNA, 22 nt, Salmonella enterica enterica serovar Typhi
aacgcccgccgcgaccagcagc

SEQ ID NO: 3673072 - RNA, 21 nt, Salmonella enterica enterica serovar Typhi
aacgcccggcgcgacaccuuc

SEQ ID NO: 3673073 - RNA, 17 nt, Salmonella enterica enterica serovar Typhi
aacgccgaagccagcgc

SEQ ID NO: 3673074 - RNA, 21 nt, Salmonella enterica enterica serovar Typhi
aacgccgaccacuucaacgcc

SEQ ID NO: 3673075 - RNA, 15 nt, Salmonella enterica enterica serovar Typhi
aacgccgagccgccc

SEQ ID NO: 3673076 - RNA, 19 nt, Salmonella enterica enterica serovar Typhi
aacgccgcacacucauuuu

SEQ ID NO: 3673077 - RNA, 13 nt, Salmonella enterica enterica serovar Typhi
aacgccgccagcu

SEQ ID NO: 3673078 - RNA, 18 nt, Salmonella enterica enterica serovar Typhi
aacgccgccgacaugacg

SEQ ID NO: 3673079 - RNA, 17 nt, Salmonella enterica enterica serovar Typhi
aacgccgccgcaaggcg

SEQ ID NO: 3673080 - RNA, 16 nt, Salmonella enterica enterica serovar Typhi
aacgccgccugcgcca

SEQ ID NO: 3673081 - RNA, 18 nt, Salmonella enterica enterica serovar Typhi
aacgccgggccugccagg

SEQ ID NO: 3673082 - RNA, 17 nt, Salmonella enterica enterica serovar Typhi
aacgccgguacgcagca

SEQ ID NO: 3673083 - RNA, 20 nt, Salmonella enterica enterica serovar Typhi
aacgccggucguggcgauca

SEQ ID NO: 3673084 - RNA, 22 nt, Salmonella enterica enterica serovar Typhi
aacgccguacuccagcccauca

SEQ ID NO: 3673085 - RNA, 14 nt, Salmonella enterica enterica serovar Typhi
aacgccgugaacgc

SEQ ID NO: 3673086 - RNA, 23 nt, Salmonella enterica enterica serovar Typhi
aacgugcauuauuuuagugaaaa

SEQ ID NO: 3673087 - RNA, 13 nt, Salmonella enterica enterica serovar Typhi
aacgugccacagu

SEQ ID NO: 3673088 - RNA, 21 nt, Salmonella enterica enterica serovar Typhi
aacgugcgguauaucacgcca

SEQ ID NO: 3673089 - RNA, 21 nt, Salmonella enterica enterica serovar Typhi
aacgugcuggauggcagacaa

SEQ ID NO: 3673090 - RNA, 12 nt, Salmonella enterica enterica serovar Typhi
aacguggcggca

SEQ ID NO: 3673091 - RNA, 18 nt, Salmonella enterica enterica serovar Typhi
aacguggcggcagagcca

SEQ ID NO: 3673092 - RNA, 21 nt, Salmonella enterica enterica serovar Typhi
aacguguccaguuuuuuacuu

SEQ ID NO: 3673093 - RNA, 22 nt, Salmonella enterica enterica serovar Typhi
aacguguuacguuuaaaccaug

SEQ ID NO: 3673094 - RNA, 23 nt, Salmonella enterica enterica serovar Typhi
aacguguuacguuuaaaccaugc

SEQ ID NO: 3673095 - RNA, 22 nt, Salmonella enterica enterica serovar Typhi
aacguguuuucgauuucauuca

SEQ ID NO: 3673096 - RNA, 16 nt, Salmonella enterica enterica serovar Typhi
aacguucaaaaucaaa

SEQ ID NO: 3673097 - RNA, 17 nt, Salmonella enterica enterica serovar Typhi
aacguucggugaagaaa

SEQ ID NO: 3673098 - RNA, 18 nt, Salmonella enterica enterica serovar Typhi
aacguugacguuucaguc

SEQ ID NO: 3673099 - RNA, 16 nt, Salmonella enterica enterica serovar Typhi
aacguuguccagcaga

SEQ ID NO: 3673100 - RNA, 22 nt, Salmonella enterica enterica serovar Typhi
aacguuguccagcggccaugac

SEQ ID NO: 3673101 - RNA, 21 nt, Salmonella enterica enterica serovar Typhi
aacguuuaaugucaccaucau

SEQ ID NO: 3673102 - RNA, 22 nt, Salmonella enterica enterica serovar Typhi
aacguuucauggaaaucaagcg

SEQ ID NO: 3673103 - RNA, 19 nt, Salmonella enterica enterica serovar Typhi
aacguuucuuucaucagau

SEQ ID NO: 3673104 - RNA, 14 nt, Salmonella enterica enterica serovar Typhi
aacguuugccagcg

SEQ ID NO: 3673105 - RNA, 18 nt, Salmonella enterica enterica serovar Typhi
aacguuuguaacagcagg

SEQ ID NO: 3673106 - RNA, 15 nt, Salmonella enterica enterica serovar Typhi
aacguuuuacgcugc

SEQ ID NO: 3673107 - RNA, 18 nt, Salmonella enterica enterica serovar Typhi
aacguuuugugucaaaaa

SEQ ID NO: 3673108 - RNA, 22 nt, Salmonella enterica enterica serovar Typhi
aacguuuuuccuugauuucauu

SEQ ID NO: 3673109 - RNA, 21 nt, Salmonella enterica enterica serovar Typhi
aacuaacccgcagccggaauc

SEQ ID NO: 3673110 - RNA, 13 nt, Salmonella enterica enterica serovar Typhi
aacuacucguaau

SEQ ID NO: 3673111 - RNA, 15 nt, Salmonella enterica enterica serovar Typhi
aacuaugcaaaacgu

SEQ ID NO: 3673112 - RNA, 21 nt, Salmonella enterica enterica serovar Typhi
aacuaugccagaauacaccgc

SEQ ID NO: 3673113 - RNA, 14 nt, Salmonella enterica enterica serovar Typhi
aacuauuaauucuu

SEQ ID NO: 3673114 - RNA, 19 nt, Salmonella enterica enterica serovar Typhi
aacuauuaauucuuuuaac

SEQ ID NO: 3673115 - RNA, 12 nt, Salmonella enterica enterica serovar Typhi
aacucaagguag

SEQ ID NO: 3673116 - RNA, 17 nt, Salmonella enterica enterica serovar Typhi
aacucacguuccccagc

SEQ ID NO: 3673117 - RNA, 19 nt, Salmonella enterica enterica serovar Typhi
aacucacguuccccagcac

SEQ ID NO: 3673118 - RNA, 12 nt, Salmonella enterica enterica serovar Typhi
aacucagcaaua

SEQ ID NO: 3673119 - RNA, 20 nt, Salmonella enterica enterica serovar Typhi
aacucagcaauauuuuguag

SEQ ID NO: 3673120 - RNA, 13 nt, Salmonella enterica enterica serovar Typhi
aacucaucacagc

SEQ ID NO: 3673121 - RNA, 17 nt, Salmonella enterica enterica serovar Typhi
aacucaucaugauauaa

SEQ ID NO: 3673122 - RNA, 23 nt, Salmonella enterica enterica serovar Typhi
aacucauccaccuuauccuggca

SEQ ID NO: 3673123 - RNA, 20 nt, Salmonella enterica enterica serovar Typhi
aacucaucgcuuagcggcuc

SEQ ID NO: 3673124 - RNA, 23 nt, Salmonella enterica enterica serovar Typhi
aacucaugacuucacacuguggu

SEQ ID NO: 3673125 - RNA, 17 nt, Salmonella enterica enterica serovar Typhi
aacuccagugcagaaag

SEQ ID NO: 3673126 - RNA, 21 nt, Salmonella enterica enterica serovar Typhi
aacuccucacugcguaaaauc

SEQ ID NO: 3673127 - RNA, 15 nt, Salmonella enterica enterica serovar Typhi
aacuccucuuccgac

SEQ ID NO: 3673128 - RNA, 20 nt, Salmonella enterica enterica serovar Typhi
aacucgccaugccaucggcc

SEQ ID NO: 3673129 - RNA, 18 nt, Salmonella enterica enterica serovar Typhi
aacucgcuguggccaggc

SEQ ID NO: 3673130 - RNA, 21 nt, Salmonella enterica enterica serovar Typhi
aacucggaggcggcguaacgg

SEQ ID NO: 3673131 - RNA, 21 nt, Salmonella enterica enterica serovar Typhi
aacucggcgggguuuuuuuau

SEQ ID NO: 3673132 - RNA, 20 nt, Salmonella enterica enterica serovar Typhi
aacucucaccgaccugccuu

SEQ ID NO: 3673133 - RNA, 20 nt, Salmonella enterica enterica serovar Typhi
aacucucguucggucaggau

SEQ ID NO: 3673134 - RNA, 23 nt, Salmonella enterica enterica serovar Typhi
aacucuggaucaguuccggauua

SEQ ID NO: 3673135 - RNA, 20 nt, Salmonella enterica enterica serovar Typhi
aacucuuccccgaucagaaa

SEQ ID NO: 3673136 - RNA, 21 nt, Salmonella enterica enterica serovar Typhi
aacucuuuuucagcaaauaca

SEQ ID NO: 3673137 - RNA, 16 nt, Salmonella enterica enterica serovar Typhi
aacugaaaccaggcac

SEQ ID NO: 3673138 - RNA, 15 nt, Salmonella enterica enterica serovar Typhi
aacugaaccaacagc

SEQ ID NO: 3673139 - RNA, 19 nt, Salmonella enterica enterica serovar Typhi
aacugaaccaacagcuggg

SEQ ID NO: 3673140 - RNA, 13 nt, Salmonella enterica enterica serovar Typhi
aacugaauuucau

SEQ ID NO: 3673141 - RNA, 22 nt, Salmonella enterica enterica serovar Typhi
aacugaauuucauccccggcgc

SEQ ID NO: 3673142 - RNA, 18 nt, Salmonella enterica enterica serovar Typhi
aacugaccauauaugaaa

SEQ ID NO: 3673143 - RNA, 17 nt, Salmonella enterica enterica serovar Typhi
aacugagacucagcagc

SEQ ID NO: 3673144 - RNA, 15 nt, Salmonella enterica enterica serovar Typhi
aacugagcgccaauu

SEQ ID NO: 3673145 - RNA, 21 nt, Salmonella enterica enterica serovar Typhi
aacugauaacgauaagugaag

SEQ ID NO: 3673146 - RNA, 20 nt, Salmonella enterica enterica serovar Typhi
aacugauaguuuaaauccag

SEQ ID NO: 3673147 - RNA, 20 nt, Salmonella enterica enterica serovar Typhi
aacugauauuacuaauaaaa

SEQ ID NO: 3673148 - RNA, 18 nt, Salmonella enterica enterica serovar Typhi
aacugauucaaaagguga

SEQ ID NO: 3673149 - RNA, 18 nt, Salmonella enterica enterica serovar Typhi
aacugcaaaucuucggca

SEQ ID NO: 3673150 - RNA, 21 nt, Salmonella enterica enterica serovar Typhi
aacugcagcgcgucgaccaua

SEQ ID NO: 3673151 - RNA, 14 nt, Salmonella enterica enterica serovar Typhi
aacugccaaaccac

SEQ ID NO: 3673152 - RNA, 20 nt, Salmonella enterica enterica serovar Typhi
aacugcgaguucaccaguuu

SEQ ID NO: 3673153 - RNA, 16 nt, Salmonella enterica enterica serovar Typhi
aacugcgccugcauau

SEQ ID NO: 3673154 - RNA, 19 nt, Salmonella enterica enterica serovar Typhi
aacugcgcgcccgccuccg

SEQ ID NO: 3673155 - RNA, 17 nt, Salmonella enterica enterica serovar Typhi
aacugcgcgccgcccug

SEQ ID NO: 3673156 - RNA, 17 nt, Salmonella enterica enterica serovar Typhi
aacugcgcggcaaugag

SEQ ID NO: 3673157 - RNA, 20 nt, Salmonella enterica enterica serovar Typhi
aacugcggaauuuuauccug

SEQ ID NO: 3673158 - RNA, 22 nt, Salmonella enterica enterica serovar Typhi
aacugcggaauuuuauccugug

SEQ ID NO: 3673159 - RNA, 14 nt, Salmonella enterica enterica serovar Typhi
aacugcggccagac

SEQ ID NO: 3673160 - RNA, 18 nt, Salmonella enterica enterica serovar Typhi
aacugcgguaaauaaugc

SEQ ID NO: 3673161 - RNA, 16 nt, Salmonella enterica enterica serovar Typhi
aacugcucguaaagca

SEQ ID NO: 3673162 - RNA, 15 nt, Salmonella enterica enterica serovar Typhi
aacugcugccgcagc

SEQ ID NO: 3673163 - RNA, 12 nt, Salmonella enterica enterica serovar Typhi
aacuggaaaaag

SEQ ID NO: 3673164 - RNA, 13 nt, Salmonella enterica enterica serovar Typhi
aacuggaaaaaga

SEQ ID NO: 3673165 - RNA, 19 nt, Salmonella enterica enterica serovar Typhi
aacuggcaagcgcuaagca

SEQ ID NO: 3673166 - RNA, 13 nt, Salmonella enterica enterica serovar Typhi
aacuggcgcaucu

SEQ ID NO: 3673167 - RNA, 15 nt, Salmonella enterica enterica serovar Typhi
aacuggcgcuggcag

SEQ ID NO: 3673168 - RNA, 16 nt, Salmonella enterica enterica serovar Typhi
aacugggcgauaaagu

SEQ ID NO: 3673169 - RNA, 23 nt, Salmonella enterica enterica serovar Typhi
aacugggcuugcauugcuuuuag

SEQ ID NO: 3673170 - RNA, 18 nt, Salmonella enterica enterica serovar Typhi
aacugggugugaucgccg

SEQ ID NO: 3673171 - RNA, 18 nt, Salmonella enterica enterica serovar Typhi
aagaccaugaacaccuca

SEQ ID NO: 3673172 - RNA, 14 nt, Salmonella enterica enterica serovar Typhi
aagacccgaaccug

SEQ ID NO: 3673173 - RNA, 17 nt, Salmonella enterica enterica serovar Typhi
aagaccgauagagacug

SEQ ID NO: 3673174 - RNA, 16 nt, Salmonella enterica enterica serovar Typhi
aagaccugcuucaggu

SEQ ID NO: 3673175 - RNA, 14 nt, Salmonella enterica enterica serovar Typhi
aagacgaaaucguc

SEQ ID NO: 3673176 - RNA, 16 nt, Salmonella enterica enterica serovar Typhi
aagacgaauaaggaau

SEQ ID NO: 3673177 - RNA, 21 nt, Salmonella enterica enterica serovar Typhi
aagacgcuacgcgucgccauc

SEQ ID NO: 3673178 - RNA, 20 nt, Salmonella enterica enterica serovar Typhi
aagacgcuuacaucgccauc

SEQ ID NO: 3673179 - RNA, 15 nt, Salmonella enterica enterica serovar Typhi
aagacuacgcaaaaa

SEQ ID NO: 3673180 - RNA, 22 nt, Salmonella enterica enterica serovar Typhi
aagacuacuuaccggcgccaga

SEQ ID NO: 3673181 - RNA, 19 nt, Salmonella enterica enterica serovar Typhi
aagacugauuuaucaccca

SEQ ID NO: 3673182 - RNA, 16 nt, Salmonella enterica enterica serovar Typhi
aagacugcuccggcaa

SEQ ID NO: 3673183 - RNA, 18 nt, Salmonella enterica enterica serovar Typhi
aagacugcuccggcaaga

SEQ ID NO: 3673184 - RNA, 18 nt, Salmonella enterica enterica serovar Typhi
aagacuggcccugccgga

SEQ ID NO: 3673185 - RNA, 17 nt, Salmonella enterica enterica serovar Typhi
aagagaaaaaucaguca

SEQ ID NO: 3673186 - RNA, 13 nt, Salmonella enterica enterica serovar Typhi
aagagaaaauacc

SEQ ID NO: 3673187 - RNA, 14 nt, Salmonella enterica enterica serovar Typhi
aagagaaaauaccg

SEQ ID NO: 3673188 - RNA, 17 nt, Salmonella enterica enterica serovar Typhi
aagagaacguucguugu

SEQ ID NO: 3673189 - RNA, 17 nt, Salmonella enterica enterica serovar Typhi
aagagaauggccagcac

SEQ ID NO: 3673190 - RNA, 17 nt, Salmonella enterica enterica serovar Typhi
aagagacacgcugaccu

SEQ ID NO: 3673191 - RNA, 21 nt, Salmonella enterica enterica serovar Typhi
aagagagccuuacaggcgcau

SEQ ID NO: 3673192 - RNA, 22 nt, Salmonella enterica enterica serovar Typhi
aagagaggcuuuaugcugacaa

SEQ ID NO: 3673193 - RNA, 19 nt, Salmonella enterica enterica serovar Typhi
aagagauggaaugagcauc

SEQ ID NO: 3673194 - RNA, 14 nt, Salmonella enterica enterica serovar Typhi
aagagauuagaacg

SEQ ID NO: 3673195 - RNA, 16 nt, Salmonella enterica enterica serovar Typhi
aagagcacuuugguaa

SEQ ID NO: 3673196 - RNA, 21 nt, Salmonella enterica enterica serovar Typhi
aagagcacuuugguaaaacgg

SEQ ID NO: 3673197 - RNA, 21 nt, Salmonella enterica enterica serovar Typhi
aagagccgcgcagcgcaacgc

SEQ ID NO: 3673198 - RNA, 16 nt, Salmonella enterica enterica serovar Typhi
aagagcguuacccaga

SEQ ID NO: 3673199 - RNA, 20 nt, Salmonella enterica enterica serovar Typhi
aagagcguuacccagacagc

SEQ ID NO: 3673200 - RNA, 21 nt, Salmonella enterica enterica serovar Typhi
aagagcguuacccagacagca

SEQ ID NO: 3673201 - RNA, 17 nt, Salmonella enterica enterica serovar Typhi
aagagcucgaccaacau

SEQ ID NO: 3673202 - RNA, 21 nt, Salmonella enterica enterica serovar Typhi
aagaggcauaaaaaaaagccg

SEQ ID NO: 3673203 - RNA, 21 nt, Salmonella enterica enterica serovar Typhi
aagaguaucucucuggcgcau

SEQ ID NO: 3673204 - RNA, 19 nt, Salmonella enterica enterica serovar Typhi
aagagugacgguuuucacu

SEQ ID NO: 3673205 - RNA, 11 nt, Salmonella enterica enterica serovar Typhi
aagaguuaacu

SEQ ID NO: 3673206 - RNA, 14 nt, Salmonella enterica enterica serovar Typhi
aagauaaaaagaca

SEQ ID NO: 3673207 - RNA, 17 nt, Salmonella enterica enterica serovar Typhi
aagauaaccauuucaaa

SEQ ID NO: 3673208 - RNA, 14 nt, Salmonella enterica enterica serovar Typhi
aagauaagaaguaa

SEQ ID NO: 3673209 - RNA, 23 nt, Salmonella enterica enterica serovar Typhi
aagauaauguccccuaaauaauu

SEQ ID NO: 3673210 - RNA, 14 nt, Salmonella enterica enterica serovar Typhi
aagauagcgggcaa

SEQ ID NO: 3673211 - RNA, 22 nt, Salmonella enterica enterica serovar Typhi
aagauauuuuguuuuaaauuca

SEQ ID NO: 3673212 - RNA, 21 nt, Salmonella enterica enterica serovar Typhi
aagaucccagggcggcgucgc

SEQ ID NO: 3673213 - RNA, 21 nt, Salmonella enterica enterica serovar Typhi
aagaucccgaccaguuuuugc

SEQ ID NO: 3673214 - RNA, 15 nt, Salmonella enterica enterica serovar Typhi
aagaucgcguacagc

SEQ ID NO: 3673215 - RNA, 20 nt, Salmonella enterica enterica serovar Typhi
aagaucgcguacagcgccau

SEQ ID NO: 3673216 - RNA, 16 nt, Salmonella enterica enterica serovar Typhi
aagaucguuauccagc

SEQ ID NO: 3673217 - RNA, 19 nt, Salmonella enterica enterica serovar Typhi
aagaucguuauccagcagc

SEQ ID NO: 3673218 - RNA, 18 nt, Salmonella enterica enterica serovar Typhi
aagaucuaaagccaguuu

SEQ ID NO: 3673219 - RNA, 17 nt, Salmonella enterica enterica serovar Typhi
aagaugaggagcuggag

SEQ ID NO: 3673220 - RNA, 20 nt, Salmonella enterica enterica serovar Typhi
aagaugaggagcuggagcag

SEQ ID NO: 3673221 - RNA, 15 nt, Salmonella enterica enterica serovar Typhi
aagaugcuacccguc

SEQ ID NO: 3673222 - RNA, 17 nt, Salmonella enterica enterica serovar Typhi
aagaugggucagugcau

SEQ ID NO: 3673223 - RNA, 19 nt, Salmonella enterica enterica serovar Typhi
aagaugugccacuccgcca

SEQ ID NO: 3673224 - RNA, 18 nt, Salmonella enterica enterica serovar Typhi
aagauugauuuauucacu

SEQ ID NO: 3673225 - RNA, 20 nt, Salmonella enterica enterica serovar Typhi
aagauugcgcagggucuggu

SEQ ID NO: 3673226 - RNA, 16 nt, Salmonella enterica enterica serovar Typhi
aagcaaaaaucaccac

SEQ ID NO: 3673227 - RNA, 18 nt, Salmonella enterica enterica serovar Typhi
aagcaaaccuauuucagu

SEQ ID NO: 3673228 - RNA, 12 nt, Salmonella enterica enterica serovar Typhi
aagcaaauucag

SEQ ID NO: 3673229 - RNA, 20 nt, Salmonella enterica enterica serovar Typhi
aagcaacugauuaaucugcc

SEQ ID NO: 3673230 - RNA, 23 nt, Salmonella enterica enterica serovar Typhi
aagcaacugauuaaucugccgac

SEQ ID NO: 3673231 - RNA, 17 nt, Salmonella enterica enterica serovar Typhi
aagcaauccauuuuaaa

SEQ ID NO: 3673232 - RNA, 21 nt, Salmonella enterica enterica serovar Typhi
aagcaauccauuuuaaauaca

SEQ ID NO: 3673233 - RNA, 14 nt, Salmonella enterica enterica serovar Typhi
aagcaaugccagaa

SEQ ID NO: 3673234 - RNA, 20 nt, Salmonella enterica enterica serovar Typhi
aagcacauaacugagacuca

SEQ ID NO: 3673235 - RNA, 19 nt, Salmonella enterica enterica serovar Typhi
aagcacaucagcaaaugaa

SEQ ID NO: 3673236 - RNA, 19 nt, Salmonella enterica enterica serovar Typhi
aagcaccaucgcaaauuca

SEQ ID NO: 3673237 - RNA, 14 nt, Salmonella enterica enterica serovar Typhi
aagcaccgccagcg

SEQ ID NO: 3673238 - RNA, 14 nt, Salmonella enterica enterica serovar Typhi
aagcacugcugcug

SEQ ID NO: 3673239 - RNA, 15 nt, Salmonella enterica enterica serovar Typhi
aagcacugcugcuga

SEQ ID NO: 3673240 - RNA, 21 nt, Salmonella enterica enterica serovar Typhi
aagcacugcugcugaaagaag

SEQ ID NO: 3673241 - RNA, 19 nt, Salmonella enterica enterica serovar Typhi
aagcacuucucgcgcauca

SEQ ID NO: 3673242 - RNA, 18 nt, Salmonella enterica enterica serovar Typhi
aagcagaacguagcccau

SEQ ID NO: 3673243 - RNA, 14 nt, Salmonella enterica enterica serovar Typhi
aagcagacgcucga

SEQ ID NO: 3673244 - RNA, 12 nt, Salmonella enterica enterica serovar Typhi
aagcagcgacaa

SEQ ID NO: 3673245 - RNA, 23 nt, Salmonella enterica enterica serovar Typhi
aagcagcgccuguaaacguuccu

SEQ ID NO: 3673246 - RNA, 23 nt, Salmonella enterica enterica serovar Typhi
aagcagcugcuuaacuucugcag

SEQ ID NO: 3673247 - RNA, 17 nt, Salmonella enterica enterica serovar Typhi
aagcagcuugcugcuuu

SEQ ID NO: 3673248 - RNA, 11 nt, Salmonella enterica enterica serovar Typhi
aagcaggccga

SEQ ID NO: 3673249 - RNA, 18 nt, Salmonella enterica enterica serovar Typhi
aagcaggcgggacgccau

SEQ ID NO: 3673250 - RNA, 17 nt, Salmonella enterica enterica serovar Typhi
aagcaguuaauacagug

SEQ ID NO: 3673251 - RNA, 14 nt, Salmonella enterica enterica serovar Typhi
aagcauaccuucac

SEQ ID NO: 3673252 - RNA, 15 nt, Salmonella enterica enterica serovar Typhi
aagcauaccuucaca

SEQ ID NO: 3673253 - RNA, 17 nt, Salmonella enterica enterica serovar Typhi
aagcauagcgccuucag

SEQ ID NO: 3673254 - RNA, 18 nt, Salmonella enterica enterica serovar Typhi
aagcauagcgccuucagg

SEQ ID NO: 3673255 - RNA, 19 nt, Salmonella enterica enterica serovar Typhi
aagcauagcgccuucaggc

SEQ ID NO: 3673256 - RNA, 23 nt, Salmonella enterica enterica serovar Typhi
aagcguccgguugcaguacaggc

SEQ ID NO: 3673257 - RNA, 14 nt, Salmonella enterica enterica serovar Typhi
aagcgugcgccauc

SEQ ID NO: 3673258 - RNA, 15 nt, Salmonella enterica enterica serovar Typhi
aagcguuaaugcguu

SEQ ID NO: 3673259 - RNA, 18 nt, Salmonella enterica enterica serovar Typhi
aagcguuacggaaaaaau

SEQ ID NO: 3673260 - RNA, 19 nt, Salmonella enterica enterica serovar Typhi
aagcguuacggaaaaaaua

SEQ ID NO: 3673261 - RNA, 20 nt, Salmonella enterica enterica serovar Typhi
aagcguuacggaaaaaauac

SEQ ID NO: 3673262 - RNA, 21 nt, Salmonella enterica enterica serovar Typhi
aagcguuacggaaaaaauacu

SEQ ID NO: 3673263 - RNA, 22 nt, Salmonella enterica enterica serovar Typhi
aagcguuagcgucauccggcau

SEQ ID NO: 3673264 - RNA, 12 nt, Salmonella enterica enterica serovar Typhi
aagcguuccagu

SEQ ID NO: 3673265 - RNA, 14 nt, Salmonella enterica enterica serovar Typhi
aagcguuccgccac

SEQ ID NO: 3673266 - RNA, 19 nt, Salmonella enterica enterica serovar Typhi
aagcguugccguaggcaac

SEQ ID NO: 3673267 - RNA, 22 nt, Salmonella enterica enterica serovar Typhi
aagcguuguaacaaaccgguaa

SEQ ID NO: 3673268 - RNA, 14 nt, Salmonella enterica enterica serovar Typhi
aagcguuuccagag

SEQ ID NO: 3673269 - RNA, 22 nt, Salmonella enterica enterica serovar Typhi
aagcguuuccagaguacauucu

SEQ ID NO: 3673270 - RNA, 18 nt, Salmonella enterica enterica serovar Typhi
aagcuaauccccagcgcu

SEQ ID NO: 3673271 - RNA, 21 nt, Salmonella enterica enterica serovar Typhi
aagcuacguuugaacagcagu

SEQ ID NO: 3673272 - RNA, 16 nt, Salmonella enterica enterica serovar Typhi
aagcuaguaaagaaau

SEQ ID NO: 3673273 - RNA, 20 nt, Salmonella enterica enterica serovar Typhi
aagcuaguaaagaaauuuug

SEQ ID NO: 3673274 - RNA, 20 nt, Salmonella enterica enterica serovar Typhi
aagcuauccucuuuuaucac

SEQ ID NO: 3673275 - RNA, 17 nt, Salmonella enterica enterica serovar Typhi
aagcuauuccuguauaa

SEQ ID NO: 3673276 - RNA, 13 nt, Salmonella enterica enterica serovar Typhi
aagcucauuuccc

SEQ ID NO: 3673277 - RNA, 21 nt, Salmonella enterica enterica serovar Typhi
aagcucauuucccaauaguuu

SEQ ID NO: 3673278 - RNA, 23 nt, Salmonella enterica enterica serovar Typhi
aagcucauuucccaauaguuuau

SEQ ID NO: 3673279 - RNA, 17 nt, Salmonella enterica enterica serovar Typhi
aagcucccgccagcgag

SEQ ID NO: 3673280 - RNA, 15 nt, Salmonella enterica enterica serovar Typhi
aagcugaccagggca

SEQ ID NO: 3673281 - RNA, 16 nt, Salmonella enterica enterica serovar Typhi
aagcugauauuuuacu

SEQ ID NO: 3673282 - RNA, 12 nt, Salmonella enterica enterica serovar Typhi
aagcugcauaau

SEQ ID NO: 3673283 - RNA, 19 nt, Salmonella enterica enterica serovar Typhi
aagcugcuggcgagcagga

SEQ ID NO: 3673284 - RNA, 18 nt, Salmonella enterica enterica serovar Typhi
aagcuggauaccgcgcca

SEQ ID NO: 3673285 - RNA, 21 nt, Salmonella enterica enterica serovar Typhi
aagcugggaaacuuaucagua

SEQ ID NO: 3673286 - RNA, 20 nt, Salmonella enterica enterica serovar Typhi
aagcugggcgucaacgugaa

SEQ ID NO: 3673287 - RNA, 18 nt, Salmonella enterica enterica serovar Typhi
aagcugggcguuacuggc

SEQ ID NO: 3673288 - RNA, 22 nt, Salmonella enterica enterica serovar Typhi
aagcugguggcgaguccugccg

SEQ ID NO: 3673289 - RNA, 16 nt, Salmonella enterica enterica serovar Typhi
aagcuguaacacugcc

SEQ ID NO: 3673290 - RNA, 19 nt, Salmonella enterica enterica serovar Typhi
aagcuguaacacugccgaa

SEQ ID NO: 3673291 - RNA, 21 nt, Salmonella enterica enterica serovar Typhi
aagcugugcguugucuaccgc

SEQ ID NO: 3673292 - RNA, 21 nt, Salmonella enterica enterica serovar Typhi
aagcuguugugucccggccca

SEQ ID NO: 3673293 - RNA, 17 nt, Salmonella enterica enterica serovar Typhi
aagcuuaggauaagaau

SEQ ID NO: 3673294 - RNA, 13 nt, Salmonella enterica enterica serovar Typhi
aagcuuguagaaa

SEQ ID NO: 3673295 - RNA, 14 nt, Salmonella enterica enterica serovar Typhi
aagcuuguagaaaa

SEQ ID NO: 3673296 - RNA, 18 nt, Salmonella enterica enterica serovar Typhi
aagcuuucugaauuucac

SEQ ID NO: 3673297 - RNA, 13 nt, Salmonella enterica enterica serovar Typhi
aagcuuucuguua

SEQ ID NO: 3673298 - RNA, 17 nt, Salmonella enterica enterica serovar Typhi
aagcuuugcguaaaaaa

SEQ ID NO: 3673299 - RNA, 19 nt, Salmonella enterica enterica serovar Typhi
aagcuuugcguaaaaaaca

SEQ ID NO: 3673300 - RNA, 20 nt, Salmonella enterica enterica serovar Typhi
aagcuuugcguaaaaaacau

SEQ ID NO: 3673301 - RNA, 22 nt, Salmonella enterica enterica serovar Typhi
aaggaaacuuauuucaacuuau

SEQ ID NO: 3673302 - RNA, 13 nt, Salmonella enterica enterica serovar Typhi
aaggaaauauuaa

SEQ ID NO: 3673303 - RNA, 15 nt, Salmonella enterica enterica serovar Typhi
aaggaaauauuaauu

SEQ ID NO: 3673304 - RNA, 13 nt, Salmonella enterica enterica serovar Typhi
aaggaagauagcg

SEQ ID NO: 3673305 - RNA, 19 nt, Salmonella enterica enterica serovar Typhi
aaggaauuaugcagacgcu

SEQ ID NO: 3673306 - RNA, 20 nt, Salmonella enterica enterica serovar Typhi
aaggacaagcugauuuuucg

SEQ ID NO: 3673307 - RNA, 14 nt, Salmonella enterica enterica serovar Typhi
aaggacaagcugcg

SEQ ID NO: 3673308 - RNA, 15 nt, Salmonella enterica enterica serovar Typhi
aaggauacagcgccg

SEQ ID NO: 3673309 - RNA, 12 nt, Salmonella enterica enterica serovar Typhi
aaggauauugcc

SEQ ID NO: 3673310 - RNA, 23 nt, Salmonella enterica enterica serovar Typhi
aaggaugaacucuaugcaaaaga

SEQ ID NO: 3673311 - RNA, 17 nt, Salmonella enterica enterica serovar Typhi
aaggaugacuaaucaau

SEQ ID NO: 3673312 - RNA, 14 nt, Salmonella enterica enterica serovar Typhi
aaggaugcccguag

SEQ ID NO: 3673313 - RNA, 20 nt, Salmonella enterica enterica serovar Typhi
aaggauuauuggcaucauaa

SEQ ID NO: 3673314 - RNA, 16 nt, Salmonella enterica enterica serovar Typhi
aaggcaacgccgccag

SEQ ID NO: 3673315 - RNA, 18 nt, Salmonella enterica enterica serovar Typhi
aaggcagaagaaucugcc

SEQ ID NO: 3673316 - RNA, 20 nt, Salmonella enterica enterica serovar Typhi
aaggcagcaaugugcgccag

SEQ ID NO: 3673317 - RNA, 19 nt, Salmonella enterica enterica serovar Typhi
aaggcaucgucggcgauug

SEQ ID NO: 3673318 - RNA, 20 nt, Salmonella enterica enterica serovar Typhi
aaggcaucguugagaaaacc

SEQ ID NO: 3673319 - RNA, 14 nt, Salmonella enterica enterica serovar Typhi
aaggcaucuucaga

SEQ ID NO: 3673320 - RNA, 15 nt, Salmonella enterica enterica serovar Typhi
aaggcaucuucagac

SEQ ID NO: 3673321 - RNA, 20 nt, Salmonella enterica enterica serovar Typhi
aaggcaucuucagacaguuu

SEQ ID NO: 3673322 - RNA, 19 nt, Salmonella enterica enterica serovar Typhi
aaggcaugaugccacgaga

SEQ ID NO: 3673323 - RNA, 19 nt, Salmonella enterica enterica serovar Typhi
aaggcaugauuaaagccac

SEQ ID NO: 3673324 - RNA, 16 nt, Salmonella enterica enterica serovar Typhi
aaggcauucaggccgg

SEQ ID NO: 3673325 - RNA, 20 nt, Salmonella enterica enterica serovar Typhi
aaggcauuuaugccgccauc

SEQ ID NO: 3673326 - RNA, 19 nt, Salmonella enterica enterica serovar Typhi
aaggcauuucaaucgccac

SEQ ID NO: 3673327 - RNA, 19 nt, Salmonella enterica enterica serovar Typhi
aaggcauuucgccgccauc

SEQ ID NO: 3673328 - RNA, 17 nt, Salmonella enterica enterica serovar Typhi
aaggccaaguuuagaaa

SEQ ID NO: 3673329 - RNA, 17 nt, Salmonella enterica enterica serovar Typhi
aaggccacgccgccauc

SEQ ID NO: 3673330 - RNA, 20 nt, Salmonella enterica enterica serovar Typhi
aaggccggcagccgcugaua

SEQ ID NO: 3673331 - RNA, 18 nt, Salmonella enterica enterica serovar Typhi
aaggccgggaaaucuucu

SEQ ID NO: 3673332 - RNA, 22 nt, Salmonella enterica enterica serovar Typhi
aaggccucaucgggacggcggu

SEQ ID NO: 3673333 - RNA, 23 nt, Salmonella enterica enterica serovar Typhi
aaggccuggcugagaaaaauacg

SEQ ID NO: 3673334 - RNA, 20 nt, Salmonella enterica enterica serovar Typhi
aaggccuuauccggccuacg

SEQ ID NO: 3673335 - RNA, 19 nt, Salmonella enterica enterica serovar Typhi
aaggcgaacuccagcgcga

SEQ ID NO: 3673336 - RNA, 22 nt, Salmonella enterica enterica serovar Typhi
aaggcgacgaugugcauaaccg

SEQ ID NO: 3673337 - RNA, 17 nt, Salmonella enterica enterica serovar Typhi
aaggcgacgcuucacgu

SEQ ID NO: 3673338 - RNA, 18 nt, Salmonella enterica enterica serovar Typhi
aaggcgauucaacagggc

SEQ ID NO: 3673339 - RNA, 14 nt, Salmonella enterica enterica serovar Typhi
aaggcgccuuuuuu

SEQ ID NO: 3673340 - RNA, 15 nt, Salmonella enterica enterica serovar Typhi
aaggcgcuagccgca

SEQ ID NO: 3673341 - RNA, 12 nt, Salmonella enterica enterica serovar Typhi
aaguuaugcauc

SEQ ID NO: 3673342 - RNA, 14 nt, Salmonella enterica enterica serovar Typhi
aaguucagccgaua

SEQ ID NO: 3673343 - RNA, 13 nt, Salmonella enterica enterica serovar Typhi
aaguucagggcga

SEQ ID NO: 3673344 - RNA, 15 nt, Salmonella enterica enterica serovar Typhi
aaguucauaaaugua

SEQ ID NO: 3673345 - RNA, 15 nt, Salmonella enterica enterica serovar Typhi
aaguucuuguuucau

SEQ ID NO: 3673346 - RNA, 15 nt, Salmonella enterica enterica serovar Typhi
aaguugaucauccuu

SEQ ID NO: 3673347 - RNA, 17 nt, Salmonella enterica enterica serovar Typhi
aaguugcgccacugcca

SEQ ID NO: 3673348 - RNA, 18 nt, Salmonella enterica enterica serovar Typhi
aaguuguugaccaacaau

SEQ ID NO: 3673349 - RNA, 15 nt, Salmonella enterica enterica serovar Typhi
aaguuuagaaaaaau

SEQ ID NO: 3673350 - RNA, 20 nt, Salmonella enterica enterica serovar Typhi
aaguuuagaaaaaauuaaaa

SEQ ID NO: 3673351 - RNA, 19 nt, Salmonella enterica enterica serovar Typhi
aaguuugaugcaaauguca

SEQ ID NO: 3673352 - RNA, 15 nt, Salmonella enterica enterica serovar Typhi
aaguuuuucucuuau

SEQ ID NO: 3673353 - RNA, 14 nt, Salmonella enterica enterica serovar Typhi
aauaaaaaaaccuc

SEQ ID NO: 3673354 - RNA, 21 nt, Salmonella enterica enterica serovar Typhi
aauaaaacugccgucaauuuu

SEQ ID NO: 3673355 - RNA, 12 nt, Salmonella enterica enterica serovar Typhi
aauaaaaggaau

SEQ ID NO: 3673356 - RNA, 11 nt, Salmonella enterica enterica serovar Typhi
aauaaaaguug

SEQ ID NO: 3673357 - RNA, 13 nt, Salmonella enterica enterica serovar Typhi
aauaaaauaacua

SEQ ID NO: 3673358 - RNA, 14 nt, Salmonella enterica enterica serovar Typhi
aauaaaauuauauu

SEQ ID NO: 3673359 - RNA, 18 nt, Salmonella enterica enterica serovar Typhi
aauaaacaaaaaccugcu

SEQ ID NO: 3673360 - RNA, 13 nt, Salmonella enterica enterica serovar Typhi
aauaaacauuuuu

SEQ ID NO: 3673361 - RNA, 20 nt, Salmonella enterica enterica serovar Typhi
aauaaacauuuuuuuugcau

SEQ ID NO: 3673362 - RNA, 22 nt, Salmonella enterica enterica serovar Typhi
aauaaacgccaguggaugcgcu

SEQ ID NO: 3673363 - RNA, 17 nt, Salmonella enterica enterica serovar Typhi
aauaaacugcauccccu

SEQ ID NO: 3673364 - RNA, 18 nt, Salmonella enterica enterica serovar Typhi
aauaaagaaagcauuaaa

SEQ ID NO: 3673365 - RNA, 15 nt, Salmonella enterica enterica serovar Typhi
aauaaagacuggccc

SEQ ID NO: 3673366 - RNA, 22 nt, Salmonella enterica enterica serovar Typhi
aauaaagagcacuucugacauu

SEQ ID NO: 3673367 - RNA, 20 nt, Salmonella enterica enterica serovar Typhi
aauaaagcccuguuauucag

SEQ ID NO: 3673368 - RNA, 21 nt, Salmonella enterica enterica serovar Typhi
aauaaagcggucuuucaacau

SEQ ID NO: 3673369 - RNA, 20 nt, Salmonella enterica enterica serovar Typhi
aauaaaggcgcuguuggcau

SEQ ID NO: 3673370 - RNA, 13 nt, Salmonella enterica enterica serovar Typhi
aauaaagugcuga

SEQ ID NO: 3673371 - RNA, 14 nt, Salmonella enterica enterica serovar Typhi
aauaaagugcugaa

SEQ ID NO: 3673372 - RNA, 16 nt, Salmonella enterica enterica serovar Typhi
aauaaaguuuauuuga

SEQ ID NO: 3673373 - RNA, 14 nt, Salmonella enterica enterica serovar Typhi
aauaaauaauaucg

SEQ ID NO: 3673374 - RNA, 19 nt, Salmonella enterica enterica serovar Typhi
aauaaauaguaaauagaaa

SEQ ID NO: 3673375 - RNA, 22 nt, Salmonella enterica enterica serovar Typhi
aauaaauaguaaauagaaaaua

SEQ ID NO: 3673376 - RNA, 15 nt, Salmonella enterica enterica serovar Typhi
aauaaaucaaugaaa

SEQ ID NO: 3673377 - RNA, 20 nt, Salmonella enterica enterica serovar Typhi
aauaaauccaugagaagaaa

SEQ ID NO: 3673378 - RNA, 17 nt, Salmonella enterica enterica serovar Typhi
aauaaaugauauuuaaa

SEQ ID NO: 3673379 - RNA, 23 nt, Salmonella enterica enterica serovar Typhi
aauaaauucuuuacgcagcaaga

SEQ ID NO: 3673380 - RNA, 23 nt, Salmonella enterica enterica serovar Typhi
aauaaauugaauucgcuaauaaa

SEQ ID NO: 3673381 - RNA, 13 nt, Salmonella enterica enterica serovar Typhi
aauaacaaaugaa

SEQ ID NO: 3673382 - RNA, 14 nt, Salmonella enterica enterica serovar Typhi
aauaacaccacaac

SEQ ID NO: 3673383 - RNA, 12 nt, Salmonella enterica enterica serovar Typhi
aauaacaucuuc

SEQ ID NO: 3673384 - RNA, 15 nt, Salmonella enterica enterica serovar Typhi
aauaaccaccuguuc

SEQ ID NO: 3673385 - RNA, 19 nt, Salmonella enterica enterica serovar Typhi
aauaaccccagcugcggca

SEQ ID NO: 3673386 - RNA, 16 nt, Salmonella enterica enterica serovar Typhi
aauaacccggauuguc

SEQ ID NO: 3673387 - RNA, 20 nt, Salmonella enterica enterica serovar Typhi
aauaaccggcagaccggaaa

SEQ ID NO: 3673388 - RNA, 19 nt, Salmonella enterica enterica serovar Typhi
aauaaccucaacgucgcuc

SEQ ID NO: 3673389 - RNA, 20 nt, Salmonella enterica enterica serovar Typhi
aauaacgaugaugaaaaaga

SEQ ID NO: 3673390 - RNA, 19 nt, Salmonella enterica enterica serovar Typhi
aauaacgcgagaagaagaa

SEQ ID NO: 3673391 - RNA, 21 nt, Salmonella enterica enterica serovar Typhi
aauaacgggcacggucugcug

SEQ ID NO: 3673392 - RNA, 20 nt, Salmonella enterica enterica serovar Typhi
aauaacgguaacggacauaa

SEQ ID NO: 3673393 - RNA, 20 nt, Salmonella enterica enterica serovar Typhi
aauaacgguagagaaugguc

SEQ ID NO: 3673394 - RNA, 13 nt, Salmonella enterica enterica serovar Typhi
aauaacguaaccg

SEQ ID NO: 3673395 - RNA, 17 nt, Salmonella enterica enterica serovar Typhi
aauaacguguaauuuca

SEQ ID NO: 3673396 - RNA, 21 nt, Salmonella enterica enterica serovar Typhi
aauaacguguaauuucauaau

SEQ ID NO: 3673397 - RNA, 22 nt, Salmonella enterica enterica serovar Typhi
aauaacguguaauuucauaaua

SEQ ID NO: 3673398 - RNA, 16 nt, Salmonella enterica enterica serovar Typhi
aauaacgugucaggau

SEQ ID NO: 3673399 - RNA, 23 nt, Salmonella enterica enterica serovar Typhi
aauaacucagcccauaagcuuag

SEQ ID NO: 3673400 - RNA, 19 nt, Salmonella enterica enterica serovar Typhi
aauaacuccagugcagaaa

SEQ ID NO: 3673401 - RNA, 17 nt, Salmonella enterica enterica serovar Typhi
aauaacugacagacuca

SEQ ID NO: 3673402 - RNA, 21 nt, Salmonella enterica enterica serovar Typhi
aauaacuuuuaauuuuuaugu

SEQ ID NO: 3673403 - RNA, 14 nt, Salmonella enterica enterica serovar Typhi
aauaagaaacugcu

SEQ ID NO: 3673404 - RNA, 16 nt, Salmonella enterica enterica serovar Typhi
aauaagaacuuuauca

SEQ ID NO: 3673405 - RNA, 18 nt, Salmonella enterica enterica serovar Typhi
aauaagaagguuaauaua

SEQ ID NO: 3673406 - RNA, 21 nt, Salmonella enterica enterica serovar Typhi
aauaagaagguuaauauacau

SEQ ID NO: 3673407 - RNA, 20 nt, Salmonella enterica enterica serovar Typhi
aauaagacauggaguuccag

SEQ ID NO: 3673408 - RNA, 22 nt, Salmonella enterica enterica serovar Typhi
aauaagcagaacguagcccauu

SEQ ID NO: 3673409 - RNA, 14 nt, Salmonella enterica enterica serovar Typhi
aauaagccagacuc

SEQ ID NO: 3673410 - RNA, 12 nt, Salmonella enterica enterica serovar Typhi
aauaagcgaauu

SEQ ID NO: 3673411 - RNA, 15 nt, Salmonella enterica enterica serovar Typhi
aauaagcgcucaggc

SEQ ID NO: 3673412 - RNA, 23 nt, Salmonella enterica enterica serovar Typhi
aauaagcuccgggacauccggau

SEQ ID NO: 3673413 - RNA, 20 nt, Salmonella enterica enterica serovar Typhi
aauaagggcauguuucaugu

SEQ ID NO: 3673414 - RNA, 17 nt, Salmonella enterica enterica serovar Typhi
aauaagguggcuaaccc

SEQ ID NO: 3673415 - RNA, 21 nt, Salmonella enterica enterica serovar Typhi
aauaaguuagcuuuuuuaugc

SEQ ID NO: 3673416 - RNA, 20 nt, Salmonella enterica enterica serovar Typhi
aauaauaaaacgacucauca

SEQ ID NO: 3673417 - RNA, 20 nt, Salmonella enterica enterica serovar Typhi
aauaauaugccccgacauca

SEQ ID NO: 3673418 - RNA, 13 nt, Salmonella enterica enterica serovar Typhi
aauaauauuauug

SEQ ID NO: 3673419 - RNA, 23 nt, Salmonella enterica enterica serovar Typhi
aauaauccuucccgcuauagaau

SEQ ID NO: 3673420 - RNA, 18 nt, Salmonella enterica enterica serovar Typhi
aauaaucgccgccgguaa

SEQ ID NO: 3673421 - RNA, 13 nt, Salmonella enterica enterica serovar Typhi
aauaaucgccggg

SEQ ID NO: 3673422 - RNA, 19 nt, Salmonella enterica enterica serovar Typhi
aauaaugaacgagcaauaa

SEQ ID NO: 3673423 - RNA, 15 nt, Salmonella enterica enterica serovar Typhi
aauaaugaccagcgc

SEQ ID NO: 3673424 - RNA, 19 nt, Salmonella enterica enterica serovar Typhi
aauaauggagaugaaaaua

SEQ ID NO: 3673425 - RNA, 14 nt, Salmonella enterica enterica serovar Typhi
aauaauguaaaaaa

SEQ ID NO: 3673426 - RNA, 16 nt, Salmonella enterica enterica serovar Typhi
aauaauguaaaaaaau

SEQ ID NO: 3673427 - RNA, 21 nt, Salmonella enterica enterica serovar Typhi
aauagcgcugaggcgcuggcu

SEQ ID NO: 3673428 - RNA, 15 nt, Salmonella enterica enterica serovar Typhi
aauagcuggcugucu

SEQ ID NO: 3673429 - RNA, 22 nt, Salmonella enterica enterica serovar Typhi
aauagcuuuuuacucagggcaa

SEQ ID NO: 3673430 - RNA, 17 nt, Salmonella enterica enterica serovar Typhi
aauaggcgaggaaaaca

SEQ ID NO: 3673431 - RNA, 16 nt, Salmonella enterica enterica serovar Typhi
aauaguaaauagaaaa

SEQ ID NO: 3673432 - RNA, 22 nt, Salmonella enterica enterica serovar Typhi
aauaguauggagcaggaaaaga

SEQ ID NO: 3673433 - RNA, 14 nt, Salmonella enterica enterica serovar Typhi
aauagugcaggaag

SEQ ID NO: 3673434 - RNA, 22 nt, Salmonella enterica enterica serovar Typhi
aauagugcggccaaauugcucg

SEQ ID NO: 3673435 - RNA, 21 nt, Salmonella enterica enterica serovar Typhi
aauagugggguguaaagucgg

SEQ ID NO: 3673436 - RNA, 18 nt, Salmonella enterica enterica serovar Typhi
aauaguguggaugucaua

SEQ ID NO: 3673437 - RNA, 15 nt, Salmonella enterica enterica serovar Typhi
aauaguuacuguuuc

SEQ ID NO: 3673438 - RNA, 14 nt, Salmonella enterica enterica serovar Typhi
aauauaaccaauuu

SEQ ID NO: 3673439 - RNA, 19 nt, Salmonella enterica enterica serovar Typhi
aauauaauccuuguccaug

SEQ ID NO: 3673440 - RNA, 14 nt, Salmonella enterica enterica serovar Typhi
aauauaaucuacca

SEQ ID NO: 3673441 - RNA, 14 nt, Salmonella enterica enterica serovar Typhi
aauauaauuauuau

SEQ ID NO: 3673442 - RNA, 18 nt, Salmonella enterica enterica serovar Typhi
aauauacauucauuuuau

SEQ ID NO: 3673443 - RNA, 21 nt, Salmonella enterica enterica serovar Typhi
aauauacauucauuuuaucga

SEQ ID NO: 3673444 - RNA, 16 nt, Salmonella enterica enterica serovar Typhi
aauauacuuaucggcg

SEQ ID NO: 3673445 - RNA, 16 nt, Salmonella enterica enterica serovar Typhi
aauauagcuaaugcaa

SEQ ID NO: 3673446 - RNA, 15 nt, Salmonella enterica enterica serovar Typhi
aauauaguuagaaaa

SEQ ID NO: 3673447 - RNA, 18 nt, Salmonella enterica enterica serovar Typhi
aauauaguuagaaaauac

SEQ ID NO: 3673448 - RNA, 19 nt, Salmonella enterica enterica serovar Typhi
aauauaguuagaaaauacu

SEQ ID NO: 3673449 - RNA, 22 nt, Salmonella enterica enterica serovar Typhi
aauauaucgcaggaugcgcugc

SEQ ID NO: 3673450 - RNA, 17 nt, Salmonella enterica enterica serovar Typhi
aauauaugacaacacuc

SEQ ID NO: 3673451 - RNA, 13 nt, Salmonella enterica enterica serovar Typhi
aauaucaaucagc

SEQ ID NO: 3673452 - RNA, 23 nt, Salmonella enterica enterica serovar Typhi
aauaucaauucaacacuuagaac

SEQ ID NO: 3673453 - RNA, 20 nt, Salmonella enterica enterica serovar Typhi
aauaucagccauuaaccaga

SEQ ID NO: 3673454 - RNA, 21 nt, Salmonella enterica enterica serovar Typhi
aauaucauccgguaucaugcu

SEQ ID NO: 3673455 - RNA, 22 nt, Salmonella enterica enterica serovar Typhi
aauaucaucgucauuaaugccu

SEQ ID NO: 3673456 - RNA, 14 nt, Salmonella enterica enterica serovar Typhi
aauaucaugaauaa

SEQ ID NO: 3673457 - RNA, 16 nt, Salmonella enterica enterica serovar Typhi
aauaucaugaauaauc

SEQ ID NO: 3673458 - RNA, 18 nt, Salmonella enterica enterica serovar Typhi
aauaucauuaauuauacu

SEQ ID NO: 3673459 - RNA, 22 nt, Salmonella enterica enterica serovar Typhi
aauaucauucgcgucauacuua

SEQ ID NO: 3673460 - RNA, 14 nt, Salmonella enterica enterica serovar Typhi
aauaucccgaugac

SEQ ID NO: 3673461 - RNA, 23 nt, Salmonella enterica enterica serovar Typhi
aauaucccgcaagaaacaggcug

SEQ ID NO: 3673462 - RNA, 19 nt, Salmonella enterica enterica serovar Typhi
aauauccgccccgcuggcu

SEQ ID NO: 3673463 - RNA, 19 nt, Salmonella enterica enterica serovar Typhi
aauauccgguacaccaacu

SEQ ID NO: 3673464 - RNA, 20 nt, Salmonella enterica enterica serovar Typhi
aauauccgguacaccaacua

SEQ ID NO: 3673465 - RNA, 14 nt, Salmonella enterica enterica serovar Typhi
aauauccuccggcg

SEQ ID NO: 3673466 - RNA, 12 nt, Salmonella enterica enterica serovar Typhi
aauauccuucag

SEQ ID NO: 3673467 - RNA, 23 nt, Salmonella enterica enterica serovar Typhi
aauaucgaaauuggaguuaucau

SEQ ID NO: 3673468 - RNA, 21 nt, Salmonella enterica enterica serovar Typhi
aauaucgcggaaauucacuuc

SEQ ID NO: 3673469 - RNA, 16 nt, Salmonella enterica enterica serovar Typhi
aauaucggcgucaacg

SEQ ID NO: 3673470 - RNA, 14 nt, Salmonella enterica enterica serovar Typhi
aauaucgucaguau

SEQ ID NO: 3673471 - RNA, 12 nt, Salmonella enterica enterica serovar Typhi
aauaucucuccc

SEQ ID NO: 3673472 - RNA, 14 nt, Salmonella enterica enterica serovar Typhi
aauaugaaagagaa

SEQ ID NO: 3673473 - RNA, 11 nt, Salmonella enterica enterica serovar Typhi
aauaugaaauu

SEQ ID NO: 3673474 - RNA, 14 nt, Salmonella enterica enterica serovar Typhi
aauaugaauauccg

SEQ ID NO: 3673475 - RNA, 14 nt, Salmonella enterica enterica serovar Typhi
aauaugauuuaaaa

SEQ ID NO: 3673476 - RNA, 17 nt, Salmonella enterica enterica serovar Typhi
aauaugauuuaaaaaag

SEQ ID NO: 3673477 - RNA, 15 nt, Salmonella enterica enterica serovar Typhi
aauaugccagauauu

SEQ ID NO: 3673478 - RNA, 13 nt, Salmonella enterica enterica serovar Typhi
aauaugccaggca

SEQ ID NO: 3673479 - RNA, 14 nt, Salmonella enterica enterica serovar Typhi
aauaugccaggcau

SEQ ID NO: 3673480 - RNA, 15 nt, Salmonella enterica enterica serovar Typhi
aauaugccugcacua

SEQ ID NO: 3673481 - RNA, 17 nt, Salmonella enterica enterica serovar Typhi
aauaugcgucagauaaa

SEQ ID NO: 3673482 - RNA, 16 nt, Salmonella enterica enterica serovar Typhi
aauaugcgucagcgcg

SEQ ID NO: 3673483 - RNA, 13 nt, Salmonella enterica enterica serovar Typhi
aauauggaauauc

SEQ ID NO: 3673484 - RNA, 21 nt, Salmonella enterica enterica serovar Typhi
aauaugggauuugaugcccaa

SEQ ID NO: 3673485 - RNA, 17 nt, Salmonella enterica enterica serovar Typhi
aauauguuccacaauca

SEQ ID NO: 3673486 - RNA, 20 nt, Salmonella enterica enterica serovar Typhi
aauauuagcgguacucuuuu

SEQ ID NO: 3673487 - RNA, 16 nt, Salmonella enterica enterica serovar Typhi
aauauuaucgccauca

SEQ ID NO: 3673488 - RNA, 19 nt, Salmonella enterica enterica serovar Typhi
aauauucagaauaugccag

SEQ ID NO: 3673489 - RNA, 14 nt, Salmonella enterica enterica serovar Typhi
aauauucagcacau

SEQ ID NO: 3673490 - RNA, 21 nt, Salmonella enterica enterica serovar Typhi
aauauucauucugucagaaau

SEQ ID NO: 3673491 - RNA, 14 nt, Salmonella enterica enterica serovar Typhi
aauauucauuucca

SEQ ID NO: 3673492 - RNA, 15 nt, Salmonella enterica enterica serovar Typhi
aauauugacaguaau

SEQ ID NO: 3673493 - RNA, 21 nt, Salmonella enterica enterica serovar Typhi
aauauugccauaaauacaauu

SEQ ID NO: 3673494 - RNA, 13 nt, Salmonella enterica enterica serovar Typhi
aauauuggcuucu

SEQ ID NO: 3673495 - RNA, 15 nt, Salmonella enterica enterica serovar Typhi
aauauuuaacacauu

SEQ ID NO: 3673496 - RNA, 14 nt, Salmonella enterica enterica serovar Typhi
aauauuuauuauuu

SEQ ID NO: 3673497 - RNA, 19 nt, Salmonella enterica enterica serovar Typhi
aauauuuauuuaauguuuc

SEQ ID NO: 3673498 - RNA, 18 nt, Salmonella enterica enterica serovar Typhi
aauauuucuuugucgcca

SEQ ID NO: 3673499 - RNA, 21 nt, Salmonella enterica enterica serovar Typhi
aauauuugaaucucagacgcc

SEQ ID NO: 3673500 - RNA, 11 nt, Salmonella enterica enterica serovar Typhi
aauauuuuucc

SEQ ID NO: 3673501 - RNA, 12 nt, Salmonella enterica enterica serovar Typhi
aauauuuuuccg

SEQ ID NO: 3673502 - RNA, 22 nt, Salmonella enterica enterica serovar Typhi
aaucaacacgucgauuuucccu

SEQ ID NO: 3673503 - RNA, 20 nt, Salmonella enterica enterica serovar Typhi
aaucaacauuauuaaaaugu

SEQ ID NO: 3673504 - RNA, 13 nt, Salmonella enterica enterica serovar Typhi
aaucaaccauaca

SEQ ID NO: 3673505 - RNA, 14 nt, Salmonella enterica enterica serovar Typhi
aaucaaccggguaa

SEQ ID NO: 3673506 - RNA, 22 nt, Salmonella enterica enterica serovar Typhi
aaucaacgccacaccgagacag

SEQ ID NO: 3673507 - RNA, 15 nt, Salmonella enterica enterica serovar Typhi
aaucaacguagaauc

SEQ ID NO: 3673508 - RNA, 20 nt, Salmonella enterica enterica serovar Typhi
aaucaacugcgccacaucau

SEQ ID NO: 3673509 - RNA, 17 nt, Salmonella enterica enterica serovar Typhi
aaucaagcccagcucag

SEQ ID NO: 3673510 - RNA, 21 nt, Salmonella enterica enterica serovar Typhi
aaucaagccuaucaccgcgau

SEQ ID NO: 3673511 - RNA, 15 nt, Salmonella enterica enterica serovar Typhi
aaucaauacugccau

SEQ ID NO: 3673512 - RNA, 22 nt, Salmonella enterica enterica serovar Typhi
aaucaauggccuugccagcgag

SEQ ID NO: 3673513 - RNA, 12 nt, Salmonella enterica enterica serovar Typhi
aaucgacucacg

SEQ ID NO: 3673514 - RNA, 13 nt, Salmonella enterica enterica serovar Typhi
aaucgagcccaga

SEQ ID NO: 3673515 - RNA, 18 nt, Salmonella enterica enterica serovar Typhi
aaucgauaagccagcgau

SEQ ID NO: 3673516 - RNA, 15 nt, Salmonella enterica enterica serovar Typhi
aaucgcaaacgccag

SEQ ID NO: 3673517 - RNA, 17 nt, Salmonella enterica enterica serovar Typhi
aaucgcaucauaaaugg

SEQ ID NO: 3673518 - RNA, 23 nt, Salmonella enterica enterica serovar Typhi
aaucgccagcaucggcagcgcca

SEQ ID NO: 3673519 - RNA, 17 nt, Salmonella enterica enterica serovar Typhi
aaucgccaucagcgcga

SEQ ID NO: 3673520 - RNA, 20 nt, Salmonella enterica enterica serovar Typhi
aaucgccccauuggcgucga

SEQ ID NO: 3673521 - RNA, 15 nt, Salmonella enterica enterica serovar Typhi
aaucgccgccgccag

SEQ ID NO: 3673522 - RNA, 23 nt, Salmonella enterica enterica serovar Typhi
aaucgccgcgccggacuccagca

SEQ ID NO: 3673523 - RNA, 16 nt, Salmonella enterica enterica serovar Typhi
aaucgccgggcggcgc

SEQ ID NO: 3673524 - RNA, 21 nt, Salmonella enterica enterica serovar Typhi
aaucgccgucagugagcccuc

SEQ ID NO: 3673525 - RNA, 14 nt, Salmonella enterica enterica serovar Typhi
aaucgccucaacca

SEQ ID NO: 3673526 - RNA, 16 nt, Salmonella enterica enterica serovar Typhi
aaucgccucaaccaac

SEQ ID NO: 3673527 - RNA, 20 nt, Salmonella enterica enterica serovar Typhi
aaucgccugcuguacuuuug

SEQ ID NO: 3673528 - RNA, 20 nt, Salmonella enterica enterica serovar Typhi
aaucgccuggcuugccggca

SEQ ID NO: 3673529 - RNA, 17 nt, Salmonella enterica enterica serovar Typhi
aaucgcgaauaaaugag

SEQ ID NO: 3673530 - RNA, 18 nt, Salmonella enterica enterica serovar Typhi
aaucgcgagccuucaaca

SEQ ID NO: 3673531 - RNA, 19 nt, Salmonella enterica enterica serovar Typhi
aaucgcgguaaaaagcuga

SEQ ID NO: 3673532 - RNA, 12 nt, Salmonella enterica enterica serovar Typhi
aaucgcguucgc

SEQ ID NO: 3673533 - RNA, 14 nt, Salmonella enterica enterica serovar Typhi
aaucgcguucgcgg

SEQ ID NO: 3673534 - RNA, 14 nt, Salmonella enterica enterica serovar Typhi
aaucgcuaaacaua

SEQ ID NO: 3673535 - RNA, 18 nt, Salmonella enterica enterica serovar Typhi
aaucgcuaaacauauacc

SEQ ID NO: 3673536 - RNA, 19 nt, Salmonella enterica enterica serovar Typhi
aaucgcuaaacauauaccg

SEQ ID NO: 3673537 - RNA, 14 nt, Salmonella enterica enterica serovar Typhi
aaucgcuuccuggg

SEQ ID NO: 3673538 - RNA, 19 nt, Salmonella enterica enterica serovar Typhi
aaucggcuaguaauaccag

SEQ ID NO: 3673539 - RNA, 23 nt, Salmonella enterica enterica serovar Typhi
aaucgggaucagaaauucgcagc

SEQ ID NO: 3673540 - RNA, 19 nt, Salmonella enterica enterica serovar Typhi
aaucgggcgcuaaacccaa

SEQ ID NO: 3673541 - RNA, 23 nt, Salmonella enterica enterica serovar Typhi
aaucgguaacaucaaguacagcu

SEQ ID NO: 3673542 - RNA, 19 nt, Salmonella enterica enterica serovar Typhi
aaucguauucauugccgua

SEQ ID NO: 3673543 - RNA, 14 nt, Salmonella enterica enterica serovar Typhi
aaucgucaucagau

SEQ ID NO: 3673544 - RNA, 22 nt, Salmonella enterica enterica serovar Typhi
aaucgucauugaccggaaaaaa

SEQ ID NO: 3673545 - RNA, 20 nt, Salmonella enterica enterica serovar Typhi
aaucgucgccaacaccgauc

SEQ ID NO: 3673546 - RNA, 15 nt, Salmonella enterica enterica serovar Typhi
aaucgucguuccgcc

SEQ ID NO: 3673547 - RNA, 18 nt, Salmonella enterica enterica serovar Typhi
aaucgugaccaccgccau

SEQ ID NO: 3673548 - RNA, 15 nt, Salmonella enterica enterica serovar Typhi
aaucgugcaauccug

SEQ ID NO: 3673549 - RNA, 20 nt, Salmonella enterica enterica serovar Typhi
aaucgugguuagacaucacg

SEQ ID NO: 3673550 - RNA, 14 nt, Salmonella enterica enterica serovar Typhi
aaucguucuugcac

SEQ ID NO: 3673551 - RNA, 21 nt, Salmonella enterica enterica serovar Typhi
aaucguucuugcacaauacuu

SEQ ID NO: 3673552 - RNA, 16 nt, Salmonella enterica enterica serovar Typhi
aaucuaagagccuguc

SEQ ID NO: 3673553 - RNA, 18 nt, Salmonella enterica enterica serovar Typhi
aaucuaagagccuguccc

SEQ ID NO: 3673554 - RNA, 19 nt, Salmonella enterica enterica serovar Typhi
aaucuaccauugauaccaa

SEQ ID NO: 3673555 - RNA, 23 nt, Salmonella enterica enterica serovar Typhi
aaucuaccauugauaccaauaaa

SEQ ID NO: 3673556 - RNA, 17 nt, Salmonella enterica enterica serovar Typhi
aaucucaauaccacgcc

SEQ ID NO: 3673557 - RNA, 20 nt, Salmonella enterica enterica serovar Typhi
aaucucacgcucauagccgc

SEQ ID NO: 3673558 - RNA, 13 nt, Salmonella enterica enterica serovar Typhi
aaucucagauaau

SEQ ID NO: 3673559 - RNA, 22 nt, Salmonella enterica enterica serovar Typhi
aaucucagauaauagcugcggc

SEQ ID NO: 3673560 - RNA, 23 nt, Salmonella enterica enterica serovar Typhi
aaucucagauaauagcugcggcu

SEQ ID NO: 3673561 - RNA, 20 nt, Salmonella enterica enterica serovar Typhi
aaucuccagaccgcugcgga

SEQ ID NO: 3673562 - RNA, 12 nt, Salmonella enterica enterica serovar Typhi
aaucuccagcau

SEQ ID NO: 3673563 - RNA, 15 nt, Salmonella enterica enterica serovar Typhi
aaucucgaaacaaua

SEQ ID NO: 3673564 - RNA, 15 nt, Salmonella enterica enterica serovar Typhi
aaucucuacacaacg

SEQ ID NO: 3673565 - RNA, 16 nt, Salmonella enterica enterica serovar Typhi
aaucucuggccaggca

SEQ ID NO: 3673566 - RNA, 15 nt, Salmonella enterica enterica serovar Typhi
aaucugccaucagca

SEQ ID NO: 3673567 - RNA, 18 nt, Salmonella enterica enterica serovar Typhi
aaucugccgucaucgacu

SEQ ID NO: 3673568 - RNA, 16 nt, Salmonella enterica enterica serovar Typhi
aaucuggauagucagg

SEQ ID NO: 3673569 - RNA, 20 nt, Salmonella enterica enterica serovar Typhi
aaucuggccuacggaaagcu

SEQ ID NO: 3673570 - RNA, 23 nt, Salmonella enterica enterica serovar Typhi
aaucuggcgcaaaugggccuacg

SEQ ID NO: 3673571 - RNA, 17 nt, Salmonella enterica enterica serovar Typhi
aaucuguagauugcgcg

SEQ ID NO: 3673572 - RNA, 14 nt, Salmonella enterica enterica serovar Typhi
aaucuguuccagcg

SEQ ID NO: 3673573 - RNA, 22 nt, Salmonella enterica enterica serovar Typhi
aaucuguuccagcgagcaggaa

SEQ ID NO: 3673574 - RNA, 22 nt, Salmonella enterica enterica serovar Typhi
aaucuucccaccgcgaauuuca

SEQ ID NO: 3673575 - RNA, 12 nt, Salmonella enterica enterica serovar Typhi
aaucuucgcggc

SEQ ID NO: 3673576 - RNA, 16 nt, Salmonella enterica enterica serovar Typhi
aaucuuuccagcucca

SEQ ID NO: 3673577 - RNA, 23 nt, Salmonella enterica enterica serovar Typhi
aaucuuucuguaagagacugaca

SEQ ID NO: 3673578 - RNA, 13 nt, Salmonella enterica enterica serovar Typhi
aaucuuugccgca

SEQ ID NO: 3673579 - RNA, 12 nt, Salmonella enterica enterica serovar Typhi
aaucuuuuauau

SEQ ID NO: 3673580 - RNA, 20 nt, Salmonella enterica enterica serovar Typhi
aaucuuuuauauguugaaua

SEQ ID NO: 3673581 - RNA, 15 nt, Salmonella enterica enterica serovar Typhi
aaugaaaacgaaucg

SEQ ID NO: 3673582 - RNA, 12 nt, Salmonella enterica enterica serovar Typhi
aaugaaaucguc

SEQ ID NO: 3673583 - RNA, 22 nt, Salmonella enterica enterica serovar Typhi
aaugaaaucgucgccaacaccg

SEQ ID NO: 3673584 - RNA, 16 nt, Salmonella enterica enterica serovar Typhi
aaugaacgagcaauaa

SEQ ID NO: 3673585 - RNA, 18 nt, Salmonella enterica enterica serovar Typhi
aaugaacguuuuguguca

SEQ ID NO: 3673586 - RNA, 21 nt, Salmonella enterica enterica serovar Typhi
aaugaacuacggcccuggcuc

SEQ ID NO: 3673587 - RNA, 13 nt, Salmonella enterica enterica serovar Typhi
aaugaagcauaaa

SEQ ID NO: 3673588 - RNA, 15 nt, Salmonella enterica enterica serovar Typhi
aaugaagcauaaaaa

SEQ ID NO: 3673589 - RNA, 18 nt, Salmonella enterica enterica serovar Typhi
aaugaagcauaaaaagac

SEQ ID NO: 3673590 - RNA, 13 nt, Salmonella enterica enterica serovar Typhi
aaugaagcgcguu

SEQ ID NO: 3673591 - RNA, 18 nt, Salmonella enterica enterica serovar Typhi
aaugaagcggaaaggacg

SEQ ID NO: 3673592 - RNA, 18 nt, Salmonella enterica enterica serovar Typhi
aaugaauuauuuuuucau

SEQ ID NO: 3673593 - RNA, 13 nt, Salmonella enterica enterica serovar Typhi
aaugacaaaaauu

SEQ ID NO: 3673594 - RNA, 11 nt, Salmonella enterica enterica serovar Typhi
aaugaccacaa

SEQ ID NO: 3673595 - RNA, 21 nt, Salmonella enterica enterica serovar Typhi
aaugaccacaccgucaacauc

SEQ ID NO: 3673596 - RNA, 15 nt, Salmonella enterica enterica serovar Typhi
aaugaccagaucaac

SEQ ID NO: 3673597 - RNA, 14 nt, Salmonella enterica enterica serovar Typhi
aaugaccagcgccc

SEQ ID NO: 3673598 - RNA, 15 nt, Salmonella enterica enterica serovar Typhi
aaugaccagcgccca

SEQ ID NO: 3673599 - RNA, 16 nt, Salmonella enterica enterica serovar Typhi
aauggccgcagcgcca

SEQ ID NO: 3673600 - RNA, 17 nt, Salmonella enterica enterica serovar Typhi
aauggccgcagcgccau

SEQ ID NO: 3673601 - RNA, 12 nt, Salmonella enterica enterica serovar Typhi
aauggccgcccc

SEQ ID NO: 3673602 - RNA, 20 nt, Salmonella enterica enterica serovar Typhi
aauggcgacgaucagcgcca

SEQ ID NO: 3673603 - RNA, 22 nt, Salmonella enterica enterica serovar Typhi
aauggcgacgaucagcgccacg

SEQ ID NO: 3673604 - RNA, 14 nt, Salmonella enterica enterica serovar Typhi
aauggcgcgaaaac

SEQ ID NO: 3673605 - RNA, 21 nt, Salmonella enterica enterica serovar Typhi
aauggcgcgucuuaaaauugc

SEQ ID NO: 3673606 - RNA, 19 nt, Salmonella enterica enterica serovar Typhi
aauggcgcguuuuaucaug

SEQ ID NO: 3673607 - RNA, 17 nt, Salmonella enterica enterica serovar Typhi
aauggcgugaaucaggc

SEQ ID NO: 3673608 - RNA, 21 nt, Salmonella enterica enterica serovar Typhi
aauggcuaugccgacaggggg

SEQ ID NO: 3673609 - RNA, 19 nt, Salmonella enterica enterica serovar Typhi
aauggcucaacuccgccgg

SEQ ID NO: 3673610 - RNA, 18 nt, Salmonella enterica enterica serovar Typhi
aauggggaucgucugcaa

SEQ ID NO: 3673611 - RNA, 23 nt, Salmonella enterica enterica serovar Typhi
aaugguauuaugcggaccgauag

SEQ ID NO: 3673612 - RNA, 18 nt, Salmonella enterica enterica serovar Typhi
aauggucccugauauaca

SEQ ID NO: 3673613 - RNA, 15 nt, Salmonella enterica enterica serovar Typhi
aaugguggucgccau

SEQ ID NO: 3673614 - RNA, 23 nt, Salmonella enterica enterica serovar Typhi
aaugguggucgcggccaccgcca

SEQ ID NO: 3673615 - RNA, 13 nt, Salmonella enterica enterica serovar Typhi
aaugguuauuaau

SEQ ID NO: 3673616 - RNA, 19 nt, Salmonella enterica enterica serovar Typhi
aaugguugucagaucgccc

SEQ ID NO: 3673617 - RNA, 13 nt, Salmonella enterica enterica serovar Typhi
aauguaaaacuga

SEQ ID NO: 3673618 - RNA, 15 nt, Salmonella enterica enterica serovar Typhi
aauguaaaacugacu

SEQ ID NO: 3673619 - RNA, 15 nt, Salmonella enterica enterica serovar Typhi
aauguacaucacauu

SEQ ID NO: 3673620 - RNA, 16 nt, Salmonella enterica enterica serovar Typhi
aauguacgccuaaaaa

SEQ ID NO: 3673621 - RNA, 12 nt, Salmonella enterica enterica serovar Typhi
aauguagcccca

SEQ ID NO: 3673622 - RNA, 13 nt, Salmonella enterica enterica serovar Typhi
aauguagcgcccu

SEQ ID NO: 3673623 - RNA, 14 nt, Salmonella enterica enterica serovar Typhi
aauguauuucagac

SEQ ID NO: 3673624 - RNA, 16 nt, Salmonella enterica enterica serovar Typhi
aauguauuuuuuguaa

SEQ ID NO: 3673625 - RNA, 12 nt, Salmonella enterica enterica serovar Typhi
aaugucaucauc

SEQ ID NO: 3673626 - RNA, 13 nt, Salmonella enterica enterica serovar Typhi
aauguccagcagu

SEQ ID NO: 3673627 - RNA, 20 nt, Salmonella enterica enterica serovar Typhi
aauguccagcagugucugcu

SEQ ID NO: 3673628 - RNA, 20 nt, Salmonella enterica enterica serovar Typhi
aaugucccaguaauaucgcc

SEQ ID NO: 3673629 - RNA, 16 nt, Salmonella enterica enterica serovar Typhi
aaugucgcgucagguu

SEQ ID NO: 3673630 - RNA, 21 nt, Salmonella enterica enterica serovar Typhi
aaugucggccugauuucugac

SEQ ID NO: 3673631 - RNA, 23 nt, Salmonella enterica enterica serovar Typhi
aaugucuuccuuuucuagccaau

SEQ ID NO: 3673632 - RNA, 18 nt, Salmonella enterica enterica serovar Typhi
aaugugaaauacagccag

SEQ ID NO: 3673633 - RNA, 17 nt, Salmonella enterica enterica serovar Typhi
aaugugaauccaggcca

SEQ ID NO: 3673634 - RNA, 19 nt, Salmonella enterica enterica serovar Typhi
aaugugccgguaagaagaa

SEQ ID NO: 3673635 - RNA, 17 nt, Salmonella enterica enterica serovar Typhi
aauguuaauaagcagaa

SEQ ID NO: 3673636 - RNA, 22 nt, Salmonella enterica enterica serovar Typhi
aauguuagcauuauuuuuaacc

SEQ ID NO: 3673637 - RNA, 15 nt, Salmonella enterica enterica serovar Typhi
aauguuagcgucugc

SEQ ID NO: 3673638 - RNA, 19 nt, Salmonella enterica enterica serovar Typhi
aauguuagcgucugcggcu

SEQ ID NO: 3673639 - RNA, 16 nt, Salmonella enterica enterica serovar Typhi
aauguuccgcagggga

SEQ ID NO: 3673640 - RNA, 17 nt, Salmonella enterica enterica serovar Typhi
aauguugguauauucga

SEQ ID NO: 3673641 - RNA, 19 nt, Salmonella enterica enterica serovar Typhi
aauguuuucugccagcaga

SEQ ID NO: 3673642 - RNA, 22 nt, Salmonella enterica enterica serovar Typhi
aauguuuuuguuguuaauuuga

SEQ ID NO: 3673643 - RNA, 18 nt, Salmonella enterica enterica serovar Typhi
aauuaaauaacaaaugaa

SEQ ID NO: 3673644 - RNA, 16 nt, Salmonella enterica enterica serovar Typhi
aauuaaaugcuugcuu

SEQ ID NO: 3673645 - RNA, 14 nt, Salmonella enterica enterica serovar Typhi
aauuaacaaauaaa

SEQ ID NO: 3673646 - RNA, 17 nt, Salmonella enterica enterica serovar Typhi
aauuaacauuuaagaaa

SEQ ID NO: 3673647 - RNA, 13 nt, Salmonella enterica enterica serovar Typhi
aauuaaccgauaa

SEQ ID NO: 3673648 - RNA, 21 nt, Salmonella enterica enterica serovar Typhi
aauuaacgacaaaaauaccac

SEQ ID NO: 3673649 - RNA, 14 nt, Salmonella enterica enterica serovar Typhi
aauuaauaaacaau

SEQ ID NO: 3673650 - RNA, 16 nt, Salmonella enterica enterica serovar Typhi
aauuaauauuuaacac

SEQ ID NO: 3673651 - RNA, 21 nt, Salmonella enterica enterica serovar Typhi
aauuaaucaggcauccugccc

SEQ ID NO: 3673652 - RNA, 16 nt, Salmonella enterica enterica serovar Typhi
aauuaaugauuaaaau

SEQ ID NO: 3673653 - RNA, 16 nt, Salmonella enterica enterica serovar Typhi
aauuacagcucauaaa

SEQ ID NO: 3673654 - RNA, 16 nt, Salmonella enterica enterica serovar Typhi
aauuacgccauaaaaa

SEQ ID NO: 3673655 - RNA, 22 nt, Salmonella enterica enterica serovar Typhi
aauuacguuggggauaaccaga

SEQ ID NO: 3673656 - RNA, 18 nt, Salmonella enterica enterica serovar Typhi
aauuacuaucuucaaagc

SEQ ID NO: 3673657 - RNA, 22 nt, Salmonella enterica enterica serovar Typhi
aauuacuccguuuuaaucuuuu

SEQ ID NO: 3673658 - RNA, 12 nt, Salmonella enterica enterica serovar Typhi
aauuacuuauga

SEQ ID NO: 3673659 - RNA, 13 nt, Salmonella enterica enterica serovar Typhi
aauuacuuaugau

SEQ ID NO: 3673660 - RNA, 16 nt, Salmonella enterica enterica serovar Typhi
aauuacuuaugauaua

SEQ ID NO: 3673661 - RNA, 19 nt, Salmonella enterica enterica serovar Typhi
aauuagacaagcaguucug

SEQ ID NO: 3673662 - RNA, 20 nt, Salmonella enterica enterica serovar Typhi
aauuagcgacauacauaacg

SEQ ID NO: 3673663 - RNA, 23 nt, Salmonella enterica enterica serovar Typhi
aauuagcucgggaauaaaaauaa

SEQ ID NO: 3673664 - RNA, 12 nt, Salmonella enterica enterica serovar Typhi
aauuauaaagca

SEQ ID NO: 3673665 - RNA, 22 nt, Salmonella enterica enterica serovar Typhi
aauuaucuguugauaaaacacu

SEQ ID NO: 3673666 - RNA, 17 nt, Salmonella enterica enterica serovar Typhi
aauuaugaauaaccauc

SEQ ID NO: 3673667 - RNA, 17 nt, Salmonella enterica enterica serovar Typhi
aauuaugaccaauguua

SEQ ID NO: 3673668 - RNA, 18 nt, Salmonella enterica enterica serovar Typhi
aauuaugccugucaucau

SEQ ID NO: 3673669 - RNA, 17 nt, Salmonella enterica enterica serovar Typhi
aauuauguauuucucgc

SEQ ID NO: 3673670 - RNA, 15 nt, Salmonella enterica enterica serovar Typhi
aauuauuaaaucaau

SEQ ID NO: 3673671 - RNA, 14 nt, Salmonella enterica enterica serovar Typhi
aauuauuacagaca

SEQ ID NO: 3673672 - RNA, 16 nt, Salmonella enterica enterica serovar Typhi
aauuauuaucaauuuc

SEQ ID NO: 3673673 - RNA, 18 nt, Salmonella enterica enterica serovar Typhi
aauuauuccuuaucacau

SEQ ID NO: 3673674 - RNA, 12 nt, Salmonella enterica enterica serovar Typhi
aauuauuuuuca

SEQ ID NO: 3673675 - RNA, 17 nt, Salmonella enterica enterica serovar Typhi
aauucaccaaauccuca

SEQ ID NO: 3673676 - RNA, 19 nt, Salmonella enterica enterica serovar Typhi
aauucaccaaauccucacu

SEQ ID NO: 3673677 - RNA, 19 nt, Salmonella enterica enterica serovar Typhi
aauucacccguuauucauu

SEQ ID NO: 3673678 - RNA, 18 nt, Salmonella enterica enterica serovar Typhi
aauucaccgcaugacaau

SEQ ID NO: 3673679 - RNA, 18 nt, Salmonella enterica enterica serovar Typhi
aauucacguuccauuuca

SEQ ID NO: 3673680 - RNA, 12 nt, Salmonella enterica enterica serovar Typhi
aauucagacuca

SEQ ID NO: 3673681 - RNA, 22 nt, Salmonella enterica enterica serovar Typhi
aauuccaggcccggugucagac

SEQ ID NO: 3673682 - RNA, 16 nt, Salmonella enterica enterica serovar Typhi
aauucccggcggaaau

SEQ ID NO: 3673683 - RNA, 20 nt, Salmonella enterica enterica serovar Typhi
aauuccgaugaaaaacugga

SEQ ID NO: 3673684 - RNA, 19 nt, Salmonella enterica enterica serovar Typhi
aauuccgcaggagagccag

SEQ ID NO: 3673685 - RNA, 16 nt, Salmonella enterica enterica serovar Typhi
aauuccgcaucauuca

SEQ ID NO: 3673686 - RNA, 17 nt, Salmonella enterica enterica serovar Typhi
aauuccgcaucauucau

SEQ ID NO: 3673687 - RNA, 14 nt, Salmonella enterica enterica serovar Typhi
aauuccgcauugag

SEQ ID NO: 3673688 - RNA, 19 nt, Salmonella enterica enterica serovar Typhi
aauuccggcacaaccuggc

SEQ ID NO: 3673689 - RNA, 19 nt, Salmonella enterica enterica serovar Typhi
aauucgcguucagaaaugu

SEQ ID NO: 3673690 - RNA, 18 nt, Salmonella enterica enterica serovar Typhi
aauucgucgccgccaaag

SEQ ID NO: 3673691 - RNA, 20 nt, Salmonella enterica enterica serovar Typhi
aauucguguuuuugaacauu

SEQ ID NO: 3673692 - RNA, 15 nt, Salmonella enterica enterica serovar Typhi
aauucuaugccaggc

SEQ ID NO: 3673693 - RNA, 16 nt, Salmonella enterica enterica serovar Typhi
aauucuaugccaggcg

SEQ ID NO: 3673694 - RNA, 22 nt, Salmonella enterica enterica serovar Typhi
aauucucacagaaucaucaggc

SEQ ID NO: 3673695 - RNA, 21 nt, Salmonella enterica enterica serovar Typhi
aauucucagaaacaacacaaa

SEQ ID NO: 3673696 - RNA, 21 nt, Salmonella enterica enterica serovar Typhi
aauucugacgcagcuucugau

SEQ ID NO: 3673697 - RNA, 19 nt, Salmonella enterica enterica serovar Typhi
aauucugaucgauaaaagu

SEQ ID NO: 3673698 - RNA, 23 nt, Salmonella enterica enterica serovar Typhi
aauucugucucaauaaaaugucu

SEQ ID NO: 3673699 - RNA, 20 nt, Salmonella enterica enterica serovar Typhi
aauucuuaacccacaagaaa

SEQ ID NO: 3673700 - RNA, 18 nt, Salmonella enterica enterica serovar Typhi
aauugaagaguuugauca

SEQ ID NO: 3673701 - RNA, 14 nt, Salmonella enterica enterica serovar Typhi
aauugaauuauaau

SEQ ID NO: 3673702 - RNA, 15 nt, Salmonella enterica enterica serovar Typhi
aauugaauuauaaua

SEQ ID NO: 3673703 - RNA, 17 nt, Salmonella enterica enterica serovar Typhi
aauugaauuauaauaaa

SEQ ID NO: 3673704 - RNA, 23 nt, Salmonella enterica enterica serovar Typhi
aauugaccguccccagccagaga

SEQ ID NO: 3673705 - RNA, 14 nt, Salmonella enterica enterica serovar Typhi
aauugacgcugccu

SEQ ID NO: 3673706 - RNA, 20 nt, Salmonella enterica enterica serovar Typhi
aauugacgcuugacucugug

SEQ ID NO: 3673707 - RNA, 14 nt, Salmonella enterica enterica serovar Typhi
aauugacuggauuu

SEQ ID NO: 3673708 - RNA, 23 nt, Salmonella enterica enterica serovar Typhi
aauugacuggauuuuugacuaaa

SEQ ID NO: 3673709 - RNA, 21 nt, Salmonella enterica enterica serovar Typhi
aauugagcgcaaaacgcugcu

SEQ ID NO: 3673710 - RNA, 12 nt, Salmonella enterica enterica serovar Typhi
aauugaggccgu

SEQ ID NO: 3673711 - RNA, 22 nt, Salmonella enterica enterica serovar Typhi
aauugaggccguuauugucaug

SEQ ID NO: 3673712 - RNA, 15 nt, Salmonella enterica enterica serovar Typhi
aauugauucugugau

SEQ ID NO: 3673713 - RNA, 18 nt, Salmonella enterica enterica serovar Typhi
aauugcagggugcagcaa

SEQ ID NO: 3673714 - RNA, 20 nt, Salmonella enterica enterica serovar Typhi
aauugcagggugcagcaaau

SEQ ID NO: 3673715 - RNA, 22 nt, Salmonella enterica enterica serovar Typhi
aauugccacgaacgauauaaaa

SEQ ID NO: 3673716 - RNA, 13 nt, Salmonella enterica enterica serovar Typhi
aauugccgcccgu

SEQ ID NO: 3673717 - RNA, 21 nt, Salmonella enterica enterica serovar Typhi
aauugccgggugacgcuuacg

SEQ ID NO: 3673718 - RNA, 16 nt, Salmonella enterica enterica serovar Typhi
aauugccgucgccgga

SEQ ID NO: 3673719 - RNA, 11 nt, Salmonella enterica enterica serovar Typhi
aauugcgcauc

SEQ ID NO: 3673720 - RNA, 23 nt, Salmonella enterica enterica serovar Typhi
aauugcgguagaugaaaauuugu

SEQ ID NO: 3673721 - RNA, 20 nt, Salmonella enterica enterica serovar Typhi
aauugcgguuuauccccgcu

SEQ ID NO: 3673722 - RNA, 23 nt, Salmonella enterica enterica serovar Typhi
aauugcuaccucguaucccgccu

SEQ ID NO: 3673723 - RNA, 11 nt, Salmonella enterica enterica serovar Typhi
aauugcugaag

SEQ ID NO: 3673724 - RNA, 22 nt, Salmonella enterica enterica serovar Typhi
aauugcugauccuguaaaaaau

SEQ ID NO: 3673725 - RNA, 16 nt, Salmonella enterica enterica serovar Typhi
aauuggaguuaucauu

SEQ ID NO: 3673726 - RNA, 17 nt, Salmonella enterica enterica serovar Typhi
aauuguuccuguaaagc

SEQ ID NO: 3673727 - RNA, 20 nt, Salmonella enterica enterica serovar Typhi
aauuguugcgccauggcuuc

SEQ ID NO: 3673728 - RNA, 16 nt, Salmonella enterica enterica serovar Typhi
aauuguuuaaaaacag

SEQ ID NO: 3673729 - RNA, 13 nt, Salmonella enterica enterica serovar Typhi
aauuuaaacaugu

SEQ ID NO: 3673730 - RNA, 13 nt, Salmonella enterica enterica serovar Typhi
aauuuaaauagca

SEQ ID NO: 3673731 - RNA, 18 nt, Salmonella enterica enterica serovar Typhi
aauuuaaccguuuuaccu

SEQ ID NO: 3673732 - RNA, 22 nt, Salmonella enterica enterica serovar Typhi
aauuuaagccagacgcgcagca

SEQ ID NO: 3673733 - RNA, 18 nt, Salmonella enterica enterica serovar Typhi
aauuuaagcuuaaugaua

SEQ ID NO: 3673734 - RNA, 15 nt, Salmonella enterica enterica serovar Typhi
aauuuauaacguauc

SEQ ID NO: 3673735 - RNA, 22 nt, Salmonella enterica enterica serovar Typhi
aauuuauaagccugagcgcgag

SEQ ID NO: 3673736 - RNA, 14 nt, Salmonella enterica enterica serovar Typhi
aauuuaucaacaaa

SEQ ID NO: 3673737 - RNA, 14 nt, Salmonella enterica enterica serovar Typhi
aauuuaucagacaa

SEQ ID NO: 3673738 - RNA, 14 nt, Salmonella enterica enterica serovar Typhi
aauuuauccaguaa

SEQ ID NO: 3673739 - RNA, 22 nt, Salmonella enterica enterica serovar Typhi
aauuuaugauuuuaacaucacc

SEQ ID NO: 3673740 - RNA, 13 nt, Salmonella enterica enterica serovar Typhi
aauuuauuucugc

SEQ ID NO: 3673741 - RNA, 21 nt, Salmonella enterica enterica serovar Typhi
aauuucaaucgccaguuuuug

SEQ ID NO: 3673742 - RNA, 19 nt, Salmonella enterica enterica serovar Typhi
aauuucaccaccgguauaa

SEQ ID NO: 3673743 - RNA, 16 nt, Salmonella enterica enterica serovar Typhi
aauuucacgcagcacg

SEQ ID NO: 3673744 - RNA, 14 nt, Salmonella enterica enterica serovar Typhi
aauuuccagcgggc

SEQ ID NO: 3673745 - RNA, 10 nt, Salmonella enterica enterica serovar Typhi
aauuuccagu

SEQ ID NO: 3673746 - RNA, 17 nt, Salmonella enterica enterica serovar Typhi
aauuuccaguucaauca

SEQ ID NO: 3673747 - RNA, 22 nt, Salmonella enterica enterica serovar Typhi
aauuuccgcacgcgcgcccaug

SEQ ID NO: 3673748 - RNA, 15 nt, Salmonella enterica enterica serovar Typhi
aauuuccgcagccag

SEQ ID NO: 3673749 - RNA, 21 nt, Salmonella enterica enterica serovar Typhi
aauuucgaaacaggaaaaaca

SEQ ID NO: 3673750 - RNA, 20 nt, Salmonella enterica enterica serovar Typhi
aauuucgcgaauaaucuguu

SEQ ID NO: 3673751 - RNA, 15 nt, Salmonella enterica enterica serovar Typhi
aauuucggcaaugac

SEQ ID NO: 3673752 - RNA, 14 nt, Salmonella enterica enterica serovar Typhi
aauuucucgcccgc

SEQ ID NO: 3673753 - RNA, 13 nt, Salmonella enterica enterica serovar Typhi
aauuucugcugcc

SEQ ID NO: 3673754 - RNA, 18 nt, Salmonella enterica enterica serovar Typhi
aauuucugguaccagauc

SEQ ID NO: 3673755 - RNA, 17 nt, Salmonella enterica enterica serovar Typhi
aauuucuuccauuagcu

SEQ ID NO: 3673756 - RNA, 16 nt, Salmonella enterica enterica serovar Typhi
aauuucuugaucaauc

SEQ ID NO: 3673757 - RNA, 18 nt, Salmonella enterica enterica serovar Typhi
aauuugauuuauuuugaa

SEQ ID NO: 3673758 - RNA, 17 nt, Salmonella enterica enterica serovar Typhi
aauuugucagacaugau

SEQ ID NO: 3673759 - RNA, 18 nt, Salmonella enterica enterica serovar Typhi
aauuugucguucacuugc

SEQ ID NO: 3673760 - RNA, 17 nt, Salmonella enterica enterica serovar Typhi
aauuuuaccauucagcu

SEQ ID NO: 3673761 - RNA, 13 nt, Salmonella enterica enterica serovar Typhi
aauuuuagaaaua

SEQ ID NO: 3673762 - RNA, 13 nt, Salmonella enterica enterica serovar Typhi
aauuuuaugacgu

SEQ ID NO: 3673763 - RNA, 18 nt, Salmonella enterica enterica serovar Typhi
aauuuuaugacguaagcg

SEQ ID NO: 3673764 - RNA, 12 nt, Salmonella enterica enterica serovar Typhi
aauuuucaacca

SEQ ID NO: 3673765 - RNA, 16 nt, Salmonella enterica enterica serovar Typhi
aauuuucacuuauaaa

SEQ ID NO: 3673766 - RNA, 19 nt, Salmonella enterica enterica serovar Typhi
aauuuucagacacugcacc

SEQ ID NO: 3673767 - RNA, 13 nt, Salmonella enterica enterica serovar Typhi
aauuuugcauaaa

SEQ ID NO: 3673768 - RNA, 15 nt, Salmonella enterica enterica serovar Typhi
aauuuugcauaaaua

SEQ ID NO: 3673769 - RNA, 12 nt, Salmonella enterica enterica serovar Typhi
aauuuuuccagc

SEQ ID NO: 3673770 - RNA, 22 nt, Salmonella enterica enterica serovar Typhi
aauuuuuccgccuccuccgguu

SEQ ID NO: 3673771 - RNA, 17 nt, Salmonella enterica enterica serovar Typhi
acaaggcuuuuggcuua

SEQ ID NO: 3673772 - RNA, 18 nt, Salmonella enterica enterica serovar Typhi
acaagguugaucaggaag

SEQ ID NO: 3673773 - RNA, 14 nt, Salmonella enterica enterica serovar Typhi
acaaguaauaaaau

SEQ ID NO: 3673774 - RNA, 16 nt, Salmonella enterica enterica serovar Typhi
acaaguaauaaaauaa

SEQ ID NO: 3673775 - RNA, 16 nt, Salmonella enterica enterica serovar Typhi
acaaguagccugccag

SEQ ID NO: 3673776 - RNA, 18 nt, Salmonella enterica enterica serovar Typhi
acaaguagccugccagca

SEQ ID NO: 3673777 - RNA, 20 nt, Salmonella enterica enterica serovar Typhi
acaaguagccugccagcaac

SEQ ID NO: 3673778 - RNA, 15 nt, Salmonella enterica enterica serovar Typhi
acaagugucgugaau

SEQ ID NO: 3673779 - RNA, 14 nt, Salmonella enterica enterica serovar Typhi
acaaguuuauccgg

SEQ ID NO: 3673780 - RNA, 19 nt, Salmonella enterica enterica serovar Typhi
acaauaacaccacaacaca

SEQ ID NO: 3673781 - RNA, 14 nt, Salmonella enterica enterica serovar Typhi
acaauaaccggcag

SEQ ID NO: 3673782 - RNA, 22 nt, Salmonella enterica enterica serovar Typhi
acaauaaucgcgagaaaauaga

SEQ ID NO: 3673783 - RNA, 13 nt, Salmonella enterica enterica serovar Typhi
acaauaccaauaa

SEQ ID NO: 3673784 - RNA, 19 nt, Salmonella enterica enterica serovar Typhi
acaauaccguuuggaucug

SEQ ID NO: 3673785 - RNA, 14 nt, Salmonella enterica enterica serovar Typhi
acaauacgccgagc

SEQ ID NO: 3673786 - RNA, 15 nt, Salmonella enterica enterica serovar Typhi
acaauacucacuauc

SEQ ID NO: 3673787 - RNA, 18 nt, Salmonella enterica enterica serovar Typhi
acaauacuuaaaccugcg

SEQ ID NO: 3673788 - RNA, 18 nt, Salmonella enterica enterica serovar Typhi
acaauagcaaucuguaac

SEQ ID NO: 3673789 - RNA, 21 nt, Salmonella enterica enterica serovar Typhi
acaauagcgcuaaacagcgcc

SEQ ID NO: 3673790 - RNA, 23 nt, Salmonella enterica enterica serovar Typhi
acaauagcgcuaaacagcgccgc

SEQ ID NO: 3673791 - RNA, 18 nt, Salmonella enterica enterica serovar Typhi
acaauauccucgcauccu

SEQ ID NO: 3673792 - RNA, 18 nt, Salmonella enterica enterica serovar Typhi
acaauaugaccacuaacu

SEQ ID NO: 3673793 - RNA, 20 nt, Salmonella enterica enterica serovar Typhi
acaauaugguuauccagcag

SEQ ID NO: 3673794 - RNA, 22 nt, Salmonella enterica enterica serovar Typhi
acaauauucgccgcgauaauaa

SEQ ID NO: 3673795 - RNA, 23 nt, Salmonella enterica enterica serovar Typhi
acaaucaauucacguuccauuuc

SEQ ID NO: 3673796 - RNA, 11 nt, Salmonella enterica enterica serovar Typhi
acaaucaccug

SEQ ID NO: 3673797 - RNA, 15 nt, Salmonella enterica enterica serovar Typhi
acaaucagaagaaau

SEQ ID NO: 3673798 - RNA, 16 nt, Salmonella enterica enterica serovar Typhi
acaauccccgaaagcc

SEQ ID NO: 3673799 - RNA, 14 nt, Salmonella enterica enterica serovar Typhi
acaaucccgccaga

SEQ ID NO: 3673800 - RNA, 16 nt, Salmonella enterica enterica serovar Typhi
acaaucccggcaacug

SEQ ID NO: 3673801 - RNA, 20 nt, Salmonella enterica enterica serovar Typhi
acaaucccggcaacugcgcc

SEQ ID NO: 3673802 - RNA, 16 nt, Salmonella enterica enterica serovar Typhi
acaauccgacgcucaa

SEQ ID NO: 3673803 - RNA, 21 nt, Salmonella enterica enterica serovar Typhi
acaauccgacgcucaaccggu

SEQ ID NO: 3673804 - RNA, 18 nt, Salmonella enterica enterica serovar Typhi
acaauccguuauuucaca

SEQ ID NO: 3673805 - RNA, 19 nt, Salmonella enterica enterica serovar Typhi
acaauccguuauuucacag

SEQ ID NO: 3673806 - RNA, 14 nt, Salmonella enterica enterica serovar Typhi
acaaucgcaccagg

SEQ ID NO: 3673807 - RNA, 14 nt, Salmonella enterica enterica serovar Typhi
acaaucgccagccc

SEQ ID NO: 3673808 - RNA, 13 nt, Salmonella enterica enterica serovar Typhi
acaaucgcguuuu

SEQ ID NO: 3673809 - RNA, 18 nt, Salmonella enterica enterica serovar Typhi
acaaucgcguuuuccagc

SEQ ID NO: 3673810 - RNA, 17 nt, Salmonella enterica enterica serovar Typhi
acaaucguuaauucaug

SEQ ID NO: 3673811 - RNA, 23 nt, Salmonella enterica enterica serovar Typhi
acaaucuccagaccgcugcggaa

SEQ ID NO: 3673812 - RNA, 13 nt, Salmonella enterica enterica serovar Typhi
acaaugaaccagc

SEQ ID NO: 3673813 - RNA, 14 nt, Salmonella enterica enterica serovar Typhi
acaaugacaugucg

SEQ ID NO: 3673814 - RNA, 13 nt, Salmonella enterica enterica serovar Typhi
acaaugcccggca

SEQ ID NO: 3673815 - RNA, 14 nt, Salmonella enterica enterica serovar Typhi
acaaugcccggcau

SEQ ID NO: 3673816 - RNA, 14 nt, Salmonella enterica enterica serovar Typhi
acaaugcugacacu

SEQ ID NO: 3673817 - RNA, 22 nt, Salmonella enterica enterica serovar Typhi
acaauggcaggcagcagauaau

SEQ ID NO: 3673818 - RNA, 18 nt, Salmonella enterica enterica serovar Typhi
acaauggcgacgaucagc

SEQ ID NO: 3673819 - RNA, 21 nt, Salmonella enterica enterica serovar Typhi
acaauggcgacgaucagcgcc

SEQ ID NO: 3673820 - RNA, 18 nt, Salmonella enterica enterica serovar Typhi
acaaugggauaaaaugga

SEQ ID NO: 3673821 - RNA, 22 nt, Salmonella enterica enterica serovar Typhi
acaaugugccggauggcgcuaa

SEQ ID NO: 3673822 - RNA, 15 nt, Salmonella enterica enterica serovar Typhi
acaauuacgcaagag

SEQ ID NO: 3673823 - RNA, 14 nt, Salmonella enterica enterica serovar Typhi
acaauucauagcca

SEQ ID NO: 3673824 - RNA, 21 nt, Salmonella enterica enterica serovar Typhi
acaauucauagccacagcgcg

SEQ ID NO: 3673825 - RNA, 21 nt, Salmonella enterica enterica serovar Typhi
acaauugcugcguaacugcca

SEQ ID NO: 3673826 - RNA, 13 nt, Salmonella enterica enterica serovar Typhi
acaauuuaucugc

SEQ ID NO: 3673827 - RNA, 19 nt, Salmonella enterica enterica serovar Typhi
acaauuucaccuuuggcuu

SEQ ID NO: 3673828 - RNA, 22 nt, Salmonella enterica enterica serovar Typhi
acaauuucccccacuucugaca

SEQ ID NO: 3673829 - RNA, 12 nt, Salmonella enterica enterica serovar Typhi
acaauuucuggc

SEQ ID NO: 3673830 - RNA, 21 nt, Salmonella enterica enterica serovar Typhi
acaauuuugauaagagaaaau

SEQ ID NO: 3673831 - RNA, 13 nt, Salmonella enterica enterica serovar Typhi
acacaacggcaca

SEQ ID NO: 3673832 - RNA, 20 nt, Salmonella enterica enterica serovar Typhi
acacaauauugcugugcuau

SEQ ID NO: 3673833 - RNA, 15 nt, Salmonella enterica enterica serovar Typhi
acacacaacuaagug

SEQ ID NO: 3673834 - RNA, 16 nt, Salmonella enterica enterica serovar Typhi
acacacaaucgguuau

SEQ ID NO: 3673835 - RNA, 14 nt, Salmonella enterica enterica serovar Typhi
acacacgcgcugac

SEQ ID NO: 3673836 - RNA, 19 nt, Salmonella enterica enterica serovar Typhi
acacacguaacaaccagaa

SEQ ID NO: 3673837 - RNA, 15 nt, Salmonella enterica enterica serovar Typhi
acacacucaucuucg

SEQ ID NO: 3673838 - RNA, 21 nt, Salmonella enterica enterica serovar Typhi
acacacucggugcauuugucg

SEQ ID NO: 3673839 - RNA, 21 nt, Salmonella enterica enterica serovar Typhi
acacagaaaaaccaaaaaaua

SEQ ID NO: 3673840 - RNA, 22 nt, Salmonella enterica enterica serovar Typhi
acacagaaaaaccaaaaaauau

SEQ ID NO: 3673841 - RNA, 20 nt, Salmonella enterica enterica serovar Typhi
acacagacugcuuguuuaau

SEQ ID NO: 3673842 - RNA, 13 nt, Salmonella enterica enterica serovar Typhi
acacagaucgaau

SEQ ID NO: 3673843 - RNA, 22 nt, Salmonella enterica enterica serovar Typhi
acacagaugacaaagccggaua

SEQ ID NO: 3673844 - RNA, 15 nt, Salmonella enterica enterica serovar Typhi
acacagcagaaagca

SEQ ID NO: 3673845 - RNA, 14 nt, Salmonella enterica enterica serovar Typhi
acacagccagcacg

SEQ ID NO: 3673846 - RNA, 22 nt, Salmonella enterica enterica serovar Typhi
acacaggggccacaggcggcau

SEQ ID NO: 3673847 - RNA, 13 nt, Salmonella enterica enterica serovar Typhi
acacaguaaaaaa

SEQ ID NO: 3673848 - RNA, 15 nt, Salmonella enterica enterica serovar Typhi
acacaguaaaaaaac

SEQ ID NO: 3673849 - RNA, 19 nt, Salmonella enterica enterica serovar Typhi
acacagucucauugaucag

SEQ ID NO: 3673850 - RNA, 13 nt, Salmonella enterica enterica serovar Typhi
acacaguugccuu

SEQ ID NO: 3673851 - RNA, 17 nt, Salmonella enterica enterica serovar Typhi
acacauaacgcccgaca

SEQ ID NO: 3673852 - RNA, 14 nt, Salmonella enterica enterica serovar Typhi
acacauagauaaaa

SEQ ID NO: 3673853 - RNA, 18 nt, Salmonella enterica enterica serovar Typhi
acacauaucgccagccau

SEQ ID NO: 3673854 - RNA, 19 nt, Salmonella enterica enterica serovar Typhi
acacauaucgccagccaug

SEQ ID NO: 3673855 - RNA, 15 nt, Salmonella enterica enterica serovar Typhi
acacaucaggaaugc

SEQ ID NO: 3673856 - RNA, 21 nt, Salmonella enterica enterica serovar Typhi
acacaugcaaaaaagcccauc

SEQ ID NO: 3673857 - RNA, 17 nt, Salmonella enterica enterica serovar Typhi
acagauuggucagcagc

SEQ ID NO: 3673858 - RNA, 22 nt, Salmonella enterica enterica serovar Typhi
acagauuuugcacuuuugccag

SEQ ID NO: 3673859 - RNA, 18 nt, Salmonella enterica enterica serovar Typhi
acagcaaaacgcgcuauc

SEQ ID NO: 3673860 - RNA, 16 nt, Salmonella enterica enterica serovar Typhi
acagcaauaucagcca

SEQ ID NO: 3673861 - RNA, 15 nt, Salmonella enterica enterica serovar Typhi
acagcaaugagcagg

SEQ ID NO: 3673862 - RNA, 16 nt, Salmonella enterica enterica serovar Typhi
acagcaaugcccaaaa

SEQ ID NO: 3673863 - RNA, 18 nt, Salmonella enterica enterica serovar Typhi
acagcaaugcccaaaaua

SEQ ID NO: 3673864 - RNA, 11 nt, Salmonella enterica enterica serovar Typhi
acagcacauag

SEQ ID NO: 3673865 - RNA, 13 nt, Salmonella enterica enterica serovar Typhi
acagcacauagaa

SEQ ID NO: 3673866 - RNA, 20 nt, Salmonella enterica enterica serovar Typhi
acagcaccaucaugcaagag

SEQ ID NO: 3673867 - RNA, 23 nt, Salmonella enterica enterica serovar Typhi
acagcacguuaccggcgguugag

SEQ ID NO: 3673868 - RNA, 23 nt, Salmonella enterica enterica serovar Typhi
acagcacuacggauggcccugcc

SEQ ID NO: 3673869 - RNA, 14 nt, Salmonella enterica enterica serovar Typhi
acagcagcgcggca

SEQ ID NO: 3673870 - RNA, 22 nt, Salmonella enterica enterica serovar Typhi
acagcagcgcggcacacagcac

SEQ ID NO: 3673871 - RNA, 12 nt, Salmonella enterica enterica serovar Typhi
acagccaaaaau

SEQ ID NO: 3673872 - RNA, 22 nt, Salmonella enterica enterica serovar Typhi
acagccaaacugcuguagcugu

SEQ ID NO: 3673873 - RNA, 14 nt, Salmonella enterica enterica serovar Typhi
acagccaaaucagc

SEQ ID NO: 3673874 - RNA, 24 nt, Salmonella enterica enterica serovar Typhi
acagccaaucauaaacgccugacg

SEQ ID NO: 3673875 - RNA, 14 nt, Salmonella enterica enterica serovar Typhi
acagccagaagccu

SEQ ID NO: 3673876 - RNA, 22 nt, Salmonella enterica enterica serovar Typhi
acagccaggcuuucccuucaga

SEQ ID NO: 3673877 - RNA, 15 nt, Salmonella enterica enterica serovar Typhi
acagccaucuucugc

SEQ ID NO: 3673878 - RNA, 22 nt, Salmonella enterica enterica serovar Typhi
acagcccauaccacaacagaau

SEQ ID NO: 3673879 - RNA, 18 nt, Salmonella enterica enterica serovar Typhi
acagcccgccagcaccag

SEQ ID NO: 3673880 - RNA, 22 nt, Salmonella enterica enterica serovar Typhi
acagccgaucaggccgcagacg

SEQ ID NO: 3673881 - RNA, 14 nt, Salmonella enterica enterica serovar Typhi
acagccgcauuuuu

SEQ ID NO: 3673882 - RNA, 14 nt, Salmonella enterica enterica serovar Typhi
acagcgacacuccg

SEQ ID NO: 3673883 - RNA, 17 nt, Salmonella enterica enterica serovar Typhi
acagcgacacuccgcgc

SEQ ID NO: 3673884 - RNA, 15 nt, Salmonella enterica enterica serovar Typhi
acagcgaccacgcca

SEQ ID NO: 3673885 - RNA, 15 nt, Salmonella enterica enterica serovar Typhi
acagcgcaauaugca

SEQ ID NO: 3673886 - RNA, 15 nt, Salmonella enterica enterica serovar Typhi
acagcgccagaauag

SEQ ID NO: 3673887 - RNA, 13 nt, Salmonella enterica enterica serovar Typhi
acagcgccagaca

SEQ ID NO: 3673888 - RNA, 12 nt, Salmonella enterica enterica serovar Typhi
acagcgccauca

SEQ ID NO: 3673889 - RNA, 19 nt, Salmonella enterica enterica serovar Typhi
acagcgccgcgcaagcgau

SEQ ID NO: 3673890 - RNA, 16 nt, Salmonella enterica enterica serovar Typhi
acagcgccggcagcag

SEQ ID NO: 3673891 - RNA, 20 nt, Salmonella enterica enterica serovar Typhi
acagcgcgccaauccaugcc

SEQ ID NO: 3673892 - RNA, 17 nt, Salmonella enterica enterica serovar Typhi
acagcgcgcgaauaucg

SEQ ID NO: 3673893 - RNA, 13 nt, Salmonella enterica enterica serovar Typhi
acagcgcgcgaca

SEQ ID NO: 3673894 - RNA, 13 nt, Salmonella enterica enterica serovar Typhi
acagcggaaaauc

SEQ ID NO: 3673895 - RNA, 12 nt, Salmonella enterica enterica serovar Typhi
acagcggagaga

SEQ ID NO: 3673896 - RNA, 22 nt, Salmonella enterica enterica serovar Typhi
acagcggauuacgcgccugccu

SEQ ID NO: 3673897 - RNA, 20 nt, Salmonella enterica enterica serovar Typhi
acagcggcucgaacuguucu

SEQ ID NO: 3673898 - RNA, 23 nt, Salmonella enterica enterica serovar Typhi
acagcgggguaaagccuuuaugc

SEQ ID NO: 3673899 - RNA, 17 nt, Salmonella enterica enterica serovar Typhi
acagcguaaugcgccag

SEQ ID NO: 3673900 - RNA, 22 nt, Salmonella enterica enterica serovar Typhi
acagcguaaugcgccaggcagc

SEQ ID NO: 3673901 - RNA, 19 nt, Salmonella enterica enterica serovar Typhi
acagcguacaauggcaggc

SEQ ID NO: 3673902 - RNA, 13 nt, Salmonella enterica enterica serovar Typhi
acagcguacaggc

SEQ ID NO: 3673903 - RNA, 16 nt, Salmonella enterica enterica serovar Typhi
acagcguacaggcgga

SEQ ID NO: 3673904 - RNA, 21 nt, Salmonella enterica enterica serovar Typhi
acagcguaguuuauucaucuc

SEQ ID NO: 3673905 - RNA, 22 nt, Salmonella enterica enterica serovar Typhi
acagcguaguuuauucaucucc

SEQ ID NO: 3673906 - RNA, 14 nt, Salmonella enterica enterica serovar Typhi
acagcgucauccag

SEQ ID NO: 3673907 - RNA, 12 nt, Salmonella enterica enterica serovar Typhi
acagcgugaaca

SEQ ID NO: 3673908 - RNA, 15 nt, Salmonella enterica enterica serovar Typhi
acagcguguucaugc

SEQ ID NO: 3673909 - RNA, 23 nt, Salmonella enterica enterica serovar Typhi
acagcguguucaugcgcggcgga

SEQ ID NO: 3673910 - RNA, 13 nt, Salmonella enterica enterica serovar Typhi
acagcucaccccu

SEQ ID NO: 3673911 - RNA, 15 nt, Salmonella enterica enterica serovar Typhi
acagcucaccccuau

SEQ ID NO: 3673912 - RNA, 14 nt, Salmonella enterica enterica serovar Typhi
acagcucauaaacg

SEQ ID NO: 3673913 - RNA, 21 nt, Salmonella enterica enterica serovar Typhi
acagcucggcaaagcccauca

SEQ ID NO: 3673914 - RNA, 19 nt, Salmonella enterica enterica serovar Typhi
acagcuuaaucaccagcgc

SEQ ID NO: 3673915 - RNA, 21 nt, Salmonella enterica enterica serovar Typhi
acagcuuaaucaccagcgcau

SEQ ID NO: 3673916 - RNA, 16 nt, Salmonella enterica enterica serovar Typhi
acagcuuagcuguaau

SEQ ID NO: 3673917 - RNA, 23 nt, Salmonella enterica enterica serovar Typhi
acagcuucaggcucaucagcgcc

SEQ ID NO: 3673918 - RNA, 20 nt, Salmonella enterica enterica serovar Typhi
acagcuugcgcccaugcuca

SEQ ID NO: 3673919 - RNA, 16 nt, Salmonella enterica enterica serovar Typhi
acaggaauaaccacug

SEQ ID NO: 3673920 - RNA, 15 nt, Salmonella enterica enterica serovar Typhi
acaggaauuccaguc

SEQ ID NO: 3673921 - RNA, 21 nt, Salmonella enterica enterica serovar Typhi
acaggacgccagcgcggcaug

SEQ ID NO: 3673922 - RNA, 16 nt, Salmonella enterica enterica serovar Typhi
acaggaguucaucaug

SEQ ID NO: 3673923 - RNA, 11 nt, Salmonella enterica enterica serovar Typhi
acaggaugcuu

SEQ ID NO: 3673924 - RNA, 20 nt, Salmonella enterica enterica serovar Typhi
acaggcauccgugaccugcu

SEQ ID NO: 3673925 - RNA, 20 nt, Salmonella enterica enterica serovar Typhi
acaggccaacauagcggcaa

SEQ ID NO: 3673926 - RNA, 18 nt, Salmonella enterica enterica serovar Typhi
acaggccauuaagcuucg

SEQ ID NO: 3673927 - RNA, 20 nt, Salmonella enterica enterica serovar Typhi
acaggccgccauaagaaugu

SEQ ID NO: 3673928 - RNA, 14 nt, Salmonella enterica enterica serovar Typhi
acaggccgccgagg

SEQ ID NO: 3673929 - RNA, 18 nt, Salmonella enterica enterica serovar Typhi
acaggccguucauucgcc

SEQ ID NO: 3673930 - RNA, 15 nt, Salmonella enterica enterica serovar Typhi
acaggcgcauacgau

SEQ ID NO: 3673931 - RNA, 16 nt, Salmonella enterica enterica serovar Typhi
acaggcgcaucagaaa

SEQ ID NO: 3673932 - RNA, 17 nt, Salmonella enterica enterica serovar Typhi
acaggcggaugaaacag

SEQ ID NO: 3673933 - RNA, 17 nt, Salmonella enterica enterica serovar Typhi
acaggcggcuguugguu

SEQ ID NO: 3673934 - RNA, 18 nt, Salmonella enterica enterica serovar Typhi
acaggcggcuguugguuu

SEQ ID NO: 3673935 - RNA, 13 nt, Salmonella enterica enterica serovar Typhi
acaggcugacaaa

SEQ ID NO: 3673936 - RNA, 16 nt, Salmonella enterica enterica serovar Typhi
acaggcuuuucaggcu

SEQ ID NO: 3673937 - RNA, 23 nt, Salmonella enterica enterica serovar Typhi
acagggcguuuuauaagccgauc

SEQ ID NO: 3673938 - RNA, 13 nt, Salmonella enterica enterica serovar Typhi
acagguaaaacaa

SEQ ID NO: 3673939 - RNA, 22 nt, Salmonella enterica enterica serovar Typhi
acagguaaaacaaaaaaacggc

SEQ ID NO: 3673940 - RNA, 22 nt, Salmonella enterica enterica serovar Typhi
acaggucggcaugcaucucuuc

SEQ ID NO: 3673941 - RNA, 14 nt, Salmonella enterica enterica serovar Typhi
acaggugcgcugug

SEQ ID NO: 3673942 - RNA, 15 nt, Salmonella enterica enterica serovar Typhi
acagguggaaagugc

SEQ ID NO: 3673943 - RNA, 21 nt, Salmonella enterica enterica serovar Typhi
accaaguuuggcaaucaaauc

SEQ ID NO: 3673944 - RNA, 14 nt, Salmonella enterica enterica serovar Typhi
accaauaagaacuu

SEQ ID NO: 3673945 - RNA, 23 nt, Salmonella enterica enterica serovar Typhi
accaauaauaaucccaacauggu

SEQ ID NO: 3673946 - RNA, 21 nt, Salmonella enterica enterica serovar Typhi
accaauaauugccgaauauug

SEQ ID NO: 3673947 - RNA, 16 nt, Salmonella enterica enterica serovar Typhi
accaauacccagcgcc

SEQ ID NO: 3673948 - RNA, 16 nt, Salmonella enterica enterica serovar Typhi
accaauaguauccaua

SEQ ID NO: 3673949 - RNA, 12 nt, Salmonella enterica enterica serovar Typhi
accaauauccgc

SEQ ID NO: 3673950 - RNA, 14 nt, Salmonella enterica enterica serovar Typhi
accaauggcgcguc

SEQ ID NO: 3673951 - RNA, 17 nt, Salmonella enterica enterica serovar Typhi
accaauggcgcgucuua

SEQ ID NO: 3673952 - RNA, 19 nt, Salmonella enterica enterica serovar Typhi
accaauggcgcgucuuaaa

SEQ ID NO: 3673953 - RNA, 13 nt, Salmonella enterica enterica serovar Typhi
accaaugugcaaa

SEQ ID NO: 3673954 - RNA, 18 nt, Salmonella enterica enterica serovar Typhi
accacaaagcgguaaauc

SEQ ID NO: 3673955 - RNA, 16 nt, Salmonella enterica enterica serovar Typhi
accacaaaggcgcgua

SEQ ID NO: 3673956 - RNA, 22 nt, Salmonella enterica enterica serovar Typhi
accacaauaaucgcgagaaaau

SEQ ID NO: 3673957 - RNA, 19 nt, Salmonella enterica enterica serovar Typhi
accacacgcuuauccugcc

SEQ ID NO: 3673958 - RNA, 22 nt, Salmonella enterica enterica serovar Typhi
accacagccuuauaagaaccau

SEQ ID NO: 3673959 - RNA, 18 nt, Salmonella enterica enterica serovar Typhi
accacagucaucgcgcca

SEQ ID NO: 3673960 - RNA, 20 nt, Salmonella enterica enterica serovar Typhi
accacaguugcgacugauaa

SEQ ID NO: 3673961 - RNA, 20 nt, Salmonella enterica enterica serovar Typhi
accacaucaauagcgcuaca

SEQ ID NO: 3673962 - RNA, 18 nt, Salmonella enterica enterica serovar Typhi
accacaugaccagcgccg

SEQ ID NO: 3673963 - RNA, 14 nt, Salmonella enterica enterica serovar Typhi
accacauuauagau

SEQ ID NO: 3673964 - RNA, 14 nt, Salmonella enterica enterica serovar Typhi
accaccaggaacgc

SEQ ID NO: 3673965 - RNA, 18 nt, Salmonella enterica enterica serovar Typhi
accaccaguacauggcuc

SEQ ID NO: 3673966 - RNA, 18 nt, Salmonella enterica enterica serovar Typhi
accaccauacccaguagc

SEQ ID NO: 3673967 - RNA, 20 nt, Salmonella enterica enterica serovar Typhi
accaccauacccaguagcag

SEQ ID NO: 3673968 - RNA, 13 nt, Salmonella enterica enterica serovar Typhi
accacccagccag

SEQ ID NO: 3673969 - RNA, 17 nt, Salmonella enterica enterica serovar Typhi
accacccgggaaaaaug

SEQ ID NO: 3673970 - RNA, 14 nt, Salmonella enterica enterica serovar Typhi
accacccugaaaag

SEQ ID NO: 3673971 - RNA, 23 nt, Salmonella enterica enterica serovar Typhi
accaccgaauuccgcuaaucuuu

SEQ ID NO: 3673972 - RNA, 21 nt, Salmonella enterica enterica serovar Typhi
accaccgcgcuagugccgcca

SEQ ID NO: 3673973 - RNA, 17 nt, Salmonella enterica enterica serovar Typhi
accaccgcucguucgau

SEQ ID NO: 3673974 - RNA, 16 nt, Salmonella enterica enterica serovar Typhi
accaccggauggcgac

SEQ ID NO: 3673975 - RNA, 20 nt, Salmonella enterica enterica serovar Typhi
accaccggcgcgccagcgca

SEQ ID NO: 3673976 - RNA, 13 nt, Salmonella enterica enterica serovar Typhi
accacgaaaauua

SEQ ID NO: 3673977 - RNA, 16 nt, Salmonella enterica enterica serovar Typhi
accacgaaaauuauuu

SEQ ID NO: 3673978 - RNA, 13 nt, Salmonella enterica enterica serovar Typhi
accacgaaucagg

SEQ ID NO: 3673979 - RNA, 14 nt, Salmonella enterica enterica serovar Typhi
accacgaucuuguc

SEQ ID NO: 3673980 - RNA, 22 nt, Salmonella enterica enterica serovar Typhi
accacgaucuugucacaauaac

SEQ ID NO: 3673981 - RNA, 13 nt, Salmonella enterica enterica serovar Typhi
accacgcagccau

SEQ ID NO: 3673982 - RNA, 16 nt, Salmonella enterica enterica serovar Typhi
accacgcagcccguaa

SEQ ID NO: 3673983 - RNA, 17 nt, Salmonella enterica enterica serovar Typhi
accacgcauaccagcca

SEQ ID NO: 3673984 - RNA, 14 nt, Salmonella enterica enterica serovar Typhi
accacgccaacguc

SEQ ID NO: 3673985 - RNA, 15 nt, Salmonella enterica enterica serovar Typhi
accacgccaccgccg

SEQ ID NO: 3673986 - RNA, 22 nt, Salmonella enterica enterica serovar Typhi
accacgccaucaacagcggaga

SEQ ID NO: 3673987 - RNA, 16 nt, Salmonella enterica enterica serovar Typhi
accacgcccaacgacc

SEQ ID NO: 3673988 - RNA, 19 nt, Salmonella enterica enterica serovar Typhi
accacgcccggaucaaaca

SEQ ID NO: 3673989 - RNA, 15 nt, Salmonella enterica enterica serovar Typhi
accacgcccuucacg

SEQ ID NO: 3673990 - RNA, 20 nt, Salmonella enterica enterica serovar Typhi
accacgccguagcugcgcgc

SEQ ID NO: 3673991 - RNA, 14 nt, Salmonella enterica enterica serovar Typhi
accacgcugccgcc

SEQ ID NO: 3673992 - RNA, 19 nt, Salmonella enterica enterica serovar Typhi
accacggaaugaauguuag

SEQ ID NO: 3673993 - RNA, 20 nt, Salmonella enterica enterica serovar Typhi
accacggagagacaguucag

SEQ ID NO: 3673994 - RNA, 16 nt, Salmonella enterica enterica serovar Typhi
accacggauaagccag

SEQ ID NO: 3673995 - RNA, 18 nt, Salmonella enterica enterica serovar Typhi
accacggauaagccagcc

SEQ ID NO: 3673996 - RNA, 17 nt, Salmonella enterica enterica serovar Typhi
accacggccacagccau

SEQ ID NO: 3673997 - RNA, 14 nt, Salmonella enterica enterica serovar Typhi
accacggcuucagc

SEQ ID NO: 3673998 - RNA, 15 nt, Salmonella enterica enterica serovar Typhi
accacgggguuggcc

SEQ ID NO: 3673999 - RNA, 17 nt, Salmonella enterica enterica serovar Typhi
accacgggguuggcccu

SEQ ID NO: 3674000 - RNA, 15 nt, Salmonella enterica enterica serovar Typhi
accacgguagagauu

SEQ ID NO: 3674001 - RNA, 21 nt, Salmonella enterica enterica serovar Typhi
accacgguguccggguucagc

SEQ ID NO: 3674002 - RNA, 20 nt, Salmonella enterica enterica serovar Typhi
accacguaacgggauucgcc

SEQ ID NO: 3674003 - RNA, 18 nt, Salmonella enterica enterica serovar Typhi
accacguaacucggcagc

SEQ ID NO: 3674004 - RNA, 19 nt, Salmonella enterica enterica serovar Typhi
accacgucauccggcaagc

SEQ ID NO: 3674005 - RNA, 15 nt, Salmonella enterica enterica serovar Typhi
accacgucugaagaa

SEQ ID NO: 3674006 - RNA, 17 nt, Salmonella enterica enterica serovar Typhi
accacgugucccggcgu

SEQ ID NO: 3674007 - RNA, 17 nt, Salmonella enterica enterica serovar Typhi
accacguuaccgcgcag

SEQ ID NO: 3674008 - RNA, 14 nt, Salmonella enterica enterica serovar Typhi
accacguuaucuuc

SEQ ID NO: 3674009 - RNA, 17 nt, Salmonella enterica enterica serovar Typhi
accacguucauuucgua

SEQ ID NO: 3674010 - RNA, 21 nt, Salmonella enterica enterica serovar Typhi
accacuccggcauaauaugca

SEQ ID NO: 3674011 - RNA, 20 nt, Salmonella enterica enterica serovar Typhi
accacuccggugcccauucc

SEQ ID NO: 3674012 - RNA, 23 nt, Salmonella enterica enterica serovar Typhi
accacucuuuggacggcaucagg

SEQ ID NO: 3674013 - RNA, 18 nt, Salmonella enterica enterica serovar Typhi
accacugacacggaacaa

SEQ ID NO: 3674014 - RNA, 23 nt, Salmonella enterica enterica serovar Typhi
accacuggaauaguuacggacau

SEQ ID NO: 3674015 - RNA, 21 nt, Salmonella enterica enterica serovar Typhi
accacuucaacgccgcgcuuc

SEQ ID NO: 3674016 - RNA, 14 nt, Salmonella enterica enterica serovar Typhi
accacuucacuauc

SEQ ID NO: 3674017 - RNA, 17 nt, Salmonella enterica enterica serovar Typhi
accacuucggcagaaaa

SEQ ID NO: 3674018 - RNA, 21 nt, Salmonella enterica enterica serovar Typhi
accagaaaaccgacagcaaua

SEQ ID NO: 3674019 - RNA, 13 nt, Salmonella enterica enterica serovar Typhi
accagaaccucac

SEQ ID NO: 3674020 - RNA, 16 nt, Salmonella enterica enterica serovar Typhi
accagaauaaugggga

SEQ ID NO: 3674021 - RNA, 18 nt, Salmonella enterica enterica serovar Typhi
accagaauacacuucuca

SEQ ID NO: 3674022 - RNA, 21 nt, Salmonella enterica enterica serovar Typhi
accagacacggugugccgcca

SEQ ID NO: 3674023 - RNA, 16 nt, Salmonella enterica enterica serovar Typhi
accagaccaacccagc

SEQ ID NO: 3674024 - RNA, 21 nt, Salmonella enterica enterica serovar Typhi
accagaccggcaucucaucuu

SEQ ID NO: 3674025 - RNA, 21 nt, Salmonella enterica enterica serovar Typhi
accagacgcgaacguuugacc

SEQ ID NO: 3674026 - RNA, 15 nt, Salmonella enterica enterica serovar Typhi
accagacuaaaacgu

SEQ ID NO: 3674027 - RNA, 18 nt, Salmonella enterica enterica serovar Typhi
accagacucaccccuucu

SEQ ID NO: 3674028 - RNA, 19 nt, Salmonella enterica enterica serovar Typhi
accauauuauucugcugaa

SEQ ID NO: 3674029 - RNA, 23 nt, Salmonella enterica enterica serovar Typhi
accauauuauucugcugaaaaag

SEQ ID NO: 3674030 - RNA, 15 nt, Salmonella enterica enterica serovar Typhi
accauauucccacag

SEQ ID NO: 3674031 - RNA, 15 nt, Salmonella enterica enterica serovar Typhi
accaucaaaaaaaau

SEQ ID NO: 3674032 - RNA, 18 nt, Salmonella enterica enterica serovar Typhi
accaucaauguugucgca

SEQ ID NO: 3674033 - RNA, 22 nt, Salmonella enterica enterica serovar Typhi
accaucagcgggcuaugcugaa

SEQ ID NO: 3674034 - RNA, 14 nt, Salmonella enterica enterica serovar Typhi
accaucaugcaaga

SEQ ID NO: 3674035 - RNA, 15 nt, Salmonella enterica enterica serovar Typhi
accauccaugaaaua

SEQ ID NO: 3674036 - RNA, 21 nt, Salmonella enterica enterica serovar Typhi
accaucccagguuauucaggu

SEQ ID NO: 3674037 - RNA, 15 nt, Salmonella enterica enterica serovar Typhi
accauccggcgcugc

SEQ ID NO: 3674038 - RNA, 21 nt, Salmonella enterica enterica serovar Typhi
accauccgguuuuaaauuccu

SEQ ID NO: 3674039 - RNA, 23 nt, Salmonella enterica enterica serovar Typhi
accaucgcaaauucaucgccgcc

SEQ ID NO: 3674040 - RNA, 15 nt, Salmonella enterica enterica serovar Typhi
accaucgcauugccg

SEQ ID NO: 3674041 - RNA, 16 nt, Salmonella enterica enterica serovar Typhi
accaucgccagccauu

SEQ ID NO: 3674042 - RNA, 14 nt, Salmonella enterica enterica serovar Typhi
accaucggcgcgua

SEQ ID NO: 3674043 - RNA, 15 nt, Salmonella enterica enterica serovar Typhi
accaucggcgcuacg

SEQ ID NO: 3674044 - RNA, 17 nt, Salmonella enterica enterica serovar Typhi
accaucguugccagcgg

SEQ ID NO: 3674045 - RNA, 16 nt, Salmonella enterica enterica serovar Typhi
accaucuuuuccggca

SEQ ID NO: 3674046 - RNA, 14 nt, Salmonella enterica enterica serovar Typhi
accaugauaaccag

SEQ ID NO: 3674047 - RNA, 15 nt, Salmonella enterica enterica serovar Typhi
accaugauaaccagc

SEQ ID NO: 3674048 - RNA, 16 nt, Salmonella enterica enterica serovar Typhi
accaugccacaacaga

SEQ ID NO: 3674049 - RNA, 20 nt, Salmonella enterica enterica serovar Typhi
accaugcucagcggcggcgg

SEQ ID NO: 3674050 - RNA, 23 nt, Salmonella enterica enterica serovar Typhi
accaugggucucauccauccaac

SEQ ID NO: 3674051 - RNA, 19 nt, Salmonella enterica enterica serovar Typhi
accaugguucccgccacug

SEQ ID NO: 3674052 - RNA, 13 nt, Salmonella enterica enterica serovar Typhi
accauguugcgca

SEQ ID NO: 3674053 - RNA, 14 nt, Salmonella enterica enterica serovar Typhi
accauuaacaucag

SEQ ID NO: 3674054 - RNA, 17 nt, Salmonella enterica enterica serovar Typhi
accauuaccauuccuca

SEQ ID NO: 3674055 - RNA, 13 nt, Salmonella enterica enterica serovar Typhi
accauuccagguc

SEQ ID NO: 3674056 - RNA, 18 nt, Salmonella enterica enterica serovar Typhi
accauucccguaaaagaa

SEQ ID NO: 3674057 - RNA, 18 nt, Salmonella enterica enterica serovar Typhi
accauuccgauagcgaaa

SEQ ID NO: 3674058 - RNA, 22 nt, Salmonella enterica enterica serovar Typhi
accauucugggaggugaaggau

SEQ ID NO: 3674059 - RNA, 14 nt, Salmonella enterica enterica serovar Typhi
accauugauaccaa

SEQ ID NO: 3674060 - RNA, 18 nt, Salmonella enterica enterica serovar Typhi
accauugcguauuucacc

SEQ ID NO: 3674061 - RNA, 15 nt, Salmonella enterica enterica serovar Typhi
accauuggcgcguca

SEQ ID NO: 3674062 - RNA, 14 nt, Salmonella enterica enterica serovar Typhi
accauuuccucugc

SEQ ID NO: 3674063 - RNA, 10 nt, Salmonella enterica enterica serovar Typhi
acccaaaaau

SEQ ID NO: 3674064 - RNA, 16 nt, Salmonella enterica enterica serovar Typhi
acccaaauaucaaaua

SEQ ID NO: 3674065 - RNA, 14 nt, Salmonella enterica enterica serovar Typhi
acccaacguuauaa

SEQ ID NO: 3674066 - RNA, 15 nt, Salmonella enterica enterica serovar Typhi
acccaaugauccgga

SEQ ID NO: 3674067 - RNA, 12 nt, Salmonella enterica enterica serovar Typhi
acccacaagaaa

SEQ ID NO: 3674068 - RNA, 13 nt, Salmonella enterica enterica serovar Typhi
acccacaagaaau

SEQ ID NO: 3674069 - RNA, 17 nt, Salmonella enterica enterica serovar Typhi
acccacaccacagccac

SEQ ID NO: 3674070 - RNA, 17 nt, Salmonella enterica enterica serovar Typhi
acccacaucagcggcac

SEQ ID NO: 3674071 - RNA, 15 nt, Salmonella enterica enterica serovar Typhi
acccaccaacuuuuc

SEQ ID NO: 3674072 - RNA, 14 nt, Salmonella enterica enterica serovar Typhi
acccaccagcgcca

SEQ ID NO: 3674073 - RNA, 16 nt, Salmonella enterica enterica serovar Typhi
acccaccauaaaacca

SEQ ID NO: 3674074 - RNA, 18 nt, Salmonella enterica enterica serovar Typhi
acccaccgacaaccccaa

SEQ ID NO: 3674075 - RNA, 24 nt, Salmonella enterica enterica serovar Typhi
acccaccguaucgacauaguaccc

SEQ ID NO: 3674076 - RNA, 17 nt, Salmonella enterica enterica serovar Typhi
acccaccucguucaaac

SEQ ID NO: 3674077 - RNA, 16 nt, Salmonella enterica enterica serovar Typhi
acccacuuugcuuuuc

SEQ ID NO: 3674078 - RNA, 21 nt, Salmonella enterica enterica serovar Typhi
acccagacugugauggcgguc

SEQ ID NO: 3674079 - RNA, 16 nt, Salmonella enterica enterica serovar Typhi
acccagauuaugggua

SEQ ID NO: 3674080 - RNA, 18 nt, Salmonella enterica enterica serovar Typhi
acccagccagacgccagc

SEQ ID NO: 3674081 - RNA, 12 nt, Salmonella enterica enterica serovar Typhi
acccagcccaau

SEQ ID NO: 3674082 - RNA, 22 nt, Salmonella enterica enterica serovar Typhi
acccagcccaauacgccagccu

SEQ ID NO: 3674083 - RNA, 16 nt, Salmonella enterica enterica serovar Typhi
acccagcgaauuauga

SEQ ID NO: 3674084 - RNA, 19 nt, Salmonella enterica enterica serovar Typhi
acccagcgcgaauuugccc

SEQ ID NO: 3674085 - RNA, 15 nt, Salmonella enterica enterica serovar Typhi
acccaggcaucagau

SEQ ID NO: 3674086 - RNA, 15 nt, Salmonella enterica enterica serovar Typhi
acccaggccaucaga

SEQ ID NO: 3674087 - RNA, 19 nt, Salmonella enterica enterica serovar Typhi
acccaggcgucgaacuccg

SEQ ID NO: 3674088 - RNA, 16 nt, Salmonella enterica enterica serovar Typhi
acccagucgcagccac

SEQ ID NO: 3674089 - RNA, 19 nt, Salmonella enterica enterica serovar Typhi
acccauaacgggaagccgu

SEQ ID NO: 3674090 - RNA, 19 nt, Salmonella enterica enterica serovar Typhi
acccauacucuuucccggc

SEQ ID NO: 3674091 - RNA, 16 nt, Salmonella enterica enterica serovar Typhi
acccauagcagcuccg

SEQ ID NO: 3674092 - RNA, 21 nt, Salmonella enterica enterica serovar Typhi
acccauauucgucuucaucuu

SEQ ID NO: 3674093 - RNA, 12 nt, Salmonella enterica enterica serovar Typhi
acccaucaauaa

SEQ ID NO: 3674094 - RNA, 13 nt, Salmonella enterica enterica serovar Typhi
acccaucaauaac

SEQ ID NO: 3674095 - RNA, 14 nt, Salmonella enterica enterica serovar Typhi
acccaucaauaacg

SEQ ID NO: 3674096 - RNA, 13 nt, Salmonella enterica enterica serovar Typhi
acccauccccaua

SEQ ID NO: 3674097 - RNA, 15 nt, Salmonella enterica enterica serovar Typhi
acccaugacgguagc

SEQ ID NO: 3674098 - RNA, 19 nt, Salmonella enterica enterica serovar Typhi
acccaugccgcgacgaagu

SEQ ID NO: 3674099 - RNA, 19 nt, Salmonella enterica enterica serovar Typhi
acccauuaccuggcaacau

SEQ ID NO: 3674100 - RNA, 17 nt, Salmonella enterica enterica serovar Typhi
acccauuuuauccucuu

SEQ ID NO: 3674101 - RNA, 15 nt, Salmonella enterica enterica serovar Typhi
accccacccacugau

SEQ ID NO: 3674102 - RNA, 18 nt, Salmonella enterica enterica serovar Typhi
accccaggcauagaaaaa

SEQ ID NO: 3674103 - RNA, 22 nt, Salmonella enterica enterica serovar Typhi
accccaggcgauaccgcgcugg

SEQ ID NO: 3674104 - RNA, 18 nt, Salmonella enterica enterica serovar Typhi
accccagggagacggcca

SEQ ID NO: 3674105 - RNA, 22 nt, Salmonella enterica enterica serovar Typhi
accccaguaauccggcaacugc

SEQ ID NO: 3674106 - RNA, 15 nt, Salmonella enterica enterica serovar Typhi
accccaucccggcaa

SEQ ID NO: 3674107 - RNA, 18 nt, Salmonella enterica enterica serovar Typhi
accccaugccgauaauaa

SEQ ID NO: 3674108 - RNA, 13 nt, Salmonella enterica enterica serovar Typhi
accccauggcguc

SEQ ID NO: 3674109 - RNA, 19 nt, Salmonella enterica enterica serovar Typhi
accccauuaugugcgacgu

SEQ ID NO: 3674110 - RNA, 17 nt, Salmonella enterica enterica serovar Typhi
acccccagcacauuaca

SEQ ID NO: 3674111 - RNA, 16 nt, Salmonella enterica enterica serovar Typhi
accccgccaccgccgc

SEQ ID NO: 3674112 - RNA, 19 nt, Salmonella enterica enterica serovar Typhi
accccgccgucagacaggc

SEQ ID NO: 3674113 - RNA, 14 nt, Salmonella enterica enterica serovar Typhi
accccggccucgcc

SEQ ID NO: 3674114 - RNA, 13 nt, Salmonella enterica enterica serovar Typhi
accgcauuuucag

SEQ ID NO: 3674115 - RNA, 17 nt, Salmonella enterica enterica serovar Typhi
accgccaaacgcgguca

SEQ ID NO: 3674116 - RNA, 15 nt, Salmonella enterica enterica serovar Typhi
accgccaaccgcccg

SEQ ID NO: 3674117 - RNA, 17 nt, Salmonella enterica enterica serovar Typhi
accgccaaccgcccguc

SEQ ID NO: 3674118 - RNA, 14 nt, Salmonella enterica enterica serovar Typhi
accgccaagcgcgg

SEQ ID NO: 3674119 - RNA, 21 nt, Salmonella enterica enterica serovar Typhi
accgccaauaaaaacugcuaa

SEQ ID NO: 3674120 - RNA, 16 nt, Salmonella enterica enterica serovar Typhi
accgccaauaauuuua

SEQ ID NO: 3674121 - RNA, 23 nt, Salmonella enterica enterica serovar Typhi
accgccacuuugcuuuguagcgc

SEQ ID NO: 3674122 - RNA, 22 nt, Salmonella enterica enterica serovar Typhi
accgccagauggaaaccggcgu

SEQ ID NO: 3674123 - RNA, 12 nt, Salmonella enterica enterica serovar Typhi
accgccagcaga

SEQ ID NO: 3674124 - RNA, 18 nt, Salmonella enterica enterica serovar Typhi
accgccagcaguagcuug

SEQ ID NO: 3674125 - RNA, 20 nt, Salmonella enterica enterica serovar Typhi
accgccauacggaugccgau

SEQ ID NO: 3674126 - RNA, 16 nt, Salmonella enterica enterica serovar Typhi
accgccaucaaacgca

SEQ ID NO: 3674127 - RNA, 18 nt, Salmonella enterica enterica serovar Typhi
accgccaucaaacgcagc

SEQ ID NO: 3674128 - RNA, 14 nt, Salmonella enterica enterica serovar Typhi
accgccauccggca

SEQ ID NO: 3674129 - RNA, 16 nt, Salmonella enterica enterica serovar Typhi
accgccauccggcauu

SEQ ID NO: 3674130 - RNA, 17 nt, Salmonella enterica enterica serovar Typhi
accgccaugcggcgcca

SEQ ID NO: 3674131 - RNA, 16 nt, Salmonella enterica enterica serovar Typhi
accgcccaacauaacg

SEQ ID NO: 3674132 - RNA, 18 nt, Salmonella enterica enterica serovar Typhi
accgcccaucaacaccag

SEQ ID NO: 3674133 - RNA, 18 nt, Salmonella enterica enterica serovar Typhi
accgcccaucgccugauu

SEQ ID NO: 3674134 - RNA, 15 nt, Salmonella enterica enterica serovar Typhi
accgcccgccgggcg

SEQ ID NO: 3674135 - RNA, 23 nt, Salmonella enterica enterica serovar Typhi
accgcccgcgcuuuagggcuucc

SEQ ID NO: 3674136 - RNA, 20 nt, Salmonella enterica enterica serovar Typhi
accgcccgcggcgaucacca

SEQ ID NO: 3674137 - RNA, 16 nt, Salmonella enterica enterica serovar Typhi
accgccgacaaucguc

SEQ ID NO: 3674138 - RNA, 12 nt, Salmonella enterica enterica serovar Typhi
accgccgacagu

SEQ ID NO: 3674139 - RNA, 21 nt, Salmonella enterica enterica serovar Typhi
accgccgagcauuuccgcagc

SEQ ID NO: 3674140 - RNA, 14 nt, Salmonella enterica enterica serovar Typhi
accgccgaugcuga

SEQ ID NO: 3674141 - RNA, 18 nt, Salmonella enterica enterica serovar Typhi
accgccgccaaacugcgc

SEQ ID NO: 3674142 - RNA, 18 nt, Salmonella enterica enterica serovar Typhi
accgccgccaccaaaaac

SEQ ID NO: 3674143 - RNA, 14 nt, Salmonella enterica enterica serovar Typhi
accgccgcgcguca

SEQ ID NO: 3674144 - RNA, 16 nt, Salmonella enterica enterica serovar Typhi
accgccguccuggcga

SEQ ID NO: 3674145 - RNA, 16 nt, Salmonella enterica enterica serovar Typhi
accgccguuagcgccu

SEQ ID NO: 3674146 - RNA, 22 nt, Salmonella enterica enterica serovar Typhi
accgccuaacagcgccgcgccg

SEQ ID NO: 3674147 - RNA, 17 nt, Salmonella enterica enterica serovar Typhi
accgccuguuuaaugau

SEQ ID NO: 3674148 - RNA, 20 nt, Salmonella enterica enterica serovar Typhi
accgccuuauccggccuaca

SEQ ID NO: 3674149 - RNA, 18 nt, Salmonella enterica enterica serovar Typhi
accgccuucagcgcgccc

SEQ ID NO: 3674150 - RNA, 16 nt, Salmonella enterica enterica serovar Typhi
accgcgaugaccauca

SEQ ID NO: 3674151 - RNA, 20 nt, Salmonella enterica enterica serovar Typhi
accgcgaugaccaucaaaua

SEQ ID NO: 3674152 - RNA, 13 nt, Salmonella enterica enterica serovar Typhi
accgcgcccgguu

SEQ ID NO: 3674153 - RNA, 19 nt, Salmonella enterica enterica serovar Typhi
accgcgcgcccgacgcgcc

SEQ ID NO: 3674154 - RNA, 19 nt, Salmonella enterica enterica serovar Typhi
accgcgcggcguucugcgc

SEQ ID NO: 3674155 - RNA, 20 nt, Salmonella enterica enterica serovar Typhi
accgcgcggcguucugcgcc

SEQ ID NO: 3674156 - RNA, 15 nt, Salmonella enterica enterica serovar Typhi
accgcgcuccuggaa

SEQ ID NO: 3674157 - RNA, 13 nt, Salmonella enterica enterica serovar Typhi
accgcguuugcgc

SEQ ID NO: 3674158 - RNA, 16 nt, Salmonella enterica enterica serovar Typhi
accgcguuuugcugau

SEQ ID NO: 3674159 - RNA, 23 nt, Salmonella enterica enterica serovar Typhi
accgcguuuugcugaugaagcga

SEQ ID NO: 3674160 - RNA, 16 nt, Salmonella enterica enterica serovar Typhi
accgcuaaugaggaaa

SEQ ID NO: 3674161 - RNA, 14 nt, Salmonella enterica enterica serovar Typhi
accgcuacaaucca

SEQ ID NO: 3674162 - RNA, 12 nt, Salmonella enterica enterica serovar Typhi
accgcuaugaau

SEQ ID NO: 3674163 - RNA, 19 nt, Salmonella enterica enterica serovar Typhi
accgcucuccgcaauuaau

SEQ ID NO: 3674164 - RNA, 21 nt, Salmonella enterica enterica serovar Typhi
accgcugauggaccuuuuggu

SEQ ID NO: 3674165 - RNA, 14 nt, Salmonella enterica enterica serovar Typhi
accgcugcgauaau

SEQ ID NO: 3674166 - RNA, 13 nt, Salmonella enterica enterica serovar Typhi
accgcugcgcuca

SEQ ID NO: 3674167 - RNA, 18 nt, Salmonella enterica enterica serovar Typhi
accgcugcggaacaccag

SEQ ID NO: 3674168 - RNA, 22 nt, Salmonella enterica enterica serovar Typhi
accgcugggaugaccugaaauc

SEQ ID NO: 3674169 - RNA, 15 nt, Salmonella enterica enterica serovar Typhi
accgcuucgcauugc

SEQ ID NO: 3674170 - RNA, 16 nt, Salmonella enterica enterica serovar Typhi
accgcuucgcauugcg

SEQ ID NO: 3674171 - RNA, 24 nt, Salmonella enterica enterica serovar Typhi
accgcuuuaucauaccagugcaga

SEQ ID NO: 3674172 - RNA, 16 nt, Salmonella enterica enterica serovar Typhi
accgcuuucccggcau

SEQ ID NO: 3674173 - RNA, 22 nt, Salmonella enterica enterica serovar Typhi
accgcuuugccgcgcucuuuaa

SEQ ID NO: 3674174 - RNA, 23 nt, Salmonella enterica enterica serovar Typhi
accggaaauggucgcuccggaac

SEQ ID NO: 3674175 - RNA, 13 nt, Salmonella enterica enterica serovar Typhi
accggaacagaag

SEQ ID NO: 3674176 - RNA, 20 nt, Salmonella enterica enterica serovar Typhi
accggaccuaauagccagcc

SEQ ID NO: 3674177 - RNA, 17 nt, Salmonella enterica enterica serovar Typhi
accggacggucggcgua

SEQ ID NO: 3674178 - RNA, 15 nt, Salmonella enterica enterica serovar Typhi
accggacuccaggca

SEQ ID NO: 3674179 - RNA, 14 nt, Salmonella enterica enterica serovar Typhi
accggacugcucgc

SEQ ID NO: 3674180 - RNA, 16 nt, Salmonella enterica enterica serovar Typhi
accggaggagugcgcc

SEQ ID NO: 3674181 - RNA, 15 nt, Salmonella enterica enterica serovar Typhi
accggauauggcaaa

SEQ ID NO: 3674182 - RNA, 17 nt, Salmonella enterica enterica serovar Typhi
accggauauggcaaaaa

SEQ ID NO: 3674183 - RNA, 18 nt, Salmonella enterica enterica serovar Typhi
accggaucaauaaacagc

SEQ ID NO: 3674184 - RNA, 20 nt, Salmonella enterica enterica serovar Typhi
accggaucaauaugccagau

SEQ ID NO: 3674185 - RNA, 19 nt, Salmonella enterica enterica serovar Typhi
accggaucgaucccggcaa

SEQ ID NO: 3674186 - RNA, 16 nt, Salmonella enterica enterica serovar Typhi
accggaugauggccug

SEQ ID NO: 3674187 - RNA, 23 nt, Salmonella enterica enterica serovar Typhi
accggaugggcagauagaaugcu

SEQ ID NO: 3674188 - RNA, 20 nt, Salmonella enterica enterica serovar Typhi
accggauuggucugauucag

SEQ ID NO: 3674189 - RNA, 14 nt, Salmonella enterica enterica serovar Typhi
accggcaauauccg

SEQ ID NO: 3674190 - RNA, 17 nt, Salmonella enterica enterica serovar Typhi
accggcacaccggccau

SEQ ID NO: 3674191 - RNA, 21 nt, Salmonella enterica enterica serovar Typhi
accggcacgguuaaugaaauc

SEQ ID NO: 3674192 - RNA, 15 nt, Salmonella enterica enterica serovar Typhi
accggcacucaccuc

SEQ ID NO: 3674193 - RNA, 18 nt, Salmonella enterica enterica serovar Typhi
accggcacucaccucuuc

SEQ ID NO: 3674194 - RNA, 14 nt, Salmonella enterica enterica serovar Typhi
accggcagccugcc

SEQ ID NO: 3674195 - RNA, 17 nt, Salmonella enterica enterica serovar Typhi
accggcagggccaguuc

SEQ ID NO: 3674196 - RNA, 20 nt, Salmonella enterica enterica serovar Typhi
accggcaggugauggcggcu

SEQ ID NO: 3674197 - RNA, 21 nt, Salmonella enterica enterica serovar Typhi
accggcauacacgccgggcac

SEQ ID NO: 3674198 - RNA, 14 nt, Salmonella enterica enterica serovar Typhi
accggcaucggcag

SEQ ID NO: 3674199 - RNA, 22 nt, Salmonella enterica enterica serovar Typhi
accggcauuucaccgucaauaa

SEQ ID NO: 3674200 - RNA, 23 nt, Salmonella enterica enterica serovar Typhi
accuaaucccuggcgaauaaaau

SEQ ID NO: 3674201 - RNA, 15 nt, Salmonella enterica enterica serovar Typhi
accuacccucaacgc

SEQ ID NO: 3674202 - RNA, 13 nt, Salmonella enterica enterica serovar Typhi
accuaccggcaua

SEQ ID NO: 3674203 - RNA, 14 nt, Salmonella enterica enterica serovar Typhi
accuacuguggugu

SEQ ID NO: 3674204 - RNA, 20 nt, Salmonella enterica enterica serovar Typhi
accuaucaggcguugaccgc

SEQ ID NO: 3674205 - RNA, 16 nt, Salmonella enterica enterica serovar Typhi
accuauuuaauaagca

SEQ ID NO: 3674206 - RNA, 19 nt, Salmonella enterica enterica serovar Typhi
accuauuucgauaccgacu

SEQ ID NO: 3674207 - RNA, 14 nt, Salmonella enterica enterica serovar Typhi
accuauuuugcaaa

SEQ ID NO: 3674208 - RNA, 16 nt, Salmonella enterica enterica serovar Typhi
accucaaggcucagca

SEQ ID NO: 3674209 - RNA, 18 nt, Salmonella enterica enterica serovar Typhi
accucagccaacccacgc

SEQ ID NO: 3674210 - RNA, 14 nt, Salmonella enterica enterica serovar Typhi
accucaucaaacag

SEQ ID NO: 3674211 - RNA, 17 nt, Salmonella enterica enterica serovar Typhi
accucaucaacgccaag

SEQ ID NO: 3674212 - RNA, 23 nt, Salmonella enterica enterica serovar Typhi
accucauccagauguuauaaacu

SEQ ID NO: 3674213 - RNA, 15 nt, Salmonella enterica enterica serovar Typhi
accuccaaagcgcua

SEQ ID NO: 3674214 - RNA, 11 nt, Salmonella enterica enterica serovar Typhi
accuccgccac

SEQ ID NO: 3674215 - RNA, 12 nt, Salmonella enterica enterica serovar Typhi
accuccgcccgg

SEQ ID NO: 3674216 - RNA, 18 nt, Salmonella enterica enterica serovar Typhi
accuccggcuaugccgga

SEQ ID NO: 3674217 - RNA, 18 nt, Salmonella enterica enterica serovar Typhi
accuccugcaaucguucu

SEQ ID NO: 3674218 - RNA, 15 nt, Salmonella enterica enterica serovar Typhi
accuccugcaucgac

SEQ ID NO: 3674219 - RNA, 14 nt, Salmonella enterica enterica serovar Typhi
accuccuucgcgcc

SEQ ID NO: 3674220 - RNA, 16 nt, Salmonella enterica enterica serovar Typhi
accucgcaauauucau

SEQ ID NO: 3674221 - RNA, 14 nt, Salmonella enterica enterica serovar Typhi
accucggcuugcuu

SEQ ID NO: 3674222 - RNA, 22 nt, Salmonella enterica enterica serovar Typhi
accucggguaaagguuugcugc

SEQ ID NO: 3674223 - RNA, 18 nt, Salmonella enterica enterica serovar Typhi
accucgguauguccugcc

SEQ ID NO: 3674224 - RNA, 20 nt, Salmonella enterica enterica serovar Typhi
accucgguauguccugccgc

SEQ ID NO: 3674225 - RNA, 22 nt, Salmonella enterica enterica serovar Typhi
accucgguauguccugccgcaa

SEQ ID NO: 3674226 - RNA, 13 nt, Salmonella enterica enterica serovar Typhi
accucguucggcg

SEQ ID NO: 3674227 - RNA, 18 nt, Salmonella enterica enterica serovar Typhi
accucuauaacuugcaaa

SEQ ID NO: 3674228 - RNA, 13 nt, Salmonella enterica enterica serovar Typhi
accucugcaaaca

SEQ ID NO: 3674229 - RNA, 23 nt, Salmonella enterica enterica serovar Typhi
accucuuugcggccuuuauccag

SEQ ID NO: 3674230 - RNA, 20 nt, Salmonella enterica enterica serovar Typhi
accucuuuggcgcgaaccgu

SEQ ID NO: 3674231 - RNA, 19 nt, Salmonella enterica enterica serovar Typhi
accugaaccagcgccgucu

SEQ ID NO: 3674232 - RNA, 16 nt, Salmonella enterica enterica serovar Typhi
accugaaugcaaagaa

SEQ ID NO: 3674233 - RNA, 17 nt, Salmonella enterica enterica serovar Typhi
accugacuauacccaaa

SEQ ID NO: 3674234 - RNA, 14 nt, Salmonella enterica enterica serovar Typhi
accugauagcgggu

SEQ ID NO: 3674235 - RNA, 16 nt, Salmonella enterica enterica serovar Typhi
accugauagcggguaa

SEQ ID NO: 3674236 - RNA, 19 nt, Salmonella enterica enterica serovar Typhi
accugaugguuauuuucag

SEQ ID NO: 3674237 - RNA, 21 nt, Salmonella enterica enterica serovar Typhi
accugauguagcucuucaucu

SEQ ID NO: 3674238 - RNA, 10 nt, Salmonella enterica enterica serovar Typhi
accugauguc

SEQ ID NO: 3674239 - RNA, 13 nt, Salmonella enterica enterica serovar Typhi
accugaugugcuu

SEQ ID NO: 3674240 - RNA, 16 nt, Salmonella enterica enterica serovar Typhi
accugauucugcagcg

SEQ ID NO: 3674241 - RNA, 23 nt, Salmonella enterica enterica serovar Typhi
accugcaaaaacgccagaccgac

SEQ ID NO: 3674242 - RNA, 21 nt, Salmonella enterica enterica serovar Typhi
accugcagggugaagauggcg

SEQ ID NO: 3674243 - RNA, 21 nt, Salmonella enterica enterica serovar Typhi
accugcaucccuuucuuuaca

SEQ ID NO: 3674244 - RNA, 20 nt, Salmonella enterica enterica serovar Typhi
accugccaguccgcccgccu

SEQ ID NO: 3674245 - RNA, 22 nt, Salmonella enterica enterica serovar Typhi
accugcccauccuuucucuggu

SEQ ID NO: 3674246 - RNA, 18 nt, Salmonella enterica enterica serovar Typhi
accugccgaccucacugg

SEQ ID NO: 3674247 - RNA, 19 nt, Salmonella enterica enterica serovar Typhi
accugcgcaaucaugacag

SEQ ID NO: 3674248 - RNA, 13 nt, Salmonella enterica enterica serovar Typhi
accugcgcugacg

SEQ ID NO: 3674249 - RNA, 18 nt, Salmonella enterica enterica serovar Typhi
accugcggcaauggcuca

SEQ ID NO: 3674250 - RNA, 22 nt, Salmonella enterica enterica serovar Typhi
accugcggccaugaucgccgcc

SEQ ID NO: 3674251 - RNA, 15 nt, Salmonella enterica enterica serovar Typhi
accugcggcgcgccc

SEQ ID NO: 3674252 - RNA, 16 nt, Salmonella enterica enterica serovar Typhi
accugcuggcggcgua

SEQ ID NO: 3674253 - RNA, 17 nt, Salmonella enterica enterica serovar Typhi
accugcuggcggcguaa

SEQ ID NO: 3674254 - RNA, 23 nt, Salmonella enterica enterica serovar Typhi
accugcuggcggcguaagcgggu

SEQ ID NO: 3674255 - RNA, 24 nt, Salmonella enterica enterica serovar Typhi
accugcugucgcgguacuucugac

SEQ ID NO: 3674256 - RNA, 14 nt, Salmonella enterica enterica serovar Typhi
accugcuucagguu

SEQ ID NO: 3674257 - RNA, 18 nt, Salmonella enterica enterica serovar Typhi
accuggaaccaggcgcga

SEQ ID NO: 3674258 - RNA, 22 nt, Salmonella enterica enterica serovar Typhi
accuggaauagcgugggcagac

SEQ ID NO: 3674259 - RNA, 19 nt, Salmonella enterica enterica serovar Typhi
accuggaugcugccugccu

SEQ ID NO: 3674260 - RNA, 23 nt, Salmonella enterica enterica serovar Typhi
accuggauuccuccaauucaggu

SEQ ID NO: 3674261 - RNA, 18 nt, Salmonella enterica enterica serovar Typhi
accuggcccugcaucagc

SEQ ID NO: 3674262 - RNA, 21 nt, Salmonella enterica enterica serovar Typhi
accuggcccugcaucagcucg

SEQ ID NO: 3674263 - RNA, 20 nt, Salmonella enterica enterica serovar Typhi
accuggcguaguacgcgcgc

SEQ ID NO: 3674264 - RNA, 11 nt, Salmonella enterica enterica serovar Typhi
accuggcuggc

SEQ ID NO: 3674265 - RNA, 16 nt, Salmonella enterica enterica serovar Typhi
accugggaaucgugca

SEQ ID NO: 3674266 - RNA, 20 nt, Salmonella enterica enterica serovar Typhi
accuggguagcuucugucug

SEQ ID NO: 3674267 - RNA, 21 nt, Salmonella enterica enterica serovar Typhi
accuggguagcuucugucugc

SEQ ID NO: 3674268 - RNA, 14 nt, Salmonella enterica enterica serovar Typhi
accugguaagcgca

SEQ ID NO: 3674269 - RNA, 14 nt, Salmonella enterica enterica serovar Typhi
accugguaagcgcc

SEQ ID NO: 3674270 - RNA, 19 nt, Salmonella enterica enterica serovar Typhi
accugguacaccagacgau

SEQ ID NO: 3674271 - RNA, 23 nt, Salmonella enterica enterica serovar Typhi
accuguaaccccagcaucugcau

SEQ ID NO: 3674272 - RNA, 17 nt, Salmonella enterica enterica serovar Typhi
accuguaaccuuaaaag

SEQ ID NO: 3674273 - RNA, 21 nt, Salmonella enterica enterica serovar Typhi
accuguagggcacugggcgau

SEQ ID NO: 3674274 - RNA, 16 nt, Salmonella enterica enterica serovar Typhi
accuguaucaaaccaa

SEQ ID NO: 3674275 - RNA, 19 nt, Salmonella enterica enterica serovar Typhi
accuguaucugcugacacc

SEQ ID NO: 3674276 - RNA, 14 nt, Salmonella enterica enterica serovar Typhi
accuguauuuucgu

SEQ ID NO: 3674277 - RNA, 22 nt, Salmonella enterica enterica serovar Typhi
accugucguacgccuaaaugaa

SEQ ID NO: 3674278 - RNA, 16 nt, Salmonella enterica enterica serovar Typhi
accugucuuugcgccg

SEQ ID NO: 3674279 - RNA, 18 nt, Salmonella enterica enterica serovar Typhi
accuguucaugccagauu

SEQ ID NO: 3674280 - RNA, 17 nt, Salmonella enterica enterica serovar Typhi
accuguuucgccaggcc

SEQ ID NO: 3674281 - RNA, 20 nt, Salmonella enterica enterica serovar Typhi
accuuaaccgucugcucaga

SEQ ID NO: 3674282 - RNA, 20 nt, Salmonella enterica enterica serovar Typhi
accuuacguuucucacuaau

SEQ ID NO: 3674283 - RNA, 17 nt, Salmonella enterica enterica serovar Typhi
accuuaucgcagucagc

SEQ ID NO: 3674284 - RNA, 17 nt, Salmonella enterica enterica serovar Typhi
accuucaacccagcagc

SEQ ID NO: 3674285 - RNA, 18 nt, Salmonella enterica enterica serovar Typhi
acgauaaccaugcucagc

SEQ ID NO: 3674286 - RNA, 22 nt, Salmonella enterica enterica serovar Typhi
acgauaauaucgucaccaggau

SEQ ID NO: 3674287 - RNA, 21 nt, Salmonella enterica enterica serovar Typhi
acgauaauguuuuacgauggu

SEQ ID NO: 3674288 - RNA, 20 nt, Salmonella enterica enterica serovar Typhi
acgauaccgacacaucaucg

SEQ ID NO: 3674289 - RNA, 12 nt, Salmonella enterica enterica serovar Typhi
acgauacgucau

SEQ ID NO: 3674290 - RNA, 18 nt, Salmonella enterica enterica serovar Typhi
acgauacgucauaucauc

SEQ ID NO: 3674291 - RNA, 16 nt, Salmonella enterica enterica serovar Typhi
acgauacucagcccca

SEQ ID NO: 3674292 - RNA, 19 nt, Salmonella enterica enterica serovar Typhi
acgauagcgccgguuucuc

SEQ ID NO: 3674293 - RNA, 21 nt, Salmonella enterica enterica serovar Typhi
acgauaggcauacacaucuuc

SEQ ID NO: 3674294 - RNA, 20 nt, Salmonella enterica enterica serovar Typhi
acgauaguuugccagagaga

SEQ ID NO: 3674295 - RNA, 14 nt, Salmonella enterica enterica serovar Typhi
acgauauagucgcc

SEQ ID NO: 3674296 - RNA, 23 nt, Salmonella enterica enterica serovar Typhi
acgauaucgccuggugugaacau

SEQ ID NO: 3674297 - RNA, 20 nt, Salmonella enterica enterica serovar Typhi
acgaucaauaaaauuaucca

SEQ ID NO: 3674298 - RNA, 21 nt, Salmonella enterica enterica serovar Typhi
acgaucaauaaaauuauccag

SEQ ID NO: 3674299 - RNA, 14 nt, Salmonella enterica enterica serovar Typhi
acgaucaugccgcc

SEQ ID NO: 3674300 - RNA, 15 nt, Salmonella enterica enterica serovar Typhi
acgaucaugccgccc

SEQ ID NO: 3674301 - RNA, 14 nt, Salmonella enterica enterica serovar Typhi
acgaucauuucacu

SEQ ID NO: 3674302 - RNA, 14 nt, Salmonella enterica enterica serovar Typhi
acgauccccgucaa

SEQ ID NO: 3674303 - RNA, 21 nt, Salmonella enterica enterica serovar Typhi
acgaucggcuggaauagacag

SEQ ID NO: 3674304 - RNA, 15 nt, Salmonella enterica enterica serovar Typhi
acgaucguuugccca

SEQ ID NO: 3674305 - RNA, 19 nt, Salmonella enterica enterica serovar Typhi
acgaucuggcaaaccaugu

SEQ ID NO: 3674306 - RNA, 22 nt, Salmonella enterica enterica serovar Typhi
acgaugauaauacauugccgca

SEQ ID NO: 3674307 - RNA, 20 nt, Salmonella enterica enterica serovar Typhi
acgaugcauaugcacagcgc

SEQ ID NO: 3674308 - RNA, 23 nt, Salmonella enterica enterica serovar Typhi
acgaugcuugccauauugccgca

SEQ ID NO: 3674309 - RNA, 11 nt, Salmonella enterica enterica serovar Typhi
acgauggcgau

SEQ ID NO: 3674310 - RNA, 14 nt, Salmonella enterica enterica serovar Typhi
acgaugucaucgcc

SEQ ID NO: 3674311 - RNA, 20 nt, Salmonella enterica enterica serovar Typhi
acgaugugcauaaccgcgcc

SEQ ID NO: 3674312 - RNA, 19 nt, Salmonella enterica enterica serovar Typhi
acgauuggccgucucuuuc

SEQ ID NO: 3674313 - RNA, 13 nt, Salmonella enterica enterica serovar Typhi
acgauuuccccug

SEQ ID NO: 3674314 - RNA, 19 nt, Salmonella enterica enterica serovar Typhi
acgauuuugguagcgcuga

SEQ ID NO: 3674315 - RNA, 19 nt, Salmonella enterica enterica serovar Typhi
acgcaaaccgcuuucauca

SEQ ID NO: 3674316 - RNA, 19 nt, Salmonella enterica enterica serovar Typhi
acgcaaagacaccccagcc

SEQ ID NO: 3674317 - RNA, 13 nt, Salmonella enterica enterica serovar Typhi
acgcaaaucaccg

SEQ ID NO: 3674318 - RNA, 14 nt, Salmonella enterica enterica serovar Typhi
acgcaacaccaucc

SEQ ID NO: 3674319 - RNA, 17 nt, Salmonella enterica enterica serovar Typhi
acgcaacaggccgcauc

SEQ ID NO: 3674320 - RNA, 19 nt, Salmonella enterica enterica serovar Typhi
acgcaacaggccgcaucgg

SEQ ID NO: 3674321 - RNA, 22 nt, Salmonella enterica enterica serovar Typhi
acgcaacaggccgcaucgggaa

SEQ ID NO: 3674322 - RNA, 17 nt, Salmonella enterica enterica serovar Typhi
acgcaagagagcaacau

SEQ ID NO: 3674323 - RNA, 13 nt, Salmonella enterica enterica serovar Typhi
acgcaagcagcac

SEQ ID NO: 3674324 - RNA, 16 nt, Salmonella enterica enterica serovar Typhi
acgcaaggaaauauua

SEQ ID NO: 3674325 - RNA, 22 nt, Salmonella enterica enterica serovar Typhi
acgcaaggaaauauuaauuaag

SEQ ID NO: 3674326 - RNA, 13 nt, Salmonella enterica enterica serovar Typhi
acgcaccagccag

SEQ ID NO: 3674327 - RNA, 21 nt, Salmonella enterica enterica serovar Typhi
acgcaccgccaaacgcgguca

SEQ ID NO: 3674328 - RNA, 17 nt, Salmonella enterica enterica serovar Typhi
acgcaccguagugacac

SEQ ID NO: 3674329 - RNA, 15 nt, Salmonella enterica enterica serovar Typhi
acgcagaagacagaa

SEQ ID NO: 3674330 - RNA, 19 nt, Salmonella enterica enterica serovar Typhi
acgcagaagcgcguuggcg

SEQ ID NO: 3674331 - RNA, 13 nt, Salmonella enterica enterica serovar Typhi
acgcagaccaaag

SEQ ID NO: 3674332 - RNA, 18 nt, Salmonella enterica enterica serovar Typhi
acgcagacuauagguggc

SEQ ID NO: 3674333 - RNA, 15 nt, Salmonella enterica enterica serovar Typhi
acgcagauauucauu

SEQ ID NO: 3674334 - RNA, 12 nt, Salmonella enterica enterica serovar Typhi
acgcagcaagaa

SEQ ID NO: 3674335 - RNA, 18 nt, Salmonella enterica enterica serovar Typhi
acgcagcacguccagaua

SEQ ID NO: 3674336 - RNA, 14 nt, Salmonella enterica enterica serovar Typhi
acgcagcaucgcca

SEQ ID NO: 3674337 - RNA, 18 nt, Salmonella enterica enterica serovar Typhi
acgcagcaucucaauauc

SEQ ID NO: 3674338 - RNA, 16 nt, Salmonella enterica enterica serovar Typhi
acgcagcauuucgucg

SEQ ID NO: 3674339 - RNA, 11 nt, Salmonella enterica enterica serovar Typhi
acgcagcccca

SEQ ID NO: 3674340 - RNA, 17 nt, Salmonella enterica enterica serovar Typhi
acgcagccgaggcuuaa

SEQ ID NO: 3674341 - RNA, 15 nt, Salmonella enterica enterica serovar Typhi
acgcagcgcgcguag

SEQ ID NO: 3674342 - RNA, 20 nt, Salmonella enterica enterica serovar Typhi
acgcagcucauacccuucca

SEQ ID NO: 3674343 - RNA, 17 nt, Salmonella enterica enterica serovar Typhi
acgcagcuuaaagccaa

SEQ ID NO: 3674344 - RNA, 14 nt, Salmonella enterica enterica serovar Typhi
acgcagcuucgccg

SEQ ID NO: 3674345 - RNA, 17 nt, Salmonella enterica enterica serovar Typhi
acgcaggcgaaaucaaa

SEQ ID NO: 3674346 - RNA, 22 nt, Salmonella enterica enterica serovar Typhi
acgcaggcuaacgcgccccagg

SEQ ID NO: 3674347 - RNA, 16 nt, Salmonella enterica enterica serovar Typhi
acgcaggcuugcccau

SEQ ID NO: 3674348 - RNA, 20 nt, Salmonella enterica enterica serovar Typhi
acgcagggccgcgagaacuu

SEQ ID NO: 3674349 - RNA, 20 nt, Salmonella enterica enterica serovar Typhi
acgcagugcgcgaccgcauc

SEQ ID NO: 3674350 - RNA, 17 nt, Salmonella enterica enterica serovar Typhi
acgcaguggcaauuuaa

SEQ ID NO: 3674351 - RNA, 19 nt, Salmonella enterica enterica serovar Typhi
acgcauaaaaaaugagaaa

SEQ ID NO: 3674352 - RNA, 15 nt, Salmonella enterica enterica serovar Typhi
acgcauaccagccau

SEQ ID NO: 3674353 - RNA, 15 nt, Salmonella enterica enterica serovar Typhi
acgcauaguccugcc

SEQ ID NO: 3674354 - RNA, 24 nt, Salmonella enterica enterica serovar Typhi
acgcauaucccacugcacgccagg

SEQ ID NO: 3674355 - RNA, 15 nt, Salmonella enterica enterica serovar Typhi
acgcaucaaagccac

SEQ ID NO: 3674356 - RNA, 16 nt, Salmonella enterica enterica serovar Typhi
acgcaucaaagccacc

SEQ ID NO: 3674357 - RNA, 23 nt, Salmonella enterica enterica serovar Typhi
acgcaucaaagccacccacggca

SEQ ID NO: 3674358 - RNA, 19 nt, Salmonella enterica enterica serovar Typhi
acgcaucaaauaccuuuuc

SEQ ID NO: 3674359 - RNA, 22 nt, Salmonella enterica enterica serovar Typhi
acgcauccagcgcaaagggaca

SEQ ID NO: 3674360 - RNA, 16 nt, Salmonella enterica enterica serovar Typhi
acgcauccugcacuuu

SEQ ID NO: 3674361 - RNA, 18 nt, Salmonella enterica enterica serovar Typhi
acgcaucugggcugagaa

SEQ ID NO: 3674362 - RNA, 16 nt, Salmonella enterica enterica serovar Typhi
acgcaucuuuuucccg

SEQ ID NO: 3674363 - RNA, 22 nt, Salmonella enterica enterica serovar Typhi
acgcaugacccaggcaucagau

SEQ ID NO: 3674364 - RNA, 15 nt, Salmonella enterica enterica serovar Typhi
acgcaugguuagcca

SEQ ID NO: 3674365 - RNA, 22 nt, Salmonella enterica enterica serovar Typhi
acgcauugagacaugccgccag

SEQ ID NO: 3674366 - RNA, 22 nt, Salmonella enterica enterica serovar Typhi
acgcauugccauguuaauacca

SEQ ID NO: 3674367 - RNA, 18 nt, Salmonella enterica enterica serovar Typhi
acgcauuggcaauuaaac

SEQ ID NO: 3674368 - RNA, 16 nt, Salmonella enterica enterica serovar Typhi
acgcauuucaagcagg

SEQ ID NO: 3674369 - RNA, 18 nt, Salmonella enterica enterica serovar Typhi
acgcauuucaagcaggcg

SEQ ID NO: 3674370 - RNA, 19 nt, Salmonella enterica enterica serovar Typhi
acgccgugaacgccaaaua

SEQ ID NO: 3674371 - RNA, 21 nt, Salmonella enterica enterica serovar Typhi
acgccgugaauuucugcugcc

SEQ ID NO: 3674372 - RNA, 16 nt, Salmonella enterica enterica serovar Typhi
acgccgugacggcgua

SEQ ID NO: 3674373 - RNA, 21 nt, Salmonella enterica enterica serovar Typhi
acgccguuuguuuauugccgc

SEQ ID NO: 3674374 - RNA, 19 nt, Salmonella enterica enterica serovar Typhi
acgccuaccgcuucccaca

SEQ ID NO: 3674375 - RNA, 15 nt, Salmonella enterica enterica serovar Typhi
acgccuccaggcuac

SEQ ID NO: 3674376 - RNA, 12 nt, Salmonella enterica enterica serovar Typhi
acgccugaugcu

SEQ ID NO: 3674377 - RNA, 14 nt, Salmonella enterica enterica serovar Typhi
acgccugccagaua

SEQ ID NO: 3674378 - RNA, 15 nt, Salmonella enterica enterica serovar Typhi
acgccugcuucacgu

SEQ ID NO: 3674379 - RNA, 12 nt, Salmonella enterica enterica serovar Typhi
acgccuggagug

SEQ ID NO: 3674380 - RNA, 20 nt, Salmonella enterica enterica serovar Typhi
acgccugggauagugcugcg

SEQ ID NO: 3674381 - RNA, 19 nt, Salmonella enterica enterica serovar Typhi
acgccuggugggauaggcu

SEQ ID NO: 3674382 - RNA, 19 nt, Salmonella enterica enterica serovar Typhi
acgccuuacccgaccuaca

SEQ ID NO: 3674383 - RNA, 21 nt, Salmonella enterica enterica serovar Typhi
acgccuuacccgaccuacauc

SEQ ID NO: 3674384 - RNA, 21 nt, Salmonella enterica enterica serovar Typhi
acgccuuauccgaccuacaga

SEQ ID NO: 3674385 - RNA, 19 nt, Salmonella enterica enterica serovar Typhi
acgccuuauccggccuaca

SEQ ID NO: 3674386 - RNA, 21 nt, Salmonella enterica enterica serovar Typhi
acgccuucauauuaaauuccg

SEQ ID NO: 3674387 - RNA, 18 nt, Salmonella enterica enterica serovar Typhi
acgccuuccuccagcauc

SEQ ID NO: 3674388 - RNA, 15 nt, Salmonella enterica enterica serovar Typhi
acgccuuugcccggu

SEQ ID NO: 3674389 - RNA, 16 nt, Salmonella enterica enterica serovar Typhi
acgccuuugcccggug

SEQ ID NO: 3674390 - RNA, 17 nt, Salmonella enterica enterica serovar Typhi
acgcgaauagccagaca

SEQ ID NO: 3674391 - RNA, 21 nt, Salmonella enterica enterica serovar Typhi
acgcgacuuuccgccaccaga

SEQ ID NO: 3674392 - RNA, 15 nt, Salmonella enterica enterica serovar Typhi
acgcgagaagcccgg

SEQ ID NO: 3674393 - RNA, 22 nt, Salmonella enterica enterica serovar Typhi
acgcgagcugccaguucauucc

SEQ ID NO: 3674394 - RNA, 19 nt, Salmonella enterica enterica serovar Typhi
acgcgagugucauccugcg

SEQ ID NO: 3674395 - RNA, 21 nt, Salmonella enterica enterica serovar Typhi
acgcgauaaaaaacgcccaga

SEQ ID NO: 3674396 - RNA, 14 nt, Salmonella enterica enterica serovar Typhi
acgcgauagauacc

SEQ ID NO: 3674397 - RNA, 17 nt, Salmonella enterica enterica serovar Typhi
acgcgauauguuugcgc

SEQ ID NO: 3674398 - RNA, 18 nt, Salmonella enterica enterica serovar Typhi
acgcgaucgcgauucgcc

SEQ ID NO: 3674399 - RNA, 15 nt, Salmonella enterica enterica serovar Typhi
acgcgaugagauaau

SEQ ID NO: 3674400 - RNA, 20 nt, Salmonella enterica enterica serovar Typhi
acgcgcagcaucucauccac

SEQ ID NO: 3674401 - RNA, 14 nt, Salmonella enterica enterica serovar Typhi
acgcgcauacucau

SEQ ID NO: 3674402 - RNA, 20 nt, Salmonella enterica enterica serovar Typhi
acgcgccacuuccagcgcgc

SEQ ID NO: 3674403 - RNA, 13 nt, Salmonella enterica enterica serovar Typhi
acgcgccagccag

SEQ ID NO: 3674404 - RNA, 15 nt, Salmonella enterica enterica serovar Typhi
acgcgccagccagcg

SEQ ID NO: 3674405 - RNA, 21 nt, Salmonella enterica enterica serovar Typhi
acgcgccaucgucaccggauc

SEQ ID NO: 3674406 - RNA, 21 nt, Salmonella enterica enterica serovar Typhi
acgcgcccaacggaugcgcca

SEQ ID NO: 3674407 - RNA, 17 nt, Salmonella enterica enterica serovar Typhi
acgcgcccucugagcug

SEQ ID NO: 3674408 - RNA, 22 nt, Salmonella enterica enterica serovar Typhi
acgcgccgagguuuucauccac

SEQ ID NO: 3674409 - RNA, 22 nt, Salmonella enterica enterica serovar Typhi
acgcgccgccaacgauacagca

SEQ ID NO: 3674410 - RNA, 18 nt, Salmonella enterica enterica serovar Typhi
acgcgccuggaucugcgc

SEQ ID NO: 3674411 - RNA, 13 nt, Salmonella enterica enterica serovar Typhi
acgcgcgcccugc

SEQ ID NO: 3674412 - RNA, 23 nt, Salmonella enterica enterica serovar Typhi
acgcgcgccggugaucccaccag

SEQ ID NO: 3674413 - RNA, 14 nt, Salmonella enterica enterica serovar Typhi
acgcgcgcgaaaag

SEQ ID NO: 3674414 - RNA, 14 nt, Salmonella enterica enterica serovar Typhi
acgcgcgcggcguc

SEQ ID NO: 3674415 - RNA, 12 nt, Salmonella enterica enterica serovar Typhi
acgcgcggcguc

SEQ ID NO: 3674416 - RNA, 16 nt, Salmonella enterica enterica serovar Typhi
acgcgcggcuacugcc

SEQ ID NO: 3674417 - RNA, 14 nt, Salmonella enterica enterica serovar Typhi
acgcgcgucaggac

SEQ ID NO: 3674418 - RNA, 17 nt, Salmonella enterica enterica serovar Typhi
acgcgcgucaggacggc

SEQ ID NO: 3674419 - RNA, 13 nt, Salmonella enterica enterica serovar Typhi
acgcgcguucguu

SEQ ID NO: 3674420 - RNA, 14 nt, Salmonella enterica enterica serovar Typhi
acgcgcuaaaugca

SEQ ID NO: 3674421 - RNA, 17 nt, Salmonella enterica enterica serovar Typhi
acgcgcucgccagcgcu

SEQ ID NO: 3674422 - RNA, 13 nt, Salmonella enterica enterica serovar Typhi
acgcgcugaccuc

SEQ ID NO: 3674423 - RNA, 14 nt, Salmonella enterica enterica serovar Typhi
acgcgcugauaccg

SEQ ID NO: 3674424 - RNA, 14 nt, Salmonella enterica enterica serovar Typhi
acgcgcuuguucgu

SEQ ID NO: 3674425 - RNA, 17 nt, Salmonella enterica enterica serovar Typhi
acgcgcuuguucgucug

SEQ ID NO: 3674426 - RNA, 21 nt, Salmonella enterica enterica serovar Typhi
acgcgcuuuuuucguaauuaa

SEQ ID NO: 3674427 - RNA, 19 nt, Salmonella enterica enterica serovar Typhi
acgcggaacuggugaaaca

SEQ ID NO: 3674428 - RNA, 14 nt, Salmonella enterica enterica serovar Typhi
acgcggaucggcac

SEQ ID NO: 3674429 - RNA, 18 nt, Salmonella enterica enterica serovar Typhi
acgcggcaucaagcauaa

SEQ ID NO: 3674430 - RNA, 13 nt, Salmonella enterica enterica serovar Typhi
acgcggcaucagg

SEQ ID NO: 3674431 - RNA, 17 nt, Salmonella enterica enterica serovar Typhi
acgcggcaucaggcaua

SEQ ID NO: 3674432 - RNA, 23 nt, Salmonella enterica enterica serovar Typhi
acgcggccuggaagcgcccaggc

SEQ ID NO: 3674433 - RNA, 12 nt, Salmonella enterica enterica serovar Typhi
acgcggcgcgcu

SEQ ID NO: 3674434 - RNA, 20 nt, Salmonella enterica enterica serovar Typhi
acgcggcgcggaagugauaa

SEQ ID NO: 3674435 - RNA, 21 nt, Salmonella enterica enterica serovar Typhi
acgcgggguaaaauggacuuc

SEQ ID NO: 3674436 - RNA, 15 nt, Salmonella enterica enterica serovar Typhi
acgcgguacccaccu

SEQ ID NO: 3674437 - RNA, 16 nt, Salmonella enterica enterica serovar Typhi
acgcgguaugauuaua

SEQ ID NO: 3674438 - RNA, 18 nt, Salmonella enterica enterica serovar Typhi
acgcggugacuuuggccg

SEQ ID NO: 3674439 - RNA, 16 nt, Salmonella enterica enterica serovar Typhi
acgcguaggccggaua

SEQ ID NO: 3674440 - RNA, 21 nt, Salmonella enterica enterica serovar Typhi
acgcgucaaauagagaaaaua

SEQ ID NO: 3674441 - RNA, 17 nt, Salmonella enterica enterica serovar Typhi
acgcgucugaaugacgc

SEQ ID NO: 3674442 - RNA, 17 nt, Salmonella enterica enterica serovar Typhi
acgcgucuguagcgcgc

SEQ ID NO: 3674443 - RNA, 21 nt, Salmonella enterica enterica serovar Typhi
acgcgucuguagcgcgcgcca

SEQ ID NO: 3674444 - RNA, 22 nt, Salmonella enterica enterica serovar Typhi
acgcgucuucaucagccagcau

SEQ ID NO: 3674445 - RNA, 23 nt, Salmonella enterica enterica serovar Typhi
acgcgucuucaucagccagcauc

SEQ ID NO: 3674446 - RNA, 18 nt, Salmonella enterica enterica serovar Typhi
acgcgugaacauggguuu

SEQ ID NO: 3674447 - RNA, 13 nt, Salmonella enterica enterica serovar Typhi
acgcgugcgaauu

SEQ ID NO: 3674448 - RNA, 17 nt, Salmonella enterica enterica serovar Typhi
acgcgugguaucgcgac

SEQ ID NO: 3674449 - RNA, 15 nt, Salmonella enterica enterica serovar Typhi
acgcguucugaauaa

SEQ ID NO: 3674450 - RNA, 17 nt, Salmonella enterica enterica serovar Typhi
acgcguucugaauaaau

SEQ ID NO: 3674451 - RNA, 18 nt, Salmonella enterica enterica serovar Typhi
acgcguuuuccagcacca

SEQ ID NO: 3674452 - RNA, 21 nt, Salmonella enterica enterica serovar Typhi
acgcguuuuccagcaccaguu

SEQ ID NO: 3674453 - RNA, 19 nt, Salmonella enterica enterica serovar Typhi
acgcuaaagcgcuggcggc

SEQ ID NO: 3674454 - RNA, 19 nt, Salmonella enterica enterica serovar Typhi
acgcuaccgucgccgacaa

SEQ ID NO: 3674455 - RNA, 21 nt, Salmonella enterica enterica serovar Typhi
acgcuauguuugcugagaauu

SEQ ID NO: 3674456 - RNA, 14 nt, Salmonella enterica enterica serovar Typhi
acggcaacugaaaa

SEQ ID NO: 3674457 - RNA, 22 nt, Salmonella enterica enterica serovar Typhi
acggcaacugaaaacaggccug

SEQ ID NO: 3674458 - RNA, 23 nt, Salmonella enterica enterica serovar Typhi
acggcaacugaaaacaggccugc

SEQ ID NO: 3674459 - RNA, 17 nt, Salmonella enterica enterica serovar Typhi
acggcaauuuuuacaaa

SEQ ID NO: 3674460 - RNA, 22 nt, Salmonella enterica enterica serovar Typhi
acggcaauuuuuacaaauuuaa

SEQ ID NO: 3674461 - RNA, 16 nt, Salmonella enterica enterica serovar Typhi
acggcacaacggccag

SEQ ID NO: 3674462 - RNA, 18 nt, Salmonella enterica enterica serovar Typhi
acggcacaacggccagca

SEQ ID NO: 3674463 - RNA, 14 nt, Salmonella enterica enterica serovar Typhi
acggcacacaggcc

SEQ ID NO: 3674464 - RNA, 19 nt, Salmonella enterica enterica serovar Typhi
acggcaccggaaccggcau

SEQ ID NO: 3674465 - RNA, 22 nt, Salmonella enterica enterica serovar Typhi
acggcacuacagcccuuucagg

SEQ ID NO: 3674466 - RNA, 14 nt, Salmonella enterica enterica serovar Typhi
acggcagccagcgu

SEQ ID NO: 3674467 - RNA, 21 nt, Salmonella enterica enterica serovar Typhi
acggcagccgccaccacaaag

SEQ ID NO: 3674468 - RNA, 20 nt, Salmonella enterica enterica serovar Typhi
acggcagcguauacgccgga

SEQ ID NO: 3674469 - RNA, 20 nt, Salmonella enterica enterica serovar Typhi
acggcaggcccgauaaacgg

SEQ ID NO: 3674470 - RNA, 21 nt, Salmonella enterica enterica serovar Typhi
acggcaguacacgcaucgggu

SEQ ID NO: 3674471 - RNA, 23 nt, Salmonella enterica enterica serovar Typhi
acggcaguguuucccaacaaugc

SEQ ID NO: 3674472 - RNA, 12 nt, Salmonella enterica enterica serovar Typhi
acggcauaagcc

SEQ ID NO: 3674473 - RNA, 15 nt, Salmonella enterica enterica serovar Typhi
acggcauaagccagu

SEQ ID NO: 3674474 - RNA, 20 nt, Salmonella enterica enterica serovar Typhi
acggcauagcuguuccgcaa

SEQ ID NO: 3674475 - RNA, 12 nt, Salmonella enterica enterica serovar Typhi
acggcauauucc

SEQ ID NO: 3674476 - RNA, 15 nt, Salmonella enterica enterica serovar Typhi
acggcauauucccug

SEQ ID NO: 3674477 - RNA, 16 nt, Salmonella enterica enterica serovar Typhi
acggcaucaagcccau

SEQ ID NO: 3674478 - RNA, 17 nt, Salmonella enterica enterica serovar Typhi
acggccagugaaauaaa

SEQ ID NO: 3674479 - RNA, 14 nt, Salmonella enterica enterica serovar Typhi
acggcccaggcauc

SEQ ID NO: 3674480 - RNA, 17 nt, Salmonella enterica enterica serovar Typhi
acggcccauaucaauca

SEQ ID NO: 3674481 - RNA, 21 nt, Salmonella enterica enterica serovar Typhi
acggcccgaagggugaggagc

SEQ ID NO: 3674482 - RNA, 14 nt, Salmonella enterica enterica serovar Typhi
acggcccguaaaca

SEQ ID NO: 3674483 - RNA, 14 nt, Salmonella enterica enterica serovar Typhi
acggcccguaaacg

SEQ ID NO: 3674484 - RNA, 17 nt, Salmonella enterica enterica serovar Typhi
acggccuaagaccagca

SEQ ID NO: 3674485 - RNA, 20 nt, Salmonella enterica enterica serovar Typhi
acggccugcaaacgaaucac

SEQ ID NO: 3674486 - RNA, 14 nt, Salmonella enterica enterica serovar Typhi
acggcgaccggcaa

SEQ ID NO: 3674487 - RNA, 22 nt, Salmonella enterica enterica serovar Typhi
acggcgacgcccgccaucugcu

SEQ ID NO: 3674488 - RNA, 22 nt, Salmonella enterica enterica serovar Typhi
acggcgcacacgaaauccaaac

SEQ ID NO: 3674489 - RNA, 23 nt, Salmonella enterica enterica serovar Typhi
acggcgcagauauuuuccaucac

SEQ ID NO: 3674490 - RNA, 18 nt, Salmonella enterica enterica serovar Typhi
acggcgcaggcaaaucaa

SEQ ID NO: 3674491 - RNA, 14 nt, Salmonella enterica enterica serovar Typhi
acggcgcgaaaggg

SEQ ID NO: 3674492 - RNA, 21 nt, Salmonella enterica enterica serovar Typhi
acggcgcgaaucccgcguucg

SEQ ID NO: 3674493 - RNA, 11 nt, Salmonella enterica enterica serovar Typhi
acggcgcgcca

SEQ ID NO: 3674494 - RNA, 13 nt, Salmonella enterica enterica serovar Typhi
acggcgcgccaau

SEQ ID NO: 3674495 - RNA, 20 nt, Salmonella enterica enterica serovar Typhi
acggcgcgccaauaaagcuu

SEQ ID NO: 3674496 - RNA, 23 nt, Salmonella enterica enterica serovar Typhi
acggcgcuaagcgcccguagcuc

SEQ ID NO: 3674497 - RNA, 17 nt, Salmonella enterica enterica serovar Typhi
acggcgcuuugggaauu

SEQ ID NO: 3674498 - RNA, 14 nt, Salmonella enterica enterica serovar Typhi
acggcggaccccuc

SEQ ID NO: 3674499 - RNA, 15 nt, Salmonella enterica enterica serovar Typhi
acggcggccagcauu

SEQ ID NO: 3674500 - RNA, 16 nt, Salmonella enterica enterica serovar Typhi
acggcggguuuaagug

SEQ ID NO: 3674501 - RNA, 19 nt, Salmonella enterica enterica serovar Typhi
acggcgucaccaccgcagg

SEQ ID NO: 3674502 - RNA, 23 nt, Salmonella enterica enterica serovar Typhi
acggcgucaccaccgcaggcagc

SEQ ID NO: 3674503 - RNA, 16 nt, Salmonella enterica enterica serovar Typhi
acggcgucauccugca

SEQ ID NO: 3674504 - RNA, 21 nt, Salmonella enterica enterica serovar Typhi
acggcgugccaguuuuaaaua

SEQ ID NO: 3674505 - RNA, 13 nt, Salmonella enterica enterica serovar Typhi
acggcuaccugca

SEQ ID NO: 3674506 - RNA, 23 nt, Salmonella enterica enterica serovar Typhi
acggcuauuccucgaucgccugg

SEQ ID NO: 3674507 - RNA, 15 nt, Salmonella enterica enterica serovar Typhi
acggcuccagcgcca

SEQ ID NO: 3674508 - RNA, 13 nt, Salmonella enterica enterica serovar Typhi
acggcuccuuuuu

SEQ ID NO: 3674509 - RNA, 13 nt, Salmonella enterica enterica serovar Typhi
acggcugaagcug

SEQ ID NO: 3674510 - RNA, 15 nt, Salmonella enterica enterica serovar Typhi
acggcuggcaaugcg

SEQ ID NO: 3674511 - RNA, 18 nt, Salmonella enterica enterica serovar Typhi
acggcuggcaaugcgcug

SEQ ID NO: 3674512 - RNA, 14 nt, Salmonella enterica enterica serovar Typhi
acggcuucaaucgu

SEQ ID NO: 3674513 - RNA, 18 nt, Salmonella enterica enterica serovar Typhi
acggcuuccacugcggca

SEQ ID NO: 3674514 - RNA, 16 nt, Salmonella enterica enterica serovar Typhi
acggcuuuccagcagc

SEQ ID NO: 3674515 - RNA, 20 nt, Salmonella enterica enterica serovar Typhi
acggcuuuccagcagccaga

SEQ ID NO: 3674516 - RNA, 14 nt, Salmonella enterica enterica serovar Typhi
acggcuuuucuuca

SEQ ID NO: 3674517 - RNA, 14 nt, Salmonella enterica enterica serovar Typhi
acgggaaaucuccc

SEQ ID NO: 3674518 - RNA, 17 nt, Salmonella enterica enterica serovar Typhi
acgggaaguaaggcaug

SEQ ID NO: 3674519 - RNA, 12 nt, Salmonella enterica enterica serovar Typhi
acgggaucgcag

SEQ ID NO: 3674520 - RNA, 14 nt, Salmonella enterica enterica serovar Typhi
acgggcagucuggc

SEQ ID NO: 3674521 - RNA, 12 nt, Salmonella enterica enterica serovar Typhi
acgggccaggcg

SEQ ID NO: 3674522 - RNA, 17 nt, Salmonella enterica enterica serovar Typhi
acgggccgccgcagcag

SEQ ID NO: 3674523 - RNA, 15 nt, Salmonella enterica enterica serovar Typhi
acgggcgcgacaaua

SEQ ID NO: 3674524 - RNA, 14 nt, Salmonella enterica enterica serovar Typhi
acgggcgcggcaua

SEQ ID NO: 3674525 - RNA, 20 nt, Salmonella enterica enterica serovar Typhi
acgggcgcugucgccgcgca

SEQ ID NO: 3674526 - RNA, 21 nt, Salmonella enterica enterica serovar Typhi
acgggcgggguaguuaucacg

SEQ ID NO: 3674527 - RNA, 22 nt, Salmonella enterica enterica serovar Typhi
acgggcggugugauuaauccaa

SEQ ID NO: 3674528 - RNA, 11 nt, Salmonella enterica enterica serovar Typhi
acggggaacag

SEQ ID NO: 3674529 - RNA, 15 nt, Salmonella enterica enterica serovar Typhi
acgguaaaacacgcc

SEQ ID NO: 3674530 - RNA, 19 nt, Salmonella enterica enterica serovar Typhi
acgguaaacgugccacagu

SEQ ID NO: 3674531 - RNA, 23 nt, Salmonella enterica enterica serovar Typhi
acgguaacgauacccaccagcgu

SEQ ID NO: 3674532 - RNA, 21 nt, Salmonella enterica enterica serovar Typhi
acgguaagcguucgcauacgc

SEQ ID NO: 3674533 - RNA, 21 nt, Salmonella enterica enterica serovar Typhi
acgguaaguugaaaggaaagg

SEQ ID NO: 3674534 - RNA, 14 nt, Salmonella enterica enterica serovar Typhi
acgguaccugaagc

SEQ ID NO: 3674535 - RNA, 19 nt, Salmonella enterica enterica serovar Typhi
acgguacuauuaccgcauc

SEQ ID NO: 3674536 - RNA, 21 nt, Salmonella enterica enterica serovar Typhi
acgguacuauuaccgcaucga

SEQ ID NO: 3674537 - RNA, 21 nt, Salmonella enterica enterica serovar Typhi
acgguagacuggguaagcgca

SEQ ID NO: 3674538 - RNA, 12 nt, Salmonella enterica enterica serovar Typhi
acgguaucagcg

SEQ ID NO: 3674539 - RNA, 21 nt, Salmonella enterica enterica serovar Typhi
acgguaugaaacauauauauc

SEQ ID NO: 3674540 - RNA, 12 nt, Salmonella enterica enterica serovar Typhi
acgguauuucca

SEQ ID NO: 3674541 - RNA, 22 nt, Salmonella enterica enterica serovar Typhi
acggucaggauaaaauccugca

SEQ ID NO: 3674542 - RNA, 14 nt, Salmonella enterica enterica serovar Typhi
acguucauccuccu

SEQ ID NO: 3674543 - RNA, 17 nt, Salmonella enterica enterica serovar Typhi
acguucauccuccuucg

SEQ ID NO: 3674544 - RNA, 12 nt, Salmonella enterica enterica serovar Typhi
acguucaucuuc

SEQ ID NO: 3674545 - RNA, 14 nt, Salmonella enterica enterica serovar Typhi
acguucaucuuccc

SEQ ID NO: 3674546 - RNA, 14 nt, Salmonella enterica enterica serovar Typhi
acguuccccagcac

SEQ ID NO: 3674547 - RNA, 19 nt, Salmonella enterica enterica serovar Typhi
acguuccuucaggagaccu

SEQ ID NO: 3674548 - RNA, 21 nt, Salmonella enterica enterica serovar Typhi
acguucggcguguagccaauc

SEQ ID NO: 3674549 - RNA, 19 nt, Salmonella enterica enterica serovar Typhi
acguucguuguccacuguu

SEQ ID NO: 3674550 - RNA, 22 nt, Salmonella enterica enterica serovar Typhi
acguucuaucagguaucccgcc

SEQ ID NO: 3674551 - RNA, 16 nt, Salmonella enterica enterica serovar Typhi
acguucuuccagaacg

SEQ ID NO: 3674552 - RNA, 22 nt, Salmonella enterica enterica serovar Typhi
acguugccguaggcgacgccaa

SEQ ID NO: 3674553 - RNA, 22 nt, Salmonella enterica enterica serovar Typhi
acguugcggcgcguucagcauc

SEQ ID NO: 3674554 - RNA, 15 nt, Salmonella enterica enterica serovar Typhi
acguugcuggcgcgc

SEQ ID NO: 3674555 - RNA, 18 nt, Salmonella enterica enterica serovar Typhi
acguuggggauaaccaga

SEQ ID NO: 3674556 - RNA, 17 nt, Salmonella enterica enterica serovar Typhi
acguugugauaaaucgu

SEQ ID NO: 3674557 - RNA, 22 nt, Salmonella enterica enterica serovar Typhi
acguuuauucuuuucaggucug

SEQ ID NO: 3674558 - RNA, 22 nt, Salmonella enterica enterica serovar Typhi
acguuucucaugcguaaaucgc

SEQ ID NO: 3674559 - RNA, 21 nt, Salmonella enterica enterica serovar Typhi
acguuucucgcgaccagagac

SEQ ID NO: 3674560 - RNA, 17 nt, Salmonella enterica enterica serovar Typhi
acguuucuuucaucaga

SEQ ID NO: 3674561 - RNA, 16 nt, Salmonella enterica enterica serovar Typhi
acguuuucagcagugc

SEQ ID NO: 3674562 - RNA, 13 nt, Salmonella enterica enterica serovar Typhi
acguuuuccugcg

SEQ ID NO: 3674563 - RNA, 23 nt, Salmonella enterica enterica serovar Typhi
acguuuugggaaaaccaguugca

SEQ ID NO: 3674564 - RNA, 19 nt, Salmonella enterica enterica serovar Typhi
acguuuuuccauucacaca

SEQ ID NO: 3674565 - RNA, 16 nt, Salmonella enterica enterica serovar Typhi
acguuuuuucgcacgc

SEQ ID NO: 3674566 - RNA, 15 nt, Salmonella enterica enterica serovar Typhi
acuaaaacgugcuga

SEQ ID NO: 3674567 - RNA, 19 nt, Salmonella enterica enterica serovar Typhi
acuaaauaaauauccuccg

SEQ ID NO: 3674568 - RNA, 14 nt, Salmonella enterica enterica serovar Typhi
acuaacagcagcag

SEQ ID NO: 3674569 - RNA, 16 nt, Salmonella enterica enterica serovar Typhi
acuaacccggcgaccg

SEQ ID NO: 3674570 - RNA, 19 nt, Salmonella enterica enterica serovar Typhi
acuaacgaggccaccauca

SEQ ID NO: 3674571 - RNA, 22 nt, Salmonella enterica enterica serovar Typhi
acuaacggcgucauccugcagg

SEQ ID NO: 3674572 - RNA, 16 nt, Salmonella enterica enterica serovar Typhi
acuaacugaccauaua

SEQ ID NO: 3674573 - RNA, 11 nt, Salmonella enterica enterica serovar Typhi
acuaacugccg

SEQ ID NO: 3674574 - RNA, 15 nt, Salmonella enterica enterica serovar Typhi
acuaagaccagcauc

SEQ ID NO: 3674575 - RNA, 20 nt, Salmonella enterica enterica serovar Typhi
acuaagaccagcaucagaau

SEQ ID NO: 3674576 - RNA, 19 nt, Salmonella enterica enterica serovar Typhi
acuaagguuuugucauggu

SEQ ID NO: 3674577 - RNA, 16 nt, Salmonella enterica enterica serovar Typhi
acuaauccccauuuuu

SEQ ID NO: 3674578 - RNA, 17 nt, Salmonella enterica enterica serovar Typhi
acuaauccucuucucug

SEQ ID NO: 3674579 - RNA, 21 nt, Salmonella enterica enterica serovar Typhi
acuaaucugucgcuaaagcac

SEQ ID NO: 3674580 - RNA, 21 nt, Salmonella enterica enterica serovar Typhi
acuaauuauuuuucaaaugau

SEQ ID NO: 3674581 - RNA, 21 nt, Salmonella enterica enterica serovar Typhi
acuaauuguuuguagaaagug

SEQ ID NO: 3674582 - RNA, 14 nt, Salmonella enterica enterica serovar Typhi
acuacagaaagcca

SEQ ID NO: 3674583 - RNA, 21 nt, Salmonella enterica enterica serovar Typhi
acuacagaaagccauaaaacu

SEQ ID NO: 3674584 - RNA, 13 nt, Salmonella enterica enterica serovar Typhi
acuaccaacugau

SEQ ID NO: 3674585 - RNA, 14 nt, Salmonella enterica enterica serovar Typhi
acuaccacuuucuu

SEQ ID NO: 3674586 - RNA, 18 nt, Salmonella enterica enterica serovar Typhi
acuaccaucggcgcuacg

SEQ ID NO: 3674587 - RNA, 20 nt, Salmonella enterica enterica serovar Typhi
acuaccaucggcgcuacggc

SEQ ID NO: 3674588 - RNA, 16 nt, Salmonella enterica enterica serovar Typhi
acuacccagaucgccc

SEQ ID NO: 3674589 - RNA, 16 nt, Salmonella enterica enterica serovar Typhi
acuaccggcaccagca

SEQ ID NO: 3674590 - RNA, 20 nt, Salmonella enterica enterica serovar Typhi
acuaccucuuauccggcugc

SEQ ID NO: 3674591 - RNA, 22 nt, Salmonella enterica enterica serovar Typhi
acuaccugcacuuuaagcggca

SEQ ID NO: 3674592 - RNA, 16 nt, Salmonella enterica enterica serovar Typhi
acuacgcggcuacaga

SEQ ID NO: 3674593 - RNA, 14 nt, Salmonella enterica enterica serovar Typhi
acuacggcaaacac

SEQ ID NO: 3674594 - RNA, 15 nt, Salmonella enterica enterica serovar Typhi
acuacgguaaaccag

SEQ ID NO: 3674595 - RNA, 21 nt, Salmonella enterica enterica serovar Typhi
acuacgguaaaccaggccagc

SEQ ID NO: 3674596 - RNA, 14 nt, Salmonella enterica enterica serovar Typhi
acuacguguacgcu

SEQ ID NO: 3674597 - RNA, 17 nt, Salmonella enterica enterica serovar Typhi
acuacguucaucaggca

SEQ ID NO: 3674598 - RNA, 16 nt, Salmonella enterica enterica serovar Typhi
acuagcgcgauuuucu

SEQ ID NO: 3674599 - RNA, 22 nt, Salmonella enterica enterica serovar Typhi
acuauauguccuuuacugcgcc

SEQ ID NO: 3674600 - RNA, 22 nt, Salmonella enterica enterica serovar Typhi
acuaucaguuuuggcaaucaca

SEQ ID NO: 3674601 - RNA, 18 nt, Salmonella enterica enterica serovar Typhi
acuaucaugaaugcccca

SEQ ID NO: 3674602 - RNA, 16 nt, Salmonella enterica enterica serovar Typhi
acuauccuggccugau

SEQ ID NO: 3674603 - RNA, 22 nt, Salmonella enterica enterica serovar Typhi
acuaugcuaauccgcugauuaa

SEQ ID NO: 3674604 - RNA, 16 nt, Salmonella enterica enterica serovar Typhi
acuauggucugaaaga

SEQ ID NO: 3674605 - RNA, 20 nt, Salmonella enterica enterica serovar Typhi
acuauggucugaaagaguuc

SEQ ID NO: 3674606 - RNA, 13 nt, Salmonella enterica enterica serovar Typhi
acuauucuucccc

SEQ ID NO: 3674607 - RNA, 22 nt, Salmonella enterica enterica serovar Typhi
acuauucuuccccuucacucuu

SEQ ID NO: 3674608 - RNA, 22 nt, Salmonella enterica enterica serovar Typhi
acuauuuuuuaugugacaauca

SEQ ID NO: 3674609 - RNA, 23 nt, Salmonella enterica enterica serovar Typhi
acucaaaccccagauuacugccc

SEQ ID NO: 3674610 - RNA, 12 nt, Salmonella enterica enterica serovar Typhi
acucaacaucau

SEQ ID NO: 3674611 - RNA, 15 nt, Salmonella enterica enterica serovar Typhi
acucaacaucauuaa

SEQ ID NO: 3674612 - RNA, 20 nt, Salmonella enterica enterica serovar Typhi
acucaaccaaccaacccaaa

SEQ ID NO: 3674613 - RNA, 16 nt, Salmonella enterica enterica serovar Typhi
acucaagcgaauccag

SEQ ID NO: 3674614 - RNA, 17 nt, Salmonella enterica enterica serovar Typhi
acucaagcgaauccaga

SEQ ID NO: 3674615 - RNA, 17 nt, Salmonella enterica enterica serovar Typhi
acucaagguagccacgc

SEQ ID NO: 3674616 - RNA, 19 nt, Salmonella enterica enterica serovar Typhi
acucaagguagccacgccc

SEQ ID NO: 3674617 - RNA, 13 nt, Salmonella enterica enterica serovar Typhi
acucaccaguccg

SEQ ID NO: 3674618 - RNA, 23 nt, Salmonella enterica enterica serovar Typhi
acucacccaggcgaugcgcggaa

SEQ ID NO: 3674619 - RNA, 19 nt, Salmonella enterica enterica serovar Typhi
acucacgacuuucaccaga

SEQ ID NO: 3674620 - RNA, 12 nt, Salmonella enterica enterica serovar Typhi
acucacgggcgu

SEQ ID NO: 3674621 - RNA, 15 nt, Salmonella enterica enterica serovar Typhi
acucacgguuuuuau

SEQ ID NO: 3674622 - RNA, 15 nt, Salmonella enterica enterica serovar Typhi
acucacguuccccag

SEQ ID NO: 3674623 - RNA, 19 nt, Salmonella enterica enterica serovar Typhi
acucacguuccccagcacc

SEQ ID NO: 3674624 - RNA, 21 nt, Salmonella enterica enterica serovar Typhi
acucacguuccccagcaccga

SEQ ID NO: 3674625 - RNA, 11 nt, Salmonella enterica enterica serovar Typhi
acucagcaaua

SEQ ID NO: 3674626 - RNA, 15 nt, Salmonella enterica enterica serovar Typhi
acucagcacauucag

SEQ ID NO: 3674627 - RNA, 17 nt, Salmonella enterica enterica serovar Typhi
acucuuuuuucagaaua

SEQ ID NO: 3674628 - RNA, 13 nt, Salmonella enterica enterica serovar Typhi
acugaaaaucaaa

SEQ ID NO: 3674629 - RNA, 15 nt, Salmonella enterica enterica serovar Typhi
acugaaaaucaaaua

SEQ ID NO: 3674630 - RNA, 16 nt, Salmonella enterica enterica serovar Typhi
acugaacaucgccguu

SEQ ID NO: 3674631 - RNA, 13 nt, Salmonella enterica enterica serovar Typhi
acugaagauaaac

SEQ ID NO: 3674632 - RNA, 23 nt, Salmonella enterica enterica serovar Typhi
acugaaugccuuuuacaauaacc

SEQ ID NO: 3674633 - RNA, 17 nt, Salmonella enterica enterica serovar Typhi
acugaauuaucaggguu

SEQ ID NO: 3674634 - RNA, 20 nt, Salmonella enterica enterica serovar Typhi
acugacaauaagugguucgu

SEQ ID NO: 3674635 - RNA, 15 nt, Salmonella enterica enterica serovar Typhi
acugaccauauauga

SEQ ID NO: 3674636 - RNA, 19 nt, Salmonella enterica enterica serovar Typhi
acugaccgcguuuaucgcg

SEQ ID NO: 3674637 - RNA, 16 nt, Salmonella enterica enterica serovar Typhi
acugacuauccacagc

SEQ ID NO: 3674638 - RNA, 12 nt, Salmonella enterica enterica serovar Typhi
acugacugcugu

SEQ ID NO: 3674639 - RNA, 17 nt, Salmonella enterica enterica serovar Typhi
acugacuucaucaaaua

SEQ ID NO: 3674640 - RNA, 13 nt, Salmonella enterica enterica serovar Typhi
acugagacucagc

SEQ ID NO: 3674641 - RNA, 19 nt, Salmonella enterica enterica serovar Typhi
acugagacucagcagcgca

SEQ ID NO: 3674642 - RNA, 16 nt, Salmonella enterica enterica serovar Typhi
acugagcgccaauuga

SEQ ID NO: 3674643 - RNA, 19 nt, Salmonella enterica enterica serovar Typhi
acugagcgucacgccauca

SEQ ID NO: 3674644 - RNA, 21 nt, Salmonella enterica enterica serovar Typhi
acugaguauuggcaagaauca

SEQ ID NO: 3674645 - RNA, 18 nt, Salmonella enterica enterica serovar Typhi
acugauaagggccuucau

SEQ ID NO: 3674646 - RNA, 18 nt, Salmonella enterica enterica serovar Typhi
acugauacagccaaauca

SEQ ID NO: 3674647 - RNA, 17 nt, Salmonella enterica enterica serovar Typhi
acugauaccccagcgau

SEQ ID NO: 3674648 - RNA, 19 nt, Salmonella enterica enterica serovar Typhi
acugauacuggauaaccgc

SEQ ID NO: 3674649 - RNA, 19 nt, Salmonella enterica enterica serovar Typhi
acugauaguccaucaccuc

SEQ ID NO: 3674650 - RNA, 19 nt, Salmonella enterica enterica serovar Typhi
acugaucgauccacuuccc

SEQ ID NO: 3674651 - RNA, 22 nt, Salmonella enterica enterica serovar Typhi
acugaucgccuaagaucgggug

SEQ ID NO: 3674652 - RNA, 20 nt, Salmonella enterica enterica serovar Typhi
acugaucgcuggugcccggu

SEQ ID NO: 3674653 - RNA, 13 nt, Salmonella enterica enterica serovar Typhi
acugaugacgcga

SEQ ID NO: 3674654 - RNA, 17 nt, Salmonella enterica enterica serovar Typhi
acugaugcuggcgccau

SEQ ID NO: 3674655 - RNA, 21 nt, Salmonella enterica enterica serovar Typhi
acugauggcgcuaagccagcc

SEQ ID NO: 3674656 - RNA, 16 nt, Salmonella enterica enterica serovar Typhi
acugauguuccggcac

SEQ ID NO: 3674657 - RNA, 18 nt, Salmonella enterica enterica serovar Typhi
acugauuaauugcgacaa

SEQ ID NO: 3674658 - RNA, 21 nt, Salmonella enterica enterica serovar Typhi
acugauucaaaaggugagaaa

SEQ ID NO: 3674659 - RNA, 16 nt, Salmonella enterica enterica serovar Typhi
acugcaaauaccacau

SEQ ID NO: 3674660 - RNA, 13 nt, Salmonella enterica enterica serovar Typhi
acugcaacgccag

SEQ ID NO: 3674661 - RNA, 15 nt, Salmonella enterica enterica serovar Typhi
acugcacgccagggu

SEQ ID NO: 3674662 - RNA, 19 nt, Salmonella enterica enterica serovar Typhi
acugcacgccaggguaaua

SEQ ID NO: 3674663 - RNA, 22 nt, Salmonella enterica enterica serovar Typhi
acugcacgccaggguaauacug

SEQ ID NO: 3674664 - RNA, 13 nt, Salmonella enterica enterica serovar Typhi
acugccaaaccac

SEQ ID NO: 3674665 - RNA, 14 nt, Salmonella enterica enterica serovar Typhi
acugccaaccauua

SEQ ID NO: 3674666 - RNA, 15 nt, Salmonella enterica enterica serovar Typhi
acugccagaccggcg

SEQ ID NO: 3674667 - RNA, 14 nt, Salmonella enterica enterica serovar Typhi
acugcccagccgcc

SEQ ID NO: 3674668 - RNA, 12 nt, Salmonella enterica enterica serovar Typhi
acugcccggcau

SEQ ID NO: 3674669 - RNA, 22 nt, Salmonella enterica enterica serovar Typhi
acugcccuacgcuucucuccau

SEQ ID NO: 3674670 - RNA, 16 nt, Salmonella enterica enterica serovar Typhi
acugcccuggaagaac

SEQ ID NO: 3674671 - RNA, 13 nt, Salmonella enterica enterica serovar Typhi
acugccgccaucg

SEQ ID NO: 3674672 - RNA, 14 nt, Salmonella enterica enterica serovar Typhi
acugccgccgucau

SEQ ID NO: 3674673 - RNA, 22 nt, Salmonella enterica enterica serovar Typhi
acugccuaaauugacgcugccu

SEQ ID NO: 3674674 - RNA, 20 nt, Salmonella enterica enterica serovar Typhi
acugcgaaaucaccgacagg

SEQ ID NO: 3674675 - RNA, 20 nt, Salmonella enterica enterica serovar Typhi
acugcgaaggcuacugcguc

SEQ ID NO: 3674676 - RNA, 22 nt, Salmonella enterica enterica serovar Typhi
acugcgaauuuccugccagacc

SEQ ID NO: 3674677 - RNA, 15 nt, Salmonella enterica enterica serovar Typhi
acugcgccagccugc

SEQ ID NO: 3674678 - RNA, 15 nt, Salmonella enterica enterica serovar Typhi
acugcgccaucuucc

SEQ ID NO: 3674679 - RNA, 16 nt, Salmonella enterica enterica serovar Typhi
acugcgcgcccgccuc

SEQ ID NO: 3674680 - RNA, 23 nt, Salmonella enterica enterica serovar Typhi
acugcgcgccgcccugcaucaug

SEQ ID NO: 3674681 - RNA, 20 nt, Salmonella enterica enterica serovar Typhi
acugcgcucuaucaccgccc

SEQ ID NO: 3674682 - RNA, 19 nt, Salmonella enterica enterica serovar Typhi
acugcggagguuucuuuuu

SEQ ID NO: 3674683 - RNA, 17 nt, Salmonella enterica enterica serovar Typhi
acugcggccugcaaaga

SEQ ID NO: 3674684 - RNA, 16 nt, Salmonella enterica enterica serovar Typhi
acugcgugagugugga

SEQ ID NO: 3674685 - RNA, 22 nt, Salmonella enterica enterica serovar Typhi
acugcguuugaaauaccaggcg

SEQ ID NO: 3674686 - RNA, 17 nt, Salmonella enterica enterica serovar Typhi
acugcuaaggagauaac

SEQ ID NO: 3674687 - RNA, 18 nt, Salmonella enterica enterica serovar Typhi
acugcugacaaucagcac

SEQ ID NO: 3674688 - RNA, 12 nt, Salmonella enterica enterica serovar Typhi
acugcugacucu

SEQ ID NO: 3674689 - RNA, 22 nt, Salmonella enterica enterica serovar Typhi
acugcugccgcagcacccgcuc

SEQ ID NO: 3674690 - RNA, 14 nt, Salmonella enterica enterica serovar Typhi
acugcugcgcgugc

SEQ ID NO: 3674691 - RNA, 18 nt, Salmonella enterica enterica serovar Typhi
acugcugcgcuuuaucaa

SEQ ID NO: 3674692 - RNA, 10 nt, Salmonella enterica enterica serovar Typhi
acugcugcuc

SEQ ID NO: 3674693 - RNA, 22 nt, Salmonella enterica enterica serovar Typhi
acugcugcugaaagaagacgaa

SEQ ID NO: 3674694 - RNA, 22 nt, Salmonella enterica enterica serovar Typhi
acugcuggcgcgucacaacagc

SEQ ID NO: 3674695 - RNA, 17 nt, Salmonella enterica enterica serovar Typhi
acugcugguaaauccaa

SEQ ID NO: 3674696 - RNA, 23 nt, Salmonella enterica enterica serovar Typhi
acugcuguguccaggucaucacc

SEQ ID NO: 3674697 - RNA, 14 nt, Salmonella enterica enterica serovar Typhi
acugcuuugaucac

SEQ ID NO: 3674698 - RNA, 23 nt, Salmonella enterica enterica serovar Typhi
acugcuuuuccggcagcgcauaa

SEQ ID NO: 3674699 - RNA, 15 nt, Salmonella enterica enterica serovar Typhi
acuggaaacagccaa

SEQ ID NO: 3674700 - RNA, 15 nt, Salmonella enterica enterica serovar Typhi
acuggaauucguuac

SEQ ID NO: 3674701 - RNA, 20 nt, Salmonella enterica enterica serovar Typhi
acuggaucaccugaaugcaa

SEQ ID NO: 3674702 - RNA, 21 nt, Salmonella enterica enterica serovar Typhi
acuggaucaccugaaugcaaa

SEQ ID NO: 3674703 - RNA, 12 nt, Salmonella enterica enterica serovar Typhi
acuggaugacga

SEQ ID NO: 3674704 - RNA, 13 nt, Salmonella enterica enterica serovar Typhi
acuggaugacgaa

SEQ ID NO: 3674705 - RNA, 16 nt, Salmonella enterica enterica serovar Typhi
acuggauggacuguuu

SEQ ID NO: 3674706 - RNA, 14 nt, Salmonella enterica enterica serovar Typhi
acuggcaaauaaaa

SEQ ID NO: 3674707 - RNA, 21 nt, Salmonella enterica enterica serovar Typhi
acuggcaaccagauaauucag

SEQ ID NO: 3674708 - RNA, 22 nt, Salmonella enterica enterica serovar Typhi
acuggcaaccagauaauucagg

SEQ ID NO: 3674709 - RNA, 17 nt, Salmonella enterica enterica serovar Typhi
acuggcagcagugacau

SEQ ID NO: 3674710 - RNA, 19 nt, Salmonella enterica enterica serovar Typhi
acuggcagcgccugacggc

SEQ ID NO: 3674711 - RNA, 15 nt, Salmonella enterica enterica serovar Typhi
acuggcauugugagc

SEQ ID NO: 3674712 - RNA, 16 nt, Salmonella enterica enterica serovar Typhi
acuggcccccuguucc

SEQ ID NO: 3674713 - RNA, 18 nt, Salmonella enterica enterica serovar Typhi
acuucggcaaauucuuuu

SEQ ID NO: 3674714 - RNA, 19 nt, Salmonella enterica enterica serovar Typhi
acuucggcaaauucuuuuc

SEQ ID NO: 3674715 - RNA, 20 nt, Salmonella enterica enterica serovar Typhi
acuucggcaaauucuuuuca

SEQ ID NO: 3674716 - RNA, 18 nt, Salmonella enterica enterica serovar Typhi
acuucguagacucaggcg

SEQ ID NO: 3674717 - RNA, 15 nt, Salmonella enterica enterica serovar Typhi
acuucuaauuuuucc

SEQ ID NO: 3674718 - RNA, 21 nt, Salmonella enterica enterica serovar Typhi
acuucugacccaaucagacgc

SEQ ID NO: 3674719 - RNA, 10 nt, Salmonella enterica enterica serovar Typhi
acuucuucca

SEQ ID NO: 3674720 - RNA, 21 nt, Salmonella enterica enterica serovar Typhi
acuucuugguaccaaacagca

SEQ ID NO: 3674721 - RNA, 14 nt, Salmonella enterica enterica serovar Typhi
acuugaccagcacu

SEQ ID NO: 3674722 - RNA, 17 nt, Salmonella enterica enterica serovar Typhi
acuugacgcuuugcauu

SEQ ID NO: 3674723 - RNA, 20 nt, Salmonella enterica enterica serovar Typhi
acuugagaaauuauuuuaaa

SEQ ID NO: 3674724 - RNA, 22 nt, Salmonella enterica enterica serovar Typhi
acuugaucgugccguccggcau

SEQ ID NO: 3674725 - RNA, 14 nt, Salmonella enterica enterica serovar Typhi
acuugauggaaaac

SEQ ID NO: 3674726 - RNA, 22 nt, Salmonella enterica enterica serovar Typhi
acuugccguuuuucucaucaag

SEQ ID NO: 3674727 - RNA, 20 nt, Salmonella enterica enterica serovar Typhi
acuuguucaauauuccuggc

SEQ ID NO: 3674728 - RNA, 22 nt, Salmonella enterica enterica serovar Typhi
acuuuaaagcccagcacggcaa

SEQ ID NO: 3674729 - RNA, 21 nt, Salmonella enterica enterica serovar Typhi
acuuuacccacaucaaucacc

SEQ ID NO: 3674730 - RNA, 13 nt, Salmonella enterica enterica serovar Typhi
acuuuacugaaua

SEQ ID NO: 3674731 - RNA, 13 nt, Salmonella enterica enterica serovar Typhi
acuuuaucaccag

SEQ ID NO: 3674732 - RNA, 18 nt, Salmonella enterica enterica serovar Typhi
acuuuauuuuucgccaga

SEQ ID NO: 3674733 - RNA, 11 nt, Salmonella enterica enterica serovar Typhi
acuuucaaaau

SEQ ID NO: 3674734 - RNA, 12 nt, Salmonella enterica enterica serovar Typhi
acuuucagauuu

SEQ ID NO: 3674735 - RNA, 17 nt, Salmonella enterica enterica serovar Typhi
acuuucagauuuuuaau

SEQ ID NO: 3674736 - RNA, 19 nt, Salmonella enterica enterica serovar Typhi
acuuucauuucacuuguuc

SEQ ID NO: 3674737 - RNA, 17 nt, Salmonella enterica enterica serovar Typhi
acuuuccagcaacugac

SEQ ID NO: 3674738 - RNA, 23 nt, Salmonella enterica enterica serovar Typhi
acuuucgcccggcgccagcucaa

SEQ ID NO: 3674739 - RNA, 13 nt, Salmonella enterica enterica serovar Typhi
acuuucuacaaau

SEQ ID NO: 3674740 - RNA, 22 nt, Salmonella enterica enterica serovar Typhi
acuuucucggcuuuccagcuca

SEQ ID NO: 3674741 - RNA, 17 nt, Salmonella enterica enterica serovar Typhi
acuuucuugccacuggc

SEQ ID NO: 3674742 - RNA, 21 nt, Salmonella enterica enterica serovar Typhi
acuuucuuuugauacucugcu

SEQ ID NO: 3674743 - RNA, 17 nt, Salmonella enterica enterica serovar Typhi
acuuugaccagcaucgc

SEQ ID NO: 3674744 - RNA, 16 nt, Salmonella enterica enterica serovar Typhi
acuuugccaugaauaa

SEQ ID NO: 3674745 - RNA, 20 nt, Salmonella enterica enterica serovar Typhi
acuuugcccuuuuugcauuc

SEQ ID NO: 3674746 - RNA, 17 nt, Salmonella enterica enterica serovar Typhi
acuuugcuuuucugcuu

SEQ ID NO: 3674747 - RNA, 15 nt, Salmonella enterica enterica serovar Typhi
acuuuuagaauuauc

SEQ ID NO: 3674748 - RNA, 16 nt, Salmonella enterica enterica serovar Typhi
acuuuucgccccggac

SEQ ID NO: 3674749 - RNA, 18 nt, Salmonella enterica enterica serovar Typhi
acuuuucuuuccugcaaa

SEQ ID NO: 3674750 - RNA, 20 nt, Salmonella enterica enterica serovar Typhi
acuuuuguagagauccagaa

SEQ ID NO: 3674751 - RNA, 22 nt, Salmonella enterica enterica serovar Typhi
acuuuuuggcuguugguaugca

SEQ ID NO: 3674752 - RNA, 17 nt, Salmonella enterica enterica serovar Typhi
acuuuuuuaaauguuuu

SEQ ID NO: 3674753 - RNA, 15 nt, Salmonella enterica enterica serovar Typhi
agaaaaaacuggugc

SEQ ID NO: 3674754 - RNA, 17 nt, Salmonella enterica enterica serovar Typhi
agaaaaacaucauggcu

SEQ ID NO: 3674755 - RNA, 12 nt, Salmonella enterica enterica serovar Typhi
agaaaaacgcgc

SEQ ID NO: 3674756 - RNA, 12 nt, Salmonella enterica enterica serovar Typhi
agaaaaagaagc

SEQ ID NO: 3674757 - RNA, 22 nt, Salmonella enterica enterica serovar Typhi
agaaaaagaccgacaucgccag

SEQ ID NO: 3674758 - RNA, 22 nt, Salmonella enterica enterica serovar Typhi
agaaaaauuuaagccagaugua

SEQ ID NO: 3674759 - RNA, 23 nt, Salmonella enterica enterica serovar Typhi
agaaaacagugauuacaaaaugu

SEQ ID NO: 3674760 - RNA, 16 nt, Salmonella enterica enterica serovar Typhi
agaaaaccccguacag

SEQ ID NO: 3674761 - RNA, 19 nt, Salmonella enterica enterica serovar Typhi
agaaaaccgacagcaauau

SEQ ID NO: 3674762 - RNA, 16 nt, Salmonella enterica enterica serovar Typhi
agaaaagcgaaaauaa

SEQ ID NO: 3674763 - RNA, 12 nt, Salmonella enterica enterica serovar Typhi
agaaaauaacaa

SEQ ID NO: 3674764 - RNA, 21 nt, Salmonella enterica enterica serovar Typhi
agaaaauaacaauauuaaaua

SEQ ID NO: 3674765 - RNA, 13 nt, Salmonella enterica enterica serovar Typhi
agaaaauauauug

SEQ ID NO: 3674766 - RNA, 16 nt, Salmonella enterica enterica serovar Typhi
agaaaaucagugaaca

SEQ ID NO: 3674767 - RNA, 13 nt, Salmonella enterica enterica serovar Typhi
agaaacaacacga

SEQ ID NO: 3674768 - RNA, 18 nt, Salmonella enterica enterica serovar Typhi
agaaacaauccguuauuu

SEQ ID NO: 3674769 - RNA, 20 nt, Salmonella enterica enterica serovar Typhi
agaaaccauaaacaaaacaa

SEQ ID NO: 3674770 - RNA, 19 nt, Salmonella enterica enterica serovar Typhi
agaaaccaucuugcguuau

SEQ ID NO: 3674771 - RNA, 19 nt, Salmonella enterica enterica serovar Typhi
agaaaccgcucgccgccuc

SEQ ID NO: 3674772 - RNA, 15 nt, Salmonella enterica enterica serovar Typhi
agaaacgcuuuccgg

SEQ ID NO: 3674773 - RNA, 18 nt, Salmonella enterica enterica serovar Typhi
agaaacggaaaucacgca

SEQ ID NO: 3674774 - RNA, 14 nt, Salmonella enterica enterica serovar Typhi
agaaacugcuguag

SEQ ID NO: 3674775 - RNA, 17 nt, Salmonella enterica enterica serovar Typhi
agaaacugcuguagcac

SEQ ID NO: 3674776 - RNA, 22 nt, Salmonella enterica enterica serovar Typhi
agaaagauaaaauacgugcgga

SEQ ID NO: 3674777 - RNA, 17 nt, Salmonella enterica enterica serovar Typhi
agaaagcauuaaaucau

SEQ ID NO: 3674778 - RNA, 23 nt, Salmonella enterica enterica serovar Typhi
agaaagcgaauggcgugaagcca

SEQ ID NO: 3674779 - RNA, 20 nt, Salmonella enterica enterica serovar Typhi
agaaagucgcaauauaaaua

SEQ ID NO: 3674780 - RNA, 12 nt, Salmonella enterica enterica serovar Typhi
agaaauaaaaua

SEQ ID NO: 3674781 - RNA, 22 nt, Salmonella enterica enterica serovar Typhi
agaaauaaaauacgcucaauau

SEQ ID NO: 3674782 - RNA, 18 nt, Salmonella enterica enterica serovar Typhi
agaaauacugugcccaga

SEQ ID NO: 3674783 - RNA, 23 nt, Salmonella enterica enterica serovar Typhi
agaaauagacgagcgaaaaacug

SEQ ID NO: 3674784 - RNA, 22 nt, Salmonella enterica enterica serovar Typhi
agaaauagccgguaacuuuccc

SEQ ID NO: 3674785 - RNA, 13 nt, Salmonella enterica enterica serovar Typhi
agaaauauuucac

SEQ ID NO: 3674786 - RNA, 13 nt, Salmonella enterica enterica serovar Typhi
agaaauccacauu

SEQ ID NO: 3674787 - RNA, 15 nt, Salmonella enterica enterica serovar Typhi
agaaauccgcgaaua

SEQ ID NO: 3674788 - RNA, 22 nt, Salmonella enterica enterica serovar Typhi
agaaaucucaucugcaaaauau

SEQ ID NO: 3674789 - RNA, 17 nt, Salmonella enterica enterica serovar Typhi
agaaauguccauaaaua

SEQ ID NO: 3674790 - RNA, 21 nt, Salmonella enterica enterica serovar Typhi
agaaauucggcagcgucuucc

SEQ ID NO: 3674791 - RNA, 23 nt, Salmonella enterica enterica serovar Typhi
agaaauugcagggugcagcaaau

SEQ ID NO: 3674792 - RNA, 14 nt, Salmonella enterica enterica serovar Typhi
agaacagcaucacc

SEQ ID NO: 3674793 - RNA, 19 nt, Salmonella enterica enterica serovar Typhi
agaacagcaucaccggccc

SEQ ID NO: 3674794 - RNA, 17 nt, Salmonella enterica enterica serovar Typhi
agaaccaacgucaucau

SEQ ID NO: 3674795 - RNA, 22 nt, Salmonella enterica enterica serovar Typhi
agaaccaacgucaucaugaaaa

SEQ ID NO: 3674796 - RNA, 21 nt, Salmonella enterica enterica serovar Typhi
agaacccacuuugcuuuucug

SEQ ID NO: 3674797 - RNA, 19 nt, Salmonella enterica enterica serovar Typhi
agaaccguugcgcccauca

SEQ ID NO: 3674798 - RNA, 18 nt, Salmonella enterica enterica serovar Typhi
agacaaaagcuggugaaa

SEQ ID NO: 3674799 - RNA, 15 nt, Salmonella enterica enterica serovar Typhi
agacaaaguugacuu

SEQ ID NO: 3674800 - RNA, 11 nt, Salmonella enterica enterica serovar Typhi
agacaaauaac

SEQ ID NO: 3674801 - RNA, 13 nt, Salmonella enterica enterica serovar Typhi
agacaacauccca

SEQ ID NO: 3674802 - RNA, 18 nt, Salmonella enterica enterica serovar Typhi
agacaaccgggcaucacc

SEQ ID NO: 3674803 - RNA, 17 nt, Salmonella enterica enterica serovar Typhi
agacaagcaguucugaa

SEQ ID NO: 3674804 - RNA, 21 nt, Salmonella enterica enterica serovar Typhi
agacacaacgugccagaaaca

SEQ ID NO: 3674805 - RNA, 18 nt, Salmonella enterica enterica serovar Typhi
agacacaauauugcugug

SEQ ID NO: 3674806 - RNA, 14 nt, Salmonella enterica enterica serovar Typhi
agacaccccagccu

SEQ ID NO: 3674807 - RNA, 13 nt, Salmonella enterica enterica serovar Typhi
agacacugcacca

SEQ ID NO: 3674808 - RNA, 18 nt, Salmonella enterica enterica serovar Typhi
agacacuggaaacagcca

SEQ ID NO: 3674809 - RNA, 19 nt, Salmonella enterica enterica serovar Typhi
agacacuggaaacagccaa

SEQ ID NO: 3674810 - RNA, 11 nt, Salmonella enterica enterica serovar Typhi
agacagaacag

SEQ ID NO: 3674811 - RNA, 18 nt, Salmonella enterica enterica serovar Typhi
agacagagaaaaucccca

SEQ ID NO: 3674812 - RNA, 22 nt, Salmonella enterica enterica serovar Typhi
agacagagaaccugaacaauaa

SEQ ID NO: 3674813 - RNA, 20 nt, Salmonella enterica enterica serovar Typhi
agacagauaacaccagcgau

SEQ ID NO: 3674814 - RNA, 16 nt, Salmonella enterica enterica serovar Typhi
agacagcauuuuucac

SEQ ID NO: 3674815 - RNA, 19 nt, Salmonella enterica enterica serovar Typhi
agacagcccuauaacagcg

SEQ ID NO: 3674816 - RNA, 17 nt, Salmonella enterica enterica serovar Typhi
agacagccucucccgaa

SEQ ID NO: 3674817 - RNA, 14 nt, Salmonella enterica enterica serovar Typhi
agacaggacgccag

SEQ ID NO: 3674818 - RNA, 17 nt, Salmonella enterica enterica serovar Typhi
agacaggccagaauuca

SEQ ID NO: 3674819 - RNA, 22 nt, Salmonella enterica enterica serovar Typhi
agacaggugaacauuacaaugu

SEQ ID NO: 3674820 - RNA, 19 nt, Salmonella enterica enterica serovar Typhi
agacaguacggaugaugua

SEQ ID NO: 3674821 - RNA, 22 nt, Salmonella enterica enterica serovar Typhi
agacaguguucccugcgcugga

SEQ ID NO: 3674822 - RNA, 21 nt, Salmonella enterica enterica serovar Typhi
agacauauacucuucgccauu

SEQ ID NO: 3674823 - RNA, 21 nt, Salmonella enterica enterica serovar Typhi
agacauccccgccgagaaaau

SEQ ID NO: 3674824 - RNA, 23 nt, Salmonella enterica enterica serovar Typhi
agacaucgauuagaccguaaauc

SEQ ID NO: 3674825 - RNA, 21 nt, Salmonella enterica enterica serovar Typhi
agacaucggagauuucauccu

SEQ ID NO: 3674826 - RNA, 22 nt, Salmonella enterica enterica serovar Typhi
agacaugaccgcacagcagaca

SEQ ID NO: 3674827 - RNA, 15 nt, Salmonella enterica enterica serovar Typhi
agacaugaucuuacc

SEQ ID NO: 3674828 - RNA, 19 nt, Salmonella enterica enterica serovar Typhi
agacaugccgccagaccaa

SEQ ID NO: 3674829 - RNA, 19 nt, Salmonella enterica enterica serovar Typhi
agacauucgcgcacggcgc

SEQ ID NO: 3674830 - RNA, 19 nt, Salmonella enterica enterica serovar Typhi
agacauugguuucaugcau

SEQ ID NO: 3674831 - RNA, 12 nt, Salmonella enterica enterica serovar Typhi
agaccaauaaaa

SEQ ID NO: 3674832 - RNA, 12 nt, Salmonella enterica enterica serovar Typhi
agaccaauacga

SEQ ID NO: 3674833 - RNA, 19 nt, Salmonella enterica enterica serovar Typhi
agaccaauacgaucggcug

SEQ ID NO: 3674834 - RNA, 15 nt, Salmonella enterica enterica serovar Typhi
agaccaccagcgaca

SEQ ID NO: 3674835 - RNA, 15 nt, Salmonella enterica enterica serovar Typhi
agaccacgaaucagg

SEQ ID NO: 3674836 - RNA, 23 nt, Salmonella enterica enterica serovar Typhi
agaccacgaaucaggauauucgc

SEQ ID NO: 3674837 - RNA, 23 nt, Salmonella enterica enterica serovar Typhi
agaccacgccaucaacagcggag

SEQ ID NO: 3674838 - RNA, 18 nt, Salmonella enterica enterica serovar Typhi
agaccagaaucccacgga

SEQ ID NO: 3674839 - RNA, 21 nt, Salmonella enterica enterica serovar Typhi
agaccagauuaaucagcagau

SEQ ID NO: 3674840 - RNA, 15 nt, Salmonella enterica enterica serovar Typhi
agaccaucaacagcg

SEQ ID NO: 3674841 - RNA, 15 nt, Salmonella enterica enterica serovar Typhi
agaccauccaugaaa

SEQ ID NO: 3674842 - RNA, 13 nt, Salmonella enterica enterica serovar Typhi
agacccaauaugc

SEQ ID NO: 3674843 - RNA, 21 nt, Salmonella enterica enterica serovar Typhi
agacccacauauugcgcuuca

SEQ ID NO: 3674844 - RNA, 23 nt, Salmonella enterica enterica serovar Typhi
agacccacauauugcgcuucacu

SEQ ID NO: 3674845 - RNA, 18 nt, Salmonella enterica enterica serovar Typhi
agacccaguacaaacaaa

SEQ ID NO: 3674846 - RNA, 11 nt, Salmonella enterica enterica serovar Typhi
agacccggcau

SEQ ID NO: 3674847 - RNA, 13 nt, Salmonella enterica enterica serovar Typhi
agacccggcauug

SEQ ID NO: 3674848 - RNA, 14 nt, Salmonella enterica enterica serovar Typhi
agaccgacaaaacu

SEQ ID NO: 3674849 - RNA, 13 nt, Salmonella enterica enterica serovar Typhi
agaccgauaaaua

SEQ ID NO: 3674850 - RNA, 20 nt, Salmonella enterica enterica serovar Typhi
agaccgcugcggaacaccag

SEQ ID NO: 3674851 - RNA, 23 nt, Salmonella enterica enterica serovar Typhi
agaccggagcgugcuucaacggu

SEQ ID NO: 3674852 - RNA, 18 nt, Salmonella enterica enterica serovar Typhi
agaccggaugauggccug

SEQ ID NO: 3674853 - RNA, 18 nt, Salmonella enterica enterica serovar Typhi
agaccggcaaucaauaca

SEQ ID NO: 3674854 - RNA, 12 nt, Salmonella enterica enterica serovar Typhi
agaccggcacaa

SEQ ID NO: 3674855 - RNA, 16 nt, Salmonella enterica enterica serovar Typhi
agaccggcacaaccgu

SEQ ID NO: 3674856 - RNA, 16 nt, Salmonella enterica enterica serovar Typhi
agaccggcgaaaucgu

SEQ ID NO: 3674857 - RNA, 20 nt, Salmonella enterica enterica serovar Typhi
agaccggcgaaaucgugcgc

SEQ ID NO: 3674858 - RNA, 23 nt, Salmonella enterica enterica serovar Typhi
agaccgggcugcacgccaucggc

SEQ ID NO: 3674859 - RNA, 16 nt, Salmonella enterica enterica serovar Typhi
agaccgugaauaagau

SEQ ID NO: 3674860 - RNA, 22 nt, Salmonella enterica enterica serovar Typhi
agaccuccgcccggugcucaau

SEQ ID NO: 3674861 - RNA, 14 nt, Salmonella enterica enterica serovar Typhi
agaccucugcaaac

SEQ ID NO: 3674862 - RNA, 18 nt, Salmonella enterica enterica serovar Typhi
agaccucugcuuugguuu

SEQ ID NO: 3674863 - RNA, 16 nt, Salmonella enterica enterica serovar Typhi
agaccuguaaaaaaac

SEQ ID NO: 3674864 - RNA, 23 nt, Salmonella enterica enterica serovar Typhi
agaccuuaucgcagucagccuug

SEQ ID NO: 3674865 - RNA, 20 nt, Salmonella enterica enterica serovar Typhi
agaccuucaacccagcagca

SEQ ID NO: 3674866 - RNA, 18 nt, Salmonella enterica enterica serovar Typhi
agaccuuuuacuucacgu

SEQ ID NO: 3674867 - RNA, 16 nt, Salmonella enterica enterica serovar Typhi
agacgacaucuuuucc

SEQ ID NO: 3674868 - RNA, 18 nt, Salmonella enterica enterica serovar Typhi
agacgacgguuaaaaagu

SEQ ID NO: 3674869 - RNA, 18 nt, Salmonella enterica enterica serovar Typhi
agacgauaaccggacgau

SEQ ID NO: 3674870 - RNA, 15 nt, Salmonella enterica enterica serovar Typhi
agacgaugaauuccu

SEQ ID NO: 3674871 - RNA, 21 nt, Salmonella enterica enterica serovar Typhi
agacgcaguagcgcuuugaca

SEQ ID NO: 3674872 - RNA, 22 nt, Salmonella enterica enterica serovar Typhi
agacgccaacgucgacagacgc

SEQ ID NO: 3674873 - RNA, 18 nt, Salmonella enterica enterica serovar Typhi
agacgcccugcaaagcaa

SEQ ID NO: 3674874 - RNA, 22 nt, Salmonella enterica enterica serovar Typhi
agacgcccugcaaagcaaaaau

SEQ ID NO: 3674875 - RNA, 20 nt, Salmonella enterica enterica serovar Typhi
agacgccgaaccuggcgggc

SEQ ID NO: 3674876 - RNA, 16 nt, Salmonella enterica enterica serovar Typhi
agacgccgccgcaucc

SEQ ID NO: 3674877 - RNA, 17 nt, Salmonella enterica enterica serovar Typhi
agacgccgcgcugcggc

SEQ ID NO: 3674878 - RNA, 18 nt, Salmonella enterica enterica serovar Typhi
agacgccgcgcugcggcg

SEQ ID NO: 3674879 - RNA, 14 nt, Salmonella enterica enterica serovar Typhi
agacgcgcagcacc

SEQ ID NO: 3674880 - RNA, 18 nt, Salmonella enterica enterica serovar Typhi
agacgcgcuagcuucagg

SEQ ID NO: 3674881 - RNA, 16 nt, Salmonella enterica enterica serovar Typhi
agacgcguaaaucaga

SEQ ID NO: 3674882 - RNA, 22 nt, Salmonella enterica enterica serovar Typhi
agacgcugacauccaucaucua

SEQ ID NO: 3674883 - RNA, 11 nt, Salmonella enterica enterica serovar Typhi
agaggcagcaa

SEQ ID NO: 3674884 - RNA, 15 nt, Salmonella enterica enterica serovar Typhi
agaggcagcaaagcu

SEQ ID NO: 3674885 - RNA, 20 nt, Salmonella enterica enterica serovar Typhi
agaggcauaaaaaaaagccg

SEQ ID NO: 3674886 - RNA, 18 nt, Salmonella enterica enterica serovar Typhi
agaggcguugccgggcau

SEQ ID NO: 3674887 - RNA, 23 nt, Salmonella enterica enterica serovar Typhi
agaggcugaaggcgcuccccugc

SEQ ID NO: 3674888 - RNA, 20 nt, Salmonella enterica enterica serovar Typhi
agaggguuggacaaaauuuu

SEQ ID NO: 3674889 - RNA, 19 nt, Salmonella enterica enterica serovar Typhi
agagguauccugaaccagc

SEQ ID NO: 3674890 - RNA, 22 nt, Salmonella enterica enterica serovar Typhi
agaggucugcauucaggccucu

SEQ ID NO: 3674891 - RNA, 20 nt, Salmonella enterica enterica serovar Typhi
agagguguuauggcaggcga

SEQ ID NO: 3674892 - RNA, 18 nt, Salmonella enterica enterica serovar Typhi
agagguuagcgcaggggg

SEQ ID NO: 3674893 - RNA, 20 nt, Salmonella enterica enterica serovar Typhi
agagguuccccagccgcuuu

SEQ ID NO: 3674894 - RNA, 13 nt, Salmonella enterica enterica serovar Typhi
agaguaacccuuu

SEQ ID NO: 3674895 - RNA, 16 nt, Salmonella enterica enterica serovar Typhi
agaguaggccggauaa

SEQ ID NO: 3674896 - RNA, 18 nt, Salmonella enterica enterica serovar Typhi
agaguauaagcgccgcug

SEQ ID NO: 3674897 - RNA, 20 nt, Salmonella enterica enterica serovar Typhi
agagucaaggcauccagcag

SEQ ID NO: 3674898 - RNA, 19 nt, Salmonella enterica enterica serovar Typhi
agagucacuagcacuacgg

SEQ ID NO: 3674899 - RNA, 13 nt, Salmonella enterica enterica serovar Typhi
agaguccagccau

SEQ ID NO: 3674900 - RNA, 22 nt, Salmonella enterica enterica serovar Typhi
agaguccauucggccugcggug

SEQ ID NO: 3674901 - RNA, 13 nt, Salmonella enterica enterica serovar Typhi
agaguccugacgu

SEQ ID NO: 3674902 - RNA, 10 nt, Salmonella enterica enterica serovar Typhi
agagucgcca

SEQ ID NO: 3674903 - RNA, 22 nt, Salmonella enterica enterica serovar Typhi
agagucucgaaacgaaucucau

SEQ ID NO: 3674904 - RNA, 18 nt, Salmonella enterica enterica serovar Typhi
agagugacgguuuucacu

SEQ ID NO: 3674905 - RNA, 20 nt, Salmonella enterica enterica serovar Typhi
agagugacgguuuucacugg

SEQ ID NO: 3674906 - RNA, 20 nt, Salmonella enterica enterica serovar Typhi
agaguguaggccugauaaga

SEQ ID NO: 3674907 - RNA, 16 nt, Salmonella enterica enterica serovar Typhi
agaguguccauaaagu

SEQ ID NO: 3674908 - RNA, 18 nt, Salmonella enterica enterica serovar Typhi
agaguucacguagcucaa

SEQ ID NO: 3674909 - RNA, 18 nt, Salmonella enterica enterica serovar Typhi
agaguucguuaaucucaa

SEQ ID NO: 3674910 - RNA, 15 nt, Salmonella enterica enterica serovar Typhi
agauaaacagcagcg

SEQ ID NO: 3674911 - RNA, 17 nt, Salmonella enterica enterica serovar Typhi
agauaaacagcagcgcg

SEQ ID NO: 3674912 - RNA, 20 nt, Salmonella enterica enterica serovar Typhi
agauaaacagguaaaacaaa

SEQ ID NO: 3674913 - RNA, 20 nt, Salmonella enterica enterica serovar Typhi
agauaaaguacggcgcgcca

SEQ ID NO: 3674914 - RNA, 15 nt, Salmonella enterica enterica serovar Typhi
agauaaccgggaaua

SEQ ID NO: 3674915 - RNA, 22 nt, Salmonella enterica enterica serovar Typhi
agauaaccgucggcgccggcgu

SEQ ID NO: 3674916 - RNA, 16 nt, Salmonella enterica enterica serovar Typhi
agauaacgcgcauaau

SEQ ID NO: 3674917 - RNA, 12 nt, Salmonella enterica enterica serovar Typhi
agauaacgcuau

SEQ ID NO: 3674918 - RNA, 16 nt, Salmonella enterica enterica serovar Typhi
agauaacgcuaugcuu

SEQ ID NO: 3674919 - RNA, 17 nt, Salmonella enterica enterica serovar Typhi
agauaagaaaaaacugg

SEQ ID NO: 3674920 - RNA, 16 nt, Salmonella enterica enterica serovar Typhi
agauaagaaguaaaca

SEQ ID NO: 3674921 - RNA, 18 nt, Salmonella enterica enterica serovar Typhi
agauaagccuccggauga

SEQ ID NO: 3674922 - RNA, 19 nt, Salmonella enterica enterica serovar Typhi
agauaaggagaaagaccuu

SEQ ID NO: 3674923 - RNA, 16 nt, Salmonella enterica enterica serovar Typhi
agauaaguccuaacac

SEQ ID NO: 3674924 - RNA, 12 nt, Salmonella enterica enterica serovar Typhi
agauaauagcug

SEQ ID NO: 3674925 - RNA, 17 nt, Salmonella enterica enterica serovar Typhi
agauaauccagcgucgc

SEQ ID NO: 3674926 - RNA, 22 nt, Salmonella enterica enterica serovar Typhi
agauaauccagcgucgccagca

SEQ ID NO: 3674927 - RNA, 12 nt, Salmonella enterica enterica serovar Typhi
agauaaugccgc

SEQ ID NO: 3674928 - RNA, 20 nt, Salmonella enterica enterica serovar Typhi
agauaaugcucauuauuugg

SEQ ID NO: 3674929 - RNA, 16 nt, Salmonella enterica enterica serovar Typhi
agauaauuaugccugu

SEQ ID NO: 3674930 - RNA, 23 nt, Salmonella enterica enterica serovar Typhi
agauaauuuucccaguucaucca

SEQ ID NO: 3674931 - RNA, 16 nt, Salmonella enterica enterica serovar Typhi
agauacggcuccagca

SEQ ID NO: 3674932 - RNA, 19 nt, Salmonella enterica enterica serovar Typhi
agauacugcgcguggcaaa

SEQ ID NO: 3674933 - RNA, 21 nt, Salmonella enterica enterica serovar Typhi
agauagcccgccagcaccagc

SEQ ID NO: 3674934 - RNA, 23 nt, Salmonella enterica enterica serovar Typhi
agauagcccgccagcaccagcag

SEQ ID NO: 3674935 - RNA, 23 nt, Salmonella enterica enterica serovar Typhi
agauagcgcugcgccagaucagg

SEQ ID NO: 3674936 - RNA, 20 nt, Salmonella enterica enterica serovar Typhi
agauagcugcuuaccauacu

SEQ ID NO: 3674937 - RNA, 18 nt, Salmonella enterica enterica serovar Typhi
agauagcuuccaugccga

SEQ ID NO: 3674938 - RNA, 15 nt, Salmonella enterica enterica serovar Typhi
agauagggccaggcg

SEQ ID NO: 3674939 - RNA, 17 nt, Salmonella enterica enterica serovar Typhi
agauagucaucaccauu

SEQ ID NO: 3674940 - RNA, 16 nt, Salmonella enterica enterica serovar Typhi
agauagucgaucccca

SEQ ID NO: 3674941 - RNA, 15 nt, Salmonella enterica enterica serovar Typhi
agauaguugagcagc

SEQ ID NO: 3674942 - RNA, 18 nt, Salmonella enterica enterica serovar Typhi
agauaguuuuuaauucca

SEQ ID NO: 3674943 - RNA, 20 nt, Salmonella enterica enterica serovar Typhi
agauauaggguggcuuucua

SEQ ID NO: 3674944 - RNA, 15 nt, Salmonella enterica enterica serovar Typhi
agauaucaaacacaa

SEQ ID NO: 3674945 - RNA, 17 nt, Salmonella enterica enterica serovar Typhi
agauaucaccaucuuuu

SEQ ID NO: 3674946 - RNA, 17 nt, Salmonella enterica enterica serovar Typhi
agauaucccaugaaacu

SEQ ID NO: 3674947 - RNA, 20 nt, Salmonella enterica enterica serovar Typhi
agauaugaaaugagaccaau

SEQ ID NO: 3674948 - RNA, 14 nt, Salmonella enterica enterica serovar Typhi
agauauggcgggga

SEQ ID NO: 3674949 - RNA, 15 nt, Salmonella enterica enterica serovar Typhi
agauauuaauaucga

SEQ ID NO: 3674950 - RNA, 15 nt, Salmonella enterica enterica serovar Typhi
agauauuauaaaaua

SEQ ID NO: 3674951 - RNA, 18 nt, Salmonella enterica enterica serovar Typhi
agauauucacuauaugcc

SEQ ID NO: 3674952 - RNA, 12 nt, Salmonella enterica enterica serovar Typhi
agauauucccgg

SEQ ID NO: 3674953 - RNA, 13 nt, Salmonella enterica enterica serovar Typhi
agaucaaaaaucu

SEQ ID NO: 3674954 - RNA, 17 nt, Salmonella enterica enterica serovar Typhi
agaucaaacaggcgaaa

SEQ ID NO: 3674955 - RNA, 12 nt, Salmonella enterica enterica serovar Typhi
agaucagacgac

SEQ ID NO: 3674956 - RNA, 18 nt, Salmonella enterica enterica serovar Typhi
agaucagacgaccaucca

SEQ ID NO: 3674957 - RNA, 17 nt, Salmonella enterica enterica serovar Typhi
agaucaggaguaaauaa

SEQ ID NO: 3674958 - RNA, 19 nt, Salmonella enterica enterica serovar Typhi
agaucaggccgauuucauu

SEQ ID NO: 3674959 - RNA, 15 nt, Salmonella enterica enterica serovar Typhi
agaucaggcgucagc

SEQ ID NO: 3674960 - RNA, 21 nt, Salmonella enterica enterica serovar Typhi
agaucaggcgucagcauggug

SEQ ID NO: 3674961 - RNA, 18 nt, Salmonella enterica enterica serovar Typhi
agaucauuccugaauacc

SEQ ID NO: 3674962 - RNA, 14 nt, Salmonella enterica enterica serovar Typhi
agaucauuuacggc

SEQ ID NO: 3674963 - RNA, 14 nt, Salmonella enterica enterica serovar Typhi
agauccaacacggc

SEQ ID NO: 3674964 - RNA, 21 nt, Salmonella enterica enterica serovar Typhi
agauccacugagcgcgccaug

SEQ ID NO: 3674965 - RNA, 17 nt, Salmonella enterica enterica serovar Typhi
agauccauaagaugaaa

SEQ ID NO: 3674966 - RNA, 13 nt, Salmonella enterica enterica serovar Typhi
agauccgcaagag

SEQ ID NO: 3674967 - RNA, 22 nt, Salmonella enterica enterica serovar Typhi
agauccugcgagcuuuccacca

SEQ ID NO: 3674968 - RNA, 16 nt, Salmonella enterica enterica serovar Typhi
agauccuuaacgucaa

SEQ ID NO: 3674969 - RNA, 22 nt, Salmonella enterica enterica serovar Typhi
agcaaacgaccuuucgccguca

SEQ ID NO: 3674970 - RNA, 17 nt, Salmonella enterica enterica serovar Typhi
agcaaagcguacaugaa

SEQ ID NO: 3674971 - RNA, 21 nt, Salmonella enterica enterica serovar Typhi
agcaaagcguacaugaauaau

SEQ ID NO: 3674972 - RNA, 14 nt, Salmonella enterica enterica serovar Typhi
agcaaaucagcuac

SEQ ID NO: 3674973 - RNA, 16 nt, Salmonella enterica enterica serovar Typhi
agcaaaucgcccauca

SEQ ID NO: 3674974 - RNA, 21 nt, Salmonella enterica enterica serovar Typhi
agcaaaucgcccaucacaugu

SEQ ID NO: 3674975 - RNA, 13 nt, Salmonella enterica enterica serovar Typhi
agcaaauugcuga

SEQ ID NO: 3674976 - RNA, 15 nt, Salmonella enterica enterica serovar Typhi
agcaaauuuaaucau

SEQ ID NO: 3674977 - RNA, 18 nt, Salmonella enterica enterica serovar Typhi
agcaacacagccagcacg

SEQ ID NO: 3674978 - RNA, 20 nt, Salmonella enterica enterica serovar Typhi
agcaacagauugaugcccuc

SEQ ID NO: 3674979 - RNA, 21 nt, Salmonella enterica enterica serovar Typhi
agcaacagugggcuaugaaga

SEQ ID NO: 3674980 - RNA, 16 nt, Salmonella enterica enterica serovar Typhi
agcaacaguugcugga

SEQ ID NO: 3674981 - RNA, 19 nt, Salmonella enterica enterica serovar Typhi
agcaaccagcuaaccuguu

SEQ ID NO: 3674982 - RNA, 16 nt, Salmonella enterica enterica serovar Typhi
agcaacccaccugcca

SEQ ID NO: 3674983 - RNA, 22 nt, Salmonella enterica enterica serovar Typhi
agcaacccugccgucucaacca

SEQ ID NO: 3674984 - RNA, 20 nt, Salmonella enterica enterica serovar Typhi
agcaacgccaucagcaaaau

SEQ ID NO: 3674985 - RNA, 16 nt, Salmonella enterica enterica serovar Typhi
agcaacgggcagucug

SEQ ID NO: 3674986 - RNA, 19 nt, Salmonella enterica enterica serovar Typhi
agcaacguaaucccgccag

SEQ ID NO: 3674987 - RNA, 23 nt, Salmonella enterica enterica serovar Typhi
agcaacguaaucccgccagccuu

SEQ ID NO: 3674988 - RNA, 20 nt, Salmonella enterica enterica serovar Typhi
agcaacguccgcagccgacg

SEQ ID NO: 3674989 - RNA, 21 nt, Salmonella enterica enterica serovar Typhi
agcaacguuaaggccgcaaac

SEQ ID NO: 3674990 - RNA, 15 nt, Salmonella enterica enterica serovar Typhi
agcaacuguagaaug

SEQ ID NO: 3674991 - RNA, 22 nt, Salmonella enterica enterica serovar Typhi
agcaacuguuuuaccaaaucaa

SEQ ID NO: 3674992 - RNA, 13 nt, Salmonella enterica enterica serovar Typhi
agcaagaacagag

SEQ ID NO: 3674993 - RNA, 19 nt, Salmonella enterica enterica serovar Typhi
agcaagaacagagcaauua

SEQ ID NO: 3674994 - RNA, 22 nt, Salmonella enterica enterica serovar Typhi
agcaagaaguuccgcuuuucug

SEQ ID NO: 3674995 - RNA, 16 nt, Salmonella enterica enterica serovar Typhi
agcaagaauaccacuu

SEQ ID NO: 3674996 - RNA, 14 nt, Salmonella enterica enterica serovar Typhi
agcaagauuucaaa

SEQ ID NO: 3674997 - RNA, 21 nt, Salmonella enterica enterica serovar Typhi
agcaaggcauuggacggaauc

SEQ ID NO: 3674998 - RNA, 14 nt, Salmonella enterica enterica serovar Typhi
agcaauaaaaggaa

SEQ ID NO: 3674999 - RNA, 12 nt, Salmonella enterica enterica serovar Typhi
agcaauaauccg

SEQ ID NO: 3675000 - RNA, 16 nt, Salmonella enterica enterica serovar Typhi
agcaauacaauuauug

SEQ ID NO: 3675001 - RNA, 17 nt, Salmonella enterica enterica serovar Typhi
agcaauacaauuauugc

SEQ ID NO: 3675002 - RNA, 21 nt, Salmonella enterica enterica serovar Typhi
agcaauagguuugaccagaua

SEQ ID NO: 3675003 - RNA, 15 nt, Salmonella enterica enterica serovar Typhi
agcaauauuuuuccg

SEQ ID NO: 3675004 - RNA, 16 nt, Salmonella enterica enterica serovar Typhi
agcaaucacuuccgcc

SEQ ID NO: 3675005 - RNA, 14 nt, Salmonella enterica enterica serovar Typhi
agcaaucaguucuc

SEQ ID NO: 3675006 - RNA, 13 nt, Salmonella enterica enterica serovar Typhi
agcaaugauuuua

SEQ ID NO: 3675007 - RNA, 15 nt, Salmonella enterica enterica serovar Typhi
agcaaugauuuuuag

SEQ ID NO: 3675008 - RNA, 20 nt, Salmonella enterica enterica serovar Typhi
agcaaugcgaauaacaucau

SEQ ID NO: 3675009 - RNA, 12 nt, Salmonella enterica enterica serovar Typhi
agcaauggcgug

SEQ ID NO: 3675010 - RNA, 20 nt, Salmonella enterica enterica serovar Typhi
agcaauggguaggccggaua

SEQ ID NO: 3675011 - RNA, 17 nt, Salmonella enterica enterica serovar Typhi
agcaaugugcgccagaa

SEQ ID NO: 3675012 - RNA, 15 nt, Salmonella enterica enterica serovar Typhi
agcaauuaacaaaua

SEQ ID NO: 3675013 - RNA, 20 nt, Salmonella enterica enterica serovar Typhi
agcaauuaacaaauaaagcg

SEQ ID NO: 3675014 - RNA, 19 nt, Salmonella enterica enterica serovar Typhi
agcaauuccgccaucucau

SEQ ID NO: 3675015 - RNA, 21 nt, Salmonella enterica enterica serovar Typhi
agcaauugccauaaaaacaau

SEQ ID NO: 3675016 - RNA, 21 nt, Salmonella enterica enterica serovar Typhi
agcaauuucagcauccuccgg

SEQ ID NO: 3675017 - RNA, 23 nt, Salmonella enterica enterica serovar Typhi
agcaauuucucgcccgccagauc

SEQ ID NO: 3675018 - RNA, 18 nt, Salmonella enterica enterica serovar Typhi
agcacaacgaguccccuc

SEQ ID NO: 3675019 - RNA, 22 nt, Salmonella enterica enterica serovar Typhi
agcacaacgcauuggcaauuaa

SEQ ID NO: 3675020 - RNA, 20 nt, Salmonella enterica enterica serovar Typhi
agcacaauaacgaccccaau

SEQ ID NO: 3675021 - RNA, 15 nt, Salmonella enterica enterica serovar Typhi
agcacaccauuucac

SEQ ID NO: 3675022 - RNA, 19 nt, Salmonella enterica enterica serovar Typhi
agcacaccauuucacaaau

SEQ ID NO: 3675023 - RNA, 17 nt, Salmonella enterica enterica serovar Typhi
agcacagcccaguaaua

SEQ ID NO: 3675024 - RNA, 13 nt, Salmonella enterica enterica serovar Typhi
agcacagcccuac

SEQ ID NO: 3675025 - RNA, 17 nt, Salmonella enterica enterica serovar Typhi
agcacagcucuaauuga

SEQ ID NO: 3675026 - RNA, 12 nt, Salmonella enterica enterica serovar Typhi
agcacaggccau

SEQ ID NO: 3675027 - RNA, 20 nt, Salmonella enterica enterica serovar Typhi
agcacauaacugagacucag

SEQ ID NO: 3675028 - RNA, 18 nt, Salmonella enterica enterica serovar Typhi
agcacaugacggcugacg

SEQ ID NO: 3675029 - RNA, 21 nt, Salmonella enterica enterica serovar Typhi
agcacaugacggcugacgcag

SEQ ID NO: 3675030 - RNA, 15 nt, Salmonella enterica enterica serovar Typhi
agcacaugcagauau

SEQ ID NO: 3675031 - RNA, 22 nt, Salmonella enterica enterica serovar Typhi
agcacauuacaggcaucuucca

SEQ ID NO: 3675032 - RNA, 19 nt, Salmonella enterica enterica serovar Typhi
agcacauucgauaaccgcc

SEQ ID NO: 3675033 - RNA, 12 nt, Salmonella enterica enterica serovar Typhi
agcaccaccugc

SEQ ID NO: 3675034 - RNA, 15 nt, Salmonella enterica enterica serovar Typhi
agcaccacgcccgga

SEQ ID NO: 3675035 - RNA, 13 nt, Salmonella enterica enterica serovar Typhi
agcaccagcaggu

SEQ ID NO: 3675036 - RNA, 15 nt, Salmonella enterica enterica serovar Typhi
agcaccagcaggugg

SEQ ID NO: 3675037 - RNA, 12 nt, Salmonella enterica enterica serovar Typhi
agcaccagcagu

SEQ ID NO: 3675038 - RNA, 13 nt, Salmonella enterica enterica serovar Typhi
agcaccagcagug

SEQ ID NO: 3675039 - RNA, 13 nt, Salmonella enterica enterica serovar Typhi
agcaccaggccaa

SEQ ID NO: 3675040 - RNA, 16 nt, Salmonella enterica enterica serovar Typhi
agcaccauucuucaac

SEQ ID NO: 3675041 - RNA, 20 nt, Salmonella enterica enterica serovar Typhi
agcacccaccaucacuucca

SEQ ID NO: 3675042 - RNA, 16 nt, Salmonella enterica enterica serovar Typhi
agcacccggcccggcg

SEQ ID NO: 3675043 - RNA, 15 nt, Salmonella enterica enterica serovar Typhi
agcaccgccagcgcc

SEQ ID NO: 3675044 - RNA, 21 nt, Salmonella enterica enterica serovar Typhi
agcaccgccgggaagaaauua

SEQ ID NO: 3675045 - RNA, 20 nt, Salmonella enterica enterica serovar Typhi
agcaccggaacagaagccug

SEQ ID NO: 3675046 - RNA, 20 nt, Salmonella enterica enterica serovar Typhi
agcaccggauacaagguauc

SEQ ID NO: 3675047 - RNA, 18 nt, Salmonella enterica enterica serovar Typhi
agcaccucaauaugaaau

SEQ ID NO: 3675048 - RNA, 13 nt, Salmonella enterica enterica serovar Typhi
agcaccuccagcg

SEQ ID NO: 3675049 - RNA, 16 nt, Salmonella enterica enterica serovar Typhi
agcaccuuauccggcc

SEQ ID NO: 3675050 - RNA, 15 nt, Salmonella enterica enterica serovar Typhi
agcacgaggguaaug

SEQ ID NO: 3675051 - RNA, 19 nt, Salmonella enterica enterica serovar Typhi
agcacgcccauauccagcu

SEQ ID NO: 3675052 - RNA, 16 nt, Salmonella enterica enterica serovar Typhi
agcacgcgcugcgccg

SEQ ID NO: 3675053 - RNA, 21 nt, Salmonella enterica enterica serovar Typhi
agcacgcggaagaaauagaac

SEQ ID NO: 3675054 - RNA, 19 nt, Salmonella enterica enterica serovar Typhi
agcacggggguuuugugau

SEQ ID NO: 3675055 - RNA, 13 nt, Salmonella enterica enterica serovar Typhi
agcaucgcauuaa

SEQ ID NO: 3675056 - RNA, 13 nt, Salmonella enterica enterica serovar Typhi
agcaucgccauca

SEQ ID NO: 3675057 - RNA, 20 nt, Salmonella enterica enterica serovar Typhi
agcaucgccgguagcuucag

SEQ ID NO: 3675058 - RNA, 22 nt, Salmonella enterica enterica serovar Typhi
agcaucgcuuuuaggcugaaag

SEQ ID NO: 3675059 - RNA, 20 nt, Salmonella enterica enterica serovar Typhi
agcaucggcagcgccaguga

SEQ ID NO: 3675060 - RNA, 15 nt, Salmonella enterica enterica serovar Typhi
agcaucgggaaucau

SEQ ID NO: 3675061 - RNA, 23 nt, Salmonella enterica enterica serovar Typhi
agcaucucaauaucguugccgcc

SEQ ID NO: 3675062 - RNA, 18 nt, Salmonella enterica enterica serovar Typhi
agcaucugauagcccauc

SEQ ID NO: 3675063 - RNA, 15 nt, Salmonella enterica enterica serovar Typhi
agcaucugcauaaug

SEQ ID NO: 3675064 - RNA, 18 nt, Salmonella enterica enterica serovar Typhi
agcaugagugauagcgcc

SEQ ID NO: 3675065 - RNA, 16 nt, Salmonella enterica enterica serovar Typhi
agcaugggcuaaagca

SEQ ID NO: 3675066 - RNA, 22 nt, Salmonella enterica enterica serovar Typhi
agcaugugaauaugaucugcac

SEQ ID NO: 3675067 - RNA, 14 nt, Salmonella enterica enterica serovar Typhi
agcauuaaaucauc

SEQ ID NO: 3675068 - RNA, 19 nt, Salmonella enterica enterica serovar Typhi
agcauuaccccgugguggg

SEQ ID NO: 3675069 - RNA, 12 nt, Salmonella enterica enterica serovar Typhi
agcauuagcgcc

SEQ ID NO: 3675070 - RNA, 13 nt, Salmonella enterica enterica serovar Typhi
agcauuauuuuua

SEQ ID NO: 3675071 - RNA, 19 nt, Salmonella enterica enterica serovar Typhi
agcauuauuuuuaaccgcc

SEQ ID NO: 3675072 - RNA, 23 nt, Salmonella enterica enterica serovar Typhi
agcauugccgucaaacgcuauca

SEQ ID NO: 3675073 - RNA, 18 nt, Salmonella enterica enterica serovar Typhi
agcauugccguuuucaau

SEQ ID NO: 3675074 - RNA, 20 nt, Salmonella enterica enterica serovar Typhi
agcauugcuucgucccugca

SEQ ID NO: 3675075 - RNA, 18 nt, Salmonella enterica enterica serovar Typhi
agcauuggaaauucaggg

SEQ ID NO: 3675076 - RNA, 15 nt, Salmonella enterica enterica serovar Typhi
agcauugggccgaua

SEQ ID NO: 3675077 - RNA, 21 nt, Salmonella enterica enterica serovar Typhi
agcauuguaggggcuuaucuc

SEQ ID NO: 3675078 - RNA, 18 nt, Salmonella enterica enterica serovar Typhi
agcauuuccgcagccaac

SEQ ID NO: 3675079 - RNA, 15 nt, Salmonella enterica enterica serovar Typhi
agcauuucgacguca

SEQ ID NO: 3675080 - RNA, 23 nt, Salmonella enterica enterica serovar Typhi
agcauuucggcguguaacugcaa

SEQ ID NO: 3675081 - RNA, 12 nt, Salmonella enterica enterica serovar Typhi
agcauuuguagc

SEQ ID NO: 3675082 - RNA, 17 nt, Salmonella enterica enterica serovar Typhi
agcauuuuaagaaaauu

SEQ ID NO: 3675083 - RNA, 22 nt, Salmonella enterica enterica serovar Typhi
agccaaaaauaacgcccugcgc

SEQ ID NO: 3675084 - RNA, 17 nt, Salmonella enterica enterica serovar Typhi
agccaaaaucgauagcg

SEQ ID NO: 3675085 - RNA, 17 nt, Salmonella enterica enterica serovar Typhi
agccaaaauuuucaaua

SEQ ID NO: 3675086 - RNA, 16 nt, Salmonella enterica enterica serovar Typhi
agccaaacaauauccc

SEQ ID NO: 3675087 - RNA, 12 nt, Salmonella enterica enterica serovar Typhi
agccaaacacuu

SEQ ID NO: 3675088 - RNA, 19 nt, Salmonella enterica enterica serovar Typhi
agccaaacacuuccccugc

SEQ ID NO: 3675089 - RNA, 19 nt, Salmonella enterica enterica serovar Typhi
agccaaagcgagguaaaaa

SEQ ID NO: 3675090 - RNA, 19 nt, Salmonella enterica enterica serovar Typhi
agccaaauagcgccagaca

SEQ ID NO: 3675091 - RNA, 17 nt, Salmonella enterica enterica serovar Typhi
agccaacaacaggccgc

SEQ ID NO: 3675092 - RNA, 15 nt, Salmonella enterica enterica serovar Typhi
agccaacacauaagc

SEQ ID NO: 3675093 - RNA, 13 nt, Salmonella enterica enterica serovar Typhi
agccaacccacgc

SEQ ID NO: 3675094 - RNA, 20 nt, Salmonella enterica enterica serovar Typhi
agccaacguauaaaauggca

SEQ ID NO: 3675095 - RNA, 17 nt, Salmonella enterica enterica serovar Typhi
agccaauccagaauacc

SEQ ID NO: 3675096 - RNA, 16 nt, Salmonella enterica enterica serovar Typhi
agccacaaucugauaa

SEQ ID NO: 3675097 - RNA, 13 nt, Salmonella enterica enterica serovar Typhi
agccacaaugaca

SEQ ID NO: 3675098 - RNA, 21 nt, Salmonella enterica enterica serovar Typhi
agccacacgacgguauuggua

SEQ ID NO: 3675099 - RNA, 14 nt, Salmonella enterica enterica serovar Typhi
agccacauuguaug

SEQ ID NO: 3675100 - RNA, 12 nt, Salmonella enterica enterica serovar Typhi
agccacccacgg

SEQ ID NO: 3675101 - RNA, 14 nt, Salmonella enterica enterica serovar Typhi
agccacccacggca

SEQ ID NO: 3675102 - RNA, 15 nt, Salmonella enterica enterica serovar Typhi
agccaccccauuaau

SEQ ID NO: 3675103 - RNA, 18 nt, Salmonella enterica enterica serovar Typhi
agccaccgcccagagaau

SEQ ID NO: 3675104 - RNA, 23 nt, Salmonella enterica enterica serovar Typhi
agccaccggcagggccaguucug

SEQ ID NO: 3675105 - RNA, 18 nt, Salmonella enterica enterica serovar Typhi
agccacgcaagcagcaca

SEQ ID NO: 3675106 - RNA, 16 nt, Salmonella enterica enterica serovar Typhi
agccacguaaagacga

SEQ ID NO: 3675107 - RNA, 19 nt, Salmonella enterica enterica serovar Typhi
agccacgucugaugcgugg

SEQ ID NO: 3675108 - RNA, 15 nt, Salmonella enterica enterica serovar Typhi
agccacguugcgcgc

SEQ ID NO: 3675109 - RNA, 20 nt, Salmonella enterica enterica serovar Typhi
agccacguugcgcgcgguca

SEQ ID NO: 3675110 - RNA, 13 nt, Salmonella enterica enterica serovar Typhi
agccacuauccag

SEQ ID NO: 3675111 - RNA, 11 nt, Salmonella enterica enterica serovar Typhi
agccacuggcu

SEQ ID NO: 3675112 - RNA, 18 nt, Salmonella enterica enterica serovar Typhi
agccacuucaugcgcuuu

SEQ ID NO: 3675113 - RNA, 15 nt, Salmonella enterica enterica serovar Typhi
agccagaacucaucu

SEQ ID NO: 3675114 - RNA, 16 nt, Salmonella enterica enterica serovar Typhi
agccagaacucaucuu

SEQ ID NO: 3675115 - RNA, 13 nt, Salmonella enterica enterica serovar Typhi
agccagacgccag

SEQ ID NO: 3675116 - RNA, 14 nt, Salmonella enterica enterica serovar Typhi
agccagacgcgcag

SEQ ID NO: 3675117 - RNA, 19 nt, Salmonella enterica enterica serovar Typhi
agccagacgcgcagcaccg

SEQ ID NO: 3675118 - RNA, 22 nt, Salmonella enterica enterica serovar Typhi
agccagacgcuccgcaguaauc

SEQ ID NO: 3675119 - RNA, 23 nt, Salmonella enterica enterica serovar Typhi
agccagacgcuccgcaguaauca

SEQ ID NO: 3675120 - RNA, 23 nt, Salmonella enterica enterica serovar Typhi
agccagacggcgcccagccugcc

SEQ ID NO: 3675121 - RNA, 19 nt, Salmonella enterica enterica serovar Typhi
agccagagauccacauugg

SEQ ID NO: 3675122 - RNA, 14 nt, Salmonella enterica enterica serovar Typhi
agccagagcgcgcu

SEQ ID NO: 3675123 - RNA, 19 nt, Salmonella enterica enterica serovar Typhi
agccagagcgcgcuggcaa

SEQ ID NO: 3675124 - RNA, 14 nt, Salmonella enterica enterica serovar Typhi
agccagauaaagca

SEQ ID NO: 3675125 - RNA, 18 nt, Salmonella enterica enterica serovar Typhi
agccagauaaagcagcga

SEQ ID NO: 3675126 - RNA, 18 nt, Salmonella enterica enterica serovar Typhi
agccagauguaaucugac

SEQ ID NO: 3675127 - RNA, 21 nt, Salmonella enterica enterica serovar Typhi
agccagauguaaucugacaga

SEQ ID NO: 3675128 - RNA, 14 nt, Salmonella enterica enterica serovar Typhi
agccagcaauaaca

SEQ ID NO: 3675129 - RNA, 13 nt, Salmonella enterica enterica serovar Typhi
agccagcagcuca

SEQ ID NO: 3675130 - RNA, 15 nt, Salmonella enterica enterica serovar Typhi
agccagcaucgcuaa

SEQ ID NO: 3675131 - RNA, 16 nt, Salmonella enterica enterica serovar Typhi
agccagcauuuccagc

SEQ ID NO: 3675132 - RNA, 21 nt, Salmonella enterica enterica serovar Typhi
agccagccaaauagcgccaga

SEQ ID NO: 3675133 - RNA, 16 nt, Salmonella enterica enterica serovar Typhi
agccagccauggcccu

SEQ ID NO: 3675134 - RNA, 20 nt, Salmonella enterica enterica serovar Typhi
agccagcccuaaggucacgc

SEQ ID NO: 3675135 - RNA, 23 nt, Salmonella enterica enterica serovar Typhi
agccagccgccaaaaauaucgcc

SEQ ID NO: 3675136 - RNA, 22 nt, Salmonella enterica enterica serovar Typhi
agccagccguugugcugguuga

SEQ ID NO: 3675137 - RNA, 19 nt, Salmonella enterica enterica serovar Typhi
agccagcgggcgcagucca

SEQ ID NO: 3675138 - RNA, 20 nt, Salmonella enterica enterica serovar Typhi
agccagcguaaauagcccgg

SEQ ID NO: 3675139 - RNA, 23 nt, Salmonella enterica enterica serovar Typhi
agccagcguaaauagcccggauc

SEQ ID NO: 3675140 - RNA, 18 nt, Salmonella enterica enterica serovar Typhi
agccagcguuucuggaag

SEQ ID NO: 3675141 - RNA, 12 nt, Salmonella enterica enterica serovar Typhi
agccgcccaucc

SEQ ID NO: 3675142 - RNA, 18 nt, Salmonella enterica enterica serovar Typhi
agccgcccaucccuaaua

SEQ ID NO: 3675143 - RNA, 17 nt, Salmonella enterica enterica serovar Typhi
agccgccccccgucagg

SEQ ID NO: 3675144 - RNA, 23 nt, Salmonella enterica enterica serovar Typhi
agccgcccgcgauaaaaauccug

SEQ ID NO: 3675145 - RNA, 21 nt, Salmonella enterica enterica serovar Typhi
agccgcccggcgcgcuggagg

SEQ ID NO: 3675146 - RNA, 21 nt, Salmonella enterica enterica serovar Typhi
agccgcccugcggacaggcga

SEQ ID NO: 3675147 - RNA, 20 nt, Salmonella enterica enterica serovar Typhi
agccgcgccaucuccuccuc

SEQ ID NO: 3675148 - RNA, 21 nt, Salmonella enterica enterica serovar Typhi
agccgcgccaucuccuccuca

SEQ ID NO: 3675149 - RNA, 20 nt, Salmonella enterica enterica serovar Typhi
agccgcgcccuaacaggcgc

SEQ ID NO: 3675150 - RNA, 14 nt, Salmonella enterica enterica serovar Typhi
agccgcgcgccgcc

SEQ ID NO: 3675151 - RNA, 18 nt, Salmonella enterica enterica serovar Typhi
agccgcgcucaagcuggg

SEQ ID NO: 3675152 - RNA, 20 nt, Salmonella enterica enterica serovar Typhi
agccgcggcgcuuucgccac

SEQ ID NO: 3675153 - RNA, 21 nt, Salmonella enterica enterica serovar Typhi
agccggaaaagcgcuggcugg

SEQ ID NO: 3675154 - RNA, 21 nt, Salmonella enterica enterica serovar Typhi
agccggaaaucaauuccgguu

SEQ ID NO: 3675155 - RNA, 19 nt, Salmonella enterica enterica serovar Typhi
agccggaaucauucuacaa

SEQ ID NO: 3675156 - RNA, 13 nt, Salmonella enterica enterica serovar Typhi
agccggagguuuu

SEQ ID NO: 3675157 - RNA, 21 nt, Salmonella enterica enterica serovar Typhi
agccggcgauagcgccccaaa

SEQ ID NO: 3675158 - RNA, 19 nt, Salmonella enterica enterica serovar Typhi
agccgggcgggaaccugcu

SEQ ID NO: 3675159 - RNA, 22 nt, Salmonella enterica enterica serovar Typhi
agccggguaauaaguugcacuc

SEQ ID NO: 3675160 - RNA, 21 nt, Salmonella enterica enterica serovar Typhi
agccgguguuaaccagauaag

SEQ ID NO: 3675161 - RNA, 20 nt, Salmonella enterica enterica serovar Typhi
agccgguuagccacaaugac

SEQ ID NO: 3675162 - RNA, 17 nt, Salmonella enterica enterica serovar Typhi
agccgguuuauccgcaa

SEQ ID NO: 3675163 - RNA, 18 nt, Salmonella enterica enterica serovar Typhi
agccgguuuauccgcaac

SEQ ID NO: 3675164 - RNA, 19 nt, Salmonella enterica enterica serovar Typhi
agccguaacgagugaggac

SEQ ID NO: 3675165 - RNA, 19 nt, Salmonella enterica enterica serovar Typhi
agccguaacuaugccagaa

SEQ ID NO: 3675166 - RNA, 16 nt, Salmonella enterica enterica serovar Typhi
agccguagcagaagac

SEQ ID NO: 3675167 - RNA, 21 nt, Salmonella enterica enterica serovar Typhi
agccgucgauaaaauccucua

SEQ ID NO: 3675168 - RNA, 22 nt, Salmonella enterica enterica serovar Typhi
agccgugccugcuccgccaggg

SEQ ID NO: 3675169 - RNA, 17 nt, Salmonella enterica enterica serovar Typhi
agccguuaccgccgagc

SEQ ID NO: 3675170 - RNA, 16 nt, Salmonella enterica enterica serovar Typhi
agccguuacuuccccc

SEQ ID NO: 3675171 - RNA, 13 nt, Salmonella enterica enterica serovar Typhi
agccguucuccag

SEQ ID NO: 3675172 - RNA, 19 nt, Salmonella enterica enterica serovar Typhi
agccguuuuggcagcgccc

SEQ ID NO: 3675173 - RNA, 22 nt, Salmonella enterica enterica serovar Typhi
agccguuuuggcagcgcccgcu

SEQ ID NO: 3675174 - RNA, 23 nt, Salmonella enterica enterica serovar Typhi
agccuaaugggccagauucuuag

SEQ ID NO: 3675175 - RNA, 16 nt, Salmonella enterica enterica serovar Typhi
agccuaccugccgcca

SEQ ID NO: 3675176 - RNA, 24 nt, Salmonella enterica enterica serovar Typhi
agccuaucgccauauacgccacgg

SEQ ID NO: 3675177 - RNA, 13 nt, Salmonella enterica enterica serovar Typhi
agccuauuaucag

SEQ ID NO: 3675178 - RNA, 21 nt, Salmonella enterica enterica serovar Typhi
agccugacuacgucagauggg

SEQ ID NO: 3675179 - RNA, 15 nt, Salmonella enterica enterica serovar Typhi
agccugccagcaacc

SEQ ID NO: 3675180 - RNA, 22 nt, Salmonella enterica enterica serovar Typhi
agccugccagcaacccaccugc

SEQ ID NO: 3675181 - RNA, 20 nt, Salmonella enterica enterica serovar Typhi
agccugcccugcggcaggca

SEQ ID NO: 3675182 - RNA, 21 nt, Salmonella enterica enterica serovar Typhi
agccugcgcguaaauuucacu

SEQ ID NO: 3675183 - RNA, 19 nt, Salmonella enterica enterica serovar Typhi
agccuggagagcagcgcca

SEQ ID NO: 3675184 - RNA, 12 nt, Salmonella enterica enterica serovar Typhi
agccuggucacc

SEQ ID NO: 3675185 - RNA, 23 nt, Salmonella enterica enterica serovar Typhi
agccuggugcccaaccugcgcag

SEQ ID NO: 3675186 - RNA, 18 nt, Salmonella enterica enterica serovar Typhi
agccugugcgccugcugc

SEQ ID NO: 3675187 - RNA, 16 nt, Salmonella enterica enterica serovar Typhi
agccuguuccagcugc

SEQ ID NO: 3675188 - RNA, 17 nt, Salmonella enterica enterica serovar Typhi
agccuguuccagcugcg

SEQ ID NO: 3675189 - RNA, 20 nt, Salmonella enterica enterica serovar Typhi
agccuguuccagcugcgaca

SEQ ID NO: 3675190 - RNA, 19 nt, Salmonella enterica enterica serovar Typhi
agccuguuuggacacggac

SEQ ID NO: 3675191 - RNA, 18 nt, Salmonella enterica enterica serovar Typhi
agccuuaaucaacugcgc

SEQ ID NO: 3675192 - RNA, 16 nt, Salmonella enterica enterica serovar Typhi
agccuuauaagaacca

SEQ ID NO: 3675193 - RNA, 22 nt, Salmonella enterica enterica serovar Typhi
agccuucccggggaacagaagc

SEQ ID NO: 3675194 - RNA, 18 nt, Salmonella enterica enterica serovar Typhi
agccuuccuggucugcca

SEQ ID NO: 3675195 - RNA, 17 nt, Salmonella enterica enterica serovar Typhi
agccuucgccuucacgc

SEQ ID NO: 3675196 - RNA, 23 nt, Salmonella enterica enterica serovar Typhi
agccuucgccuucacgcauucuu

SEQ ID NO: 3675197 - RNA, 19 nt, Salmonella enterica enterica serovar Typhi
agccuugauaccgccgcaa

SEQ ID NO: 3675198 - RNA, 12 nt, Salmonella enterica enterica serovar Typhi
agccuugcaucu

SEQ ID NO: 3675199 - RNA, 23 nt, Salmonella enterica enterica serovar Typhi
agccuuuccgcauggccgcuauc

SEQ ID NO: 3675200 - RNA, 15 nt, Salmonella enterica enterica serovar Typhi
agccuuuuucuuuca

SEQ ID NO: 3675201 - RNA, 19 nt, Salmonella enterica enterica serovar Typhi
agcgaaaugcgaauccggc

SEQ ID NO: 3675202 - RNA, 23 nt, Salmonella enterica enterica serovar Typhi
agcgaacaguacggucaggcuca

SEQ ID NO: 3675203 - RNA, 14 nt, Salmonella enterica enterica serovar Typhi
agcgaaccuuccau

SEQ ID NO: 3675204 - RNA, 19 nt, Salmonella enterica enterica serovar Typhi
agcgaacguccagcggcca

SEQ ID NO: 3675205 - RNA, 13 nt, Salmonella enterica enterica serovar Typhi
agcgaacugauaa

SEQ ID NO: 3675206 - RNA, 22 nt, Salmonella enterica enterica serovar Typhi
agcgaaggggcgggcagcagca

SEQ ID NO: 3675207 - RNA, 18 nt, Salmonella enterica enterica serovar Typhi
agcgaauaacauaauauu

SEQ ID NO: 3675208 - RNA, 19 nt, Salmonella enterica enterica serovar Typhi
agcgaauccagaucgcccu

SEQ ID NO: 3675209 - RNA, 15 nt, Salmonella enterica enterica serovar Typhi
agcgaauggcggcac

SEQ ID NO: 3675210 - RNA, 23 nt, Salmonella enterica enterica serovar Typhi
agcgaauguauuaacgcuuugcc

SEQ ID NO: 3675211 - RNA, 20 nt, Salmonella enterica enterica serovar Typhi
agcgaauuccggccaucaga

SEQ ID NO: 3675212 - RNA, 21 nt, Salmonella enterica enterica serovar Typhi
agcgacaccugaucuguaggc

SEQ ID NO: 3675213 - RNA, 18 nt, Salmonella enterica enterica serovar Typhi
agcgacaucgucacaaua

SEQ ID NO: 3675214 - RNA, 14 nt, Salmonella enterica enterica serovar Typhi
agcgacauggcggu

SEQ ID NO: 3675215 - RNA, 22 nt, Salmonella enterica enterica serovar Typhi
agcgaccacgccaccgccgcca

SEQ ID NO: 3675216 - RNA, 17 nt, Salmonella enterica enterica serovar Typhi
agcgaccggcgucauca

SEQ ID NO: 3675217 - RNA, 11 nt, Salmonella enterica enterica serovar Typhi
agcgacgcccu

SEQ ID NO: 3675218 - RNA, 15 nt, Salmonella enterica enterica serovar Typhi
agcgacggcgcgccg

SEQ ID NO: 3675219 - RNA, 22 nt, Salmonella enterica enterica serovar Typhi
agcgacgguuuuauccccuuca

SEQ ID NO: 3675220 - RNA, 23 nt, Salmonella enterica enterica serovar Typhi
agcgacucauucagcaacugcgu

SEQ ID NO: 3675221 - RNA, 12 nt, Salmonella enterica enterica serovar Typhi
agcgacugauaa

SEQ ID NO: 3675222 - RNA, 18 nt, Salmonella enterica enterica serovar Typhi
agcgacuuauccggccua

SEQ ID NO: 3675223 - RNA, 14 nt, Salmonella enterica enterica serovar Typhi
agcgagacgcugga

SEQ ID NO: 3675224 - RNA, 19 nt, Salmonella enterica enterica serovar Typhi
agcgagauaaccgggaaua

SEQ ID NO: 3675225 - RNA, 16 nt, Salmonella enterica enterica serovar Typhi
agcgagaugaaaaguc

SEQ ID NO: 3675226 - RNA, 19 nt, Salmonella enterica enterica serovar Typhi
agcgccggcagcaguucuu

SEQ ID NO: 3675227 - RNA, 16 nt, Salmonella enterica enterica serovar Typhi
agcgccgucauaccgc

SEQ ID NO: 3675228 - RNA, 19 nt, Salmonella enterica enterica serovar Typhi
agcgccgucauaccgccca

SEQ ID NO: 3675229 - RNA, 14 nt, Salmonella enterica enterica serovar Typhi
agcgccguccgaca

SEQ ID NO: 3675230 - RNA, 16 nt, Salmonella enterica enterica serovar Typhi
agcgccguuaaacugc

SEQ ID NO: 3675231 - RNA, 18 nt, Salmonella enterica enterica serovar Typhi
agcgccguuaacgcggcc

SEQ ID NO: 3675232 - RNA, 23 nt, Salmonella enterica enterica serovar Typhi
agcgccuccgcguagcccagcgc

SEQ ID NO: 3675233 - RNA, 19 nt, Salmonella enterica enterica serovar Typhi
agcgccucugauuuuucca

SEQ ID NO: 3675234 - RNA, 21 nt, Salmonella enterica enterica serovar Typhi
agcgccugaauguacgcauau

SEQ ID NO: 3675235 - RNA, 16 nt, Salmonella enterica enterica serovar Typhi
agcgccugcugcgcaa

SEQ ID NO: 3675236 - RNA, 22 nt, Salmonella enterica enterica serovar Typhi
agcgccuguaaacguuccugcc

SEQ ID NO: 3675237 - RNA, 19 nt, Salmonella enterica enterica serovar Typhi
agcgccugucgggccuaca

SEQ ID NO: 3675238 - RNA, 17 nt, Salmonella enterica enterica serovar Typhi
agcgccuguucaacaug

SEQ ID NO: 3675239 - RNA, 19 nt, Salmonella enterica enterica serovar Typhi
agcgccuucaggcaucaga

SEQ ID NO: 3675240 - RNA, 23 nt, Salmonella enterica enterica serovar Typhi
agcgccuucaggcaucagauaaa

SEQ ID NO: 3675241 - RNA, 13 nt, Salmonella enterica enterica serovar Typhi
agcgcgaaauuua

SEQ ID NO: 3675242 - RNA, 15 nt, Salmonella enterica enterica serovar Typhi
agcgcgaaucgccuc

SEQ ID NO: 3675243 - RNA, 14 nt, Salmonella enterica enterica serovar Typhi
agcgcgacauagag

SEQ ID NO: 3675244 - RNA, 23 nt, Salmonella enterica enterica serovar Typhi
agcgcgaccaggaaaccgguaaa

SEQ ID NO: 3675245 - RNA, 16 nt, Salmonella enterica enterica serovar Typhi
agcgcgauacgcagca

SEQ ID NO: 3675246 - RNA, 22 nt, Salmonella enterica enterica serovar Typhi
agcgcgaucgccccgaccagga

SEQ ID NO: 3675247 - RNA, 17 nt, Salmonella enterica enterica serovar Typhi
agcgcgccauccugagu

SEQ ID NO: 3675248 - RNA, 18 nt, Salmonella enterica enterica serovar Typhi
agcgcgcccgccaccagc

SEQ ID NO: 3675249 - RNA, 19 nt, Salmonella enterica enterica serovar Typhi
agcgcgcccgccaccagca

SEQ ID NO: 3675250 - RNA, 21 nt, Salmonella enterica enterica serovar Typhi
agcgcgccgcagcgccgacgu

SEQ ID NO: 3675251 - RNA, 19 nt, Salmonella enterica enterica serovar Typhi
agcgcgccgccgcccauaa

SEQ ID NO: 3675252 - RNA, 19 nt, Salmonella enterica enterica serovar Typhi
agcgcgcgacaugcgucuu

SEQ ID NO: 3675253 - RNA, 18 nt, Salmonella enterica enterica serovar Typhi
agcgcgcgacccagcgca

SEQ ID NO: 3675254 - RNA, 21 nt, Salmonella enterica enterica serovar Typhi
agcgcgcgacccagcgcauga

SEQ ID NO: 3675255 - RNA, 12 nt, Salmonella enterica enterica serovar Typhi
agcgcgcgcaca

SEQ ID NO: 3675256 - RNA, 23 nt, Salmonella enterica enterica serovar Typhi
agcgcgcgcuaauuuucagggug

SEQ ID NO: 3675257 - RNA, 19 nt, Salmonella enterica enterica serovar Typhi
agcgcgcggauauggcggc

SEQ ID NO: 3675258 - RNA, 16 nt, Salmonella enterica enterica serovar Typhi
agcgcgcuccagacca

SEQ ID NO: 3675259 - RNA, 16 nt, Salmonella enterica enterica serovar Typhi
agcgcgcucugccuuu

SEQ ID NO: 3675260 - RNA, 22 nt, Salmonella enterica enterica serovar Typhi
agcgcggagaacgguucaucca

SEQ ID NO: 3675261 - RNA, 13 nt, Salmonella enterica enterica serovar Typhi
agcgcggcaagga

SEQ ID NO: 3675262 - RNA, 16 nt, Salmonella enterica enterica serovar Typhi
agcgcggcagcagcuu

SEQ ID NO: 3675263 - RNA, 20 nt, Salmonella enterica enterica serovar Typhi
agcgcggcgcccauuccgcc

SEQ ID NO: 3675264 - RNA, 23 nt, Salmonella enterica enterica serovar Typhi
agcgcggcgcccauuccgccugc

SEQ ID NO: 3675265 - RNA, 16 nt, Salmonella enterica enterica serovar Typhi
agcgcgguggcgcaca

SEQ ID NO: 3675266 - RNA, 19 nt, Salmonella enterica enterica serovar Typhi
agcgcgguuucuauuaaau

SEQ ID NO: 3675267 - RNA, 21 nt, Salmonella enterica enterica serovar Typhi
agcgcguaaauaccuucuggc

SEQ ID NO: 3675268 - RNA, 13 nt, Salmonella enterica enterica serovar Typhi
agcgcgucaaugg

SEQ ID NO: 3675269 - RNA, 14 nt, Salmonella enterica enterica serovar Typhi
agcgcgucagcgcc

SEQ ID NO: 3675270 - RNA, 20 nt, Salmonella enterica enterica serovar Typhi
agcgcgucagcgccuccgcg

SEQ ID NO: 3675271 - RNA, 17 nt, Salmonella enterica enterica serovar Typhi
agcgcguccccgguaag

SEQ ID NO: 3675272 - RNA, 18 nt, Salmonella enterica enterica serovar Typhi
agcgcgucguucacgcca

SEQ ID NO: 3675273 - RNA, 20 nt, Salmonella enterica enterica serovar Typhi
agcgcgucguucacgccaaa

SEQ ID NO: 3675274 - RNA, 22 nt, Salmonella enterica enterica serovar Typhi
agcgcguguauuaaaggaucga

SEQ ID NO: 3675275 - RNA, 22 nt, Salmonella enterica enterica serovar Typhi
agcgcguucgccgucacgccga

SEQ ID NO: 3675276 - RNA, 15 nt, Salmonella enterica enterica serovar Typhi
agcgcuaacgcgaag

SEQ ID NO: 3675277 - RNA, 14 nt, Salmonella enterica enterica serovar Typhi
agcgcuaagcaaca

SEQ ID NO: 3675278 - RNA, 22 nt, Salmonella enterica enterica serovar Typhi
agcgcuacauccgccagccgcc

SEQ ID NO: 3675279 - RNA, 16 nt, Salmonella enterica enterica serovar Typhi
agcgcucaaucagcgc

SEQ ID NO: 3675280 - RNA, 18 nt, Salmonella enterica enterica serovar Typhi
agcgcucaaucagcgcuu

SEQ ID NO: 3675281 - RNA, 22 nt, Salmonella enterica enterica serovar Typhi
agcgcuccaccaaccaggcaaa

SEQ ID NO: 3675282 - RNA, 19 nt, Salmonella enterica enterica serovar Typhi
agcgcugaggcgcuggcuu

SEQ ID NO: 3675283 - RNA, 19 nt, Salmonella enterica enterica serovar Typhi
agcgcugagucauccuucc

SEQ ID NO: 3675284 - RNA, 13 nt, Salmonella enterica enterica serovar Typhi
agcgcugccgcaa

SEQ ID NO: 3675285 - RNA, 14 nt, Salmonella enterica enterica serovar Typhi
agcgcugccgcaac

SEQ ID NO: 3675286 - RNA, 19 nt, Salmonella enterica enterica serovar Typhi
agcgcuggagaaugggauu

SEQ ID NO: 3675287 - RNA, 20 nt, Salmonella enterica enterica serovar Typhi
agcgcuggcauuccccaucg

SEQ ID NO: 3675288 - RNA, 17 nt, Salmonella enterica enterica serovar Typhi
agcgcuggcuggcgaca

SEQ ID NO: 3675289 - RNA, 23 nt, Salmonella enterica enterica serovar Typhi
agcgcugugcuaucaggccuaca

SEQ ID NO: 3675290 - RNA, 23 nt, Salmonella enterica enterica serovar Typhi
agcgcuuaccacuuugcgcuccu

SEQ ID NO: 3675291 - RNA, 22 nt, Salmonella enterica enterica serovar Typhi
agcgcuuacccgaccgacaaaa

SEQ ID NO: 3675292 - RNA, 16 nt, Salmonella enterica enterica serovar Typhi
agcgcuucgccugccg

SEQ ID NO: 3675293 - RNA, 16 nt, Salmonella enterica enterica serovar Typhi
agcgcuucgcuugccc

SEQ ID NO: 3675294 - RNA, 19 nt, Salmonella enterica enterica serovar Typhi
agcgcuugauaaugucaac

SEQ ID NO: 3675295 - RNA, 23 nt, Salmonella enterica enterica serovar Typhi
agcgcuuuccagucccugaagaa

SEQ ID NO: 3675296 - RNA, 14 nt, Salmonella enterica enterica serovar Typhi
agcgcuuucuucuu

SEQ ID NO: 3675297 - RNA, 16 nt, Salmonella enterica enterica serovar Typhi
agcgcuuucuucuuca

SEQ ID NO: 3675298 - RNA, 16 nt, Salmonella enterica enterica serovar Typhi
agcgcuuugccgcugc

SEQ ID NO: 3675299 - RNA, 22 nt, Salmonella enterica enterica serovar Typhi
agcgcuuugccgcugcugccuu

SEQ ID NO: 3675300 - RNA, 15 nt, Salmonella enterica enterica serovar Typhi
agcggacacccgcag

SEQ ID NO: 3675301 - RNA, 20 nt, Salmonella enterica enterica serovar Typhi
agcggacacccgcagccaga

SEQ ID NO: 3675302 - RNA, 20 nt, Salmonella enterica enterica serovar Typhi
agcggaucgcguccauuacu

SEQ ID NO: 3675303 - RNA, 22 nt, Salmonella enterica enterica serovar Typhi
agcggaucgcguccauuacucu

SEQ ID NO: 3675304 - RNA, 17 nt, Salmonella enterica enterica serovar Typhi
agcggauggccugcuca

SEQ ID NO: 3675305 - RNA, 14 nt, Salmonella enterica enterica serovar Typhi
agcggauuaaaacg

SEQ ID NO: 3675306 - RNA, 12 nt, Salmonella enterica enterica serovar Typhi
agcggauucuuc

SEQ ID NO: 3675307 - RNA, 18 nt, Salmonella enterica enterica serovar Typhi
agcggauugccgcgcuca

SEQ ID NO: 3675308 - RNA, 14 nt, Salmonella enterica enterica serovar Typhi
agcggcaacagcac

SEQ ID NO: 3675309 - RNA, 22 nt, Salmonella enterica enterica serovar Typhi
agcggcagaucguuuacgaccu

SEQ ID NO: 3675310 - RNA, 13 nt, Salmonella enterica enterica serovar Typhi
agcggcagccaug

SEQ ID NO: 3675311 - RNA, 16 nt, Salmonella enterica enterica serovar Typhi
agcuaauccccagcgc

SEQ ID NO: 3675312 - RNA, 22 nt, Salmonella enterica enterica serovar Typhi
agcuaaugauuaucuuuuuuag

SEQ ID NO: 3675313 - RNA, 17 nt, Salmonella enterica enterica serovar Typhi
agcuacgaccggucagc

SEQ ID NO: 3675314 - RNA, 21 nt, Salmonella enterica enterica serovar Typhi
agcuacgaccggucagccggu

SEQ ID NO: 3675315 - RNA, 18 nt, Salmonella enterica enterica serovar Typhi
agcuacucaggagaucgg

SEQ ID NO: 3675316 - RNA, 14 nt, Salmonella enterica enterica serovar Typhi
agcuagccaauaau

SEQ ID NO: 3675317 - RNA, 22 nt, Salmonella enterica enterica serovar Typhi
agcuagccaauaaucgaaauaa

SEQ ID NO: 3675318 - RNA, 19 nt, Salmonella enterica enterica serovar Typhi
agcuauccacgcagacgcc

SEQ ID NO: 3675319 - RNA, 19 nt, Salmonella enterica enterica serovar Typhi
agcuauccaguuucugacg

SEQ ID NO: 3675320 - RNA, 18 nt, Salmonella enterica enterica serovar Typhi
agcuauguuuaagccaga

SEQ ID NO: 3675321 - RNA, 16 nt, Salmonella enterica enterica serovar Typhi
agcuauuccaaaauaa

SEQ ID NO: 3675322 - RNA, 22 nt, Salmonella enterica enterica serovar Typhi
agcuauuccuguauaauuauuu

SEQ ID NO: 3675323 - RNA, 17 nt, Salmonella enterica enterica serovar Typhi
agcucaaacguaaagca

SEQ ID NO: 3675324 - RNA, 15 nt, Salmonella enterica enterica serovar Typhi
agcucacgccaaaau

SEQ ID NO: 3675325 - RNA, 18 nt, Salmonella enterica enterica serovar Typhi
agcucagcuggauagagc

SEQ ID NO: 3675326 - RNA, 21 nt, Salmonella enterica enterica serovar Typhi
agcucaggguccccauauccc

SEQ ID NO: 3675327 - RNA, 22 nt, Salmonella enterica enterica serovar Typhi
agcucaggguccccauaucccg

SEQ ID NO: 3675328 - RNA, 19 nt, Salmonella enterica enterica serovar Typhi
agcucaguccagccgccgc

SEQ ID NO: 3675329 - RNA, 22 nt, Salmonella enterica enterica serovar Typhi
agcucaguugguagagcccugg

SEQ ID NO: 3675330 - RNA, 17 nt, Salmonella enterica enterica serovar Typhi
agcucauacccuuccag

SEQ ID NO: 3675331 - RNA, 21 nt, Salmonella enterica enterica serovar Typhi
agcucauguagucauauugcg

SEQ ID NO: 3675332 - RNA, 21 nt, Salmonella enterica enterica serovar Typhi
agcucauuuuuacagacacga

SEQ ID NO: 3675333 - RNA, 22 nt, Salmonella enterica enterica serovar Typhi
agcuccauagaaaucagcaggu

SEQ ID NO: 3675334 - RNA, 16 nt, Salmonella enterica enterica serovar Typhi
agcuccgcaaagccca

SEQ ID NO: 3675335 - RNA, 19 nt, Salmonella enterica enterica serovar Typhi
agcuccgcaaagcccauca

SEQ ID NO: 3675336 - RNA, 24 nt, Salmonella enterica enterica serovar Typhi
agcuccgcaaagcccaucagcgcc

SEQ ID NO: 3675337 - RNA, 21 nt, Salmonella enterica enterica serovar Typhi
agcuccuuucggacuuccugu

SEQ ID NO: 3675338 - RNA, 14 nt, Salmonella enterica enterica serovar Typhi
agcucgauccggca

SEQ ID NO: 3675339 - RNA, 20 nt, Salmonella enterica enterica serovar Typhi
agcucgcaggccauaaaacg

SEQ ID NO: 3675340 - RNA, 14 nt, Salmonella enterica enterica serovar Typhi
agcucgcccagcac

SEQ ID NO: 3675341 - RNA, 15 nt, Salmonella enterica enterica serovar Typhi
agcucgcccagcacu

SEQ ID NO: 3675342 - RNA, 22 nt, Salmonella enterica enterica serovar Typhi
agcucgccgaccggcgcgccgu

SEQ ID NO: 3675343 - RNA, 20 nt, Salmonella enterica enterica serovar Typhi
agcucggcuucgacauagcc

SEQ ID NO: 3675344 - RNA, 20 nt, Salmonella enterica enterica serovar Typhi
agcucgguucuucggcauaa

SEQ ID NO: 3675345 - RNA, 14 nt, Salmonella enterica enterica serovar Typhi
agcucguuauuucc

SEQ ID NO: 3675346 - RNA, 15 nt, Salmonella enterica enterica serovar Typhi
agcucguuauuuccg

SEQ ID NO: 3675347 - RNA, 15 nt, Salmonella enterica enterica serovar Typhi
agcucuccuggaugc

SEQ ID NO: 3675348 - RNA, 15 nt, Salmonella enterica enterica serovar Typhi
agcucugcgugacgc

SEQ ID NO: 3675349 - RNA, 19 nt, Salmonella enterica enterica serovar Typhi
agcucuggaaaaauuguuu

SEQ ID NO: 3675350 - RNA, 22 nt, Salmonella enterica enterica serovar Typhi
agcucugguugcagcgccagag

SEQ ID NO: 3675351 - RNA, 22 nt, Salmonella enterica enterica serovar Typhi
agcucuucuucgcucucgccgc

SEQ ID NO: 3675352 - RNA, 10 nt, Salmonella enterica enterica serovar Typhi
agcucuuuca

SEQ ID NO: 3675353 - RNA, 19 nt, Salmonella enterica enterica serovar Typhi
agcucuuucauuucugccu

SEQ ID NO: 3675354 - RNA, 21 nt, Salmonella enterica enterica serovar Typhi
agcucuuucauuucugccugc

SEQ ID NO: 3675355 - RNA, 18 nt, Salmonella enterica enterica serovar Typhi
agcugaaugcuucgccac

SEQ ID NO: 3675356 - RNA, 18 nt, Salmonella enterica enterica serovar Typhi
agcugacaaugugccgga

SEQ ID NO: 3675357 - RNA, 19 nt, Salmonella enterica enterica serovar Typhi
agcugacgacgccagcccu

SEQ ID NO: 3675358 - RNA, 21 nt, Salmonella enterica enterica serovar Typhi
agcugacugcaaaucugccgu

SEQ ID NO: 3675359 - RNA, 14 nt, Salmonella enterica enterica serovar Typhi
agcugagcgucagg

SEQ ID NO: 3675360 - RNA, 16 nt, Salmonella enterica enterica serovar Typhi
agcugagcuaaucacc

SEQ ID NO: 3675361 - RNA, 17 nt, Salmonella enterica enterica serovar Typhi
agcugagcuaaucaccc

SEQ ID NO: 3675362 - RNA, 20 nt, Salmonella enterica enterica serovar Typhi
agcugauaagcuaguaaaga

SEQ ID NO: 3675363 - RNA, 20 nt, Salmonella enterica enterica serovar Typhi
agcugauauuuuacuuuuug

SEQ ID NO: 3675364 - RNA, 18 nt, Salmonella enterica enterica serovar Typhi
agcugaugauuggccucc

SEQ ID NO: 3675365 - RNA, 18 nt, Salmonella enterica enterica serovar Typhi
agcugauugauuuuguaa

SEQ ID NO: 3675366 - RNA, 13 nt, Salmonella enterica enterica serovar Typhi
agcugauuuuucg

SEQ ID NO: 3675367 - RNA, 16 nt, Salmonella enterica enterica serovar Typhi
agcugcaccaggagca

SEQ ID NO: 3675368 - RNA, 17 nt, Salmonella enterica enterica serovar Typhi
agcugcaguuauuuuuu

SEQ ID NO: 3675369 - RNA, 18 nt, Salmonella enterica enterica serovar Typhi
agcugccacaccacaugc

SEQ ID NO: 3675370 - RNA, 21 nt, Salmonella enterica enterica serovar Typhi
agcugcccggauaaccgcccg

SEQ ID NO: 3675371 - RNA, 18 nt, Salmonella enterica enterica serovar Typhi
agcugccguuggcgagcc

SEQ ID NO: 3675372 - RNA, 16 nt, Salmonella enterica enterica serovar Typhi
agcugcgaucaaguuu

SEQ ID NO: 3675373 - RNA, 12 nt, Salmonella enterica enterica serovar Typhi
agcugcgucagc

SEQ ID NO: 3675374 - RNA, 20 nt, Salmonella enterica enterica serovar Typhi
agcugcgucagcgcuugccg

SEQ ID NO: 3675375 - RNA, 18 nt, Salmonella enterica enterica serovar Typhi
agcuggaccgcagcuuau

SEQ ID NO: 3675376 - RNA, 14 nt, Salmonella enterica enterica serovar Typhi
agcuggagcaggaa

SEQ ID NO: 3675377 - RNA, 17 nt, Salmonella enterica enterica serovar Typhi
agcuggcauaaccgcag

SEQ ID NO: 3675378 - RNA, 19 nt, Salmonella enterica enterica serovar Typhi
agcuggccggaucggcggu

SEQ ID NO: 3675379 - RNA, 22 nt, Salmonella enterica enterica serovar Typhi
agcuggcggucgggaacgcugu

SEQ ID NO: 3675380 - RNA, 21 nt, Salmonella enterica enterica serovar Typhi
agcuggcuugccagcagauuu

SEQ ID NO: 3675381 - RNA, 19 nt, Salmonella enterica enterica serovar Typhi
agcugggcgucaacgugaa

SEQ ID NO: 3675382 - RNA, 18 nt, Salmonella enterica enterica serovar Typhi
agcugguauaggccaggc

SEQ ID NO: 3675383 - RNA, 22 nt, Salmonella enterica enterica serovar Typhi
agcugguugagauccauaagau

SEQ ID NO: 3675384 - RNA, 21 nt, Salmonella enterica enterica serovar Typhi
agcugguugauauugugcaua

SEQ ID NO: 3675385 - RNA, 13 nt, Salmonella enterica enterica serovar Typhi
agcuguaacacug

SEQ ID NO: 3675386 - RNA, 23 nt, Salmonella enterica enterica serovar Typhi
agcuguaccaucaccugaugucc

SEQ ID NO: 3675387 - RNA, 22 nt, Salmonella enterica enterica serovar Typhi
agcuguacuuugccggggaggg

SEQ ID NO: 3675388 - RNA, 13 nt, Salmonella enterica enterica serovar Typhi
agcuguagcauaa

SEQ ID NO: 3675389 - RNA, 22 nt, Salmonella enterica enterica serovar Typhi
agcugugauugcgacaggcugc

SEQ ID NO: 3675390 - RNA, 16 nt, Salmonella enterica enterica serovar Typhi
agcuguuuugucggcc

SEQ ID NO: 3675391 - RNA, 17 nt, Salmonella enterica enterica serovar Typhi
agcuuaaaaaauccugc

SEQ ID NO: 3675392 - RNA, 18 nt, Salmonella enterica enterica serovar Typhi
agcuuaaaaaauccugca

SEQ ID NO: 3675393 - RNA, 18 nt, Salmonella enterica enterica serovar Typhi
agcuuaaucaccagcgca

SEQ ID NO: 3675394 - RNA, 22 nt, Salmonella enterica enterica serovar Typhi
agcuuaaugauaauuguuaauu

SEQ ID NO: 3675395 - RNA, 16 nt, Salmonella enterica enterica serovar Typhi
agcuuaauuuuauagc

SEQ ID NO: 3675396 - RNA, 21 nt, Salmonella enterica enterica serovar Typhi
aggauauuuauuugguuucua

SEQ ID NO: 3675397 - RNA, 23 nt, Salmonella enterica enterica serovar Typhi
aggaucaaaaucgcgccccacgg

SEQ ID NO: 3675398 - RNA, 14 nt, Salmonella enterica enterica serovar Typhi
aggaugaacucuau

SEQ ID NO: 3675399 - RNA, 18 nt, Salmonella enterica enterica serovar Typhi
aggaugccacuguucaga

SEQ ID NO: 3675400 - RNA, 17 nt, Salmonella enterica enterica serovar Typhi
aggaugcgcugcgcgcg

SEQ ID NO: 3675401 - RNA, 18 nt, Salmonella enterica enterica serovar Typhi
aggauuagacuucuucca

SEQ ID NO: 3675402 - RNA, 13 nt, Salmonella enterica enterica serovar Typhi
aggauugcuguga

SEQ ID NO: 3675403 - RNA, 18 nt, Salmonella enterica enterica serovar Typhi
aggauuugucucaucuga

SEQ ID NO: 3675404 - RNA, 20 nt, Salmonella enterica enterica serovar Typhi
aggcaaaaaucgucaucaga

SEQ ID NO: 3675405 - RNA, 17 nt, Salmonella enterica enterica serovar Typhi
aggcaaaaugccagccc

SEQ ID NO: 3675406 - RNA, 20 nt, Salmonella enterica enterica serovar Typhi
aggcaaacaccucagccacc

SEQ ID NO: 3675407 - RNA, 14 nt, Salmonella enterica enterica serovar Typhi
aggcaaaccagcac

SEQ ID NO: 3675408 - RNA, 15 nt, Salmonella enterica enterica serovar Typhi
aggcaaaccagcacc

SEQ ID NO: 3675409 - RNA, 14 nt, Salmonella enterica enterica serovar Typhi
aggcaaagccccag

SEQ ID NO: 3675410 - RNA, 23 nt, Salmonella enterica enterica serovar Typhi
aggcaaaucaacauuauuaaaau

SEQ ID NO: 3675411 - RNA, 22 nt, Salmonella enterica enterica serovar Typhi
aggcaaauucuguugccggaaa

SEQ ID NO: 3675412 - RNA, 17 nt, Salmonella enterica enterica serovar Typhi
aggcaacgacccgaagg

SEQ ID NO: 3675413 - RNA, 17 nt, Salmonella enterica enterica serovar Typhi
aggcaacggcccgaagg

SEQ ID NO: 3675414 - RNA, 17 nt, Salmonella enterica enterica serovar Typhi
aggcaacugauccugcg

SEQ ID NO: 3675415 - RNA, 19 nt, Salmonella enterica enterica serovar Typhi
aggcaagcugguaaaugcg

SEQ ID NO: 3675416 - RNA, 15 nt, Salmonella enterica enterica serovar Typhi
aggcaaguucuuguu

SEQ ID NO: 3675417 - RNA, 19 nt, Salmonella enterica enterica serovar Typhi
aggcaauaaaaaaggcaga

SEQ ID NO: 3675418 - RNA, 18 nt, Salmonella enterica enterica serovar Typhi
aggcaauaugucuuaaac

SEQ ID NO: 3675419 - RNA, 16 nt, Salmonella enterica enterica serovar Typhi
aggcaaucgcuuccag

SEQ ID NO: 3675420 - RNA, 21 nt, Salmonella enterica enterica serovar Typhi
aggcaccuguaaccuuaaaag

SEQ ID NO: 3675421 - RNA, 16 nt, Salmonella enterica enterica serovar Typhi
aggcagcaaugugcgc

SEQ ID NO: 3675422 - RNA, 14 nt, Salmonella enterica enterica serovar Typhi
aggcagcacaauca

SEQ ID NO: 3675423 - RNA, 19 nt, Salmonella enterica enterica serovar Typhi
aggcagcacaaucagcgcg

SEQ ID NO: 3675424 - RNA, 19 nt, Salmonella enterica enterica serovar Typhi
aggcagcaccucaauauga

SEQ ID NO: 3675425 - RNA, 23 nt, Salmonella enterica enterica serovar Typhi
aggcagccacaaugggggcauaa

SEQ ID NO: 3675426 - RNA, 22 nt, Salmonella enterica enterica serovar Typhi
aggcagccggauuuuaaauugg

SEQ ID NO: 3675427 - RNA, 15 nt, Salmonella enterica enterica serovar Typhi
aggcaggaaauccag

SEQ ID NO: 3675428 - RNA, 17 nt, Salmonella enterica enterica serovar Typhi
aggcaggaaauccagca

SEQ ID NO: 3675429 - RNA, 11 nt, Salmonella enterica enterica serovar Typhi
aggcaguuugc

SEQ ID NO: 3675430 - RNA, 13 nt, Salmonella enterica enterica serovar Typhi
aggcauaaaaaaa

SEQ ID NO: 3675431 - RNA, 16 nt, Salmonella enterica enterica serovar Typhi
aggcauaaaaaagagg

SEQ ID NO: 3675432 - RNA, 22 nt, Salmonella enterica enterica serovar Typhi
aggcauacagaugccguccauc

SEQ ID NO: 3675433 - RNA, 14 nt, Salmonella enterica enterica serovar Typhi
aggcauagaaaaag

SEQ ID NO: 3675434 - RNA, 14 nt, Salmonella enterica enterica serovar Typhi
aggcaucagauaaa

SEQ ID NO: 3675435 - RNA, 23 nt, Salmonella enterica enterica serovar Typhi
aggcaucccguuuucgucccagc

SEQ ID NO: 3675436 - RNA, 23 nt, Salmonella enterica enterica serovar Typhi
aggcauccgugaccugcugacua

SEQ ID NO: 3675437 - RNA, 22 nt, Salmonella enterica enterica serovar Typhi
aggcaucgacgccagcggguga

SEQ ID NO: 3675438 - RNA, 14 nt, Salmonella enterica enterica serovar Typhi
aggcaucugaaaug

SEQ ID NO: 3675439 - RNA, 14 nt, Salmonella enterica enterica serovar Typhi
aggcaucugcgcaa

SEQ ID NO: 3675440 - RNA, 19 nt, Salmonella enterica enterica serovar Typhi
aggcaucugcgcaacugga

SEQ ID NO: 3675441 - RNA, 16 nt, Salmonella enterica enterica serovar Typhi
aggcaugaugccacga

SEQ ID NO: 3675442 - RNA, 16 nt, Salmonella enterica enterica serovar Typhi
aggcaugcacuccaau

SEQ ID NO: 3675443 - RNA, 20 nt, Salmonella enterica enterica serovar Typhi
aggcaugccaaaccagacuc

SEQ ID NO: 3675444 - RNA, 15 nt, Salmonella enterica enterica serovar Typhi
aggcauggcagcagg

SEQ ID NO: 3675445 - RNA, 16 nt, Salmonella enterica enterica serovar Typhi
aggcauggcagcaggg

SEQ ID NO: 3675446 - RNA, 15 nt, Salmonella enterica enterica serovar Typhi
aggcauggccuucaa

SEQ ID NO: 3675447 - RNA, 21 nt, Salmonella enterica enterica serovar Typhi
aggcauguugcgcaaucacgc

SEQ ID NO: 3675448 - RNA, 14 nt, Salmonella enterica enterica serovar Typhi
aggcauuaaaaaaa

SEQ ID NO: 3675449 - RNA, 15 nt, Salmonella enterica enterica serovar Typhi
aggcauuaaaaaaac

SEQ ID NO: 3675450 - RNA, 20 nt, Salmonella enterica enterica serovar Typhi
aggcauugauaaagcgcuca

SEQ ID NO: 3675451 - RNA, 18 nt, Salmonella enterica enterica serovar Typhi
aggcauuucaaucgccac

SEQ ID NO: 3675452 - RNA, 12 nt, Salmonella enterica enterica serovar Typhi
aggccaaacccu

SEQ ID NO: 3675453 - RNA, 18 nt, Salmonella enterica enterica serovar Typhi
aggccaaauagaacgcuc

SEQ ID NO: 3675454 - RNA, 22 nt, Salmonella enterica enterica serovar Typhi
aggccaacauagcggcaaggaa

SEQ ID NO: 3675455 - RNA, 17 nt, Salmonella enterica enterica serovar Typhi
aggccaauuccgccaua

SEQ ID NO: 3675456 - RNA, 23 nt, Salmonella enterica enterica serovar Typhi
aggccacgauauagucgcccauc

SEQ ID NO: 3675457 - RNA, 15 nt, Salmonella enterica enterica serovar Typhi
aggccacgcagcgca

SEQ ID NO: 3675458 - RNA, 21 nt, Salmonella enterica enterica serovar Typhi
aggccacgcagcgcagaccga

SEQ ID NO: 3675459 - RNA, 15 nt, Salmonella enterica enterica serovar Typhi
aggccacugcccugg

SEQ ID NO: 3675460 - RNA, 16 nt, Salmonella enterica enterica serovar Typhi
aggccacugcccugga

SEQ ID NO: 3675461 - RNA, 13 nt, Salmonella enterica enterica serovar Typhi
aggccacuucaca

SEQ ID NO: 3675462 - RNA, 16 nt, Salmonella enterica enterica serovar Typhi
aggccagauucaccac

SEQ ID NO: 3675463 - RNA, 12 nt, Salmonella enterica enterica serovar Typhi
aggccagcagca

SEQ ID NO: 3675464 - RNA, 20 nt, Salmonella enterica enterica serovar Typhi
aggccagcuacaccugggcu

SEQ ID NO: 3675465 - RNA, 16 nt, Salmonella enterica enterica serovar Typhi
aggccagugccaagca

SEQ ID NO: 3675466 - RNA, 15 nt, Salmonella enterica enterica serovar Typhi
aggccaucauaccgc

SEQ ID NO: 3675467 - RNA, 13 nt, Salmonella enterica enterica serovar Typhi
aggcccagccgcu

SEQ ID NO: 3675468 - RNA, 20 nt, Salmonella enterica enterica serovar Typhi
aggcccggcaaggaaggaaa

SEQ ID NO: 3675469 - RNA, 16 nt, Salmonella enterica enterica serovar Typhi
aggccgcaaacagcac

SEQ ID NO: 3675470 - RNA, 18 nt, Salmonella enterica enterica serovar Typhi
aggccgccaccgccucgc

SEQ ID NO: 3675471 - RNA, 17 nt, Salmonella enterica enterica serovar Typhi
aggccgccgcacaggcg

SEQ ID NO: 3675472 - RNA, 18 nt, Salmonella enterica enterica serovar Typhi
aggccgccgcacaggcga

SEQ ID NO: 3675473 - RNA, 20 nt, Salmonella enterica enterica serovar Typhi
aggccgcgauacccgcgauc

SEQ ID NO: 3675474 - RNA, 13 nt, Salmonella enterica enterica serovar Typhi
aggccgcggcugu

SEQ ID NO: 3675475 - RNA, 18 nt, Salmonella enterica enterica serovar Typhi
aggccggauaagcaacgc

SEQ ID NO: 3675476 - RNA, 15 nt, Salmonella enterica enterica serovar Typhi
aggccggauaagccg

SEQ ID NO: 3675477 - RNA, 23 nt, Salmonella enterica enterica serovar Typhi
aggccggauaagcggcagcgcca

SEQ ID NO: 3675478 - RNA, 18 nt, Salmonella enterica enterica serovar Typhi
aggccggauaaggcgcag

SEQ ID NO: 3675479 - RNA, 18 nt, Salmonella enterica enterica serovar Typhi
aggccggauaaggcgcuu

SEQ ID NO: 3675480 - RNA, 16 nt, Salmonella enterica enterica serovar Typhi
aggccggcauaaugau

SEQ ID NO: 3675481 - RNA, 23 nt, Salmonella enterica enterica serovar Typhi
aggccggguaggacauagccgcc

SEQ ID NO: 3675482 - RNA, 21 nt, Salmonella enterica enterica serovar Typhi
aggcucgcauucgcgagccuu

SEQ ID NO: 3675483 - RNA, 19 nt, Salmonella enterica enterica serovar Typhi
aggcucuccgguugcugau

SEQ ID NO: 3675484 - RNA, 12 nt, Salmonella enterica enterica serovar Typhi
aggcugaagcgc

SEQ ID NO: 3675485 - RNA, 19 nt, Salmonella enterica enterica serovar Typhi
aggcugacgaagaacuuag

SEQ ID NO: 3675486 - RNA, 21 nt, Salmonella enterica enterica serovar Typhi
aggcugacgaagaacuuagga

SEQ ID NO: 3675487 - RNA, 21 nt, Salmonella enterica enterica serovar Typhi
aggcugagcguagaccgccca

SEQ ID NO: 3675488 - RNA, 23 nt, Salmonella enterica enterica serovar Typhi
aggcugccgacaacgccuccugc

SEQ ID NO: 3675489 - RNA, 13 nt, Salmonella enterica enterica serovar Typhi
aggcugcggauga

SEQ ID NO: 3675490 - RNA, 11 nt, Salmonella enterica enterica serovar Typhi
aggcuggaaca

SEQ ID NO: 3675491 - RNA, 17 nt, Salmonella enterica enterica serovar Typhi
aggcuggagagcaacgc

SEQ ID NO: 3675492 - RNA, 20 nt, Salmonella enterica enterica serovar Typhi
aggcuggcgguaacaggcac

SEQ ID NO: 3675493 - RNA, 22 nt, Salmonella enterica enterica serovar Typhi
aggcuggguugauaccggagga

SEQ ID NO: 3675494 - RNA, 20 nt, Salmonella enterica enterica serovar Typhi
aggcuucaucggauagauga

SEQ ID NO: 3675495 - RNA, 15 nt, Salmonella enterica enterica serovar Typhi
aggcuuccacgcacg

SEQ ID NO: 3675496 - RNA, 23 nt, Salmonella enterica enterica serovar Typhi
aggcuucgacaaacagcuaucca

SEQ ID NO: 3675497 - RNA, 13 nt, Salmonella enterica enterica serovar Typhi
aggcuugcaggau

SEQ ID NO: 3675498 - RNA, 23 nt, Salmonella enterica enterica serovar Typhi
aggcuuggcagccccugaaauaa

SEQ ID NO: 3675499 - RNA, 15 nt, Salmonella enterica enterica serovar Typhi
aggcuuugcgccauc

SEQ ID NO: 3675500 - RNA, 16 nt, Salmonella enterica enterica serovar Typhi
aggcuuuucaggcugu

SEQ ID NO: 3675501 - RNA, 14 nt, Salmonella enterica enterica serovar Typhi
aggcuuuugauuca

SEQ ID NO: 3675502 - RNA, 17 nt, Salmonella enterica enterica serovar Typhi
agggaaaagccauugcc

SEQ ID NO: 3675503 - RNA, 13 nt, Salmonella enterica enterica serovar Typhi
agggaauaugauu

SEQ ID NO: 3675504 - RNA, 20 nt, Salmonella enterica enterica serovar Typhi
agggacacauuucuuuugau

SEQ ID NO: 3675505 - RNA, 19 nt, Salmonella enterica enterica serovar Typhi
agggacuauaggcaaugau

SEQ ID NO: 3675506 - RNA, 16 nt, Salmonella enterica enterica serovar Typhi
agggagaacucaucuc

SEQ ID NO: 3675507 - RNA, 12 nt, Salmonella enterica enterica serovar Typhi
agggagggccaa

SEQ ID NO: 3675508 - RNA, 21 nt, Salmonella enterica enterica serovar Typhi
agggaggugcucucccagcug

SEQ ID NO: 3675509 - RNA, 23 nt, Salmonella enterica enterica serovar Typhi
agggaggugcucucccagcugag

SEQ ID NO: 3675510 - RNA, 23 nt, Salmonella enterica enterica serovar Typhi
agggaguaugcggucaaaagcug

SEQ ID NO: 3675511 - RNA, 16 nt, Salmonella enterica enterica serovar Typhi
agggagugagucccca

SEQ ID NO: 3675512 - RNA, 21 nt, Salmonella enterica enterica serovar Typhi
agggauaagaaagauaaaaua

SEQ ID NO: 3675513 - RNA, 16 nt, Salmonella enterica enterica serovar Typhi
agggaucaucuucacu

SEQ ID NO: 3675514 - RNA, 13 nt, Salmonella enterica enterica serovar Typhi
agggaugacagaa

SEQ ID NO: 3675515 - RNA, 16 nt, Salmonella enterica enterica serovar Typhi
agggaugacagaaagc

SEQ ID NO: 3675516 - RNA, 13 nt, Salmonella enterica enterica serovar Typhi
agggauuuugcuu

SEQ ID NO: 3675517 - RNA, 21 nt, Salmonella enterica enterica serovar Typhi
agggauuuugcuuuuucggca

SEQ ID NO: 3675518 - RNA, 21 nt, Salmonella enterica enterica serovar Typhi
agggcaaaguuaucccugcug

SEQ ID NO: 3675519 - RNA, 16 nt, Salmonella enterica enterica serovar Typhi
agggcaacaaacauaa

SEQ ID NO: 3675520 - RNA, 13 nt, Salmonella enterica enterica serovar Typhi
agggcagcgagca

SEQ ID NO: 3675521 - RNA, 13 nt, Salmonella enterica enterica serovar Typhi
agggcaggggaaa

SEQ ID NO: 3675522 - RNA, 23 nt, Salmonella enterica enterica serovar Typhi
agggcaugauuacagauauccac

SEQ ID NO: 3675523 - RNA, 18 nt, Salmonella enterica enterica serovar Typhi
agggcauuuuuuccagua

SEQ ID NO: 3675524 - RNA, 17 nt, Salmonella enterica enterica serovar Typhi
agggccgauaccggcaa

SEQ ID NO: 3675525 - RNA, 21 nt, Salmonella enterica enterica serovar Typhi
agggccgcaaacgguucgcgg

SEQ ID NO: 3675526 - RNA, 14 nt, Salmonella enterica enterica serovar Typhi
agggcgagcguagc

SEQ ID NO: 3675527 - RNA, 19 nt, Salmonella enterica enterica serovar Typhi
agggcgaggcccaugaaug

SEQ ID NO: 3675528 - RNA, 17 nt, Salmonella enterica enterica serovar Typhi
agggcgaugccucaccc

SEQ ID NO: 3675529 - RNA, 18 nt, Salmonella enterica enterica serovar Typhi
agggcgaugccucacccc

SEQ ID NO: 3675530 - RNA, 22 nt, Salmonella enterica enterica serovar Typhi
agggcggaagcagauaccagcc

SEQ ID NO: 3675531 - RNA, 13 nt, Salmonella enterica enterica serovar Typhi
agggcggcuggau

SEQ ID NO: 3675532 - RNA, 16 nt, Salmonella enterica enterica serovar Typhi
agggcgugaaccagca

SEQ ID NO: 3675533 - RNA, 16 nt, Salmonella enterica enterica serovar Typhi
agggcgugacgcgcca

SEQ ID NO: 3675534 - RNA, 17 nt, Salmonella enterica enterica serovar Typhi
agggcuggaaaaucacg

SEQ ID NO: 3675535 - RNA, 15 nt, Salmonella enterica enterica serovar Typhi
aggggcuccugcgcc

SEQ ID NO: 3675536 - RNA, 13 nt, Salmonella enterica enterica serovar Typhi
agggguauuuauc

SEQ ID NO: 3675537 - RNA, 16 nt, Salmonella enterica enterica serovar Typhi
agggguguuacgccau

SEQ ID NO: 3675538 - RNA, 17 nt, Salmonella enterica enterica serovar Typhi
agggguugaugccgacc

SEQ ID NO: 3675539 - RNA, 22 nt, Salmonella enterica enterica serovar Typhi
agggguuuucgccagcaacgcc

SEQ ID NO: 3675540 - RNA, 18 nt, Salmonella enterica enterica serovar Typhi
aggguaacaucgcccgca

SEQ ID NO: 3675541 - RNA, 13 nt, Salmonella enterica enterica serovar Typhi
aggguagaaaaag

SEQ ID NO: 3675542 - RNA, 20 nt, Salmonella enterica enterica serovar Typhi
agggucgccgcgcccagcag

SEQ ID NO: 3675543 - RNA, 22 nt, Salmonella enterica enterica serovar Typhi
agggucgccgcgcccagcagca

SEQ ID NO: 3675544 - RNA, 16 nt, Salmonella enterica enterica serovar Typhi
agggugaauaccagcg

SEQ ID NO: 3675545 - RNA, 18 nt, Salmonella enterica enterica serovar Typhi
agggugcaaagaaacguu

SEQ ID NO: 3675546 - RNA, 17 nt, Salmonella enterica enterica serovar Typhi
agggugcagcaaauaau

SEQ ID NO: 3675547 - RNA, 19 nt, Salmonella enterica enterica serovar Typhi
aggguuaugauuucaggca

SEQ ID NO: 3675548 - RNA, 13 nt, Salmonella enterica enterica serovar Typhi
aggguugccagag

SEQ ID NO: 3675549 - RNA, 17 nt, Salmonella enterica enterica serovar Typhi
aggguugccagaggcag

SEQ ID NO: 3675550 - RNA, 23 nt, Salmonella enterica enterica serovar Typhi
aggguuuucaauuccacaggcgc

SEQ ID NO: 3675551 - RNA, 22 nt, Salmonella enterica enterica serovar Typhi
agguaaagaucggcuuauaaaa

SEQ ID NO: 3675552 - RNA, 23 nt, Salmonella enterica enterica serovar Typhi
agguaaagccgccauccggcauu

SEQ ID NO: 3675553 - RNA, 20 nt, Salmonella enterica enterica serovar Typhi
agguaaaggucguuaggcca

SEQ ID NO: 3675554 - RNA, 22 nt, Salmonella enterica enterica serovar Typhi
agguaacugcacaagccccacg

SEQ ID NO: 3675555 - RNA, 16 nt, Salmonella enterica enterica serovar Typhi
agguacagaugcugua

SEQ ID NO: 3675556 - RNA, 22 nt, Salmonella enterica enterica serovar Typhi
agguacggggcaucuauuuaac

SEQ ID NO: 3675557 - RNA, 21 nt, Salmonella enterica enterica serovar Typhi
agguacuuucccccagauugu

SEQ ID NO: 3675558 - RNA, 17 nt, Salmonella enterica enterica serovar Typhi
agguagcagaccgguac

SEQ ID NO: 3675559 - RNA, 17 nt, Salmonella enterica enterica serovar Typhi
agguauaggaaaaugau

SEQ ID NO: 3675560 - RNA, 18 nt, Salmonella enterica enterica serovar Typhi
agguaucauaugugccga

SEQ ID NO: 3675561 - RNA, 13 nt, Salmonella enterica enterica serovar Typhi
agguauccagcag

SEQ ID NO: 3675562 - RNA, 14 nt, Salmonella enterica enterica serovar Typhi
agguauccgccaua

SEQ ID NO: 3675563 - RNA, 18 nt, Salmonella enterica enterica serovar Typhi
agguauccgccauauccc

SEQ ID NO: 3675564 - RNA, 16 nt, Salmonella enterica enterica serovar Typhi
agguauccuaaugcca

SEQ ID NO: 3675565 - RNA, 16 nt, Salmonella enterica enterica serovar Typhi
agguauccuccugcca

SEQ ID NO: 3675566 - RNA, 14 nt, Salmonella enterica enterica serovar Typhi
agguaugcuucagc

SEQ ID NO: 3675567 - RNA, 21 nt, Salmonella enterica enterica serovar Typhi
aguaccgaacagccaggcuuu

SEQ ID NO: 3675568 - RNA, 17 nt, Salmonella enterica enterica serovar Typhi
aguaccgccgccgggcc

SEQ ID NO: 3675569 - RNA, 14 nt, Salmonella enterica enterica serovar Typhi
aguaccuccggauu

SEQ ID NO: 3675570 - RNA, 11 nt, Salmonella enterica enterica serovar Typhi
aguaccugaug

SEQ ID NO: 3675571 - RNA, 22 nt, Salmonella enterica enterica serovar Typhi
aguacgauagcaauuaauaaac

SEQ ID NO: 3675572 - RNA, 23 nt, Salmonella enterica enterica serovar Typhi
aguacgauagcaauuaauaaaca

SEQ ID NO: 3675573 - RNA, 22 nt, Salmonella enterica enterica serovar Typhi
aguacgcaccagcccagguuac

SEQ ID NO: 3675574 - RNA, 22 nt, Salmonella enterica enterica serovar Typhi
aguacgcccgugacgccaggca

SEQ ID NO: 3675575 - RNA, 15 nt, Salmonella enterica enterica serovar Typhi
aguacgcgaccgccg

SEQ ID NO: 3675576 - RNA, 19 nt, Salmonella enterica enterica serovar Typhi
aguacggcgcgccaauaaa

SEQ ID NO: 3675577 - RNA, 17 nt, Salmonella enterica enterica serovar Typhi
aguacuauuuucgccga

SEQ ID NO: 3675578 - RNA, 16 nt, Salmonella enterica enterica serovar Typhi
aguacuggaauaucua

SEQ ID NO: 3675579 - RNA, 16 nt, Salmonella enterica enterica serovar Typhi
aguacuucacaaucag

SEQ ID NO: 3675580 - RNA, 16 nt, Salmonella enterica enterica serovar Typhi
aguacuuucuuuugau

SEQ ID NO: 3675581 - RNA, 19 nt, Salmonella enterica enterica serovar Typhi
aguagacgguaacggcugg

SEQ ID NO: 3675582 - RNA, 18 nt, Salmonella enterica enterica serovar Typhi
aguagaugucaucaacau

SEQ ID NO: 3675583 - RNA, 14 nt, Salmonella enterica enterica serovar Typhi
aguagcagagaaaa

SEQ ID NO: 3675584 - RNA, 17 nt, Salmonella enterica enterica serovar Typhi
aguagccaugcauaaug

SEQ ID NO: 3675585 - RNA, 15 nt, Salmonella enterica enterica serovar Typhi
aguagcguucuuucc

SEQ ID NO: 3675586 - RNA, 18 nt, Salmonella enterica enterica serovar Typhi
aguagcguucuuuccagu

SEQ ID NO: 3675587 - RNA, 20 nt, Salmonella enterica enterica serovar Typhi
aguagcguucuuuccaguuc

SEQ ID NO: 3675588 - RNA, 14 nt, Salmonella enterica enterica serovar Typhi
aguagcuaaugauu

SEQ ID NO: 3675589 - RNA, 17 nt, Salmonella enterica enterica serovar Typhi
aguagcuaaugauuauc

SEQ ID NO: 3675590 - RNA, 15 nt, Salmonella enterica enterica serovar Typhi
aguagguauccagca

SEQ ID NO: 3675591 - RNA, 16 nt, Salmonella enterica enterica serovar Typhi
aguagguauccagcag

SEQ ID NO: 3675592 - RNA, 22 nt, Salmonella enterica enterica serovar Typhi
aguaguauccccggcaaccuua

SEQ ID NO: 3675593 - RNA, 13 nt, Salmonella enterica enterica serovar Typhi
aguaguuaaaaaa

SEQ ID NO: 3675594 - RNA, 21 nt, Salmonella enterica enterica serovar Typhi
aguaguuguuauagcgcgccc

SEQ ID NO: 3675595 - RNA, 12 nt, Salmonella enterica enterica serovar Typhi
aguauaaaacuc

SEQ ID NO: 3675596 - RNA, 14 nt, Salmonella enterica enterica serovar Typhi
aguauaaauaccuu

SEQ ID NO: 3675597 - RNA, 15 nt, Salmonella enterica enterica serovar Typhi
aguauaagcgccgcu

SEQ ID NO: 3675598 - RNA, 17 nt, Salmonella enterica enterica serovar Typhi
aguaucgcucuauaucc

SEQ ID NO: 3675599 - RNA, 19 nt, Salmonella enterica enterica serovar Typhi
aguaucgcucuauauccug

SEQ ID NO: 3675600 - RNA, 20 nt, Salmonella enterica enterica serovar Typhi
aguaucgcucuauauccugc

SEQ ID NO: 3675601 - RNA, 17 nt, Salmonella enterica enterica serovar Typhi
aguaucgggauggcgau

SEQ ID NO: 3675602 - RNA, 22 nt, Salmonella enterica enterica serovar Typhi
aguaucucgccaguaaagacac

SEQ ID NO: 3675603 - RNA, 23 nt, Salmonella enterica enterica serovar Typhi
aguaugaaggguauauaaaucaa

SEQ ID NO: 3675604 - RNA, 15 nt, Salmonella enterica enterica serovar Typhi
aguaugccucgcgca

SEQ ID NO: 3675605 - RNA, 23 nt, Salmonella enterica enterica serovar Typhi
aguaugccucgcgcaccauaaua

SEQ ID NO: 3675606 - RNA, 18 nt, Salmonella enterica enterica serovar Typhi
aguaugcuuauugucgcc

SEQ ID NO: 3675607 - RNA, 19 nt, Salmonella enterica enterica serovar Typhi
aguauggccucuucaaauu

SEQ ID NO: 3675608 - RNA, 21 nt, Salmonella enterica enterica serovar Typhi
aguauggccucuucaaauuug

SEQ ID NO: 3675609 - RNA, 11 nt, Salmonella enterica enterica serovar Typhi
aguauggcgac

SEQ ID NO: 3675610 - RNA, 19 nt, Salmonella enterica enterica serovar Typhi
aguauggcgaccaggaauu

SEQ ID NO: 3675611 - RNA, 16 nt, Salmonella enterica enterica serovar Typhi
aguauguuaggguaga

SEQ ID NO: 3675612 - RNA, 14 nt, Salmonella enterica enterica serovar Typhi
aguauugcaccagg

SEQ ID NO: 3675613 - RNA, 14 nt, Salmonella enterica enterica serovar Typhi
aguauuggcaagaa

SEQ ID NO: 3675614 - RNA, 15 nt, Salmonella enterica enterica serovar Typhi
aguauuggcugccga

SEQ ID NO: 3675615 - RNA, 20 nt, Salmonella enterica enterica serovar Typhi
aguauuuacaaaaaagauaa

SEQ ID NO: 3675616 - RNA, 19 nt, Salmonella enterica enterica serovar Typhi
aguauuuaccuacuguggu

SEQ ID NO: 3675617 - RNA, 22 nt, Salmonella enterica enterica serovar Typhi
agucaaaauaaaauuauauucu

SEQ ID NO: 3675618 - RNA, 21 nt, Salmonella enterica enterica serovar Typhi
agucaaacacgaccagcgaca

SEQ ID NO: 3675619 - RNA, 14 nt, Salmonella enterica enterica serovar Typhi
agucaaagguaaua

SEQ ID NO: 3675620 - RNA, 15 nt, Salmonella enterica enterica serovar Typhi
agucaaauuccagca

SEQ ID NO: 3675621 - RNA, 17 nt, Salmonella enterica enterica serovar Typhi
agucaaauuccagcaau

SEQ ID NO: 3675622 - RNA, 22 nt, Salmonella enterica enterica serovar Typhi
agucaacucaugccgcugcugg

SEQ ID NO: 3675623 - RNA, 18 nt, Salmonella enterica enterica serovar Typhi
agucaaggcauccagcag

SEQ ID NO: 3675624 - RNA, 14 nt, Salmonella enterica enterica serovar Typhi
agucaauaaacugg

SEQ ID NO: 3675625 - RNA, 15 nt, Salmonella enterica enterica serovar Typhi
agucaauaaacugga

SEQ ID NO: 3675626 - RNA, 18 nt, Salmonella enterica enterica serovar Typhi
agucaauaagcuugcuuu

SEQ ID NO: 3675627 - RNA, 17 nt, Salmonella enterica enterica serovar Typhi
agucacaaguaagguag

SEQ ID NO: 3675628 - RNA, 16 nt, Salmonella enterica enterica serovar Typhi
agucacuccaggcguu

SEQ ID NO: 3675629 - RNA, 17 nt, Salmonella enterica enterica serovar Typhi
agucacuuacuuucuug

SEQ ID NO: 3675630 - RNA, 21 nt, Salmonella enterica enterica serovar Typhi
agucagacaaguagccugcca

SEQ ID NO: 3675631 - RNA, 15 nt, Salmonella enterica enterica serovar Typhi
agucagacaccagcc

SEQ ID NO: 3675632 - RNA, 23 nt, Salmonella enterica enterica serovar Typhi
agucagcaacauggauucgcugg

SEQ ID NO: 3675633 - RNA, 17 nt, Salmonella enterica enterica serovar Typhi
agucagcgcgagcguga

SEQ ID NO: 3675634 - RNA, 19 nt, Salmonella enterica enterica serovar Typhi
agucagcuccuuucggacu

SEQ ID NO: 3675635 - RNA, 21 nt, Salmonella enterica enterica serovar Typhi
agucagcucgguggcgguauc

SEQ ID NO: 3675636 - RNA, 15 nt, Salmonella enterica enterica serovar Typhi
agucagucccgcgcu

SEQ ID NO: 3675637 - RNA, 15 nt, Salmonella enterica enterica serovar Typhi
agucaguuuaugacu

SEQ ID NO: 3675638 - RNA, 23 nt, Salmonella enterica enterica serovar Typhi
agucauaauacucaauauccugc

SEQ ID NO: 3675639 - RNA, 15 nt, Salmonella enterica enterica serovar Typhi
agucauaauuaaaaa

SEQ ID NO: 3675640 - RNA, 15 nt, Salmonella enterica enterica serovar Typhi
agucauaccuguucc

SEQ ID NO: 3675641 - RNA, 16 nt, Salmonella enterica enterica serovar Typhi
agucauaccuguuccu

SEQ ID NO: 3675642 - RNA, 14 nt, Salmonella enterica enterica serovar Typhi
agucaucaauugcu

SEQ ID NO: 3675643 - RNA, 19 nt, Salmonella enterica enterica serovar Typhi
agucauccgguucauaauc

SEQ ID NO: 3675644 - RNA, 13 nt, Salmonella enterica enterica serovar Typhi
agucaucugccag

SEQ ID NO: 3675645 - RNA, 16 nt, Salmonella enterica enterica serovar Typhi
agucaucugccaguua

SEQ ID NO: 3675646 - RNA, 14 nt, Salmonella enterica enterica serovar Typhi
agucauggcuuuua

SEQ ID NO: 3675647 - RNA, 19 nt, Salmonella enterica enterica serovar Typhi
agucauuacccaauaauga

SEQ ID NO: 3675648 - RNA, 20 nt, Salmonella enterica enterica serovar Typhi
agucauuacccgugagcuac

SEQ ID NO: 3675649 - RNA, 12 nt, Salmonella enterica enterica serovar Typhi
aguccaaauaag

SEQ ID NO: 3675650 - RNA, 20 nt, Salmonella enterica enterica serovar Typhi
aguccaacaaggauauccgc

SEQ ID NO: 3675651 - RNA, 15 nt, Salmonella enterica enterica serovar Typhi
aguccacuuucugua

SEQ ID NO: 3675652 - RNA, 13 nt, Salmonella enterica enterica serovar Typhi
aguccagcaucca

SEQ ID NO: 3675653 - RNA, 20 nt, Salmonella enterica enterica serovar Typhi
agugauaaagcacagcccca

SEQ ID NO: 3675654 - RNA, 22 nt, Salmonella enterica enterica serovar Typhi
agugauagcgccauggagaaac

SEQ ID NO: 3675655 - RNA, 21 nt, Salmonella enterica enterica serovar Typhi
agugaucccgacauaggccag

SEQ ID NO: 3675656 - RNA, 16 nt, Salmonella enterica enterica serovar Typhi
agugauuauaaaucaa

SEQ ID NO: 3675657 - RNA, 17 nt, Salmonella enterica enterica serovar Typhi
agugauuauaaaucaau

SEQ ID NO: 3675658 - RNA, 19 nt, Salmonella enterica enterica serovar Typhi
agugauuuacuccaaaaau

SEQ ID NO: 3675659 - RNA, 15 nt, Salmonella enterica enterica serovar Typhi
agugcaaaggccucu

SEQ ID NO: 3675660 - RNA, 12 nt, Salmonella enterica enterica serovar Typhi
agugcaacggcu

SEQ ID NO: 3675661 - RNA, 18 nt, Salmonella enterica enterica serovar Typhi
agugcaguauugcaccag

SEQ ID NO: 3675662 - RNA, 22 nt, Salmonella enterica enterica serovar Typhi
agugcauguacaacuucaugag

SEQ ID NO: 3675663 - RNA, 22 nt, Salmonella enterica enterica serovar Typhi
agugccaguccgguauaaaacg

SEQ ID NO: 3675664 - RNA, 20 nt, Salmonella enterica enterica serovar Typhi
agugcccgaaagcaauacug

SEQ ID NO: 3675665 - RNA, 21 nt, Salmonella enterica enterica serovar Typhi
agugcccguuugcgagacggc

SEQ ID NO: 3675666 - RNA, 15 nt, Salmonella enterica enterica serovar Typhi
agugccgccaggcaa

SEQ ID NO: 3675667 - RNA, 20 nt, Salmonella enterica enterica serovar Typhi
agugccggugacaugaaaau

SEQ ID NO: 3675668 - RNA, 11 nt, Salmonella enterica enterica serovar Typhi
agugccugccg

SEQ ID NO: 3675669 - RNA, 12 nt, Salmonella enterica enterica serovar Typhi
agugcgcggcga

SEQ ID NO: 3675670 - RNA, 20 nt, Salmonella enterica enterica serovar Typhi
agugcgcggcgaaaaagccg

SEQ ID NO: 3675671 - RNA, 14 nt, Salmonella enterica enterica serovar Typhi
agugcguuaacccg

SEQ ID NO: 3675672 - RNA, 14 nt, Salmonella enterica enterica serovar Typhi
agugcugaaaaucg

SEQ ID NO: 3675673 - RNA, 20 nt, Salmonella enterica enterica serovar Typhi
agugcugaaaaucgucucuc

SEQ ID NO: 3675674 - RNA, 14 nt, Salmonella enterica enterica serovar Typhi
agugcugaacaaua

SEQ ID NO: 3675675 - RNA, 16 nt, Salmonella enterica enterica serovar Typhi
agugcuugcauuuuac

SEQ ID NO: 3675676 - RNA, 22 nt, Salmonella enterica enterica serovar Typhi
aguggagaggccaccagcgcca

SEQ ID NO: 3675677 - RNA, 20 nt, Salmonella enterica enterica serovar Typhi
aguggccaucuuccagcauc

SEQ ID NO: 3675678 - RNA, 21 nt, Salmonella enterica enterica serovar Typhi
aguggcgaaacuccuccggga

SEQ ID NO: 3675679 - RNA, 14 nt, Salmonella enterica enterica serovar Typhi
aguggcggcaaaaa

SEQ ID NO: 3675680 - RNA, 16 nt, Salmonella enterica enterica serovar Typhi
agugggucacaucgcc

SEQ ID NO: 3675681 - RNA, 12 nt, Salmonella enterica enterica serovar Typhi
agugguggguga

SEQ ID NO: 3675682 - RNA, 13 nt, Salmonella enterica enterica serovar Typhi
aguggugggugau

SEQ ID NO: 3675683 - RNA, 14 nt, Salmonella enterica enterica serovar Typhi
aguggugggugaug

SEQ ID NO: 3675684 - RNA, 17 nt, Salmonella enterica enterica serovar Typhi
aguggugggugaugacg

SEQ ID NO: 3675685 - RNA, 15 nt, Salmonella enterica enterica serovar Typhi
agugguuccauucca

SEQ ID NO: 3675686 - RNA, 22 nt, Salmonella enterica enterica serovar Typhi
agugguucguccaucaguucuu

SEQ ID NO: 3675687 - RNA, 22 nt, Salmonella enterica enterica serovar Typhi
aguguaaaaauuuuugaucugc

SEQ ID NO: 3675688 - RNA, 17 nt, Salmonella enterica enterica serovar Typhi
agugucgccauaaauca

SEQ ID NO: 3675689 - RNA, 22 nt, Salmonella enterica enterica serovar Typhi
agugugcaaacgauaaaagcuc

SEQ ID NO: 3675690 - RNA, 22 nt, Salmonella enterica enterica serovar Typhi
aguguggaaaacagcgccggca

SEQ ID NO: 3675691 - RNA, 14 nt, Salmonella enterica enterica serovar Typhi
aguguggcaccugc

SEQ ID NO: 3675692 - RNA, 15 nt, Salmonella enterica enterica serovar Typhi
aguguguaccagcag

SEQ ID NO: 3675693 - RNA, 16 nt, Salmonella enterica enterica serovar Typhi
aguguguaccagcagc

SEQ ID NO: 3675694 - RNA, 19 nt, Salmonella enterica enterica serovar Typhi
aguguuaacuuccucuuuc

SEQ ID NO: 3675695 - RNA, 14 nt, Salmonella enterica enterica serovar Typhi
aguguuagcgucag

SEQ ID NO: 3675696 - RNA, 21 nt, Salmonella enterica enterica serovar Typhi
aguguuauauucccgaaaggu

SEQ ID NO: 3675697 - RNA, 21 nt, Salmonella enterica enterica serovar Typhi
aguguuggaugaaccauauca

SEQ ID NO: 3675698 - RNA, 18 nt, Salmonella enterica enterica serovar Typhi
aguguuucccaacaaugc

SEQ ID NO: 3675699 - RNA, 15 nt, Salmonella enterica enterica serovar Typhi
aguuaaauaaacaaa

SEQ ID NO: 3675700 - RNA, 16 nt, Salmonella enterica enterica serovar Typhi
aguuaaauaaacaaaa

SEQ ID NO: 3675701 - RNA, 22 nt, Salmonella enterica enterica serovar Typhi
aguuaaauaaacaaaaaccugc

SEQ ID NO: 3675702 - RNA, 17 nt, Salmonella enterica enterica serovar Typhi
aguuaacuucuccgcca

SEQ ID NO: 3675703 - RNA, 12 nt, Salmonella enterica enterica serovar Typhi
aguuaauaauga

SEQ ID NO: 3675704 - RNA, 21 nt, Salmonella enterica enterica serovar Typhi
aguuaaucagcgccgucgcca

SEQ ID NO: 3675705 - RNA, 16 nt, Salmonella enterica enterica serovar Typhi
aguuaauuaaaugcuu

SEQ ID NO: 3675706 - RNA, 21 nt, Salmonella enterica enterica serovar Typhi
aguuaccauccauuaaaaucu

SEQ ID NO: 3675707 - RNA, 15 nt, Salmonella enterica enterica serovar Typhi
aguuacgcacgccag

SEQ ID NO: 3675708 - RNA, 19 nt, Salmonella enterica enterica serovar Typhi
aguuacgcacgccagauaa

SEQ ID NO: 3675709 - RNA, 16 nt, Salmonella enterica enterica serovar Typhi
aguuacuuuccauaua

SEQ ID NO: 3675710 - RNA, 16 nt, Salmonella enterica enterica serovar Typhi
aguuagcgaucgcgcc

SEQ ID NO: 3675711 - RNA, 23 nt, Salmonella enterica enterica serovar Typhi
aguuauaaauccccgccgccauc

SEQ ID NO: 3675712 - RNA, 14 nt, Salmonella enterica enterica serovar Typhi
aguuauaaauuuau

SEQ ID NO: 3675713 - RNA, 21 nt, Salmonella enterica enterica serovar Typhi
aguuaucauuauauagucuua

SEQ ID NO: 3675714 - RNA, 19 nt, Salmonella enterica enterica serovar Typhi
aguuauguuauccccacuu

SEQ ID NO: 3675715 - RNA, 19 nt, Salmonella enterica enterica serovar Typhi
aguucaaauucuucccggc

SEQ ID NO: 3675716 - RNA, 19 nt, Salmonella enterica enterica serovar Typhi
aguucacgacugauagguu

SEQ ID NO: 3675717 - RNA, 13 nt, Salmonella enterica enterica serovar Typhi
aguucagcagcac

SEQ ID NO: 3675718 - RNA, 15 nt, Salmonella enterica enterica serovar Typhi
aguucagcagcacca

SEQ ID NO: 3675719 - RNA, 16 nt, Salmonella enterica enterica serovar Typhi
aguucagcagcaccac

SEQ ID NO: 3675720 - RNA, 12 nt, Salmonella enterica enterica serovar Typhi
aguucagccgcc

SEQ ID NO: 3675721 - RNA, 23 nt, Salmonella enterica enterica serovar Typhi
aguucaguaugaucaugcccggc

SEQ ID NO: 3675722 - RNA, 17 nt, Salmonella enterica enterica serovar Typhi
aguucauagccguggcu

SEQ ID NO: 3675723 - RNA, 22 nt, Salmonella enterica enterica serovar Typhi
aguuccaaucucuuuugcggcg

SEQ ID NO: 3675724 - RNA, 16 nt, Salmonella enterica enterica serovar Typhi
aguucccacagcuuca

SEQ ID NO: 3675725 - RNA, 11 nt, Salmonella enterica enterica serovar Typhi
aguucccagcg

SEQ ID NO: 3675726 - RNA, 14 nt, Salmonella enterica enterica serovar Typhi
aguucccuacucuc

SEQ ID NO: 3675727 - RNA, 22 nt, Salmonella enterica enterica serovar Typhi
aguucccuacucucgcaugggg

SEQ ID NO: 3675728 - RNA, 23 nt, Salmonella enterica enterica serovar Typhi
aguucccuucuccucaacagaca

SEQ ID NO: 3675729 - RNA, 18 nt, Salmonella enterica enterica serovar Typhi
aguuccgcaauccuggcu

SEQ ID NO: 3675730 - RNA, 13 nt, Salmonella enterica enterica serovar Typhi
aguuccgccagac

SEQ ID NO: 3675731 - RNA, 21 nt, Salmonella enterica enterica serovar Typhi
aguuccgccagacucagccag

SEQ ID NO: 3675732 - RNA, 11 nt, Salmonella enterica enterica serovar Typhi
aguuccuccug

SEQ ID NO: 3675733 - RNA, 12 nt, Salmonella enterica enterica serovar Typhi
aguuccuccugg

SEQ ID NO: 3675734 - RNA, 12 nt, Salmonella enterica enterica serovar Typhi
aguucgccgcca

SEQ ID NO: 3675735 - RNA, 15 nt, Salmonella enterica enterica serovar Typhi
aguucgcugaggcgu

SEQ ID NO: 3675736 - RNA, 16 nt, Salmonella enterica enterica serovar Typhi
aguucuacgcugccau

SEQ ID NO: 3675737 - RNA, 17 nt, Salmonella enterica enterica serovar Typhi
aguucucaaugaacagu

SEQ ID NO: 3675738 - RNA, 14 nt, Salmonella enterica enterica serovar Typhi
aguucuugcaggca

SEQ ID NO: 3675739 - RNA, 15 nt, Salmonella enterica enterica serovar Typhi
auaaacauaaagaca

SEQ ID NO: 3675740 - RNA, 24 nt, Salmonella enterica enterica serovar Typhi
auaaacaucagcgcggacacgaua

SEQ ID NO: 3675741 - RNA, 16 nt, Salmonella enterica enterica serovar Typhi
auaaaccaaagcagag

SEQ ID NO: 3675742 - RNA, 14 nt, Salmonella enterica enterica serovar Typhi
auaaaccaacagcc

SEQ ID NO: 3675743 - RNA, 15 nt, Salmonella enterica enterica serovar Typhi
auaaaccggcggccu

SEQ ID NO: 3675744 - RNA, 17 nt, Salmonella enterica enterica serovar Typhi
auaaaccuucguaauag

SEQ ID NO: 3675745 - RNA, 16 nt, Salmonella enterica enterica serovar Typhi
auaaacgccucauccg

SEQ ID NO: 3675746 - RNA, 19 nt, Salmonella enterica enterica serovar Typhi
auaaacgcgccaaguaaau

SEQ ID NO: 3675747 - RNA, 16 nt, Salmonella enterica enterica serovar Typhi
auaaacgcugcgcaac

SEQ ID NO: 3675748 - RNA, 14 nt, Salmonella enterica enterica serovar Typhi
auaaacgggaagua

SEQ ID NO: 3675749 - RNA, 22 nt, Salmonella enterica enterica serovar Typhi
auaaacgggcccggcuuucugu

SEQ ID NO: 3675750 - RNA, 12 nt, Salmonella enterica enterica serovar Typhi
auaaacucagca

SEQ ID NO: 3675751 - RNA, 14 nt, Salmonella enterica enterica serovar Typhi
auaaacucagcaau

SEQ ID NO: 3675752 - RNA, 21 nt, Salmonella enterica enterica serovar Typhi
auaaacucuguguuaugaaug

SEQ ID NO: 3675753 - RNA, 19 nt, Salmonella enterica enterica serovar Typhi
auaaacuucaauucagaaa

SEQ ID NO: 3675754 - RNA, 22 nt, Salmonella enterica enterica serovar Typhi
auaaacuucaauucagaaaguu

SEQ ID NO: 3675755 - RNA, 20 nt, Salmonella enterica enterica serovar Typhi
auaaagaccggcacaaccgu

SEQ ID NO: 3675756 - RNA, 22 nt, Salmonella enterica enterica serovar Typhi
auaaagauauugucgcccugca

SEQ ID NO: 3675757 - RNA, 22 nt, Salmonella enterica enterica serovar Typhi
auaaagauuggcaucugcaauu

SEQ ID NO: 3675758 - RNA, 17 nt, Salmonella enterica enterica serovar Typhi
auaaagcacagccccag

SEQ ID NO: 3675759 - RNA, 14 nt, Salmonella enterica enterica serovar Typhi
auaaagcauaaaua

SEQ ID NO: 3675760 - RNA, 18 nt, Salmonella enterica enterica serovar Typhi
auaaagcccuguuauuca

SEQ ID NO: 3675761 - RNA, 17 nt, Salmonella enterica enterica serovar Typhi
auaaagcgaauaauuaa

SEQ ID NO: 3675762 - RNA, 20 nt, Salmonella enterica enterica serovar Typhi
auaaagcgaccgaucaucau

SEQ ID NO: 3675763 - RNA, 22 nt, Salmonella enterica enterica serovar Typhi
auaaagcugguugagauccaua

SEQ ID NO: 3675764 - RNA, 15 nt, Salmonella enterica enterica serovar Typhi
auaaagcuuucaucu

SEQ ID NO: 3675765 - RNA, 19 nt, Salmonella enterica enterica serovar Typhi
auaaaggccggcagccgcu

SEQ ID NO: 3675766 - RNA, 14 nt, Salmonella enterica enterica serovar Typhi
auaaaggggugcuu

SEQ ID NO: 3675767 - RNA, 20 nt, Salmonella enterica enterica serovar Typhi
auaaagggugcgcaaauugg

SEQ ID NO: 3675768 - RNA, 21 nt, Salmonella enterica enterica serovar Typhi
auaaaggucacaucaucgcca

SEQ ID NO: 3675769 - RNA, 15 nt, Salmonella enterica enterica serovar Typhi
auaaaggucggcugc

SEQ ID NO: 3675770 - RNA, 16 nt, Salmonella enterica enterica serovar Typhi
auaaaguagccaaugc

SEQ ID NO: 3675771 - RNA, 20 nt, Salmonella enterica enterica serovar Typhi
auaaagucagacaaguagcc

SEQ ID NO: 3675772 - RNA, 21 nt, Salmonella enterica enterica serovar Typhi
auaaagugcugaacaauaaca

SEQ ID NO: 3675773 - RNA, 13 nt, Salmonella enterica enterica serovar Typhi
auaaaguuuauuu

SEQ ID NO: 3675774 - RNA, 21 nt, Salmonella enterica enterica serovar Typhi
auaaauaacauuucagucuaa

SEQ ID NO: 3675775 - RNA, 19 nt, Salmonella enterica enterica serovar Typhi
auaaauaaccgguaacugu

SEQ ID NO: 3675776 - RNA, 17 nt, Salmonella enterica enterica serovar Typhi
auaaauaccguaaugcc

SEQ ID NO: 3675777 - RNA, 18 nt, Salmonella enterica enterica serovar Typhi
auaaauagccagcaucau

SEQ ID NO: 3675778 - RNA, 18 nt, Salmonella enterica enterica serovar Typhi
auaaauaggcgccgccga

SEQ ID NO: 3675779 - RNA, 23 nt, Salmonella enterica enterica serovar Typhi
auaaauaguaaauagaaaauaau

SEQ ID NO: 3675780 - RNA, 16 nt, Salmonella enterica enterica serovar Typhi
auaaauauguuauuua

SEQ ID NO: 3675781 - RNA, 18 nt, Salmonella enterica enterica serovar Typhi
auaaauauucaucaaaau

SEQ ID NO: 3675782 - RNA, 23 nt, Salmonella enterica enterica serovar Typhi
auaaauauugcaacgaucccuaa

SEQ ID NO: 3675783 - RNA, 13 nt, Salmonella enterica enterica serovar Typhi
auaaaucagcaca

SEQ ID NO: 3675784 - RNA, 12 nt, Salmonella enterica enterica serovar Typhi
auaaaucauuac

SEQ ID NO: 3675785 - RNA, 18 nt, Salmonella enterica enterica serovar Typhi
auaaauccccgccgccau

SEQ ID NO: 3675786 - RNA, 20 nt, Salmonella enterica enterica serovar Typhi
auaaauccccgccgccauca

SEQ ID NO: 3675787 - RNA, 18 nt, Salmonella enterica enterica serovar Typhi
auaaaugaauuauuuuuu

SEQ ID NO: 3675788 - RNA, 20 nt, Salmonella enterica enterica serovar Typhi
auaaaugaggcuguuuuuua

SEQ ID NO: 3675789 - RNA, 18 nt, Salmonella enterica enterica serovar Typhi
auaaauguacugcaauaa

SEQ ID NO: 3675790 - RNA, 15 nt, Salmonella enterica enterica serovar Typhi
auaaauucgaaauaa

SEQ ID NO: 3675791 - RNA, 22 nt, Salmonella enterica enterica serovar Typhi
auaaauuuauuuuuugcuggga

SEQ ID NO: 3675792 - RNA, 14 nt, Salmonella enterica enterica serovar Typhi
auaaauuucagugg

SEQ ID NO: 3675793 - RNA, 19 nt, Salmonella enterica enterica serovar Typhi
auaaauuucauccaugcca

SEQ ID NO: 3675794 - RNA, 14 nt, Salmonella enterica enterica serovar Typhi
auaaauuuuuuaac

SEQ ID NO: 3675795 - RNA, 18 nt, Salmonella enterica enterica serovar Typhi
auaaauuuuuuaacagaa

SEQ ID NO: 3675796 - RNA, 14 nt, Salmonella enterica enterica serovar Typhi
auaacaaacgccgc

SEQ ID NO: 3675797 - RNA, 22 nt, Salmonella enterica enterica serovar Typhi
auaacacggcuggcaaugcgcu

SEQ ID NO: 3675798 - RNA, 23 nt, Salmonella enterica enterica serovar Typhi
auaacagacgaaaaaaaagacgc

SEQ ID NO: 3675799 - RNA, 13 nt, Salmonella enterica enterica serovar Typhi
auaacagcaccau

SEQ ID NO: 3675800 - RNA, 17 nt, Salmonella enterica enterica serovar Typhi
auaacagccagcgggcg

SEQ ID NO: 3675801 - RNA, 13 nt, Salmonella enterica enterica serovar Typhi
auaacagcgcugg

SEQ ID NO: 3675802 - RNA, 20 nt, Salmonella enterica enterica serovar Typhi
auaacaucguaaaucaaaug

SEQ ID NO: 3675803 - RNA, 18 nt, Salmonella enterica enterica serovar Typhi
auaacauuucagucuaau

SEQ ID NO: 3675804 - RNA, 21 nt, Salmonella enterica enterica serovar Typhi
auaaccaaacgcgcauuuuau

SEQ ID NO: 3675805 - RNA, 16 nt, Salmonella enterica enterica serovar Typhi
auaaccacgaaaauua

SEQ ID NO: 3675806 - RNA, 21 nt, Salmonella enterica enterica serovar Typhi
auaaccacgaaaauuauuuuc

SEQ ID NO: 3675807 - RNA, 14 nt, Salmonella enterica enterica serovar Typhi
auaaccagaaaacc

SEQ ID NO: 3675808 - RNA, 16 nt, Salmonella enterica enterica serovar Typhi
auaaccagaaaaccga

SEQ ID NO: 3675809 - RNA, 22 nt, Salmonella enterica enterica serovar Typhi
auaaccagaaaaccgacagcaa

SEQ ID NO: 3675810 - RNA, 15 nt, Salmonella enterica enterica serovar Typhi
auaaccagauggggc

SEQ ID NO: 3675811 - RNA, 22 nt, Salmonella enterica enterica serovar Typhi
auaaccagauggggcuuccauu

SEQ ID NO: 3675812 - RNA, 14 nt, Salmonella enterica enterica serovar Typhi
auaaccaucggacg

SEQ ID NO: 3675813 - RNA, 15 nt, Salmonella enterica enterica serovar Typhi
auaaccaugcucagc

SEQ ID NO: 3675814 - RNA, 23 nt, Salmonella enterica enterica serovar Typhi
auaacccggauugucuuaaauau

SEQ ID NO: 3675815 - RNA, 14 nt, Salmonella enterica enterica serovar Typhi
auaaccgcccgcgg

SEQ ID NO: 3675816 - RNA, 22 nt, Salmonella enterica enterica serovar Typhi
auaaccgccgccgcgcccgcgu

SEQ ID NO: 3675817 - RNA, 23 nt, Salmonella enterica enterica serovar Typhi
auaaccucaacgucgcucagaau

SEQ ID NO: 3675818 - RNA, 19 nt, Salmonella enterica enterica serovar Typhi
auaaccucaaugauuuccg

SEQ ID NO: 3675819 - RNA, 20 nt, Salmonella enterica enterica serovar Typhi
auaacgaugaugaaaaagaa

SEQ ID NO: 3675820 - RNA, 22 nt, Salmonella enterica enterica serovar Typhi
auaacgaugauuauuguuaaaa

SEQ ID NO: 3675821 - RNA, 18 nt, Salmonella enterica enterica serovar Typhi
auaacgcaacgucagcga

SEQ ID NO: 3675822 - RNA, 19 nt, Salmonella enterica enterica serovar Typhi
auaacgccgauaaccagcg

SEQ ID NO: 3675823 - RNA, 22 nt, Salmonella enterica enterica serovar Typhi
auaacgccgaugccgccgacaa

SEQ ID NO: 3675824 - RNA, 19 nt, Salmonella enterica enterica serovar Typhi
auaaucagcgcuccgacaa

SEQ ID NO: 3675825 - RNA, 13 nt, Salmonella enterica enterica serovar Typhi
auaaucauccgcu

SEQ ID NO: 3675826 - RNA, 19 nt, Salmonella enterica enterica serovar Typhi
auaaucccggcgccaauca

SEQ ID NO: 3675827 - RNA, 20 nt, Salmonella enterica enterica serovar Typhi
auaauccgccuuuuccccca

SEQ ID NO: 3675828 - RNA, 20 nt, Salmonella enterica enterica serovar Typhi
auaauccggaauaagaauau

SEQ ID NO: 3675829 - RNA, 12 nt, Salmonella enterica enterica serovar Typhi
auaauccuuccu

SEQ ID NO: 3675830 - RNA, 20 nt, Salmonella enterica enterica serovar Typhi
auaauccuuccuuucauuuu

SEQ ID NO: 3675831 - RNA, 18 nt, Salmonella enterica enterica serovar Typhi
auaauccuuguccaugua

SEQ ID NO: 3675832 - RNA, 14 nt, Salmonella enterica enterica serovar Typhi
auaaucgauauaau

SEQ ID NO: 3675833 - RNA, 16 nt, Salmonella enterica enterica serovar Typhi
auaaucggccaggaug

SEQ ID NO: 3675834 - RNA, 17 nt, Salmonella enterica enterica serovar Typhi
auaaucgguagcacuuu

SEQ ID NO: 3675835 - RNA, 20 nt, Salmonella enterica enterica serovar Typhi
auaaucgguagcacuuuaaa

SEQ ID NO: 3675836 - RNA, 15 nt, Salmonella enterica enterica serovar Typhi
auaaucguuuuaugc

SEQ ID NO: 3675837 - RNA, 23 nt, Salmonella enterica enterica serovar Typhi
auaaucuaccauugauaccaaua

SEQ ID NO: 3675838 - RNA, 22 nt, Salmonella enterica enterica serovar Typhi
auaaucucugcgacaaucaggu

SEQ ID NO: 3675839 - RNA, 19 nt, Salmonella enterica enterica serovar Typhi
auaaugaagcauaaaaaga

SEQ ID NO: 3675840 - RNA, 14 nt, Salmonella enterica enterica serovar Typhi
auaaugaauacaca

SEQ ID NO: 3675841 - RNA, 11 nt, Salmonella enterica enterica serovar Typhi
auaaugcaauc

SEQ ID NO: 3675842 - RNA, 16 nt, Salmonella enterica enterica serovar Typhi
auaaugcaaugccuaa

SEQ ID NO: 3675843 - RNA, 16 nt, Salmonella enterica enterica serovar Typhi
auaaugcagccauccu

SEQ ID NO: 3675844 - RNA, 13 nt, Salmonella enterica enterica serovar Typhi
auaaugccgccgu

SEQ ID NO: 3675845 - RNA, 12 nt, Salmonella enterica enterica serovar Typhi
auaaugcuuacg

SEQ ID NO: 3675846 - RNA, 15 nt, Salmonella enterica enterica serovar Typhi
auaauggaacugccu

SEQ ID NO: 3675847 - RNA, 16 nt, Salmonella enterica enterica serovar Typhi
auaauggagaacccag

SEQ ID NO: 3675848 - RNA, 19 nt, Salmonella enterica enterica serovar Typhi
auaauggagaugaaaauaa

SEQ ID NO: 3675849 - RNA, 21 nt, Salmonella enterica enterica serovar Typhi
auaauggagaugaaaauaauu

SEQ ID NO: 3675850 - RNA, 19 nt, Salmonella enterica enterica serovar Typhi
auaauggcgccgauaacac

SEQ ID NO: 3675851 - RNA, 21 nt, Salmonella enterica enterica serovar Typhi
auaauggggauuaucaggaug

SEQ ID NO: 3675852 - RNA, 13 nt, Salmonella enterica enterica serovar Typhi
auaaugugcgcga

SEQ ID NO: 3675853 - RNA, 18 nt, Salmonella enterica enterica serovar Typhi
auaauguugguaaauuua

SEQ ID NO: 3675854 - RNA, 23 nt, Salmonella enterica enterica serovar Typhi
auaauguuuacuccauucccagc

SEQ ID NO: 3675855 - RNA, 16 nt, Salmonella enterica enterica serovar Typhi
auaauuaagaccauac

SEQ ID NO: 3675856 - RNA, 12 nt, Salmonella enterica enterica serovar Typhi
auaauuccccca

SEQ ID NO: 3675857 - RNA, 22 nt, Salmonella enterica enterica serovar Typhi
auaauucgaguugcuuaaaagc

SEQ ID NO: 3675858 - RNA, 20 nt, Salmonella enterica enterica serovar Typhi
auaauugcucacccauuuua

SEQ ID NO: 3675859 - RNA, 19 nt, Salmonella enterica enterica serovar Typhi
auaauuuuauuauauuuaa

SEQ ID NO: 3675860 - RNA, 13 nt, Salmonella enterica enterica serovar Typhi
auacaaauauccc

SEQ ID NO: 3675861 - RNA, 18 nt, Salmonella enterica enterica serovar Typhi
auacaagguauccgccau

SEQ ID NO: 3675862 - RNA, 21 nt, Salmonella enterica enterica serovar Typhi
auacaccaaacgaauuuaaau

SEQ ID NO: 3675863 - RNA, 18 nt, Salmonella enterica enterica serovar Typhi
auacaccgccauauauuu

SEQ ID NO: 3675864 - RNA, 15 nt, Salmonella enterica enterica serovar Typhi
auacaccggcgccag

SEQ ID NO: 3675865 - RNA, 11 nt, Salmonella enterica enterica serovar Typhi
auacaccuuca

SEQ ID NO: 3675866 - RNA, 15 nt, Salmonella enterica enterica serovar Typhi
auacaccuuugcccg

SEQ ID NO: 3675867 - RNA, 21 nt, Salmonella enterica enterica serovar Typhi
auacacgccuuccuccagcau

SEQ ID NO: 3675868 - RNA, 15 nt, Salmonella enterica enterica serovar Typhi
auacacguaauacau

SEQ ID NO: 3675869 - RNA, 20 nt, Salmonella enterica enterica serovar Typhi
auacagaauccggcgcucau

SEQ ID NO: 3675870 - RNA, 14 nt, Salmonella enterica enterica serovar Typhi
auacagagucgcuu

SEQ ID NO: 3675871 - RNA, 12 nt, Salmonella enterica enterica serovar Typhi
auacagcagcac

SEQ ID NO: 3675872 - RNA, 14 nt, Salmonella enterica enterica serovar Typhi
auacaggcuuaaca

SEQ ID NO: 3675873 - RNA, 17 nt, Salmonella enterica enterica serovar Typhi
auacaggguuugucagc

SEQ ID NO: 3675874 - RNA, 19 nt, Salmonella enterica enterica serovar Typhi
auacaguucgacaaugucc

SEQ ID NO: 3675875 - RNA, 16 nt, Salmonella enterica enterica serovar Typhi
auacauaaauccggau

SEQ ID NO: 3675876 - RNA, 21 nt, Salmonella enterica enterica serovar Typhi
auacauaccacgcagcggcau

SEQ ID NO: 3675877 - RNA, 20 nt, Salmonella enterica enterica serovar Typhi
auacauauuguuuucuauuu

SEQ ID NO: 3675878 - RNA, 22 nt, Salmonella enterica enterica serovar Typhi
auacaucacuuuaugaccauac

SEQ ID NO: 3675879 - RNA, 13 nt, Salmonella enterica enterica serovar Typhi
auacaucagaaaa

SEQ ID NO: 3675880 - RNA, 15 nt, Salmonella enterica enterica serovar Typhi
auacauccugauuau

SEQ ID NO: 3675881 - RNA, 21 nt, Salmonella enterica enterica serovar Typhi
auacaugaggauuuugagcac

SEQ ID NO: 3675882 - RNA, 21 nt, Salmonella enterica enterica serovar Typhi
auacaugccugcgccauguuc

SEQ ID NO: 3675883 - RNA, 14 nt, Salmonella enterica enterica serovar Typhi
auacauucgcucag

SEQ ID NO: 3675884 - RNA, 18 nt, Salmonella enterica enterica serovar Typhi
auacauuugaauaauucu

SEQ ID NO: 3675885 - RNA, 19 nt, Salmonella enterica enterica serovar Typhi
auacauuuuuguaauaaaa

SEQ ID NO: 3675886 - RNA, 15 nt, Salmonella enterica enterica serovar Typhi
auaccaaaaauaauu

SEQ ID NO: 3675887 - RNA, 14 nt, Salmonella enterica enterica serovar Typhi
auaccacaaauuuu

SEQ ID NO: 3675888 - RNA, 15 nt, Salmonella enterica enterica serovar Typhi
auaccacaacagaau

SEQ ID NO: 3675889 - RNA, 20 nt, Salmonella enterica enterica serovar Typhi
auaccacaacagaaucgcga

SEQ ID NO: 3675890 - RNA, 20 nt, Salmonella enterica enterica serovar Typhi
auaccacccgcuaugaagac

SEQ ID NO: 3675891 - RNA, 15 nt, Salmonella enterica enterica serovar Typhi
auaccaccugccaaa

SEQ ID NO: 3675892 - RNA, 17 nt, Salmonella enterica enterica serovar Typhi
auaccacgcagcggcau

SEQ ID NO: 3675893 - RNA, 23 nt, Salmonella enterica enterica serovar Typhi
auaccacgcccgccgccagcauu

SEQ ID NO: 3675894 - RNA, 17 nt, Salmonella enterica enterica serovar Typhi
auaccagcguaauccuc

SEQ ID NO: 3675895 - RNA, 12 nt, Salmonella enterica enterica serovar Typhi
auaccaggcacu

SEQ ID NO: 3675896 - RNA, 17 nt, Salmonella enterica enterica serovar Typhi
auaccaggcacuugaga

SEQ ID NO: 3675897 - RNA, 21 nt, Salmonella enterica enterica serovar Typhi
auaccaggcacuugagaaauu

SEQ ID NO: 3675898 - RNA, 20 nt, Salmonella enterica enterica serovar Typhi
auaccagucgacaguauaga

SEQ ID NO: 3675899 - RNA, 22 nt, Salmonella enterica enterica serovar Typhi
auaccauaaaugaaaccucaau

SEQ ID NO: 3675900 - RNA, 14 nt, Salmonella enterica enterica serovar Typhi
auaccauccccuuu

SEQ ID NO: 3675901 - RNA, 18 nt, Salmonella enterica enterica serovar Typhi
auacccaccucguucaaa

SEQ ID NO: 3675902 - RNA, 16 nt, Salmonella enterica enterica serovar Typhi
auaccccuguucaaaa

SEQ ID NO: 3675903 - RNA, 17 nt, Salmonella enterica enterica serovar Typhi
auacccgacucuuuuuu

SEQ ID NO: 3675904 - RNA, 15 nt, Salmonella enterica enterica serovar Typhi
auaccgaacagaaaa

SEQ ID NO: 3675905 - RNA, 15 nt, Salmonella enterica enterica serovar Typhi
auaccgccagcccca

SEQ ID NO: 3675906 - RNA, 19 nt, Salmonella enterica enterica serovar Typhi
auaccgccauccggcauuc

SEQ ID NO: 3675907 - RNA, 18 nt, Salmonella enterica enterica serovar Typhi
auaccgccugaugagguu

SEQ ID NO: 3675908 - RNA, 17 nt, Salmonella enterica enterica serovar Typhi
auaccgcguuugcgcaa

SEQ ID NO: 3675909 - RNA, 16 nt, Salmonella enterica enterica serovar Typhi
auaccgcuuuguaaaa

SEQ ID NO: 3675910 - RNA, 14 nt, Salmonella enterica enterica serovar Typhi
auagagaaaucaac

SEQ ID NO: 3675911 - RNA, 14 nt, Salmonella enterica enterica serovar Typhi
auagagaguuccuc

SEQ ID NO: 3675912 - RNA, 15 nt, Salmonella enterica enterica serovar Typhi
auagaguaauacauc

SEQ ID NO: 3675913 - RNA, 15 nt, Salmonella enterica enterica serovar Typhi
auagauaaguccuaa

SEQ ID NO: 3675914 - RNA, 20 nt, Salmonella enterica enterica serovar Typhi
auagauauaacccaguucaa

SEQ ID NO: 3675915 - RNA, 22 nt, Salmonella enterica enterica serovar Typhi
auagauaucaaacacaaauuuc

SEQ ID NO: 3675916 - RNA, 20 nt, Salmonella enterica enterica serovar Typhi
auagaucgccaccguaacua

SEQ ID NO: 3675917 - RNA, 13 nt, Salmonella enterica enterica serovar Typhi
auagauuugauuc

SEQ ID NO: 3675918 - RNA, 17 nt, Salmonella enterica enterica serovar Typhi
auagcaaacccucaucg

SEQ ID NO: 3675919 - RNA, 17 nt, Salmonella enterica enterica serovar Typhi
auagcaacguccgcagc

SEQ ID NO: 3675920 - RNA, 17 nt, Salmonella enterica enterica serovar Typhi
auagcaauacuuuccag

SEQ ID NO: 3675921 - RNA, 15 nt, Salmonella enterica enterica serovar Typhi
auagcaaucauccug

SEQ ID NO: 3675922 - RNA, 19 nt, Salmonella enterica enterica serovar Typhi
auagcaaucauccugauuu

SEQ ID NO: 3675923 - RNA, 20 nt, Salmonella enterica enterica serovar Typhi
auagcaauuaauaaacaaug

SEQ ID NO: 3675924 - RNA, 13 nt, Salmonella enterica enterica serovar Typhi
auagcaauuucag

SEQ ID NO: 3675925 - RNA, 14 nt, Salmonella enterica enterica serovar Typhi
auagcacacaaacg

SEQ ID NO: 3675926 - RNA, 14 nt, Salmonella enterica enterica serovar Typhi
auagcaccaggcca

SEQ ID NO: 3675927 - RNA, 23 nt, Salmonella enterica enterica serovar Typhi
auagcaccucgcaauauucaugc

SEQ ID NO: 3675928 - RNA, 13 nt, Salmonella enterica enterica serovar Typhi
auagcagcaaauu

SEQ ID NO: 3675929 - RNA, 16 nt, Salmonella enterica enterica serovar Typhi
auagcaggagauauag

SEQ ID NO: 3675930 - RNA, 15 nt, Salmonella enterica enterica serovar Typhi
auagcaggcgauuaa

SEQ ID NO: 3675931 - RNA, 20 nt, Salmonella enterica enterica serovar Typhi
auagcaucggucaacugaau

SEQ ID NO: 3675932 - RNA, 17 nt, Salmonella enterica enterica serovar Typhi
auagcaucguaagccgc

SEQ ID NO: 3675933 - RNA, 16 nt, Salmonella enterica enterica serovar Typhi
auagcaucuuccucug

SEQ ID NO: 3675934 - RNA, 15 nt, Salmonella enterica enterica serovar Typhi
auagcauuaagcuga

SEQ ID NO: 3675935 - RNA, 19 nt, Salmonella enterica enterica serovar Typhi
auagcauuaagcugauauu

SEQ ID NO: 3675936 - RNA, 21 nt, Salmonella enterica enterica serovar Typhi
auagcauuuuuacucagcaca

SEQ ID NO: 3675937 - RNA, 14 nt, Salmonella enterica enterica serovar Typhi
auagccagaaugcc

SEQ ID NO: 3675938 - RNA, 22 nt, Salmonella enterica enterica serovar Typhi
auagccagccccagaaaauuaa

SEQ ID NO: 3675939 - RNA, 17 nt, Salmonella enterica enterica serovar Typhi
auagccagcccccugcc

SEQ ID NO: 3675940 - RNA, 18 nt, Salmonella enterica enterica serovar Typhi
auagccagcgauccugcg

SEQ ID NO: 3675941 - RNA, 11 nt, Salmonella enterica enterica serovar Typhi
auagccaggca

SEQ ID NO: 3675942 - RNA, 14 nt, Salmonella enterica enterica serovar Typhi
auagccccaguaaa

SEQ ID NO: 3675943 - RNA, 21 nt, Salmonella enterica enterica serovar Typhi
auagccccggucaacgcgccg

SEQ ID NO: 3675944 - RNA, 22 nt, Salmonella enterica enterica serovar Typhi
auagcccggcauguccaucaga

SEQ ID NO: 3675945 - RNA, 12 nt, Salmonella enterica enterica serovar Typhi
auagcccggcuu

SEQ ID NO: 3675946 - RNA, 15 nt, Salmonella enterica enterica serovar Typhi
auagccgaaacuuau

SEQ ID NO: 3675947 - RNA, 17 nt, Salmonella enterica enterica serovar Typhi
auagccgacccgcaucg

SEQ ID NO: 3675948 - RNA, 23 nt, Salmonella enterica enterica serovar Typhi
auagccggauaauuuauccagua

SEQ ID NO: 3675949 - RNA, 16 nt, Salmonella enterica enterica serovar Typhi
auagccgguaacuuuc

SEQ ID NO: 3675950 - RNA, 17 nt, Salmonella enterica enterica serovar Typhi
auagccguagcccuuga

SEQ ID NO: 3675951 - RNA, 21 nt, Salmonella enterica enterica serovar Typhi
auagccuugauccuguaacgc

SEQ ID NO: 3675952 - RNA, 20 nt, Salmonella enterica enterica serovar Typhi
auagccuuuauugaugacau

SEQ ID NO: 3675953 - RNA, 14 nt, Salmonella enterica enterica serovar Typhi
auagcgaccagcgu

SEQ ID NO: 3675954 - RNA, 13 nt, Salmonella enterica enterica serovar Typhi
auagcgagaggca

SEQ ID NO: 3675955 - RNA, 18 nt, Salmonella enterica enterica serovar Typhi
auagcgaggcagcaggau

SEQ ID NO: 3675956 - RNA, 23 nt, Salmonella enterica enterica serovar Typhi
auagcgccagacagauaacacca

SEQ ID NO: 3675957 - RNA, 12 nt, Salmonella enterica enterica serovar Typhi
auagcgccaucc

SEQ ID NO: 3675958 - RNA, 13 nt, Salmonella enterica enterica serovar Typhi
auagcgccauccu

SEQ ID NO: 3675959 - RNA, 15 nt, Salmonella enterica enterica serovar Typhi
auagcgccauccugc

SEQ ID NO: 3675960 - RNA, 14 nt, Salmonella enterica enterica serovar Typhi
auagcgccgcaucg

SEQ ID NO: 3675961 - RNA, 14 nt, Salmonella enterica enterica serovar Typhi
auagcgcggaauau

SEQ ID NO: 3675962 - RNA, 23 nt, Salmonella enterica enterica serovar Typhi
auagcgcuaugcgcuccaggaug

SEQ ID NO: 3675963 - RNA, 16 nt, Salmonella enterica enterica serovar Typhi
auagcgcugaugcguu

SEQ ID NO: 3675964 - RNA, 22 nt, Salmonella enterica enterica serovar Typhi
auagcgcuggcgccgcaaacca

SEQ ID NO: 3675965 - RNA, 15 nt, Salmonella enterica enterica serovar Typhi
auagcgcuuuccugc

SEQ ID NO: 3675966 - RNA, 20 nt, Salmonella enterica enterica serovar Typhi
auagcggcguuuauauaaaa

SEQ ID NO: 3675967 - RNA, 14 nt, Salmonella enterica enterica serovar Typhi
auagcgggugauua

SEQ ID NO: 3675968 - RNA, 18 nt, Salmonella enterica enterica serovar Typhi
auagcgguucaaucacgc

SEQ ID NO: 3675969 - RNA, 17 nt, Salmonella enterica enterica serovar Typhi
auagcguagcgccaucc

SEQ ID NO: 3675970 - RNA, 13 nt, Salmonella enterica enterica serovar Typhi
auagcguuuucca

SEQ ID NO: 3675971 - RNA, 16 nt, Salmonella enterica enterica serovar Typhi
auagcuaaauaaaaau

SEQ ID NO: 3675972 - RNA, 15 nt, Salmonella enterica enterica serovar Typhi
auagcuaaugcaaua

SEQ ID NO: 3675973 - RNA, 20 nt, Salmonella enterica enterica serovar Typhi
auagcuaaugcgguugcgau

SEQ ID NO: 3675974 - RNA, 18 nt, Salmonella enterica enterica serovar Typhi
auagcuacgaccggucag

SEQ ID NO: 3675975 - RNA, 15 nt, Salmonella enterica enterica serovar Typhi
auagcuauggucacu

SEQ ID NO: 3675976 - RNA, 20 nt, Salmonella enterica enterica serovar Typhi
auagcuucaaugauccacgg

SEQ ID NO: 3675977 - RNA, 23 nt, Salmonella enterica enterica serovar Typhi
auagcuuuuggcguaauggcggg

SEQ ID NO: 3675978 - RNA, 19 nt, Salmonella enterica enterica serovar Typhi
auaggauguugcugcugcg

SEQ ID NO: 3675979 - RNA, 22 nt, Salmonella enterica enterica serovar Typhi
auaggcaauauccuccggcgua

SEQ ID NO: 3675980 - RNA, 12 nt, Salmonella enterica enterica serovar Typhi
auaggccaggcu

SEQ ID NO: 3675981 - RNA, 23 nt, Salmonella enterica enterica serovar Typhi
auaggccucgaccaguuuuuccg

SEQ ID NO: 3675982 - RNA, 14 nt, Salmonella enterica enterica serovar Typhi
auagguacggggca

SEQ ID NO: 3675983 - RNA, 15 nt, Salmonella enterica enterica serovar Typhi
auagguacggggcau

SEQ ID NO: 3675984 - RNA, 21 nt, Salmonella enterica enterica serovar Typhi
auagguucaauaugccaggca

SEQ ID NO: 3675985 - RNA, 12 nt, Salmonella enterica enterica serovar Typhi
auagguugaaag

SEQ ID NO: 3675986 - RNA, 22 nt, Salmonella enterica enterica serovar Typhi
auagguugaauaaccauacuga

SEQ ID NO: 3675987 - RNA, 18 nt, Salmonella enterica enterica serovar Typhi
auaguaaauagaaaauaa

SEQ ID NO: 3675988 - RNA, 17 nt, Salmonella enterica enterica serovar Typhi
auaguaacguaugcugg

SEQ ID NO: 3675989 - RNA, 18 nt, Salmonella enterica enterica serovar Typhi
auaguacccucugcacca

SEQ ID NO: 3675990 - RNA, 21 nt, Salmonella enterica enterica serovar Typhi
auaguacccucugcaccagaa

SEQ ID NO: 3675991 - RNA, 23 nt, Salmonella enterica enterica serovar Typhi
auaguacccucugcaccagaacu

SEQ ID NO: 3675992 - RNA, 22 nt, Salmonella enterica enterica serovar Typhi
auaguacgauagcaauuaauaa

SEQ ID NO: 3675993 - RNA, 18 nt, Salmonella enterica enterica serovar Typhi
auaguauccauaauuuuc

SEQ ID NO: 3675994 - RNA, 20 nt, Salmonella enterica enterica serovar Typhi
auagucauaauacucaauau

SEQ ID NO: 3675995 - RNA, 16 nt, Salmonella enterica enterica serovar Typhi
auaguccacuuucugu

SEQ ID NO: 3675996 - RNA, 15 nt, Salmonella enterica enterica serovar Typhi
auaugaaagagaaau

SEQ ID NO: 3675997 - RNA, 13 nt, Salmonella enterica enterica serovar Typhi
auaugaaccaaga

SEQ ID NO: 3675998 - RNA, 17 nt, Salmonella enterica enterica serovar Typhi
auaugaaccaagauaag

SEQ ID NO: 3675999 - RNA, 15 nt, Salmonella enterica enterica serovar Typhi
auaugaauaaacugu

SEQ ID NO: 3676000 - RNA, 20 nt, Salmonella enterica enterica serovar Typhi
auaugaauaauuucggcggc

SEQ ID NO: 3676001 - RNA, 17 nt, Salmonella enterica enterica serovar Typhi
auaugaaucaucagaau

SEQ ID NO: 3676002 - RNA, 20 nt, Salmonella enterica enterica serovar Typhi
auaugaauuauuuucuaaaa

SEQ ID NO: 3676003 - RNA, 18 nt, Salmonella enterica enterica serovar Typhi
auaugaucugcacaacau

SEQ ID NO: 3676004 - RNA, 16 nt, Salmonella enterica enterica serovar Typhi
auaugauuuaaaaaag

SEQ ID NO: 3676005 - RNA, 14 nt, Salmonella enterica enterica serovar Typhi
auaugcaggcauaa

SEQ ID NO: 3676006 - RNA, 17 nt, Salmonella enterica enterica serovar Typhi
auaugcaggcauaaaaa

SEQ ID NO: 3676007 - RNA, 21 nt, Salmonella enterica enterica serovar Typhi
auaugcagugcugcugccauu

SEQ ID NO: 3676008 - RNA, 14 nt, Salmonella enterica enterica serovar Typhi
auaugccaaguaau

SEQ ID NO: 3676009 - RNA, 19 nt, Salmonella enterica enterica serovar Typhi
auaugccaaguaauaaaga

SEQ ID NO: 3676010 - RNA, 22 nt, Salmonella enterica enterica serovar Typhi
auaugccaaguaauaaagagaa

SEQ ID NO: 3676011 - RNA, 13 nt, Salmonella enterica enterica serovar Typhi
auaugccaggcau

SEQ ID NO: 3676012 - RNA, 18 nt, Salmonella enterica enterica serovar Typhi
auaugccccgacaucaga

SEQ ID NO: 3676013 - RNA, 17 nt, Salmonella enterica enterica serovar Typhi
auaugccggauaguuac

SEQ ID NO: 3676014 - RNA, 13 nt, Salmonella enterica enterica serovar Typhi
auaugccugccaa

SEQ ID NO: 3676015 - RNA, 13 nt, Salmonella enterica enterica serovar Typhi
auaugcgcaauca

SEQ ID NO: 3676016 - RNA, 12 nt, Salmonella enterica enterica serovar Typhi
auaugcgcauca

SEQ ID NO: 3676017 - RNA, 14 nt, Salmonella enterica enterica serovar Typhi
auaugcggcgccau

SEQ ID NO: 3676018 - RNA, 23 nt, Salmonella enterica enterica serovar Typhi
auaugcggucguauuaccaaccc

SEQ ID NO: 3676019 - RNA, 18 nt, Salmonella enterica enterica serovar Typhi
auaugcuguuuauggcgc

SEQ ID NO: 3676020 - RNA, 20 nt, Salmonella enterica enterica serovar Typhi
auauggauauucaucgccgu

SEQ ID NO: 3676021 - RNA, 17 nt, Salmonella enterica enterica serovar Typhi
auauggaugagucuugc

SEQ ID NO: 3676022 - RNA, 15 nt, Salmonella enterica enterica serovar Typhi
auaugguuauccagc

SEQ ID NO: 3676023 - RNA, 13 nt, Salmonella enterica enterica serovar Typhi
auauguaaaucgg

SEQ ID NO: 3676024 - RNA, 22 nt, Salmonella enterica enterica serovar Typhi
auauguccaugcgcaguaggca

SEQ ID NO: 3676025 - RNA, 17 nt, Salmonella enterica enterica serovar Typhi
auauguuugacaagcag

SEQ ID NO: 3676026 - RNA, 14 nt, Salmonella enterica enterica serovar Typhi
auauuaauuaagga

SEQ ID NO: 3676027 - RNA, 14 nt, Salmonella enterica enterica serovar Typhi
auauuacaacaugu

SEQ ID NO: 3676028 - RNA, 15 nt, Salmonella enterica enterica serovar Typhi
auauuacuaauaaaa

SEQ ID NO: 3676029 - RNA, 19 nt, Salmonella enterica enterica serovar Typhi
auauuagcgguacucuuuu

SEQ ID NO: 3676030 - RNA, 16 nt, Salmonella enterica enterica serovar Typhi
auauuaguguuauaua

SEQ ID NO: 3676031 - RNA, 12 nt, Salmonella enterica enterica serovar Typhi
auauuauaaaau

SEQ ID NO: 3676032 - RNA, 14 nt, Salmonella enterica enterica serovar Typhi
auauuauaaaauaa

SEQ ID NO: 3676033 - RNA, 12 nt, Salmonella enterica enterica serovar Typhi
auauuauauuuu

SEQ ID NO: 3676034 - RNA, 19 nt, Salmonella enterica enterica serovar Typhi
auauuaucgcgcugaauaa

SEQ ID NO: 3676035 - RNA, 19 nt, Salmonella enterica enterica serovar Typhi
auauuauucugcugaaaaa

SEQ ID NO: 3676036 - RNA, 15 nt, Salmonella enterica enterica serovar Typhi
auauucaaaauccgc

SEQ ID NO: 3676037 - RNA, 14 nt, Salmonella enterica enterica serovar Typhi
auauucaccuguaa

SEQ ID NO: 3676038 - RNA, 22 nt, Salmonella enterica enterica serovar Typhi
auauucacuauaugccugccaa

SEQ ID NO: 3676039 - RNA, 13 nt, Salmonella enterica enterica serovar Typhi
auauucagaauuu

SEQ ID NO: 3676040 - RNA, 19 nt, Salmonella enterica enterica serovar Typhi
auauucaucaguuuaaccg

SEQ ID NO: 3676041 - RNA, 11 nt, Salmonella enterica enterica serovar Typhi
auauuccagaa

SEQ ID NO: 3676042 - RNA, 16 nt, Salmonella enterica enterica serovar Typhi
auauuccgcgcuaucg

SEQ ID NO: 3676043 - RNA, 20 nt, Salmonella enterica enterica serovar Typhi
auauuccucuuccucgauau

SEQ ID NO: 3676044 - RNA, 11 nt, Salmonella enterica enterica serovar Typhi
auauuccuggc

SEQ ID NO: 3676045 - RNA, 18 nt, Salmonella enterica enterica serovar Typhi
auauucgcagcucugugu

SEQ ID NO: 3676046 - RNA, 23 nt, Salmonella enterica enterica serovar Typhi
auauucgcgaugcucaaccagua

SEQ ID NO: 3676047 - RNA, 21 nt, Salmonella enterica enterica serovar Typhi
auauucugggcuuacuuucca

SEQ ID NO: 3676048 - RNA, 20 nt, Salmonella enterica enterica serovar Typhi
auauucuguuagcgcccucu

SEQ ID NO: 3676049 - RNA, 21 nt, Salmonella enterica enterica serovar Typhi
auauucuucuuagaauagaau

SEQ ID NO: 3676050 - RNA, 19 nt, Salmonella enterica enterica serovar Typhi
auauugaccgcuuuuucca

SEQ ID NO: 3676051 - RNA, 21 nt, Salmonella enterica enterica serovar Typhi
auauugaccgcuuuuuccagc

SEQ ID NO: 3676052 - RNA, 17 nt, Salmonella enterica enterica serovar Typhi
auauugauggccacauc

SEQ ID NO: 3676053 - RNA, 18 nt, Salmonella enterica enterica serovar Typhi
auauugauggccacaucg

SEQ ID NO: 3676054 - RNA, 12 nt, Salmonella enterica enterica serovar Typhi
auauugcauuuu

SEQ ID NO: 3676055 - RNA, 14 nt, Salmonella enterica enterica serovar Typhi
auauugcauuuuau

SEQ ID NO: 3676056 - RNA, 20 nt, Salmonella enterica enterica serovar Typhi
auauugcauuuuaucuuuug

SEQ ID NO: 3676057 - RNA, 14 nt, Salmonella enterica enterica serovar Typhi
auauugccauaaau

SEQ ID NO: 3676058 - RNA, 20 nt, Salmonella enterica enterica serovar Typhi
auauugccauaaauacaauu

SEQ ID NO: 3676059 - RNA, 19 nt, Salmonella enterica enterica serovar Typhi
auauugccauucgccagcc

SEQ ID NO: 3676060 - RNA, 21 nt, Salmonella enterica enterica serovar Typhi
auauugccgaccgccagcaga

SEQ ID NO: 3676061 - RNA, 19 nt, Salmonella enterica enterica serovar Typhi
auauugcgacaacuagaau

SEQ ID NO: 3676062 - RNA, 22 nt, Salmonella enterica enterica serovar Typhi
auauugcgacaacuagaauuuu

SEQ ID NO: 3676063 - RNA, 16 nt, Salmonella enterica enterica serovar Typhi
auauugcguaaaaacc

SEQ ID NO: 3676064 - RNA, 14 nt, Salmonella enterica enterica serovar Typhi
auauuggcguuaga

SEQ ID NO: 3676065 - RNA, 20 nt, Salmonella enterica enterica serovar Typhi
auauuggcuucuuuaacuaa

SEQ ID NO: 3676066 - RNA, 13 nt, Salmonella enterica enterica serovar Typhi
auauugguagcau

SEQ ID NO: 3676067 - RNA, 23 nt, Salmonella enterica enterica serovar Typhi
auauugugccucuuuuuucgcca

SEQ ID NO: 3676068 - RNA, 15 nt, Salmonella enterica enterica serovar Typhi
auauuguugaaauua

SEQ ID NO: 3676069 - RNA, 15 nt, Salmonella enterica enterica serovar Typhi
auauuuaaaauucca

SEQ ID NO: 3676070 - RNA, 17 nt, Salmonella enterica enterica serovar Typhi
auauuuaaucgcuuuua

SEQ ID NO: 3676071 - RNA, 16 nt, Salmonella enterica enterica serovar Typhi
auauuuaccgccgcuu

SEQ ID NO: 3676072 - RNA, 15 nt, Salmonella enterica enterica serovar Typhi
auauuuacugaauaa

SEQ ID NO: 3676073 - RNA, 13 nt, Salmonella enterica enterica serovar Typhi
auauuuauuuaau

SEQ ID NO: 3676074 - RNA, 17 nt, Salmonella enterica enterica serovar Typhi
auauuuauuuaauguuu

SEQ ID NO: 3676075 - RNA, 18 nt, Salmonella enterica enterica serovar Typhi
auauuuauuuaauguuuc

SEQ ID NO: 3676076 - RNA, 18 nt, Salmonella enterica enterica serovar Typhi
auauuuauuugcauugua

SEQ ID NO: 3676077 - RNA, 13 nt, Salmonella enterica enterica serovar Typhi
auauuuccgcgau

SEQ ID NO: 3676078 - RNA, 21 nt, Salmonella enterica enterica serovar Typhi
auauuucuguaaucgauacua

SEQ ID NO: 3676079 - RNA, 13 nt, Salmonella enterica enterica serovar Typhi
auauuuguaucug

SEQ ID NO: 3676080 - RNA, 20 nt, Salmonella enterica enterica serovar Typhi
auauuugugaccaacaucau

SEQ ID NO: 3676081 - RNA, 19 nt, Salmonella enterica enterica serovar Typhi
auauuuguuggaaaugcgu

SEQ ID NO: 3676082 - RNA, 22 nt, Salmonella enterica enterica serovar Typhi
aucaccgcugacugaacucauc

SEQ ID NO: 3676083 - RNA, 13 nt, Salmonella enterica enterica serovar Typhi
aucaccggcauuu

SEQ ID NO: 3676084 - RNA, 16 nt, Salmonella enterica enterica serovar Typhi
aucaccguuuuccagg

SEQ ID NO: 3676085 - RNA, 23 nt, Salmonella enterica enterica serovar Typhi
aucaccucagguaaauccgccag

SEQ ID NO: 3676086 - RNA, 19 nt, Salmonella enterica enterica serovar Typhi
aucaccucgcuucccugac

SEQ ID NO: 3676087 - RNA, 16 nt, Salmonella enterica enterica serovar Typhi
aucaccucuuucucca

SEQ ID NO: 3676088 - RNA, 18 nt, Salmonella enterica enterica serovar Typhi
aucaccugaaugcaaaga

SEQ ID NO: 3676089 - RNA, 21 nt, Salmonella enterica enterica serovar Typhi
aucaccugaccgauauagcca

SEQ ID NO: 3676090 - RNA, 23 nt, Salmonella enterica enterica serovar Typhi
aucaccugcuggcggcguaagcg

SEQ ID NO: 3676091 - RNA, 18 nt, Salmonella enterica enterica serovar Typhi
aucaccuucuuuggcuua

SEQ ID NO: 3676092 - RNA, 13 nt, Salmonella enterica enterica serovar Typhi
aucacgcaucacu

SEQ ID NO: 3676093 - RNA, 21 nt, Salmonella enterica enterica serovar Typhi
aucacgccacaguauuccggc

SEQ ID NO: 3676094 - RNA, 22 nt, Salmonella enterica enterica serovar Typhi
aucacgccacaguauuccggca

SEQ ID NO: 3676095 - RNA, 17 nt, Salmonella enterica enterica serovar Typhi
aucacgccguccagcac

SEQ ID NO: 3676096 - RNA, 19 nt, Salmonella enterica enterica serovar Typhi
aucacgcguaucuggucau

SEQ ID NO: 3676097 - RNA, 18 nt, Salmonella enterica enterica serovar Typhi
aucacgcucaucggcggc

SEQ ID NO: 3676098 - RNA, 23 nt, Salmonella enterica enterica serovar Typhi
aucacgcugaaaacggcaucaag

SEQ ID NO: 3676099 - RNA, 18 nt, Salmonella enterica enterica serovar Typhi
aucacgcuggauaagacg

SEQ ID NO: 3676100 - RNA, 23 nt, Salmonella enterica enterica serovar Typhi
aucacggccuucgcagaucgccu

SEQ ID NO: 3676101 - RNA, 15 nt, Salmonella enterica enterica serovar Typhi
aucacgguacgcauc

SEQ ID NO: 3676102 - RNA, 15 nt, Salmonella enterica enterica serovar Typhi
aucacguagccagag

SEQ ID NO: 3676103 - RNA, 22 nt, Salmonella enterica enterica serovar Typhi
aucacguguuacgccgcaauca

SEQ ID NO: 3676104 - RNA, 21 nt, Salmonella enterica enterica serovar Typhi
aucacguuggggaauaaauau

SEQ ID NO: 3676105 - RNA, 19 nt, Salmonella enterica enterica serovar Typhi
aucacguuuugcagcgcca

SEQ ID NO: 3676106 - RNA, 13 nt, Salmonella enterica enterica serovar Typhi
aucacuaauuugc

SEQ ID NO: 3676107 - RNA, 16 nt, Salmonella enterica enterica serovar Typhi
aucacuaccgccauca

SEQ ID NO: 3676108 - RNA, 18 nt, Salmonella enterica enterica serovar Typhi
aucacuaccgccgcggau

SEQ ID NO: 3676109 - RNA, 21 nt, Salmonella enterica enterica serovar Typhi
aucacuaucaguuuuggcaau

SEQ ID NO: 3676110 - RNA, 19 nt, Salmonella enterica enterica serovar Typhi
aucacuauuugugcggcau

SEQ ID NO: 3676111 - RNA, 13 nt, Salmonella enterica enterica serovar Typhi
aucacucucuugu

SEQ ID NO: 3676112 - RNA, 13 nt, Salmonella enterica enterica serovar Typhi
aucacugauauaa

SEQ ID NO: 3676113 - RNA, 13 nt, Salmonella enterica enterica serovar Typhi
aucacugcaccuc

SEQ ID NO: 3676114 - RNA, 14 nt, Salmonella enterica enterica serovar Typhi
aucacugccgccac

SEQ ID NO: 3676115 - RNA, 20 nt, Salmonella enterica enterica serovar Typhi
aucacuggagcgcauuuuac

SEQ ID NO: 3676116 - RNA, 17 nt, Salmonella enterica enterica serovar Typhi
aucacuuacuaagguaa

SEQ ID NO: 3676117 - RNA, 10 nt, Salmonella enterica enterica serovar Typhi
aucacuucca

SEQ ID NO: 3676118 - RNA, 13 nt, Salmonella enterica enterica serovar Typhi
aucacuuccgcca

SEQ ID NO: 3676119 - RNA, 14 nt, Salmonella enterica enterica serovar Typhi
aucacuuccgccac

SEQ ID NO: 3676120 - RNA, 20 nt, Salmonella enterica enterica serovar Typhi
aucacuuuacccacaucaau

SEQ ID NO: 3676121 - RNA, 17 nt, Salmonella enterica enterica serovar Typhi
aucacuuucacccaugc

SEQ ID NO: 3676122 - RNA, 16 nt, Salmonella enterica enterica serovar Typhi
aucacuuuugauaaug

SEQ ID NO: 3676123 - RNA, 16 nt, Salmonella enterica enterica serovar Typhi
aucacuuuugccguca

SEQ ID NO: 3676124 - RNA, 15 nt, Salmonella enterica enterica serovar Typhi
aucagaaaaaccucc

SEQ ID NO: 3676125 - RNA, 18 nt, Salmonella enterica enterica serovar Typhi
aucagaaaaaccuccggc

SEQ ID NO: 3676126 - RNA, 19 nt, Salmonella enterica enterica serovar Typhi
aucagaaaaaccuccggcu

SEQ ID NO: 3676127 - RNA, 19 nt, Salmonella enterica enterica serovar Typhi
aucagaagcuaagggaugc

SEQ ID NO: 3676128 - RNA, 12 nt, Salmonella enterica enterica serovar Typhi
aucagaagcuuc

SEQ ID NO: 3676129 - RNA, 15 nt, Salmonella enterica enterica serovar Typhi
aucagaauaguuuug

SEQ ID NO: 3676130 - RNA, 14 nt, Salmonella enterica enterica serovar Typhi
aucagaauauccgg

SEQ ID NO: 3676131 - RNA, 17 nt, Salmonella enterica enterica serovar Typhi
aucagaauuucgcccug

SEQ ID NO: 3676132 - RNA, 22 nt, Salmonella enterica enterica serovar Typhi
aucagaccaucggccgcuaucu

SEQ ID NO: 3676133 - RNA, 16 nt, Salmonella enterica enterica serovar Typhi
aucagaccgacaaaac

SEQ ID NO: 3676134 - RNA, 17 nt, Salmonella enterica enterica serovar Typhi
aucagaccuguaaaaaa

SEQ ID NO: 3676135 - RNA, 18 nt, Salmonella enterica enterica serovar Typhi
aucagaccuguaaaaaaa

SEQ ID NO: 3676136 - RNA, 13 nt, Salmonella enterica enterica serovar Typhi
aucagacgcauca

SEQ ID NO: 3676137 - RNA, 16 nt, Salmonella enterica enterica serovar Typhi
aucagacuguuacgcu

SEQ ID NO: 3676138 - RNA, 14 nt, Salmonella enterica enterica serovar Typhi
aucagagacaaaua

SEQ ID NO: 3676139 - RNA, 19 nt, Salmonella enterica enterica serovar Typhi
aucagauacggcuccagca

SEQ ID NO: 3676140 - RNA, 20 nt, Salmonella enterica enterica serovar Typhi
aucagauacggcuccagcac

SEQ ID NO: 3676141 - RNA, 18 nt, Salmonella enterica enterica serovar Typhi
aucagauaggcggcaaau

SEQ ID NO: 3676142 - RNA, 18 nt, Salmonella enterica enterica serovar Typhi
aucagauaucccugcaaa

SEQ ID NO: 3676143 - RNA, 18 nt, Salmonella enterica enterica serovar Typhi
aucagauauuccagcgac

SEQ ID NO: 3676144 - RNA, 22 nt, Salmonella enterica enterica serovar Typhi
aucagauggcgauucauaugcg

SEQ ID NO: 3676145 - RNA, 20 nt, Salmonella enterica enterica serovar Typhi
aucagauugauacggguaau

SEQ ID NO: 3676146 - RNA, 15 nt, Salmonella enterica enterica serovar Typhi
aucagcaaaauaccg

SEQ ID NO: 3676147 - RNA, 20 nt, Salmonella enterica enterica serovar Typhi
aucagcaaacgaccuuucgc

SEQ ID NO: 3676148 - RNA, 14 nt, Salmonella enterica enterica serovar Typhi
aucagcaaaugaac

SEQ ID NO: 3676149 - RNA, 15 nt, Salmonella enterica enterica serovar Typhi
aucagcaacgcgcca

SEQ ID NO: 3676150 - RNA, 13 nt, Salmonella enterica enterica serovar Typhi
aucagcagaucca

SEQ ID NO: 3676151 - RNA, 17 nt, Salmonella enterica enterica serovar Typhi
aucagcaguugcgacug

SEQ ID NO: 3676152 - RNA, 13 nt, Salmonella enterica enterica serovar Typhi
aucagcaucccac

SEQ ID NO: 3676153 - RNA, 15 nt, Salmonella enterica enterica serovar Typhi
aucagcaucccaccg

SEQ ID NO: 3676154 - RNA, 21 nt, Salmonella enterica enterica serovar Typhi
aucagcauuacccccgccaua

SEQ ID NO: 3676155 - RNA, 21 nt, Salmonella enterica enterica serovar Typhi
aucagccagccgccaaaaaua

SEQ ID NO: 3676156 - RNA, 13 nt, Salmonella enterica enterica serovar Typhi
aucagccaggagu

SEQ ID NO: 3676157 - RNA, 13 nt, Salmonella enterica enterica serovar Typhi
aucagccauuaac

SEQ ID NO: 3676158 - RNA, 17 nt, Salmonella enterica enterica serovar Typhi
aucagccauuaaccaga

SEQ ID NO: 3676159 - RNA, 14 nt, Salmonella enterica enterica serovar Typhi
aucagccccagcac

SEQ ID NO: 3676160 - RNA, 13 nt, Salmonella enterica enterica serovar Typhi
aucagcccgcaaa

SEQ ID NO: 3676161 - RNA, 23 nt, Salmonella enterica enterica serovar Typhi
aucagcccgcaaaggaccaacac

SEQ ID NO: 3676162 - RNA, 18 nt, Salmonella enterica enterica serovar Typhi
aucagcccuaucgcugcg

SEQ ID NO: 3676163 - RNA, 18 nt, Salmonella enterica enterica serovar Typhi
aucagccguuacuucccc

SEQ ID NO: 3676164 - RNA, 20 nt, Salmonella enterica enterica serovar Typhi
aucagccguuacuuccccca

SEQ ID NO: 3676165 - RNA, 15 nt, Salmonella enterica enterica serovar Typhi
aucagcgaaggcaac

SEQ ID NO: 3676166 - RNA, 14 nt, Salmonella enterica enterica serovar Typhi
aucagcgacucauu

SEQ ID NO: 3676167 - RNA, 14 nt, Salmonella enterica enterica serovar Typhi
aucagcgagacagc

SEQ ID NO: 3676168 - RNA, 15 nt, Salmonella enterica enterica serovar Typhi
aucaucguaccaaua

SEQ ID NO: 3676169 - RNA, 12 nt, Salmonella enterica enterica serovar Typhi
aucaucuaccuu

SEQ ID NO: 3676170 - RNA, 19 nt, Salmonella enterica enterica serovar Typhi
aucaucucccaggccgcca

SEQ ID NO: 3676171 - RNA, 20 nt, Salmonella enterica enterica serovar Typhi
aucaucucugucgaccaucg

SEQ ID NO: 3676172 - RNA, 21 nt, Salmonella enterica enterica serovar Typhi
aucaucuucacuucacaaaca

SEQ ID NO: 3676173 - RNA, 15 nt, Salmonella enterica enterica serovar Typhi
aucaucuuuuaccgc

SEQ ID NO: 3676174 - RNA, 18 nt, Salmonella enterica enterica serovar Typhi
aucaucuuuuaccgccug

SEQ ID NO: 3676175 - RNA, 14 nt, Salmonella enterica enterica serovar Typhi
aucaugaaaaacag

SEQ ID NO: 3676176 - RNA, 14 nt, Salmonella enterica enterica serovar Typhi
aucaugaaaaauau

SEQ ID NO: 3676177 - RNA, 22 nt, Salmonella enterica enterica serovar Typhi
aucaugauuucuugagcggcau

SEQ ID NO: 3676178 - RNA, 21 nt, Salmonella enterica enterica serovar Typhi
aucaugcccaaaccugagcau

SEQ ID NO: 3676179 - RNA, 18 nt, Salmonella enterica enterica serovar Typhi
aucaugcccacaggcagg

SEQ ID NO: 3676180 - RNA, 13 nt, Salmonella enterica enterica serovar Typhi
aucaugcccggca

SEQ ID NO: 3676181 - RNA, 16 nt, Salmonella enterica enterica serovar Typhi
aucaugccgcccaggc

SEQ ID NO: 3676182 - RNA, 15 nt, Salmonella enterica enterica serovar Typhi
aucaugcugaugacu

SEQ ID NO: 3676183 - RNA, 20 nt, Salmonella enterica enterica serovar Typhi
aucaugcugcaccgcaucaa

SEQ ID NO: 3676184 - RNA, 16 nt, Salmonella enterica enterica serovar Typhi
aucaugcuugcuuugc

SEQ ID NO: 3676185 - RNA, 14 nt, Salmonella enterica enterica serovar Typhi
aucauggcucagau

SEQ ID NO: 3676186 - RNA, 22 nt, Salmonella enterica enterica serovar Typhi
aucauggcuugaucgcgcagca

SEQ ID NO: 3676187 - RNA, 16 nt, Salmonella enterica enterica serovar Typhi
aucauggguaauuccg

SEQ ID NO: 3676188 - RNA, 15 nt, Salmonella enterica enterica serovar Typhi
aucaugguugaaaaa

SEQ ID NO: 3676189 - RNA, 15 nt, Salmonella enterica enterica serovar Typhi
aucaugugaucuaua

SEQ ID NO: 3676190 - RNA, 18 nt, Salmonella enterica enterica serovar Typhi
aucauuaauaaccccagc

SEQ ID NO: 3676191 - RNA, 13 nt, Salmonella enterica enterica serovar Typhi
aucauuacaggcg

SEQ ID NO: 3676192 - RNA, 18 nt, Salmonella enterica enterica serovar Typhi
aucauuacuuauauuuau

SEQ ID NO: 3676193 - RNA, 19 nt, Salmonella enterica enterica serovar Typhi
aucauuauauagucuuaau

SEQ ID NO: 3676194 - RNA, 15 nt, Salmonella enterica enterica serovar Typhi
aucauuaucgccaaa

SEQ ID NO: 3676195 - RNA, 13 nt, Salmonella enterica enterica serovar Typhi
aucauuauucccc

SEQ ID NO: 3676196 - RNA, 16 nt, Salmonella enterica enterica serovar Typhi
aucauuauuccccucc

SEQ ID NO: 3676197 - RNA, 17 nt, Salmonella enterica enterica serovar Typhi
aucauucaacgcaucaa

SEQ ID NO: 3676198 - RNA, 18 nt, Salmonella enterica enterica serovar Typhi
aucauucaacgcaucaaa

SEQ ID NO: 3676199 - RNA, 16 nt, Salmonella enterica enterica serovar Typhi
aucauucucuacgccc

SEQ ID NO: 3676200 - RNA, 14 nt, Salmonella enterica enterica serovar Typhi
aucauugacuucaa

SEQ ID NO: 3676201 - RNA, 21 nt, Salmonella enterica enterica serovar Typhi
aucauugccuguaucgcuauc

SEQ ID NO: 3676202 - RNA, 18 nt, Salmonella enterica enterica serovar Typhi
aucauuggggaaccuggc

SEQ ID NO: 3676203 - RNA, 18 nt, Salmonella enterica enterica serovar Typhi
aucauuggggggaaauua

SEQ ID NO: 3676204 - RNA, 22 nt, Salmonella enterica enterica serovar Typhi
aucauugguuaacucaagcgaa

SEQ ID NO: 3676205 - RNA, 18 nt, Salmonella enterica enterica serovar Typhi
aucauuuguacaaaaaau

SEQ ID NO: 3676206 - RNA, 21 nt, Salmonella enterica enterica serovar Typhi
auccaacacggcgcucaggau

SEQ ID NO: 3676207 - RNA, 15 nt, Salmonella enterica enterica serovar Typhi
auccaacgaaacgca

SEQ ID NO: 3676208 - RNA, 17 nt, Salmonella enterica enterica serovar Typhi
auccaacgcggaaaugu

SEQ ID NO: 3676209 - RNA, 13 nt, Salmonella enterica enterica serovar Typhi
auccaagccccuc

SEQ ID NO: 3676210 - RNA, 19 nt, Salmonella enterica enterica serovar Typhi
auccaauagacuucacuuu

SEQ ID NO: 3676211 - RNA, 14 nt, Salmonella enterica enterica serovar Typhi
auccacaaucgucg

SEQ ID NO: 3676212 - RNA, 20 nt, Salmonella enterica enterica serovar Typhi
auccacauuccagaccugaa

SEQ ID NO: 3676213 - RNA, 17 nt, Salmonella enterica enterica serovar Typhi
auccacauugguuuugc

SEQ ID NO: 3676214 - RNA, 19 nt, Salmonella enterica enterica serovar Typhi
auccaccaccagcaucacg

SEQ ID NO: 3676215 - RNA, 14 nt, Salmonella enterica enterica serovar Typhi
auccaccagcccca

SEQ ID NO: 3676216 - RNA, 16 nt, Salmonella enterica enterica serovar Typhi
auccaccaggcaugca

SEQ ID NO: 3676217 - RNA, 15 nt, Salmonella enterica enterica serovar Typhi
auccacgccuggcag

SEQ ID NO: 3676218 - RNA, 22 nt, Salmonella enterica enterica serovar Typhi
auccacgguucucaccguggca

SEQ ID NO: 3676219 - RNA, 20 nt, Salmonella enterica enterica serovar Typhi
auccacucccugcuuuuuca

SEQ ID NO: 3676220 - RNA, 23 nt, Salmonella enterica enterica serovar Typhi
auccagaaccguugcgcccauca

SEQ ID NO: 3676221 - RNA, 23 nt, Salmonella enterica enterica serovar Typhi
auccagaacugcgaaaucaccga

SEQ ID NO: 3676222 - RNA, 24 nt, Salmonella enterica enterica serovar Typhi
auccagaacugcgaaaucaccgac

SEQ ID NO: 3676223 - RNA, 18 nt, Salmonella enterica enterica serovar Typhi
auccagaauaccagaauc

SEQ ID NO: 3676224 - RNA, 21 nt, Salmonella enterica enterica serovar Typhi
auccagaauacgccgccgccc

SEQ ID NO: 3676225 - RNA, 16 nt, Salmonella enterica enterica serovar Typhi
auccagacaugcacau

SEQ ID NO: 3676226 - RNA, 14 nt, Salmonella enterica enterica serovar Typhi
auccagacccacag

SEQ ID NO: 3676227 - RNA, 13 nt, Salmonella enterica enterica serovar Typhi
auccagacccaga

SEQ ID NO: 3676228 - RNA, 22 nt, Salmonella enterica enterica serovar Typhi
auccagagcggauaaauaguga

SEQ ID NO: 3676229 - RNA, 22 nt, Salmonella enterica enterica serovar Typhi
auccagaggguaauuucuucca

SEQ ID NO: 3676230 - RNA, 18 nt, Salmonella enterica enterica serovar Typhi
auccagaucggcaugaug

SEQ ID NO: 3676231 - RNA, 16 nt, Salmonella enterica enterica serovar Typhi
auccagauguuauaaa

SEQ ID NO: 3676232 - RNA, 19 nt, Salmonella enterica enterica serovar Typhi
auccagauguuauaaacuu

SEQ ID NO: 3676233 - RNA, 14 nt, Salmonella enterica enterica serovar Typhi
auccagcaaaauaa

SEQ ID NO: 3676234 - RNA, 11 nt, Salmonella enterica enterica serovar Typhi
auccagcacag

SEQ ID NO: 3676235 - RNA, 16 nt, Salmonella enterica enterica serovar Typhi
auccagcaguugccau

SEQ ID NO: 3676236 - RNA, 23 nt, Salmonella enterica enterica serovar Typhi
auccagccccagcgccagcugcg

SEQ ID NO: 3676237 - RNA, 19 nt, Salmonella enterica enterica serovar Typhi
auccagcgaaccuuccauc

SEQ ID NO: 3676238 - RNA, 16 nt, Salmonella enterica enterica serovar Typhi
auccagcgcaaaggga

SEQ ID NO: 3676239 - RNA, 16 nt, Salmonella enterica enterica serovar Typhi
auccagcgcucaauca

SEQ ID NO: 3676240 - RNA, 23 nt, Salmonella enterica enterica serovar Typhi
auccagcguaggguagaucacgc

SEQ ID NO: 3676241 - RNA, 15 nt, Salmonella enterica enterica serovar Typhi
auccagcgucacagg

SEQ ID NO: 3676242 - RNA, 17 nt, Salmonella enterica enterica serovar Typhi
auccagcuacuggccac

SEQ ID NO: 3676243 - RNA, 19 nt, Salmonella enterica enterica serovar Typhi
auccagcucaguuuccagc

SEQ ID NO: 3676244 - RNA, 21 nt, Salmonella enterica enterica serovar Typhi
auccagcucuuucaauccuuc

SEQ ID NO: 3676245 - RNA, 16 nt, Salmonella enterica enterica serovar Typhi
auccaggaauuuuccc

SEQ ID NO: 3676246 - RNA, 15 nt, Salmonella enterica enterica serovar Typhi
auccaggagcauugg

SEQ ID NO: 3676247 - RNA, 20 nt, Salmonella enterica enterica serovar Typhi
auccaggccgucggcgccag

SEQ ID NO: 3676248 - RNA, 16 nt, Salmonella enterica enterica serovar Typhi
auccaggucuuccgcc

SEQ ID NO: 3676249 - RNA, 17 nt, Salmonella enterica enterica serovar Typhi
auccaggucuuccgccg

SEQ ID NO: 3676250 - RNA, 11 nt, Salmonella enterica enterica serovar Typhi
auccaggugga

SEQ ID NO: 3676251 - RNA, 19 nt, Salmonella enterica enterica serovar Typhi
auccagguggaucggaaau

SEQ ID NO: 3676252 - RNA, 21 nt, Salmonella enterica enterica serovar Typhi
auccaguaacgcguccaacug

SEQ ID NO: 3676253 - RNA, 18 nt, Salmonella enterica enterica serovar Typhi
auccaguauuuuuaucgu

SEQ ID NO: 3676254 - RNA, 17 nt, Salmonella enterica enterica serovar Typhi
auccggccugcggugua

SEQ ID NO: 3676255 - RNA, 21 nt, Salmonella enterica enterica serovar Typhi
auccggcgcgguauuucgccg

SEQ ID NO: 3676256 - RNA, 19 nt, Salmonella enterica enterica serovar Typhi
auccggcugccugccggau

SEQ ID NO: 3676257 - RNA, 21 nt, Salmonella enterica enterica serovar Typhi
auccgggauauaaaauuauug

SEQ ID NO: 3676258 - RNA, 14 nt, Salmonella enterica enterica serovar Typhi
auccgggcuggcaa

SEQ ID NO: 3676259 - RNA, 23 nt, Salmonella enterica enterica serovar Typhi
auccggguaauuuugccaucgcg

SEQ ID NO: 3676260 - RNA, 15 nt, Salmonella enterica enterica serovar Typhi
auccgguuacucgca

SEQ ID NO: 3676261 - RNA, 21 nt, Salmonella enterica enterica serovar Typhi
auccgguugacgauaaaaugc

SEQ ID NO: 3676262 - RNA, 15 nt, Salmonella enterica enterica serovar Typhi
auccguacuuucuac

SEQ ID NO: 3676263 - RNA, 20 nt, Salmonella enterica enterica serovar Typhi
auccguagcggauugccgcg

SEQ ID NO: 3676264 - RNA, 19 nt, Salmonella enterica enterica serovar Typhi
auccgucaaaaugaucaga

SEQ ID NO: 3676265 - RNA, 18 nt, Salmonella enterica enterica serovar Typhi
auccgucaggaugggcuu

SEQ ID NO: 3676266 - RNA, 18 nt, Salmonella enterica enterica serovar Typhi
auccgugaauguccugcg

SEQ ID NO: 3676267 - RNA, 16 nt, Salmonella enterica enterica serovar Typhi
auccguuaagcccuga

SEQ ID NO: 3676268 - RNA, 12 nt, Salmonella enterica enterica serovar Typhi
auccguuauuua

SEQ ID NO: 3676269 - RNA, 18 nt, Salmonella enterica enterica serovar Typhi
auccguuauuucacagca

SEQ ID NO: 3676270 - RNA, 15 nt, Salmonella enterica enterica serovar Typhi
auccucaauguuaac

SEQ ID NO: 3676271 - RNA, 17 nt, Salmonella enterica enterica serovar Typhi
auccucacuugccgagu

SEQ ID NO: 3676272 - RNA, 23 nt, Salmonella enterica enterica serovar Typhi
auccucauuuuguugcuccagca

SEQ ID NO: 3676273 - RNA, 16 nt, Salmonella enterica enterica serovar Typhi
auccucgcauccucca

SEQ ID NO: 3676274 - RNA, 13 nt, Salmonella enterica enterica serovar Typhi
auccucuauuuuu

SEQ ID NO: 3676275 - RNA, 22 nt, Salmonella enterica enterica serovar Typhi
auccugaaccagcggcaccagc

SEQ ID NO: 3676276 - RNA, 19 nt, Salmonella enterica enterica serovar Typhi
auccugaagacaugcuguu

SEQ ID NO: 3676277 - RNA, 12 nt, Salmonella enterica enterica serovar Typhi
auccugaagaug

SEQ ID NO: 3676278 - RNA, 13 nt, Salmonella enterica enterica serovar Typhi
auccugaagaugg

SEQ ID NO: 3676279 - RNA, 17 nt, Salmonella enterica enterica serovar Typhi
auccugacuauugcuga

SEQ ID NO: 3676280 - RNA, 18 nt, Salmonella enterica enterica serovar Typhi
auccugacuauugcugag

SEQ ID NO: 3676281 - RNA, 10 nt, Salmonella enterica enterica serovar Typhi
auccugaucu

SEQ ID NO: 3676282 - RNA, 20 nt, Salmonella enterica enterica serovar Typhi
auccugcaaauagcgcugau

SEQ ID NO: 3676283 - RNA, 19 nt, Salmonella enterica enterica serovar Typhi
auccugcaccgccugcggc

SEQ ID NO: 3676284 - RNA, 14 nt, Salmonella enterica enterica serovar Typhi
auccugcacuucca

SEQ ID NO: 3676285 - RNA, 14 nt, Salmonella enterica enterica serovar Typhi
auccugccgcacca

SEQ ID NO: 3676286 - RNA, 22 nt, Salmonella enterica enterica serovar Typhi
auccugcguuaacgacccauca

SEQ ID NO: 3676287 - RNA, 20 nt, Salmonella enterica enterica serovar Typhi
auccuggauacguuccagca

SEQ ID NO: 3676288 - RNA, 23 nt, Salmonella enterica enterica serovar Typhi
auccuguaacaacuguuuuucac

SEQ ID NO: 3676289 - RNA, 24 nt, Salmonella enterica enterica serovar Typhi
auccuguaacaacuguuuuucacu

SEQ ID NO: 3676290 - RNA, 15 nt, Salmonella enterica enterica serovar Typhi
auccuguaccaccac

SEQ ID NO: 3676291 - RNA, 23 nt, Salmonella enterica enterica serovar Typhi
auccugugaaguaaaaaaaccgu

SEQ ID NO: 3676292 - RNA, 18 nt, Salmonella enterica enterica serovar Typhi
auccuguuaaucaucgcu

SEQ ID NO: 3676293 - RNA, 14 nt, Salmonella enterica enterica serovar Typhi
auccuuaucagacu

SEQ ID NO: 3676294 - RNA, 13 nt, Salmonella enterica enterica serovar Typhi
auccuuccagccc

SEQ ID NO: 3676295 - RNA, 11 nt, Salmonella enterica enterica serovar Typhi
auccuucgccg

SEQ ID NO: 3676296 - RNA, 14 nt, Salmonella enterica enterica serovar Typhi
auccuucuaccuuc

SEQ ID NO: 3676297 - RNA, 12 nt, Salmonella enterica enterica serovar Typhi
auccuucuucca

SEQ ID NO: 3676298 - RNA, 15 nt, Salmonella enterica enterica serovar Typhi
auccuucuuccauuc

SEQ ID NO: 3676299 - RNA, 18 nt, Salmonella enterica enterica serovar Typhi
auccuuuaauuaauccau

SEQ ID NO: 3676300 - RNA, 16 nt, Salmonella enterica enterica serovar Typhi
auccuuucucugguuu

SEQ ID NO: 3676301 - RNA, 17 nt, Salmonella enterica enterica serovar Typhi
auccuuuguuugccgcg

SEQ ID NO: 3676302 - RNA, 15 nt, Salmonella enterica enterica serovar Typhi
auccuuuuucaugca

SEQ ID NO: 3676303 - RNA, 13 nt, Salmonella enterica enterica serovar Typhi
aucgaaaaccggu

SEQ ID NO: 3676304 - RNA, 20 nt, Salmonella enterica enterica serovar Typhi
aucgaacgccgccugcgcca

SEQ ID NO: 3676305 - RNA, 19 nt, Salmonella enterica enterica serovar Typhi
aucgaacgggcgauggugc

SEQ ID NO: 3676306 - RNA, 16 nt, Salmonella enterica enterica serovar Typhi
aucgaacugugagccu

SEQ ID NO: 3676307 - RNA, 17 nt, Salmonella enterica enterica serovar Typhi
aucgaaggcaucuucag

SEQ ID NO: 3676308 - RNA, 15 nt, Salmonella enterica enterica serovar Typhi
aucgaauccagcagg

SEQ ID NO: 3676309 - RNA, 18 nt, Salmonella enterica enterica serovar Typhi
aucgaauggggaaauaaa

SEQ ID NO: 3676310 - RNA, 22 nt, Salmonella enterica enterica serovar Typhi
aucgacaaaagauuuaucaauu

SEQ ID NO: 3676311 - RNA, 18 nt, Salmonella enterica enterica serovar Typhi
aucgacaacgcguuuauu

SEQ ID NO: 3676312 - RNA, 14 nt, Salmonella enterica enterica serovar Typhi
aucgacaauccgcc

SEQ ID NO: 3676313 - RNA, 23 nt, Salmonella enterica enterica serovar Typhi
aucgacagacuucacccacugca

SEQ ID NO: 3676314 - RNA, 19 nt, Salmonella enterica enterica serovar Typhi
aucgacauaaguaaauaac

SEQ ID NO: 3676315 - RNA, 22 nt, Salmonella enterica enterica serovar Typhi
aucgacauuaacaaugccuuau

SEQ ID NO: 3676316 - RNA, 15 nt, Salmonella enterica enterica serovar Typhi
aucgacauuaugauc

SEQ ID NO: 3676317 - RNA, 18 nt, Salmonella enterica enterica serovar Typhi
aucgaccuuuucccguaa

SEQ ID NO: 3676318 - RNA, 13 nt, Salmonella enterica enterica serovar Typhi
aucgacgaaaugg

SEQ ID NO: 3676319 - RNA, 18 nt, Salmonella enterica enterica serovar Typhi
aucgacggccuugcuggc

SEQ ID NO: 3676320 - RNA, 15 nt, Salmonella enterica enterica serovar Typhi
aucgacguugaucgc

SEQ ID NO: 3676321 - RNA, 20 nt, Salmonella enterica enterica serovar Typhi
aucgacguugaucgccaucg

SEQ ID NO: 3676322 - RNA, 15 nt, Salmonella enterica enterica serovar Typhi
aucgacguuguucgc

SEQ ID NO: 3676323 - RNA, 23 nt, Salmonella enterica enterica serovar Typhi
aucgacuggcggaauggcgggcg

SEQ ID NO: 3676324 - RNA, 14 nt, Salmonella enterica enterica serovar Typhi
aucgagagcgggug

SEQ ID NO: 3676325 - RNA, 13 nt, Salmonella enterica enterica serovar Typhi
aucgagauaagau

SEQ ID NO: 3676326 - RNA, 18 nt, Salmonella enterica enterica serovar Typhi
aucgagcggcaguagcag

SEQ ID NO: 3676327 - RNA, 23 nt, Salmonella enterica enterica serovar Typhi
aucgaggcuggucgcgauagccg

SEQ ID NO: 3676328 - RNA, 16 nt, Salmonella enterica enterica serovar Typhi
aucgagucaggcgcca

SEQ ID NO: 3676329 - RNA, 15 nt, Salmonella enterica enterica serovar Typhi
aucgauaaagaacgc

SEQ ID NO: 3676330 - RNA, 14 nt, Salmonella enterica enterica serovar Typhi
aucgauaagccagc

SEQ ID NO: 3676331 - RNA, 16 nt, Salmonella enterica enterica serovar Typhi
aucgauacuaaaacuu

SEQ ID NO: 3676332 - RNA, 14 nt, Salmonella enterica enterica serovar Typhi
aucgauauaucgcg

SEQ ID NO: 3676333 - RNA, 19 nt, Salmonella enterica enterica serovar Typhi
aucgauauaucgcgucauc

SEQ ID NO: 3676334 - RNA, 22 nt, Salmonella enterica enterica serovar Typhi
aucgaugccacagcgcauucac

SEQ ID NO: 3676335 - RNA, 19 nt, Salmonella enterica enterica serovar Typhi
aucgauggcagucgcauca

SEQ ID NO: 3676336 - RNA, 14 nt, Salmonella enterica enterica serovar Typhi
aucgaugugauaaa

SEQ ID NO: 3676337 - RNA, 21 nt, Salmonella enterica enterica serovar Typhi
aucgauuuagagcuaaucaau

SEQ ID NO: 3676338 - RNA, 15 nt, Salmonella enterica enterica serovar Typhi
aucgcaaauucugua

SEQ ID NO: 3676339 - RNA, 21 nt, Salmonella enterica enterica serovar Typhi
aucgcaacgccggugccugcc

SEQ ID NO: 3676340 - RNA, 18 nt, Salmonella enterica enterica serovar Typhi
aucggccaggauggcccg

SEQ ID NO: 3676341 - RNA, 19 nt, Salmonella enterica enterica serovar Typhi
aucggccauauccagccag

SEQ ID NO: 3676342 - RNA, 20 nt, Salmonella enterica enterica serovar Typhi
aucggccauauccagccagu

SEQ ID NO: 3676343 - RNA, 23 nt, Salmonella enterica enterica serovar Typhi
aucggccggaugccagucaauaa

SEQ ID NO: 3676344 - RNA, 14 nt, Salmonella enterica enterica serovar Typhi
aucggccugaaugc

SEQ ID NO: 3676345 - RNA, 14 nt, Salmonella enterica enterica serovar Typhi
aucggccugcucuu

SEQ ID NO: 3676346 - RNA, 22 nt, Salmonella enterica enterica serovar Typhi
aucggcgccggggugcuguucu

SEQ ID NO: 3676347 - RNA, 23 nt, Salmonella enterica enterica serovar Typhi
aucggcgccggggugcuguucuu

SEQ ID NO: 3676348 - RNA, 16 nt, Salmonella enterica enterica serovar Typhi
aucggcgcgcuggcgu

SEQ ID NO: 3676349 - RNA, 17 nt, Salmonella enterica enterica serovar Typhi
aucggcggcaaagccga

SEQ ID NO: 3676350 - RNA, 16 nt, Salmonella enterica enterica serovar Typhi
aucggcgggguuuaac

SEQ ID NO: 3676351 - RNA, 15 nt, Salmonella enterica enterica serovar Typhi
aucggcguugcccau

SEQ ID NO: 3676352 - RNA, 21 nt, Salmonella enterica enterica serovar Typhi
aucggcuuugacguaauaccg

SEQ ID NO: 3676353 - RNA, 21 nt, Salmonella enterica enterica serovar Typhi
aucgggcuguuauucagcagg

SEQ ID NO: 3676354 - RNA, 15 nt, Salmonella enterica enterica serovar Typhi
aucgggcuuccagcg

SEQ ID NO: 3676355 - RNA, 17 nt, Salmonella enterica enterica serovar Typhi
aucgggcuuccagcguu

SEQ ID NO: 3676356 - RNA, 23 nt, Salmonella enterica enterica serovar Typhi
aucgggugacgagggaaggggau

SEQ ID NO: 3676357 - RNA, 17 nt, Salmonella enterica enterica serovar Typhi
aucgggugauaaaauaa

SEQ ID NO: 3676358 - RNA, 17 nt, Salmonella enterica enterica serovar Typhi
aucggguuuuccugaau

SEQ ID NO: 3676359 - RNA, 20 nt, Salmonella enterica enterica serovar Typhi
aucgguaagcgccugcugcg

SEQ ID NO: 3676360 - RNA, 21 nt, Salmonella enterica enterica serovar Typhi
aucgguaauugcgccguucac

SEQ ID NO: 3676361 - RNA, 23 nt, Salmonella enterica enterica serovar Typhi
aucgguaggccggauaaggcauu

SEQ ID NO: 3676362 - RNA, 18 nt, Salmonella enterica enterica serovar Typhi
aucgguaguguuaucgcc

SEQ ID NO: 3676363 - RNA, 18 nt, Salmonella enterica enterica serovar Typhi
aucgguauaacuggucau

SEQ ID NO: 3676364 - RNA, 14 nt, Salmonella enterica enterica serovar Typhi
aucgguuaauugcc

SEQ ID NO: 3676365 - RNA, 20 nt, Salmonella enterica enterica serovar Typhi
aucgguucaucuucgccugg

SEQ ID NO: 3676366 - RNA, 18 nt, Salmonella enterica enterica serovar Typhi
aucgguuugagcaccacg

SEQ ID NO: 3676367 - RNA, 19 nt, Salmonella enterica enterica serovar Typhi
aucguaaaaucaacagcaa

SEQ ID NO: 3676368 - RNA, 17 nt, Salmonella enterica enterica serovar Typhi
aucguaaaaugaaaaac

SEQ ID NO: 3676369 - RNA, 18 nt, Salmonella enterica enterica serovar Typhi
aucguaaaucaaaugaga

SEQ ID NO: 3676370 - RNA, 19 nt, Salmonella enterica enterica serovar Typhi
aucguaagccgcauuacaa

SEQ ID NO: 3676371 - RNA, 23 nt, Salmonella enterica enterica serovar Typhi
aucguagcaucucuucgacaucu

SEQ ID NO: 3676372 - RNA, 23 nt, Salmonella enterica enterica serovar Typhi
aucguauccagcggcaaaggcau

SEQ ID NO: 3676373 - RNA, 21 nt, Salmonella enterica enterica serovar Typhi
aucguauccggucaauacauc

SEQ ID NO: 3676374 - RNA, 19 nt, Salmonella enterica enterica serovar Typhi
aucguaugcagccaggcca

SEQ ID NO: 3676375 - RNA, 13 nt, Salmonella enterica enterica serovar Typhi
aucguaugcgccu

SEQ ID NO: 3676376 - RNA, 14 nt, Salmonella enterica enterica serovar Typhi
aucguaugcgccug

SEQ ID NO: 3676377 - RNA, 16 nt, Salmonella enterica enterica serovar Typhi
aucguccggcgaaaac

SEQ ID NO: 3676378 - RNA, 17 nt, Salmonella enterica enterica serovar Typhi
aucguccucacaaacgg

SEQ ID NO: 3676379 - RNA, 15 nt, Salmonella enterica enterica serovar Typhi
aucgucgccgaucgg

SEQ ID NO: 3676380 - RNA, 23 nt, Salmonella enterica enterica serovar Typhi
aucgucgcgaucgcgccagccuu

SEQ ID NO: 3676381 - RNA, 12 nt, Salmonella enterica enterica serovar Typhi
aucgucgcgcca

SEQ ID NO: 3676382 - RNA, 19 nt, Salmonella enterica enterica serovar Typhi
aucgucgcgguugccguca

SEQ ID NO: 3676383 - RNA, 18 nt, Salmonella enterica enterica serovar Typhi
aucgucucucauccgcca

SEQ ID NO: 3676384 - RNA, 18 nt, Salmonella enterica enterica serovar Typhi
aucgugagcgcgucauca

SEQ ID NO: 3676385 - RNA, 21 nt, Salmonella enterica enterica serovar Typhi
aucgugauaacgcgauggcca

SEQ ID NO: 3676386 - RNA, 19 nt, Salmonella enterica enterica serovar Typhi
aucgugauaggccagacga

SEQ ID NO: 3676387 - RNA, 19 nt, Salmonella enterica enterica serovar Typhi
aucgugccguccggcauca

SEQ ID NO: 3676388 - RNA, 23 nt, Salmonella enterica enterica serovar Typhi
aucgugccguccggcaucacaaa

SEQ ID NO: 3676389 - RNA, 20 nt, Salmonella enterica enterica serovar Typhi
aucgugcggcgaagcaucuu

SEQ ID NO: 3676390 - RNA, 19 nt, Salmonella enterica enterica serovar Typhi
aucguguuauuuucaaaaa

SEQ ID NO: 3676391 - RNA, 22 nt, Salmonella enterica enterica serovar Typhi
aucguguuauuuucaaaaacaa

SEQ ID NO: 3676392 - RNA, 18 nt, Salmonella enterica enterica serovar Typhi
aucguuaauucauggcca

SEQ ID NO: 3676393 - RNA, 13 nt, Salmonella enterica enterica serovar Typhi
aucguuauauaua

SEQ ID NO: 3676394 - RNA, 14 nt, Salmonella enterica enterica serovar Typhi
aucguuauccagca

SEQ ID NO: 3676395 - RNA, 16 nt, Salmonella enterica enterica serovar Typhi
aucguuauccagcagc

SEQ ID NO: 3676396 - RNA, 19 nt, Salmonella enterica enterica serovar Typhi
aucguuauccagcagccac

SEQ ID NO: 3676397 - RNA, 18 nt, Salmonella enterica enterica serovar Typhi
aucguucgccagugacaa

SEQ ID NO: 3676398 - RNA, 15 nt, Salmonella enterica enterica serovar Typhi
aucguucgcggaacg

SEQ ID NO: 3676399 - RNA, 19 nt, Salmonella enterica enterica serovar Typhi
aucguucuugcacaauacu

SEQ ID NO: 3676400 - RNA, 14 nt, Salmonella enterica enterica serovar Typhi
aucguugccgccgu

SEQ ID NO: 3676401 - RNA, 13 nt, Salmonella enterica enterica serovar Typhi
aucguuuuucuuc

SEQ ID NO: 3676402 - RNA, 17 nt, Salmonella enterica enterica serovar Typhi
aucuaaaauuauuuuua

SEQ ID NO: 3676403 - RNA, 17 nt, Salmonella enterica enterica serovar Typhi
aucuaacccgcucagac

SEQ ID NO: 3676404 - RNA, 17 nt, Salmonella enterica enterica serovar Typhi
aucuacaaacgcggaca

SEQ ID NO: 3676405 - RNA, 23 nt, Salmonella enterica enterica serovar Typhi
aucuacaaucgucuucagcaauu

SEQ ID NO: 3676406 - RNA, 18 nt, Salmonella enterica enterica serovar Typhi
aucuacgguaucugcaua

SEQ ID NO: 3676407 - RNA, 19 nt, Salmonella enterica enterica serovar Typhi
aucuacuguuauugacgau

SEQ ID NO: 3676408 - RNA, 14 nt, Salmonella enterica enterica serovar Typhi
aucuacuucagcac

SEQ ID NO: 3676409 - RNA, 21 nt, Salmonella enterica enterica serovar Typhi
aucuagcggaaccuguccuga

SEQ ID NO: 3676410 - RNA, 16 nt, Salmonella enterica enterica serovar Typhi
aucuauauauucuucu

SEQ ID NO: 3676411 - RNA, 17 nt, Salmonella enterica enterica serovar Typhi
aucuauauauucuucuu

SEQ ID NO: 3676412 - RNA, 12 nt, Salmonella enterica enterica serovar Typhi
aucuauucagcc

SEQ ID NO: 3676413 - RNA, 20 nt, Salmonella enterica enterica serovar Typhi
aucuauuuagcguauaguac

SEQ ID NO: 3676414 - RNA, 17 nt, Salmonella enterica enterica serovar Typhi
aucucaauaccacgccg

SEQ ID NO: 3676415 - RNA, 22 nt, Salmonella enterica enterica serovar Typhi
aucucacgcauggcguugcugc

SEQ ID NO: 3676416 - RNA, 18 nt, Salmonella enterica enterica serovar Typhi
aucucagauaauagcugc

SEQ ID NO: 3676417 - RNA, 19 nt, Salmonella enterica enterica serovar Typhi
aucucaucugcaaaauaua

SEQ ID NO: 3676418 - RNA, 17 nt, Salmonella enterica enterica serovar Typhi
aucuccagaccgcugcg

SEQ ID NO: 3676419 - RNA, 21 nt, Salmonella enterica enterica serovar Typhi
aucuccagcgcauugccuuuc

SEQ ID NO: 3676420 - RNA, 13 nt, Salmonella enterica enterica serovar Typhi
aucucccugccag

SEQ ID NO: 3676421 - RNA, 16 nt, Salmonella enterica enterica serovar Typhi
aucuccggcaucucaa

SEQ ID NO: 3676422 - RNA, 22 nt, Salmonella enterica enterica serovar Typhi
aucuccgggaaaaacgugucca

SEQ ID NO: 3676423 - RNA, 17 nt, Salmonella enterica enterica serovar Typhi
aucuccuccggcuucag

SEQ ID NO: 3676424 - RNA, 21 nt, Salmonella enterica enterica serovar Typhi
aucuccuccucauucagcggc

SEQ ID NO: 3676425 - RNA, 21 nt, Salmonella enterica enterica serovar Typhi
aucuucggcgggaucuccaga

SEQ ID NO: 3676426 - RNA, 21 nt, Salmonella enterica enterica serovar Typhi
aucuucguuggcgcugccgga

SEQ ID NO: 3676427 - RNA, 17 nt, Salmonella enterica enterica serovar Typhi
aucuucuaccuggaacc

SEQ ID NO: 3676428 - RNA, 19 nt, Salmonella enterica enterica serovar Typhi
aucuucuccauugaucacu

SEQ ID NO: 3676429 - RNA, 20 nt, Salmonella enterica enterica serovar Typhi
aucuucuuugacccacgcca

SEQ ID NO: 3676430 - RNA, 17 nt, Salmonella enterica enterica serovar Typhi
aucuugaguuuggccug

SEQ ID NO: 3676431 - RNA, 13 nt, Salmonella enterica enterica serovar Typhi
aucuuguccucau

SEQ ID NO: 3676432 - RNA, 22 nt, Salmonella enterica enterica serovar Typhi
aucuuguccucaucauucgguu

SEQ ID NO: 3676433 - RNA, 21 nt, Salmonella enterica enterica serovar Typhi
aucuuuaccagggaauaugau

SEQ ID NO: 3676434 - RNA, 14 nt, Salmonella enterica enterica serovar Typhi
aucuuuauccugca

SEQ ID NO: 3676435 - RNA, 17 nt, Salmonella enterica enterica serovar Typhi
aucuuuaugucaguaau

SEQ ID NO: 3676436 - RNA, 19 nt, Salmonella enterica enterica serovar Typhi
aucuuuauugaaaagcagc

SEQ ID NO: 3676437 - RNA, 14 nt, Salmonella enterica enterica serovar Typhi
aucuuuccggaacg

SEQ ID NO: 3676438 - RNA, 13 nt, Salmonella enterica enterica serovar Typhi
aucuuuccuuuuu

SEQ ID NO: 3676439 - RNA, 14 nt, Salmonella enterica enterica serovar Typhi
aucuuucuuuuuau

SEQ ID NO: 3676440 - RNA, 19 nt, Salmonella enterica enterica serovar Typhi
aucuuugaagggcauauua

SEQ ID NO: 3676441 - RNA, 15 nt, Salmonella enterica enterica serovar Typhi
aucuuuuaaaaucag

SEQ ID NO: 3676442 - RNA, 16 nt, Salmonella enterica enterica serovar Typhi
aucuuuuacgaaacaa

SEQ ID NO: 3676443 - RNA, 17 nt, Salmonella enterica enterica serovar Typhi
aucuuuucaaucagguu

SEQ ID NO: 3676444 - RNA, 14 nt, Salmonella enterica enterica serovar Typhi
aucuuuuccugaag

SEQ ID NO: 3676445 - RNA, 11 nt, Salmonella enterica enterica serovar Typhi
augaaaaaaac

SEQ ID NO: 3676446 - RNA, 12 nt, Salmonella enterica enterica serovar Typhi
augaaaaaaacg

SEQ ID NO: 3676447 - RNA, 17 nt, Salmonella enterica enterica serovar Typhi
augaaaaacuggaaaac

SEQ ID NO: 3676448 - RNA, 18 nt, Salmonella enterica enterica serovar Typhi
augaaaaauauaaaaagc

SEQ ID NO: 3676449 - RNA, 17 nt, Salmonella enterica enterica serovar Typhi
augaaaaauccccgcaa

SEQ ID NO: 3676450 - RNA, 14 nt, Salmonella enterica enterica serovar Typhi
augaaagaaaucac

SEQ ID NO: 3676451 - RNA, 12 nt, Salmonella enterica enterica serovar Typhi
augaaagagaaa

SEQ ID NO: 3676452 - RNA, 14 nt, Salmonella enterica enterica serovar Typhi
augaaaucacccag

SEQ ID NO: 3676453 - RNA, 22 nt, Salmonella enterica enterica serovar Typhi
augaaaucgccuguuaauggua

SEQ ID NO: 3676454 - RNA, 22 nt, Salmonella enterica enterica serovar Typhi
augaaaucgucgccaacaccga

SEQ ID NO: 3676455 - RNA, 21 nt, Salmonella enterica enterica serovar Typhi
augaaccauaucaaacaggac

SEQ ID NO: 3676456 - RNA, 22 nt, Salmonella enterica enterica serovar Typhi
augaacccucgaaugugaauuc

SEQ ID NO: 3676457 - RNA, 18 nt, Salmonella enterica enterica serovar Typhi
augaaccugaugugcuuu

SEQ ID NO: 3676458 - RNA, 22 nt, Salmonella enterica enterica serovar Typhi
augaacgacgcugauuugccaa

SEQ ID NO: 3676459 - RNA, 22 nt, Salmonella enterica enterica serovar Typhi
augaacucuaugcaaaagaaaa

SEQ ID NO: 3676460 - RNA, 13 nt, Salmonella enterica enterica serovar Typhi
augaacuuacacu

SEQ ID NO: 3676461 - RNA, 15 nt, Salmonella enterica enterica serovar Typhi
augaagauauucacu

SEQ ID NO: 3676462 - RNA, 16 nt, Salmonella enterica enterica serovar Typhi
augaagcauaaaaaga

SEQ ID NO: 3676463 - RNA, 16 nt, Salmonella enterica enterica serovar Typhi
augaagcggaaaggac

SEQ ID NO: 3676464 - RNA, 14 nt, Salmonella enterica enterica serovar Typhi
augaagcgucauca

SEQ ID NO: 3676465 - RNA, 19 nt, Salmonella enterica enterica serovar Typhi
augaaggagagcauuuuuu

SEQ ID NO: 3676466 - RNA, 23 nt, Salmonella enterica enterica serovar Typhi
augaaggauacggaauggauaac

SEQ ID NO: 3676467 - RNA, 16 nt, Salmonella enterica enterica serovar Typhi
augaaggguaaaacgu

SEQ ID NO: 3676468 - RNA, 18 nt, Salmonella enterica enterica serovar Typhi
augaauaaaugaauuauu

SEQ ID NO: 3676469 - RNA, 15 nt, Salmonella enterica enterica serovar Typhi
augaauaaccucccg

SEQ ID NO: 3676470 - RNA, 22 nt, Salmonella enterica enterica serovar Typhi
augaauaaccucccgccggggc

SEQ ID NO: 3676471 - RNA, 13 nt, Salmonella enterica enterica serovar Typhi
augaauaauaaua

SEQ ID NO: 3676472 - RNA, 15 nt, Salmonella enterica enterica serovar Typhi
augaauaaucucugc

SEQ ID NO: 3676473 - RNA, 20 nt, Salmonella enterica enterica serovar Typhi
augaauagccccucaauuau

SEQ ID NO: 3676474 - RNA, 17 nt, Salmonella enterica enterica serovar Typhi
augaauauuuugcugga

SEQ ID NO: 3676475 - RNA, 19 nt, Salmonella enterica enterica serovar Typhi
augaauuacagcucauaaa

SEQ ID NO: 3676476 - RNA, 21 nt, Salmonella enterica enterica serovar Typhi
augaauuauuuucuaaaaucu

SEQ ID NO: 3676477 - RNA, 14 nt, Salmonella enterica enterica serovar Typhi
augaauuauuuuuu

SEQ ID NO: 3676478 - RNA, 16 nt, Salmonella enterica enterica serovar Typhi
augaauuauuuuuuca

SEQ ID NO: 3676479 - RNA, 23 nt, Salmonella enterica enterica serovar Typhi
augaauuuauggagucaugaaug

SEQ ID NO: 3676480 - RNA, 21 nt, Salmonella enterica enterica serovar Typhi
augacaaagccggauaucgcu

SEQ ID NO: 3676481 - RNA, 23 nt, Salmonella enterica enterica serovar Typhi
augacaauauugccauaaauaca

SEQ ID NO: 3676482 - RNA, 13 nt, Salmonella enterica enterica serovar Typhi
augacagaaagcg

SEQ ID NO: 3676483 - RNA, 16 nt, Salmonella enterica enterica serovar Typhi
augacaucgcaaugcc

SEQ ID NO: 3676484 - RNA, 20 nt, Salmonella enterica enterica serovar Typhi
augaccacaccgucaacauc

SEQ ID NO: 3676485 - RNA, 19 nt, Salmonella enterica enterica serovar Typhi
augaccaccgcaucggcau

SEQ ID NO: 3676486 - RNA, 15 nt, Salmonella enterica enterica serovar Typhi
augaccagcgcccac

SEQ ID NO: 3676487 - RNA, 16 nt, Salmonella enterica enterica serovar Typhi
augaccagcgcccaca

SEQ ID NO: 3676488 - RNA, 13 nt, Salmonella enterica enterica serovar Typhi
augaccagcgccg

SEQ ID NO: 3676489 - RNA, 20 nt, Salmonella enterica enterica serovar Typhi
augaccaguacaggcgguaa

SEQ ID NO: 3676490 - RNA, 16 nt, Salmonella enterica enterica serovar Typhi
augaccgcacagcaga

SEQ ID NO: 3676491 - RNA, 18 nt, Salmonella enterica enterica serovar Typhi
augaccguauuacaagua

SEQ ID NO: 3676492 - RNA, 13 nt, Salmonella enterica enterica serovar Typhi
augacgaacagga

SEQ ID NO: 3676493 - RNA, 23 nt, Salmonella enterica enterica serovar Typhi
augacgaacaggauauuaccgcc

SEQ ID NO: 3676494 - RNA, 14 nt, Salmonella enterica enterica serovar Typhi
augacgcagggcaa

SEQ ID NO: 3676495 - RNA, 21 nt, Salmonella enterica enterica serovar Typhi
augacgcccugcgccagcaug

SEQ ID NO: 3676496 - RNA, 17 nt, Salmonella enterica enterica serovar Typhi
augacgccgaaauaaau

SEQ ID NO: 3676497 - RNA, 14 nt, Salmonella enterica enterica serovar Typhi
augacgccugccag

SEQ ID NO: 3676498 - RNA, 15 nt, Salmonella enterica enterica serovar Typhi
augacgcgcaggccg

SEQ ID NO: 3676499 - RNA, 20 nt, Salmonella enterica enterica serovar Typhi
augacgcugcgcuuauccgg

SEQ ID NO: 3676500 - RNA, 16 nt, Salmonella enterica enterica serovar Typhi
augacgcuggaaguau

SEQ ID NO: 3676501 - RNA, 21 nt, Salmonella enterica enterica serovar Typhi
augacggcaaagcccacgccc

SEQ ID NO: 3676502 - RNA, 16 nt, Salmonella enterica enterica serovar Typhi
augacggccaccagcg

SEQ ID NO: 3676503 - RNA, 23 nt, Salmonella enterica enterica serovar Typhi
augacgggaucgaaccgccgacc

SEQ ID NO: 3676504 - RNA, 19 nt, Salmonella enterica enterica serovar Typhi
augacgguauugcuuucaa

SEQ ID NO: 3676505 - RNA, 17 nt, Salmonella enterica enterica serovar Typhi
augacgguucaucgcag

SEQ ID NO: 3676506 - RNA, 14 nt, Salmonella enterica enterica serovar Typhi
augacgucagcaag

SEQ ID NO: 3676507 - RNA, 14 nt, Salmonella enterica enterica serovar Typhi
augacguccaggcc

SEQ ID NO: 3676508 - RNA, 15 nt, Salmonella enterica enterica serovar Typhi
augacguggccagca

SEQ ID NO: 3676509 - RNA, 18 nt, Salmonella enterica enterica serovar Typhi
augacucauuaaaaaaac

SEQ ID NO: 3676510 - RNA, 20 nt, Salmonella enterica enterica serovar Typhi
augacugcgaauuuccugcc

SEQ ID NO: 3676511 - RNA, 20 nt, Salmonella enterica enterica serovar Typhi
augcagguaguccaaauaag

SEQ ID NO: 3676512 - RNA, 15 nt, Salmonella enterica enterica serovar Typhi
augcagguucccgcc

SEQ ID NO: 3676513 - RNA, 22 nt, Salmonella enterica enterica serovar Typhi
augcagguucccgcccugcccg

SEQ ID NO: 3676514 - RNA, 13 nt, Salmonella enterica enterica serovar Typhi
augcagugcugcu

SEQ ID NO: 3676515 - RNA, 20 nt, Salmonella enterica enterica serovar Typhi
augcauacggaugaaauacu

SEQ ID NO: 3676516 - RNA, 18 nt, Salmonella enterica enterica serovar Typhi
augcauauuauucaugau

SEQ ID NO: 3676517 - RNA, 11 nt, Salmonella enterica enterica serovar Typhi
augcauauuca

SEQ ID NO: 3676518 - RNA, 13 nt, Salmonella enterica enterica serovar Typhi
augcaucaugcua

SEQ ID NO: 3676519 - RNA, 16 nt, Salmonella enterica enterica serovar Typhi
augcaucuugaaugau

SEQ ID NO: 3676520 - RNA, 18 nt, Salmonella enterica enterica serovar Typhi
augcaugacgggggcgau

SEQ ID NO: 3676521 - RNA, 14 nt, Salmonella enterica enterica serovar Typhi
augcauggcagaua

SEQ ID NO: 3676522 - RNA, 12 nt, Salmonella enterica enterica serovar Typhi
augcauugcuga

SEQ ID NO: 3676523 - RNA, 22 nt, Salmonella enterica enterica serovar Typhi
augcauuugauuuguuuuuuau

SEQ ID NO: 3676524 - RNA, 19 nt, Salmonella enterica enterica serovar Typhi
augccaaauagcacgugca

SEQ ID NO: 3676525 - RNA, 14 nt, Salmonella enterica enterica serovar Typhi
augccaaccaccgc

SEQ ID NO: 3676526 - RNA, 20 nt, Salmonella enterica enterica serovar Typhi
augccaaguaauaaagagaa

SEQ ID NO: 3676527 - RNA, 14 nt, Salmonella enterica enterica serovar Typhi
augccacgaucccc

SEQ ID NO: 3676528 - RNA, 20 nt, Salmonella enterica enterica serovar Typhi
augccacgccccuaaggcag

SEQ ID NO: 3676529 - RNA, 13 nt, Salmonella enterica enterica serovar Typhi
augccacuguuca

SEQ ID NO: 3676530 - RNA, 16 nt, Salmonella enterica enterica serovar Typhi
augccagaagcaaauu

SEQ ID NO: 3676531 - RNA, 17 nt, Salmonella enterica enterica serovar Typhi
augccagaauugcacgc

SEQ ID NO: 3676532 - RNA, 22 nt, Salmonella enterica enterica serovar Typhi
augccagauuuuccaggccgcc

SEQ ID NO: 3676533 - RNA, 15 nt, Salmonella enterica enterica serovar Typhi
augccagcgauuauu

SEQ ID NO: 3676534 - RNA, 21 nt, Salmonella enterica enterica serovar Typhi
augccauaguagaagugaagc

SEQ ID NO: 3676535 - RNA, 19 nt, Salmonella enterica enterica serovar Typhi
augccaucggccagcaggc

SEQ ID NO: 3676536 - RNA, 20 nt, Salmonella enterica enterica serovar Typhi
augccaucucuuaauguaaa

SEQ ID NO: 3676537 - RNA, 21 nt, Salmonella enterica enterica serovar Typhi
augccaugcuggcucuugguu

SEQ ID NO: 3676538 - RNA, 18 nt, Salmonella enterica enterica serovar Typhi
augccauguuucuuuuaa

SEQ ID NO: 3676539 - RNA, 23 nt, Salmonella enterica enterica serovar Typhi
augcccaccggaccuaauagcca

SEQ ID NO: 3676540 - RNA, 23 nt, Salmonella enterica enterica serovar Typhi
augcccaccguggagcguucgcg

SEQ ID NO: 3676541 - RNA, 21 nt, Salmonella enterica enterica serovar Typhi
augcccaccugaaaaagggua

SEQ ID NO: 3676542 - RNA, 23 nt, Salmonella enterica enterica serovar Typhi
augcccagcgccgucauaccgcc

SEQ ID NO: 3676543 - RNA, 20 nt, Salmonella enterica enterica serovar Typhi
augcccaggcggcgggaaug

SEQ ID NO: 3676544 - RNA, 20 nt, Salmonella enterica enterica serovar Typhi
augccccaucacgggaucgc

SEQ ID NO: 3676545 - RNA, 17 nt, Salmonella enterica enterica serovar Typhi
augcccggaugauuauc

SEQ ID NO: 3676546 - RNA, 17 nt, Salmonella enterica enterica serovar Typhi
augcccggggugaacaa

SEQ ID NO: 3676547 - RNA, 19 nt, Salmonella enterica enterica serovar Typhi
augcccucuuccagcgcca

SEQ ID NO: 3676548 - RNA, 15 nt, Salmonella enterica enterica serovar Typhi
augccgaccagcguc

SEQ ID NO: 3676549 - RNA, 14 nt, Salmonella enterica enterica serovar Typhi
augccgacccaccu

SEQ ID NO: 3676550 - RNA, 17 nt, Salmonella enterica enterica serovar Typhi
augccgacccaccugac

SEQ ID NO: 3676551 - RNA, 16 nt, Salmonella enterica enterica serovar Typhi
augccgaguuccggau

SEQ ID NO: 3676552 - RNA, 21 nt, Salmonella enterica enterica serovar Typhi
augccgauagucuccgccacc

SEQ ID NO: 3676553 - RNA, 16 nt, Salmonella enterica enterica serovar Typhi
augccgaucaccagcg

SEQ ID NO: 3676554 - RNA, 16 nt, Salmonella enterica enterica serovar Typhi
augccgcacaaaauuu

SEQ ID NO: 3676555 - RNA, 19 nt, Salmonella enterica enterica serovar Typhi
augccgcacuccccagaau

SEQ ID NO: 3676556 - RNA, 21 nt, Salmonella enterica enterica serovar Typhi
augccgcacuccccagaauga

SEQ ID NO: 3676557 - RNA, 20 nt, Salmonella enterica enterica serovar Typhi
augccgccauccgacacagc

SEQ ID NO: 3676558 - RNA, 10 nt, Salmonella enterica enterica serovar Typhi
augccgccgc

SEQ ID NO: 3676559 - RNA, 13 nt, Salmonella enterica enterica serovar Typhi
augccgccgccag

SEQ ID NO: 3676560 - RNA, 22 nt, Salmonella enterica enterica serovar Typhi
augccgccugccgcgccgccgc

SEQ ID NO: 3676561 - RNA, 17 nt, Salmonella enterica enterica serovar Typhi
augccgcgucaggagcg

SEQ ID NO: 3676562 - RNA, 21 nt, Salmonella enterica enterica serovar Typhi
augccgcgucaggagcgggua

SEQ ID NO: 3676563 - RNA, 20 nt, Salmonella enterica enterica serovar Typhi
augccgcuggcguauucgcc

SEQ ID NO: 3676564 - RNA, 22 nt, Salmonella enterica enterica serovar Typhi
augccggauaguuacccggcaa

SEQ ID NO: 3676565 - RNA, 20 nt, Salmonella enterica enterica serovar Typhi
augccggccugauauccacg

SEQ ID NO: 3676566 - RNA, 15 nt, Salmonella enterica enterica serovar Typhi
augccgggcaaaaaa

SEQ ID NO: 3676567 - RNA, 17 nt, Salmonella enterica enterica serovar Typhi
augccgggugcggcgcu

SEQ ID NO: 3676568 - RNA, 23 nt, Salmonella enterica enterica serovar Typhi
augccggugcgagaaaaagcaau

SEQ ID NO: 3676569 - RNA, 13 nt, Salmonella enterica enterica serovar Typhi
augccguagcggc

SEQ ID NO: 3676570 - RNA, 16 nt, Salmonella enterica enterica serovar Typhi
augccguagcggccau

SEQ ID NO: 3676571 - RNA, 19 nt, Salmonella enterica enterica serovar Typhi
augccguccauccggcgua

SEQ ID NO: 3676572 - RNA, 18 nt, Salmonella enterica enterica serovar Typhi
augccguuggcuuuggcu

SEQ ID NO: 3676573 - RNA, 18 nt, Salmonella enterica enterica serovar Typhi
augccguuuuaacgucau

SEQ ID NO: 3676574 - RNA, 15 nt, Salmonella enterica enterica serovar Typhi
augccuaacccuuuu

SEQ ID NO: 3676575 - RNA, 20 nt, Salmonella enterica enterica serovar Typhi
augccuaacguguuaucgcu

SEQ ID NO: 3676576 - RNA, 22 nt, Salmonella enterica enterica serovar Typhi
augccucguuucccucauauuu

SEQ ID NO: 3676577 - RNA, 17 nt, Salmonella enterica enterica serovar Typhi
augccucuuacagggcg

SEQ ID NO: 3676578 - RNA, 22 nt, Salmonella enterica enterica serovar Typhi
augccugcgccauguucauaaa

SEQ ID NO: 3676579 - RNA, 11 nt, Salmonella enterica enterica serovar Typhi
augccuggcag

SEQ ID NO: 3676580 - RNA, 14 nt, Salmonella enterica enterica serovar Typhi
augccugucaucau

SEQ ID NO: 3676581 - RNA, 23 nt, Salmonella enterica enterica serovar Typhi
augccuguguaucgcccugccag

SEQ ID NO: 3676582 - RNA, 21 nt, Salmonella enterica enterica serovar Typhi
augccuucauaaugaauacgc

SEQ ID NO: 3676583 - RNA, 17 nt, Salmonella enterica enterica serovar Typhi
augccuuccuguggaag

SEQ ID NO: 3676584 - RNA, 15 nt, Salmonella enterica enterica serovar Typhi
augcgaauaaucgcc

SEQ ID NO: 3676585 - RNA, 14 nt, Salmonella enterica enterica serovar Typhi
augcgaauccggcg

SEQ ID NO: 3676586 - RNA, 16 nt, Salmonella enterica enterica serovar Typhi
augcgacgcccaacca

SEQ ID NO: 3676587 - RNA, 16 nt, Salmonella enterica enterica serovar Typhi
augcgacuaaccugau

SEQ ID NO: 3676588 - RNA, 17 nt, Salmonella enterica enterica serovar Typhi
augcgacugaaaaucaa

SEQ ID NO: 3676589 - RNA, 13 nt, Salmonella enterica enterica serovar Typhi
augcgacuuauca

SEQ ID NO: 3676590 - RNA, 21 nt, Salmonella enterica enterica serovar Typhi
augcgauacguaggccugaua

SEQ ID NO: 3676591 - RNA, 21 nt, Salmonella enterica enterica serovar Typhi
augcgcagcaugaucggcugg

SEQ ID NO: 3676592 - RNA, 16 nt, Salmonella enterica enterica serovar Typhi
augcgcaugggcauaa

SEQ ID NO: 3676593 - RNA, 16 nt, Salmonella enterica enterica serovar Typhi
augcgcaugugagcau

SEQ ID NO: 3676594 - RNA, 19 nt, Salmonella enterica enterica serovar Typhi
augcgccagccagucgcca

SEQ ID NO: 3676595 - RNA, 23 nt, Salmonella enterica enterica serovar Typhi
augcgccagccagucgccaggca

SEQ ID NO: 3676596 - RNA, 18 nt, Salmonella enterica enterica serovar Typhi
auggcaacaaagccugcu

SEQ ID NO: 3676597 - RNA, 14 nt, Salmonella enterica enterica serovar Typhi
auggcaauugcgcc

SEQ ID NO: 3676598 - RNA, 15 nt, Salmonella enterica enterica serovar Typhi
auggcacgauaacca

SEQ ID NO: 3676599 - RNA, 16 nt, Salmonella enterica enterica serovar Typhi
auggcagaauaaaaca

SEQ ID NO: 3676600 - RNA, 15 nt, Salmonella enterica enterica serovar Typhi
auggcagauaaacca

SEQ ID NO: 3676601 - RNA, 18 nt, Salmonella enterica enterica serovar Typhi
auggcaggcauagacauc

SEQ ID NO: 3676602 - RNA, 18 nt, Salmonella enterica enterica serovar Typhi
auggcagggcgauaucca

SEQ ID NO: 3676603 - RNA, 19 nt, Salmonella enterica enterica serovar Typhi
auggcaguauaaauaccuu

SEQ ID NO: 3676604 - RNA, 22 nt, Salmonella enterica enterica serovar Typhi
auggcauaacgcuguagcguuu

SEQ ID NO: 3676605 - RNA, 22 nt, Salmonella enterica enterica serovar Typhi
auggcauaugacgguauugcuu

SEQ ID NO: 3676606 - RNA, 22 nt, Salmonella enterica enterica serovar Typhi
auggccaauguacguaaaacca

SEQ ID NO: 3676607 - RNA, 18 nt, Salmonella enterica enterica serovar Typhi
auggccagaaugacaugg

SEQ ID NO: 3676608 - RNA, 18 nt, Salmonella enterica enterica serovar Typhi
auggccagcaccagcauu

SEQ ID NO: 3676609 - RNA, 20 nt, Salmonella enterica enterica serovar Typhi
auggccagcaccagcauuag

SEQ ID NO: 3676610 - RNA, 14 nt, Salmonella enterica enterica serovar Typhi
auggccauagacuu

SEQ ID NO: 3676611 - RNA, 15 nt, Salmonella enterica enterica serovar Typhi
auggcccaauguuuu

SEQ ID NO: 3676612 - RNA, 19 nt, Salmonella enterica enterica serovar Typhi
auggcccaguguacugcca

SEQ ID NO: 3676613 - RNA, 12 nt, Salmonella enterica enterica serovar Typhi
auggccgcagcc

SEQ ID NO: 3676614 - RNA, 22 nt, Salmonella enterica enterica serovar Typhi
auggccggucuuaugcugccag

SEQ ID NO: 3676615 - RNA, 20 nt, Salmonella enterica enterica serovar Typhi
auggccguuuucaugcacga

SEQ ID NO: 3676616 - RNA, 14 nt, Salmonella enterica enterica serovar Typhi
auggccugaugacg

SEQ ID NO: 3676617 - RNA, 22 nt, Salmonella enterica enterica serovar Typhi
auggccugcucaauacuuuccg

SEQ ID NO: 3676618 - RNA, 21 nt, Salmonella enterica enterica serovar Typhi
auggcgaaaaucggcaggccg

SEQ ID NO: 3676619 - RNA, 15 nt, Salmonella enterica enterica serovar Typhi
auggcgacgaucagc

SEQ ID NO: 3676620 - RNA, 17 nt, Salmonella enterica enterica serovar Typhi
auggcgacgaucagcgc

SEQ ID NO: 3676621 - RNA, 17 nt, Salmonella enterica enterica serovar Typhi
auggcgacgcguagcgu

SEQ ID NO: 3676622 - RNA, 16 nt, Salmonella enterica enterica serovar Typhi
auggcgaucagcgcca

SEQ ID NO: 3676623 - RNA, 22 nt, Salmonella enterica enterica serovar Typhi
auggcgaucagcgccaccacaa

SEQ ID NO: 3676624 - RNA, 18 nt, Salmonella enterica enterica serovar Typhi
auggcgcagcauacgcug

SEQ ID NO: 3676625 - RNA, 22 nt, Salmonella enterica enterica serovar Typhi
auggcgccagccauagcagcaa

SEQ ID NO: 3676626 - RNA, 18 nt, Salmonella enterica enterica serovar Typhi
auggcgcgaaaacagcug

SEQ ID NO: 3676627 - RNA, 19 nt, Salmonella enterica enterica serovar Typhi
auggcgcgaaaacagcugg

SEQ ID NO: 3676628 - RNA, 21 nt, Salmonella enterica enterica serovar Typhi
auggcgcgaagugccagguuu

SEQ ID NO: 3676629 - RNA, 22 nt, Salmonella enterica enterica serovar Typhi
auggcgcgacgcuuaucagccc

SEQ ID NO: 3676630 - RNA, 18 nt, Salmonella enterica enterica serovar Typhi
auggcgcgccacuucuuu

SEQ ID NO: 3676631 - RNA, 20 nt, Salmonella enterica enterica serovar Typhi
auggcgcgccacuucuuuga

SEQ ID NO: 3676632 - RNA, 17 nt, Salmonella enterica enterica serovar Typhi
auggcgcuaagccagcc

SEQ ID NO: 3676633 - RNA, 22 nt, Salmonella enterica enterica serovar Typhi
auggcgcuacgcuuaucaggcc

SEQ ID NO: 3676634 - RNA, 15 nt, Salmonella enterica enterica serovar Typhi
auggcgcugcgcgca

SEQ ID NO: 3676635 - RNA, 20 nt, Salmonella enterica enterica serovar Typhi
auggcgcugcgcuuaucaga

SEQ ID NO: 3676636 - RNA, 22 nt, Salmonella enterica enterica serovar Typhi
auggcgcugcgcuuaucaggcc

SEQ ID NO: 3676637 - RNA, 20 nt, Salmonella enterica enterica serovar Typhi
auggcggcgaaaugccuuau

SEQ ID NO: 3676638 - RNA, 23 nt, Salmonella enterica enterica serovar Typhi
auggcggcgaaaugccuuauccg

SEQ ID NO: 3676639 - RNA, 13 nt, Salmonella enterica enterica serovar Typhi
auggcggcgcaaa

SEQ ID NO: 3676640 - RNA, 20 nt, Salmonella enterica enterica serovar Typhi
auggcggcggacaugguaau

SEQ ID NO: 3676641 - RNA, 17 nt, Salmonella enterica enterica serovar Typhi
auggcggcguuuuccgg

SEQ ID NO: 3676642 - RNA, 18 nt, Salmonella enterica enterica serovar Typhi
auggcgggccugugccug

SEQ ID NO: 3676643 - RNA, 15 nt, Salmonella enterica enterica serovar Typhi
auggcgguauaacug

SEQ ID NO: 3676644 - RNA, 16 nt, Salmonella enterica enterica serovar Typhi
auggcgguauaacugc

SEQ ID NO: 3676645 - RNA, 21 nt, Salmonella enterica enterica serovar Typhi
auggcggugcuuaaccgggau

SEQ ID NO: 3676646 - RNA, 17 nt, Salmonella enterica enterica serovar Typhi
auggcgguuccggggaa

SEQ ID NO: 3676647 - RNA, 18 nt, Salmonella enterica enterica serovar Typhi
auggcgucgcuacgggcg

SEQ ID NO: 3676648 - RNA, 15 nt, Salmonella enterica enterica serovar Typhi
auggcgucgugcagc

SEQ ID NO: 3676649 - RNA, 20 nt, Salmonella enterica enterica serovar Typhi
auggcguggcgcuuuccggc

SEQ ID NO: 3676650 - RNA, 17 nt, Salmonella enterica enterica serovar Typhi
auggcuaugaagcugga

SEQ ID NO: 3676651 - RNA, 12 nt, Salmonella enterica enterica serovar Typhi
auggcuggauga

SEQ ID NO: 3676652 - RNA, 13 nt, Salmonella enterica enterica serovar Typhi
auggcuuagcgcc

SEQ ID NO: 3676653 - RNA, 24 nt, Salmonella enterica enterica serovar Typhi
auggcuucaccguugugcuccagc

SEQ ID NO: 3676654 - RNA, 17 nt, Salmonella enterica enterica serovar Typhi
auggcuugugaauacca

SEQ ID NO: 3676655 - RNA, 18 nt, Salmonella enterica enterica serovar Typhi
auggcuuucagauuagcc

SEQ ID NO: 3676656 - RNA, 20 nt, Salmonella enterica enterica serovar Typhi
auggcuuucagauuagccag

SEQ ID NO: 3676657 - RNA, 15 nt, Salmonella enterica enterica serovar Typhi
augggaaaucacagc

SEQ ID NO: 3676658 - RNA, 16 nt, Salmonella enterica enterica serovar Typhi
augggauaacgcagaa

SEQ ID NO: 3676659 - RNA, 22 nt, Salmonella enterica enterica serovar Typhi
augggauaacgcagaagacaga

SEQ ID NO: 3676660 - RNA, 18 nt, Salmonella enterica enterica serovar Typhi
augggauagugccugccg

SEQ ID NO: 3676661 - RNA, 18 nt, Salmonella enterica enterica serovar Typhi
augggauuugaugcccaa

SEQ ID NO: 3676662 - RNA, 22 nt, Salmonella enterica enterica serovar Typhi
augggcaggagaugaccugccc

SEQ ID NO: 3676663 - RNA, 18 nt, Salmonella enterica enterica serovar Typhi
augggccaaccugccgau

SEQ ID NO: 3676664 - RNA, 17 nt, Salmonella enterica enterica serovar Typhi
augggccuacgccugga

SEQ ID NO: 3676665 - RNA, 18 nt, Salmonella enterica enterica serovar Typhi
augggccuacgccuggau

SEQ ID NO: 3676666 - RNA, 17 nt, Salmonella enterica enterica serovar Typhi
augggcgcacagcgcca

SEQ ID NO: 3676667 - RNA, 15 nt, Salmonella enterica enterica serovar Typhi
augggcuucuucacu

SEQ ID NO: 3676668 - RNA, 22 nt, Salmonella enterica enterica serovar Typhi
auggggaaauaaauauguuauu

SEQ ID NO: 3676669 - RNA, 17 nt, Salmonella enterica enterica serovar Typhi
auggggaucgucugcaa

SEQ ID NO: 3676670 - RNA, 19 nt, Salmonella enterica enterica serovar Typhi
auggggauuaagcgagcgc

SEQ ID NO: 3676671 - RNA, 19 nt, Salmonella enterica enterica serovar Typhi
auggggauuaucaggauga

SEQ ID NO: 3676672 - RNA, 22 nt, Salmonella enterica enterica serovar Typhi
augggguuuguccugcagcgcc

SEQ ID NO: 3676673 - RNA, 20 nt, Salmonella enterica enterica serovar Typhi
auggguaggccggauaagcg

SEQ ID NO: 3676674 - RNA, 20 nt, Salmonella enterica enterica serovar Typhi
augggucacauccagacagc

SEQ ID NO: 3676675 - RNA, 14 nt, Salmonella enterica enterica serovar Typhi
augggucucaucca

SEQ ID NO: 3676676 - RNA, 14 nt, Salmonella enterica enterica serovar Typhi
augguaaaauccuu

SEQ ID NO: 3676677 - RNA, 20 nt, Salmonella enterica enterica serovar Typhi
augguaaaauccuuuuucau

SEQ ID NO: 3676678 - RNA, 23 nt, Salmonella enterica enterica serovar Typhi
augguaaaauuauugugagaaaa

SEQ ID NO: 3676679 - RNA, 24 nt, Salmonella enterica enterica serovar Typhi
augguaacugcggcuauauaaaau

SEQ ID NO: 3676680 - RNA, 16 nt, Salmonella enterica enterica serovar Typhi
augguacucaacauca

SEQ ID NO: 3676681 - RNA, 16 nt, Salmonella enterica enterica serovar Typhi
auguugaugucacuca

SEQ ID NO: 3676682 - RNA, 15 nt, Salmonella enterica enterica serovar Typhi
auguugccacaggcu

SEQ ID NO: 3676683 - RNA, 16 nt, Salmonella enterica enterica serovar Typhi
auguugccaugaucca

SEQ ID NO: 3676684 - RNA, 21 nt, Salmonella enterica enterica serovar Typhi
auguugccaugauccaucucg

SEQ ID NO: 3676685 - RNA, 17 nt, Salmonella enterica enterica serovar Typhi
auguugcguaaauaaau

SEQ ID NO: 3676686 - RNA, 14 nt, Salmonella enterica enterica serovar Typhi
auguugcugcugcg

SEQ ID NO: 3676687 - RNA, 22 nt, Salmonella enterica enterica serovar Typhi
auguuggauuauacauucgcuc

SEQ ID NO: 3676688 - RNA, 13 nt, Salmonella enterica enterica serovar Typhi
auguuggcgcccu

SEQ ID NO: 3676689 - RNA, 15 nt, Salmonella enterica enterica serovar Typhi
auguuguuccagagu

SEQ ID NO: 3676690 - RNA, 17 nt, Salmonella enterica enterica serovar Typhi
auguuguuccagagugc

SEQ ID NO: 3676691 - RNA, 14 nt, Salmonella enterica enterica serovar Typhi
auguuguuugaaaa

SEQ ID NO: 3676692 - RNA, 16 nt, Salmonella enterica enterica serovar Typhi
auguuuaaaagcgccu

SEQ ID NO: 3676693 - RNA, 15 nt, Salmonella enterica enterica serovar Typhi
auguuuccguuugua

SEQ ID NO: 3676694 - RNA, 18 nt, Salmonella enterica enterica serovar Typhi
auguuucgacaguuucuu

SEQ ID NO: 3676695 - RNA, 20 nt, Salmonella enterica enterica serovar Typhi
auguuucgacaguuucuucu

SEQ ID NO: 3676696 - RNA, 16 nt, Salmonella enterica enterica serovar Typhi
auguuugccacgccaa

SEQ ID NO: 3676697 - RNA, 20 nt, Salmonella enterica enterica serovar Typhi
auguuuguaggcuuccagaa

SEQ ID NO: 3676698 - RNA, 14 nt, Salmonella enterica enterica serovar Typhi
auguuuuaccagua

SEQ ID NO: 3676699 - RNA, 19 nt, Salmonella enterica enterica serovar Typhi
auguuuuuaucagcuugcc

SEQ ID NO: 3676700 - RNA, 14 nt, Salmonella enterica enterica serovar Typhi
auguuuuuguuguu

SEQ ID NO: 3676701 - RNA, 15 nt, Salmonella enterica enterica serovar Typhi
auguuuuuucaucuc

SEQ ID NO: 3676702 - RNA, 15 nt, Salmonella enterica enterica serovar Typhi
auuaaaaaggccgac

SEQ ID NO: 3676703 - RNA, 15 nt, Salmonella enterica enterica serovar Typhi
auuaaaaauacccca

SEQ ID NO: 3676704 - RNA, 22 nt, Salmonella enterica enterica serovar Typhi
auuaaaaauaccccaggggcau

SEQ ID NO: 3676705 - RNA, 23 nt, Salmonella enterica enterica serovar Typhi
auuaaaagucaacugcucuacca

SEQ ID NO: 3676706 - RNA, 22 nt, Salmonella enterica enterica serovar Typhi
auuaaacagacaauaccagggc

SEQ ID NO: 3676707 - RNA, 17 nt, Salmonella enterica enterica serovar Typhi
auuaaagauuagcguuu

SEQ ID NO: 3676708 - RNA, 20 nt, Salmonella enterica enterica serovar Typhi
auuaaagauuagcguuuuua

SEQ ID NO: 3676709 - RNA, 21 nt, Salmonella enterica enterica serovar Typhi
auuaaagauuagcguuuuuau

SEQ ID NO: 3676710 - RNA, 21 nt, Salmonella enterica enterica serovar Typhi
auuaaagcacaagaacuuaaa

SEQ ID NO: 3676711 - RNA, 11 nt, Salmonella enterica enterica serovar Typhi
auuaaagccac

SEQ ID NO: 3676712 - RNA, 13 nt, Salmonella enterica enterica serovar Typhi
auuaaagccccuu

SEQ ID NO: 3676713 - RNA, 17 nt, Salmonella enterica enterica serovar Typhi
auuaaaguucagccgau

SEQ ID NO: 3676714 - RNA, 22 nt, Salmonella enterica enterica serovar Typhi
auuaaauaaauaguaaauagaa

SEQ ID NO: 3676715 - RNA, 18 nt, Salmonella enterica enterica serovar Typhi
auuaaauaacaaaugaag

SEQ ID NO: 3676716 - RNA, 21 nt, Salmonella enterica enterica serovar Typhi
auuaaaucagauaacaaugac

SEQ ID NO: 3676717 - RNA, 20 nt, Salmonella enterica enterica serovar Typhi
auuaaauccugaaacccaua

SEQ ID NO: 3676718 - RNA, 21 nt, Salmonella enterica enterica serovar Typhi
auuaaaugacgcccugcgcca

SEQ ID NO: 3676719 - RNA, 16 nt, Salmonella enterica enterica serovar Typhi
auuaaaugacggacca

SEQ ID NO: 3676720 - RNA, 18 nt, Salmonella enterica enterica serovar Typhi
auuaaaugcgccagcggc

SEQ ID NO: 3676721 - RNA, 12 nt, Salmonella enterica enterica serovar Typhi
auuaacaaauaa

SEQ ID NO: 3676722 - RNA, 13 nt, Salmonella enterica enterica serovar Typhi
auuaacaaauaaa

SEQ ID NO: 3676723 - RNA, 20 nt, Salmonella enterica enterica serovar Typhi
auuaacagcgccaucaggaa

SEQ ID NO: 3676724 - RNA, 23 nt, Salmonella enterica enterica serovar Typhi
auuaacaggcgccggggcagcaa

SEQ ID NO: 3676725 - RNA, 16 nt, Salmonella enterica enterica serovar Typhi
auuaacagucuaucgc

SEQ ID NO: 3676726 - RNA, 17 nt, Salmonella enterica enterica serovar Typhi
auuaacagucuaucgcu

SEQ ID NO: 3676727 - RNA, 15 nt, Salmonella enterica enterica serovar Typhi
auuaacauuuaagaa

SEQ ID NO: 3676728 - RNA, 18 nt, Salmonella enterica enterica serovar Typhi
auuaacccacaugccggu

SEQ ID NO: 3676729 - RNA, 15 nt, Salmonella enterica enterica serovar Typhi
auuaacgcgaaaaua

SEQ ID NO: 3676730 - RNA, 16 nt, Salmonella enterica enterica serovar Typhi
auuaacgcgaaaauac

SEQ ID NO: 3676731 - RNA, 23 nt, Salmonella enterica enterica serovar Typhi
auuaacgcggugacuuuggccgg

SEQ ID NO: 3676732 - RNA, 19 nt, Salmonella enterica enterica serovar Typhi
auuaacgucacgauggcga

SEQ ID NO: 3676733 - RNA, 12 nt, Salmonella enterica enterica serovar Typhi
auuaacucauca

SEQ ID NO: 3676734 - RNA, 13 nt, Salmonella enterica enterica serovar Typhi
auuaacucuuccg

SEQ ID NO: 3676735 - RNA, 23 nt, Salmonella enterica enterica serovar Typhi
auuaacuugacuuugcucuccuu

SEQ ID NO: 3676736 - RNA, 21 nt, Salmonella enterica enterica serovar Typhi
auuaagaccauacuuugcauu

SEQ ID NO: 3676737 - RNA, 15 nt, Salmonella enterica enterica serovar Typhi
auuaagcaauccauu

SEQ ID NO: 3676738 - RNA, 20 nt, Salmonella enterica enterica serovar Typhi
auuaagcaauccauuuuaaa

SEQ ID NO: 3676739 - RNA, 13 nt, Salmonella enterica enterica serovar Typhi
auuaagcaggccg

SEQ ID NO: 3676740 - RNA, 23 nt, Salmonella enterica enterica serovar Typhi
auuaagcaggccgauauugcggc

SEQ ID NO: 3676741 - RNA, 17 nt, Salmonella enterica enterica serovar Typhi
auuaagccauauggcau

SEQ ID NO: 3676742 - RNA, 18 nt, Salmonella enterica enterica serovar Typhi
auuaagcgaauccagcgc

SEQ ID NO: 3676743 - RNA, 21 nt, Salmonella enterica enterica serovar Typhi
auuaagcugauauuuuacuuu

SEQ ID NO: 3676744 - RNA, 12 nt, Salmonella enterica enterica serovar Typhi
auuaaguuuuuu

SEQ ID NO: 3676745 - RNA, 17 nt, Salmonella enterica enterica serovar Typhi
auuaaguuuuuuuaaaa

SEQ ID NO: 3676746 - RNA, 17 nt, Salmonella enterica enterica serovar Typhi
auuaauaaacaaugcag

SEQ ID NO: 3676747 - RNA, 13 nt, Salmonella enterica enterica serovar Typhi
auuaauacccaua

SEQ ID NO: 3676748 - RNA, 14 nt, Salmonella enterica enterica serovar Typhi
auuaauaugcgcaa

SEQ ID NO: 3676749 - RNA, 18 nt, Salmonella enterica enterica serovar Typhi
auuaaucccaacccgacc

SEQ ID NO: 3676750 - RNA, 12 nt, Salmonella enterica enterica serovar Typhi
auuaauccugcg

SEQ ID NO: 3676751 - RNA, 14 nt, Salmonella enterica enterica serovar Typhi
auuaauccugcgcu

SEQ ID NO: 3676752 - RNA, 14 nt, Salmonella enterica enterica serovar Typhi
auuaaucgccagca

SEQ ID NO: 3676753 - RNA, 18 nt, Salmonella enterica enterica serovar Typhi
auuaaucugugagcacag

SEQ ID NO: 3676754 - RNA, 20 nt, Salmonella enterica enterica serovar Typhi
auuaaugaauaaaugaauua

SEQ ID NO: 3676755 - RNA, 17 nt, Salmonella enterica enterica serovar Typhi
auuaaugauuaaaauaa

SEQ ID NO: 3676756 - RNA, 18 nt, Salmonella enterica enterica serovar Typhi
auuaaugauuaaaauaaa

SEQ ID NO: 3676757 - RNA, 15 nt, Salmonella enterica enterica serovar Typhi
auuaaugauuugcuu

SEQ ID NO: 3676758 - RNA, 17 nt, Salmonella enterica enterica serovar Typhi
auuaaugcuccaauaaa

SEQ ID NO: 3676759 - RNA, 18 nt, Salmonella enterica enterica serovar Typhi
auuaaugcuccaauaaau

SEQ ID NO: 3676760 - RNA, 19 nt, Salmonella enterica enterica serovar Typhi
auuaaugcuccaauaaaua

SEQ ID NO: 3676761 - RNA, 14 nt, Salmonella enterica enterica serovar Typhi
auuaauggcgcaau

SEQ ID NO: 3676762 - RNA, 22 nt, Salmonella enterica enterica serovar Typhi
auuaauucccgcagccagcaau

SEQ ID NO: 3676763 - RNA, 21 nt, Salmonella enterica enterica serovar Typhi
auuaauucuuuuaacauaagu

SEQ ID NO: 3676764 - RNA, 16 nt, Salmonella enterica enterica serovar Typhi
auuaauuuacugauaa

SEQ ID NO: 3676765 - RNA, 18 nt, Salmonella enterica enterica serovar Typhi
auuaauuuauccaacagg

SEQ ID NO: 3676766 - RNA, 15 nt, Salmonella enterica enterica serovar Typhi
auuaauuuucacgcu

SEQ ID NO: 3676767 - RNA, 17 nt, Salmonella enterica enterica serovar Typhi
auuauuuucuaaaaucu

SEQ ID NO: 3676768 - RNA, 14 nt, Salmonella enterica enterica serovar Typhi
auuauuuuuaaaua

SEQ ID NO: 3676769 - RNA, 18 nt, Salmonella enterica enterica serovar Typhi
auuauuuuuaaauaacuu

SEQ ID NO: 3676770 - RNA, 17 nt, Salmonella enterica enterica serovar Typhi
auuauuuuucaaaugau

SEQ ID NO: 3676771 - RNA, 20 nt, Salmonella enterica enterica serovar Typhi
auucaaauguuguuugaaaa

SEQ ID NO: 3676772 - RNA, 19 nt, Salmonella enterica enterica serovar Typhi
auucaacacauuccauuuu

SEQ ID NO: 3676773 - RNA, 19 nt, Salmonella enterica enterica serovar Typhi
auucaacagggguuccggc

SEQ ID NO: 3676774 - RNA, 23 nt, Salmonella enterica enterica serovar Typhi
ugcggcaauggccgcagcgccau

SEQ ID NO: 3676775 - RNA, 18 nt, Salmonella enterica enterica serovar Typhi
ugcggcaauggcucaggc

SEQ ID NO: 3676776 - RNA, 19 nt, Salmonella enterica enterica serovar Typhi
ugcggcacacagccaaaau

SEQ ID NO: 3676777 - RNA, 13 nt, Salmonella enterica enterica serovar Typhi
ugcggcaucagau

SEQ ID NO: 3676778 - RNA, 19 nt, Salmonella enterica enterica serovar Typhi
ugcggcaucagauggcgau

SEQ ID NO: 3676779 - RNA, 21 nt, Salmonella enterica enterica serovar Typhi
ugcggccagacaauacuuaaa

SEQ ID NO: 3676780 - RNA, 15 nt, Salmonella enterica enterica serovar Typhi
ugcggccauccugcg

SEQ ID NO: 3676781 - RNA, 18 nt, Salmonella enterica enterica serovar Typhi
ugcggccgaugccguaag

SEQ ID NO: 3676782 - RNA, 20 nt, Salmonella enterica enterica serovar Typhi
ugcggccuugccgccagcgc

SEQ ID NO: 3676783 - RNA, 19 nt, Salmonella enterica enterica serovar Typhi
ugcggccuuuauccagcgg

SEQ ID NO: 3676784 - RNA, 22 nt, Salmonella enterica enterica serovar Typhi
ugcggcgaagcaucuuuccgga

SEQ ID NO: 3676785 - RNA, 17 nt, Salmonella enterica enterica serovar Typhi
ugcggcgcgcccggcaa

SEQ ID NO: 3676786 - RNA, 15 nt, Salmonella enterica enterica serovar Typhi
ugcggcgcuuccaga

SEQ ID NO: 3676787 - RNA, 16 nt, Salmonella enterica enterica serovar Typhi
ugcggcggccucuuug

SEQ ID NO: 3676788 - RNA, 23 nt, Salmonella enterica enterica serovar Typhi
ugcggcggggauaaucagcagcg

SEQ ID NO: 3676789 - RNA, 17 nt, Salmonella enterica enterica serovar Typhi
ugcggcuauauaaaauc

SEQ ID NO: 3676790 - RNA, 15 nt, Salmonella enterica enterica serovar Typhi
ugcggcuuacccuga

SEQ ID NO: 3676791 - RNA, 17 nt, Salmonella enterica enterica serovar Typhi
ugcggcuucagcgacau

SEQ ID NO: 3676792 - RNA, 18 nt, Salmonella enterica enterica serovar Typhi
ugcgggcaugggaaauaa

SEQ ID NO: 3676793 - RNA, 19 nt, Salmonella enterica enterica serovar Typhi
ugcgggccagcagccaggc

SEQ ID NO: 3676794 - RNA, 16 nt, Salmonella enterica enterica serovar Typhi
ugcgggcgaucggcug

SEQ ID NO: 3676795 - RNA, 15 nt, Salmonella enterica enterica serovar Typhi
ugcgguaaauaaugc

SEQ ID NO: 3676796 - RNA, 13 nt, Salmonella enterica enterica serovar Typhi
ugcgguaccgcgu

SEQ ID NO: 3676797 - RNA, 15 nt, Salmonella enterica enterica serovar Typhi
ugcgguaccgcguua

SEQ ID NO: 3676798 - RNA, 19 nt, Salmonella enterica enterica serovar Typhi
ugcgguagagaacagcauc

SEQ ID NO: 3676799 - RNA, 14 nt, Salmonella enterica enterica serovar Typhi
ugcgguagcgccga

SEQ ID NO: 3676800 - RNA, 17 nt, Salmonella enterica enterica serovar Typhi
ugcgguagcuccagaca

SEQ ID NO: 3676801 - RNA, 19 nt, Salmonella enterica enterica serovar Typhi
ugcgguaguccgccagcac

SEQ ID NO: 3676802 - RNA, 22 nt, Salmonella enterica enterica serovar Typhi
ugcggucguauuuaccgcuggc

SEQ ID NO: 3676803 - RNA, 21 nt, Salmonella enterica enterica serovar Typhi
ugcgguggccgacuuaucgac

SEQ ID NO: 3676804 - RNA, 17 nt, Salmonella enterica enterica serovar Typhi
ugcgguucucccggcau

SEQ ID NO: 3676805 - RNA, 22 nt, Salmonella enterica enterica serovar Typhi
ugcgguuuuccugaugauauuu

SEQ ID NO: 3676806 - RNA, 16 nt, Salmonella enterica enterica serovar Typhi
ugcguaaaaucgcagu

SEQ ID NO: 3676807 - RNA, 17 nt, Salmonella enterica enterica serovar Typhi
ugcguaaucagcuuuuc

SEQ ID NO: 3676808 - RNA, 17 nt, Salmonella enterica enterica serovar Typhi
ugcguaauccggccugg

SEQ ID NO: 3676809 - RNA, 19 nt, Salmonella enterica enterica serovar Typhi
ugcguaaugagcgucgcca

SEQ ID NO: 3676810 - RNA, 20 nt, Salmonella enterica enterica serovar Typhi
ugcguaggggcgaccgggcg

SEQ ID NO: 3676811 - RNA, 14 nt, Salmonella enterica enterica serovar Typhi
ugcguauccagcgc

SEQ ID NO: 3676812 - RNA, 15 nt, Salmonella enterica enterica serovar Typhi
ugcguaucgcccacc

SEQ ID NO: 3676813 - RNA, 11 nt, Salmonella enterica enterica serovar Typhi
ugcgucaacgc

SEQ ID NO: 3676814 - RNA, 23 nt, Salmonella enterica enterica serovar Typhi
ugcgucaaucaggaaagagccgc

SEQ ID NO: 3676815 - RNA, 15 nt, Salmonella enterica enterica serovar Typhi
ugcgucaccgggcug

SEQ ID NO: 3676816 - RNA, 16 nt, Salmonella enterica enterica serovar Typhi
ugcgucagcgcccgau

SEQ ID NO: 3676817 - RNA, 13 nt, Salmonella enterica enterica serovar Typhi
ugcgucaguaccu

SEQ ID NO: 3676818 - RNA, 14 nt, Salmonella enterica enterica serovar Typhi
ugcguccgccagau

SEQ ID NO: 3676819 - RNA, 14 nt, Salmonella enterica enterica serovar Typhi
ugcguccgccgcua

SEQ ID NO: 3676820 - RNA, 19 nt, Salmonella enterica enterica serovar Typhi
ugcgucgcgcuuucaaucg

SEQ ID NO: 3676821 - RNA, 20 nt, Salmonella enterica enterica serovar Typhi
ugcgucgcgcuuucaaucgu

SEQ ID NO: 3676822 - RNA, 17 nt, Salmonella enterica enterica serovar Typhi
ugcgucgcguaccagcg

SEQ ID NO: 3676823 - RNA, 20 nt, Salmonella enterica enterica serovar Typhi
ugcgucgcguaccagcgccc

SEQ ID NO: 3676824 - RNA, 15 nt, Salmonella enterica enterica serovar Typhi
ugcgugaaucccguu

SEQ ID NO: 3676825 - RNA, 17 nt, Salmonella enterica enterica serovar Typhi
ugcgugacaaucuccuc

SEQ ID NO: 3676826 - RNA, 14 nt, Salmonella enterica enterica serovar Typhi
ugcgugaugcugca

SEQ ID NO: 3676827 - RNA, 23 nt, Salmonella enterica enterica serovar Typhi
ugcguuaaacgcugugaccagua

SEQ ID NO: 3676828 - RNA, 16 nt, Salmonella enterica enterica serovar Typhi
ugcguuacucgauggc

SEQ ID NO: 3676829 - RNA, 20 nt, Salmonella enterica enterica serovar Typhi
ugcguucaggcggcaaaaaa

SEQ ID NO: 3676830 - RNA, 12 nt, Salmonella enterica enterica serovar Typhi
ugcguucuucca

SEQ ID NO: 3676831 - RNA, 13 nt, Salmonella enterica enterica serovar Typhi
ugcguucuuccac

SEQ ID NO: 3676832 - RNA, 21 nt, Salmonella enterica enterica serovar Typhi
ugcguucuuccacuucagcag

SEQ ID NO: 3676833 - RNA, 14 nt, Salmonella enterica enterica serovar Typhi
ugcguugaccagcg

SEQ ID NO: 3676834 - RNA, 23 nt, Salmonella enterica enterica serovar Typhi
ugcguuggaagugcguuaacccg

SEQ ID NO: 3676835 - RNA, 16 nt, Salmonella enterica enterica serovar Typhi
ugcuaaaagaagcugu

SEQ ID NO: 3676836 - RNA, 14 nt, Salmonella enterica enterica serovar Typhi
ugcuaacagugaaa

SEQ ID NO: 3676837 - RNA, 22 nt, Salmonella enterica enterica serovar Typhi
ugcuaagcuggauaccgcgcca

SEQ ID NO: 3676838 - RNA, 22 nt, Salmonella enterica enterica serovar Typhi
ugcuacaggcaaguuuaauucc

SEQ ID NO: 3676839 - RNA, 23 nt, Salmonella enterica enterica serovar Typhi
ugcuacgaaccugauuguuuuac

SEQ ID NO: 3676840 - RNA, 12 nt, Salmonella enterica enterica serovar Typhi
ugcuacgcgcca

SEQ ID NO: 3676841 - RNA, 20 nt, Salmonella enterica enterica serovar Typhi
ugcuacgggcgcugucgccg

SEQ ID NO: 3676842 - RNA, 21 nt, Salmonella enterica enterica serovar Typhi
ugcuauaugcaggcauaaaaa

SEQ ID NO: 3676843 - RNA, 23 nt, Salmonella enterica enterica serovar Typhi
ugcuauaugcaggcauaaaaaag

SEQ ID NO: 3676844 - RNA, 15 nt, Salmonella enterica enterica serovar Typhi
uggaccgcagcuuau

SEQ ID NO: 3676845 - RNA, 20 nt, Salmonella enterica enterica serovar Typhi
uggaccgcagcuuauuccag

SEQ ID NO: 3676846 - RNA, 20 nt, Salmonella enterica enterica serovar Typhi
uggacgugccuuccaucggc

SEQ ID NO: 3676847 - RNA, 22 nt, Salmonella enterica enterica serovar Typhi
uggacguggauauucaucaguu

SEQ ID NO: 3676848 - RNA, 20 nt, Salmonella enterica enterica serovar Typhi
uggagagcaucaucugccau

SEQ ID NO: 3676849 - RNA, 19 nt, Salmonella enterica enterica serovar Typhi
uggagaggccaccagcgcc

SEQ ID NO: 3676850 - RNA, 16 nt, Salmonella enterica enterica serovar Typhi
uggagcguaagcgcgg

SEQ ID NO: 3676851 - RNA, 15 nt, Salmonella enterica enterica serovar Typhi
uggaggaacagcgcc

SEQ ID NO: 3676852 - RNA, 17 nt, Salmonella enterica enterica serovar Typhi
uggaggaacagcgccgu

SEQ ID NO: 3676853 - RNA, 20 nt, Salmonella enterica enterica serovar Typhi
uggaguacgggcagaugguc

SEQ ID NO: 3676854 - RNA, 17 nt, Salmonella enterica enterica serovar Typhi
uggaguagauguagcug

SEQ ID NO: 3676855 - RNA, 18 nt, Salmonella enterica enterica serovar Typhi
uggagucugaaaauaauu

SEQ ID NO: 3676856 - RNA, 15 nt, Salmonella enterica enterica serovar Typhi
uggaguuaucauuau

SEQ ID NO: 3676857 - RNA, 23 nt, Salmonella enterica enterica serovar Typhi
uggaguuaucauuauauagucuu

SEQ ID NO: 3676858 - RNA, 23 nt, Salmonella enterica enterica serovar Typhi
uggaguuuaaacacucuccacca

SEQ ID NO: 3676859 - RNA, 15 nt, Salmonella enterica enterica serovar Typhi
uggauaaaucgguca

SEQ ID NO: 3676860 - RNA, 11 nt, Salmonella enterica enterica serovar Typhi Ty2
acauuacccau

SEQ ID NO: 3676861 - RNA, 22 nt, Salmonella enterica enterica serovar Typhi Ty2
acauuagagaguaaaaccggca

SEQ ID NO: 3676862 - RNA, 20 nt, Salmonella enterica enterica serovar Typhi Ty2
acauuagcggugcgucaugc

SEQ ID NO: 3676863 - RNA, 14 nt, Salmonella enterica enterica serovar Typhi Ty2
acauuaugcgcaug

SEQ ID NO: 3676864 - RNA, 21 nt, Salmonella enterica enterica serovar Typhi Ty2
acauuauuaaaaugucuuuuc

SEQ ID NO: 3676865 - RNA, 23 nt, Salmonella enterica enterica serovar Typhi Ty2
acauuauucacgcuauguuugcu

SEQ ID NO: 3676866 - RNA, 15 nt, Salmonella enterica enterica serovar Typhi Ty2
acauuauugucuuug

SEQ ID NO: 3676867 - RNA, 13 nt, Salmonella enterica enterica serovar Typhi Ty2
acauucagcacau

SEQ ID NO: 3676868 - RNA, 15 nt, Salmonella enterica enterica serovar Typhi Ty2
acauucaggcgguaa

SEQ ID NO: 3676869 - RNA, 18 nt, Salmonella enterica enterica serovar Typhi Ty2
acauucauugccgccagu

SEQ ID NO: 3676870 - RNA, 21 nt, Salmonella enterica enterica serovar Typhi Ty2
acauuccauuuuucgaucuuc

SEQ ID NO: 3676871 - RNA, 22 nt, Salmonella enterica enterica serovar Typhi Ty2
acauugagcgucaggccaucgc

SEQ ID NO: 3676872 - RNA, 14 nt, Salmonella enterica enterica serovar Typhi Ty2
acauugaguaaaua

SEQ ID NO: 3676873 - RNA, 14 nt, Salmonella enterica enterica serovar Typhi Ty2
acauugccggcauc

SEQ ID NO: 3676874 - RNA, 15 nt, Salmonella enterica enterica serovar Typhi Ty2
acauugccggcauca

SEQ ID NO: 3676875 - RNA, 18 nt, Salmonella enterica enterica serovar Typhi Ty2
acauugcuguggaaaauc

SEQ ID NO: 3676876 - RNA, 20 nt, Salmonella enterica enterica serovar Typhi Ty2
acauugcuguggaaaaucug

SEQ ID NO: 3676877 - RNA, 22 nt, Salmonella enterica enterica serovar Typhi Ty2
acauuggcaaaccccugcucgc

SEQ ID NO: 3676878 - RNA, 14 nt, Salmonella enterica enterica serovar Typhi Ty2
acauuggcgcggca

SEQ ID NO: 3676879 - RNA, 18 nt, Salmonella enterica enterica serovar Typhi Ty2
acauugucagcugaacag

SEQ ID NO: 3676880 - RNA, 16 nt, Salmonella enterica enterica serovar Typhi Ty2
acauuguucuaaacgu

SEQ ID NO: 3676881 - RNA, 16 nt, Salmonella enterica enterica serovar Typhi Ty2
acauuuaagauuuaaa

SEQ ID NO: 3676882 - RNA, 20 nt, Salmonella enterica enterica serovar Typhi Ty2
acauuuaagauuuaaaacaa

SEQ ID NO: 3676883 - RNA, 21 nt, Salmonella enterica enterica serovar Typhi Ty2
acauuuaagauuuaaaacaag

SEQ ID NO: 3676884 - RNA, 17 nt, Salmonella enterica enterica serovar Typhi Ty2
acauuuacgccagccag

SEQ ID NO: 3676885 - RNA, 12 nt, Salmonella enterica enterica serovar Typhi Ty2
acauuuauauua

SEQ ID NO: 3676886 - RNA, 20 nt, Salmonella enterica enterica serovar Typhi Ty2
acauuucccgagccggguua

SEQ ID NO: 3676887 - RNA, 18 nt, Salmonella enterica enterica serovar Typhi Ty2
acauuuuuacaguuacca

SEQ ID NO: 3676888 - RNA, 20 nt, Salmonella enterica enterica serovar Typhi Ty2
accaaaaacgcccccagaua

SEQ ID NO: 3676889 - RNA, 13 nt, Salmonella enterica enterica serovar Typhi Ty2
accaaaacaguac

SEQ ID NO: 3676890 - RNA, 13 nt, Salmonella enterica enterica serovar Typhi Ty2
accaaaaggcaga

SEQ ID NO: 3676891 - RNA, 15 nt, Salmonella enterica enterica serovar Typhi Ty2
accaaacgaauuuaa

SEQ ID NO: 3676892 - RNA, 12 nt, Salmonella enterica enterica serovar Typhi Ty2
accaaagccagg

SEQ ID NO: 3676893 - RNA, 21 nt, Salmonella enterica enterica serovar Typhi Ty2
accaaagccaggccgccagca

SEQ ID NO: 3676894 - RNA, 16 nt, Salmonella enterica enterica serovar Typhi Ty2
accaaagucaaacuga

SEQ ID NO: 3676895 - RNA, 22 nt, Salmonella enterica enterica serovar Typhi Ty2
accaaaguccaacuguuaucau

SEQ ID NO: 3676896 - RNA, 15 nt, Salmonella enterica enterica serovar Typhi Ty2
accaaaucaauagaa

SEQ ID NO: 3676897 - RNA, 15 nt, Salmonella enterica enterica serovar Typhi Ty2
accaaaugcccagcu

SEQ ID NO: 3676898 - RNA, 14 nt, Salmonella enterica enterica serovar Typhi Ty2
accaacaacagaua

SEQ ID NO: 3676899 - RNA, 14 nt, Salmonella enterica enterica serovar Typhi Ty2
accaacaucauuau

SEQ ID NO: 3676900 - RNA, 13 nt, Salmonella enterica enterica serovar Typhi Ty2
accaaccaacagg

SEQ ID NO: 3676901 - RNA, 15 nt, Salmonella enterica enterica serovar Typhi Ty2
accaacccagccugc

SEQ ID NO: 3676902 - RNA, 17 nt, Salmonella enterica enterica serovar Typhi Ty2
accaaccgccagucacc

SEQ ID NO: 3676903 - RNA, 16 nt, Salmonella enterica enterica serovar Typhi Ty2
accaacgcauaaaaac

SEQ ID NO: 3676904 - RNA, 15 nt, Salmonella enterica enterica serovar Typhi Ty2
accaacggcgcuggc

SEQ ID NO: 3676905 - RNA, 20 nt, Salmonella enterica enterica serovar Typhi Ty2
accaacgucgugccagugau

SEQ ID NO: 3676906 - RNA, 18 nt, Salmonella enterica enterica serovar Typhi Ty2
accaacguuuuuccuuga

SEQ ID NO: 3676907 - RNA, 16 nt, Salmonella enterica enterica serovar Typhi Ty2
accaagucucaggagu

SEQ ID NO: 3676908 - RNA, 22 nt, Salmonella enterica enterica serovar Typhi Ty2
accaauaaaggucggcugcccu

SEQ ID NO: 3676909 - RNA, 23 nt, Salmonella enterica enterica serovar Typhi Ty2
accaauaauaaucccaacauggu

SEQ ID NO: 3676910 - RNA, 21 nt, Salmonella enterica enterica serovar Typhi Ty2
accaauaauugccgaauauug

SEQ ID NO: 3676911 - RNA, 22 nt, Salmonella enterica enterica serovar Typhi Ty2
accaauagagagcgacagcccg

SEQ ID NO: 3676912 - RNA, 13 nt, Salmonella enterica enterica serovar Typhi Ty2
accaauagccuug

SEQ ID NO: 3676913 - RNA, 14 nt, Salmonella enterica enterica serovar Typhi Ty2
accaauaguaucca

SEQ ID NO: 3676914 - RNA, 16 nt, Salmonella enterica enterica serovar Typhi Ty2
accaauaguauccaua

SEQ ID NO: 3676915 - RNA, 17 nt, Salmonella enterica enterica serovar Typhi Ty2
accaaugccaaaaaaac

SEQ ID NO: 3676916 - RNA, 14 nt, Salmonella enterica enterica serovar Typhi Ty2
accaauggcgcguc

SEQ ID NO: 3676917 - RNA, 14 nt, Salmonella enterica enterica serovar Typhi Ty2
accagcaucgcguu

SEQ ID NO: 3676918 - RNA, 13 nt, Salmonella enterica enterica serovar Typhi Ty2
accagcaugugcc

SEQ ID NO: 3676919 - RNA, 16 nt, Salmonella enterica enterica serovar Typhi Ty2
accagccacugcgcca

SEQ ID NO: 3676920 - RNA, 13 nt, Salmonella enterica enterica serovar Typhi Ty2
accagccaugcca

SEQ ID NO: 3676921 - RNA, 22 nt, Salmonella enterica enterica serovar Typhi Ty2
accagcccaacggucuuugccg

SEQ ID NO: 3676922 - RNA, 18 nt, Salmonella enterica enterica serovar Typhi Ty2
accagccgaucaucacga

SEQ ID NO: 3676923 - RNA, 18 nt, Salmonella enterica enterica serovar Typhi Ty2
accagccgcaucuuauau

SEQ ID NO: 3676924 - RNA, 19 nt, Salmonella enterica enterica serovar Typhi Ty2
accagccuaccugccgcca

SEQ ID NO: 3676925 - RNA, 14 nt, Salmonella enterica enterica serovar Typhi Ty2
accagccugccguc

SEQ ID NO: 3676926 - RNA, 15 nt, Salmonella enterica enterica serovar Typhi Ty2
accagcgacggccag

SEQ ID NO: 3676927 - RNA, 15 nt, Salmonella enterica enterica serovar Typhi Ty2
accagcgacggcgua

SEQ ID NO: 3676928 - RNA, 19 nt, Salmonella enterica enterica serovar Typhi Ty2
accagcgcaguaaacuccu

SEQ ID NO: 3676929 - RNA, 12 nt, Salmonella enterica enterica serovar Typhi Ty2
accagcgcaucu

SEQ ID NO: 3676930 - RNA, 17 nt, Salmonella enterica enterica serovar Typhi Ty2
accagcgcauugacgau

SEQ ID NO: 3676931 - RNA, 15 nt, Salmonella enterica enterica serovar Typhi Ty2
accagcgccauaauc

SEQ ID NO: 3676932 - RNA, 14 nt, Salmonella enterica enterica serovar Typhi Ty2
accagcgccgccag

SEQ ID NO: 3676933 - RNA, 15 nt, Salmonella enterica enterica serovar Typhi Ty2
accagcgccugcgcu

SEQ ID NO: 3676934 - RNA, 12 nt, Salmonella enterica enterica serovar Typhi Ty2
accagcgcgcca

SEQ ID NO: 3676935 - RNA, 14 nt, Salmonella enterica enterica serovar Typhi Ty2
accagcgcgccaaa

SEQ ID NO: 3676936 - RNA, 13 nt, Salmonella enterica enterica serovar Typhi Ty2
accagcgcggcac

SEQ ID NO: 3676937 - RNA, 15 nt, Salmonella enterica enterica serovar Typhi Ty2
accagcgcggcgcca

SEQ ID NO: 3676938 - RNA, 16 nt, Salmonella enterica enterica serovar Typhi Ty2
accagcgcuauccagg

SEQ ID NO: 3676939 - RNA, 22 nt, Salmonella enterica enterica serovar Typhi Ty2
accagcggaauccccgccgcca

SEQ ID NO: 3676940 - RNA, 20 nt, Salmonella enterica enterica serovar Typhi Ty2
accagcgggccgcugauguu

SEQ ID NO: 3676941 - RNA, 19 nt, Salmonella enterica enterica serovar Typhi Ty2
accagcgguaugcaccucu

SEQ ID NO: 3676942 - RNA, 22 nt, Salmonella enterica enterica serovar Typhi Ty2
accagcgguugcauaaaauccu

SEQ ID NO: 3676943 - RNA, 19 nt, Salmonella enterica enterica serovar Typhi Ty2
accagcguggcuauccaua

SEQ ID NO: 3676944 - RNA, 19 nt, Salmonella enterica enterica serovar Typhi Ty2
accagcugacgacgccagc

SEQ ID NO: 3676945 - RNA, 22 nt, Salmonella enterica enterica serovar Typhi Ty2
accagcugacgacgccagcccu

SEQ ID NO: 3676946 - RNA, 15 nt, Salmonella enterica enterica serovar Typhi Ty2
accagcugacgcagc

SEQ ID NO: 3676947 - RNA, 18 nt, Salmonella enterica enterica serovar Typhi Ty2
accagcugacgcagcagu

SEQ ID NO: 3676948 - RNA, 21 nt, Salmonella enterica enterica serovar Typhi Ty2
accagcuuguuauccaucagc

SEQ ID NO: 3676949 - RNA, 14 nt, Salmonella enterica enterica serovar Typhi Ty2
accaggaacgccau

SEQ ID NO: 3676950 - RNA, 17 nt, Salmonella enterica enterica serovar Typhi Ty2
accaggaugccaaccac

SEQ ID NO: 3676951 - RNA, 23 nt, Salmonella enterica enterica serovar Typhi Ty2
accaggauggccagcaccagcau

SEQ ID NO: 3676952 - RNA, 17 nt, Salmonella enterica enterica serovar Typhi Ty2
accaggcaaaccagcac

SEQ ID NO: 3676953 - RNA, 14 nt, Salmonella enterica enterica serovar Typhi Ty2
accaggcacuugag

SEQ ID NO: 3676954 - RNA, 20 nt, Salmonella enterica enterica serovar Typhi Ty2
accaggcagcgcgccagcgc

SEQ ID NO: 3676955 - RNA, 15 nt, Salmonella enterica enterica serovar Typhi Ty2
accaggcaugcagcu

SEQ ID NO: 3676956 - RNA, 13 nt, Salmonella enterica enterica serovar Typhi Ty2
accaggcggcguu

SEQ ID NO: 3676957 - RNA, 13 nt, Salmonella enterica enterica serovar Typhi Ty2
accagguaauccg

SEQ ID NO: 3676958 - RNA, 22 nt, Salmonella enterica enterica serovar Typhi Ty2
accaggucuuaccuauuuuaaa

SEQ ID NO: 3676959 - RNA, 14 nt, Salmonella enterica enterica serovar Typhi Ty2
accaguaaccgcca

SEQ ID NO: 3676960 - RNA, 18 nt, Salmonella enterica enterica serovar Typhi Ty2
accaguaccgucauuucc

SEQ ID NO: 3676961 - RNA, 22 nt, Salmonella enterica enterica serovar Typhi Ty2
accaguccagugcgucacuuua

SEQ ID NO: 3676962 - RNA, 23 nt, Salmonella enterica enterica serovar Typhi Ty2
accaguccggcagaaagcagcag

SEQ ID NO: 3676963 - RNA, 22 nt, Salmonella enterica enterica serovar Typhi Ty2
accagugaacgucugcacggca

SEQ ID NO: 3676964 - RNA, 22 nt, Salmonella enterica enterica serovar Typhi Ty2
accagugcggcaaccaccagca

SEQ ID NO: 3676965 - RNA, 15 nt, Salmonella enterica enterica serovar Typhi Ty2
accaguggcggggca

SEQ ID NO: 3676966 - RNA, 14 nt, Salmonella enterica enterica serovar Typhi Ty2
accaguucacuccu

SEQ ID NO: 3676967 - RNA, 21 nt, Salmonella enterica enterica serovar Typhi Ty2
accaguuguuccgcgcugaug

SEQ ID NO: 3676968 - RNA, 13 nt, Salmonella enterica enterica serovar Typhi Ty2
accaguuuuuccg

SEQ ID NO: 3676969 - RNA, 16 nt, Salmonella enterica enterica serovar Typhi Ty2
accauaaacaaaacaa

SEQ ID NO: 3676970 - RNA, 22 nt, Salmonella enterica enterica serovar Typhi Ty2
accauaaacggcaccuggaagu

SEQ ID NO: 3676971 - RNA, 19 nt, Salmonella enterica enterica serovar Typhi Ty2
accauaaaugaaaccucaa

SEQ ID NO: 3676972 - RNA, 18 nt, Salmonella enterica enterica serovar Typhi Ty2
accauaaaugaaaugccc

SEQ ID NO: 3676973 - RNA, 14 nt, Salmonella enterica enterica serovar Typhi Ty2
accauaauuaccgg

SEQ ID NO: 3676974 - RNA, 21 nt, Salmonella enterica enterica serovar Typhi Ty2
accauaccgcuuaacagcgua

SEQ ID NO: 3676975 - RNA, 19 nt, Salmonella enterica enterica serovar Typhi Ty2
accauaccggugcgcccca

SEQ ID NO: 3676976 - RNA, 16 nt, Salmonella enterica enterica serovar Typhi Ty2
accauacugaccaaca

SEQ ID NO: 3676977 - RNA, 17 nt, Salmonella enterica enterica serovar Typhi Ty2
accauacugacuuaaua

SEQ ID NO: 3676978 - RNA, 23 nt, Salmonella enterica enterica serovar Typhi Ty2
accauacugcucaagaauacccu

SEQ ID NO: 3676979 - RNA, 21 nt, Salmonella enterica enterica serovar Typhi Ty2
accauagccguagcccuugau

SEQ ID NO: 3676980 - RNA, 21 nt, Salmonella enterica enterica serovar Typhi Ty2
accauaggccagcgucaccuc

SEQ ID NO: 3676981 - RNA, 16 nt, Salmonella enterica enterica serovar Typhi Ty2
accauaucgccgcugc

SEQ ID NO: 3676982 - RNA, 19 nt, Salmonella enterica enterica serovar Typhi Ty2
accauauuauucugcugaa

SEQ ID NO: 3676983 - RNA, 23 nt, Salmonella enterica enterica serovar Typhi Ty2
accauauuauucugcugaaaaag

SEQ ID NO: 3676984 - RNA, 14 nt, Salmonella enterica enterica serovar Typhi Ty2
accauauucacgca

SEQ ID NO: 3676985 - RNA, 15 nt, Salmonella enterica enterica serovar Typhi Ty2
accauauucccacag

SEQ ID NO: 3676986 - RNA, 20 nt, Salmonella enterica enterica serovar Typhi Ty2
accaucaaaaaaaauagcca

SEQ ID NO: 3676987 - RNA, 22 nt, Salmonella enterica enterica serovar Typhi Ty2
accaucagcgggcuaugcugaa

SEQ ID NO: 3676988 - RNA, 14 nt, Salmonella enterica enterica serovar Typhi Ty2
accaucaguucagg

SEQ ID NO: 3676989 - RNA, 16 nt, Salmonella enterica enterica serovar Typhi Ty2
accauccgcgccgagg

SEQ ID NO: 3676990 - RNA, 15 nt, Salmonella enterica enterica serovar Typhi Ty2
accauccggcgcugc

SEQ ID NO: 3676991 - RNA, 21 nt, Salmonella enterica enterica serovar Typhi Ty2
accauccgguuuuaaauuccu

SEQ ID NO: 3676992 - RNA, 23 nt, Salmonella enterica enterica serovar Typhi Ty2
accaucgcaaauucaucgccgcc

SEQ ID NO: 3676993 - RNA, 15 nt, Salmonella enterica enterica serovar Typhi Ty2
accaucgcauugccg

SEQ ID NO: 3676994 - RNA, 10 nt, Salmonella enterica enterica serovar Typhi Ty2
accaucgccg

SEQ ID NO: 3676995 - RNA, 14 nt, Salmonella enterica enterica serovar Typhi Ty2
accaucgccggaga

SEQ ID NO: 3676996 - RNA, 14 nt, Salmonella enterica enterica serovar Typhi Ty2
accaucggcgcgua

SEQ ID NO: 3676997 - RNA, 16 nt, Salmonella enterica enterica serovar Typhi Ty2
accaucuuuuccggca

SEQ ID NO: 3676998 - RNA, 15 nt, Salmonella enterica enterica serovar Typhi Ty2
accaugauaaccagc

SEQ ID NO: 3676999 - RNA, 21 nt, Salmonella enterica enterica serovar Typhi Ty2
acccgcgaucacuaccgccau

SEQ ID NO: 3677000 - RNA, 20 nt, Salmonella enterica enterica serovar Typhi Ty2
acccgcgcgcuuuccacaau

SEQ ID NO: 3677001 - RNA, 17 nt, Salmonella enterica enterica serovar Typhi Ty2
acccgcgcucuccggca

SEQ ID NO: 3677002 - RNA, 17 nt, Salmonella enterica enterica serovar Typhi Ty2
acccgcgugcggacgua

SEQ ID NO: 3677003 - RNA, 13 nt, Salmonella enterica enterica serovar Typhi Ty2
acccgcuaugaag

SEQ ID NO: 3677004 - RNA, 15 nt, Salmonella enterica enterica serovar Typhi Ty2
acccgcuaugaagac

SEQ ID NO: 3677005 - RNA, 19 nt, Salmonella enterica enterica serovar Typhi Ty2
acccgcucgcccgccgcaa

SEQ ID NO: 3677006 - RNA, 16 nt, Salmonella enterica enterica serovar Typhi Ty2
acccgcugcuucacgg

SEQ ID NO: 3677007 - RNA, 15 nt, Salmonella enterica enterica serovar Typhi Ty2
acccgcuuccaguuu

SEQ ID NO: 3677008 - RNA, 18 nt, Salmonella enterica enterica serovar Typhi Ty2
acccgcuuucgcguagcc

SEQ ID NO: 3677009 - RNA, 18 nt, Salmonella enterica enterica serovar Typhi Ty2
acccgcuuuuccuguucu

SEQ ID NO: 3677010 - RNA, 16 nt, Salmonella enterica enterica serovar Typhi Ty2
acccggagagaaacaa

SEQ ID NO: 3677011 - RNA, 14 nt, Salmonella enterica enterica serovar Typhi Ty2
acccggcccggcgc

SEQ ID NO: 3677012 - RNA, 22 nt, Salmonella enterica enterica serovar Typhi Ty2
acccggcugccauuaucaccau

SEQ ID NO: 3677013 - RNA, 16 nt, Salmonella enterica enterica serovar Typhi Ty2
acccggcuuuugcuuu

SEQ ID NO: 3677014 - RNA, 21 nt, Salmonella enterica enterica serovar Typhi Ty2
acccggcuuuuuuauugccua

SEQ ID NO: 3677015 - RNA, 18 nt, Salmonella enterica enterica serovar Typhi Ty2
acccgggaaaaaugacgc

SEQ ID NO: 3677016 - RNA, 21 nt, Salmonella enterica enterica serovar Typhi Ty2
acccgggccaucuuuuuucac

SEQ ID NO: 3677017 - RNA, 20 nt, Salmonella enterica enterica serovar Typhi Ty2
acccggugcggcaagcgcgc

SEQ ID NO: 3677018 - RNA, 22 nt, Salmonella enterica enterica serovar Typhi Ty2
acccgguguaaaaaauggguau

SEQ ID NO: 3677019 - RNA, 19 nt, Salmonella enterica enterica serovar Typhi Ty2
acccguuaaauaccagcac

SEQ ID NO: 3677020 - RNA, 20 nt, Salmonella enterica enterica serovar Typhi Ty2
acccguuaaauaccagcacc

SEQ ID NO: 3677021 - RNA, 21 nt, Salmonella enterica enterica serovar Typhi Ty2
acccuauaagcugccucuuug

SEQ ID NO: 3677022 - RNA, 18 nt, Salmonella enterica enterica serovar Typhi Ty2
acccuauugccacaauau

SEQ ID NO: 3677023 - RNA, 16 nt, Salmonella enterica enterica serovar Typhi Ty2
acccugagcgccgcca

SEQ ID NO: 3677024 - RNA, 15 nt, Salmonella enterica enterica serovar Typhi Ty2
acccugcugauacac

SEQ ID NO: 3677025 - RNA, 14 nt, Salmonella enterica enterica serovar Typhi Ty2
acccuucaugcagc

SEQ ID NO: 3677026 - RNA, 18 nt, Salmonella enterica enterica serovar Typhi Ty2
acccuuccccggcagccu

SEQ ID NO: 3677027 - RNA, 13 nt, Salmonella enterica enterica serovar Typhi Ty2
acccuuccuuuuc

SEQ ID NO: 3677028 - RNA, 20 nt, Salmonella enterica enterica serovar Typhi Ty2
acccuucuucuggcucagac

SEQ ID NO: 3677029 - RNA, 18 nt, Salmonella enterica enterica serovar Typhi Ty2
acccuuugaccauuacca

SEQ ID NO: 3677030 - RNA, 14 nt, Salmonella enterica enterica serovar Typhi Ty2
acccuuuggccacc

SEQ ID NO: 3677031 - RNA, 13 nt, Salmonella enterica enterica serovar Typhi Ty2
accgaaaucauca

SEQ ID NO: 3677032 - RNA, 22 nt, Salmonella enterica enterica serovar Typhi Ty2
accgacacgugguacacaauca

SEQ ID NO: 3677033 - RNA, 17 nt, Salmonella enterica enterica serovar Typhi Ty2
accgacagauagcccug

SEQ ID NO: 3677034 - RNA, 20 nt, Salmonella enterica enterica serovar Typhi Ty2
accgacagauagcccugagc

SEQ ID NO: 3677035 - RNA, 12 nt, Salmonella enterica enterica serovar Typhi Ty2
accgaccugccu

SEQ ID NO: 3677036 - RNA, 22 nt, Salmonella enterica enterica serovar Typhi Ty2
accgagaauguguucucccugc

SEQ ID NO: 3677037 - RNA, 14 nt, Salmonella enterica enterica serovar Typhi Ty2
accgagauacgcug

SEQ ID NO: 3677038 - RNA, 13 nt, Salmonella enterica enterica serovar Typhi Ty2
accgagcagcuug

SEQ ID NO: 3677039 - RNA, 20 nt, Salmonella enterica enterica serovar Typhi Ty2
accgagguucaccagcgcgc

SEQ ID NO: 3677040 - RNA, 24 nt, Salmonella enterica enterica serovar Typhi Ty2
accgaguaauguugaugucacuca

SEQ ID NO: 3677041 - RNA, 18 nt, Salmonella enterica enterica serovar Typhi Ty2
accgauaaucaccagccc

SEQ ID NO: 3677042 - RNA, 19 nt, Salmonella enterica enterica serovar Typhi Ty2
accgauaaucaccagcccg

SEQ ID NO: 3677043 - RNA, 18 nt, Salmonella enterica enterica serovar Typhi Ty2
accgauagcuaucacaca

SEQ ID NO: 3677044 - RNA, 12 nt, Salmonella enterica enterica serovar Typhi Ty2
accgaucaucau

SEQ ID NO: 3677045 - RNA, 16 nt, Salmonella enterica enterica serovar Typhi Ty2
accgaugcccagcuug

SEQ ID NO: 3677046 - RNA, 19 nt, Salmonella enterica enterica serovar Typhi Ty2
accgaugccgugaggcuga

SEQ ID NO: 3677047 - RNA, 21 nt, Salmonella enterica enterica serovar Typhi Ty2
accgaugugcguauugagcgc

SEQ ID NO: 3677048 - RNA, 18 nt, Salmonella enterica enterica serovar Typhi Ty2
accgauguuggcgacaga

SEQ ID NO: 3677049 - RNA, 17 nt, Salmonella enterica enterica serovar Typhi Ty2
accgauuucaucgcuga

SEQ ID NO: 3677050 - RNA, 18 nt, Salmonella enterica enterica serovar Typhi Ty2
accgcagaaacagauagu

SEQ ID NO: 3677051 - RNA, 14 nt, Salmonella enterica enterica serovar Typhi Ty2
accgcagaagguca

SEQ ID NO: 3677052 - RNA, 20 nt, Salmonella enterica enterica serovar Typhi Ty2
accgcagaaggucacgccgg

SEQ ID NO: 3677053 - RNA, 15 nt, Salmonella enterica enterica serovar Typhi Ty2
accgcagcgcggccu

SEQ ID NO: 3677054 - RNA, 14 nt, Salmonella enterica enterica serovar Typhi Ty2
accgcauacugaac

SEQ ID NO: 3677055 - RNA, 14 nt, Salmonella enterica enterica serovar Typhi Ty2
accgcaucacgcga

SEQ ID NO: 3677056 - RNA, 14 nt, Salmonella enterica enterica serovar Typhi Ty2
accgcaucacggca

SEQ ID NO: 3677057 - RNA, 15 nt, Salmonella enterica enterica serovar Typhi Ty2
accgcaucgcgccca

SEQ ID NO: 3677058 - RNA, 15 nt, Salmonella enterica enterica serovar Typhi Ty2
accgcaucggcauca

SEQ ID NO: 3677059 - RNA, 13 nt, Salmonella enterica enterica serovar Typhi Ty2
accgcaugacaau

SEQ ID NO: 3677060 - RNA, 15 nt, Salmonella enterica enterica serovar Typhi Ty2
accgcaugacaauau

SEQ ID NO: 3677061 - RNA, 17 nt, Salmonella enterica enterica serovar Typhi Ty2
accgccaaacgcgguca

SEQ ID NO: 3677062 - RNA, 15 nt, Salmonella enterica enterica serovar Typhi Ty2
accgccaaccgcccg

SEQ ID NO: 3677063 - RNA, 17 nt, Salmonella enterica enterica serovar Typhi Ty2
accgccaaccgcccguc

SEQ ID NO: 3677064 - RNA, 21 nt, Salmonella enterica enterica serovar Typhi Ty2
accgccaauaaaaacugcuaa

SEQ ID NO: 3677065 - RNA, 16 nt, Salmonella enterica enterica serovar Typhi Ty2
accgccaauaauuuua

SEQ ID NO: 3677066 - RNA, 23 nt, Salmonella enterica enterica serovar Typhi Ty2
accgccacuuugcuuuguagcgc

SEQ ID NO: 3677067 - RNA, 12 nt, Salmonella enterica enterica serovar Typhi Ty2
accgccagcaga

SEQ ID NO: 3677068 - RNA, 22 nt, Salmonella enterica enterica serovar Typhi Ty2
accgccagcggcguuuuuuccu

SEQ ID NO: 3677069 - RNA, 15 nt, Salmonella enterica enterica serovar Typhi Ty2
accgccagucacccu

SEQ ID NO: 3677070 - RNA, 15 nt, Salmonella enterica enterica serovar Typhi Ty2
accgccagucccagc

SEQ ID NO: 3677071 - RNA, 20 nt, Salmonella enterica enterica serovar Typhi Ty2
accgccauacggaugccgau

SEQ ID NO: 3677072 - RNA, 18 nt, Salmonella enterica enterica serovar Typhi Ty2
accgccaucaaacgcagc

SEQ ID NO: 3677073 - RNA, 16 nt, Salmonella enterica enterica serovar Typhi Ty2
accgccauccggcauu

SEQ ID NO: 3677074 - RNA, 15 nt, Salmonella enterica enterica serovar Typhi Ty2
accgcccgccgggcg

SEQ ID NO: 3677075 - RNA, 23 nt, Salmonella enterica enterica serovar Typhi Ty2
accgcccgcgcuuuagggcuucc

SEQ ID NO: 3677076 - RNA, 20 nt, Salmonella enterica enterica serovar Typhi Ty2
accgcccgcggcgaucacca

SEQ ID NO: 3677077 - RNA, 16 nt, Salmonella enterica enterica serovar Typhi Ty2
accgccgacaaucguc

SEQ ID NO: 3677078 - RNA, 16 nt, Salmonella enterica enterica serovar Typhi Ty2
accgccgacaccggcc

SEQ ID NO: 3677079 - RNA, 21 nt, Salmonella enterica enterica serovar Typhi Ty2
accgccgacaccggccugccu

SEQ ID NO: 3677080 - RNA, 12 nt, Salmonella enterica enterica serovar Typhi Ty2
accgccgacagu

SEQ ID NO: 3677081 - RNA, 19 nt, Salmonella enterica enterica serovar Typhi Ty2
accggcgacgugacgcgcc

SEQ ID NO: 3677082 - RNA, 17 nt, Salmonella enterica enterica serovar Typhi Ty2
accggcgauguuggcgc

SEQ ID NO: 3677083 - RNA, 15 nt, Salmonella enterica enterica serovar Typhi Ty2
accggcgccagcucu

SEQ ID NO: 3677084 - RNA, 19 nt, Salmonella enterica enterica serovar Typhi Ty2
accggcgcgccuuccagca

SEQ ID NO: 3677085 - RNA, 19 nt, Salmonella enterica enterica serovar Typhi Ty2
accggcggccuaccaguug

SEQ ID NO: 3677086 - RNA, 16 nt, Salmonella enterica enterica serovar Typhi Ty2
accggcguaauugcgc

SEQ ID NO: 3677087 - RNA, 15 nt, Salmonella enterica enterica serovar Typhi Ty2
accggcgucaucauu

SEQ ID NO: 3677088 - RNA, 20 nt, Salmonella enterica enterica serovar Typhi Ty2
accggcguccccguucugac

SEQ ID NO: 3677089 - RNA, 13 nt, Salmonella enterica enterica serovar Typhi Ty2
accggcuccggca

SEQ ID NO: 3677090 - RNA, 21 nt, Salmonella enterica enterica serovar Typhi Ty2
accggcuccggguugccugau

SEQ ID NO: 3677091 - RNA, 21 nt, Salmonella enterica enterica serovar Typhi Ty2
accggcuguauacacuuucca

SEQ ID NO: 3677092 - RNA, 18 nt, Salmonella enterica enterica serovar Typhi Ty2
accggcugugggcguguc

SEQ ID NO: 3677093 - RNA, 23 nt, Salmonella enterica enterica serovar Typhi Ty2
accggcuguucacguaccaggca

SEQ ID NO: 3677094 - RNA, 18 nt, Salmonella enterica enterica serovar Typhi Ty2
accgggcaggauacggcg

SEQ ID NO: 3677095 - RNA, 22 nt, Salmonella enterica enterica serovar Typhi Ty2
accgggccuccuuuccugugcu

SEQ ID NO: 3677096 - RNA, 17 nt, Salmonella enterica enterica serovar Typhi Ty2
accgggccugaugcgcg

SEQ ID NO: 3677097 - RNA, 23 nt, Salmonella enterica enterica serovar Typhi Ty2
accgggccugaugcgcguuuagc

SEQ ID NO: 3677098 - RNA, 20 nt, Salmonella enterica enterica serovar Typhi Ty2
accgggcgaaagcacuucuc

SEQ ID NO: 3677099 - RNA, 12 nt, Salmonella enterica enterica serovar Typhi Ty2
accgggcuaaac

SEQ ID NO: 3677100 - RNA, 15 nt, Salmonella enterica enterica serovar Typhi Ty2
accgggcugcagccc

SEQ ID NO: 3677101 - RNA, 16 nt, Salmonella enterica enterica serovar Typhi Ty2
accggggcgcgccgcu

SEQ ID NO: 3677102 - RNA, 19 nt, Salmonella enterica enterica serovar Typhi Ty2
accggggcgcucgccugau

SEQ ID NO: 3677103 - RNA, 15 nt, Salmonella enterica enterica serovar Typhi Ty2
accgguaaggcaggc

SEQ ID NO: 3677104 - RNA, 16 nt, Salmonella enterica enterica serovar Typhi Ty2
accgguaaugauacca

SEQ ID NO: 3677105 - RNA, 15 nt, Salmonella enterica enterica serovar Typhi Ty2
accgguacucuucca

SEQ ID NO: 3677106 - RNA, 21 nt, Salmonella enterica enterica serovar Typhi Ty2
accgguaucgaucacgcgcag

SEQ ID NO: 3677107 - RNA, 19 nt, Salmonella enterica enterica serovar Typhi Ty2
accggugcgauucagcgca

SEQ ID NO: 3677108 - RNA, 13 nt, Salmonella enterica enterica serovar Typhi Ty2
accggugcgcccc

SEQ ID NO: 3677109 - RNA, 16 nt, Salmonella enterica enterica serovar Typhi Ty2
accggugcgccccagc

SEQ ID NO: 3677110 - RNA, 19 nt, Salmonella enterica enterica serovar Typhi Ty2
accggugcgccccagcaug

SEQ ID NO: 3677111 - RNA, 15 nt, Salmonella enterica enterica serovar Typhi Ty2
accgguuugucauuc

SEQ ID NO: 3677112 - RNA, 13 nt, Salmonella enterica enterica serovar Typhi Ty2
accgguuuuuccg

SEQ ID NO: 3677113 - RNA, 17 nt, Salmonella enterica enterica serovar Typhi Ty2
accguaaacgccugcac

SEQ ID NO: 3677114 - RNA, 23 nt, Salmonella enterica enterica serovar Typhi Ty2
accguaagcuuucugaauuucac

SEQ ID NO: 3677115 - RNA, 19 nt, Salmonella enterica enterica serovar Typhi Ty2
accguauccagacccccgg

SEQ ID NO: 3677116 - RNA, 14 nt, Salmonella enterica enterica serovar Typhi Ty2
accguauccgccac

SEQ ID NO: 3677117 - RNA, 18 nt, Salmonella enterica enterica serovar Typhi Ty2
accguauccuuccagccc

SEQ ID NO: 3677118 - RNA, 18 nt, Salmonella enterica enterica serovar Typhi Ty2
accguauuaucaaaucuu

SEQ ID NO: 3677119 - RNA, 18 nt, Salmonella enterica enterica serovar Typhi Ty2
accguauugccagaucug

SEQ ID NO: 3677120 - RNA, 15 nt, Salmonella enterica enterica serovar Typhi Ty2
accgucaaaacgcgc

SEQ ID NO: 3677121 - RNA, 14 nt, Salmonella enterica enterica serovar Typhi Ty2
accgucagcagcac

SEQ ID NO: 3677122 - RNA, 15 nt, Salmonella enterica enterica serovar Typhi Ty2
accgucaucagccgu

SEQ ID NO: 3677123 - RNA, 13 nt, Salmonella enterica enterica serovar Typhi Ty2
accgucaucgccc

SEQ ID NO: 3677124 - RNA, 15 nt, Salmonella enterica enterica serovar Typhi Ty2
accguccacauccag

SEQ ID NO: 3677125 - RNA, 22 nt, Salmonella enterica enterica serovar Typhi Ty2
accgucgcgcccuccuccagcg

SEQ ID NO: 3677126 - RNA, 22 nt, Salmonella enterica enterica serovar Typhi Ty2
accgucggacuuuuugaaauca

SEQ ID NO: 3677127 - RNA, 14 nt, Salmonella enterica enterica serovar Typhi Ty2
accgucggcacgca

SEQ ID NO: 3677128 - RNA, 15 nt, Salmonella enterica enterica serovar Typhi Ty2
accgucgugaaucau

SEQ ID NO: 3677129 - RNA, 18 nt, Salmonella enterica enterica serovar Typhi Ty2
accgucguuacccuccug

SEQ ID NO: 3677130 - RNA, 18 nt, Salmonella enterica enterica serovar Typhi Ty2
accgucuggcgaggcgcc

SEQ ID NO: 3677131 - RNA, 13 nt, Salmonella enterica enterica serovar Typhi Ty2
accgugagcgcgc

SEQ ID NO: 3677132 - RNA, 14 nt, Salmonella enterica enterica serovar Typhi Ty2
accgugauuuuuac

SEQ ID NO: 3677133 - RNA, 21 nt, Salmonella enterica enterica serovar Typhi Ty2
accgugauuuuuaccgccggu

SEQ ID NO: 3677134 - RNA, 14 nt, Salmonella enterica enterica serovar Typhi Ty2
accgugcacgcugc

SEQ ID NO: 3677135 - RNA, 19 nt, Salmonella enterica enterica serovar Typhi Ty2
accguggcggcagugggcu

SEQ ID NO: 3677136 - RNA, 16 nt, Salmonella enterica enterica serovar Typhi Ty2
accguggucuccgccu

SEQ ID NO: 3677137 - RNA, 14 nt, Salmonella enterica enterica serovar Typhi Ty2
accgugugcaguga

SEQ ID NO: 3677138 - RNA, 22 nt, Salmonella enterica enterica serovar Typhi Ty2
accgugugcagugacagaggaa

SEQ ID NO: 3677139 - RNA, 21 nt, Salmonella enterica enterica serovar Typhi Ty2
accguuaacguuuuacgcugc

SEQ ID NO: 3677140 - RNA, 22 nt, Salmonella enterica enterica serovar Typhi Ty2
accguuaacguuuuacgcugcc

SEQ ID NO: 3677141 - RNA, 14 nt, Salmonella enterica enterica serovar Typhi Ty2
accguuauccggca

SEQ ID NO: 3677142 - RNA, 19 nt, Salmonella enterica enterica serovar Typhi Ty2
accguucacgcucacgcag

SEQ ID NO: 3677143 - RNA, 15 nt, Salmonella enterica enterica serovar Typhi Ty2
accguugcgcccauc

SEQ ID NO: 3677144 - RNA, 16 nt, Salmonella enterica enterica serovar Typhi Ty2
accguugcgcccauca

SEQ ID NO: 3677145 - RNA, 18 nt, Salmonella enterica enterica serovar Typhi Ty2
accguugcgcccaucauc

SEQ ID NO: 3677146 - RNA, 17 nt, Salmonella enterica enterica serovar Typhi Ty2
accguuggaauaaauca

SEQ ID NO: 3677147 - RNA, 18 nt, Salmonella enterica enterica serovar Typhi Ty2
accguuuaaaaacaucau

SEQ ID NO: 3677148 - RNA, 21 nt, Salmonella enterica enterica serovar Typhi Ty2
accguuuuguaggccggauaa

SEQ ID NO: 3677149 - RNA, 22 nt, Salmonella enterica enterica serovar Typhi Ty2
accuaaauaagcgccgaguagc

SEQ ID NO: 3677150 - RNA, 15 nt, Salmonella enterica enterica serovar Typhi Ty2
accuaauagccagcc

SEQ ID NO: 3677151 - RNA, 22 nt, Salmonella enterica enterica serovar Typhi Ty2
accuaaucccuggcgaauaaaa

SEQ ID NO: 3677152 - RNA, 23 nt, Salmonella enterica enterica serovar Typhi Ty2
accuaaucccuggcgaauaaaau

SEQ ID NO: 3677153 - RNA, 21 nt, Salmonella enterica enterica serovar Typhi Ty2
accuaauuaaauagggacuua

SEQ ID NO: 3677154 - RNA, 15 nt, Salmonella enterica enterica serovar Typhi Ty2
accuacagaaaauca

SEQ ID NO: 3677155 - RNA, 18 nt, Salmonella enterica enterica serovar Typhi Ty2
accuacgcuauccggcgc

SEQ ID NO: 3677156 - RNA, 14 nt, Salmonella enterica enterica serovar Typhi Ty2
accuacuguggugu

SEQ ID NO: 3677157 - RNA, 21 nt, Salmonella enterica enterica serovar Typhi Ty2
accuacuuuauuuuucgccag

SEQ ID NO: 3677158 - RNA, 13 nt, Salmonella enterica enterica serovar Typhi Ty2
accuauuuaauaa

SEQ ID NO: 3677159 - RNA, 16 nt, Salmonella enterica enterica serovar Typhi Ty2
accuauuuaauaagca

SEQ ID NO: 3677160 - RNA, 19 nt, Salmonella enterica enterica serovar Typhi Ty2
accuauuucgauaccgacu

SEQ ID NO: 3677161 - RNA, 20 nt, Salmonella enterica enterica serovar Typhi Ty2
accuauuuuaaauucccagc

SEQ ID NO: 3677162 - RNA, 16 nt, Salmonella enterica enterica serovar Typhi Ty2
accucaaggcucagca

SEQ ID NO: 3677163 - RNA, 19 nt, Salmonella enterica enterica serovar Typhi Ty2
accuucacccccaucgccc

SEQ ID NO: 3677164 - RNA, 15 nt, Salmonella enterica enterica serovar Typhi Ty2
accuucaccggauac

SEQ ID NO: 3677165 - RNA, 18 nt, Salmonella enterica enterica serovar Typhi Ty2
accuucacgcagugcgcg

SEQ ID NO: 3677166 - RNA, 15 nt, Salmonella enterica enterica serovar Typhi Ty2
accuucacgccgcca

SEQ ID NO: 3677167 - RNA, 21 nt, Salmonella enterica enterica serovar Typhi Ty2
accuucaucucuuugcccguc

SEQ ID NO: 3677168 - RNA, 19 nt, Salmonella enterica enterica serovar Typhi Ty2
accuuccauuaugaugagu

SEQ ID NO: 3677169 - RNA, 22 nt, Salmonella enterica enterica serovar Typhi Ty2
accuucccgcgauaaaaacagc

SEQ ID NO: 3677170 - RNA, 15 nt, Salmonella enterica enterica serovar Typhi Ty2
accuucgacgagguu

SEQ ID NO: 3677171 - RNA, 19 nt, Salmonella enterica enterica serovar Typhi Ty2
accuucgcuuuuaaaacuu

SEQ ID NO: 3677172 - RNA, 13 nt, Salmonella enterica enterica serovar Typhi Ty2
accuucggccucc

SEQ ID NO: 3677173 - RNA, 22 nt, Salmonella enterica enterica serovar Typhi Ty2
accuucggccuccgcuuccugc

SEQ ID NO: 3677174 - RNA, 17 nt, Salmonella enterica enterica serovar Typhi Ty2
accuucggucccaucgc

SEQ ID NO: 3677175 - RNA, 15 nt, Salmonella enterica enterica serovar Typhi Ty2
accuucucuuuaugc

SEQ ID NO: 3677176 - RNA, 22 nt, Salmonella enterica enterica serovar Typhi Ty2
accuucugugaaaguuucagga

SEQ ID NO: 3677177 - RNA, 21 nt, Salmonella enterica enterica serovar Typhi Ty2
accuucuucacuaaaaacagg

SEQ ID NO: 3677178 - RNA, 15 nt, Salmonella enterica enterica serovar Typhi Ty2
accuucuucgccaac

SEQ ID NO: 3677179 - RNA, 14 nt, Salmonella enterica enterica serovar Typhi Ty2
accuugcccuggaa

SEQ ID NO: 3677180 - RNA, 22 nt, Salmonella enterica enterica serovar Typhi Ty2
accuugcccuggaauuuuucca

SEQ ID NO: 3677181 - RNA, 14 nt, Salmonella enterica enterica serovar Typhi Ty2
accuuguucuucca

SEQ ID NO: 3677182 - RNA, 15 nt, Salmonella enterica enterica serovar Typhi Ty2
accuuguucuuccau

SEQ ID NO: 3677183 - RNA, 20 nt, Salmonella enterica enterica serovar Typhi Ty2
accuuuaaccucuuuuucau

SEQ ID NO: 3677184 - RNA, 12 nt, Salmonella enterica enterica serovar Typhi Ty2
accuuuccaguc

SEQ ID NO: 3677185 - RNA, 13 nt, Salmonella enterica enterica serovar Typhi Ty2
accuuucugccag

SEQ ID NO: 3677186 - RNA, 22 nt, Salmonella enterica enterica serovar Typhi Ty2
accuuugcccgagcgcuggcau

SEQ ID NO: 3677187 - RNA, 15 nt, Salmonella enterica enterica serovar Typhi Ty2
accuuuuacuucacg

SEQ ID NO: 3677188 - RNA, 21 nt, Salmonella enterica enterica serovar Typhi Ty2
accuuuucauuggucaguaag

SEQ ID NO: 3677189 - RNA, 14 nt, Salmonella enterica enterica serovar Typhi Ty2
accuuuugccgccc

SEQ ID NO: 3677190 - RNA, 22 nt, Salmonella enterica enterica serovar Typhi Ty2
accuuuuugauccguuucagaa

SEQ ID NO: 3677191 - RNA, 20 nt, Salmonella enterica enterica serovar Typhi Ty2
accuuuuuuuccagcgucug

SEQ ID NO: 3677192 - RNA, 13 nt, Salmonella enterica enterica serovar Typhi Ty2
acgaaaaaaaaga

SEQ ID NO: 3677193 - RNA, 14 nt, Salmonella enterica enterica serovar Typhi Ty2
acgaaaaaagcgcc

SEQ ID NO: 3677194 - RNA, 11 nt, Salmonella enterica enterica serovar Typhi Ty2
acgaaaaauaa

SEQ ID NO: 3677195 - RNA, 12 nt, Salmonella enterica enterica serovar Typhi Ty2
acgaaaaauaaa

SEQ ID NO: 3677196 - RNA, 18 nt, Salmonella enterica enterica serovar Typhi Ty2
acgaaaaccgagcgcaug

SEQ ID NO: 3677197 - RNA, 17 nt, Salmonella enterica enterica serovar Typhi Ty2
acgaaaaccguccacau

SEQ ID NO: 3677198 - RNA, 16 nt, Salmonella enterica enterica serovar Typhi Ty2
acgaaaaucauccgcu

SEQ ID NO: 3677199 - RNA, 16 nt, Salmonella enterica enterica serovar Typhi Ty2
acgaaacagauuaaaa

SEQ ID NO: 3677200 - RNA, 14 nt, Salmonella enterica enterica serovar Typhi Ty2
acgaaacgcaucgu

SEQ ID NO: 3677201 - RNA, 23 nt, Salmonella enterica enterica serovar Typhi Ty2
acgaaagcggcgaauauagcuaa

SEQ ID NO: 3677202 - RNA, 21 nt, Salmonella enterica enterica serovar Typhi Ty2
acgaaaucagagacaaauaca

SEQ ID NO: 3677203 - RNA, 21 nt, Salmonella enterica enterica serovar Typhi Ty2
acgaaauggugugcauggugu

SEQ ID NO: 3677204 - RNA, 21 nt, Salmonella enterica enterica serovar Typhi Ty2
acgaacaacaucagacaguac

SEQ ID NO: 3677205 - RNA, 13 nt, Salmonella enterica enterica serovar Typhi Ty2
acgaacacggcgu

SEQ ID NO: 3677206 - RNA, 14 nt, Salmonella enterica enterica serovar Typhi Ty2
acgaaccgagcggu

SEQ ID NO: 3677207 - RNA, 19 nt, Salmonella enterica enterica serovar Typhi Ty2
acgaaccugauuguuuuac

SEQ ID NO: 3677208 - RNA, 20 nt, Salmonella enterica enterica serovar Typhi Ty2
acgaacgcuggcacuuuccg

SEQ ID NO: 3677209 - RNA, 17 nt, Salmonella enterica enterica serovar Typhi Ty2
acgaagagaccugugua

SEQ ID NO: 3677210 - RNA, 19 nt, Salmonella enterica enterica serovar Typhi Ty2
acgaagaucgcguacagcg

SEQ ID NO: 3677211 - RNA, 22 nt, Salmonella enterica enterica serovar Typhi Ty2
acgaagaucgcguacagcgcca

SEQ ID NO: 3677212 - RNA, 12 nt, Salmonella enterica enterica serovar Typhi Ty2
acgaagcgcaaa

SEQ ID NO: 3677213 - RNA, 22 nt, Salmonella enterica enterica serovar Typhi Ty2
acgaaguccuucacaaacuucu

SEQ ID NO: 3677214 - RNA, 12 nt, Salmonella enterica enterica serovar Typhi Ty2
acgaaguuuaau

SEQ ID NO: 3677215 - RNA, 17 nt, Salmonella enterica enterica serovar Typhi Ty2
acgaaguuuaauucuuu

SEQ ID NO: 3677216 - RNA, 13 nt, Salmonella enterica enterica serovar Typhi Ty2
acgaauagcgcgc

SEQ ID NO: 3677217 - RNA, 18 nt, Salmonella enterica enterica serovar Typhi Ty2
acgaauauucauuuccag

SEQ ID NO: 3677218 - RNA, 18 nt, Salmonella enterica enterica serovar Typhi Ty2
acgaaucucgcugccgga

SEQ ID NO: 3677219 - RNA, 22 nt, Salmonella enterica enterica serovar Typhi Ty2
acgaaugccgauagucuccgcc

SEQ ID NO: 3677220 - RNA, 19 nt, Salmonella enterica enterica serovar Typhi Ty2
acgaauggcggcguuuucc

SEQ ID NO: 3677221 - RNA, 19 nt, Salmonella enterica enterica serovar Typhi Ty2
acgaaugucgcgucagguu

SEQ ID NO: 3677222 - RNA, 18 nt, Salmonella enterica enterica serovar Typhi Ty2
acgaauuuaaauagcaau

SEQ ID NO: 3677223 - RNA, 19 nt, Salmonella enterica enterica serovar Typhi Ty2
acgaauuuacucgccaaua

SEQ ID NO: 3677224 - RNA, 21 nt, Salmonella enterica enterica serovar Typhi Ty2
acgacacccgauacacgccga

SEQ ID NO: 3677225 - RNA, 21 nt, Salmonella enterica enterica serovar Typhi Ty2
acgacagugcuauacaguaaa

SEQ ID NO: 3677226 - RNA, 13 nt, Salmonella enterica enterica serovar Typhi Ty2
acgaccaaacaag

SEQ ID NO: 3677227 - RNA, 15 nt, Salmonella enterica enterica serovar Typhi Ty2
acgaccauaaauagc

SEQ ID NO: 3677228 - RNA, 17 nt, Salmonella enterica enterica serovar Typhi Ty2
acgacccaucaauaacg

SEQ ID NO: 3677229 - RNA, 18 nt, Salmonella enterica enterica serovar Typhi Ty2
acgacccaucaauaacga

SEQ ID NO: 3677230 - RNA, 18 nt, Salmonella enterica enterica serovar Typhi Ty2
acgaccccgccgagaauu

SEQ ID NO: 3677231 - RNA, 23 nt, Salmonella enterica enterica serovar Typhi Ty2
acgacccuuuuuugguuauccag

SEQ ID NO: 3677232 - RNA, 20 nt, Salmonella enterica enterica serovar Typhi Ty2
acgaccgccgacaaucguca

SEQ ID NO: 3677233 - RNA, 18 nt, Salmonella enterica enterica serovar Typhi Ty2
acgacgaauaagcugaau

SEQ ID NO: 3677234 - RNA, 15 nt, Salmonella enterica enterica serovar Typhi Ty2
acgacgauaaggcca

SEQ ID NO: 3677235 - RNA, 19 nt, Salmonella enterica enterica serovar Typhi Ty2
acgacgccggagaccggcg

SEQ ID NO: 3677236 - RNA, 22 nt, Salmonella enterica enterica serovar Typhi Ty2
acgacgucgacgccuuccacuu

SEQ ID NO: 3677237 - RNA, 21 nt, Salmonella enterica enterica serovar Typhi Ty2
acgacuccaauaauggagaug

SEQ ID NO: 3677238 - RNA, 18 nt, Salmonella enterica enterica serovar Typhi Ty2
acgagaacccacuuugcu

SEQ ID NO: 3677239 - RNA, 18 nt, Salmonella enterica enterica serovar Typhi Ty2
acgagaagcgauuagcug

SEQ ID NO: 3677240 - RNA, 16 nt, Salmonella enterica enterica serovar Typhi Ty2
acgagcggucaggcca

SEQ ID NO: 3677241 - RNA, 19 nt, Salmonella enterica enterica serovar Typhi Ty2
acgaggccacgcagcgcag

SEQ ID NO: 3677242 - RNA, 12 nt, Salmonella enterica enterica serovar Typhi Ty2
acgauaaaaaaa

SEQ ID NO: 3677243 - RNA, 13 nt, Salmonella enterica enterica serovar Typhi Ty2
acgauaaaaaaag

SEQ ID NO: 3677244 - RNA, 13 nt, Salmonella enterica enterica serovar Typhi Ty2
acgauaaaagcuc

SEQ ID NO: 3677245 - RNA, 20 nt, Salmonella enterica enterica serovar Typhi Ty2
acgcauugagacaugccgcc

SEQ ID NO: 3677246 - RNA, 18 nt, Salmonella enterica enterica serovar Typhi Ty2
acgcauuggcaauuaaac

SEQ ID NO: 3677247 - RNA, 16 nt, Salmonella enterica enterica serovar Typhi Ty2
acgcauuucaagcagg

SEQ ID NO: 3677248 - RNA, 18 nt, Salmonella enterica enterica serovar Typhi Ty2
acgcauuucaagcaggcg

SEQ ID NO: 3677249 - RNA, 19 nt, Salmonella enterica enterica serovar Typhi Ty2
acgcauuucaagcaggcga

SEQ ID NO: 3677250 - RNA, 20 nt, Salmonella enterica enterica serovar Typhi Ty2
acgcauuuuuccguauugca

SEQ ID NO: 3677251 - RNA, 12 nt, Salmonella enterica enterica serovar Typhi Ty2
acgccaacgcgc

SEQ ID NO: 3677252 - RNA, 14 nt, Salmonella enterica enterica serovar Typhi Ty2
acgccaagcugcaa

SEQ ID NO: 3677253 - RNA, 15 nt, Salmonella enterica enterica serovar Typhi Ty2
acgccaagcugcaau

SEQ ID NO: 3677254 - RNA, 16 nt, Salmonella enterica enterica serovar Typhi Ty2
acgccaccacagucau

SEQ ID NO: 3677255 - RNA, 14 nt, Salmonella enterica enterica serovar Typhi Ty2
acgccaccacgccg

SEQ ID NO: 3677256 - RNA, 15 nt, Salmonella enterica enterica serovar Typhi Ty2
acgccacccagcgaa

SEQ ID NO: 3677257 - RNA, 17 nt, Salmonella enterica enterica serovar Typhi Ty2
acgccaccgccaccugc

SEQ ID NO: 3677258 - RNA, 24 nt, Salmonella enterica enterica serovar Typhi Ty2
acgccagacuauccguccucuuuc

SEQ ID NO: 3677259 - RNA, 14 nt, Salmonella enterica enterica serovar Typhi Ty2
acgccagcagcucg

SEQ ID NO: 3677260 - RNA, 16 nt, Salmonella enterica enterica serovar Typhi Ty2
acgccagccacugacu

SEQ ID NO: 3677261 - RNA, 19 nt, Salmonella enterica enterica serovar Typhi Ty2
acgccagccagaauauuag

SEQ ID NO: 3677262 - RNA, 12 nt, Salmonella enterica enterica serovar Typhi Ty2
acgccagccagc

SEQ ID NO: 3677263 - RNA, 18 nt, Salmonella enterica enterica serovar Typhi Ty2
acgccagccauuaaagaa

SEQ ID NO: 3677264 - RNA, 17 nt, Salmonella enterica enterica serovar Typhi Ty2
acgccagcgggugaucg

SEQ ID NO: 3677265 - RNA, 16 nt, Salmonella enterica enterica serovar Typhi Ty2
acgccaggcagaacgc

SEQ ID NO: 3677266 - RNA, 21 nt, Salmonella enterica enterica serovar Typhi Ty2
acgccagguagccgacggcca

SEQ ID NO: 3677267 - RNA, 18 nt, Salmonella enterica enterica serovar Typhi Ty2
acgccagucuuugcagga

SEQ ID NO: 3677268 - RNA, 19 nt, Salmonella enterica enterica serovar Typhi Ty2
acgccagucuuugcaggag

SEQ ID NO: 3677269 - RNA, 14 nt, Salmonella enterica enterica serovar Typhi Ty2
acgccagugcgcau

SEQ ID NO: 3677270 - RNA, 14 nt, Salmonella enterica enterica serovar Typhi Ty2
acucuccaccaaau

SEQ ID NO: 3677271 - RNA, 17 nt, Salmonella enterica enterica serovar Typhi Ty2
acucucuugccagcgca

SEQ ID NO: 3677272 - RNA, 12 nt, Salmonella enterica enterica serovar Typhi Ty2
acucugaaaaaa

SEQ ID NO: 3677273 - RNA, 17 nt, Salmonella enterica enterica serovar Typhi Ty2
acucugaaaaaauuucg

SEQ ID NO: 3677274 - RNA, 20 nt, Salmonella enterica enterica serovar Typhi Ty2
acucugacgccgguauucau

SEQ ID NO: 3677275 - RNA, 13 nt, Salmonella enterica enterica serovar Typhi Ty2
acucugcaaacgg

SEQ ID NO: 3677276 - RNA, 18 nt, Salmonella enterica enterica serovar Typhi Ty2
acucugcgacgccaggcg

SEQ ID NO: 3677277 - RNA, 12 nt, Salmonella enterica enterica serovar Typhi Ty2
acucugcgcgua

SEQ ID NO: 3677278 - RNA, 13 nt, Salmonella enterica enterica serovar Typhi Ty2
acucuguuauaua

SEQ ID NO: 3677279 - RNA, 15 nt, Salmonella enterica enterica serovar Typhi Ty2
acucuguuauauauu

SEQ ID NO: 3677280 - RNA, 13 nt, Salmonella enterica enterica serovar Typhi Ty2
acucuuccaccac

SEQ ID NO: 3677281 - RNA, 21 nt, Salmonella enterica enterica serovar Typhi Ty2
acucuuccaccacggcaaaaa

SEQ ID NO: 3677282 - RNA, 17 nt, Salmonella enterica enterica serovar Typhi Ty2
acucuuccaccauccgc

SEQ ID NO: 3677283 - RNA, 12 nt, Salmonella enterica enterica serovar Typhi Ty2
acucuuccagca

SEQ ID NO: 3677284 - RNA, 22 nt, Salmonella enterica enterica serovar Typhi Ty2
acucuuccagcugcucuccuug

SEQ ID NO: 3677285 - RNA, 20 nt, Salmonella enterica enterica serovar Typhi Ty2
acucuuccccgaucagaaaa

SEQ ID NO: 3677286 - RNA, 21 nt, Salmonella enterica enterica serovar Typhi Ty2
acucuuccccgaucagaaaac

SEQ ID NO: 3677287 - RNA, 23 nt, Salmonella enterica enterica serovar Typhi Ty2
acucuuccccgaucagaaaaccu

SEQ ID NO: 3677288 - RNA, 16 nt, Salmonella enterica enterica serovar Typhi Ty2
acucuuccgcaaucac

SEQ ID NO: 3677289 - RNA, 17 nt, Salmonella enterica enterica serovar Typhi Ty2
acucuuccgcaaucaca

SEQ ID NO: 3677290 - RNA, 19 nt, Salmonella enterica enterica serovar Typhi Ty2
acucuuccgggcugacaua

SEQ ID NO: 3677291 - RNA, 15 nt, Salmonella enterica enterica serovar Typhi Ty2
acucuuccugcugcg

SEQ ID NO: 3677292 - RNA, 17 nt, Salmonella enterica enterica serovar Typhi Ty2
acucuucgacauauuua

SEQ ID NO: 3677293 - RNA, 19 nt, Salmonella enterica enterica serovar Typhi Ty2
acucuuuacccagcgggug

SEQ ID NO: 3677294 - RNA, 19 nt, Salmonella enterica enterica serovar Typhi Ty2
acucuuugccgauggcuau

SEQ ID NO: 3677295 - RNA, 17 nt, Salmonella enterica enterica serovar Typhi Ty2
acucuuuuuucagaaua

SEQ ID NO: 3677296 - RNA, 19 nt, Salmonella enterica enterica serovar Typhi Ty2
acugaacaagcgaucgcca

SEQ ID NO: 3677297 - RNA, 14 nt, Salmonella enterica enterica serovar Typhi Ty2
acugaaccaacagc

SEQ ID NO: 3677298 - RNA, 23 nt, Salmonella enterica enterica serovar Typhi Ty2
acugaaugccuuuuacaauaacc

SEQ ID NO: 3677299 - RNA, 20 nt, Salmonella enterica enterica serovar Typhi Ty2
acugaauuacugcguaaacc

SEQ ID NO: 3677300 - RNA, 17 nt, Salmonella enterica enterica serovar Typhi Ty2
acugaauuaucaggguu

SEQ ID NO: 3677301 - RNA, 20 nt, Salmonella enterica enterica serovar Typhi Ty2
acugacaauaagugguucgu

SEQ ID NO: 3677302 - RNA, 17 nt, Salmonella enterica enterica serovar Typhi Ty2
acugacaauuuccagau

SEQ ID NO: 3677303 - RNA, 15 nt, Salmonella enterica enterica serovar Typhi Ty2
acugacacccaucgc

SEQ ID NO: 3677304 - RNA, 16 nt, Salmonella enterica enterica serovar Typhi Ty2
acugaccagacagccc

SEQ ID NO: 3677305 - RNA, 15 nt, Salmonella enterica enterica serovar Typhi Ty2
acugaccauauauga

SEQ ID NO: 3677306 - RNA, 19 nt, Salmonella enterica enterica serovar Typhi Ty2
acugaccgcguuuaucgcg

SEQ ID NO: 3677307 - RNA, 14 nt, Salmonella enterica enterica serovar Typhi Ty2
acugacgaaaaccg

SEQ ID NO: 3677308 - RNA, 21 nt, Salmonella enterica enterica serovar Typhi Ty2
acugacggcgcucuuuacaua

SEQ ID NO: 3677309 - RNA, 16 nt, Salmonella enterica enterica serovar Typhi Ty2
acugacuauccacagc

SEQ ID NO: 3677310 - RNA, 21 nt, Salmonella enterica enterica serovar Typhi Ty2
acugacuauccacagcgaauu

SEQ ID NO: 3677311 - RNA, 15 nt, Salmonella enterica enterica serovar Typhi Ty2
acugacugcugucau

SEQ ID NO: 3677312 - RNA, 13 nt, Salmonella enterica enterica serovar Typhi Ty2
acugagacucagc

SEQ ID NO: 3677313 - RNA, 23 nt, Salmonella enterica enterica serovar Typhi Ty2
acugagcgguuuuuuuguggccu

SEQ ID NO: 3677314 - RNA, 19 nt, Salmonella enterica enterica serovar Typhi Ty2
acugagcgucacgccauca

SEQ ID NO: 3677315 - RNA, 22 nt, Salmonella enterica enterica serovar Typhi Ty2
acugagcuucaccgccagagca

SEQ ID NO: 3677316 - RNA, 21 nt, Salmonella enterica enterica serovar Typhi Ty2
acugaguauuggcaagaauca

SEQ ID NO: 3677317 - RNA, 23 nt, Salmonella enterica enterica serovar Typhi Ty2
acugauaaaagcccuuaucgccc

SEQ ID NO: 3677318 - RNA, 17 nt, Salmonella enterica enterica serovar Typhi Ty2
acugauaccccagcgau

SEQ ID NO: 3677319 - RNA, 19 nt, Salmonella enterica enterica serovar Typhi Ty2
acugauagacaauugcugc

SEQ ID NO: 3677320 - RNA, 19 nt, Salmonella enterica enterica serovar Typhi Ty2
acugauaguccaucaccuc

SEQ ID NO: 3677321 - RNA, 23 nt, Salmonella enterica enterica serovar Typhi Ty2
acugauaguccaucaccucuucg

SEQ ID NO: 3677322 - RNA, 15 nt, Salmonella enterica enterica serovar Typhi Ty2
acugauaguuuaaau

SEQ ID NO: 3677323 - RNA, 22 nt, Salmonella enterica enterica serovar Typhi Ty2
acugauaguuuaaauccagcgc

SEQ ID NO: 3677324 - RNA, 23 nt, Salmonella enterica enterica serovar Typhi Ty2
acugaucccacuuaggcagccag

SEQ ID NO: 3677325 - RNA, 19 nt, Salmonella enterica enterica serovar Typhi Ty2
acugaucgauccacuuccc

SEQ ID NO: 3677326 - RNA, 21 nt, Salmonella enterica enterica serovar Typhi Ty2
acugguggcgagauaagccgu

SEQ ID NO: 3677327 - RNA, 13 nt, Salmonella enterica enterica serovar Typhi Ty2
acuggugguuuug

SEQ ID NO: 3677328 - RNA, 21 nt, Salmonella enterica enterica serovar Typhi Ty2
acugguucaacaucagcgcua

SEQ ID NO: 3677329 - RNA, 17 nt, Salmonella enterica enterica serovar Typhi Ty2
acugguuuguugcgucu

SEQ ID NO: 3677330 - RNA, 15 nt, Salmonella enterica enterica serovar Typhi Ty2
acuguaagccucgcu

SEQ ID NO: 3677331 - RNA, 22 nt, Salmonella enterica enterica serovar Typhi Ty2
acuguaagccucgcucaccggu

SEQ ID NO: 3677332 - RNA, 20 nt, Salmonella enterica enterica serovar Typhi Ty2
acuguagcaacugccaggcg

SEQ ID NO: 3677333 - RNA, 14 nt, Salmonella enterica enterica serovar Typhi Ty2
acugucgaaaccag

SEQ ID NO: 3677334 - RNA, 13 nt, Salmonella enterica enterica serovar Typhi Ty2
acugucgcuggau

SEQ ID NO: 3677335 - RNA, 21 nt, Salmonella enterica enterica serovar Typhi Ty2
acugucuuaucaggccuacac

SEQ ID NO: 3677336 - RNA, 19 nt, Salmonella enterica enterica serovar Typhi Ty2
acugucuuguggaacacca

SEQ ID NO: 3677337 - RNA, 13 nt, Salmonella enterica enterica serovar Typhi Ty2
acugugacgggug

SEQ ID NO: 3677338 - RNA, 21 nt, Salmonella enterica enterica serovar Typhi Ty2
acugugaggcgucuuccagca

SEQ ID NO: 3677339 - RNA, 18 nt, Salmonella enterica enterica serovar Typhi Ty2
acugugcgucgcguucgc

SEQ ID NO: 3677340 - RNA, 22 nt, Salmonella enterica enterica serovar Typhi Ty2
acugugcugauuuuggcuucac

SEQ ID NO: 3677341 - RNA, 16 nt, Salmonella enterica enterica serovar Typhi Ty2
acugugggauuuuugg

SEQ ID NO: 3677342 - RNA, 12 nt, Salmonella enterica enterica serovar Typhi Ty2
acuguggugugc

SEQ ID NO: 3677343 - RNA, 19 nt, Salmonella enterica enterica serovar Typhi Ty2
acuguggugugccugcgcu

SEQ ID NO: 3677344 - RNA, 19 nt, Salmonella enterica enterica serovar Typhi Ty2
acuguggugugccugcguu

SEQ ID NO: 3677345 - RNA, 21 nt, Salmonella enterica enterica serovar Typhi Ty2
acugugguuaugguugccgca

SEQ ID NO: 3677346 - RNA, 21 nt, Salmonella enterica enterica serovar Typhi Ty2
acuguucaucaaagaaaacca

SEQ ID NO: 3677347 - RNA, 20 nt, Salmonella enterica enterica serovar Typhi Ty2
acuguugaaagccccggcuc

SEQ ID NO: 3677348 - RNA, 15 nt, Salmonella enterica enterica serovar Typhi Ty2
acuguugcaguuuac

SEQ ID NO: 3677349 - RNA, 23 nt, Salmonella enterica enterica serovar Typhi Ty2
acuguugccgacagcggaaaauc

SEQ ID NO: 3677350 - RNA, 18 nt, Salmonella enterica enterica serovar Typhi Ty2
acuguuuaaugcuuucaa

SEQ ID NO: 3677351 - RNA, 15 nt, Salmonella enterica enterica serovar Typhi Ty2
acuguuugcugacaa

SEQ ID NO: 3677352 - RNA, 18 nt, Salmonella enterica enterica serovar Typhi Ty2
acuguuugucucagguau

SEQ ID NO: 3677353 - RNA, 19 nt, Salmonella enterica enterica serovar Typhi Ty2
acuguuuuaccaaaucaau

SEQ ID NO: 3677354 - RNA, 20 nt, Salmonella enterica enterica serovar Typhi Ty2
acuguuuuaccaaaucaaua

SEQ ID NO: 3677355 - RNA, 21 nt, Salmonella enterica enterica serovar Typhi Ty2
acuguuuuaucagggaauggu

SEQ ID NO: 3677356 - RNA, 13 nt, Salmonella enterica enterica serovar Typhi Ty2
acuguuuuugcuu

SEQ ID NO: 3677357 - RNA, 22 nt, Salmonella enterica enterica serovar Typhi Ty2
acuuaaacgccggauuccagaa

SEQ ID NO: 3677358 - RNA, 20 nt, Salmonella enterica enterica serovar Typhi Ty2
acuuaaacguucguccgcac

SEQ ID NO: 3677359 - RNA, 14 nt, Salmonella enterica enterica serovar Typhi Ty2
acuuacgacgcgcc

SEQ ID NO: 3677360 - RNA, 14 nt, Salmonella enterica enterica serovar Typhi Ty2
acuuacgcacaaac

SEQ ID NO: 3677361 - RNA, 22 nt, Salmonella enterica enterica serovar Typhi Ty2
acuuacgcccuauccggccgac

SEQ ID NO: 3677362 - RNA, 13 nt, Salmonella enterica enterica serovar Typhi Ty2
acuuacugcuguc

SEQ ID NO: 3677363 - RNA, 15 nt, Salmonella enterica enterica serovar Typhi Ty2
acuuagagccuaucc

SEQ ID NO: 3677364 - RNA, 17 nt, Salmonella enterica enterica serovar Typhi Ty2
acuuagcccuggccaau

SEQ ID NO: 3677365 - RNA, 21 nt, Salmonella enterica enterica serovar Typhi Ty2
acuuagcgccggaauggcgac

SEQ ID NO: 3677366 - RNA, 21 nt, Salmonella enterica enterica serovar Typhi Ty2
acuuauaaguacgccugaaaa

SEQ ID NO: 3677367 - RNA, 16 nt, Salmonella enterica enterica serovar Typhi Ty2
acuuauacugauaaac

SEQ ID NO: 3677368 - RNA, 22 nt, Salmonella enterica enterica serovar Typhi Ty2
acuuaucggcguguuucaucuc

SEQ ID NO: 3677369 - RNA, 18 nt, Salmonella enterica enterica serovar Typhi Ty2
acuuaucucuuuuucucg

SEQ ID NO: 3677370 - RNA, 16 nt, Salmonella enterica enterica serovar Typhi Ty2
acuuauugauccacgg

SEQ ID NO: 3677371 - RNA, 16 nt, Salmonella enterica enterica serovar Typhi Ty2
acuuauugcaagaaau

SEQ ID NO: 3677372 - RNA, 11 nt, Salmonella enterica enterica serovar Typhi Ty2
acuuauuucua

SEQ ID NO: 3677373 - RNA, 17 nt, Salmonella enterica enterica serovar Typhi Ty2
acuuauuuuauuuuuau

SEQ ID NO: 3677374 - RNA, 17 nt, Salmonella enterica enterica serovar Typhi Ty2
acuucaaaaauggcuuc

SEQ ID NO: 3677375 - RNA, 18 nt, Salmonella enterica enterica serovar Typhi Ty2
acuucaauauugaugcua

SEQ ID NO: 3677376 - RNA, 12 nt, Salmonella enterica enterica serovar Typhi Ty2
acuucaaucacu

SEQ ID NO: 3677377 - RNA, 17 nt, Salmonella enterica enterica serovar Typhi Ty2
acuucaauuuuccagau

SEQ ID NO: 3677378 - RNA, 20 nt, Salmonella enterica enterica serovar Typhi Ty2
acuucacaaacaauuucccc

SEQ ID NO: 3677379 - RNA, 20 nt, Salmonella enterica enterica serovar Typhi Ty2
acuucacaaucagcgcaaua

SEQ ID NO: 3677380 - RNA, 15 nt, Salmonella enterica enterica serovar Typhi Ty2
acuucacacgaacuu

SEQ ID NO: 3677381 - RNA, 18 nt, Salmonella enterica enterica serovar Typhi Ty2
acuucaccauaaaucauu

SEQ ID NO: 3677382 - RNA, 21 nt, Salmonella enterica enterica serovar Typhi Ty2
acuucaccauaaaucauuacu

SEQ ID NO: 3677383 - RNA, 12 nt, Salmonella enterica enterica serovar Typhi Ty2
acuucacgcugg

SEQ ID NO: 3677384 - RNA, 12 nt, Salmonella enterica enterica serovar Typhi Ty2
acuucacuuucc

SEQ ID NO: 3677385 - RNA, 12 nt, Salmonella enterica enterica serovar Typhi Ty2
acuucagauacc

SEQ ID NO: 3677386 - RNA, 23 nt, Salmonella enterica enterica serovar Typhi Ty2
acuucagcauacaggucuuuccg

SEQ ID NO: 3677387 - RNA, 15 nt, Salmonella enterica enterica serovar Typhi Ty2
acuucaggcugccaa

SEQ ID NO: 3677388 - RNA, 21 nt, Salmonella enterica enterica serovar Typhi Ty2
acuucauacgaauggguaaua

SEQ ID NO: 3677389 - RNA, 22 nt, Salmonella enterica enterica serovar Typhi Ty2
acuuccagaccacuaacccggc

SEQ ID NO: 3677390 - RNA, 20 nt, Salmonella enterica enterica serovar Typhi Ty2
acuuccauucggcgaaagaa

SEQ ID NO: 3677391 - RNA, 17 nt, Salmonella enterica enterica serovar Typhi Ty2
acuuccccuguaacugc

SEQ ID NO: 3677392 - RNA, 18 nt, Salmonella enterica enterica serovar Typhi Ty2
acuuccgcacgcgcgccc

SEQ ID NO: 3677393 - RNA, 15 nt, Salmonella enterica enterica serovar Typhi Ty2
acuuccgcaucaaua

SEQ ID NO: 3677394 - RNA, 14 nt, Salmonella enterica enterica serovar Typhi Ty2
acuuccgccucgcc

SEQ ID NO: 3677395 - RNA, 15 nt, Salmonella enterica enterica serovar Typhi Ty2
acuuccggaucgcua

SEQ ID NO: 3677396 - RNA, 16 nt, Salmonella enterica enterica serovar Typhi Ty2
acuuccggcugcggaa

SEQ ID NO: 3677397 - RNA, 21 nt, Salmonella enterica enterica serovar Typhi Ty2
acuuccgguugaccgcauaau

SEQ ID NO: 3677398 - RNA, 17 nt, Salmonella enterica enterica serovar Typhi Ty2
acuuccguaaaaagaac

SEQ ID NO: 3677399 - RNA, 15 nt, Salmonella enterica enterica serovar Typhi Ty2
acuuccugcgucagg

SEQ ID NO: 3677400 - RNA, 19 nt, Salmonella enterica enterica serovar Typhi Ty2
acuuccugcgucaggcugu

SEQ ID NO: 3677401 - RNA, 14 nt, Salmonella enterica enterica serovar Typhi Ty2
acuuccuguacaaa

SEQ ID NO: 3677402 - RNA, 20 nt, Salmonella enterica enterica serovar Typhi Ty2
acuucgauaaacgccucgcu

SEQ ID NO: 3677403 - RNA, 15 nt, Salmonella enterica enterica serovar Typhi Ty2
acuucgcuuccugca

SEQ ID NO: 3677404 - RNA, 21 nt, Salmonella enterica enterica serovar Typhi Ty2
acuucgcuuuguuuuccagau

SEQ ID NO: 3677405 - RNA, 18 nt, Salmonella enterica enterica serovar Typhi Ty2
acuucggcaaauucuuuu

SEQ ID NO: 3677406 - RNA, 19 nt, Salmonella enterica enterica serovar Typhi Ty2
acuucggcaaauucuuuuc

SEQ ID NO: 3677407 - RNA, 20 nt, Salmonella enterica enterica serovar Typhi Ty2
acuucggcaaauucuuuuca

SEQ ID NO: 3677408 - RNA, 22 nt, Salmonella enterica enterica serovar Typhi Ty2
agaaauagacgagcgaaaaacu

SEQ ID NO: 3677409 - RNA, 23 nt, Salmonella enterica enterica serovar Typhi Ty2
agaaauagacgagcgaaaaacug

SEQ ID NO: 3677410 - RNA, 19 nt, Salmonella enterica enterica serovar Typhi Ty2
agaaauagccgguaacuuu

SEQ ID NO: 3677411 - RNA, 22 nt, Salmonella enterica enterica serovar Typhi Ty2
agaaauagccgguaacuuuccc

SEQ ID NO: 3677412 - RNA, 12 nt, Salmonella enterica enterica serovar Typhi Ty2
agaaauauucag

SEQ ID NO: 3677413 - RNA, 13 nt, Salmonella enterica enterica serovar Typhi Ty2
agaaauauuucac

SEQ ID NO: 3677414 - RNA, 14 nt, Salmonella enterica enterica serovar Typhi Ty2
agaaaucaacgaaa

SEQ ID NO: 3677415 - RNA, 18 nt, Salmonella enterica enterica serovar Typhi Ty2
agaaaucaacgaaaucag

SEQ ID NO: 3677416 - RNA, 19 nt, Salmonella enterica enterica serovar Typhi Ty2
agaaaucaacgaaaucaga

SEQ ID NO: 3677417 - RNA, 13 nt, Salmonella enterica enterica serovar Typhi Ty2
agaaaucagcagg

SEQ ID NO: 3677418 - RNA, 16 nt, Salmonella enterica enterica serovar Typhi Ty2
agaaauuauuuuaaau

SEQ ID NO: 3677419 - RNA, 18 nt, Salmonella enterica enterica serovar Typhi Ty2
agaaauucgcagcgcagg

SEQ ID NO: 3677420 - RNA, 16 nt, Salmonella enterica enterica serovar Typhi Ty2
agaaauugaauuauaa

SEQ ID NO: 3677421 - RNA, 14 nt, Salmonella enterica enterica serovar Typhi Ty2
agaacagcaucacc

SEQ ID NO: 3677422 - RNA, 19 nt, Salmonella enterica enterica serovar Typhi Ty2
agaacagcaucaccggccc

SEQ ID NO: 3677423 - RNA, 15 nt, Salmonella enterica enterica serovar Typhi Ty2
agaacauaaacagcg

SEQ ID NO: 3677424 - RNA, 18 nt, Salmonella enterica enterica serovar Typhi Ty2
agaacauaaacagcguga

SEQ ID NO: 3677425 - RNA, 14 nt, Salmonella enterica enterica serovar Typhi Ty2
agaacaugacggca

SEQ ID NO: 3677426 - RNA, 22 nt, Salmonella enterica enterica serovar Typhi Ty2
agaacaugacggcagucgcuac

SEQ ID NO: 3677427 - RNA, 16 nt, Salmonella enterica enterica serovar Typhi Ty2
agaacauuucccgaaa

SEQ ID NO: 3677428 - RNA, 22 nt, Salmonella enterica enterica serovar Typhi Ty2
agaaccaacgucaucaugaaaa

SEQ ID NO: 3677429 - RNA, 20 nt, Salmonella enterica enterica serovar Typhi Ty2
agaaccaauaguauggagca

SEQ ID NO: 3677430 - RNA, 21 nt, Salmonella enterica enterica serovar Typhi Ty2
agaacccacuuugcuuuucug

SEQ ID NO: 3677431 - RNA, 16 nt, Salmonella enterica enterica serovar Typhi Ty2
agaaccccugccacaa

SEQ ID NO: 3677432 - RNA, 22 nt, Salmonella enterica enterica serovar Typhi Ty2
agaaccguugcgcccaucauca

SEQ ID NO: 3677433 - RNA, 23 nt, Salmonella enterica enterica serovar Typhi Ty2
agaaccguugcgcccaucaucau

SEQ ID NO: 3677434 - RNA, 11 nt, Salmonella enterica enterica serovar Typhi Ty2
acgccgguacu

SEQ ID NO: 3677435 - RNA, 21 nt, Salmonella enterica enterica serovar Typhi Ty2
acgccggugauuuuaaaguaa

SEQ ID NO: 3677436 - RNA, 16 nt, Salmonella enterica enterica serovar Typhi Ty2
acgccggugccugccg

SEQ ID NO: 3677437 - RNA, 17 nt, Salmonella enterica enterica serovar Typhi Ty2
acgccguacuccagccc

SEQ ID NO: 3677438 - RNA, 13 nt, Salmonella enterica enterica serovar Typhi Ty2
acgccguccagca

SEQ ID NO: 3677439 - RNA, 14 nt, Salmonella enterica enterica serovar Typhi Ty2
acgccguccggcga

SEQ ID NO: 3677440 - RNA, 22 nt, Salmonella enterica enterica serovar Typhi Ty2
acgccguccggcgaacaaacuc

SEQ ID NO: 3677441 - RNA, 18 nt, Salmonella enterica enterica serovar Typhi Ty2
acgccgucgaugauggcg

SEQ ID NO: 3677442 - RNA, 22 nt, Salmonella enterica enterica serovar Typhi Ty2
acgccgucgaugauggcggcua

SEQ ID NO: 3677443 - RNA, 14 nt, Salmonella enterica enterica serovar Typhi Ty2
acgccgucucuuuu

SEQ ID NO: 3677444 - RNA, 19 nt, Salmonella enterica enterica serovar Typhi Ty2
acgccgugaacgccaaaua

SEQ ID NO: 3677445 - RNA, 16 nt, Salmonella enterica enterica serovar Typhi Ty2
acgccgugacggcgua

SEQ ID NO: 3677446 - RNA, 15 nt, Salmonella enterica enterica serovar Typhi Ty2
acgccgugcggcgug

SEQ ID NO: 3677447 - RNA, 16 nt, Salmonella enterica enterica serovar Typhi Ty2
acgccguuaccagcau

SEQ ID NO: 3677448 - RNA, 13 nt, Salmonella enterica enterica serovar Typhi Ty2
acgccuaaaugaa

SEQ ID NO: 3677449 - RNA, 16 nt, Salmonella enterica enterica serovar Typhi Ty2
acgccuaaugaagcgc

SEQ ID NO: 3677450 - RNA, 19 nt, Salmonella enterica enterica serovar Typhi Ty2
acgccuaccgcuucccaca

SEQ ID NO: 3677451 - RNA, 20 nt, Salmonella enterica enterica serovar Typhi Ty2
acgccucauccggccuggcg

SEQ ID NO: 3677452 - RNA, 15 nt, Salmonella enterica enterica serovar Typhi Ty2
acgccuccaggcuac

SEQ ID NO: 3677453 - RNA, 19 nt, Salmonella enterica enterica serovar Typhi Ty2
acgccugaaaugcuuaaaa

SEQ ID NO: 3677454 - RNA, 16 nt, Salmonella enterica enterica serovar Typhi Ty2
acgccugcauaaagga

SEQ ID NO: 3677455 - RNA, 15 nt, Salmonella enterica enterica serovar Typhi Ty2
acgccugcuucacgu

SEQ ID NO: 3677456 - RNA, 20 nt, Salmonella enterica enterica serovar Typhi Ty2
acgccugggauagugcugcg

SEQ ID NO: 3677457 - RNA, 15 nt, Salmonella enterica enterica serovar Typhi Ty2
acgccuuacccgacc

SEQ ID NO: 3677458 - RNA, 19 nt, Salmonella enterica enterica serovar Typhi Ty2
acgccuuacccgaccuaca

SEQ ID NO: 3677459 - RNA, 21 nt, Salmonella enterica enterica serovar Typhi Ty2
acgccuuacccgaccuacauc

SEQ ID NO: 3677460 - RNA, 21 nt, Salmonella enterica enterica serovar Typhi Ty2
acgccuuauccgaccuacaga

SEQ ID NO: 3677461 - RNA, 19 nt, Salmonella enterica enterica serovar Typhi Ty2
acgccuuuacccuuacggc

SEQ ID NO: 3677462 - RNA, 17 nt, Salmonella enterica enterica serovar Typhi Ty2
acgcgaaaauaccccag

SEQ ID NO: 3677463 - RNA, 23 nt, Salmonella enterica enterica serovar Typhi Ty2
acgcgaagauuaacccggucauc

SEQ ID NO: 3677464 - RNA, 15 nt, Salmonella enterica enterica serovar Typhi Ty2
acgcgaagcggcgcu

SEQ ID NO: 3677465 - RNA, 15 nt, Salmonella enterica enterica serovar Typhi Ty2
acgcgaagcggcguc

SEQ ID NO: 3677466 - RNA, 17 nt, Salmonella enterica enterica serovar Typhi Ty2
acgcgaauagccagaca

SEQ ID NO: 3677467 - RNA, 16 nt, Salmonella enterica enterica serovar Typhi Ty2
acgcgaccagacacgg

SEQ ID NO: 3677468 - RNA, 15 nt, Salmonella enterica enterica serovar Typhi Ty2
acgcgaccagcgcgc

SEQ ID NO: 3677469 - RNA, 16 nt, Salmonella enterica enterica serovar Typhi Ty2
acgcgacgcgccagcc

SEQ ID NO: 3677470 - RNA, 19 nt, Salmonella enterica enterica serovar Typhi Ty2
acgcgacucccaggcgcgc

SEQ ID NO: 3677471 - RNA, 21 nt, Salmonella enterica enterica serovar Typhi Ty2
acgcgacuuuccgccaccaga

SEQ ID NO: 3677472 - RNA, 18 nt, Salmonella enterica enterica serovar Typhi Ty2
acgcgagaagcccggcca

SEQ ID NO: 3677473 - RNA, 14 nt, Salmonella enterica enterica serovar Typhi Ty2
acgcgauagauacc

SEQ ID NO: 3677474 - RNA, 17 nt, Salmonella enterica enterica serovar Typhi Ty2
acgcgauauguuugcgc

SEQ ID NO: 3677475 - RNA, 19 nt, Salmonella enterica enterica serovar Typhi Ty2
acgcgauauguuugcgcgu

SEQ ID NO: 3677476 - RNA, 21 nt, Salmonella enterica enterica serovar Typhi Ty2
acgcgcaaaacucucaccgac

SEQ ID NO: 3677477 - RNA, 20 nt, Salmonella enterica enterica serovar Typhi Ty2
acgcgcagagauagccagcg

SEQ ID NO: 3677478 - RNA, 20 nt, Salmonella enterica enterica serovar Typhi Ty2
acgcgcagcaucucauccac

SEQ ID NO: 3677479 - RNA, 15 nt, Salmonella enterica enterica serovar Typhi Ty2
acgcgcaucuucacu

SEQ ID NO: 3677480 - RNA, 20 nt, Salmonella enterica enterica serovar Typhi Ty2
acgcgcauuaauaugcgcaa

SEQ ID NO: 3677481 - RNA, 21 nt, Salmonella enterica enterica serovar Typhi Ty2
acgcgccagcagugggaaaau

SEQ ID NO: 3677482 - RNA, 15 nt, Salmonella enterica enterica serovar Typhi Ty2
acgcgccagccagcg

SEQ ID NO: 3677483 - RNA, 21 nt, Salmonella enterica enterica serovar Typhi Ty2
acgcgccaucgucaccggauc

SEQ ID NO: 3677484 - RNA, 21 nt, Salmonella enterica enterica serovar Typhi Ty2
acgcgcccaacggaugcgcca

SEQ ID NO: 3677485 - RNA, 22 nt, Salmonella enterica enterica serovar Typhi Ty2
acgcgccgagguuuucauccac

SEQ ID NO: 3677486 - RNA, 23 nt, Salmonella enterica enterica serovar Typhi Ty2
acgcgccugcucccgcugcggcg

SEQ ID NO: 3677487 - RNA, 18 nt, Salmonella enterica enterica serovar Typhi Ty2
acgcgccuggaucugcgc

SEQ ID NO: 3677488 - RNA, 18 nt, Salmonella enterica enterica serovar Typhi Ty2
acgcgcgagaacugcugc

SEQ ID NO: 3677489 - RNA, 20 nt, Salmonella enterica enterica serovar Typhi Ty2
acgcgcgccugccgccagca

SEQ ID NO: 3677490 - RNA, 12 nt, Salmonella enterica enterica serovar Typhi Ty2
acgcgcggcguc

SEQ ID NO: 3677491 - RNA, 16 nt, Salmonella enterica enterica serovar Typhi Ty2
acgcgcggcuacugcc

SEQ ID NO: 3677492 - RNA, 13 nt, Salmonella enterica enterica serovar Typhi Ty2
acgcgcguucguu

SEQ ID NO: 3677493 - RNA, 14 nt, Salmonella enterica enterica serovar Typhi Ty2
acgcgcuaaaugca

SEQ ID NO: 3677494 - RNA, 15 nt, Salmonella enterica enterica serovar Typhi Ty2
acgcgcucgccagcg

SEQ ID NO: 3677495 - RNA, 17 nt, Salmonella enterica enterica serovar Typhi Ty2
acgcgcucgccagcgcu

SEQ ID NO: 3677496 - RNA, 22 nt, Salmonella enterica enterica serovar Typhi Ty2
acgcgcucguacaaaucacugg

SEQ ID NO: 3677497 - RNA, 13 nt, Salmonella enterica enterica serovar Typhi Ty2
acgcgcugaccuc

SEQ ID NO: 3677498 - RNA, 14 nt, Salmonella enterica enterica serovar Typhi Ty2
acgcgcuuguucgu

SEQ ID NO: 3677499 - RNA, 20 nt, Salmonella enterica enterica serovar Typhi Ty2
acgcgcuuuuucuuccguca

SEQ ID NO: 3677500 - RNA, 17 nt, Salmonella enterica enterica serovar Typhi Ty2
acgcggaacuggugaaa

SEQ ID NO: 3677501 - RNA, 19 nt, Salmonella enterica enterica serovar Typhi Ty2
acgcggacgccaccacagu

SEQ ID NO: 3677502 - RNA, 16 nt, Salmonella enterica enterica serovar Typhi Ty2
acgcggaucagacggc

SEQ ID NO: 3677503 - RNA, 18 nt, Salmonella enterica enterica serovar Typhi Ty2
acgcggcaucaagcauaa

SEQ ID NO: 3677504 - RNA, 17 nt, Salmonella enterica enterica serovar Typhi Ty2
acgcggcaucaggcaua

SEQ ID NO: 3677505 - RNA, 14 nt, Salmonella enterica enterica serovar Typhi Ty2
acgcggcguaccgc

SEQ ID NO: 3677506 - RNA, 16 nt, Salmonella enterica enterica serovar Typhi Ty2
acgcggguacgggacg

SEQ ID NO: 3677507 - RNA, 16 nt, Salmonella enterica enterica serovar Typhi Ty2
acgcggucgucaucgg

SEQ ID NO: 3677508 - RNA, 23 nt, Salmonella enterica enterica serovar Typhi Ty2
acgcggugaaggcaaaacaccau

SEQ ID NO: 3677509 - RNA, 20 nt, Salmonella enterica enterica serovar Typhi Ty2
acgcgucaaauagagaaaau

SEQ ID NO: 3677510 - RNA, 21 nt, Salmonella enterica enterica serovar Typhi Ty2
acgcgucaaauagagaaaaua

SEQ ID NO: 3677511 - RNA, 22 nt, Salmonella enterica enterica serovar Typhi Ty2
acgcgucagugaauauccccug

SEQ ID NO: 3677512 - RNA, 20 nt, Salmonella enterica enterica serovar Typhi Ty2
acgcgucugaaugacgccgu

SEQ ID NO: 3677513 - RNA, 18 nt, Salmonella enterica enterica serovar Typhi Ty2
acgcgugaacauggguuu

SEQ ID NO: 3677514 - RNA, 15 nt, Salmonella enterica enterica serovar Typhi Ty2
acgcguucugaauaa

SEQ ID NO: 3677515 - RNA, 17 nt, Salmonella enterica enterica serovar Typhi Ty2
acgcguucugaauaaau

SEQ ID NO: 3677516 - RNA, 10 nt, Salmonella enterica enterica serovar Typhi Ty2
acgcguugcc

SEQ ID NO: 3677517 - RNA, 18 nt, Salmonella enterica enterica serovar Typhi Ty2
acgcguuucacaucgcca

SEQ ID NO: 3677518 - RNA, 22 nt, Salmonella enterica enterica serovar Typhi Ty2
acgcguuucacaucgccaguua

SEQ ID NO: 3677519 - RNA, 18 nt, Salmonella enterica enterica serovar Typhi Ty2
acgcguuuuccagcacca

SEQ ID NO: 3677520 - RNA, 21 nt, Salmonella enterica enterica serovar Typhi Ty2
acgcguuuuccagcaccaguu

SEQ ID NO: 3677521 - RNA, 16 nt, Salmonella enterica enterica serovar Typhi Ty2
acgcuaaaccacauga

SEQ ID NO: 3677522 - RNA, 18 nt, Salmonella enterica enterica serovar Typhi Ty2
acgcuaccgucgacgucu

SEQ ID NO: 3677523 - RNA, 16 nt, Salmonella enterica enterica serovar Typhi Ty2
acgcuauguuugcuga

SEQ ID NO: 3677524 - RNA, 21 nt, Salmonella enterica enterica serovar Typhi Ty2
acgcuauguuugcugagaauu

SEQ ID NO: 3677525 - RNA, 17 nt, Salmonella enterica enterica serovar Typhi Ty2
acgcucaaccgguuugu

SEQ ID NO: 3677526 - RNA, 15 nt, Salmonella enterica enterica serovar Typhi Ty2
acgcucacgcagaua

SEQ ID NO: 3677527 - RNA, 23 nt, Salmonella enterica enterica serovar Typhi Ty2
acgcucacgcagauauucauuga

SEQ ID NO: 3677528 - RNA, 23 nt, Salmonella enterica enterica serovar Typhi Ty2
acgcucacuuuucuuuccugcaa

SEQ ID NO: 3677529 - RNA, 12 nt, Salmonella enterica enterica serovar Typhi Ty2
acgcuccagcag

SEQ ID NO: 3677530 - RNA, 17 nt, Salmonella enterica enterica serovar Typhi Ty2
acgcuccagcuggcugg

SEQ ID NO: 3677531 - RNA, 18 nt, Salmonella enterica enterica serovar Typhi Ty2
acgcuccagcuggcuggc

SEQ ID NO: 3677532 - RNA, 16 nt, Salmonella enterica enterica serovar Typhi Ty2
acgcuccggcaggcaa

SEQ ID NO: 3677533 - RNA, 22 nt, Salmonella enterica enterica serovar Typhi Ty2
acgcuccgguuuuugcgcgcug

SEQ ID NO: 3677534 - RNA, 15 nt, Salmonella enterica enterica serovar Typhi Ty2
acgcuccugcuccug

SEQ ID NO: 3677535 - RNA, 11 nt, Salmonella enterica enterica serovar Typhi Ty2
acgcuccugga

SEQ ID NO: 3677536 - RNA, 13 nt, Salmonella enterica enterica serovar Typhi Ty2
acgcuccuggauu

SEQ ID NO: 3677537 - RNA, 15 nt, Salmonella enterica enterica serovar Typhi Ty2
acgcucgacgccggu

SEQ ID NO: 3677538 - RNA, 16 nt, Salmonella enterica enterica serovar Typhi Ty2
acgcucgaguucuuca

SEQ ID NO: 3677539 - RNA, 19 nt, Salmonella enterica enterica serovar Typhi Ty2
acgcucgaguucuucacgc

SEQ ID NO: 3677540 - RNA, 13 nt, Salmonella enterica enterica serovar Typhi Ty2
acgcucuucgcca

SEQ ID NO: 3677541 - RNA, 21 nt, Salmonella enterica enterica serovar Typhi Ty2
acgcugaauaucgucaguaug

SEQ ID NO: 3677542 - RNA, 15 nt, Salmonella enterica enterica serovar Typhi Ty2
acgcugaccacgccg

SEQ ID NO: 3677543 - RNA, 19 nt, Salmonella enterica enterica serovar Typhi Ty2
acgcugaccacgccgccgc

SEQ ID NO: 3677544 - RNA, 21 nt, Salmonella enterica enterica serovar Typhi Ty2
acgcugaccuuuuucauccuc

SEQ ID NO: 3677545 - RNA, 18 nt, Salmonella enterica enterica serovar Typhi Ty2
acgcugagagaacugcga

SEQ ID NO: 3677546 - RNA, 20 nt, Salmonella enterica enterica serovar Typhi Ty2
acgcugauacguaacaugac

SEQ ID NO: 3677547 - RNA, 14 nt, Salmonella enterica enterica serovar Typhi Ty2
acgcugaugaaaac

SEQ ID NO: 3677548 - RNA, 15 nt, Salmonella enterica enterica serovar Typhi Ty2
acgcugaugaaaacc

SEQ ID NO: 3677549 - RNA, 22 nt, Salmonella enterica enterica serovar Typhi Ty2
acgcugaugcugugcagacugc

SEQ ID NO: 3677550 - RNA, 17 nt, Salmonella enterica enterica serovar Typhi Ty2
acgcugcaaaguuauua

SEQ ID NO: 3677551 - RNA, 21 nt, Salmonella enterica enterica serovar Typhi Ty2
acgcugcaaaguuauuacauu

SEQ ID NO: 3677552 - RNA, 14 nt, Salmonella enterica enterica serovar Typhi Ty2
acgcugcaucguuu

SEQ ID NO: 3677553 - RNA, 20 nt, Salmonella enterica enterica serovar Typhi Ty2
acgcugccauccucauuuug

SEQ ID NO: 3677554 - RNA, 15 nt, Salmonella enterica enterica serovar Typhi Ty2
acgcugcgccgcgcc

SEQ ID NO: 3677555 - RNA, 21 nt, Salmonella enterica enterica serovar Typhi Ty2
acgcugcgcguucugcuccag

SEQ ID NO: 3677556 - RNA, 15 nt, Salmonella enterica enterica serovar Typhi Ty2
acgcugcggccugcc

SEQ ID NO: 3677557 - RNA, 21 nt, Salmonella enterica enterica serovar Typhi Ty2
acgcugcuauccggcaacacg

SEQ ID NO: 3677558 - RNA, 20 nt, Salmonella enterica enterica serovar Typhi Ty2
acgcugcuauuuugcgcuuu

SEQ ID NO: 3677559 - RNA, 21 nt, Salmonella enterica enterica serovar Typhi Ty2
acgcuggaaaauuucagugaa

SEQ ID NO: 3677560 - RNA, 17 nt, Salmonella enterica enterica serovar Typhi Ty2
acgcuggcacuggcagc

SEQ ID NO: 3677561 - RNA, 19 nt, Salmonella enterica enterica serovar Typhi Ty2
acgcuggcacuuuccgguu

SEQ ID NO: 3677562 - RNA, 21 nt, Salmonella enterica enterica serovar Typhi Ty2
acgcuggcggcccgcauugaa

SEQ ID NO: 3677563 - RNA, 18 nt, Salmonella enterica enterica serovar Typhi Ty2
acgcuggugcgcgggaga

SEQ ID NO: 3677564 - RNA, 18 nt, Salmonella enterica enterica serovar Typhi Ty2
acgcuggugcugugccug

SEQ ID NO: 3677565 - RNA, 17 nt, Salmonella enterica enterica serovar Typhi Ty2
acgcugguuucggcauc

SEQ ID NO: 3677566 - RNA, 23 nt, Salmonella enterica enterica serovar Typhi Ty2
acgcugguuugugugcaggagca

SEQ ID NO: 3677567 - RNA, 14 nt, Salmonella enterica enterica serovar Typhi Ty2
acgcuguucgcaac

SEQ ID NO: 3677568 - RNA, 12 nt, Salmonella enterica enterica serovar Typhi Ty2
acgcuguugccg

SEQ ID NO: 3677569 - RNA, 21 nt, Salmonella enterica enterica serovar Typhi Ty2
acgcuuaaucaguugcaggaa

SEQ ID NO: 3677570 - RNA, 16 nt, Salmonella enterica enterica serovar Typhi Ty2
acgcuuacaucgccau

SEQ ID NO: 3677571 - RNA, 20 nt, Salmonella enterica enterica serovar Typhi Ty2
acgcuuacccggccuacauu

SEQ ID NO: 3677572 - RNA, 19 nt, Salmonella enterica enterica serovar Typhi Ty2
acgcuuaucagcccuacaa

SEQ ID NO: 3677573 - RNA, 20 nt, Salmonella enterica enterica serovar Typhi Ty2
acgcuuaucaggccuacaac

SEQ ID NO: 3677574 - RNA, 16 nt, Salmonella enterica enterica serovar Typhi Ty2
acgcuuaucccagccg

SEQ ID NO: 3677575 - RNA, 14 nt, Salmonella enterica enterica serovar Typhi Ty2
acgcuuauccggcu

SEQ ID NO: 3677576 - RNA, 11 nt, Salmonella enterica enterica serovar Typhi Ty2
acgcuuauccu

SEQ ID NO: 3677577 - RNA, 14 nt, Salmonella enterica enterica serovar Typhi Ty2
acgcuuauccugcc

SEQ ID NO: 3677578 - RNA, 23 nt, Salmonella enterica enterica serovar Typhi Ty2
acgcuuauucggucugacggccu

SEQ ID NO: 3677579 - RNA, 16 nt, Salmonella enterica enterica serovar Typhi Ty2
acgcuucacgucagcg

SEQ ID NO: 3677580 - RNA, 16 nt, Salmonella enterica enterica serovar Typhi Ty2
acgcuucagagcaggu

SEQ ID NO: 3677581 - RNA, 22 nt, Salmonella enterica enterica serovar Typhi Ty2
acgcuucauugguuaauucaaa

SEQ ID NO: 3677582 - RNA, 23 nt, Salmonella enterica enterica serovar Typhi Ty2
acgcuuccagaugaagcgcaucg

SEQ ID NO: 3677583 - RNA, 20 nt, Salmonella enterica enterica serovar Typhi Ty2
acgcuuccggcgaggcguaa

SEQ ID NO: 3677584 - RNA, 22 nt, Salmonella enterica enterica serovar Typhi Ty2
acgcuucgccuguugcugacga

SEQ ID NO: 3677585 - RNA, 20 nt, Salmonella enterica enterica serovar Typhi Ty2
acgcuugcccgguucgccau

SEQ ID NO: 3677586 - RNA, 22 nt, Salmonella enterica enterica serovar Typhi Ty2
acgcuuuaggguaucauuucca

SEQ ID NO: 3677587 - RNA, 23 nt, Salmonella enterica enterica serovar Typhi Ty2
acgcuuuauucugucgccaccac

SEQ ID NO: 3677588 - RNA, 19 nt, Salmonella enterica enterica serovar Typhi Ty2
acgcuuucuucccuccccu

SEQ ID NO: 3677589 - RNA, 21 nt, Salmonella enterica enterica serovar Typhi Ty2
acgcuuugcgauagcccggca

SEQ ID NO: 3677590 - RNA, 23 nt, Salmonella enterica enterica serovar Typhi Ty2
acgcuuugcgauagcccggcaug

SEQ ID NO: 3677591 - RNA, 23 nt, Salmonella enterica enterica serovar Typhi Ty2
acgcuuuggcaggccucuaucuu

SEQ ID NO: 3677592 - RNA, 20 nt, Salmonella enterica enterica serovar Typhi Ty2
acgcuuuucagcgccagaua

SEQ ID NO: 3677593 - RNA, 16 nt, Salmonella enterica enterica serovar Typhi Ty2
acgcuuuugcgcacug

SEQ ID NO: 3677594 - RNA, 20 nt, Salmonella enterica enterica serovar Typhi Ty2
acgcuuuuuugcuggcuggc

SEQ ID NO: 3677595 - RNA, 14 nt, Salmonella enterica enterica serovar Typhi Ty2
acggaaaaaauacu

SEQ ID NO: 3677596 - RNA, 16 nt, Salmonella enterica enterica serovar Typhi Ty2
acggaaaccagauauc

SEQ ID NO: 3677597 - RNA, 14 nt, Salmonella enterica enterica serovar Typhi Ty2
acggaaaccagcau

SEQ ID NO: 3677598 - RNA, 23 nt, Salmonella enterica enterica serovar Typhi Ty2
acggaacaacggcacacaggccg

SEQ ID NO: 3677599 - RNA, 14 nt, Salmonella enterica enterica serovar Typhi Ty2
acggaaccaaaaua

SEQ ID NO: 3677600 - RNA, 22 nt, Salmonella enterica enterica serovar Typhi Ty2
acggaaccaaaauagauaaucg

SEQ ID NO: 3677601 - RNA, 18 nt, Salmonella enterica enterica serovar Typhi Ty2
acggaaccaaaugcccag

SEQ ID NO: 3677602 - RNA, 22 nt, Salmonella enterica enterica serovar Typhi Ty2
acggaaccauuccgacagugaa

SEQ ID NO: 3677603 - RNA, 14 nt, Salmonella enterica enterica serovar Typhi Ty2
acggaacccagcaa

SEQ ID NO: 3677604 - RNA, 12 nt, Salmonella enterica enterica serovar Typhi Ty2
acggaaggggcc

SEQ ID NO: 3677605 - RNA, 20 nt, Salmonella enterica enterica serovar Typhi Ty2
acggaagguaauagcccucg

SEQ ID NO: 3677606 - RNA, 19 nt, Salmonella enterica enterica serovar Typhi Ty2
acggaauaucccgcaagaa

SEQ ID NO: 3677607 - RNA, 18 nt, Salmonella enterica enterica serovar Typhi Ty2
acggaaucucgcacauca

SEQ ID NO: 3677608 - RNA, 20 nt, Salmonella enterica enterica serovar Typhi Ty2
acggaauggcacagcgcagc

SEQ ID NO: 3677609 - RNA, 19 nt, Salmonella enterica enterica serovar Typhi Ty2
acggacauaaaggaaaugc

SEQ ID NO: 3677610 - RNA, 16 nt, Salmonella enterica enterica serovar Typhi Ty2
acggacaucagaggua

SEQ ID NO: 3677611 - RNA, 15 nt, Salmonella enterica enterica serovar Typhi Ty2
acggacucaggccuu

SEQ ID NO: 3677612 - RNA, 17 nt, Salmonella enterica enterica serovar Typhi Ty2
acggagagacaguucag

SEQ ID NO: 3677613 - RNA, 15 nt, Salmonella enterica enterica serovar Typhi Ty2
acggagauuaacagc

SEQ ID NO: 3677614 - RNA, 21 nt, Salmonella enterica enterica serovar Typhi Ty2
acggagauuaacagcgcgacc

SEQ ID NO: 3677615 - RNA, 19 nt, Salmonella enterica enterica serovar Typhi Ty2
acggagcauaauuuuccug

SEQ ID NO: 3677616 - RNA, 21 nt, Salmonella enterica enterica serovar Typhi Ty2
acggaggugccagagauaauu

SEQ ID NO: 3677617 - RNA, 22 nt, Salmonella enterica enterica serovar Typhi Ty2
acggagugcgcggcgaaaaagc

SEQ ID NO: 3677618 - RNA, 12 nt, Salmonella enterica enterica serovar Typhi Ty2
acggauaaaaac

SEQ ID NO: 3677619 - RNA, 15 nt, Salmonella enterica enterica serovar Typhi Ty2
acggauccagaacug

SEQ ID NO: 3677620 - RNA, 22 nt, Salmonella enterica enterica serovar Typhi Ty2
acggaucuuccacuaccgcaau

SEQ ID NO: 3677621 - RNA, 20 nt, Salmonella enterica enterica serovar Typhi Ty2
acggcaaaauaaauauccuc

SEQ ID NO: 3677622 - RNA, 14 nt, Salmonella enterica enterica serovar Typhi Ty2
acggcaaaguucca

SEQ ID NO: 3677623 - RNA, 22 nt, Salmonella enterica enterica serovar Typhi Ty2
acggcaacggcgacaagaauau

SEQ ID NO: 3677624 - RNA, 22 nt, Salmonella enterica enterica serovar Typhi Ty2
acggcaacugaaaacaggccug

SEQ ID NO: 3677625 - RNA, 17 nt, Salmonella enterica enterica serovar Typhi Ty2
acggcaauuuuuacaaa

SEQ ID NO: 3677626 - RNA, 22 nt, Salmonella enterica enterica serovar Typhi Ty2
acggcaauuuuuacaaauuuaa

SEQ ID NO: 3677627 - RNA, 18 nt, Salmonella enterica enterica serovar Typhi Ty2
acggcacaacggccagca

SEQ ID NO: 3677628 - RNA, 22 nt, Salmonella enterica enterica serovar Typhi Ty2
acggcacaacggccagcaaaau

SEQ ID NO: 3677629 - RNA, 14 nt, Salmonella enterica enterica serovar Typhi Ty2
acggcacacaggcc

SEQ ID NO: 3677630 - RNA, 19 nt, Salmonella enterica enterica serovar Typhi Ty2
acggcaccggaaccggcau

SEQ ID NO: 3677631 - RNA, 20 nt, Salmonella enterica enterica serovar Typhi Ty2
acggcaccggaaccggcauc

SEQ ID NO: 3677632 - RNA, 22 nt, Salmonella enterica enterica serovar Typhi Ty2
acggcacuacagcccuuucagg

SEQ ID NO: 3677633 - RNA, 21 nt, Salmonella enterica enterica serovar Typhi Ty2
acggcagccgccaccacaaag

SEQ ID NO: 3677634 - RNA, 22 nt, Salmonella enterica enterica serovar Typhi Ty2
acggcagccucuuucagaucgc

SEQ ID NO: 3677635 - RNA, 20 nt, Salmonella enterica enterica serovar Typhi Ty2
acggcagcguauacgccgga

SEQ ID NO: 3677636 - RNA, 18 nt, Salmonella enterica enterica serovar Typhi Ty2
acggcaguguuucccaac

SEQ ID NO: 3677637 - RNA, 15 nt, Salmonella enterica enterica serovar Typhi Ty2
acggcauaagccagu

SEQ ID NO: 3677638 - RNA, 16 nt, Salmonella enterica enterica serovar Typhi Ty2
acggcaucaagcccau

SEQ ID NO: 3677639 - RNA, 12 nt, Salmonella enterica enterica serovar Typhi Ty2
acggcaucagga

SEQ ID NO: 3677640 - RNA, 13 nt, Salmonella enterica enterica serovar Typhi Ty2
acggcaucaggaa

SEQ ID NO: 3677641 - RNA, 18 nt, Salmonella enterica enterica serovar Typhi Ty2
acggcaucugcggcauga

SEQ ID NO: 3677642 - RNA, 17 nt, Salmonella enterica enterica serovar Typhi Ty2
acggccagugaaauaaa

SEQ ID NO: 3677643 - RNA, 15 nt, Salmonella enterica enterica serovar Typhi Ty2
acggccaguugcgca

SEQ ID NO: 3677644 - RNA, 14 nt, Salmonella enterica enterica serovar Typhi Ty2
acggcccaggcauc

SEQ ID NO: 3677645 - RNA, 17 nt, Salmonella enterica enterica serovar Typhi Ty2
acggcccauaucaauca

SEQ ID NO: 3677646 - RNA, 21 nt, Salmonella enterica enterica serovar Typhi Ty2
acggcccgaagggugaggagc

SEQ ID NO: 3677647 - RNA, 14 nt, Salmonella enterica enterica serovar Typhi Ty2
acggcccguaaaca

SEQ ID NO: 3677648 - RNA, 14 nt, Salmonella enterica enterica serovar Typhi Ty2
acggcccguaaacg

SEQ ID NO: 3677649 - RNA, 18 nt, Salmonella enterica enterica serovar Typhi Ty2
acggcccgugauauugac

SEQ ID NO: 3677650 - RNA, 20 nt, Salmonella enterica enterica serovar Typhi Ty2
acggccugcaaacgaaucac

SEQ ID NO: 3677651 - RNA, 16 nt, Salmonella enterica enterica serovar Typhi Ty2
acggccugcgcggcga

SEQ ID NO: 3677652 - RNA, 18 nt, Salmonella enterica enterica serovar Typhi Ty2
acggccuucgcagaucgc

SEQ ID NO: 3677653 - RNA, 22 nt, Salmonella enterica enterica serovar Typhi Ty2
acggccuucgcagaucgccugg

SEQ ID NO: 3677654 - RNA, 16 nt, Salmonella enterica enterica serovar Typhi Ty2
acggcgaauacgggau

SEQ ID NO: 3677655 - RNA, 15 nt, Salmonella enterica enterica serovar Typhi Ty2
acggcgacaggcaca

SEQ ID NO: 3677656 - RNA, 14 nt, Salmonella enterica enterica serovar Typhi Ty2
acggcgaccggcaa

SEQ ID NO: 3677657 - RNA, 20 nt, Salmonella enterica enterica serovar Typhi Ty2
acggcgacggcuucacugcc

SEQ ID NO: 3677658 - RNA, 19 nt, Salmonella enterica enterica serovar Typhi Ty2
acggcgacguuccgcgaca

SEQ ID NO: 3677659 - RNA, 15 nt, Salmonella enterica enterica serovar Typhi Ty2
acggcgauaccagua

SEQ ID NO: 3677660 - RNA, 12 nt, Salmonella enterica enterica serovar Typhi Ty2
acggcgaucagc

SEQ ID NO: 3677661 - RNA, 23 nt, Salmonella enterica enterica serovar Typhi Ty2
acggcgcagauauuuuccaucac

SEQ ID NO: 3677662 - RNA, 18 nt, Salmonella enterica enterica serovar Typhi Ty2
acggcgcaggcaaaucaa

SEQ ID NO: 3677663 - RNA, 19 nt, Salmonella enterica enterica serovar Typhi Ty2
acggcgcagguaaaaucca

SEQ ID NO: 3677664 - RNA, 14 nt, Salmonella enterica enterica serovar Typhi Ty2
acggcgcgaaaggg

SEQ ID NO: 3677665 - RNA, 21 nt, Salmonella enterica enterica serovar Typhi Ty2
acggcgcgaaucccgcguucg

SEQ ID NO: 3677666 - RNA, 11 nt, Salmonella enterica enterica serovar Typhi Ty2
acggcgcgcca

SEQ ID NO: 3677667 - RNA, 20 nt, Salmonella enterica enterica serovar Typhi Ty2
acggcgcgccaauaaagcuu

SEQ ID NO: 3677668 - RNA, 17 nt, Salmonella enterica enterica serovar Typhi Ty2
acggcgcuuugggaauu

SEQ ID NO: 3677669 - RNA, 15 nt, Salmonella enterica enterica serovar Typhi Ty2
acggcggccagcauu

SEQ ID NO: 3677670 - RNA, 23 nt, Salmonella enterica enterica serovar Typhi Ty2
acggcgguaccauaccugcggcc

SEQ ID NO: 3677671 - RNA, 12 nt, Salmonella enterica enterica serovar Typhi Ty2
acggcguagcga

SEQ ID NO: 3677672 - RNA, 19 nt, Salmonella enterica enterica serovar Typhi Ty2
acggcgucaccaccgcagg

SEQ ID NO: 3677673 - RNA, 16 nt, Salmonella enterica enterica serovar Typhi Ty2
acggcgugacaccggu

SEQ ID NO: 3677674 - RNA, 21 nt, Salmonella enterica enterica serovar Typhi Ty2
acggcgugccaguuuuaaaua

SEQ ID NO: 3677675 - RNA, 16 nt, Salmonella enterica enterica serovar Typhi Ty2
acggcuccagcgccag

SEQ ID NO: 3677676 - RNA, 13 nt, Salmonella enterica enterica serovar Typhi Ty2
acggcuccuuuuu

SEQ ID NO: 3677677 - RNA, 14 nt, Salmonella enterica enterica serovar Typhi Ty2
acggcugaggcuuu

SEQ ID NO: 3677678 - RNA, 19 nt, Salmonella enterica enterica serovar Typhi Ty2
acggcugcacaaaauacug

SEQ ID NO: 3677679 - RNA, 16 nt, Salmonella enterica enterica serovar Typhi Ty2
acgucgcaagacgaaa

SEQ ID NO: 3677680 - RNA, 17 nt, Salmonella enterica enterica serovar Typhi Ty2
acgucgcaagacgaaaa

SEQ ID NO: 3677681 - RNA, 20 nt, Salmonella enterica enterica serovar Typhi Ty2
acgucgcaagacgaaaaaug

SEQ ID NO: 3677682 - RNA, 18 nt, Salmonella enterica enterica serovar Typhi Ty2
acgucgccuggcauggug

SEQ ID NO: 3677683 - RNA, 21 nt, Salmonella enterica enterica serovar Typhi Ty2
acgucgcgcgccgccugcgcc

SEQ ID NO: 3677684 - RNA, 20 nt, Salmonella enterica enterica serovar Typhi Ty2
acgucgcguacaccuuaucu

SEQ ID NO: 3677685 - RNA, 14 nt, Salmonella enterica enterica serovar Typhi Ty2
acgucguaaaaccu

SEQ ID NO: 3677686 - RNA, 15 nt, Salmonella enterica enterica serovar Typhi Ty2
acgucgucaccacgg

SEQ ID NO: 3677687 - RNA, 13 nt, Salmonella enterica enterica serovar Typhi Ty2
acgucugaagaag

SEQ ID NO: 3677688 - RNA, 20 nt, Salmonella enterica enterica serovar Typhi Ty2
acgucugcgcuguugauaac

SEQ ID NO: 3677689 - RNA, 21 nt, Salmonella enterica enterica serovar Typhi Ty2
acgugaaacugauaguuuaaa

SEQ ID NO: 3677690 - RNA, 17 nt, Salmonella enterica enterica serovar Typhi Ty2
acgugacgcgccagcgg

SEQ ID NO: 3677691 - RNA, 19 nt, Salmonella enterica enterica serovar Typhi Ty2
acgugagugguagaaacug

SEQ ID NO: 3677692 - RNA, 22 nt, Salmonella enterica enterica serovar Typhi Ty2
acgugaugaucguguugcagcc

SEQ ID NO: 3677693 - RNA, 13 nt, Salmonella enterica enterica serovar Typhi Ty2
acgugcaucuccu

SEQ ID NO: 3677694 - RNA, 17 nt, Salmonella enterica enterica serovar Typhi Ty2
acgugccgaccagcggu

SEQ ID NO: 3677695 - RNA, 15 nt, Salmonella enterica enterica serovar Typhi Ty2
acguggccagcaugc

SEQ ID NO: 3677696 - RNA, 16 nt, Salmonella enterica enterica serovar Typhi Ty2
acguggggguucaagu

SEQ ID NO: 3677697 - RNA, 15 nt, Salmonella enterica enterica serovar Typhi Ty2
acgugggucgagaau

SEQ ID NO: 3677698 - RNA, 18 nt, Salmonella enterica enterica serovar Typhi Ty2
acguggugcgggauacgu

SEQ ID NO: 3677699 - RNA, 15 nt, Salmonella enterica enterica serovar Typhi Ty2
acguguggcgcugug

SEQ ID NO: 3677700 - RNA, 19 nt, Salmonella enterica enterica serovar Typhi Ty2
acguuaaagccgaccaucg

SEQ ID NO: 3677701 - RNA, 21 nt, Salmonella enterica enterica serovar Typhi Ty2
acguuaaagccgaccaucgcg

SEQ ID NO: 3677702 - RNA, 15 nt, Salmonella enterica enterica serovar Typhi Ty2
acguuaauacaucau

SEQ ID NO: 3677703 - RNA, 18 nt, Salmonella enterica enterica serovar Typhi Ty2
acguuaauggcacgcugg

SEQ ID NO: 3677704 - RNA, 20 nt, Salmonella enterica enterica serovar Typhi Ty2
acguuacauuuuccaugccu

SEQ ID NO: 3677705 - RNA, 18 nt, Salmonella enterica enterica serovar Typhi Ty2
acguuaccauaauuugau

SEQ ID NO: 3677706 - RNA, 17 nt, Salmonella enterica enterica serovar Typhi Ty2
acguuacuugauggaaa

SEQ ID NO: 3677707 - RNA, 21 nt, Salmonella enterica enterica serovar Typhi Ty2
acguuaucgccgacaaacagu

SEQ ID NO: 3677708 - RNA, 23 nt, Salmonella enterica enterica serovar Typhi Ty2
acguuaucgccgacaaacaguga

SEQ ID NO: 3677709 - RNA, 19 nt, Salmonella enterica enterica serovar Typhi Ty2
acguuaucgcgcacgcgcc

SEQ ID NO: 3677710 - RNA, 18 nt, Salmonella enterica enterica serovar Typhi Ty2
acguuaucucgccaggaa

SEQ ID NO: 3677711 - RNA, 21 nt, Salmonella enterica enterica serovar Typhi Ty2
acguuaucugaccuacaggcc

SEQ ID NO: 3677712 - RNA, 21 nt, Salmonella enterica enterica serovar Typhi Ty2
acguuaucugccucaacaagu

SEQ ID NO: 3677713 - RNA, 15 nt, Salmonella enterica enterica serovar Typhi Ty2
acguucaaaaucaaa

SEQ ID NO: 3677714 - RNA, 21 nt, Salmonella enterica enterica serovar Typhi Ty2
acguucaccccgucauauuac

SEQ ID NO: 3677715 - RNA, 23 nt, Salmonella enterica enterica serovar Typhi Ty2
acguucagcauauccagcgccug

SEQ ID NO: 3677716 - RNA, 19 nt, Salmonella enterica enterica serovar Typhi Ty2
acguucaucaggccugcaa

SEQ ID NO: 3677717 - RNA, 17 nt, Salmonella enterica enterica serovar Typhi Ty2
acguucauccuccuucg

SEQ ID NO: 3677718 - RNA, 14 nt, Salmonella enterica enterica serovar Typhi Ty2
acguuccccagcac

SEQ ID NO: 3677719 - RNA, 23 nt, Salmonella enterica enterica serovar Typhi Ty2
acguucggcaaaacgccgcagaa

SEQ ID NO: 3677720 - RNA, 19 nt, Salmonella enterica enterica serovar Typhi Ty2
acguucguuguccacuguu

SEQ ID NO: 3677721 - RNA, 16 nt, Salmonella enterica enterica serovar Typhi Ty2
acguucuuccagaacg

SEQ ID NO: 3677722 - RNA, 17 nt, Salmonella enterica enterica serovar Typhi Ty2
acguucuuccagaacgc

SEQ ID NO: 3677723 - RNA, 12 nt, Salmonella enterica enterica serovar Typhi Ty2
acguucuucucc

SEQ ID NO: 3677724 - RNA, 14 nt, Salmonella enterica enterica serovar Typhi Ty2
acguucuucuccca

SEQ ID NO: 3677725 - RNA, 17 nt, Salmonella enterica enterica serovar Typhi Ty2
acguugaucgccaucgc

SEQ ID NO: 3677726 - RNA, 18 nt, Salmonella enterica enterica serovar Typhi Ty2
acguuggggauaaccaga

SEQ ID NO: 3677727 - RNA, 19 nt, Salmonella enterica enterica serovar Typhi Ty2
acguuggugcguccgguag

SEQ ID NO: 3677728 - RNA, 17 nt, Salmonella enterica enterica serovar Typhi Ty2
acguuguccagcggcca

SEQ ID NO: 3677729 - RNA, 15 nt, Salmonella enterica enterica serovar Typhi Ty2
acguuucgcuaucgc

SEQ ID NO: 3677730 - RNA, 19 nt, Salmonella enterica enterica serovar Typhi Ty2
acguuugccggugccauuc

SEQ ID NO: 3677731 - RNA, 13 nt, Salmonella enterica enterica serovar Typhi Ty2
acguuuuccugcg

SEQ ID NO: 3677732 - RNA, 20 nt, Salmonella enterica enterica serovar Typhi Ty2
acguuuuccugcgcuugcau

SEQ ID NO: 3677733 - RNA, 23 nt, Salmonella enterica enterica serovar Typhi Ty2
acuaaaaauucaaaaaagcagua

SEQ ID NO: 3677734 - RNA, 14 nt, Salmonella enterica enterica serovar Typhi Ty2
acuaaaacaccggu

SEQ ID NO: 3677735 - RNA, 15 nt, Salmonella enterica enterica serovar Typhi Ty2
acuaaaacgugcuga

SEQ ID NO: 3677736 - RNA, 19 nt, Salmonella enterica enterica serovar Typhi Ty2
acuaaauaaauauccuccg

SEQ ID NO: 3677737 - RNA, 14 nt, Salmonella enterica enterica serovar Typhi Ty2
acuaacagcagcag

SEQ ID NO: 3677738 - RNA, 15 nt, Salmonella enterica enterica serovar Typhi Ty2
acuaacgaggccacc

SEQ ID NO: 3677739 - RNA, 19 nt, Salmonella enterica enterica serovar Typhi Ty2
acuaacgaggccaccauca

SEQ ID NO: 3677740 - RNA, 22 nt, Salmonella enterica enterica serovar Typhi Ty2
acuaacggcgucauccugcagg

SEQ ID NO: 3677741 - RNA, 16 nt, Salmonella enterica enterica serovar Typhi Ty2
acuaacugaccauaua

SEQ ID NO: 3677742 - RNA, 11 nt, Salmonella enterica enterica serovar Typhi Ty2
acuaacugccg

SEQ ID NO: 3677743 - RNA, 12 nt, Salmonella enterica enterica serovar Typhi Ty2
acuaacuggcaa

SEQ ID NO: 3677744 - RNA, 13 nt, Salmonella enterica enterica serovar Typhi Ty2
acuaagaccagca

SEQ ID NO: 3677745 - RNA, 18 nt, Salmonella enterica enterica serovar Typhi Ty2
acuaagccaguucucaau

SEQ ID NO: 3677746 - RNA, 17 nt, Salmonella enterica enterica serovar Typhi Ty2
acuaauccccauuuuuu

SEQ ID NO: 3677747 - RNA, 21 nt, Salmonella enterica enterica serovar Typhi Ty2
acuaaucccccggaucaccgg

SEQ ID NO: 3677748 - RNA, 15 nt, Salmonella enterica enterica serovar Typhi Ty2
acuaauuauuuuuca

SEQ ID NO: 3677749 - RNA, 21 nt, Salmonella enterica enterica serovar Typhi Ty2
acuaauuauuuuucaaaugau

SEQ ID NO: 3677750 - RNA, 21 nt, Salmonella enterica enterica serovar Typhi Ty2
acuaauuguuuguagaaagug

SEQ ID NO: 3677751 - RNA, 13 nt, Salmonella enterica enterica serovar Typhi Ty2
acuaauuugcgau

SEQ ID NO: 3677752 - RNA, 12 nt, Salmonella enterica enterica serovar Typhi Ty2
acuacagaaagc

SEQ ID NO: 3677753 - RNA, 21 nt, Salmonella enterica enterica serovar Typhi Ty2
acuacagaaagccauaaaacu

SEQ ID NO: 3677754 - RNA, 11 nt, Salmonella enterica enterica serovar Typhi Ty2
acuacagcccu

SEQ ID NO: 3677755 - RNA, 15 nt, Salmonella enterica enterica serovar Typhi Ty2
acuaccacuuucuug

SEQ ID NO: 3677756 - RNA, 18 nt, Salmonella enterica enterica serovar Typhi Ty2
acuaccagaaacaacacg

SEQ ID NO: 3677757 - RNA, 18 nt, Salmonella enterica enterica serovar Typhi Ty2
acuacccggaggcaauau

SEQ ID NO: 3677758 - RNA, 16 nt, Salmonella enterica enterica serovar Typhi Ty2
acuaccggcaccagca

SEQ ID NO: 3677759 - RNA, 17 nt, Salmonella enterica enterica serovar Typhi Ty2
acuacgccaaugaacuc

SEQ ID NO: 3677760 - RNA, 21 nt, Salmonella enterica enterica serovar Typhi Ty2
acuacgguaaaccaggccagc

SEQ ID NO: 3677761 - RNA, 13 nt, Salmonella enterica enterica serovar Typhi Ty2
acuccugcaucga

SEQ ID NO: 3677762 - RNA, 21 nt, Salmonella enterica enterica serovar Typhi Ty2
acuccugcaucgauuccccac

SEQ ID NO: 3677763 - RNA, 15 nt, Salmonella enterica enterica serovar Typhi Ty2
acuccugggcaaaau

SEQ ID NO: 3677764 - RNA, 17 nt, Salmonella enterica enterica serovar Typhi Ty2
acuccuuagauuaauca

SEQ ID NO: 3677765 - RNA, 13 nt, Salmonella enterica enterica serovar Typhi Ty2
acucgaauuauuu

SEQ ID NO: 3677766 - RNA, 14 nt, Salmonella enterica enterica serovar Typhi Ty2
acucgaauuguuaa

SEQ ID NO: 3677767 - RNA, 22 nt, Salmonella enterica enterica serovar Typhi Ty2
acucgaccuucaucucuuugcc

SEQ ID NO: 3677768 - RNA, 14 nt, Salmonella enterica enterica serovar Typhi Ty2
acucgcacaguaca

SEQ ID NO: 3677769 - RNA, 19 nt, Salmonella enterica enterica serovar Typhi Ty2
acucgccaugccaucggcc

SEQ ID NO: 3677770 - RNA, 21 nt, Salmonella enterica enterica serovar Typhi Ty2
acucgccuuucuccaugguca

SEQ ID NO: 3677771 - RNA, 16 nt, Salmonella enterica enterica serovar Typhi Ty2
acucgcugauacgcug

SEQ ID NO: 3677772 - RNA, 19 nt, Salmonella enterica enterica serovar Typhi Ty2
acucgcuguauuucccucu

SEQ ID NO: 3677773 - RNA, 15 nt, Salmonella enterica enterica serovar Typhi Ty2
acucgcuguggccag

SEQ ID NO: 3677774 - RNA, 16 nt, Salmonella enterica enterica serovar Typhi Ty2
acucggcgaucaccac

SEQ ID NO: 3677775 - RNA, 21 nt, Salmonella enterica enterica serovar Typhi Ty2
acucgggccagcucuuuucug

SEQ ID NO: 3677776 - RNA, 13 nt, Salmonella enterica enterica serovar Typhi Ty2
acucggugccgcu

SEQ ID NO: 3677777 - RNA, 15 nt, Salmonella enterica enterica serovar Typhi Ty2
acucguaagaggcgu

SEQ ID NO: 3677778 - RNA, 15 nt, Salmonella enterica enterica serovar Typhi Ty2
acucguagccaaaau

SEQ ID NO: 3677779 - RNA, 19 nt, Salmonella enterica enterica serovar Typhi Ty2
acucguucccguuuauguu

SEQ ID NO: 3677780 - RNA, 14 nt, Salmonella enterica enterica serovar Typhi Ty2
acucuaugcaaaag

SEQ ID NO: 3677781 - RNA, 23 nt, Salmonella enterica enterica serovar Typhi Ty2
acucuaugcaaaagaaaaaacuu

SEQ ID NO: 3677782 - RNA, 15 nt, Salmonella enterica enterica serovar Typhi Ty2
acucucaaugcccau

SEQ ID NO: 3677783 - RNA, 21 nt, Salmonella enterica enterica serovar Typhi Ty2
acucucaaugcccaucugacg

SEQ ID NO: 3677784 - RNA, 19 nt, Salmonella enterica enterica serovar Typhi Ty2
acucucaccgaccugccuu

SEQ ID NO: 3677785 - RNA, 20 nt, Salmonella enterica enterica serovar Typhi Ty2
acucucaccgaccugccuug

SEQ ID NO: 3677786 - RNA, 20 nt, Salmonella enterica enterica serovar Typhi Ty2
uaccgugcaaaaucacgcgg

SEQ ID NO: 3677787 - RNA, 20 nt, Salmonella enterica enterica serovar Typhi Ty2
uaccgugugcagugacagag

SEQ ID NO: 3677788 - RNA, 21 nt, Salmonella enterica enterica serovar Typhi Ty2
uaccguugaugauuacugcug

SEQ ID NO: 3677789 - RNA, 15 nt, Salmonella enterica enterica serovar Typhi Ty2
uaccguuuuccaguc

SEQ ID NO: 3677790 - RNA, 18 nt, Salmonella enterica enterica serovar Typhi Ty2
uaccuacgcgauaaaaaa

SEQ ID NO: 3677791 - RNA, 20 nt, Salmonella enterica enterica serovar Typhi Ty2
uaccuauuuguuccggcaag

SEQ ID NO: 3677792 - RNA, 13 nt, Salmonella enterica enterica serovar Typhi Ty2
uaccuauuuuaaa

SEQ ID NO: 3677793 - RNA, 20 nt, Salmonella enterica enterica serovar Typhi Ty2
uaccuauuuuaaauucccag

SEQ ID NO: 3677794 - RNA, 22 nt, Salmonella enterica enterica serovar Typhi Ty2
uaccuauuuuaaauucccagcg

SEQ ID NO: 3677795 - RNA, 22 nt, Salmonella enterica enterica serovar Typhi Ty2
uaccucagguaucauaugugcc

SEQ ID NO: 3677796 - RNA, 14 nt, Salmonella enterica enterica serovar Typhi Ty2
uaccuccuggcguu

SEQ ID NO: 3677797 - RNA, 19 nt, Salmonella enterica enterica serovar Typhi Ty2
uaccuccuggcguuaucau

SEQ ID NO: 3677798 - RNA, 13 nt, Salmonella enterica enterica serovar Typhi Ty2
uaccucgccgacg

SEQ ID NO: 3677799 - RNA, 16 nt, Salmonella enterica enterica serovar Typhi Ty2
uaccucuuauccggcu

SEQ ID NO: 3677800 - RNA, 16 nt, Salmonella enterica enterica serovar Typhi Ty2
uaccugaagccauccu

SEQ ID NO: 3677801 - RNA, 24 nt, Salmonella enterica enterica serovar Typhi Ty2
uaccugaagccauccucacgcaac

SEQ ID NO: 3677802 - RNA, 19 nt, Salmonella enterica enterica serovar Typhi Ty2
uaccugauccagcucuucu

SEQ ID NO: 3677803 - RNA, 22 nt, Salmonella enterica enterica serovar Typhi Ty2
uaccugauccagcucuucuucg

SEQ ID NO: 3677804 - RNA, 12 nt, Salmonella enterica enterica serovar Typhi Ty2
uaccugaugagc

SEQ ID NO: 3677805 - RNA, 18 nt, Salmonella enterica enterica serovar Typhi Ty2
uaccugaugagcaggcca

SEQ ID NO: 3677806 - RNA, 18 nt, Salmonella enterica enterica serovar Typhi Ty2
uaccugaugucauucuuu

SEQ ID NO: 3677807 - RNA, 19 nt, Salmonella enterica enterica serovar Typhi Ty2
uaccugcaaaaacgccaga

SEQ ID NO: 3677808 - RNA, 18 nt, Salmonella enterica enterica serovar Typhi Ty2
uaccugcgcaaucaugac

SEQ ID NO: 3677809 - RNA, 13 nt, Salmonella enterica enterica serovar Typhi Ty2
uaccuggaaccag

SEQ ID NO: 3677810 - RNA, 17 nt, Salmonella enterica enterica serovar Typhi Ty2
uaccuguaucaaaccaa

SEQ ID NO: 3677811 - RNA, 13 nt, Salmonella enterica enterica serovar Typhi Ty2
uaccuguauuaug

SEQ ID NO: 3677812 - RNA, 22 nt, Salmonella enterica enterica serovar Typhi Ty2
uaccuguauuuucguuugcauu

SEQ ID NO: 3677813 - RNA, 19 nt, Salmonella enterica enterica serovar Typhi Ty2
uaccugucguacgccuaaa

SEQ ID NO: 3677814 - RNA, 22 nt, Salmonella enterica enterica serovar Typhi Ty2
uaccuugucggguggcgcuagc

SEQ ID NO: 3677815 - RNA, 15 nt, Salmonella enterica enterica serovar Typhi Ty2
uaccuuguucuucca

SEQ ID NO: 3677816 - RNA, 16 nt, Salmonella enterica enterica serovar Typhi Ty2
uaccuuguucuuccau

SEQ ID NO: 3677817 - RNA, 13 nt, Salmonella enterica enterica serovar Typhi Ty2
uaccuuuacgcag

SEQ ID NO: 3677818 - RNA, 15 nt, Salmonella enterica enterica serovar Typhi Ty2
uaccuuuaucuugac

SEQ ID NO: 3677819 - RNA, 19 nt, Salmonella enterica enterica serovar Typhi Ty2
uacgacacccgauacacgc

SEQ ID NO: 3677820 - RNA, 14 nt, Salmonella enterica enterica serovar Typhi Ty2
uacgaccgccgaca

SEQ ID NO: 3677821 - RNA, 17 nt, Salmonella enterica enterica serovar Typhi Ty2
uacgacgcgccaccauc

SEQ ID NO: 3677822 - RNA, 16 nt, Salmonella enterica enterica serovar Typhi Ty2
uacgacugcacccauc

SEQ ID NO: 3677823 - RNA, 18 nt, Salmonella enterica enterica serovar Typhi Ty2
uacgagaaccaacugcca

SEQ ID NO: 3677824 - RNA, 14 nt, Salmonella enterica enterica serovar Typhi Ty2
uacgagauaaaaac

SEQ ID NO: 3677825 - RNA, 19 nt, Salmonella enterica enterica serovar Typhi Ty2
uacgagcauccagaucggc

SEQ ID NO: 3677826 - RNA, 23 nt, Salmonella enterica enterica serovar Typhi Ty2
uacgaggugggcucagcgaccug

SEQ ID NO: 3677827 - RNA, 19 nt, Salmonella enterica enterica serovar Typhi Ty2
uacgagugcguucuuccac

SEQ ID NO: 3677828 - RNA, 14 nt, Salmonella enterica enterica serovar Typhi Ty2
uacgauaccccauc

SEQ ID NO: 3677829 - RNA, 13 nt, Salmonella enterica enterica serovar Typhi Ty2
uacgauaucaucg

SEQ ID NO: 3677830 - RNA, 18 nt, Salmonella enterica enterica serovar Typhi Ty2
uacgaucgcaacggcauu

SEQ ID NO: 3677831 - RNA, 16 nt, Salmonella enterica enterica serovar Typhi Ty2
uacgaucgccaccgca

SEQ ID NO: 3677832 - RNA, 16 nt, Salmonella enterica enterica serovar Typhi Ty2
uacgaugcagcaccag

SEQ ID NO: 3677833 - RNA, 17 nt, Salmonella enterica enterica serovar Typhi Ty2
uacgauuucauuacgcc

SEQ ID NO: 3677834 - RNA, 14 nt, Salmonella enterica enterica serovar Typhi Ty2
uacgcagcaggcag

SEQ ID NO: 3677835 - RNA, 18 nt, Salmonella enterica enterica serovar Typhi Ty2
uacgcagcgccuucgcuu

SEQ ID NO: 3677836 - RNA, 17 nt, Salmonella enterica enterica serovar Typhi Ty2
uacgcagcuuaaagcca

SEQ ID NO: 3677837 - RNA, 19 nt, Salmonella enterica enterica serovar Typhi Ty2
uacgcagcuuaaagccaau

SEQ ID NO: 3677838 - RNA, 17 nt, Salmonella enterica enterica serovar Typhi Ty2
uacgcaggacuuucgcu

SEQ ID NO: 3677839 - RNA, 16 nt, Salmonella enterica enterica serovar Typhi Ty2
uacuccugcaacagaa

SEQ ID NO: 3677840 - RNA, 20 nt, Salmonella enterica enterica serovar Typhi Ty2
uacucgacgcacuccagaug

SEQ ID NO: 3677841 - RNA, 22 nt, Salmonella enterica enterica serovar Typhi Ty2
uacucgccaauauccccagccc

SEQ ID NO: 3677842 - RNA, 22 nt, Salmonella enterica enterica serovar Typhi Ty2
uacucgggccagcucuuuucug

SEQ ID NO: 3677843 - RNA, 21 nt, Salmonella enterica enterica serovar Typhi Ty2
uacucguaaucuaaaauuauu

SEQ ID NO: 3677844 - RNA, 13 nt, Salmonella enterica enterica serovar Typhi Ty2
uacucugcuuuuu

SEQ ID NO: 3677845 - RNA, 13 nt, Salmonella enterica enterica serovar Typhi Ty2
uacucuucacccu

SEQ ID NO: 3677846 - RNA, 15 nt, Salmonella enterica enterica serovar Typhi Ty2
uacucuuucccggca

SEQ ID NO: 3677847 - RNA, 23 nt, Salmonella enterica enterica serovar Typhi Ty2
uacucuuucccggcaauuaccgc

SEQ ID NO: 3677848 - RNA, 15 nt, Salmonella enterica enterica serovar Typhi Ty2
uacucuuugaugguu

SEQ ID NO: 3677849 - RNA, 19 nt, Salmonella enterica enterica serovar Typhi Ty2
uacugaauaacagcaccau

SEQ ID NO: 3677850 - RNA, 18 nt, Salmonella enterica enterica serovar Typhi Ty2
uacugaccaacaacagau

SEQ ID NO: 3677851 - RNA, 20 nt, Salmonella enterica enterica serovar Typhi Ty2
uacugaccaagcgucagcau

SEQ ID NO: 3677852 - RNA, 15 nt, Salmonella enterica enterica serovar Typhi Ty2
uacugaccagacagc

SEQ ID NO: 3677853 - RNA, 17 nt, Salmonella enterica enterica serovar Typhi Ty2
uacugaccagacagccc

SEQ ID NO: 3677854 - RNA, 17 nt, Salmonella enterica enterica serovar Typhi Ty2
uacugagcauccaccgg

SEQ ID NO: 3677855 - RNA, 17 nt, Salmonella enterica enterica serovar Typhi Ty2
uacugagcgccucugau

SEQ ID NO: 3677856 - RNA, 21 nt, Salmonella enterica enterica serovar Typhi Ty2
uacugauagcauuguauccag

SEQ ID NO: 3677857 - RNA, 13 nt, Salmonella enterica enterica serovar Typhi Ty2
uacugauuccugc

SEQ ID NO: 3677858 - RNA, 15 nt, Salmonella enterica enterica serovar Typhi Ty2
uacugccaaccauua

SEQ ID NO: 3677859 - RNA, 20 nt, Salmonella enterica enterica serovar Typhi Ty2
uacugccagcgucgcugauu

SEQ ID NO: 3677860 - RNA, 16 nt, Salmonella enterica enterica serovar Typhi Ty2
uacugcccguggcgga

SEQ ID NO: 3677861 - RNA, 16 nt, Salmonella enterica enterica serovar Typhi Ty2
uacugccgccaucgcu

SEQ ID NO: 3677862 - RNA, 18 nt, Salmonella enterica enterica serovar Typhi Ty2
uacugcgcguggcaaaua

SEQ ID NO: 3677863 - RNA, 21 nt, Salmonella enterica enterica serovar Typhi Ty2
uacugcgcucuaucaccgccc

SEQ ID NO: 3677864 - RNA, 21 nt, Salmonella enterica enterica serovar Typhi Ty2
uacugcggguguccguuccug

SEQ ID NO: 3677865 - RNA, 13 nt, Salmonella enterica enterica serovar Typhi Ty2
uacugcuauuagc

SEQ ID NO: 3677866 - RNA, 16 nt, Salmonella enterica enterica serovar Typhi Ty2
uacugcuggccuaucu

SEQ ID NO: 3677867 - RNA, 17 nt, Salmonella enterica enterica serovar Typhi Ty2
uacugcuggccuaucug

SEQ ID NO: 3677868 - RNA, 18 nt, Salmonella enterica enterica serovar Typhi Ty2
uacugcuguccgccagca

SEQ ID NO: 3677869 - RNA, 20 nt, Salmonella enterica enterica serovar Typhi Ty2
uacugcuuagcucaucagcc

SEQ ID NO: 3677870 - RNA, 17 nt, Salmonella enterica enterica serovar Typhi Ty2
uacugcuuuaauaccgg

SEQ ID NO: 3677871 - RNA, 17 nt, Salmonella enterica enterica serovar Typhi Ty2
uacuggagcucgcgaug

SEQ ID NO: 3677872 - RNA, 19 nt, Salmonella enterica enterica serovar Typhi Ty2
uacuggauaaccgcuucga

SEQ ID NO: 3677873 - RNA, 22 nt, Salmonella enterica enterica serovar Typhi Ty2
uacuggaucgcuccauucuguc

SEQ ID NO: 3677874 - RNA, 23 nt, Salmonella enterica enterica serovar Typhi Ty2
uacuggccacggagugcgcggcg

SEQ ID NO: 3677875 - RNA, 17 nt, Salmonella enterica enterica serovar Typhi Ty2
uacuggcgauuuucaua

SEQ ID NO: 3677876 - RNA, 22 nt, Salmonella enterica enterica serovar Typhi Ty2
uacuggcgauuuucauagcugg

SEQ ID NO: 3677877 - RNA, 22 nt, Salmonella enterica enterica serovar Typhi Ty2
uacuggcuaucuuuaugucagu

SEQ ID NO: 3677878 - RNA, 21 nt, Salmonella enterica enterica serovar Typhi Ty2
uacuggugcccgcaaaaccuu

SEQ ID NO: 3677879 - RNA, 21 nt, Salmonella enterica enterica serovar Typhi Ty2
uacugucaucccgauauacca

SEQ ID NO: 3677880 - RNA, 21 nt, Salmonella enterica enterica serovar Typhi Ty2
uacugucgcgcggcgucccua

SEQ ID NO: 3677881 - RNA, 19 nt, Salmonella enterica enterica serovar Typhi Ty2
uacugucuuguggaacacc

SEQ ID NO: 3677882 - RNA, 21 nt, Salmonella enterica enterica serovar Typhi Ty2
uacugugggccguuccgcaac

SEQ ID NO: 3677883 - RNA, 17 nt, Salmonella enterica enterica serovar Typhi Ty2
uacuguggugugccugc

SEQ ID NO: 3677884 - RNA, 16 nt, Salmonella enterica enterica serovar Typhi Ty2
uacuuaaaauugaauu

SEQ ID NO: 3677885 - RNA, 18 nt, Salmonella enterica enterica serovar Typhi Ty2
uacuuaauucugcugccu

SEQ ID NO: 3677886 - RNA, 11 nt, Salmonella enterica enterica serovar Typhi Ty2
uacuuaucggc

SEQ ID NO: 3677887 - RNA, 15 nt, Salmonella enterica enterica serovar Typhi Ty2
uacuucaggcugcca

SEQ ID NO: 3677888 - RNA, 11 nt, Salmonella enterica enterica serovar Typhi Ty2
uacuucaucag

SEQ ID NO: 3677889 - RNA, 21 nt, Salmonella enterica enterica serovar Typhi Ty2
uacuucgauggccucaucaug

SEQ ID NO: 3677890 - RNA, 22 nt, Salmonella enterica enterica serovar Typhi Ty2
uacuucgcucucuuuuggcgac

SEQ ID NO: 3677891 - RNA, 17 nt, Salmonella enterica enterica serovar Typhi Ty2
uacuucgcuuuguuuuc

SEQ ID NO: 3677892 - RNA, 19 nt, Salmonella enterica enterica serovar Typhi Ty2
uacuucguagacucaggcg

SEQ ID NO: 3677893 - RNA, 16 nt, Salmonella enterica enterica serovar Typhi Ty2
uacuucugacagugac

SEQ ID NO: 3677894 - RNA, 20 nt, Salmonella enterica enterica serovar Typhi Ty2
uacuucugacagugacggca

SEQ ID NO: 3677895 - RNA, 23 nt, Salmonella enterica enterica serovar Typhi Ty2
uacuucuucaguuccgccagacu

SEQ ID NO: 3677896 - RNA, 14 nt, Salmonella enterica enterica serovar Typhi Ty2
uacuuuaaaacaua

SEQ ID NO: 3677897 - RNA, 21 nt, Salmonella enterica enterica serovar Typhi Ty2
uacuuuauaaaucaggaaaaa

SEQ ID NO: 3677898 - RNA, 17 nt, Salmonella enterica enterica serovar Typhi Ty2
uacuuucaaaauacugg

SEQ ID NO: 3677899 - RNA, 11 nt, Salmonella enterica enterica serovar Typhi Ty2
uacuuuccagc

SEQ ID NO: 3677900 - RNA, 16 nt, Salmonella enterica enterica serovar Typhi Ty2
uacuuucccccagauu

SEQ ID NO: 3677901 - RNA, 11 nt, Salmonella enterica enterica serovar Typhi Ty2
uacuuuccuga

SEQ ID NO: 3677902 - RNA, 14 nt, Salmonella enterica enterica serovar Typhi Ty2
uacuuucuacaaau

SEQ ID NO: 3677903 - RNA, 14 nt, Salmonella enterica enterica serovar Typhi Ty2
uacuuuguacugua

SEQ ID NO: 3677904 - RNA, 19 nt, Salmonella enterica enterica serovar Typhi Ty2
uacuuuuacccuucagaua

SEQ ID NO: 3677905 - RNA, 18 nt, Salmonella enterica enterica serovar Typhi Ty2
uacuuuuuuaaauguuuu

SEQ ID NO: 3677906 - RNA, 23 nt, Salmonella enterica enterica serovar Typhi Ty2
uacuuuuuuaaauguuuuuucau

SEQ ID NO: 3677907 - RNA, 13 nt, Salmonella enterica enterica serovar Typhi Ty2
uagaaaaaauuaa

SEQ ID NO: 3677908 - RNA, 18 nt, Salmonella enterica enterica serovar Typhi Ty2
uagaaaaaauuaaaaaua

SEQ ID NO: 3677909 - RNA, 17 nt, Salmonella enterica enterica serovar Typhi Ty2
uagaaaaagguaacuau

SEQ ID NO: 3677910 - RNA, 22 nt, Salmonella enterica enterica serovar Typhi Ty2
uagaaaauaauucauauuagcu

SEQ ID NO: 3677911 - RNA, 14 nt, Salmonella enterica enterica serovar Typhi Ty2
uagaaaauauauug

SEQ ID NO: 3677912 - RNA, 23 nt, Salmonella enterica enterica serovar Typhi Ty2
uagaaacucuuuaaagcgcugcg

SEQ ID NO: 3677913 - RNA, 23 nt, Salmonella enterica enterica serovar Typhi Ty2
uagaaagauuucaucaggcugac

SEQ ID NO: 3677914 - RNA, 20 nt, Salmonella enterica enterica serovar Typhi Ty2
uagaaaguacaucauuggcc

SEQ ID NO: 3677915 - RNA, 22 nt, Salmonella enterica enterica serovar Typhi Ty2
uagaaagucuuuuguuuuucuc

SEQ ID NO: 3677916 - RNA, 19 nt, Salmonella enterica enterica serovar Typhi Ty2
uagaaaguggcauaucaug

SEQ ID NO: 3677917 - RNA, 14 nt, Salmonella enterica enterica serovar Typhi Ty2
uagaaccacuuauu

SEQ ID NO: 3677918 - RNA, 15 nt, Salmonella enterica enterica serovar Typhi Ty2
uagaauagcgccgug

SEQ ID NO: 3677919 - RNA, 18 nt, Salmonella enterica enterica serovar Typhi Ty2
uagaaucccaccaauugc

SEQ ID NO: 3677920 - RNA, 13 nt, Salmonella enterica enterica serovar Typhi Ty2
uagaaucuauuau

SEQ ID NO: 3677921 - RNA, 14 nt, Salmonella enterica enterica serovar Typhi Ty2
uagaauuuucacuu

SEQ ID NO: 3677922 - RNA, 11 nt, Salmonella enterica enterica serovar Typhi Ty2
uagacaaacag

SEQ ID NO: 3677923 - RNA, 18 nt, Salmonella enterica enterica serovar Typhi Ty2
uagacaacaucccagaaa

SEQ ID NO: 3677924 - RNA, 21 nt, Salmonella enterica enterica serovar Typhi Ty2
uagacaacaucccagaaaaug

SEQ ID NO: 3677925 - RNA, 19 nt, Salmonella enterica enterica serovar Typhi Ty2
uagacagcaccaucaugca

SEQ ID NO: 3677926 - RNA, 21 nt, Salmonella enterica enterica serovar Typhi Ty2
uagacaguuuuuucguuccag

SEQ ID NO: 3677927 - RNA, 16 nt, Salmonella enterica enterica serovar Typhi Ty2
uagaccagcggcccgc

SEQ ID NO: 3677928 - RNA, 23 nt, Salmonella enterica enterica serovar Typhi Ty2
uagaccgcccaggauaucgcggg

SEQ ID NO: 3677929 - RNA, 15 nt, Salmonella enterica enterica serovar Typhi Ty2
uagaccugaaaucag

SEQ ID NO: 3677930 - RNA, 22 nt, Salmonella enterica enterica serovar Typhi Ty2
uagaccugaaaucagccugcua

SEQ ID NO: 3677931 - RNA, 15 nt, Salmonella enterica enterica serovar Typhi Ty2
uagacgaugcaggcc

SEQ ID NO: 3677932 - RNA, 17 nt, Salmonella enterica enterica serovar Typhi Ty2
uagacgccggucaugcc

SEQ ID NO: 3677933 - RNA, 23 nt, Salmonella enterica enterica serovar Typhi Ty2
uagacgucgcguacaauugcuuc

SEQ ID NO: 3677934 - RNA, 20 nt, Salmonella enterica enterica serovar Typhi Ty2
uagacuccgucaaagaaaac

SEQ ID NO: 3677935 - RNA, 15 nt, Salmonella enterica enterica serovar Typhi Ty2
uagacucgcggguuu

SEQ ID NO: 3677936 - RNA, 16 nt, Salmonella enterica enterica serovar Typhi Ty2
uagacuucacuuuccc

SEQ ID NO: 3677937 - RNA, 21 nt, Salmonella enterica enterica serovar Typhi Ty2
uagacuuuggcgcagucacag

SEQ ID NO: 3677938 - RNA, 13 nt, Salmonella enterica enterica serovar Typhi Ty2
uagagaaaauaac

SEQ ID NO: 3677939 - RNA, 12 nt, Salmonella enterica enterica serovar Typhi Ty2
uagagaaaucaa

SEQ ID NO: 3677940 - RNA, 13 nt, Salmonella enterica enterica serovar Typhi Ty2
uagagaaaucaac

SEQ ID NO: 3677941 - RNA, 15 nt, Salmonella enterica enterica serovar Typhi Ty2
uagagaacagcauca

SEQ ID NO: 3677942 - RNA, 16 nt, Salmonella enterica enterica serovar Typhi Ty2
uagagaccgcuuuagc

SEQ ID NO: 3677943 - RNA, 20 nt, Salmonella enterica enterica serovar Typhi Ty2
uagagaguaaaaccggcaca

SEQ ID NO: 3677944 - RNA, 18 nt, Salmonella enterica enterica serovar Typhi Ty2
uagagcaggucaaagacg

SEQ ID NO: 3677945 - RNA, 20 nt, Salmonella enterica enterica serovar Typhi Ty2
uagagcaggucaaagacgaa

SEQ ID NO: 3677946 - RNA, 21 nt, Salmonella enterica enterica serovar Typhi Ty2
uagagugauccaccaccagca

SEQ ID NO: 3677947 - RNA, 16 nt, Salmonella enterica enterica serovar Typhi Ty2
uagagugcuucugcaa

SEQ ID NO: 3677948 - RNA, 17 nt, Salmonella enterica enterica serovar Typhi Ty2
uagagugcuucugcaaa

SEQ ID NO: 3677949 - RNA, 18 nt, Salmonella enterica enterica serovar Typhi Ty2
uagauaaguccuaacacc

SEQ ID NO: 3677950 - RNA, 16 nt, Salmonella enterica enterica serovar Typhi Ty2
uagauaccuacuuuau

SEQ ID NO: 3677951 - RNA, 23 nt, Salmonella enterica enterica serovar Typhi Ty2
uagauaccuacuuuauuuuucgc

SEQ ID NO: 3677952 - RNA, 14 nt, Salmonella enterica enterica serovar Typhi Ty2
uagauauuccccac

SEQ ID NO: 3677953 - RNA, 20 nt, Salmonella enterica enterica serovar Typhi Ty2
uagaugaaacucgcuguggc

SEQ ID NO: 3677954 - RNA, 22 nt, Salmonella enterica enterica serovar Typhi Ty2
uagauggcguaucgcuugauac

SEQ ID NO: 3677955 - RNA, 20 nt, Salmonella enterica enterica serovar Typhi Ty2
uagauguuaaaguuuuucau

SEQ ID NO: 3677956 - RNA, 13 nt, Salmonella enterica enterica serovar Typhi Ty2
uagcaaaaaugcc

SEQ ID NO: 3677957 - RNA, 18 nt, Salmonella enterica enterica serovar Typhi Ty2
uagcaaagcguacaugaa

SEQ ID NO: 3677958 - RNA, 21 nt, Salmonella enterica enterica serovar Typhi Ty2
uagcaaagcguacaugaauaa

SEQ ID NO: 3677959 - RNA, 20 nt, Salmonella enterica enterica serovar Typhi Ty2
uagcaacacagacuuugcac

SEQ ID NO: 3677960 - RNA, 20 nt, Salmonella enterica enterica serovar Typhi Ty2
uagcaaccucggcuugcuuc

SEQ ID NO: 3677961 - RNA, 14 nt, Salmonella enterica enterica serovar Typhi Ty2
uagcaauuaauaaa

SEQ ID NO: 3677962 - RNA, 13 nt, Salmonella enterica enterica serovar Typhi Ty2
uagcaauuauauu

SEQ ID NO: 3677963 - RNA, 19 nt, Salmonella enterica enterica serovar Typhi Ty2
uagcaauugccauaaaaac

SEQ ID NO: 3677964 - RNA, 13 nt, Salmonella enterica enterica serovar Typhi Ty2
uagcacaaagaau

SEQ ID NO: 3677965 - RNA, 14 nt, Salmonella enterica enterica serovar Typhi Ty2
uagcacaaagaauu

SEQ ID NO: 3677966 - RNA, 12 nt, Salmonella enterica enterica serovar Typhi Ty2
uagcacagcgcu

SEQ ID NO: 3677967 - RNA, 14 nt, Salmonella enterica enterica serovar Typhi Ty2
uagcaccaggccaa

SEQ ID NO: 3677968 - RNA, 14 nt, Salmonella enterica enterica serovar Typhi Ty2
uagcacuacggcaa

SEQ ID NO: 3677969 - RNA, 15 nt, Salmonella enterica enterica serovar Typhi Ty2
uagcacuuuaaacac

SEQ ID NO: 3677970 - RNA, 14 nt, Salmonella enterica enterica serovar Typhi Ty2
uagcagacagccga

SEQ ID NO: 3677971 - RNA, 19 nt, Salmonella enterica enterica serovar Typhi Ty2
uagcagcauaaacaucagc

SEQ ID NO: 3677972 - RNA, 23 nt, Salmonella enterica enterica serovar Typhi Ty2
uagcaggauauuuugcucauauu

SEQ ID NO: 3677973 - RNA, 14 nt, Salmonella enterica enterica serovar Typhi Ty2
uagcaguggagagg

SEQ ID NO: 3677974 - RNA, 21 nt, Salmonella enterica enterica serovar Typhi Ty2
uagcauaaaugcgaugaacau

SEQ ID NO: 3677975 - RNA, 19 nt, Salmonella enterica enterica serovar Typhi Ty2
uagcauaacguuuccuuau

SEQ ID NO: 3677976 - RNA, 12 nt, Salmonella enterica enterica serovar Typhi Ty2
uagcaucaccag

SEQ ID NO: 3677977 - RNA, 12 nt, Salmonella enterica enterica serovar Typhi Ty2
uagcauccagca

SEQ ID NO: 3677978 - RNA, 23 nt, Salmonella enterica enterica serovar Typhi Ty2
uagcauuuccgcaucguuaucau

SEQ ID NO: 3677979 - RNA, 16 nt, Salmonella enterica enterica serovar Typhi Ty2
uagcauuuuuacucag

SEQ ID NO: 3677980 - RNA, 20 nt, Salmonella enterica enterica serovar Typhi Ty2
uagccaaacucugaaaaaau

SEQ ID NO: 3677981 - RNA, 19 nt, Salmonella enterica enterica serovar Typhi Ty2
uagccaaagauuagcccca

SEQ ID NO: 3677982 - RNA, 20 nt, Salmonella enterica enterica serovar Typhi Ty2
uagccaaagcgguaauuaau

SEQ ID NO: 3677983 - RNA, 15 nt, Salmonella enterica enterica serovar Typhi Ty2
uagccaacacauaag

SEQ ID NO: 3677984 - RNA, 15 nt, Salmonella enterica enterica serovar Typhi Ty2
uagccacagcgguua

SEQ ID NO: 3677985 - RNA, 16 nt, Salmonella enterica enterica serovar Typhi Ty2
uagccacucacggcaa

SEQ ID NO: 3677986 - RNA, 12 nt, Salmonella enterica enterica serovar Typhi Ty2
uagccagcauca

SEQ ID NO: 3677987 - RNA, 22 nt, Salmonella enterica enterica serovar Typhi Ty2
uagccagccauggcccuuuugc

SEQ ID NO: 3677988 - RNA, 17 nt, Salmonella enterica enterica serovar Typhi Ty2
uagccagcgauccugcg

SEQ ID NO: 3677989 - RNA, 20 nt, Salmonella enterica enterica serovar Typhi Ty2
uagccagcgauccugcggca

SEQ ID NO: 3677990 - RNA, 22 nt, Salmonella enterica enterica serovar Typhi Ty2
uagccaguucgccuucuucauc

SEQ ID NO: 3677991 - RNA, 19 nt, Salmonella enterica enterica serovar Typhi Ty2
uagccaucaaaguagaugu

SEQ ID NO: 3677992 - RNA, 18 nt, Salmonella enterica enterica serovar Typhi Ty2
uagccauucauuaaaauu

SEQ ID NO: 3677993 - RNA, 15 nt, Salmonella enterica enterica serovar Typhi Ty2
uagccauuuaaugau

SEQ ID NO: 3677994 - RNA, 13 nt, Salmonella enterica enterica serovar Typhi Ty2
uagcccacaggua

SEQ ID NO: 3677995 - RNA, 17 nt, Salmonella enterica enterica serovar Typhi Ty2
uagcccauauuggcaau

SEQ ID NO: 3677996 - RNA, 22 nt, Salmonella enterica enterica serovar Typhi Ty2
uagcccgccagcaccagcagcg

SEQ ID NO: 3677997 - RNA, 15 nt, Salmonella enterica enterica serovar Typhi Ty2
uagcccguacgaucu

SEQ ID NO: 3677998 - RNA, 16 nt, Salmonella enterica enterica serovar Typhi Ty2
uagcccguuaugccau

SEQ ID NO: 3677999 - RNA, 20 nt, Salmonella enterica enterica serovar Typhi Ty2
uagcccucgguggauaaauu

SEQ ID NO: 3678000 - RNA, 19 nt, Salmonella enterica enterica serovar Typhi Ty2
uagcccugagcccacagcg

SEQ ID NO: 3678001 - RNA, 23 nt, Salmonella enterica enterica serovar Typhi Ty2
uagccgacggccauaaaccccga

SEQ ID NO: 3678002 - RNA, 22 nt, Salmonella enterica enterica serovar Typhi Ty2
uagccgccagcuaauuuuacuu

SEQ ID NO: 3678003 - RNA, 17 nt, Salmonella enterica enterica serovar Typhi Ty2
uaggccaggcauccggc

SEQ ID NO: 3678004 - RNA, 19 nt, Salmonella enterica enterica serovar Typhi Ty2
uaggccgaauaagccaggc

SEQ ID NO: 3678005 - RNA, 20 nt, Salmonella enterica enterica serovar Typhi Ty2
uaggccggauaagcggcagc

SEQ ID NO: 3678006 - RNA, 20 nt, Salmonella enterica enterica serovar Typhi Ty2
uaggccggauaaggcgcagc

SEQ ID NO: 3678007 - RNA, 23 nt, Salmonella enterica enterica serovar Typhi Ty2
uaggccggcgaagauccgcucac

SEQ ID NO: 3678008 - RNA, 19 nt, Salmonella enterica enterica serovar Typhi Ty2
uaggccugauaagcgcagc

SEQ ID NO: 3678009 - RNA, 18 nt, Salmonella enterica enterica serovar Typhi Ty2
uaggccugguaagcguag

SEQ ID NO: 3678010 - RNA, 13 nt, Salmonella enterica enterica serovar Typhi Ty2
uaggcgcgaaaug

SEQ ID NO: 3678011 - RNA, 13 nt, Salmonella enterica enterica serovar Typhi Ty2
uaggcgguuucau

SEQ ID NO: 3678012 - RNA, 20 nt, Salmonella enterica enterica serovar Typhi Ty2
uagggauaaugacauccaga

SEQ ID NO: 3678013 - RNA, 20 nt, Salmonella enterica enterica serovar Typhi Ty2
uagggccgggcagugcucga

SEQ ID NO: 3678014 - RNA, 17 nt, Salmonella enterica enterica serovar Typhi Ty2
uagggcugccaucaggc

SEQ ID NO: 3678015 - RNA, 18 nt, Salmonella enterica enterica serovar Typhi Ty2
uagggugcagugaaccau

SEQ ID NO: 3678016 - RNA, 15 nt, Salmonella enterica enterica serovar Typhi Ty2
uaggguggcuuucua

SEQ ID NO: 3678017 - RNA, 17 nt, Salmonella enterica enterica serovar Typhi Ty2
uaggguguuucgacccc

SEQ ID NO: 3678018 - RNA, 21 nt, Salmonella enterica enterica serovar Typhi Ty2
uagguaagauauuuuguuuua

SEQ ID NO: 3678019 - RNA, 18 nt, Salmonella enterica enterica serovar Typhi Ty2
uagguucugcgaggugau

SEQ ID NO: 3678020 - RNA, 21 nt, Salmonella enterica enterica serovar Typhi Ty2
uaguaaaccgguugcuccguu

SEQ ID NO: 3678021 - RNA, 18 nt, Salmonella enterica enterica serovar Typhi Ty2
uaguaaagaaauuuugca

SEQ ID NO: 3678022 - RNA, 11 nt, Salmonella enterica enterica serovar Typhi Ty2
uaguaaauagg

SEQ ID NO: 3678023 - RNA, 13 nt, Salmonella enterica enterica serovar Typhi Ty2
uaguaacuuacaa

SEQ ID NO: 3678024 - RNA, 15 nt, Salmonella enterica enterica serovar Typhi Ty2
uaguaaugcaugguc

SEQ ID NO: 3678025 - RNA, 22 nt, Salmonella enterica enterica serovar Typhi Ty2
uaguacccucugcaccagaacu

SEQ ID NO: 3678026 - RNA, 19 nt, Salmonella enterica enterica serovar Typhi Ty2
uaguaccgaacagccaggc

SEQ ID NO: 3678027 - RNA, 16 nt, Salmonella enterica enterica serovar Typhi Ty2
uaguacgcgcgccggu

SEQ ID NO: 3678028 - RNA, 15 nt, Salmonella enterica enterica serovar Typhi Ty2
uaguacugaccagac

SEQ ID NO: 3678029 - RNA, 13 nt, Salmonella enterica enterica serovar Typhi Ty2
uaguagcuaauga

SEQ ID NO: 3678030 - RNA, 18 nt, Salmonella enterica enterica serovar Typhi Ty2
uaguauuuacaaaaaaga

SEQ ID NO: 3678031 - RNA, 13 nt, Salmonella enterica enterica serovar Typhi Ty2
uagucaaauugaa

SEQ ID NO: 3678032 - RNA, 22 nt, Salmonella enterica enterica serovar Typhi Ty2
uagucauaauacucaauauccu

SEQ ID NO: 3678033 - RNA, 17 nt, Salmonella enterica enterica serovar Typhi Ty2
uagucauauucacggcc

SEQ ID NO: 3678034 - RNA, 16 nt, Salmonella enterica enterica serovar Typhi Ty2
uagucauugacagcaa

SEQ ID NO: 3678035 - RNA, 21 nt, Salmonella enterica enterica serovar Typhi Ty2
uagucccuccgcuuccacucu

SEQ ID NO: 3678036 - RNA, 22 nt, Salmonella enterica enterica serovar Typhi Ty2
uaguccucgcgcgggaaaucgu

SEQ ID NO: 3678037 - RNA, 16 nt, Salmonella enterica enterica serovar Typhi Ty2
uagucggcaaugcucu

SEQ ID NO: 3678038 - RNA, 21 nt, Salmonella enterica enterica serovar Typhi Ty2
uagucgucaugauuaugcgaa

SEQ ID NO: 3678039 - RNA, 15 nt, Salmonella enterica enterica serovar Typhi Ty2
uagucgucuauuucc

SEQ ID NO: 3678040 - RNA, 12 nt, Salmonella enterica enterica serovar Typhi Ty2
uagucucccucc

SEQ ID NO: 3678041 - RNA, 17 nt, Salmonella enterica enterica serovar Typhi Ty2
uagucucccuccugcuc

SEQ ID NO: 3678042 - RNA, 12 nt, Salmonella enterica enterica serovar Typhi Ty2
uagucuccgcca

SEQ ID NO: 3678043 - RNA, 22 nt, Salmonella enterica enterica serovar Typhi Ty2
uagucuccugccaaugaaauaa

SEQ ID NO: 3678044 - RNA, 20 nt, Salmonella enterica enterica serovar Typhi Ty2
uagucugauugccggaugac

SEQ ID NO: 3678045 - RNA, 22 nt, Salmonella enterica enterica serovar Typhi Ty2
uagucuuaauuugcuguuuuuu

SEQ ID NO: 3678046 - RNA, 23 nt, Salmonella enterica enterica serovar Typhi Ty2
uagucuuguuacucaauaaaagu

SEQ ID NO: 3678047 - RNA, 19 nt, Salmonella enterica enterica serovar Typhi Ty2
uagugcaggcgcggucugg

SEQ ID NO: 3678048 - RNA, 15 nt, Salmonella enterica enterica serovar Typhi Ty2
uagugcgauaugugg

SEQ ID NO: 3678049 - RNA, 20 nt, Salmonella enterica enterica serovar Typhi Ty2
uagugcuucucuucaaacuc

SEQ ID NO: 3678050 - RNA, 12 nt, Salmonella enterica enterica serovar Typhi Ty2
uaguggaacugu

SEQ ID NO: 3678051 - RNA, 15 nt, Salmonella enterica enterica serovar Typhi Ty2
uaguggaucagcaga

SEQ ID NO: 3678052 - RNA, 14 nt, Salmonella enterica enterica serovar Typhi Ty2
uaguggauggccca

SEQ ID NO: 3678053 - RNA, 13 nt, Salmonella enterica enterica serovar Typhi Ty2
uaguguaauucuc

SEQ ID NO: 3678054 - RNA, 20 nt, Salmonella enterica enterica serovar Typhi Ty2
uaguuaccguaaucaucgcg

SEQ ID NO: 3678055 - RNA, 15 nt, Salmonella enterica enterica serovar Typhi Ty2
uaguuauaaauuuau

SEQ ID NO: 3678056 - RNA, 21 nt, Salmonella enterica enterica serovar Typhi Ty2
uaguuauaaauuuauuuuuug

SEQ ID NO: 3678057 - RNA, 20 nt, Salmonella enterica enterica serovar Typhi Ty2
uaguuauacauuuuuuucuu

SEQ ID NO: 3678058 - RNA, 21 nt, Salmonella enterica enterica serovar Typhi Ty2
uaguuaucacguuccuuuacu

SEQ ID NO: 3678059 - RNA, 18 nt, Salmonella enterica enterica serovar Typhi Ty2
uaguucaaguuuagaaaa

SEQ ID NO: 3678060 - RNA, 21 nt, Salmonella enterica enterica serovar Typhi Ty2
uaguucaaguuuagaaaaaau

SEQ ID NO: 3678061 - RNA, 23 nt, Salmonella enterica enterica serovar Typhi Ty2
uaguucagcgcagagugaccagc

SEQ ID NO: 3678062 - RNA, 12 nt, Salmonella enterica enterica serovar Typhi Ty2
uaguuguuuuau

SEQ ID NO: 3678063 - RNA, 24 nt, Salmonella enterica enterica serovar Typhi Ty2
uaguuuauugagauaauuuaugau

SEQ ID NO: 3678064 - RNA, 22 nt, Salmonella enterica enterica serovar Typhi Ty2
uaguuuccgccgcgguauucau

SEQ ID NO: 3678065 - RNA, 14 nt, Salmonella enterica enterica serovar Typhi Ty2
uaguuucuauuaaa

SEQ ID NO: 3678066 - RNA, 18 nt, Salmonella enterica enterica serovar Typhi Ty2
uauaaaaaacauauaauu

SEQ ID NO: 3678067 - RNA, 20 nt, Salmonella enterica enterica serovar Typhi Ty2
uauaaaaaaugguuuuauuu

SEQ ID NO: 3678068 - RNA, 22 nt, Salmonella enterica enterica serovar Typhi Ty2
uauaaaaaccgacgaaagauaa

SEQ ID NO: 3678069 - RNA, 16 nt, Salmonella enterica enterica serovar Typhi Ty2
uauaaaaauagcuggc

SEQ ID NO: 3678070 - RNA, 20 nt, Salmonella enterica enterica serovar Typhi Ty2
uauaaaacgucacaauacuu

SEQ ID NO: 3678071 - RNA, 14 nt, Salmonella enterica enterica serovar Typhi Ty2
uauaaaauauuugg

SEQ ID NO: 3678072 - RNA, 20 nt, Salmonella enterica enterica serovar Typhi Ty2
uauaaauaaccgguaacugu

SEQ ID NO: 3678073 - RNA, 11 nt, Salmonella enterica enterica serovar Typhi Ty2
uauaaauauag

SEQ ID NO: 3678074 - RNA, 12 nt, Salmonella enterica enterica serovar Typhi Ty2
uauaaauaucau

SEQ ID NO: 3678075 - RNA, 14 nt, Salmonella enterica enterica serovar Typhi Ty2
uauaaauaucauug

SEQ ID NO: 3678076 - RNA, 17 nt, Salmonella enterica enterica serovar Typhi Ty2
uauaaauuuuuuaacag

SEQ ID NO: 3678077 - RNA, 18 nt, Salmonella enterica enterica serovar Typhi Ty2
uauaacagaauaagccag

SEQ ID NO: 3678078 - RNA, 12 nt, Salmonella enterica enterica serovar Typhi Ty2
uauaacauaaau

SEQ ID NO: 3678079 - RNA, 21 nt, Salmonella enterica enterica serovar Typhi Ty2
uauaacccugucugcgcaacg

SEQ ID NO: 3678080 - RNA, 20 nt, Salmonella enterica enterica serovar Typhi Ty2
uauaacuaaacucaucuuua

SEQ ID NO: 3678081 - RNA, 19 nt, Salmonella enterica enterica serovar Typhi Ty2
uauaacucuuaauuauaaa

SEQ ID NO: 3678082 - RNA, 13 nt, Salmonella enterica enterica serovar Typhi Ty2
uauaacuugcaaa

SEQ ID NO: 3678083 - RNA, 15 nt, Salmonella enterica enterica serovar Typhi Ty2
uauaacuuucaauau

SEQ ID NO: 3678084 - RNA, 21 nt, Salmonella enterica enterica serovar Typhi Ty2
uauaagaaccaucuaccauau

SEQ ID NO: 3678085 - RNA, 19 nt, Salmonella enterica enterica serovar Typhi Ty2
uaucaccgcugacugaacu

SEQ ID NO: 3678086 - RNA, 21 nt, Salmonella enterica enterica serovar Typhi Ty2
uaucacugguuauaugaauaa

SEQ ID NO: 3678087 - RNA, 23 nt, Salmonella enterica enterica serovar Typhi Ty2
uaucagacagaucgguuuauccc

SEQ ID NO: 3678088 - RNA, 14 nt, Salmonella enterica enterica serovar Typhi Ty2
uaucagaccgacaa

SEQ ID NO: 3678089 - RNA, 19 nt, Salmonella enterica enterica serovar Typhi Ty2
uaucagccauuaaccagau

SEQ ID NO: 3678090 - RNA, 14 nt, Salmonella enterica enterica serovar Typhi Ty2
uaucagccgcgaca

SEQ ID NO: 3678091 - RNA, 20 nt, Salmonella enterica enterica serovar Typhi Ty2
uaucaggaucaaaaucgcgc

SEQ ID NO: 3678092 - RNA, 13 nt, Salmonella enterica enterica serovar Typhi Ty2
uaucaggccgaca

SEQ ID NO: 3678093 - RNA, 14 nt, Salmonella enterica enterica serovar Typhi Ty2
uaucaggccgacaa

SEQ ID NO: 3678094 - RNA, 18 nt, Salmonella enterica enterica serovar Typhi Ty2
uaucaggccgacaaauga

SEQ ID NO: 3678095 - RNA, 19 nt, Salmonella enterica enterica serovar Typhi Ty2
uaucaggccgacaaaugac

SEQ ID NO: 3678096 - RNA, 21 nt, Salmonella enterica enterica serovar Typhi Ty2
uaucaggccgacaaaugacgu

SEQ ID NO: 3678097 - RNA, 17 nt, Salmonella enterica enterica serovar Typhi Ty2
uaucaggccuacaaggc

SEQ ID NO: 3678098 - RNA, 20 nt, Salmonella enterica enterica serovar Typhi Ty2
uaucaggccuaccaucgcgc

SEQ ID NO: 3678099 - RNA, 19 nt, Salmonella enterica enterica serovar Typhi Ty2
uaucagggcuuuuuucucg

SEQ ID NO: 3678100 - RNA, 23 nt, Salmonella enterica enterica serovar Typhi Ty2
uaucaggguuauuuccgcuggcc

SEQ ID NO: 3678101 - RNA, 23 nt, Salmonella enterica enterica serovar Typhi Ty2
uaucaguccccacauuacgccca

SEQ ID NO: 3678102 - RNA, 20 nt, Salmonella enterica enterica serovar Typhi Ty2
uaucaugaaugccccagcgc

SEQ ID NO: 3678103 - RNA, 18 nt, Salmonella enterica enterica serovar Typhi Ty2
uaucaugcugaugacuaa

SEQ ID NO: 3678104 - RNA, 14 nt, Salmonella enterica enterica serovar Typhi Ty2
uaucauggugcccg

SEQ ID NO: 3678105 - RNA, 20 nt, Salmonella enterica enterica serovar Typhi Ty2
uaucaugugaucuauauauu

SEQ ID NO: 3678106 - RNA, 15 nt, Salmonella enterica enterica serovar Typhi Ty2
uaucauuaucgccaa

SEQ ID NO: 3678107 - RNA, 17 nt, Salmonella enterica enterica serovar Typhi Ty2
uaucauuaugggcagca

SEQ ID NO: 3678108 - RNA, 12 nt, Salmonella enterica enterica serovar Typhi Ty2
uauccacccggu

SEQ ID NO: 3678109 - RNA, 23 nt, Salmonella enterica enterica serovar Typhi Ty2
uauccagacguuggauaacagcg

SEQ ID NO: 3678110 - RNA, 16 nt, Salmonella enterica enterica serovar Typhi Ty2
uauccagauagcgauc

SEQ ID NO: 3678111 - RNA, 20 nt, Salmonella enterica enterica serovar Typhi Ty2
uauccagcaccucaucaccc

SEQ ID NO: 3678112 - RNA, 12 nt, Salmonella enterica enterica serovar Typhi Ty2
uauccagcagcc

SEQ ID NO: 3678113 - RNA, 23 nt, Salmonella enterica enterica serovar Typhi Ty2
uauccagcagguaacguuucagu

SEQ ID NO: 3678114 - RNA, 20 nt, Salmonella enterica enterica serovar Typhi Ty2
uauccagcgcguaaauaccu

SEQ ID NO: 3678115 - RNA, 18 nt, Salmonella enterica enterica serovar Typhi Ty2
uauccagcggcaaaggca

SEQ ID NO: 3678116 - RNA, 20 nt, Salmonella enterica enterica serovar Typhi Ty2
uauccagcggcaaaggcaug

SEQ ID NO: 3678117 - RNA, 17 nt, Salmonella enterica enterica serovar Typhi Ty2
uauccaggccagcuccg

SEQ ID NO: 3678118 - RNA, 21 nt, Salmonella enterica enterica serovar Typhi Ty2
uauccaggccgucggcgccag

SEQ ID NO: 3678119 - RNA, 14 nt, Salmonella enterica enterica serovar Typhi Ty2
uauccaguugauga

SEQ ID NO: 3678120 - RNA, 18 nt, Salmonella enterica enterica serovar Typhi Ty2
uaucccaaacgucguaaa

SEQ ID NO: 3678121 - RNA, 15 nt, Salmonella enterica enterica serovar Typhi Ty2
uaucccauugcguuc

SEQ ID NO: 3678122 - RNA, 18 nt, Salmonella enterica enterica serovar Typhi Ty2
uauccccagucuuccugc

SEQ ID NO: 3678123 - RNA, 14 nt, Salmonella enterica enterica serovar Typhi Ty2
uauccccgcuggcg

SEQ ID NO: 3678124 - RNA, 24 nt, Salmonella enterica enterica serovar Typhi Ty2
uauccccugacagagcucgucaaa

SEQ ID NO: 3678125 - RNA, 15 nt, Salmonella enterica enterica serovar Typhi Ty2
uaucccgaaaagcgu

SEQ ID NO: 3678126 - RNA, 13 nt, Salmonella enterica enterica serovar Typhi Ty2
uaucccgguauuc

SEQ ID NO: 3678127 - RNA, 16 nt, Salmonella enterica enterica serovar Typhi Ty2
uaucccugcaaacuau

SEQ ID NO: 3678128 - RNA, 14 nt, Salmonella enterica enterica serovar Typhi Ty2
uaucccugcugagu

SEQ ID NO: 3678129 - RNA, 15 nt, Salmonella enterica enterica serovar Typhi Ty2
uauccgcauucuaaa

SEQ ID NO: 3678130 - RNA, 18 nt, Salmonella enterica enterica serovar Typhi Ty2
uauccgccagcgcaacgc

SEQ ID NO: 3678131 - RNA, 21 nt, Salmonella enterica enterica serovar Typhi Ty2
uauccgccaucgacagcgcca

SEQ ID NO: 3678132 - RNA, 18 nt, Salmonella enterica enterica serovar Typhi Ty2
uauccgccugcugacaaa

SEQ ID NO: 3678133 - RNA, 15 nt, Salmonella enterica enterica serovar Typhi Ty2
uauccgcgcucaaca

SEQ ID NO: 3678134 - RNA, 18 nt, Salmonella enterica enterica serovar Typhi Ty2
uauccggcaaaagaggcu

SEQ ID NO: 3678135 - RNA, 20 nt, Salmonella enterica enterica serovar Typhi Ty2
uauccggcaucacaggcuua

SEQ ID NO: 3678136 - RNA, 13 nt, Salmonella enterica enterica serovar Typhi Ty2
uauccggccuaca

SEQ ID NO: 3678137 - RNA, 13 nt, Salmonella enterica enterica serovar Typhi Ty2
uauccggccuacg

SEQ ID NO: 3678138 - RNA, 20 nt, Salmonella enterica enterica serovar Typhi Ty2
uauccggccuauagcuaaug

SEQ ID NO: 3678139 - RNA, 17 nt, Salmonella enterica enterica serovar Typhi Ty2
uauccggccugcaggca

SEQ ID NO: 3678140 - RNA, 19 nt, Salmonella enterica enterica serovar Typhi Ty2
uauccuaaaucugccauca

SEQ ID NO: 3678141 - RNA, 15 nt, Salmonella enterica enterica serovar Typhi Ty2
uauccugcccuuuac

SEQ ID NO: 3678142 - RNA, 14 nt, Salmonella enterica enterica serovar Typhi Ty2
uauccugcuugccu

SEQ ID NO: 3678143 - RNA, 15 nt, Salmonella enterica enterica serovar Typhi Ty2
uauccuggcagucca

SEQ ID NO: 3678144 - RNA, 12 nt, Salmonella enterica enterica serovar Typhi Ty2
uauccuggccug

SEQ ID NO: 3678145 - RNA, 17 nt, Salmonella enterica enterica serovar Typhi Ty2
uauccuggccugauaag

SEQ ID NO: 3678146 - RNA, 13 nt, Salmonella enterica enterica serovar Typhi Ty2
uaucgaagcccag

SEQ ID NO: 3678147 - RNA, 18 nt, Salmonella enterica enterica serovar Typhi Ty2
uaucgacgcuauuuuuca

SEQ ID NO: 3678148 - RNA, 21 nt, Salmonella enterica enterica serovar Typhi Ty2
uaucgacucucccggcgccca

SEQ ID NO: 3678149 - RNA, 23 nt, Salmonella enterica enterica serovar Typhi Ty2
uaucgaguggagcggucgacagc

SEQ ID NO: 3678150 - RNA, 13 nt, Salmonella enterica enterica serovar Typhi Ty2
uaucgauaaucaa

SEQ ID NO: 3678151 - RNA, 21 nt, Salmonella enterica enterica serovar Typhi Ty2
uaucgauaaucaacaaugucg

SEQ ID NO: 3678152 - RNA, 18 nt, Salmonella enterica enterica serovar Typhi Ty2
uaucgcacuggcgccugc

SEQ ID NO: 3678153 - RNA, 17 nt, Salmonella enterica enterica serovar Typhi Ty2
uaucgccauauacgcca

SEQ ID NO: 3678154 - RNA, 20 nt, Salmonella enterica enterica serovar Typhi Ty2
uaucgccgaaagcgaucaca

SEQ ID NO: 3678155 - RNA, 24 nt, Salmonella enterica enterica serovar Typhi Ty2
uaucgccggcagacgauagcgggu

SEQ ID NO: 3678156 - RNA, 14 nt, Salmonella enterica enterica serovar Typhi Ty2
uaucgccucccugc

SEQ ID NO: 3678157 - RNA, 15 nt, Salmonella enterica enterica serovar Typhi Ty2
uaucgcgucaucaaa

SEQ ID NO: 3678158 - RNA, 14 nt, Salmonella enterica enterica serovar Typhi Ty2
uaucgcugcccaga

SEQ ID NO: 3678159 - RNA, 21 nt, Salmonella enterica enterica serovar Typhi Ty2
uaucgcugucggucagauuca

SEQ ID NO: 3678160 - RNA, 17 nt, Salmonella enterica enterica serovar Typhi Ty2
uaucgcuugauacgcca

SEQ ID NO: 3678161 - RNA, 16 nt, Salmonella enterica enterica serovar Typhi Ty2
uaucgcuuggcguuaa

SEQ ID NO: 3678162 - RNA, 17 nt, Salmonella enterica enterica serovar Typhi Ty2
uaucggaaguauacauc

SEQ ID NO: 3678163 - RNA, 13 nt, Salmonella enterica enterica serovar Typhi Ty2
uaucggagauaac

SEQ ID NO: 3678164 - RNA, 20 nt, Salmonella enterica enterica serovar Typhi Ty2
uaucggcaauauugccgcac

SEQ ID NO: 3678165 - RNA, 13 nt, Salmonella enterica enterica serovar Typhi Ty2
uaucggccagcgc

SEQ ID NO: 3678166 - RNA, 21 nt, Salmonella enterica enterica serovar Typhi Ty2
uaucggcgucgcggcaauagc

SEQ ID NO: 3678167 - RNA, 17 nt, Salmonella enterica enterica serovar Typhi Ty2
uaugguauucgugcauc

SEQ ID NO: 3678168 - RNA, 17 nt, Salmonella enterica enterica serovar Typhi Ty2
uauggugaguaauaaca

SEQ ID NO: 3678169 - RNA, 18 nt, Salmonella enterica enterica serovar Typhi Ty2
uauguacgccaagcugca

SEQ ID NO: 3678170 - RNA, 22 nt, Salmonella enterica enterica serovar Typhi Ty2
uauguaggccugauaagguaaa

SEQ ID NO: 3678171 - RNA, 21 nt, Salmonella enterica enterica serovar Typhi Ty2
uaugucaguaauauauuacga

SEQ ID NO: 3678172 - RNA, 23 nt, Salmonella enterica enterica serovar Typhi Ty2
uaugugacaaucacucucuugua

SEQ ID NO: 3678173 - RNA, 20 nt, Salmonella enterica enterica serovar Typhi Ty2
uaugugccgcccaggccuga

SEQ ID NO: 3678174 - RNA, 21 nt, Salmonella enterica enterica serovar Typhi Ty2
uauguuaacgccgauuaaugc

SEQ ID NO: 3678175 - RNA, 14 nt, Salmonella enterica enterica serovar Typhi Ty2
uauguuauuuacaa

SEQ ID NO: 3678176 - RNA, 15 nt, Salmonella enterica enterica serovar Typhi Ty2
uauuaaaaagccagc

SEQ ID NO: 3678177 - RNA, 23 nt, Salmonella enterica enterica serovar Typhi Ty2
uauuaaagcacaagaacuuaaau

SEQ ID NO: 3678178 - RNA, 12 nt, Salmonella enterica enterica serovar Typhi Ty2
uauuaaauaaau

SEQ ID NO: 3678179 - RNA, 14 nt, Salmonella enterica enterica serovar Typhi Ty2
uauuaaaucagaua

SEQ ID NO: 3678180 - RNA, 12 nt, Salmonella enterica enterica serovar Typhi Ty2
uauuaacgcuuu

SEQ ID NO: 3678181 - RNA, 18 nt, Salmonella enterica enterica serovar Typhi Ty2
uauuaacgugauggcgau

SEQ ID NO: 3678182 - RNA, 16 nt, Salmonella enterica enterica serovar Typhi Ty2
uauuacaacauguccu

SEQ ID NO: 3678183 - RNA, 16 nt, Salmonella enterica enterica serovar Typhi Ty2
uauuacaagcaguuaa

SEQ ID NO: 3678184 - RNA, 23 nt, Salmonella enterica enterica serovar Typhi Ty2
uauuacagacagucuggauauaa

SEQ ID NO: 3678185 - RNA, 18 nt, Salmonella enterica enterica serovar Typhi Ty2
uauuacauagaaaauaua

SEQ ID NO: 3678186 - RNA, 14 nt, Salmonella enterica enterica serovar Typhi Ty2
uauuaccgaagaua

SEQ ID NO: 3678187 - RNA, 16 nt, Salmonella enterica enterica serovar Typhi Ty2
uauuaccgcaucgacc

SEQ ID NO: 3678188 - RNA, 22 nt, Salmonella enterica enterica serovar Typhi Ty2
uauuacgcaagaucacauacaa

SEQ ID NO: 3678189 - RNA, 18 nt, Salmonella enterica enterica serovar Typhi Ty2
uauuacuaauaaaauuca

SEQ ID NO: 3678190 - RNA, 16 nt, Salmonella enterica enterica serovar Typhi Ty2
uauuacugauaaaguu

SEQ ID NO: 3678191 - RNA, 16 nt, Salmonella enterica enterica serovar Typhi Ty2
uauuacuggaucauac

SEQ ID NO: 3678192 - RNA, 14 nt, Salmonella enterica enterica serovar Typhi Ty2
uauuacuuuccagc

SEQ ID NO: 3678193 - RNA, 18 nt, Salmonella enterica enterica serovar Typhi Ty2
uauuagccaaagcgguaa

SEQ ID NO: 3678194 - RNA, 12 nt, Salmonella enterica enterica serovar Typhi Ty2
uauuagcgguac

SEQ ID NO: 3678195 - RNA, 21 nt, Salmonella enterica enterica serovar Typhi Ty2
uauuagcgguacucuuuuucc

SEQ ID NO: 3678196 - RNA, 18 nt, Salmonella enterica enterica serovar Typhi Ty2
uauuaggcacuaccaccu

SEQ ID NO: 3678197 - RNA, 13 nt, Salmonella enterica enterica serovar Typhi Ty2
uauuauaaaauaa

SEQ ID NO: 3678198 - RNA, 14 nt, Salmonella enterica enterica serovar Typhi Ty2
uauuauauuuaaaa

SEQ ID NO: 3678199 - RNA, 14 nt, Salmonella enterica enterica serovar Typhi Ty2
uauuaucaaaucuu

SEQ ID NO: 3678200 - RNA, 22 nt, Salmonella enterica enterica serovar Typhi Ty2
uauuaucaaaucuucauuucau

SEQ ID NO: 3678201 - RNA, 20 nt, Salmonella enterica enterica serovar Typhi Ty2
uauuaucgccaucauagccc

SEQ ID NO: 3678202 - RNA, 18 nt, Salmonella enterica enterica serovar Typhi Ty2
uauuaucugauucaauua

SEQ ID NO: 3678203 - RNA, 20 nt, Salmonella enterica enterica serovar Typhi Ty2
uauuaugcguuuuuaucuuu

SEQ ID NO: 3678204 - RNA, 19 nt, Salmonella enterica enterica serovar Typhi Ty2
uauuauuacgcaucauaua

SEQ ID NO: 3678205 - RNA, 13 nt, Salmonella enterica enterica serovar Typhi Ty2
uauuauuauuacg

SEQ ID NO: 3678206 - RNA, 22 nt, Salmonella enterica enterica serovar Typhi Ty2
uauuauuuugauacucaucaua

SEQ ID NO: 3678207 - RNA, 16 nt, Salmonella enterica enterica serovar Typhi Ty2
uauuauuuugggaaug

SEQ ID NO: 3678208 - RNA, 22 nt, Salmonella enterica enterica serovar Typhi Ty2
uauuauuuugggaauggaaaca

SEQ ID NO: 3678209 - RNA, 22 nt, Salmonella enterica enterica serovar Typhi Ty2
uauucaacgccaucuuccucac

SEQ ID NO: 3678210 - RNA, 12 nt, Salmonella enterica enterica serovar Typhi Ty2
uauucaauaaua

SEQ ID NO: 3678211 - RNA, 23 nt, Salmonella enterica enterica serovar Typhi Ty2
uauucaauaauauuaucauaaug

SEQ ID NO: 3678212 - RNA, 21 nt, Salmonella enterica enterica serovar Typhi Ty2
uauucacacgcucacccaguu

SEQ ID NO: 3678213 - RNA, 15 nt, Salmonella enterica enterica serovar Typhi Ty2
uauucaccgcucacc

SEQ ID NO: 3678214 - RNA, 23 nt, Salmonella enterica enterica serovar Typhi Ty2
uauucaccucccugcaacagcac

SEQ ID NO: 3678215 - RNA, 23 nt, Salmonella enterica enterica serovar Typhi Ty2
uauucacgcagcuuauuggcaau

SEQ ID NO: 3678216 - RNA, 19 nt, Salmonella enterica enterica serovar Typhi Ty2
uauucacuuuccgaaucag

SEQ ID NO: 3678217 - RNA, 13 nt, Salmonella enterica enterica serovar Typhi Ty2
uauucaggccucc

SEQ ID NO: 3678218 - RNA, 12 nt, Salmonella enterica enterica serovar Typhi Ty2
uauucaggugga

SEQ ID NO: 3678219 - RNA, 18 nt, Salmonella enterica enterica serovar Typhi Ty2
uauucaucaguuuaaccg

SEQ ID NO: 3678220 - RNA, 23 nt, Salmonella enterica enterica serovar Typhi Ty2
uauucauuacagguguuaaucau

SEQ ID NO: 3678221 - RNA, 22 nt, Salmonella enterica enterica serovar Typhi Ty2
uauucauuauuuuuaaauaacu

SEQ ID NO: 3678222 - RNA, 19 nt, Salmonella enterica enterica serovar Typhi Ty2
uauucauucacccaauaaa

SEQ ID NO: 3678223 - RNA, 15 nt, Salmonella enterica enterica serovar Typhi Ty2
uauuccaaaauaaua

SEQ ID NO: 3678224 - RNA, 21 nt, Salmonella enterica enterica serovar Typhi Ty2
uauuccagccaggaauggcua

SEQ ID NO: 3678225 - RNA, 16 nt, Salmonella enterica enterica serovar Typhi Ty2
uauucccaggcaaaug

SEQ ID NO: 3678226 - RNA, 13 nt, Salmonella enterica enterica serovar Typhi Ty2
uauuccgaauacg

SEQ ID NO: 3678227 - RNA, 22 nt, Salmonella enterica enterica serovar Typhi Ty2
uauuccucggaggccagauuca

SEQ ID NO: 3678228 - RNA, 16 nt, Salmonella enterica enterica serovar Typhi Ty2
uauuccucuuccucga

SEQ ID NO: 3678229 - RNA, 14 nt, Salmonella enterica enterica serovar Typhi Ty2
uauuccuuaucaca

SEQ ID NO: 3678230 - RNA, 20 nt, Salmonella enterica enterica serovar Typhi Ty2
uauucgacuguuguucuuca

SEQ ID NO: 3678231 - RNA, 21 nt, Salmonella enterica enterica serovar Typhi Ty2
uauucgcaucgguaauuucaa

SEQ ID NO: 3678232 - RNA, 19 nt, Salmonella enterica enterica serovar Typhi Ty2
uauucgcugacaucgugua

SEQ ID NO: 3678233 - RNA, 13 nt, Salmonella enterica enterica serovar Typhi Ty2
uauucgcuuguuu

SEQ ID NO: 3678234 - RNA, 14 nt, Salmonella enterica enterica serovar Typhi Ty2
uauucggauuggcc

SEQ ID NO: 3678235 - RNA, 14 nt, Salmonella enterica enterica serovar Typhi Ty2
uauucguuccgauc

SEQ ID NO: 3678236 - RNA, 20 nt, Salmonella enterica enterica serovar Typhi Ty2
uauucucaaccagccgauca

SEQ ID NO: 3678237 - RNA, 23 nt, Salmonella enterica enterica serovar Typhi Ty2
uauucugcacgcacgacagugcu

SEQ ID NO: 3678238 - RNA, 16 nt, Salmonella enterica enterica serovar Typhi Ty2
uauugaacauuuuuuc

SEQ ID NO: 3678239 - RNA, 17 nt, Salmonella enterica enterica serovar Typhi Ty2
uauugaacauuuuuuca

SEQ ID NO: 3678240 - RNA, 17 nt, Salmonella enterica enterica serovar Typhi Ty2
uauugaccgcuuuuucc

SEQ ID NO: 3678241 - RNA, 17 nt, Salmonella enterica enterica serovar Typhi Ty2
uauugacgaaaagauaa

SEQ ID NO: 3678242 - RNA, 13 nt, Salmonella enterica enterica serovar Typhi Ty2
uauugagaauaaa

SEQ ID NO: 3678243 - RNA, 14 nt, Salmonella enterica enterica serovar Typhi Ty2
uauugagaauaaac

SEQ ID NO: 3678244 - RNA, 16 nt, Salmonella enterica enterica serovar Typhi Ty2
uauugauuagcuuuuu

SEQ ID NO: 3678245 - RNA, 24 nt, Salmonella enterica enterica serovar Typhi Ty2
uauugcaccugggaaucgugcaau

SEQ ID NO: 3678246 - RNA, 22 nt, Salmonella enterica enterica serovar Typhi Ty2
uauugcauggcaauuaaauuag

SEQ ID NO: 3678247 - RNA, 22 nt, Salmonella enterica enterica serovar Typhi Ty2
uauugccacagcgguauaucug

SEQ ID NO: 3678248 - RNA, 15 nt, Salmonella enterica enterica serovar Typhi Ty2
uauugcccuuuuguu

SEQ ID NO: 3678249 - RNA, 16 nt, Salmonella enterica enterica serovar Typhi Ty2
ucaaagaccuccgccc

SEQ ID NO: 3678250 - RNA, 18 nt, Salmonella enterica enterica serovar Typhi Ty2
ucaaagccacacugcauc

SEQ ID NO: 3678251 - RNA, 19 nt, Salmonella enterica enterica serovar Typhi Ty2
ucaaagccacacugcaucg

SEQ ID NO: 3678252 - RNA, 18 nt, Salmonella enterica enterica serovar Typhi Ty2
ucaaagcguaccgucugg

SEQ ID NO: 3678253 - RNA, 22 nt, Salmonella enterica enterica serovar Typhi Ty2
ucaaaggcgcugaacgcauaca

SEQ ID NO: 3678254 - RNA, 20 nt, Salmonella enterica enterica serovar Typhi Ty2
ucaaagggcccguggaaaaa

SEQ ID NO: 3678255 - RNA, 19 nt, Salmonella enterica enterica serovar Typhi Ty2
ucaaaguuauuuaccacgg

SEQ ID NO: 3678256 - RNA, 23 nt, Salmonella enterica enterica serovar Typhi Ty2
ucaaauaagacauggaguuccag

SEQ ID NO: 3678257 - RNA, 22 nt, Salmonella enterica enterica serovar Typhi Ty2
ucaaauacgcgauaaaaaccca

SEQ ID NO: 3678258 - RNA, 12 nt, Salmonella enterica enterica serovar Typhi Ty2
ucaaauacgcua

SEQ ID NO: 3678259 - RNA, 14 nt, Salmonella enterica enterica serovar Typhi Ty2
ucaaauagagaaaa

SEQ ID NO: 3678260 - RNA, 14 nt, Salmonella enterica enterica serovar Typhi Ty2
ucaaauauauugaa

SEQ ID NO: 3678261 - RNA, 23 nt, Salmonella enterica enterica serovar Typhi Ty2
ucaaauccagcucaguuuccagc

SEQ ID NO: 3678262 - RNA, 22 nt, Salmonella enterica enterica serovar Typhi Ty2
ucaaaucuucauuucauugcgu

SEQ ID NO: 3678263 - RNA, 14 nt, Salmonella enterica enterica serovar Typhi Ty2
ucaaaugagaauag

SEQ ID NO: 3678264 - RNA, 17 nt, Salmonella enterica enterica serovar Typhi Ty2
ucaaaugcgaaaaaaag

SEQ ID NO: 3678265 - RNA, 12 nt, Salmonella enterica enterica serovar Typhi Ty2
ucaaaugggauc

SEQ ID NO: 3678266 - RNA, 21 nt, Salmonella enterica enterica serovar Typhi Ty2
ucaaaugggaucuucaaugaa

SEQ ID NO: 3678267 - RNA, 20 nt, Salmonella enterica enterica serovar Typhi Ty2
ucaaauguuguuugaaaagu

SEQ ID NO: 3678268 - RNA, 17 nt, Salmonella enterica enterica serovar Typhi Ty2
ucaaauuccagcaauga

SEQ ID NO: 3678269 - RNA, 17 nt, Salmonella enterica enterica serovar Typhi Ty2
ucaacaaauuccggcac

SEQ ID NO: 3678270 - RNA, 18 nt, Salmonella enterica enterica serovar Typhi Ty2
ucaacaacuucaaaauag

SEQ ID NO: 3678271 - RNA, 19 nt, Salmonella enterica enterica serovar Typhi Ty2
ucaacaacuucaaaauagg

SEQ ID NO: 3678272 - RNA, 14 nt, Salmonella enterica enterica serovar Typhi Ty2
ucaacaaucguuaa

SEQ ID NO: 3678273 - RNA, 12 nt, Salmonella enterica enterica serovar Typhi Ty2
ucaacaauuacg

SEQ ID NO: 3678274 - RNA, 20 nt, Salmonella enterica enterica serovar Typhi Ty2
ucaacacgcagacccaggcg

SEQ ID NO: 3678275 - RNA, 18 nt, Salmonella enterica enterica serovar Typhi Ty2
ucaacacuuagaacgcgg

SEQ ID NO: 3678276 - RNA, 22 nt, Salmonella enterica enterica serovar Typhi Ty2
ucaacagcacccaggcacgggu

SEQ ID NO: 3678277 - RNA, 17 nt, Salmonella enterica enterica serovar Typhi Ty2
ucaacagcgcggcagac

SEQ ID NO: 3678278 - RNA, 19 nt, Salmonella enterica enterica serovar Typhi Ty2
ucaacagggguuccggcaa

SEQ ID NO: 3678279 - RNA, 21 nt, Salmonella enterica enterica serovar Typhi Ty2
ucaacauacgccgccagccac

SEQ ID NO: 3678280 - RNA, 23 nt, Salmonella enterica enterica serovar Typhi Ty2
ucaacauacgccgccagccacug

SEQ ID NO: 3678281 - RNA, 16 nt, Salmonella enterica enterica serovar Typhi Ty2
ucaacauacugauuuc

SEQ ID NO: 3678282 - RNA, 21 nt, Salmonella enterica enterica serovar Typhi Ty2
ucaacaucagcgcuaccagcg

SEQ ID NO: 3678283 - RNA, 15 nt, Salmonella enterica enterica serovar Typhi Ty2
ucaacaucaucggau

SEQ ID NO: 3678284 - RNA, 13 nt, Salmonella enterica enterica serovar Typhi Ty2
ucaacaucauuaa

SEQ ID NO: 3678285 - RNA, 14 nt, Salmonella enterica enterica serovar Typhi Ty2
ucaacauuauuaaa

SEQ ID NO: 3678286 - RNA, 16 nt, Salmonella enterica enterica serovar Typhi Ty2
ucaaccaaugcaacgc

SEQ ID NO: 3678287 - RNA, 21 nt, Salmonella enterica enterica serovar Typhi Ty2
ucaaccacaaguuuauccagc

SEQ ID NO: 3678288 - RNA, 19 nt, Salmonella enterica enterica serovar Typhi Ty2
ucaaccaccaaaaagccac

SEQ ID NO: 3678289 - RNA, 20 nt, Salmonella enterica enterica serovar Typhi Ty2
ucaaccacggauaagccagc

SEQ ID NO: 3678290 - RNA, 21 nt, Salmonella enterica enterica serovar Typhi Ty2
ucaaccagccgaucaucacga

SEQ ID NO: 3678291 - RNA, 17 nt, Salmonella enterica enterica serovar Typhi Ty2
ucaacccagcagcagau

SEQ ID NO: 3678292 - RNA, 18 nt, Salmonella enterica enterica serovar Typhi Ty2
ucaacccagcagcagaua

SEQ ID NO: 3678293 - RNA, 19 nt, Salmonella enterica enterica serovar Typhi Ty2
ucaacccaguuuuuauccu

SEQ ID NO: 3678294 - RNA, 20 nt, Salmonella enterica enterica serovar Typhi Ty2
ucaacccgaucgccauccug

SEQ ID NO: 3678295 - RNA, 21 nt, Salmonella enterica enterica serovar Typhi Ty2
ucaacccgaucgccauccugc

SEQ ID NO: 3678296 - RNA, 18 nt, Salmonella enterica enterica serovar Typhi Ty2
ucaacgaggugaauaaau

SEQ ID NO: 3678297 - RNA, 21 nt, Salmonella enterica enterica serovar Typhi Ty2
ucaacgaggugaauaaauccu

SEQ ID NO: 3678298 - RNA, 15 nt, Salmonella enterica enterica serovar Typhi Ty2
ucaacgcaggcugga

SEQ ID NO: 3678299 - RNA, 20 nt, Salmonella enterica enterica serovar Typhi Ty2
ucaacgcaggcuggagagcg

SEQ ID NO: 3678300 - RNA, 18 nt, Salmonella enterica enterica serovar Typhi Ty2
ucaacgcaucaaauaccu

SEQ ID NO: 3678301 - RNA, 15 nt, Salmonella enterica enterica serovar Typhi Ty2
ucaacgccaucuucc

SEQ ID NO: 3678302 - RNA, 20 nt, Salmonella enterica enterica serovar Typhi Ty2
ucaacgcccgcuuucaccau

SEQ ID NO: 3678303 - RNA, 20 nt, Salmonella enterica enterica serovar Typhi Ty2
ucaacgccgcgcuucuggaa

SEQ ID NO: 3678304 - RNA, 18 nt, Salmonella enterica enterica serovar Typhi Ty2
ucaacgcgaccggauaac

SEQ ID NO: 3678305 - RNA, 23 nt, Salmonella enterica enterica serovar Typhi Ty2
ucaacgcgccgcucacaaccguc

SEQ ID NO: 3678306 - RNA, 14 nt, Salmonella enterica enterica serovar Typhi Ty2
ucaacggcaucaau

SEQ ID NO: 3678307 - RNA, 13 nt, Salmonella enterica enterica serovar Typhi Ty2
ucaacguaaauag

SEQ ID NO: 3678308 - RNA, 19 nt, Salmonella enterica enterica serovar Typhi Ty2
ucaacguuccuucaggaga

SEQ ID NO: 3678309 - RNA, 13 nt, Salmonella enterica enterica serovar Typhi Ty2
ucaacuauuaaag

SEQ ID NO: 3678310 - RNA, 19 nt, Salmonella enterica enterica serovar Typhi Ty2
ucaacuccugcaucgauuc

SEQ ID NO: 3678311 - RNA, 14 nt, Salmonella enterica enterica serovar Typhi Ty2
ucaacucuccuuuc

SEQ ID NO: 3678312 - RNA, 17 nt, Salmonella enterica enterica serovar Typhi Ty2
ucaacucuuucaggcga

SEQ ID NO: 3678313 - RNA, 20 nt, Salmonella enterica enterica serovar Typhi Ty2
ucaacugcucuaccaacuga

SEQ ID NO: 3678314 - RNA, 21 nt, Salmonella enterica enterica serovar Typhi Ty2
ucaacuguaccugauccagcu

SEQ ID NO: 3678315 - RNA, 16 nt, Salmonella enterica enterica serovar Typhi Ty2
ucaacugucgaucggu

SEQ ID NO: 3678316 - RNA, 20 nt, Salmonella enterica enterica serovar Typhi Ty2
ucaacuuauccauuagcgcc

SEQ ID NO: 3678317 - RNA, 21 nt, Salmonella enterica enterica serovar Typhi Ty2
ucaagaaucaauauaucaggc

SEQ ID NO: 3678318 - RNA, 16 nt, Salmonella enterica enterica serovar Typhi Ty2
ucaagaaugaccagcc

SEQ ID NO: 3678319 - RNA, 15 nt, Salmonella enterica enterica serovar Typhi Ty2
ucaagagaugcagac

SEQ ID NO: 3678320 - RNA, 16 nt, Salmonella enterica enterica serovar Typhi Ty2
ucaagaucgcgcagca

SEQ ID NO: 3678321 - RNA, 21 nt, Salmonella enterica enterica serovar Typhi Ty2
ucaagaucgcgcagcaggcca

SEQ ID NO: 3678322 - RNA, 14 nt, Salmonella enterica enterica serovar Typhi Ty2
ucaagcaguuccag

SEQ ID NO: 3678323 - RNA, 16 nt, Salmonella enterica enterica serovar Typhi Ty2
ucaagcaguuccagca

SEQ ID NO: 3678324 - RNA, 19 nt, Salmonella enterica enterica serovar Typhi Ty2
ucaagcauaucaaacugaa

SEQ ID NO: 3678325 - RNA, 22 nt, Salmonella enterica enterica serovar Typhi Ty2
ucaagcccauguucaugaacca

SEQ ID NO: 3678326 - RNA, 17 nt, Salmonella enterica enterica serovar Typhi Ty2
ucaagcgauacgucagc

SEQ ID NO: 3678327 - RNA, 13 nt, Salmonella enterica enterica serovar Typhi Ty2
ucaagcgcaauca

SEQ ID NO: 3678328 - RNA, 21 nt, Salmonella enterica enterica serovar Typhi Ty2
ucaagcgguagcguuauccag

SEQ ID NO: 3678329 - RNA, 22 nt, Salmonella enterica enterica serovar Typhi Ty2
ucaagcguuuccagaguacauu

SEQ ID NO: 3678330 - RNA, 22 nt, Salmonella enterica enterica serovar Typhi Ty2
ucaccacgccauagcgcuaugc

SEQ ID NO: 3678331 - RNA, 22 nt, Salmonella enterica enterica serovar Typhi Ty2
ucaccacgcgaauaccuaacag

SEQ ID NO: 3678332 - RNA, 17 nt, Salmonella enterica enterica serovar Typhi Ty2
ucaccacuucaaacggu

SEQ ID NO: 3678333 - RNA, 21 nt, Salmonella enterica enterica serovar Typhi Ty2
ucaccagcccuuccaccaguu

SEQ ID NO: 3678334 - RNA, 19 nt, Salmonella enterica enterica serovar Typhi Ty2
ucaccagcgcauugacgau

SEQ ID NO: 3678335 - RNA, 12 nt, Salmonella enterica enterica serovar Typhi Ty2
ucaccagcgcgc

SEQ ID NO: 3678336 - RNA, 20 nt, Salmonella enterica enterica serovar Typhi Ty2
ucaccagcugacgcagcagu

SEQ ID NO: 3678337 - RNA, 18 nt, Salmonella enterica enterica serovar Typhi Ty2
ucaccaguccggcagaaa

SEQ ID NO: 3678338 - RNA, 15 nt, Salmonella enterica enterica serovar Typhi Ty2
ucaccauaaaucauu

SEQ ID NO: 3678339 - RNA, 20 nt, Salmonella enterica enterica serovar Typhi Ty2
ucaccauaauuaccggcaca

SEQ ID NO: 3678340 - RNA, 15 nt, Salmonella enterica enterica serovar Typhi Ty2
ucaccaucccaugau

SEQ ID NO: 3678341 - RNA, 13 nt, Salmonella enterica enterica serovar Typhi Ty2
ucaccaucuucac

SEQ ID NO: 3678342 - RNA, 14 nt, Salmonella enterica enterica serovar Typhi Ty2
ucaccaucuucaca

SEQ ID NO: 3678343 - RNA, 13 nt, Salmonella enterica enterica serovar Typhi Ty2
ucaccauuaauac

SEQ ID NO: 3678344 - RNA, 15 nt, Salmonella enterica enterica serovar Typhi Ty2
ucaccauucauguuu

SEQ ID NO: 3678345 - RNA, 14 nt, Salmonella enterica enterica serovar Typhi Ty2
ucaccauucccagc

SEQ ID NO: 3678346 - RNA, 14 nt, Salmonella enterica enterica serovar Typhi Ty2
ucacccacaucagc

SEQ ID NO: 3678347 - RNA, 22 nt, Salmonella enterica enterica serovar Typhi Ty2
ucacccagaauacggccuucuu

SEQ ID NO: 3678348 - RNA, 16 nt, Salmonella enterica enterica serovar Typhi Ty2
ucacccagacugugau

SEQ ID NO: 3678349 - RNA, 20 nt, Salmonella enterica enterica serovar Typhi Ty2
ucacccagacugugauggcg

SEQ ID NO: 3678350 - RNA, 14 nt, Salmonella enterica enterica serovar Typhi Ty2
ucacccaucgccag

SEQ ID NO: 3678351 - RNA, 22 nt, Salmonella enterica enterica serovar Typhi Ty2
ucacccaugccgcgacgaaguc

SEQ ID NO: 3678352 - RNA, 15 nt, Salmonella enterica enterica serovar Typhi Ty2
ucacccauuuuaucc

SEQ ID NO: 3678353 - RNA, 22 nt, Salmonella enterica enterica serovar Typhi Ty2
ucaccccagcgguaaaaucugu

SEQ ID NO: 3678354 - RNA, 21 nt, Salmonella enterica enterica serovar Typhi Ty2
ucaccccgucauauuacauag

SEQ ID NO: 3678355 - RNA, 18 nt, Salmonella enterica enterica serovar Typhi Ty2
ucacccgccggcagcagc

SEQ ID NO: 3678356 - RNA, 13 nt, Salmonella enterica enterica serovar Typhi Ty2
ucacccgcgccag

SEQ ID NO: 3678357 - RNA, 18 nt, Salmonella enterica enterica serovar Typhi Ty2
ucacccgcgccagcaggu

SEQ ID NO: 3678358 - RNA, 16 nt, Salmonella enterica enterica serovar Typhi Ty2
ucacccgcuuuuccug

SEQ ID NO: 3678359 - RNA, 16 nt, Salmonella enterica enterica serovar Typhi Ty2
ucacccggauacgcgg

SEQ ID NO: 3678360 - RNA, 19 nt, Salmonella enterica enterica serovar Typhi Ty2
gugcgguauaucacgccau

SEQ ID NO: 3678361 - RNA, 20 nt, Salmonella enterica enterica serovar Typhi Ty2
gugcggugguauagaauacu

SEQ ID NO: 3678362 - RNA, 15 nt, Salmonella enterica enterica serovar Typhi Ty2
gugcgguuuuccuga

SEQ ID NO: 3678363 - RNA, 14 nt, Salmonella enterica enterica serovar Typhi Ty2
gugcguaaacaggc

SEQ ID NO: 3678364 - RNA, 24 nt, Salmonella enterica enterica serovar Typhi Ty2
gugcgugacccacaguuucauauc

SEQ ID NO: 3678365 - RNA, 18 nt, Salmonella enterica enterica serovar Typhi Ty2
gugcuaaaauuauacacu

SEQ ID NO: 3678366 - RNA, 14 nt, Salmonella enterica enterica serovar Typhi Ty2
gugcuacgggcgcu

SEQ ID NO: 3678367 - RNA, 20 nt, Salmonella enterica enterica serovar Typhi Ty2
gugcuacgggcgcugucgcc

SEQ ID NO: 3678368 - RNA, 13 nt, Salmonella enterica enterica serovar Typhi Ty2
gugcuacugcugg

SEQ ID NO: 3678369 - RNA, 22 nt, Salmonella enterica enterica serovar Typhi Ty2
gugcuauacaguaaaacgccaa

SEQ ID NO: 3678370 - RNA, 18 nt, Salmonella enterica enterica serovar Typhi Ty2
gugcucgauauauuuucc

SEQ ID NO: 3678371 - RNA, 14 nt, Salmonella enterica enterica serovar Typhi Ty2
gugcucgcggcgga

SEQ ID NO: 3678372 - RNA, 21 nt, Salmonella enterica enterica serovar Typhi Ty2
gugcucucccagcugagcuaa

SEQ ID NO: 3678373 - RNA, 17 nt, Salmonella enterica enterica serovar Typhi Ty2
gugcuggauggcagaca

SEQ ID NO: 3678374 - RNA, 13 nt, Salmonella enterica enterica serovar Typhi Ty2
gugcuggcggccg

SEQ ID NO: 3678375 - RNA, 14 nt, Salmonella enterica enterica serovar Typhi Ty2
gugcuggugguggg

SEQ ID NO: 3678376 - RNA, 18 nt, Salmonella enterica enterica serovar Typhi Ty2
gugcuguaccgcguccug

SEQ ID NO: 3678377 - RNA, 16 nt, Salmonella enterica enterica serovar Typhi Ty2
gugcuuccagcuccau

SEQ ID NO: 3678378 - RNA, 20 nt, Salmonella enterica enterica serovar Typhi Ty2
guggaaaacagcauaauaaa

SEQ ID NO: 3678379 - RNA, 19 nt, Salmonella enterica enterica serovar Typhi Ty2
guggaaaguaccaaaacag

SEQ ID NO: 3678380 - RNA, 22 nt, Salmonella enterica enterica serovar Typhi Ty2
guggaacuuuaucgcgcggcga

SEQ ID NO: 3678381 - RNA, 19 nt, Salmonella enterica enterica serovar Typhi Ty2
guggaaggaagggcgcugc

SEQ ID NO: 3678382 - RNA, 22 nt, Salmonella enterica enterica serovar Typhi Ty2
guggaaugccccagguuauaga

SEQ ID NO: 3678383 - RNA, 22 nt, Salmonella enterica enterica serovar Typhi Ty2
guggacaucgccauuccaagaa

SEQ ID NO: 3678384 - RNA, 17 nt, Salmonella enterica enterica serovar Typhi Ty2
guggagggguauuuauc

SEQ ID NO: 3678385 - RNA, 16 nt, Salmonella enterica enterica serovar Typhi Ty2
guggauuuauggcguc

SEQ ID NO: 3678386 - RNA, 11 nt, Salmonella enterica enterica serovar Typhi Ty2
guggcaaauac

SEQ ID NO: 3678387 - RNA, 22 nt, Salmonella enterica enterica serovar Typhi Ty2
guggcaacgcuggcggcguccg

SEQ ID NO: 3678388 - RNA, 12 nt, Salmonella enterica enterica serovar Typhi Ty2
guggcaucauca

SEQ ID NO: 3678389 - RNA, 14 nt, Salmonella enterica enterica serovar Typhi Ty2
guggcaucuuauca

SEQ ID NO: 3678390 - RNA, 17 nt, Salmonella enterica enterica serovar Typhi Ty2
guggcaucuuaucaggc

SEQ ID NO: 3678391 - RNA, 17 nt, Salmonella enterica enterica serovar Typhi Ty2
guggcaugcccggugau

SEQ ID NO: 3678392 - RNA, 18 nt, Salmonella enterica enterica serovar Typhi Ty2
guggccagcaugcccgcc

SEQ ID NO: 3678393 - RNA, 21 nt, Salmonella enterica enterica serovar Typhi Ty2
guggccagcaugcccgccagc

SEQ ID NO: 3678394 - RNA, 13 nt, Salmonella enterica enterica serovar Typhi Ty2
guggccagggcag

SEQ ID NO: 3678395 - RNA, 14 nt, Salmonella enterica enterica serovar Typhi Ty2
guggccagggcagg

SEQ ID NO: 3678396 - RNA, 16 nt, Salmonella enterica enterica serovar Typhi Ty2
guggccaucuuccagc

SEQ ID NO: 3678397 - RNA, 19 nt, Salmonella enterica enterica serovar Typhi Ty2
guggcccgcacugccgagu

SEQ ID NO: 3678398 - RNA, 23 nt, Salmonella enterica enterica serovar Typhi Ty2
guggccgauauggccguuuucau

SEQ ID NO: 3678399 - RNA, 19 nt, Salmonella enterica enterica serovar Typhi Ty2
guggccgauauugccuuca

SEQ ID NO: 3678400 - RNA, 15 nt, Salmonella enterica enterica serovar Typhi Ty2
guggccgcgcaaggc

SEQ ID NO: 3678401 - RNA, 20 nt, Salmonella enterica enterica serovar Typhi Ty2
guggcgaaacuccuccggga

SEQ ID NO: 3678402 - RNA, 21 nt, Salmonella enterica enterica serovar Typhi Ty2
guggcgaaauugguagacgca

SEQ ID NO: 3678403 - RNA, 22 nt, Salmonella enterica enterica serovar Typhi Ty2
guggcgaaauugguagacgcac

SEQ ID NO: 3678404 - RNA, 18 nt, Salmonella enterica enterica serovar Typhi Ty2
guggcgaacaggcucagc

SEQ ID NO: 3678405 - RNA, 22 nt, Salmonella enterica enterica serovar Typhi Ty2
guggcgaacaggcucagcgcca

SEQ ID NO: 3678406 - RNA, 14 nt, Salmonella enterica enterica serovar Typhi Ty2
guggcgaccagcag

SEQ ID NO: 3678407 - RNA, 21 nt, Salmonella enterica enterica serovar Typhi Ty2
guggcgagauaagccgucaua

SEQ ID NO: 3678408 - RNA, 20 nt, Salmonella enterica enterica serovar Typhi Ty2
guggcgcaguuuacgcagcg

SEQ ID NO: 3678409 - RNA, 23 nt, Salmonella enterica enterica serovar Typhi Ty2
guggcgcaguuuacgcagcgccu

SEQ ID NO: 3678410 - RNA, 23 nt, Salmonella enterica enterica serovar Typhi Ty2
guggcgcugcgcuuaccgggccu

SEQ ID NO: 3678411 - RNA, 20 nt, Salmonella enterica enterica serovar Typhi Ty2
guggcgcuggccgaauagcu

SEQ ID NO: 3678412 - RNA, 13 nt, Salmonella enterica enterica serovar Typhi Ty2
guggcgcuguucu

SEQ ID NO: 3678413 - RNA, 22 nt, Salmonella enterica enterica serovar Typhi Ty2
guggcgcuguucuugcugcugc

SEQ ID NO: 3678414 - RNA, 15 nt, Salmonella enterica enterica serovar Typhi Ty2
guggcggaauuggua

SEQ ID NO: 3678415 - RNA, 18 nt, Salmonella enterica enterica serovar Typhi Ty2
guggcggauacgcuucca

SEQ ID NO: 3678416 - RNA, 14 nt, Salmonella enterica enterica serovar Typhi Ty2
guggcggcaaaaaa

SEQ ID NO: 3678417 - RNA, 15 nt, Salmonella enterica enterica serovar Typhi Ty2
guggcgggcguuugc

SEQ ID NO: 3678418 - RNA, 15 nt, Salmonella enterica enterica serovar Typhi Ty2
guggcguuuucauua

SEQ ID NO: 3678419 - RNA, 17 nt, Salmonella enterica enterica serovar Typhi Ty2
guggcuaauuucaauuu

SEQ ID NO: 3678420 - RNA, 21 nt, Salmonella enterica enterica serovar Typhi Ty2
guggcuauagcucaguuggua

SEQ ID NO: 3678421 - RNA, 17 nt, Salmonella enterica enterica serovar Typhi Ty2
guggcuguguucauccc

SEQ ID NO: 3678422 - RNA, 18 nt, Salmonella enterica enterica serovar Typhi Ty2
guggcuuaccguaugcaa

SEQ ID NO: 3678423 - RNA, 23 nt, Salmonella enterica enterica serovar Typhi Ty2
gugggauugcaguagaucgacau

SEQ ID NO: 3678424 - RNA, 14 nt, Salmonella enterica enterica serovar Typhi Ty2
gugggccguuccgc

SEQ ID NO: 3678425 - RNA, 15 nt, Salmonella enterica enterica serovar Typhi Ty2
gugggcuaugcucca

SEQ ID NO: 3678426 - RNA, 22 nt, Salmonella enterica enterica serovar Typhi Ty2
guggggaauguauuucagacuu

SEQ ID NO: 3678427 - RNA, 18 nt, Salmonella enterica enterica serovar Typhi Ty2
guggggccuaaugagcca

SEQ ID NO: 3678428 - RNA, 17 nt, Salmonella enterica enterica serovar Typhi Ty2
guggggcuaagugagca

SEQ ID NO: 3678429 - RNA, 13 nt, Salmonella enterica enterica serovar Typhi Ty2
gugggguucccga

SEQ ID NO: 3678430 - RNA, 18 nt, Salmonella enterica enterica serovar Typhi Ty2
gugggguucccgagcgau

SEQ ID NO: 3678431 - RNA, 22 nt, Salmonella enterica enterica serovar Typhi Ty2
guggguaccucaugccggcugg

SEQ ID NO: 3678432 - RNA, 17 nt, Salmonella enterica enterica serovar Typhi Ty2
gugguaggcuucaaccg

SEQ ID NO: 3678433 - RNA, 22 nt, Salmonella enterica enterica serovar Typhi Ty2
guggucauauugucgcgcccgu

SEQ ID NO: 3678434 - RNA, 18 nt, Salmonella enterica enterica serovar Typhi Ty2
guggucaucgcggccagc

SEQ ID NO: 3678435 - RNA, 21 nt, Salmonella enterica enterica serovar Typhi Ty2
guggucauuuuacugcguaau

SEQ ID NO: 3678436 - RNA, 21 nt, Salmonella enterica enterica serovar Typhi Ty2
guggucgcggcucaccagcug

SEQ ID NO: 3678437 - RNA, 19 nt, Salmonella enterica enterica serovar Typhi Ty2
guggucgucagccgugagc

SEQ ID NO: 3678438 - RNA, 20 nt, Salmonella enterica enterica serovar Typhi Ty2
guggucgucagccgugagca

SEQ ID NO: 3678439 - RNA, 20 nt, Salmonella enterica enterica serovar Typhi Ty2
gugguggauauccagcauaa

SEQ ID NO: 3678440 - RNA, 18 nt, Salmonella enterica enterica serovar Typhi Ty2
gugguuaucgaauccagc

SEQ ID NO: 3678441 - RNA, 20 nt, Salmonella enterica enterica serovar Typhi Ty2
uaaaaauucaaaaaagcagu

SEQ ID NO: 3678442 - RNA, 17 nt, Salmonella enterica enterica serovar Typhi Ty2
uaaaaauuguuccugua

SEQ ID NO: 3678443 - RNA, 22 nt, Salmonella enterica enterica serovar Typhi Ty2
uaaaacaaaaaaacggccucaa

SEQ ID NO: 3678444 - RNA, 21 nt, Salmonella enterica enterica serovar Typhi Ty2
uaaaacaccgguugcgcaacc

SEQ ID NO: 3678445 - RNA, 12 nt, Salmonella enterica enterica serovar Typhi Ty2
uaaaaccuggca

SEQ ID NO: 3678446 - RNA, 14 nt, Salmonella enterica enterica serovar Typhi Ty2
uaaaacgcauacug

SEQ ID NO: 3678447 - RNA, 19 nt, Salmonella enterica enterica serovar Typhi Ty2
uaaaacgcgcccaacggau

SEQ ID NO: 3678448 - RNA, 18 nt, Salmonella enterica enterica serovar Typhi Ty2
uaaaacgguaugaaacau

SEQ ID NO: 3678449 - RNA, 17 nt, Salmonella enterica enterica serovar Typhi Ty2
uaaaacuggcuaucgcc

SEQ ID NO: 3678450 - RNA, 21 nt, Salmonella enterica enterica serovar Typhi Ty2
uaaaacuucccgcgcagugca

SEQ ID NO: 3678451 - RNA, 15 nt, Salmonella enterica enterica serovar Typhi Ty2
uaaaagaaaaccgua

SEQ ID NO: 3678452 - RNA, 16 nt, Salmonella enterica enterica serovar Typhi Ty2
uaaaagagagcgccaa

SEQ ID NO: 3678453 - RNA, 22 nt, Salmonella enterica enterica serovar Typhi Ty2
uaaaagagagcgccaaaaagaa

SEQ ID NO: 3678454 - RNA, 17 nt, Salmonella enterica enterica serovar Typhi Ty2
uaaaagcccuuaucgcc

SEQ ID NO: 3678455 - RNA, 21 nt, Salmonella enterica enterica serovar Typhi Ty2
uaaaagcgauaaagacagguu

SEQ ID NO: 3678456 - RNA, 23 nt, Salmonella enterica enterica serovar Typhi Ty2
uaaaauaaacacuaaaucauaau

SEQ ID NO: 3678457 - RNA, 15 nt, Salmonella enterica enterica serovar Typhi Ty2
uaaaauaacuauaau

SEQ ID NO: 3678458 - RNA, 12 nt, Salmonella enterica enterica serovar Typhi Ty2
uaaaauaagaau

SEQ ID NO: 3678459 - RNA, 20 nt, Salmonella enterica enterica serovar Typhi Ty2
uaaaauauccaugcuuucaa

SEQ ID NO: 3678460 - RNA, 23 nt, Salmonella enterica enterica serovar Typhi Ty2
uaaaauauccaugcuuucaauaa

SEQ ID NO: 3678461 - RNA, 19 nt, Salmonella enterica enterica serovar Typhi Ty2
uaaaauccggcugccugcc

SEQ ID NO: 3678462 - RNA, 20 nt, Salmonella enterica enterica serovar Typhi Ty2
uaaaauccugguaacggcac

SEQ ID NO: 3678463 - RNA, 19 nt, Salmonella enterica enterica serovar Typhi Ty2
uaaaauccuuuuucaugca

SEQ ID NO: 3678464 - RNA, 13 nt, Salmonella enterica enterica serovar Typhi Ty2
uaaaauggacauu

SEQ ID NO: 3678465 - RNA, 15 nt, Salmonella enterica enterica serovar Typhi Ty2
uaaaaugucuuuucg

SEQ ID NO: 3678466 - RNA, 21 nt, Salmonella enterica enterica serovar Typhi Ty2
uaaaauuauuuuuacuuaaaa

SEQ ID NO: 3678467 - RNA, 22 nt, Salmonella enterica enterica serovar Typhi Ty2
uaaaauuauuuuuacuuaaaau

SEQ ID NO: 3678468 - RNA, 18 nt, Salmonella enterica enterica serovar Typhi Ty2
uaaaauuccaauauuuau

SEQ ID NO: 3678469 - RNA, 15 nt, Salmonella enterica enterica serovar Typhi Ty2
uaaaauugaacggac

SEQ ID NO: 3678470 - RNA, 15 nt, Salmonella enterica enterica serovar Typhi Ty2
uaaacaaaacaacaa

SEQ ID NO: 3678471 - RNA, 19 nt, Salmonella enterica enterica serovar Typhi Ty2
uaaacacagcaaacauccc

SEQ ID NO: 3678472 - RNA, 20 nt, Salmonella enterica enterica serovar Typhi Ty2
uaaacacgauggcaaauaau

SEQ ID NO: 3678473 - RNA, 15 nt, Salmonella enterica enterica serovar Typhi Ty2
uaaacacguuaucug

SEQ ID NO: 3678474 - RNA, 21 nt, Salmonella enterica enterica serovar Typhi Ty2
uaaacacucuccaccaaaucc

SEQ ID NO: 3678475 - RNA, 16 nt, Salmonella enterica enterica serovar Typhi Ty2
uaaacagacaauuagc

SEQ ID NO: 3678476 - RNA, 20 nt, Salmonella enterica enterica serovar Typhi Ty2
uaaacagcgugaacacgccc

SEQ ID NO: 3678477 - RNA, 16 nt, Salmonella enterica enterica serovar Typhi Ty2
uaaacagcuccgcaaa

SEQ ID NO: 3678478 - RNA, 16 nt, Salmonella enterica enterica serovar Typhi Ty2
uaaacagcuugucgcc

SEQ ID NO: 3678479 - RNA, 12 nt, Salmonella enterica enterica serovar Typhi Ty2
uaaacaggcagg

SEQ ID NO: 3678480 - RNA, 17 nt, Salmonella enterica enterica serovar Typhi Ty2
uaaaccaaacuuaucuc

SEQ ID NO: 3678481 - RNA, 13 nt, Salmonella enterica enterica serovar Typhi Ty2
uaaaccaggccag

SEQ ID NO: 3678482 - RNA, 16 nt, Salmonella enterica enterica serovar Typhi Ty2
uaaaccauuucuccug

SEQ ID NO: 3678483 - RNA, 19 nt, Salmonella enterica enterica serovar Typhi Ty2
uaaacccccuggccggaaa

SEQ ID NO: 3678484 - RNA, 23 nt, Salmonella enterica enterica serovar Typhi Ty2
uaaaccgcugccacacucucucc

SEQ ID NO: 3678485 - RNA, 21 nt, Salmonella enterica enterica serovar Typhi Ty2
uaaaccggucucuuaaugcca

SEQ ID NO: 3678486 - RNA, 15 nt, Salmonella enterica enterica serovar Typhi Ty2
uaaaccguuuuuccg

SEQ ID NO: 3678487 - RNA, 18 nt, Salmonella enterica enterica serovar Typhi Ty2
uaaacgagcgcaauaaca

SEQ ID NO: 3678488 - RNA, 19 nt, Salmonella enterica enterica serovar Typhi Ty2
uaaacgaucgguuaucacg

SEQ ID NO: 3678489 - RNA, 20 nt, Salmonella enterica enterica serovar Typhi Ty2
uaaacgcaaugucaucaggc

SEQ ID NO: 3678490 - RNA, 18 nt, Salmonella enterica enterica serovar Typhi Ty2
uaaacgccaguggaugcg

SEQ ID NO: 3678491 - RNA, 12 nt, Salmonella enterica enterica serovar Typhi Ty2
uaaacgccggau

SEQ ID NO: 3678492 - RNA, 13 nt, Salmonella enterica enterica serovar Typhi Ty2
uaaacgccugcac

SEQ ID NO: 3678493 - RNA, 19 nt, Salmonella enterica enterica serovar Typhi Ty2
uaaacgcgccaaguaaauu

SEQ ID NO: 3678494 - RNA, 15 nt, Salmonella enterica enterica serovar Typhi Ty2
uaaacgcucaagcaa

SEQ ID NO: 3678495 - RNA, 23 nt, Salmonella enterica enterica serovar Typhi Ty2
uaaacgcuccggcaggcaaaucu

SEQ ID NO: 3678496 - RNA, 21 nt, Salmonella enterica enterica serovar Typhi Ty2
uaaacggcagccgccaccaca

SEQ ID NO: 3678497 - RNA, 22 nt, Salmonella enterica enterica serovar Typhi Ty2
uaaacggcucugcaucauuccu

SEQ ID NO: 3678498 - RNA, 12 nt, Salmonella enterica enterica serovar Typhi Ty2
uaaacgggcugc

SEQ ID NO: 3678499 - RNA, 14 nt, Salmonella enterica enterica serovar Typhi Ty2
uaaacgucaugcug

SEQ ID NO: 3678500 - RNA, 12 nt, Salmonella enterica enterica serovar Typhi Ty2
uaaacgucccug

SEQ ID NO: 3678501 - RNA, 15 nt, Salmonella enterica enterica serovar Typhi Ty2
uaaacgugccacagu

SEQ ID NO: 3678502 - RNA, 16 nt, Salmonella enterica enterica serovar Typhi Ty2
uaaacgugcuggaugg

SEQ ID NO: 3678503 - RNA, 14 nt, Salmonella enterica enterica serovar Typhi Ty2
uaaacguuccugcc

SEQ ID NO: 3678504 - RNA, 17 nt, Salmonella enterica enterica serovar Typhi Ty2
uaaacguuccugccagc

SEQ ID NO: 3678505 - RNA, 19 nt, Salmonella enterica enterica serovar Typhi Ty2
uaaacuaaguaaggaggaa

SEQ ID NO: 3678506 - RNA, 18 nt, Salmonella enterica enterica serovar Typhi Ty2
uaaacucaucuuuauuca

SEQ ID NO: 3678507 - RNA, 17 nt, Salmonella enterica enterica serovar Typhi Ty2
uaaacuccauuaaauua

SEQ ID NO: 3678508 - RNA, 19 nt, Salmonella enterica enterica serovar Typhi Ty2
uaaacuccauuaaauuacu

SEQ ID NO: 3678509 - RNA, 19 nt, Salmonella enterica enterica serovar Typhi Ty2
uaaacucuguguuaugaau

SEQ ID NO: 3678510 - RNA, 18 nt, Salmonella enterica enterica serovar Typhi Ty2
uaaacugcgcgauaucug

SEQ ID NO: 3678511 - RNA, 16 nt, Salmonella enterica enterica serovar Typhi Ty2
uaaacuguuuccaguu

SEQ ID NO: 3678512 - RNA, 11 nt, Salmonella enterica enterica serovar Typhi Ty2
uaaagaaaaac

SEQ ID NO: 3678513 - RNA, 12 nt, Salmonella enterica enterica serovar Typhi Ty2
uaaagaaaaacg

SEQ ID NO: 3678514 - RNA, 15 nt, Salmonella enterica enterica serovar Typhi Ty2
uaaagaaauuuaaag

SEQ ID NO: 3678515 - RNA, 14 nt, Salmonella enterica enterica serovar Typhi Ty2
uaaagauuggcauc

SEQ ID NO: 3678516 - RNA, 18 nt, Salmonella enterica enterica serovar Typhi Ty2
uaaagauuggcaucugca

SEQ ID NO: 3678517 - RNA, 22 nt, Salmonella enterica enterica serovar Typhi Ty2
uaaagcacaagaacuuaaauua

SEQ ID NO: 3678518 - RNA, 18 nt, Salmonella enterica enterica serovar Typhi Ty2
uaaagcagaccaccccac

SEQ ID NO: 3678519 - RNA, 13 nt, Salmonella enterica enterica serovar Typhi Ty2
uaaagcagugcag

SEQ ID NO: 3678520 - RNA, 19 nt, Salmonella enterica enterica serovar Typhi Ty2
uaaagcauagcgucaucaa

SEQ ID NO: 3678521 - RNA, 14 nt, Salmonella enterica enterica serovar Typhi Ty2
uaaagcaucagacu

SEQ ID NO: 3678522 - RNA, 19 nt, Salmonella enterica enterica serovar Typhi Ty2
uaaagcccgguucaccguu

SEQ ID NO: 3678523 - RNA, 17 nt, Salmonella enterica enterica serovar Typhi Ty2
uaacaaccagaauaaug

SEQ ID NO: 3678524 - RNA, 18 nt, Salmonella enterica enterica serovar Typhi Ty2
uaacaaccagaauaaugg

SEQ ID NO: 3678525 - RNA, 15 nt, Salmonella enterica enterica serovar Typhi Ty2
uaacaacuguuuuuc

SEQ ID NO: 3678526 - RNA, 16 nt, Salmonella enterica enterica serovar Typhi Ty2
uaacaacuguuuuuca

SEQ ID NO: 3678527 - RNA, 21 nt, Salmonella enterica enterica serovar Typhi Ty2
uaacaauauuaaauaaauagu

SEQ ID NO: 3678528 - RNA, 14 nt, Salmonella enterica enterica serovar Typhi Ty2
uaacaaugccucga

SEQ ID NO: 3678529 - RNA, 14 nt, Salmonella enterica enterica serovar Typhi Ty2
uaacaauuuaucag

SEQ ID NO: 3678530 - RNA, 17 nt, Salmonella enterica enterica serovar Typhi Ty2
uaacacaaucaggcgca

SEQ ID NO: 3678531 - RNA, 19 nt, Salmonella enterica enterica serovar Typhi Ty2
uaacacacaguugccuucg

SEQ ID NO: 3678532 - RNA, 14 nt, Salmonella enterica enterica serovar Typhi Ty2
uaacacggcuggca

SEQ ID NO: 3678533 - RNA, 16 nt, Salmonella enterica enterica serovar Typhi Ty2
uaacacggcuggcaau

SEQ ID NO: 3678534 - RNA, 19 nt, Salmonella enterica enterica serovar Typhi Ty2
uaacagacgcaucuuuuuc

SEQ ID NO: 3678535 - RNA, 21 nt, Salmonella enterica enterica serovar Typhi Ty2
uaacagacgcaucuuuuuccc

SEQ ID NO: 3678536 - RNA, 18 nt, Salmonella enterica enterica serovar Typhi Ty2
uaacagagagggaaaaaa

SEQ ID NO: 3678537 - RNA, 19 nt, Salmonella enterica enterica serovar Typhi Ty2
uaacagagagggaaaaaaa

SEQ ID NO: 3678538 - RNA, 19 nt, Salmonella enterica enterica serovar Typhi Ty2
uaacagccgcggaccuuuu

SEQ ID NO: 3678539 - RNA, 12 nt, Salmonella enterica enterica serovar Typhi Ty2
uaacagcgccau

SEQ ID NO: 3678540 - RNA, 22 nt, Salmonella enterica enterica serovar Typhi Ty2
uaacagcgccgcgccgauagcg

SEQ ID NO: 3678541 - RNA, 19 nt, Salmonella enterica enterica serovar Typhi Ty2
uaacagcgcgaccagcgug

SEQ ID NO: 3678542 - RNA, 22 nt, Salmonella enterica enterica serovar Typhi Ty2
uaacagcgguauacaccagcuc

SEQ ID NO: 3678543 - RNA, 17 nt, Salmonella enterica enterica serovar Typhi Ty2
uaacagcuggcuugcca

SEQ ID NO: 3678544 - RNA, 18 nt, Salmonella enterica enterica serovar Typhi Ty2
uaacaggcaccagcguau

SEQ ID NO: 3678545 - RNA, 21 nt, Salmonella enterica enterica serovar Typhi Ty2
uaacagggugauggugucaau

SEQ ID NO: 3678546 - RNA, 16 nt, Salmonella enterica enterica serovar Typhi Ty2
uaacaguucaaacggc

SEQ ID NO: 3678547 - RNA, 22 nt, Salmonella enterica enterica serovar Typhi Ty2
uaacauaaauaguauuaguuga

SEQ ID NO: 3678548 - RNA, 20 nt, Salmonella enterica enterica serovar Typhi Ty2
uaacauaagugauacaugcu

SEQ ID NO: 3678549 - RNA, 14 nt, Salmonella enterica enterica serovar Typhi Ty2
uaacauacaaaaag

SEQ ID NO: 3678550 - RNA, 17 nt, Salmonella enterica enterica serovar Typhi Ty2
uaacauauagcagcagu

SEQ ID NO: 3678551 - RNA, 18 nt, Salmonella enterica enterica serovar Typhi Ty2
uaacauaucgacauaagu

SEQ ID NO: 3678552 - RNA, 23 nt, Salmonella enterica enterica serovar Typhi Ty2
uaacauaucgacauaaguaaaua

SEQ ID NO: 3678553 - RNA, 18 nt, Salmonella enterica enterica serovar Typhi Ty2
uaacaucaaguacagcuu

SEQ ID NO: 3678554 - RNA, 21 nt, Salmonella enterica enterica serovar Typhi Ty2
uaacaucaccuuucauuuuau

SEQ ID NO: 3678555 - RNA, 19 nt, Salmonella enterica enterica serovar Typhi Ty2
uaacaugcuggauucaguu

SEQ ID NO: 3678556 - RNA, 18 nt, Salmonella enterica enterica serovar Typhi Ty2
uaacauuuaagaaacaau

SEQ ID NO: 3678557 - RNA, 15 nt, Salmonella enterica enterica serovar Typhi Ty2
uaacauuucagucua

SEQ ID NO: 3678558 - RNA, 16 nt, Salmonella enterica enterica serovar Typhi Ty2
uaaccaaagcaccauu

SEQ ID NO: 3678559 - RNA, 18 nt, Salmonella enterica enterica serovar Typhi Ty2
uaaccaacaggaggaucg

SEQ ID NO: 3678560 - RNA, 23 nt, Salmonella enterica enterica serovar Typhi Ty2
uaaccaccggcgcgccagcgcau

SEQ ID NO: 3678561 - RNA, 15 nt, Salmonella enterica enterica serovar Typhi Ty2
uaaccaccuguucgc

SEQ ID NO: 3678562 - RNA, 17 nt, Salmonella enterica enterica serovar Typhi Ty2
uaaccacgaaaauuauu

SEQ ID NO: 3678563 - RNA, 21 nt, Salmonella enterica enterica serovar Typhi Ty2
uaaccagaaaaccgacagcaa

SEQ ID NO: 3678564 - RNA, 16 nt, Salmonella enterica enterica serovar Typhi Ty2
uaaccagaucggcuau

SEQ ID NO: 3678565 - RNA, 21 nt, Salmonella enterica enterica serovar Typhi Ty2
uaaccagcgcaagcagcgccc

SEQ ID NO: 3678566 - RNA, 18 nt, Salmonella enterica enterica serovar Typhi Ty2
uaaccagcgcgccgccaa

SEQ ID NO: 3678567 - RNA, 17 nt, Salmonella enterica enterica serovar Typhi Ty2
uaaccagcucgcugauc

SEQ ID NO: 3678568 - RNA, 18 nt, Salmonella enterica enterica serovar Typhi Ty2
uaaccauucccgauaaug

SEQ ID NO: 3678569 - RNA, 16 nt, Salmonella enterica enterica serovar Typhi Ty2
uaacccacaagaaaug

SEQ ID NO: 3678570 - RNA, 18 nt, Salmonella enterica enterica serovar Typhi Ty2
uaaccccugcgcggccug

SEQ ID NO: 3678571 - RNA, 16 nt, Salmonella enterica enterica serovar Typhi Ty2
uaacccgauacccuga

SEQ ID NO: 3678572 - RNA, 15 nt, Salmonella enterica enterica serovar Typhi Ty2
uaaccgcaaaugcca

SEQ ID NO: 3678573 - RNA, 16 nt, Salmonella enterica enterica serovar Typhi Ty2
uaaccgccuccgacaa

SEQ ID NO: 3678574 - RNA, 17 nt, Salmonella enterica enterica serovar Typhi Ty2
uaaccgcgaucgaugug

SEQ ID NO: 3678575 - RNA, 23 nt, Salmonella enterica enterica serovar Typhi Ty2
uaaccgcuaaacagcaaaucggg

SEQ ID NO: 3678576 - RNA, 21 nt, Salmonella enterica enterica serovar Typhi Ty2
uaaccggaauggucgcgccag

SEQ ID NO: 3678577 - RNA, 16 nt, Salmonella enterica enterica serovar Typhi Ty2
uaaccgggcgcuuaau

SEQ ID NO: 3678578 - RNA, 19 nt, Salmonella enterica enterica serovar Typhi Ty2
uaaccguaacgcuccugga

SEQ ID NO: 3678579 - RNA, 17 nt, Salmonella enterica enterica serovar Typhi Ty2
uaaccguggcggcagug

SEQ ID NO: 3678580 - RNA, 15 nt, Salmonella enterica enterica serovar Typhi Ty2
uaaccguucuuccug

SEQ ID NO: 3678581 - RNA, 16 nt, Salmonella enterica enterica serovar Typhi Ty2
uaaccguucuuccugg

SEQ ID NO: 3678582 - RNA, 13 nt, Salmonella enterica enterica serovar Typhi Ty2
uaaccucuuuuuc

SEQ ID NO: 3678583 - RNA, 18 nt, Salmonella enterica enterica serovar Typhi Ty2
uaaccugguaugauaucg

SEQ ID NO: 3678584 - RNA, 17 nt, Salmonella enterica enterica serovar Typhi Ty2
uaaccuguaaauaauag

SEQ ID NO: 3678585 - RNA, 15 nt, Salmonella enterica enterica serovar Typhi Ty2
uaaccuuucaccuua

SEQ ID NO: 3678586 - RNA, 20 nt, Salmonella enterica enterica serovar Typhi Ty2
uaacgaaccaucauuaauau

SEQ ID NO: 3678587 - RNA, 17 nt, Salmonella enterica enterica serovar Typhi Ty2
uaacgaauuaagcggau

SEQ ID NO: 3678588 - RNA, 17 nt, Salmonella enterica enterica serovar Typhi Ty2
uaacgacaaaaauacca

SEQ ID NO: 3678589 - RNA, 17 nt, Salmonella enterica enterica serovar Typhi Ty2
uaacgacgcuccagaau

SEQ ID NO: 3678590 - RNA, 16 nt, Salmonella enterica enterica serovar Typhi Ty2
uaacgaugaugaaaaa

SEQ ID NO: 3678591 - RNA, 15 nt, Salmonella enterica enterica serovar Typhi Ty2
uaacgauuuccccug

SEQ ID NO: 3678592 - RNA, 20 nt, Salmonella enterica enterica serovar Typhi Ty2
uaacgauuuccccuguacac

SEQ ID NO: 3678593 - RNA, 22 nt, Salmonella enterica enterica serovar Typhi Ty2
uaacgcacuaccagaaacaaca

SEQ ID NO: 3678594 - RNA, 18 nt, Salmonella enterica enterica serovar Typhi Ty2
uaacgcacuuuuccagcc

SEQ ID NO: 3678595 - RNA, 22 nt, Salmonella enterica enterica serovar Typhi Ty2
uaacgcagaauauuuuucucag

SEQ ID NO: 3678596 - RNA, 17 nt, Salmonella enterica enterica serovar Typhi Ty2
uaacgcagcaucgccau

SEQ ID NO: 3678597 - RNA, 15 nt, Salmonella enterica enterica serovar Typhi Ty2
uaacgcaggcgauag

SEQ ID NO: 3678598 - RNA, 23 nt, Salmonella enterica enterica serovar Typhi Ty2
uaacgcaggcgauagccccagua

SEQ ID NO: 3678599 - RNA, 18 nt, Salmonella enterica enterica serovar Typhi Ty2
uaacgcauacauucuguu

SEQ ID NO: 3678600 - RNA, 13 nt, Salmonella enterica enterica serovar Typhi Ty2
uaacgcaucgcgg

SEQ ID NO: 3678601 - RNA, 15 nt, Salmonella enterica enterica serovar Typhi Ty2
uaacgcaucgcggau

SEQ ID NO: 3678602 - RNA, 17 nt, Salmonella enterica enterica serovar Typhi Ty2
uaacgcauguuccgcua

SEQ ID NO: 3678603 - RNA, 22 nt, Salmonella enterica enterica serovar Typhi Ty2
uaacgccgaacacgcauaauug

SEQ ID NO: 3678604 - RNA, 15 nt, Salmonella enterica enterica serovar Typhi Ty2
uaacgccgauuaaug

SEQ ID NO: 3678605 - RNA, 14 nt, Salmonella enterica enterica serovar Typhi Ty2
uaagccaccagauc

SEQ ID NO: 3678606 - RNA, 14 nt, Salmonella enterica enterica serovar Typhi Ty2
uaagccagcgauga

SEQ ID NO: 3678607 - RNA, 15 nt, Salmonella enterica enterica serovar Typhi Ty2
uaagccaggcaccau

SEQ ID NO: 3678608 - RNA, 19 nt, Salmonella enterica enterica serovar Typhi Ty2
uaagccaugugacggcaug

SEQ ID NO: 3678609 - RNA, 21 nt, Salmonella enterica enterica serovar Typhi Ty2
uaagcccauggcaggcagcac

SEQ ID NO: 3678610 - RNA, 23 nt, Salmonella enterica enterica serovar Typhi Ty2
uaagcccauggcaggcagcacaa

SEQ ID NO: 3678611 - RNA, 21 nt, Salmonella enterica enterica serovar Typhi Ty2
uaagccggcaggcagcgccag

SEQ ID NO: 3678612 - RNA, 22 nt, Salmonella enterica enterica serovar Typhi Ty2
uaagccggcaggcagcgccagc

SEQ ID NO: 3678613 - RNA, 17 nt, Salmonella enterica enterica serovar Typhi Ty2
uaagccgguaaucacug

SEQ ID NO: 3678614 - RNA, 16 nt, Salmonella enterica enterica serovar Typhi Ty2
uaagccgucauaaaau

SEQ ID NO: 3678615 - RNA, 14 nt, Salmonella enterica enterica serovar Typhi Ty2
uaagcgaaugcugu

SEQ ID NO: 3678616 - RNA, 22 nt, Salmonella enterica enterica serovar Typhi Ty2
uaagcgcaauauuguuaaccag

SEQ ID NO: 3678617 - RNA, 17 nt, Salmonella enterica enterica serovar Typhi Ty2
uaagcgcagcgccaccg

SEQ ID NO: 3678618 - RNA, 15 nt, Salmonella enterica enterica serovar Typhi Ty2
uaagcgcagcgccau

SEQ ID NO: 3678619 - RNA, 20 nt, Salmonella enterica enterica serovar Typhi Ty2
uaagcgcagcgccauccggc

SEQ ID NO: 3678620 - RNA, 13 nt, Salmonella enterica enterica serovar Typhi Ty2
uaagcgccgauaa

SEQ ID NO: 3678621 - RNA, 16 nt, Salmonella enterica enterica serovar Typhi Ty2
uaagcgccgucauccg

SEQ ID NO: 3678622 - RNA, 13 nt, Salmonella enterica enterica serovar Typhi Ty2
uaagcgcucaggc

SEQ ID NO: 3678623 - RNA, 14 nt, Salmonella enterica enterica serovar Typhi Ty2
uaagcgcucaggca

SEQ ID NO: 3678624 - RNA, 16 nt, Salmonella enterica enterica serovar Typhi Ty2
uaagcggcagcgccau

SEQ ID NO: 3678625 - RNA, 19 nt, Salmonella enterica enterica serovar Typhi Ty2
uaagcggcggaccagcgug

SEQ ID NO: 3678626 - RNA, 22 nt, Salmonella enterica enterica serovar Typhi Ty2
uaagcggguauacuuaacccug

SEQ ID NO: 3678627 - RNA, 17 nt, Salmonella enterica enterica serovar Typhi Ty2
uaagcggguugcacauu

SEQ ID NO: 3678628 - RNA, 22 nt, Salmonella enterica enterica serovar Typhi Ty2
uaagcgucugcaaugguaaaac

SEQ ID NO: 3678629 - RNA, 14 nt, Salmonella enterica enterica serovar Typhi Ty2
uaagcgugcaaccc

SEQ ID NO: 3678630 - RNA, 14 nt, Salmonella enterica enterica serovar Typhi Ty2
uaagcgugcgccau

SEQ ID NO: 3678631 - RNA, 19 nt, Salmonella enterica enterica serovar Typhi Ty2
uaagcgugcgccauccggc

SEQ ID NO: 3678632 - RNA, 18 nt, Salmonella enterica enterica serovar Typhi Ty2
uaagcguggcgcaaccga

SEQ ID NO: 3678633 - RNA, 17 nt, Salmonella enterica enterica serovar Typhi Ty2
uaagcguuacggaaaaa

SEQ ID NO: 3678634 - RNA, 23 nt, Salmonella enterica enterica serovar Typhi Ty2
uaagcuaguaaagaaauuuugca

SEQ ID NO: 3678635 - RNA, 16 nt, Salmonella enterica enterica serovar Typhi Ty2
uaagcuauuccuguau

SEQ ID NO: 3678636 - RNA, 19 nt, Salmonella enterica enterica serovar Typhi Ty2
uaagcuauuccuguauaau

SEQ ID NO: 3678637 - RNA, 18 nt, Salmonella enterica enterica serovar Typhi Ty2
uaagcugagccuucaccg

SEQ ID NO: 3678638 - RNA, 20 nt, Salmonella enterica enterica serovar Typhi Ty2
uaagcugcgaagccaccgga

SEQ ID NO: 3678639 - RNA, 20 nt, Salmonella enterica enterica serovar Typhi Ty2
uaagcuuuaaccacagccuu

SEQ ID NO: 3678640 - RNA, 17 nt, Salmonella enterica enterica serovar Typhi Ty2
uaagcuuugcaccacuu

SEQ ID NO: 3678641 - RNA, 20 nt, Salmonella enterica enterica serovar Typhi Ty2
uaaggacuuuaucuuuacca

SEQ ID NO: 3678642 - RNA, 22 nt, Salmonella enterica enterica serovar Typhi Ty2
uaaggaugaacucuaugcaaaa

SEQ ID NO: 3678643 - RNA, 12 nt, Salmonella enterica enterica serovar Typhi Ty2
uaaggcagccau

SEQ ID NO: 3678644 - RNA, 19 nt, Salmonella enterica enterica serovar Typhi Ty2
uaaggccugccguccugau

SEQ ID NO: 3678645 - RNA, 20 nt, Salmonella enterica enterica serovar Typhi Ty2
uaaggcgauucaacagggca

SEQ ID NO: 3678646 - RNA, 22 nt, Salmonella enterica enterica serovar Typhi Ty2
uaaggcgcagccgccauccggc

SEQ ID NO: 3678647 - RNA, 13 nt, Salmonella enterica enterica serovar Typhi Ty2
uaaggcgccuuuu

SEQ ID NO: 3678648 - RNA, 19 nt, Salmonella enterica enterica serovar Typhi Ty2
uaaggcgcuugcgccgcca

SEQ ID NO: 3678649 - RNA, 20 nt, Salmonella enterica enterica serovar Typhi Ty2
uaaggcgcuugugauaucug

SEQ ID NO: 3678650 - RNA, 12 nt, Salmonella enterica enterica serovar Typhi Ty2
uaaggcguucac

SEQ ID NO: 3678651 - RNA, 20 nt, Salmonella enterica enterica serovar Typhi Ty2
uaaggcguucacgccgccau

SEQ ID NO: 3678652 - RNA, 16 nt, Salmonella enterica enterica serovar Typhi Ty2
uaaggcuaaucgcauu

SEQ ID NO: 3678653 - RNA, 20 nt, Salmonella enterica enterica serovar Typhi Ty2
uaaggcucucuuaccagccg

SEQ ID NO: 3678654 - RNA, 14 nt, Salmonella enterica enterica serovar Typhi Ty2
uaagggccuucauu

SEQ ID NO: 3678655 - RNA, 16 nt, Salmonella enterica enterica serovar Typhi Ty2
uaagggcuggaaaauc

SEQ ID NO: 3678656 - RNA, 20 nt, Salmonella enterica enterica serovar Typhi Ty2
uaagguaacgcgaaaaaaga

SEQ ID NO: 3678657 - RNA, 16 nt, Salmonella enterica enterica serovar Typhi Ty2
uaagguccagggaaaa

SEQ ID NO: 3678658 - RNA, 21 nt, Salmonella enterica enterica serovar Typhi Ty2
uaaggucgcuauccagcagua

SEQ ID NO: 3678659 - RNA, 19 nt, Salmonella enterica enterica serovar Typhi Ty2
uaagguuacaggugccugg

SEQ ID NO: 3678660 - RNA, 18 nt, Salmonella enterica enterica serovar Typhi Ty2
uaagguucgcuuaaucuc

SEQ ID NO: 3678661 - RNA, 15 nt, Salmonella enterica enterica serovar Typhi Ty2
uaagguucuggcauu

SEQ ID NO: 3678662 - RNA, 21 nt, Salmonella enterica enterica serovar Typhi Ty2
uaagguucuggcauuggcauc

SEQ ID NO: 3678663 - RNA, 16 nt, Salmonella enterica enterica serovar Typhi Ty2
uaaguaaggaggaauc

SEQ ID NO: 3678664 - RNA, 20 nt, Salmonella enterica enterica serovar Typhi Ty2
uaagucaucuguucaacuuu

SEQ ID NO: 3678665 - RNA, 19 nt, Salmonella enterica enterica serovar Typhi Ty2
uaagucgccgcagcuccau

SEQ ID NO: 3678666 - RNA, 14 nt, Salmonella enterica enterica serovar Typhi Ty2
uaagugauaccgau

SEQ ID NO: 3678667 - RNA, 14 nt, Salmonella enterica enterica serovar Typhi Ty2
uaagugcaggcuga

SEQ ID NO: 3678668 - RNA, 15 nt, Salmonella enterica enterica serovar Typhi Ty2
uaaguugaccacauc

SEQ ID NO: 3678669 - RNA, 15 nt, Salmonella enterica enterica serovar Typhi Ty2
uaauaaaaaucgggu

SEQ ID NO: 3678670 - RNA, 18 nt, Salmonella enterica enterica serovar Typhi Ty2
uaauaaaaucuaagagcc

SEQ ID NO: 3678671 - RNA, 14 nt, Salmonella enterica enterica serovar Typhi Ty2
uaauaaaauucacu

SEQ ID NO: 3678672 - RNA, 23 nt, Salmonella enterica enterica serovar Typhi Ty2
uaauaagcggccuauauuagugu

SEQ ID NO: 3678673 - RNA, 21 nt, Salmonella enterica enterica serovar Typhi Ty2
uaauaaguccgcgggcaaaag

SEQ ID NO: 3678674 - RNA, 22 nt, Salmonella enterica enterica serovar Typhi Ty2
uaauaauacaccgccauauauu

SEQ ID NO: 3678675 - RNA, 13 nt, Salmonella enterica enterica serovar Typhi Ty2
uaauaaucauaua

SEQ ID NO: 3678676 - RNA, 22 nt, Salmonella enterica enterica serovar Typhi Ty2
uaauaauugagcgcaaaacgcu

SEQ ID NO: 3678677 - RNA, 20 nt, Salmonella enterica enterica serovar Typhi Ty2
uaauacaccgccauauauuu

SEQ ID NO: 3678678 - RNA, 17 nt, Salmonella enterica enterica serovar Typhi Ty2
uaauacaucaugcuugc

SEQ ID NO: 3678679 - RNA, 19 nt, Salmonella enterica enterica serovar Typhi Ty2
uaauaccaucuccaucggg

SEQ ID NO: 3678680 - RNA, 23 nt, Salmonella enterica enterica serovar Typhi Ty2
uaauacgaucuucuccauugauc

SEQ ID NO: 3678681 - RNA, 18 nt, Salmonella enterica enterica serovar Typhi Ty2
uaauacggagcaaaaaau

SEQ ID NO: 3678682 - RNA, 19 nt, Salmonella enterica enterica serovar Typhi Ty2
uaauacguaaaccgcucac

SEQ ID NO: 3678683 - RNA, 23 nt, Salmonella enterica enterica serovar Typhi Ty2
uaauacgucgugacccacacaua

SEQ ID NO: 3678684 - RNA, 19 nt, Salmonella enterica enterica serovar Typhi Ty2
uaauacguuuauucuuuuc

SEQ ID NO: 3678685 - RNA, 13 nt, Salmonella enterica enterica serovar Typhi Ty2
uaauacugccgca

SEQ ID NO: 3678686 - RNA, 15 nt, Salmonella enterica enterica serovar Typhi Ty2
uaauacuggcgccuu

SEQ ID NO: 3678687 - RNA, 14 nt, Salmonella enterica enterica serovar Typhi Ty2
uaaugauaucgccc

SEQ ID NO: 3678688 - RNA, 16 nt, Salmonella enterica enterica serovar Typhi Ty2
uaaugauuguccagcc

SEQ ID NO: 3678689 - RNA, 17 nt, Salmonella enterica enterica serovar Typhi Ty2
uaaugcaauaaacuaag

SEQ ID NO: 3678690 - RNA, 21 nt, Salmonella enterica enterica serovar Typhi Ty2
uaaugcaauauuacaaagcag

SEQ ID NO: 3678691 - RNA, 18 nt, Salmonella enterica enterica serovar Typhi Ty2
uaaugcacaauacgccga

SEQ ID NO: 3678692 - RNA, 19 nt, Salmonella enterica enterica serovar Typhi Ty2
uaaugcaggcagcacugcu

SEQ ID NO: 3678693 - RNA, 15 nt, Salmonella enterica enterica serovar Typhi Ty2
uaaugcauggcagau

SEQ ID NO: 3678694 - RNA, 15 nt, Salmonella enterica enterica serovar Typhi Ty2
uaaugcauuggccag

SEQ ID NO: 3678695 - RNA, 14 nt, Salmonella enterica enterica serovar Typhi Ty2
uaaugccaucauca

SEQ ID NO: 3678696 - RNA, 15 nt, Salmonella enterica enterica serovar Typhi Ty2
uaaugcccgauggcg

SEQ ID NO: 3678697 - RNA, 22 nt, Salmonella enterica enterica serovar Typhi Ty2
uaaugcccggcccgucaucuuc

SEQ ID NO: 3678698 - RNA, 20 nt, Salmonella enterica enterica serovar Typhi Ty2
uaaugcccggcgcggcauca

SEQ ID NO: 3678699 - RNA, 20 nt, Salmonella enterica enterica serovar Typhi Ty2
uaaugccgccguacaaaccc

SEQ ID NO: 3678700 - RNA, 16 nt, Salmonella enterica enterica serovar Typhi Ty2
uaaugccuucugaaaa

SEQ ID NO: 3678701 - RNA, 22 nt, Salmonella enterica enterica serovar Typhi Ty2
uaaugcgccccggcggcguaca

SEQ ID NO: 3678702 - RNA, 17 nt, Salmonella enterica enterica serovar Typhi Ty2
uaaugcgcgcuucuuca

SEQ ID NO: 3678703 - RNA, 21 nt, Salmonella enterica enterica serovar Typhi Ty2
uaaugcgcguugccgccaaca

SEQ ID NO: 3678704 - RNA, 20 nt, Salmonella enterica enterica serovar Typhi Ty2
uaaugcucuuaaaaugaucg

SEQ ID NO: 3678705 - RNA, 20 nt, Salmonella enterica enterica serovar Typhi Ty2
uaaugcuuauccggccuaca

SEQ ID NO: 3678706 - RNA, 16 nt, Salmonella enterica enterica serovar Typhi Ty2
uaaugcuuuccagcca

SEQ ID NO: 3678707 - RNA, 11 nt, Salmonella enterica enterica serovar Typhi Ty2
uaaugcuuuug

SEQ ID NO: 3678708 - RNA, 19 nt, Salmonella enterica enterica serovar Typhi Ty2
uaauggcagaauaaaacag

SEQ ID NO: 3678709 - RNA, 18 nt, Salmonella enterica enterica serovar Typhi Ty2
uaauggcauaacgcugua

SEQ ID NO: 3678710 - RNA, 12 nt, Salmonella enterica enterica serovar Typhi Ty2
uaauggcccagu

SEQ ID NO: 3678711 - RNA, 12 nt, Salmonella enterica enterica serovar Typhi Ty2
uaauggccuaca

SEQ ID NO: 3678712 - RNA, 12 nt, Salmonella enterica enterica serovar Typhi Ty2
uaauggcgauaa

SEQ ID NO: 3678713 - RNA, 17 nt, Salmonella enterica enterica serovar Typhi Ty2
uaauggcgccgauaaca

SEQ ID NO: 3678714 - RNA, 18 nt, Salmonella enterica enterica serovar Typhi Ty2
uaauggcgcgaaaacagc

SEQ ID NO: 3678715 - RNA, 12 nt, Salmonella enterica enterica serovar Typhi Ty2
uaauggcgucaa

SEQ ID NO: 3678716 - RNA, 18 nt, Salmonella enterica enterica serovar Typhi Ty2
uaaugguggcaaccugac

SEQ ID NO: 3678717 - RNA, 18 nt, Salmonella enterica enterica serovar Typhi Ty2
uaauguaaaacaagagaa

SEQ ID NO: 3678718 - RNA, 16 nt, Salmonella enterica enterica serovar Typhi Ty2
uaauguaaaggugagc

SEQ ID NO: 3678719 - RNA, 17 nt, Salmonella enterica enterica serovar Typhi Ty2
uaaugucaugcgccacg

SEQ ID NO: 3678720 - RNA, 16 nt, Salmonella enterica enterica serovar Typhi Ty2
uaaugucuggugcagc

SEQ ID NO: 3678721 - RNA, 16 nt, Salmonella enterica enterica serovar Typhi Ty2
uaaugugauccgcccc

SEQ ID NO: 3678722 - RNA, 17 nt, Salmonella enterica enterica serovar Typhi Ty2
uaauguuaggaguaaau

SEQ ID NO: 3678723 - RNA, 20 nt, Salmonella enterica enterica serovar Typhi Ty2
uaauguugguaaauuuaugg

SEQ ID NO: 3678724 - RNA, 18 nt, Salmonella enterica enterica serovar Typhi Ty2
uaauguuucacguagcaa

SEQ ID NO: 3678725 - RNA, 12 nt, Salmonella enterica enterica serovar Typhi Ty2
uaauuaaaugcu

SEQ ID NO: 3678726 - RNA, 13 nt, Salmonella enterica enterica serovar Typhi Ty2
uaauuaaccgcgc

SEQ ID NO: 3678727 - RNA, 21 nt, Salmonella enterica enterica serovar Typhi Ty2
uaauuacuccguuuuaaucuu

SEQ ID NO: 3678728 - RNA, 13 nt, Salmonella enterica enterica serovar Typhi Ty2
uaauuagagacau

SEQ ID NO: 3678729 - RNA, 21 nt, Salmonella enterica enterica serovar Typhi Ty2
uaauuauaaagcauaaauaca

SEQ ID NO: 3678730 - RNA, 22 nt, Salmonella enterica enterica serovar Typhi Ty2
uaauuauuacuggaucauacau

SEQ ID NO: 3678731 - RNA, 19 nt, Salmonella enterica enterica serovar Typhi Ty2
uaauuauuuuucaaaugau

SEQ ID NO: 3678732 - RNA, 14 nt, Salmonella enterica enterica serovar Typhi Ty2
uaauucagcucaac

SEQ ID NO: 3678733 - RNA, 18 nt, Salmonella enterica enterica serovar Typhi Ty2
uaauucagcucaacgccc

SEQ ID NO: 3678734 - RNA, 16 nt, Salmonella enterica enterica serovar Typhi Ty2
uaauucauaacaccaa

SEQ ID NO: 3678735 - RNA, 14 nt, Salmonella enterica enterica serovar Typhi Ty2
uaauucaugcugua

SEQ ID NO: 3678736 - RNA, 22 nt, Salmonella enterica enterica serovar Typhi Ty2
uaauucauggccaucaacuucu

SEQ ID NO: 3678737 - RNA, 17 nt, Salmonella enterica enterica serovar Typhi Ty2
uaauuccucagaauccg

SEQ ID NO: 3678738 - RNA, 17 nt, Salmonella enterica enterica serovar Typhi Ty2
uaauucucacagaauca

SEQ ID NO: 3678739 - RNA, 18 nt, Salmonella enterica enterica serovar Typhi Ty2
uaauucucacagaaucau

SEQ ID NO: 3678740 - RNA, 19 nt, Salmonella enterica enterica serovar Typhi Ty2
uaauucuuaacccacaaga

SEQ ID NO: 3678741 - RNA, 20 nt, Salmonella enterica enterica serovar Typhi Ty2
uaauugcucugccagcgccc

SEQ ID NO: 3678742 - RNA, 16 nt, Salmonella enterica enterica serovar Typhi Ty2
uaauugcugaagauaa

SEQ ID NO: 3678743 - RNA, 20 nt, Salmonella enterica enterica serovar Typhi Ty2
uaauugcugacgcgcuuuuu

SEQ ID NO: 3678744 - RNA, 19 nt, Salmonella enterica enterica serovar Typhi Ty2
uaauuguggaaauaagagu

SEQ ID NO: 3678745 - RNA, 15 nt, Salmonella enterica enterica serovar Typhi Ty2
uaauuguguaaucuu

SEQ ID NO: 3678746 - RNA, 15 nt, Salmonella enterica enterica serovar Typhi Ty2
uaauuuauagccauu

SEQ ID NO: 3678747 - RNA, 22 nt, Salmonella enterica enterica serovar Typhi Ty2
uaauuuaugauuuuaacaucac

SEQ ID NO: 3678748 - RNA, 12 nt, Salmonella enterica enterica serovar Typhi Ty2
uaauuucaauuu

SEQ ID NO: 3678749 - RNA, 16 nt, Salmonella enterica enterica serovar Typhi Ty2
uaauuucaauuuugcc

SEQ ID NO: 3678750 - RNA, 14 nt, Salmonella enterica enterica serovar Typhi Ty2
uaauuucagugaau

SEQ ID NO: 3678751 - RNA, 23 nt, Salmonella enterica enterica serovar Typhi Ty2
uaauuuccagugccaguuaagca

SEQ ID NO: 3678752 - RNA, 11 nt, Salmonella enterica enterica serovar Typhi Ty2
uaauuugauuu

SEQ ID NO: 3678753 - RNA, 15 nt, Salmonella enterica enterica serovar Typhi Ty2
uaauuugauuuauuu

SEQ ID NO: 3678754 - RNA, 15 nt, Salmonella enterica enterica serovar Typhi Ty2
uaauuugcaaaccau

SEQ ID NO: 3678755 - RNA, 15 nt, Salmonella enterica enterica serovar Typhi Ty2
uaauuugcgccaucg

SEQ ID NO: 3678756 - RNA, 17 nt, Salmonella enterica enterica serovar Typhi Ty2
uaauuuuacuuucauuc

SEQ ID NO: 3678757 - RNA, 18 nt, Salmonella enterica enterica serovar Typhi Ty2
uaauuuuacuuucauucc

SEQ ID NO: 3678758 - RNA, 22 nt, Salmonella enterica enterica serovar Typhi Ty2
uaauuuuauuauauuuaaaauu

SEQ ID NO: 3678759 - RNA, 23 nt, Salmonella enterica enterica serovar Typhi Ty2
uaauuuucuucuggccauuucau

SEQ ID NO: 3678760 - RNA, 16 nt, Salmonella enterica enterica serovar Typhi Ty2
uaauuuugccaucgcg

SEQ ID NO: 3678761 - RNA, 17 nt, Salmonella enterica enterica serovar Typhi Ty2
uaauuuugccaucgcgc

SEQ ID NO: 3678762 - RNA, 13 nt, Salmonella enterica enterica serovar Typhi Ty2
uaauuuugcgaug

SEQ ID NO: 3678763 - RNA, 22 nt, Salmonella enterica enterica serovar Typhi Ty2
uaauuuuuccagcauuucuuca

SEQ ID NO: 3678764 - RNA, 23 nt, Salmonella enterica enterica serovar Typhi Ty2
uacaaaaaaugugagccauaaca

SEQ ID NO: 3678765 - RNA, 18 nt, Salmonella enterica enterica serovar Typhi Ty2
uacaaaacccauaucccc

SEQ ID NO: 3678766 - RNA, 23 nt, Salmonella enterica enterica serovar Typhi Ty2
uacaaaauaugggauuugaugcc

SEQ ID NO: 3678767 - RNA, 13 nt, Salmonella enterica enterica serovar Typhi Ty2
uacaaacaaauaa

SEQ ID NO: 3678768 - RNA, 23 nt, Salmonella enterica enterica serovar Typhi Ty2
uacaaagccaaaauuuucaauac

SEQ ID NO: 3678769 - RNA, 16 nt, Salmonella enterica enterica serovar Typhi Ty2
uacaugaggauuuuga

SEQ ID NO: 3678770 - RNA, 16 nt, Salmonella enterica enterica serovar Typhi Ty2
uacaugcccgucuggg

SEQ ID NO: 3678771 - RNA, 15 nt, Salmonella enterica enterica serovar Typhi Ty2
uacaugcuacaggca

SEQ ID NO: 3678772 - RNA, 17 nt, Salmonella enterica enterica serovar Typhi Ty2
uacauuauugcacauaa

SEQ ID NO: 3678773 - RNA, 18 nt, Salmonella enterica enterica serovar Typhi Ty2
uacauucgcucaggacag

SEQ ID NO: 3678774 - RNA, 14 nt, Salmonella enterica enterica serovar Typhi Ty2
uacauucuguuuuc

SEQ ID NO: 3678775 - RNA, 13 nt, Salmonella enterica enterica serovar Typhi Ty2
uacauugccaguc

SEQ ID NO: 3678776 - RNA, 20 nt, Salmonella enterica enterica serovar Typhi Ty2
uacauugggucguaauauuc

SEQ ID NO: 3678777 - RNA, 18 nt, Salmonella enterica enterica serovar Typhi Ty2
uacauuucgucaucgcuu

SEQ ID NO: 3678778 - RNA, 15 nt, Salmonella enterica enterica serovar Typhi Ty2
uacauuuuccaugcc

SEQ ID NO: 3678779 - RNA, 16 nt, Salmonella enterica enterica serovar Typhi Ty2
uaccaaaacagaaaag

SEQ ID NO: 3678780 - RNA, 18 nt, Salmonella enterica enterica serovar Typhi Ty2
uaccaaaacagaaaagau

SEQ ID NO: 3678781 - RNA, 19 nt, Salmonella enterica enterica serovar Typhi Ty2
uaccaaagugguuccaggc

SEQ ID NO: 3678782 - RNA, 15 nt, Salmonella enterica enterica serovar Typhi Ty2
uaccaaauauuucuu

SEQ ID NO: 3678783 - RNA, 21 nt, Salmonella enterica enterica serovar Typhi Ty2
uaccaaauauuucuuugucgc

SEQ ID NO: 3678784 - RNA, 15 nt, Salmonella enterica enterica serovar Typhi Ty2
uaccaacguaaauua

SEQ ID NO: 3678785 - RNA, 21 nt, Salmonella enterica enterica serovar Typhi Ty2
uaccaauaagaacuuuaucac

SEQ ID NO: 3678786 - RNA, 14 nt, Salmonella enterica enterica serovar Typhi Ty2
uaccaauacccagc

SEQ ID NO: 3678787 - RNA, 22 nt, Salmonella enterica enterica serovar Typhi Ty2
uaccacaaauuuugauaaaaac

SEQ ID NO: 3678788 - RNA, 17 nt, Salmonella enterica enterica serovar Typhi Ty2
uaccacaauaaucgcga

SEQ ID NO: 3678789 - RNA, 16 nt, Salmonella enterica enterica serovar Typhi Ty2
uaccaccacgcccuuc

SEQ ID NO: 3678790 - RNA, 19 nt, Salmonella enterica enterica serovar Typhi Ty2
uaccaccagaaucgccagc

SEQ ID NO: 3678791 - RNA, 17 nt, Salmonella enterica enterica serovar Typhi Ty2
uaccacccagccagacg

SEQ ID NO: 3678792 - RNA, 19 nt, Salmonella enterica enterica serovar Typhi Ty2
uaccacccgcuaugaagac

SEQ ID NO: 3678793 - RNA, 16 nt, Salmonella enterica enterica serovar Typhi Ty2
uaccaccugccaaagc

SEQ ID NO: 3678794 - RNA, 16 nt, Salmonella enterica enterica serovar Typhi Ty2
uaccacgcagcggcau

SEQ ID NO: 3678795 - RNA, 22 nt, Salmonella enterica enterica serovar Typhi Ty2
uaccacgccguagcugcgcgcc

SEQ ID NO: 3678796 - RNA, 20 nt, Salmonella enterica enterica serovar Typhi Ty2
uaccacuucggcagaaaaag

SEQ ID NO: 3678797 - RNA, 21 nt, Salmonella enterica enterica serovar Typhi Ty2
uaccacuuucuugaugucauc

SEQ ID NO: 3678798 - RNA, 18 nt, Salmonella enterica enterica serovar Typhi Ty2
uaccagaaccacuugaac

SEQ ID NO: 3678799 - RNA, 14 nt, Salmonella enterica enterica serovar Typhi Ty2
uaccagaaucaucg

SEQ ID NO: 3678800 - RNA, 19 nt, Salmonella enterica enterica serovar Typhi Ty2
uaccagaucgucacgacgg

SEQ ID NO: 3678801 - RNA, 15 nt, Salmonella enterica enterica serovar Typhi Ty2
uaccagcacaugaug

SEQ ID NO: 3678802 - RNA, 15 nt, Salmonella enterica enterica serovar Typhi Ty2
uaccagcagcgccag

SEQ ID NO: 3678803 - RNA, 15 nt, Salmonella enterica enterica serovar Typhi Ty2
uaccagcaucgcguu

SEQ ID NO: 3678804 - RNA, 20 nt, Salmonella enterica enterica serovar Typhi Ty2
uaccagccgcgcccuaacag

SEQ ID NO: 3678805 - RNA, 17 nt, Salmonella enterica enterica serovar Typhi Ty2
uaccagcgauaguuguu

SEQ ID NO: 3678806 - RNA, 19 nt, Salmonella enterica enterica serovar Typhi Ty2
uaccagcgcgaacauuaca

SEQ ID NO: 3678807 - RNA, 23 nt, Salmonella enterica enterica serovar Typhi Ty2
uaccagcgcgaacauuacauccu

SEQ ID NO: 3678808 - RNA, 16 nt, Salmonella enterica enterica serovar Typhi Ty2
uaccagcgcggcgcca

SEQ ID NO: 3678809 - RNA, 20 nt, Salmonella enterica enterica serovar Typhi Ty2
uaccagcggcagcuucagcc

SEQ ID NO: 3678810 - RNA, 10 nt, Salmonella enterica enterica serovar Typhi Ty2
uaccaggcac

SEQ ID NO: 3678811 - RNA, 22 nt, Salmonella enterica enterica serovar Typhi Ty2
uaccagggaauaugauuuaaaa

SEQ ID NO: 3678812 - RNA, 20 nt, Salmonella enterica enterica serovar Typhi Ty2
uaccagucgacaguauagaa

SEQ ID NO: 3678813 - RNA, 17 nt, Salmonella enterica enterica serovar Typhi Ty2
uaccagugcuaaaauua

SEQ ID NO: 3678814 - RNA, 21 nt, Salmonella enterica enterica serovar Typhi Ty2
uaccagugcuaaaauuauaca

SEQ ID NO: 3678815 - RNA, 21 nt, Salmonella enterica enterica serovar Typhi Ty2
uaccauaucgccgcugccgcu

SEQ ID NO: 3678816 - RNA, 16 nt, Salmonella enterica enterica serovar Typhi Ty2
uaccauccauuaaaau

SEQ ID NO: 3678817 - RNA, 21 nt, Salmonella enterica enterica serovar Typhi Ty2
uacccaaauuaauuuauugac

SEQ ID NO: 3678818 - RNA, 16 nt, Salmonella enterica enterica serovar Typhi Ty2
uacccaacgcaaugcg

SEQ ID NO: 3678819 - RNA, 22 nt, Salmonella enterica enterica serovar Typhi Ty2
uacccagcgccaacgccacugc

SEQ ID NO: 3678820 - RNA, 22 nt, Salmonella enterica enterica serovar Typhi Ty2
uacccaguagcagacagccgau

SEQ ID NO: 3678821 - RNA, 16 nt, Salmonella enterica enterica serovar Typhi Ty2
uacccaguuuuaagcg

SEQ ID NO: 3678822 - RNA, 14 nt, Salmonella enterica enterica serovar Typhi Ty2
uacccauaucgcgg

SEQ ID NO: 3678823 - RNA, 20 nt, Salmonella enterica enterica serovar Typhi Ty2
uacccauuucuucuucaagc

SEQ ID NO: 3678824 - RNA, 13 nt, Salmonella enterica enterica serovar Typhi Ty2
uaccccagcgcgc

SEQ ID NO: 3678825 - RNA, 18 nt, Salmonella enterica enterica serovar Typhi Ty2
uaccccaggggcauauau

SEQ ID NO: 3678826 - RNA, 22 nt, Salmonella enterica enterica serovar Typhi Ty2
uaccccgcagcgaaaauccagu

SEQ ID NO: 3678827 - RNA, 15 nt, Salmonella enterica enterica serovar Typhi Ty2
uaccccggcgcggcg

SEQ ID NO: 3678828 - RNA, 17 nt, Salmonella enterica enterica serovar Typhi Ty2
uaccccggcgcggcgcg

SEQ ID NO: 3678829 - RNA, 14 nt, Salmonella enterica enterica serovar Typhi Ty2
uaccccgugguggg

SEQ ID NO: 3678830 - RNA, 15 nt, Salmonella enterica enterica serovar Typhi Ty2
uacccgacucuuuuu

SEQ ID NO: 3678831 - RNA, 21 nt, Salmonella enterica enterica serovar Typhi Ty2
uacccgcacgcuuucuucguu

SEQ ID NO: 3678832 - RNA, 17 nt, Salmonella enterica enterica serovar Typhi Ty2
uacccgcccagaucagg

SEQ ID NO: 3678833 - RNA, 18 nt, Salmonella enterica enterica serovar Typhi Ty2
uacccgccgcuggcuguu

SEQ ID NO: 3678834 - RNA, 13 nt, Salmonella enterica enterica serovar Typhi Ty2
uacccgguaauac

SEQ ID NO: 3678835 - RNA, 15 nt, Salmonella enterica enterica serovar Typhi Ty2
uacccgguaauacuu

SEQ ID NO: 3678836 - RNA, 21 nt, Salmonella enterica enterica serovar Typhi Ty2
uacccgguguaaaaaaugggu

SEQ ID NO: 3678837 - RNA, 13 nt, Salmonella enterica enterica serovar Typhi Ty2
uacccucaacgcg

SEQ ID NO: 3678838 - RNA, 12 nt, Salmonella enterica enterica serovar Typhi Ty2
uacccucugcac

SEQ ID NO: 3678839 - RNA, 13 nt, Salmonella enterica enterica serovar Typhi Ty2
uacccucugcguc

SEQ ID NO: 3678840 - RNA, 19 nt, Salmonella enterica enterica serovar Typhi Ty2
uacccugauuuucaaauuu

SEQ ID NO: 3678841 - RNA, 21 nt, Salmonella enterica enterica serovar Typhi Ty2
uacccuuccccggcagccuca

SEQ ID NO: 3678842 - RNA, 19 nt, Salmonella enterica enterica serovar Typhi Ty2
uaccgaaaucaucaaucgc

SEQ ID NO: 3678843 - RNA, 15 nt, Salmonella enterica enterica serovar Typhi Ty2
uaccgaacagccagg

SEQ ID NO: 3678844 - RNA, 17 nt, Salmonella enterica enterica serovar Typhi Ty2
uaccgaacagccaggcu

SEQ ID NO: 3678845 - RNA, 14 nt, Salmonella enterica enterica serovar Typhi Ty2
uaccgaagaacaua

SEQ ID NO: 3678846 - RNA, 22 nt, Salmonella enterica enterica serovar Typhi Ty2
uaccgaaggcgcuuuuggcguc

SEQ ID NO: 3678847 - RNA, 20 nt, Salmonella enterica enterica serovar Typhi Ty2
uaccgacaaaucaaacucac

SEQ ID NO: 3678848 - RNA, 16 nt, Salmonella enterica enterica serovar Typhi Ty2
uaccgacacaucaucg

SEQ ID NO: 3678849 - RNA, 19 nt, Salmonella enterica enterica serovar Typhi Ty2
uaccgacuggggcaugaug

SEQ ID NO: 3678850 - RNA, 21 nt, Salmonella enterica enterica serovar Typhi Ty2
uaccgaggacgggacuugaac

SEQ ID NO: 3678851 - RNA, 13 nt, Salmonella enterica enterica serovar Typhi Ty2
uucgcgcaguuca

SEQ ID NO: 3678852 - RNA, 22 nt, Salmonella enterica enterica serovar Typhi Ty2
uucgcgcuaaaugacaaauaga

SEQ ID NO: 3678853 - RNA, 16 nt, Salmonella enterica enterica serovar Typhi Ty2
uucgcggaauuucagg

SEQ ID NO: 3678854 - RNA, 14 nt, Salmonella enterica enterica serovar Typhi Ty2
uucgcgguaaucgc

SEQ ID NO: 3678855 - RNA, 13 nt, Salmonella enterica enterica serovar Typhi Ty2
uucgcucgcuuug

SEQ ID NO: 3678856 - RNA, 13 nt, Salmonella enterica enterica serovar Typhi Ty2
uucgcugauaccg

SEQ ID NO: 3678857 - RNA, 18 nt, Salmonella enterica enterica serovar Typhi Ty2
uucgcugauuugcgucaa

SEQ ID NO: 3678858 - RNA, 13 nt, Salmonella enterica enterica serovar Typhi Ty2
uucgcugcaacuu

SEQ ID NO: 3678859 - RNA, 15 nt, Salmonella enterica enterica serovar Typhi Ty2
uucgcuuaccaggcc

SEQ ID NO: 3678860 - RNA, 14 nt, Salmonella enterica enterica serovar Typhi Ty2
uucgcuuuuaaaac

SEQ ID NO: 3678861 - RNA, 13 nt, Salmonella enterica enterica serovar Typhi Ty2
uucggagaucagc

SEQ ID NO: 3678862 - RNA, 15 nt, Salmonella enterica enterica serovar Typhi Ty2
uucggauucaauauu

SEQ ID NO: 3678863 - RNA, 22 nt, Salmonella enterica enterica serovar Typhi Ty2
uucggcaaaacgccgcagaaaa

SEQ ID NO: 3678864 - RNA, 16 nt, Salmonella enterica enterica serovar Typhi Ty2
uucggcaauggccaga

SEQ ID NO: 3678865 - RNA, 14 nt, Salmonella enterica enterica serovar Typhi Ty2
uucggcacaucaau

SEQ ID NO: 3678866 - RNA, 18 nt, Salmonella enterica enterica serovar Typhi Ty2
uucggcagaaaaaguaga

SEQ ID NO: 3678867 - RNA, 17 nt, Salmonella enterica enterica serovar Typhi Ty2
uucggcgauuuccagcg

SEQ ID NO: 3678868 - RNA, 23 nt, Salmonella enterica enterica serovar Typhi Ty2
uucggcguaucggaaguauacau

SEQ ID NO: 3678869 - RNA, 21 nt, Salmonella enterica enterica serovar Typhi Ty2
uucggcuccagguugcucagg

SEQ ID NO: 3678870 - RNA, 17 nt, Salmonella enterica enterica serovar Typhi Ty2
uucggcuucaccgauuu

SEQ ID NO: 3678871 - RNA, 17 nt, Salmonella enterica enterica serovar Typhi Ty2
uucgggcacuccggcuc

SEQ ID NO: 3678872 - RNA, 13 nt, Salmonella enterica enterica serovar Typhi Ty2
uucgggccgccgc

SEQ ID NO: 3678873 - RNA, 20 nt, Salmonella enterica enterica serovar Typhi Ty2
uucgggcgcaugucagugac

SEQ ID NO: 3678874 - RNA, 14 nt, Salmonella enterica enterica serovar Typhi Ty2
uucggguuuuccug

SEQ ID NO: 3678875 - RNA, 17 nt, Salmonella enterica enterica serovar Typhi Ty2
uucgguaguuccagaau

SEQ ID NO: 3678876 - RNA, 13 nt, Salmonella enterica enterica serovar Typhi Ty2
uucgguggaaacc

SEQ ID NO: 3678877 - RNA, 17 nt, Salmonella enterica enterica serovar Typhi Ty2
uucgguguaauuucucg

SEQ ID NO: 3678878 - RNA, 18 nt, Salmonella enterica enterica serovar Typhi Ty2
uucguagcgcaaauaucc

SEQ ID NO: 3678879 - RNA, 20 nt, Salmonella enterica enterica serovar Typhi Ty2
uucgucaaugcugcuuugau

SEQ ID NO: 3678880 - RNA, 18 nt, Salmonella enterica enterica serovar Typhi Ty2
uucguccggcugccacuc

SEQ ID NO: 3678881 - RNA, 12 nt, Salmonella enterica enterica serovar Typhi Ty2
uucgucggcaaa

SEQ ID NO: 3678882 - RNA, 21 nt, Salmonella enterica enterica serovar Typhi Ty2
uucgucggggauucgccagcg

SEQ ID NO: 3678883 - RNA, 13 nt, Salmonella enterica enterica serovar Typhi Ty2
uucgucuucaucu

SEQ ID NO: 3678884 - RNA, 20 nt, Salmonella enterica enterica serovar Typhi Ty2
uucguggcgcuguucuugcu

SEQ ID NO: 3678885 - RNA, 15 nt, Salmonella enterica enterica serovar Typhi Ty2
uucguuaacccggca

SEQ ID NO: 3678886 - RNA, 19 nt, Salmonella enterica enterica serovar Typhi Ty2
uucguuaccgccuuuuuuc

SEQ ID NO: 3678887 - RNA, 17 nt, Salmonella enterica enterica serovar Typhi Ty2
uucguuacuuucauaau

SEQ ID NO: 3678888 - RNA, 17 nt, Salmonella enterica enterica serovar Typhi Ty2
uucguuauaaggccugc

SEQ ID NO: 3678889 - RNA, 15 nt, Salmonella enterica enterica serovar Typhi Ty2
uucguuaugaauggc

SEQ ID NO: 3678890 - RNA, 14 nt, Salmonella enterica enterica serovar Typhi Ty2
uucguuauuuuccu

SEQ ID NO: 3678891 - RNA, 18 nt, Salmonella enterica enterica serovar Typhi Ty2
uucguuccgcgauuuccu

SEQ ID NO: 3678892 - RNA, 14 nt, Salmonella enterica enterica serovar Typhi Ty2
uucguucucugaau

SEQ ID NO: 3678893 - RNA, 16 nt, Salmonella enterica enterica serovar Typhi Ty2
uucguugguaccgcuu

SEQ ID NO: 3678894 - RNA, 18 nt, Salmonella enterica enterica serovar Typhi Ty2
uucuaaagacaugaucuu

SEQ ID NO: 3678895 - RNA, 14 nt, Salmonella enterica enterica serovar Typhi Ty2
uucuacaaugcggu

SEQ ID NO: 3678896 - RNA, 18 nt, Salmonella enterica enterica serovar Typhi Ty2
uucuacucgggccagcuc

SEQ ID NO: 3678897 - RNA, 13 nt, Salmonella enterica enterica serovar Typhi Ty2
uucuacugguuaa

SEQ ID NO: 3678898 - RNA, 16 nt, Salmonella enterica enterica serovar Typhi Ty2
uucuaucguuauauau

SEQ ID NO: 3678899 - RNA, 20 nt, Salmonella enterica enterica serovar Typhi Ty2
uucuaucguuauauauacuu

SEQ ID NO: 3678900 - RNA, 16 nt, Salmonella enterica enterica serovar Typhi Ty2
uucuaucuuucagacc

SEQ ID NO: 3678901 - RNA, 15 nt, Salmonella enterica enterica serovar Typhi Ty2
uucucaaaggcuuug

SEQ ID NO: 3678902 - RNA, 17 nt, Salmonella enterica enterica serovar Typhi Ty2
uucucaacauacgccgc

SEQ ID NO: 3678903 - RNA, 15 nt, Salmonella enterica enterica serovar Typhi Ty2
uucucaauacgauau

SEQ ID NO: 3678904 - RNA, 19 nt, Salmonella enterica enterica serovar Typhi Ty2
uucucaauacgauauucug

SEQ ID NO: 3678905 - RNA, 22 nt, Salmonella enterica enterica serovar Typhi Ty2
uucucacagaaucaucaggcua

SEQ ID NO: 3678906 - RNA, 16 nt, Salmonella enterica enterica serovar Typhi Ty2
uucucacggucuccug

SEQ ID NO: 3678907 - RNA, 16 nt, Salmonella enterica enterica serovar Typhi Ty2
uucucagccagaucca

SEQ ID NO: 3678908 - RNA, 20 nt, Salmonella enterica enterica serovar Typhi Ty2
uucuccauggucagacgcuc

SEQ ID NO: 3678909 - RNA, 18 nt, Salmonella enterica enterica serovar Typhi Ty2
uucucccgccagaugcag

SEQ ID NO: 3678910 - RNA, 23 nt, Salmonella enterica enterica serovar Typhi Ty2
uucucccgccagaugcagcggca

SEQ ID NO: 3678911 - RNA, 15 nt, Salmonella enterica enterica serovar Typhi Ty2
uucucccuacugcuu

SEQ ID NO: 3678912 - RNA, 18 nt, Salmonella enterica enterica serovar Typhi Ty2
uucuccggcaguccaugc

SEQ ID NO: 3678913 - RNA, 19 nt, Salmonella enterica enterica serovar Typhi Ty2
uucuccugcgcuugcggcc

SEQ ID NO: 3678914 - RNA, 17 nt, Salmonella enterica enterica serovar Typhi Ty2
uucucgaggacagugaa

SEQ ID NO: 3678915 - RNA, 18 nt, Salmonella enterica enterica serovar Typhi Ty2
uucucgcccgccagaucg

SEQ ID NO: 3678916 - RNA, 23 nt, Salmonella enterica enterica serovar Typhi Ty2
uucucgccgccauuuuauccagg

SEQ ID NO: 3678917 - RNA, 15 nt, Salmonella enterica enterica serovar Typhi Ty2
uucucgcgccaccug

SEQ ID NO: 3678918 - RNA, 17 nt, Salmonella enterica enterica serovar Typhi Ty2
uucucgcguccccagcc

SEQ ID NO: 3678919 - RNA, 16 nt, Salmonella enterica enterica serovar Typhi Ty2
uucucgcuaauuggcu

SEQ ID NO: 3678920 - RNA, 24 nt, Salmonella enterica enterica serovar Typhi Ty2
uucucgggccuguuccggcgagga

SEQ ID NO: 3678921 - RNA, 19 nt, Salmonella enterica enterica serovar Typhi Ty2
uucucguguagccaguacg

SEQ ID NO: 3678922 - RNA, 17 nt, Salmonella enterica enterica serovar Typhi Ty2
uucucuaucagcgccuc

SEQ ID NO: 3678923 - RNA, 23 nt, Salmonella enterica enterica serovar Typhi Ty2
uucucugcccccgagccagaacg

SEQ ID NO: 3678924 - RNA, 15 nt, Salmonella enterica enterica serovar Typhi Ty2
uucucugucgccgcc

SEQ ID NO: 3678925 - RNA, 19 nt, Salmonella enterica enterica serovar Typhi Ty2
uucucuuaugccgcuuuug

SEQ ID NO: 3678926 - RNA, 18 nt, Salmonella enterica enterica serovar Typhi Ty2
uucucuucguuauuuucc

SEQ ID NO: 3678927 - RNA, 19 nt, Salmonella enterica enterica serovar Typhi Ty2
uucucuucguuauuuuccu

SEQ ID NO: 3678928 - RNA, 22 nt, Salmonella enterica enterica serovar Typhi Ty2
uucucuucuaccacgcugccgc

SEQ ID NO: 3678929 - RNA, 13 nt, Salmonella enterica enterica serovar Typhi Ty2
uucucuucugcug

SEQ ID NO: 3678930 - RNA, 15 nt, Salmonella enterica enterica serovar Typhi Ty2
uucucuucuucaaug

SEQ ID NO: 3678931 - RNA, 13 nt, Salmonella enterica enterica serovar Typhi Ty2
uucugaacgcugc

SEQ ID NO: 3678932 - RNA, 19 nt, Salmonella enterica enterica serovar Typhi Ty2
uucugaagcuaaccgcgca

SEQ ID NO: 3678933 - RNA, 13 nt, Salmonella enterica enterica serovar Typhi Ty2
uucugaauaaauu

SEQ ID NO: 3678934 - RNA, 18 nt, Salmonella enterica enterica serovar Typhi Ty2
uucugaauuucacgcuuc

SEQ ID NO: 3678935 - RNA, 20 nt, Salmonella enterica enterica serovar Typhi Ty2
uucugacagaauauaggaga

SEQ ID NO: 3678936 - RNA, 17 nt, Salmonella enterica enterica serovar Typhi Ty2
uucugauaacgcaggcg

SEQ ID NO: 3678937 - RNA, 14 nt, Salmonella enterica enterica serovar Typhi Ty2
uucugaucgauaaa

SEQ ID NO: 3678938 - RNA, 18 nt, Salmonella enterica enterica serovar Typhi Ty2
uucugaucgauaaaaguu

SEQ ID NO: 3678939 - RNA, 11 nt, Salmonella enterica enterica serovar Typhi Ty2
uucugcaaaau

SEQ ID NO: 3678940 - RNA, 23 nt, Salmonella enterica enterica serovar Typhi Ty2
uucugcaggcgggugcgcagccc

SEQ ID NO: 3678941 - RNA, 21 nt, Salmonella enterica enterica serovar Typhi Ty2
uucugcauuggcgacgauaaa

SEQ ID NO: 3678942 - RNA, 22 nt, Salmonella enterica enterica serovar Typhi Ty2
uucugccgcgcgguauuucgca

SEQ ID NO: 3678943 - RNA, 16 nt, Salmonella enterica enterica serovar Typhi Ty2
uucugcgccagccagc

SEQ ID NO: 3678944 - RNA, 18 nt, Salmonella enterica enterica serovar Typhi Ty2
uucugcgccagccagcuc

SEQ ID NO: 3678945 - RNA, 19 nt, Salmonella enterica enterica serovar Typhi Ty2
uucugcgccauuuccagcc

SEQ ID NO: 3678946 - RNA, 19 nt, Salmonella enterica enterica serovar Typhi Ty2
uucugcgguaaucugccag

SEQ ID NO: 3678947 - RNA, 15 nt, Salmonella enterica enterica serovar Typhi Ty2
uucugcgucaugcuu

SEQ ID NO: 3678948 - RNA, 14 nt, Salmonella enterica enterica serovar Typhi Ty2
uucugcucaaugau

SEQ ID NO: 3678949 - RNA, 16 nt, Salmonella enterica enterica serovar Typhi Ty2
uucugcucgguaaaaa

SEQ ID NO: 3678950 - RNA, 13 nt, Salmonella enterica enterica serovar Typhi Ty2
uucugcugauaau

SEQ ID NO: 3678951 - RNA, 15 nt, Salmonella enterica enterica serovar Typhi Ty2
uucugcugaugcugg

SEQ ID NO: 3678952 - RNA, 22 nt, Salmonella enterica enterica serovar Typhi Ty2
uucuggacgggcuaucaauaug

SEQ ID NO: 3678953 - RNA, 16 nt, Salmonella enterica enterica serovar Typhi Ty2
uucuggauagcgguuu

SEQ ID NO: 3678954 - RNA, 14 nt, Salmonella enterica enterica serovar Typhi Ty2
uucuggcaauaagg

SEQ ID NO: 3678955 - RNA, 18 nt, Salmonella enterica enterica serovar Typhi Ty2
uucuggcauuggcaucug

SEQ ID NO: 3678956 - RNA, 19 nt, Salmonella enterica enterica serovar Typhi Ty2
uucuggcauuggcaucugu

SEQ ID NO: 3678957 - RNA, 16 nt, Salmonella enterica enterica serovar Typhi Ty2
uucuggccauuucauc

SEQ ID NO: 3678958 - RNA, 20 nt, Salmonella enterica enterica serovar Typhi Ty2
uucuggccccugagcaauca

SEQ ID NO: 3678959 - RNA, 21 nt, Salmonella enterica enterica serovar Typhi Ty2
uucuggcgaguuucaccggua

SEQ ID NO: 3678960 - RNA, 22 nt, Salmonella enterica enterica serovar Typhi Ty2
uucuggcgaugugcccgaguga

SEQ ID NO: 3678961 - RNA, 15 nt, Salmonella enterica enterica serovar Typhi Ty2
uucuggcgcagauac

SEQ ID NO: 3678962 - RNA, 20 nt, Salmonella enterica enterica serovar Typhi Ty2
uucuggcgcagauacgcguc

SEQ ID NO: 3678963 - RNA, 15 nt, Salmonella enterica enterica serovar Typhi Ty2
uucugguaaaccuca

SEQ ID NO: 3678964 - RNA, 17 nt, Salmonella enterica enterica serovar Typhi Ty2
uucuguaauacgcugua

SEQ ID NO: 3678965 - RNA, 17 nt, Salmonella enterica enterica serovar Typhi Ty2
uucuguaggcugugcaa

SEQ ID NO: 3678966 - RNA, 16 nt, Salmonella enterica enterica serovar Typhi Ty2
uucugucagaaaucug

SEQ ID NO: 3678967 - RNA, 13 nt, Salmonella enterica enterica serovar Typhi Ty2
uucuguucagugg

SEQ ID NO: 3678968 - RNA, 18 nt, Salmonella enterica enterica serovar Typhi Ty2
uucuuaacccacaagaaa

SEQ ID NO: 3678969 - RNA, 23 nt, Salmonella enterica enterica serovar Typhi Ty2
uucuuacgauaccccauccacuu

SEQ ID NO: 3678970 - RNA, 14 nt, Salmonella enterica enterica serovar Typhi Ty2
uucuuacuaauaaa

SEQ ID NO: 3678971 - RNA, 15 nt, Salmonella enterica enterica serovar Typhi Ty2
uucuuacuaauaaau

SEQ ID NO: 3678972 - RNA, 17 nt, Salmonella enterica enterica serovar Typhi Ty2
uucuuaucccacagcgu

SEQ ID NO: 3678973 - RNA, 12 nt, Salmonella enterica enterica serovar Typhi Ty2
uucuuauuuauu

SEQ ID NO: 3678974 - RNA, 17 nt, Salmonella enterica enterica serovar Typhi Ty2
uucuucaagccaggcuu

SEQ ID NO: 3678975 - RNA, 12 nt, Salmonella enterica enterica serovar Typhi Ty2
uucuucaaugaa

SEQ ID NO: 3678976 - RNA, 20 nt, Salmonella enterica enterica serovar Typhi Ty2
uucuucaguuccgccagacu

SEQ ID NO: 3678977 - RNA, 23 nt, Salmonella enterica enterica serovar Typhi Ty2
uucuucaucaaagaaauacccuu

SEQ ID NO: 3678978 - RNA, 13 nt, Salmonella enterica enterica serovar Typhi Ty2
uucuucaucuuca

SEQ ID NO: 3678979 - RNA, 15 nt, Salmonella enterica enterica serovar Typhi Ty2
uucuuccagcggcag

SEQ ID NO: 3678980 - RNA, 17 nt, Salmonella enterica enterica serovar Typhi Ty2
uucuuccgucagcgaau

SEQ ID NO: 3678981 - RNA, 12 nt, Salmonella enterica enterica serovar Typhi Ty2
uucuuccgugcc

SEQ ID NO: 3678982 - RNA, 23 nt, Salmonella enterica enterica serovar Typhi Ty2
uucuucgcgcauuucuguugcaa

SEQ ID NO: 3678983 - RNA, 14 nt, Salmonella enterica enterica serovar Typhi Ty2
uucuucuguaauac

SEQ ID NO: 3678984 - RNA, 19 nt, Salmonella enterica enterica serovar Typhi Ty2
uucuugcccgcugaguggu

SEQ ID NO: 3678985 - RNA, 13 nt, Salmonella enterica enterica serovar Typhi Ty2
uucuugcccggug

SEQ ID NO: 3678986 - RNA, 14 nt, Salmonella enterica enterica serovar Typhi Ty2
uucuugccgccauc

SEQ ID NO: 3678987 - RNA, 20 nt, Salmonella enterica enterica serovar Typhi Ty2
uucuuuaagaacgguuggaa

SEQ ID NO: 3678988 - RNA, 15 nt, Salmonella enterica enterica serovar Typhi Ty2
uucuuuaaucagauu

SEQ ID NO: 3678989 - RNA, 19 nt, Salmonella enterica enterica serovar Typhi Ty2
uucuuuacgcagcaagaac

SEQ ID NO: 3678990 - RNA, 14 nt, Salmonella enterica enterica serovar Typhi Ty2
uucuuuaugcgccu

SEQ ID NO: 3678991 - RNA, 13 nt, Salmonella enterica enterica serovar Typhi Ty2
uucuuucacuguc

SEQ ID NO: 3678992 - RNA, 13 nt, Salmonella enterica enterica serovar Typhi Ty2
uucuuucaucaaa

SEQ ID NO: 3678993 - RNA, 16 nt, Salmonella enterica enterica serovar Typhi Ty2
uucuuucauuuuaccu

SEQ ID NO: 3678994 - RNA, 15 nt, Salmonella enterica enterica serovar Typhi Ty2
uucuuuccugcaaau

SEQ ID NO: 3678995 - RNA, 23 nt, Salmonella enterica enterica serovar Typhi Ty2
uucuuugacccacgccagcagcu

SEQ ID NO: 3678996 - RNA, 15 nt, Salmonella enterica enterica serovar Typhi Ty2
uucuuugccuuuuuc

SEQ ID NO: 3678997 - RNA, 17 nt, Salmonella enterica enterica serovar Typhi Ty2
uucuuugcgccuuauuc

SEQ ID NO: 3678998 - RNA, 12 nt, Salmonella enterica enterica serovar Typhi Ty2
uucuuuucaggc

SEQ ID NO: 3678999 - RNA, 14 nt, Salmonella enterica enterica serovar Typhi Ty2
uucuuuucuuucag

SEQ ID NO: 3679000 - RNA, 20 nt, Salmonella enterica enterica serovar Typhi Ty2
uugaaaaaaacaucgcugau

SEQ ID NO: 3679001 - RNA, 12 nt, Salmonella enterica enterica serovar Typhi Ty2
uugaaauccucu

SEQ ID NO: 3679002 - RNA, 13 nt, Salmonella enterica enterica serovar Typhi Ty2
uugaaauccucua

SEQ ID NO: 3679003 - RNA, 20 nt, Salmonella enterica enterica serovar Typhi Ty2
uugaacagcgucauccagug

SEQ ID NO: 3679004 - RNA, 22 nt, Salmonella enterica enterica serovar Typhi Ty2
uugaacagcgucauccaguguu

SEQ ID NO: 3679005 - RNA, 16 nt, Salmonella enterica enterica serovar Typhi Ty2
uugaacauuuuuucag

SEQ ID NO: 3679006 - RNA, 15 nt, Salmonella enterica enterica serovar Typhi Ty2
uugaacucuuucaga

SEQ ID NO: 3679007 - RNA, 17 nt, Salmonella enterica enterica serovar Typhi Ty2
uugaacuuacccagcaa

SEQ ID NO: 3679008 - RNA, 11 nt, Salmonella enterica enterica serovar Typhi Ty2
uugaagacagc

SEQ ID NO: 3679009 - RNA, 23 nt, Salmonella enterica enterica serovar Typhi Ty2
uugaagugguggcgaacaggcuc

SEQ ID NO: 3679010 - RNA, 16 nt, Salmonella enterica enterica serovar Typhi Ty2
uugaaguuauccagcg

SEQ ID NO: 3679011 - RNA, 19 nt, Salmonella enterica enterica serovar Typhi Ty2
uugaaguuauccagcgccc

SEQ ID NO: 3679012 - RNA, 17 nt, Salmonella enterica enterica serovar Typhi Ty2
uugaauaacguguuaug

SEQ ID NO: 3679013 - RNA, 22 nt, Salmonella enterica enterica serovar Typhi Ty2
uugaaucgccuggcuugccggc

SEQ ID NO: 3679014 - RNA, 14 nt, Salmonella enterica enterica serovar Typhi Ty2
uugaaucguagcgu

SEQ ID NO: 3679015 - RNA, 14 nt, Salmonella enterica enterica serovar Typhi Ty2
uugaauuauaauaa

SEQ ID NO: 3679016 - RNA, 13 nt, Salmonella enterica enterica serovar Typhi Ty2
uugacaucaggau

SEQ ID NO: 3679017 - RNA, 13 nt, Salmonella enterica enterica serovar Typhi Ty2
uugacaugaaaaa

SEQ ID NO: 3679018 - RNA, 18 nt, Salmonella enterica enterica serovar Typhi Ty2
uugaccagauaaucaaac

SEQ ID NO: 3679019 - RNA, 19 nt, Salmonella enterica enterica serovar Typhi Ty2
uugaccaggucgccagcgg

SEQ ID NO: 3679020 - RNA, 12 nt, Salmonella enterica enterica serovar Typhi Ty2
uugaccauuacc

SEQ ID NO: 3679021 - RNA, 17 nt, Salmonella enterica enterica serovar Typhi Ty2
uugaccauuaccauucc

SEQ ID NO: 3679022 - RNA, 15 nt, Salmonella enterica enterica serovar Typhi Ty2
uugacccacgccagc

SEQ ID NO: 3679023 - RNA, 21 nt, Salmonella enterica enterica serovar Typhi Ty2
uugaccggggcgcaauccgcg

SEQ ID NO: 3679024 - RNA, 17 nt, Salmonella enterica enterica serovar Typhi Ty2
uugaccguccccagcca

SEQ ID NO: 3679025 - RNA, 13 nt, Salmonella enterica enterica serovar Typhi Ty2
uugacgcaaacug

SEQ ID NO: 3679026 - RNA, 22 nt, Salmonella enterica enterica serovar Typhi Ty2
uugacgcaaacugccaggcaau

SEQ ID NO: 3679027 - RNA, 14 nt, Salmonella enterica enterica serovar Typhi Ty2
uugacggccaccau

SEQ ID NO: 3679028 - RNA, 22 nt, Salmonella enterica enterica serovar Typhi Ty2
uugacguaacgcuggugaccaa

SEQ ID NO: 3679029 - RNA, 16 nt, Salmonella enterica enterica serovar Typhi Ty2
uugacguuauccagua

SEQ ID NO: 3679030 - RNA, 13 nt, Salmonella enterica enterica serovar Typhi Ty2
uugacucugaagc

SEQ ID NO: 3679031 - RNA, 19 nt, Salmonella enterica enterica serovar Typhi Ty2
uugacuucaacgcaggcga

SEQ ID NO: 3679032 - RNA, 14 nt, Salmonella enterica enterica serovar Typhi Ty2
uugagaaaaccaua

SEQ ID NO: 3679033 - RNA, 14 nt, Salmonella enterica enterica serovar Typhi Ty2
uugagcagaucagc

SEQ ID NO: 3679034 - RNA, 18 nt, Salmonella enterica enterica serovar Typhi Ty2
uugagcgcaaaacgcugc

SEQ ID NO: 3679035 - RNA, 16 nt, Salmonella enterica enterica serovar Typhi Ty2
uugagcuggauaagcu

SEQ ID NO: 3679036 - RNA, 17 nt, Salmonella enterica enterica serovar Typhi Ty2
uugaguuccgcuucgua

SEQ ID NO: 3679037 - RNA, 15 nt, Salmonella enterica enterica serovar Typhi Ty2
uugaguuugcaaucc

SEQ ID NO: 3679038 - RNA, 18 nt, Salmonella enterica enterica serovar Typhi Ty2
uugaguuugcaauccaga

SEQ ID NO: 3679039 - RNA, 18 nt, Salmonella enterica enterica serovar Typhi Ty2
uugauaaaacgaauacua

SEQ ID NO: 3679040 - RNA, 12 nt, Salmonella enterica enterica serovar Typhi Ty2
uugauaaagcgc

SEQ ID NO: 3679041 - RNA, 16 nt, Salmonella enterica enterica serovar Typhi Ty2
uugauaacggaaucac

SEQ ID NO: 3679042 - RNA, 14 nt, Salmonella enterica enterica serovar Typhi Ty2
uugauaagagaaaa

SEQ ID NO: 3679043 - RNA, 21 nt, Salmonella enterica enterica serovar Typhi Ty2
uugauaagcggguugcacauu

SEQ ID NO: 3679044 - RNA, 16 nt, Salmonella enterica enterica serovar Typhi Ty2
uugauaccuauuuaau

SEQ ID NO: 3679045 - RNA, 18 nt, Salmonella enterica enterica serovar Typhi Ty2
uugauaccuauuuaauaa

SEQ ID NO: 3679046 - RNA, 18 nt, Salmonella enterica enterica serovar Typhi Ty2
uugauaccuuuaaccucu

SEQ ID NO: 3679047 - RNA, 18 nt, Salmonella enterica enterica serovar Typhi Ty2
uugauagggugaaugcgu

SEQ ID NO: 3679048 - RNA, 23 nt, Salmonella enterica enterica serovar Typhi Ty2
uugaucacuuuugggccgcguag

SEQ ID NO: 3679049 - RNA, 22 nt, Salmonella enterica enterica serovar Typhi Ty2
uugaucaggcaaaaaucggccu

SEQ ID NO: 3679050 - RNA, 23 nt, Salmonella enterica enterica serovar Typhi Ty2
uugaucaucagggcgaacauucc

SEQ ID NO: 3679051 - RNA, 14 nt, Salmonella enterica enterica serovar Typhi Ty2
uugaucgcgcagca

SEQ ID NO: 3679052 - RNA, 22 nt, Salmonella enterica enterica serovar Typhi Ty2
uugaucgcgcagcaaaucagcu

SEQ ID NO: 3679053 - RNA, 17 nt, Salmonella enterica enterica serovar Typhi Ty2
uugaucggguuuuccug

SEQ ID NO: 3679054 - RNA, 19 nt, Salmonella enterica enterica serovar Typhi Ty2
uugaucggguuuuccugaa

SEQ ID NO: 3679055 - RNA, 19 nt, Salmonella enterica enterica serovar Typhi Ty2
uugaucguccggcgaugcc

SEQ ID NO: 3679056 - RNA, 12 nt, Salmonella enterica enterica serovar Typhi Ty2
uugaucugcuug

SEQ ID NO: 3679057 - RNA, 13 nt, Salmonella enterica enterica serovar Typhi Ty2
uugaugaaccgcu

SEQ ID NO: 3679058 - RNA, 20 nt, Salmonella enterica enterica serovar Typhi Ty2
uugaugaaccgcuguagcgu

SEQ ID NO: 3679059 - RNA, 20 nt, Salmonella enterica enterica serovar Typhi Ty2
uugaugauaaccgccgccaa

SEQ ID NO: 3679060 - RNA, 20 nt, Salmonella enterica enterica serovar Typhi Ty2
uugaugccuggcaguucccu

SEQ ID NO: 3679061 - RNA, 13 nt, Salmonella enterica enterica serovar Typhi Ty2
uugauggacgcga

SEQ ID NO: 3679062 - RNA, 12 nt, Salmonella enterica enterica serovar Typhi Ty2
uugauggccagc

SEQ ID NO: 3679063 - RNA, 17 nt, Salmonella enterica enterica serovar Typhi Ty2
uugauuaaucgucaucc

SEQ ID NO: 3679064 - RNA, 15 nt, Salmonella enterica enterica serovar Typhi Ty2
uugauuuguuuuuua

SEQ ID NO: 3679065 - RNA, 12 nt, Salmonella enterica enterica serovar Typhi Ty2
uugauuuuauga

SEQ ID NO: 3679066 - RNA, 15 nt, Salmonella enterica enterica serovar Typhi Ty2
uugcaaagcccauaa

SEQ ID NO: 3679067 - RNA, 16 nt, Salmonella enterica enterica serovar Typhi Ty2
uugcaaagcccauaaa

SEQ ID NO: 3679068 - RNA, 11 nt, Salmonella enterica enterica serovar Typhi Ty2
uugcaaggcga

SEQ ID NO: 3679069 - RNA, 19 nt, Salmonella enterica enterica serovar Typhi Ty2
uugcaccgcuaaaaaacag

SEQ ID NO: 3679070 - RNA, 15 nt, Salmonella enterica enterica serovar Typhi Ty2
uugcacguucugcug

SEQ ID NO: 3679071 - RNA, 17 nt, Salmonella enterica enterica serovar Typhi Ty2
uugcacuuuugccaggc

SEQ ID NO: 3679072 - RNA, 16 nt, Salmonella enterica enterica serovar Typhi Ty2
uugcagacgugcaaua

SEQ ID NO: 3679073 - RNA, 17 nt, Salmonella enterica enterica serovar Typhi Ty2
uugcagacgugcaauau

SEQ ID NO: 3679074 - RNA, 15 nt, Salmonella enterica enterica serovar Typhi Ty2
uugcagauaccagcg

SEQ ID NO: 3679075 - RNA, 14 nt, Salmonella enterica enterica serovar Typhi Ty2
uugcagauccgcga

SEQ ID NO: 3679076 - RNA, 20 nt, Salmonella enterica enterica serovar Typhi Ty2
uugcagcagcgagauggcuu

SEQ ID NO: 3679077 - RNA, 22 nt, Salmonella enterica enterica serovar Typhi Ty2
uugcagcagcgagauggcuuuu

SEQ ID NO: 3679078 - RNA, 12 nt, Salmonella enterica enterica serovar Typhi Ty2
uugcagcgccau

SEQ ID NO: 3679079 - RNA, 17 nt, Salmonella enterica enterica serovar Typhi Ty2
uugcagcgcggccagcg

SEQ ID NO: 3679080 - RNA, 15 nt, Salmonella enterica enterica serovar Typhi Ty2
uugcagcgguaaaca

SEQ ID NO: 3679081 - RNA, 18 nt, Salmonella enterica enterica serovar Typhi Ty2
uugcagcgguaaacacca

SEQ ID NO: 3679082 - RNA, 20 nt, Salmonella enterica enterica serovar Typhi Ty2
uugcagcgguaaacaccacc

SEQ ID NO: 3679083 - RNA, 15 nt, Salmonella enterica enterica serovar Typhi Ty2
uugcagcuccuuuua

SEQ ID NO: 3679084 - RNA, 19 nt, Salmonella enterica enterica serovar Typhi Ty2
uugcaggaaaaacuguccc

SEQ ID NO: 3679085 - RNA, 13 nt, Salmonella enterica enterica serovar Typhi Ty2
uugcaggaggcgc

SEQ ID NO: 3679086 - RNA, 20 nt, Salmonella enterica enterica serovar Typhi Ty2
uugcagggugcagcaaauaa

SEQ ID NO: 3679087 - RNA, 21 nt, Salmonella enterica enterica serovar Typhi Ty2
uugcagguaacgacuacuucc

SEQ ID NO: 3679088 - RNA, 13 nt, Salmonella enterica enterica serovar Typhi Ty2
uugcauaaagaac

SEQ ID NO: 3679089 - RNA, 13 nt, Salmonella enterica enterica serovar Typhi Ty2
uugcauaaauaau

SEQ ID NO: 3679090 - RNA, 14 nt, Salmonella enterica enterica serovar Typhi Ty2
uugcauaagagguc

SEQ ID NO: 3679091 - RNA, 21 nt, Salmonella enterica enterica serovar Typhi Ty2
uugcauagaucuuugggccgg

SEQ ID NO: 3679092 - RNA, 23 nt, Salmonella enterica enterica serovar Typhi Ty2
uugcauauaaggcccauacccca

SEQ ID NO: 3679093 - RNA, 17 nt, Salmonella enterica enterica serovar Typhi Ty2
uugcauccguagcuuca

SEQ ID NO: 3679094 - RNA, 14 nt, Salmonella enterica enterica serovar Typhi Ty2
uugcaugaccaucc

SEQ ID NO: 3679095 - RNA, 18 nt, Salmonella enterica enterica serovar Typhi Ty2
uugcauggcaauuaaauu

SEQ ID NO: 3679096 - RNA, 13 nt, Salmonella enterica enterica serovar Typhi Ty2
uugcauuauauuu

SEQ ID NO: 3679097 - RNA, 13 nt, Salmonella enterica enterica serovar Typhi Ty2
uugccaaacugcu

SEQ ID NO: 3679098 - RNA, 15 nt, Salmonella enterica enterica serovar Typhi Ty2
uugccacauuucccg

SEQ ID NO: 3679099 - RNA, 15 nt, Salmonella enterica enterica serovar Typhi Ty2
uucauuucaggcaaa

SEQ ID NO: 3679100 - RNA, 22 nt, Salmonella enterica enterica serovar Typhi Ty2
uucauuuguuccucgaaacgcu

SEQ ID NO: 3679101 - RNA, 18 nt, Salmonella enterica enterica serovar Typhi Ty2
uucauuuuauagucccuc

SEQ ID NO: 3679102 - RNA, 22 nt, Salmonella enterica enterica serovar Typhi Ty2
uuccaauauuuauuuaauguuu

SEQ ID NO: 3679103 - RNA, 17 nt, Salmonella enterica enterica serovar Typhi Ty2
uuccacacguccauccg

SEQ ID NO: 3679104 - RNA, 12 nt, Salmonella enterica enterica serovar Typhi Ty2
uuccaccaccuc

SEQ ID NO: 3679105 - RNA, 17 nt, Salmonella enterica enterica serovar Typhi Ty2
uuccaccaccuccugcu

SEQ ID NO: 3679106 - RNA, 20 nt, Salmonella enterica enterica serovar Typhi Ty2
uuccaccagcuuaucugacc

SEQ ID NO: 3679107 - RNA, 16 nt, Salmonella enterica enterica serovar Typhi Ty2
uuccaccgcaugguua

SEQ ID NO: 3679108 - RNA, 11 nt, Salmonella enterica enterica serovar Typhi Ty2
uuccaccgcca

SEQ ID NO: 3679109 - RNA, 16 nt, Salmonella enterica enterica serovar Typhi Ty2
uuccaccgccaauaaa

SEQ ID NO: 3679110 - RNA, 23 nt, Salmonella enterica enterica serovar Typhi Ty2
uuccacgcguacgguuacaaccc

SEQ ID NO: 3679111 - RNA, 14 nt, Salmonella enterica enterica serovar Typhi Ty2
uuccacgguaaaac

SEQ ID NO: 3679112 - RNA, 17 nt, Salmonella enterica enterica serovar Typhi Ty2
uuccacucuucgggaau

SEQ ID NO: 3679113 - RNA, 22 nt, Salmonella enterica enterica serovar Typhi Ty2
uuccacugagcuucaccgccag

SEQ ID NO: 3679114 - RNA, 16 nt, Salmonella enterica enterica serovar Typhi Ty2
uuccacuguuggcgaa

SEQ ID NO: 3679115 - RNA, 18 nt, Salmonella enterica enterica serovar Typhi Ty2
uuccagagugcucaauaa

SEQ ID NO: 3679116 - RNA, 15 nt, Salmonella enterica enterica serovar Typhi Ty2
uuccagauucucaac

SEQ ID NO: 3679117 - RNA, 13 nt, Salmonella enterica enterica serovar Typhi Ty2
uuccagcacgccc

SEQ ID NO: 3679118 - RNA, 16 nt, Salmonella enterica enterica serovar Typhi Ty2
uuccagcagccagccg

SEQ ID NO: 3679119 - RNA, 20 nt, Salmonella enterica enterica serovar Typhi Ty2
uuccagcagcucaucaauaa

SEQ ID NO: 3679120 - RNA, 21 nt, Salmonella enterica enterica serovar Typhi Ty2
uuccagcaucgaccaggauuu

SEQ ID NO: 3679121 - RNA, 16 nt, Salmonella enterica enterica serovar Typhi Ty2
uuccagccaugccagc

SEQ ID NO: 3679122 - RNA, 23 nt, Salmonella enterica enterica serovar Typhi Ty2
uuccagccgcccgcgauaaaaau

SEQ ID NO: 3679123 - RNA, 18 nt, Salmonella enterica enterica serovar Typhi Ty2
uuccagcgcguccagccc

SEQ ID NO: 3679124 - RNA, 17 nt, Salmonella enterica enterica serovar Typhi Ty2
uuccagcggcggaaugc

SEQ ID NO: 3679125 - RNA, 16 nt, Salmonella enterica enterica serovar Typhi Ty2
uuccagcgugccgagc

SEQ ID NO: 3679126 - RNA, 20 nt, Salmonella enterica enterica serovar Typhi Ty2
uuccagcuguaccaucaccu

SEQ ID NO: 3679127 - RNA, 14 nt, Salmonella enterica enterica serovar Typhi Ty2
uuccaggccgccag

SEQ ID NO: 3679128 - RNA, 15 nt, Salmonella enterica enterica serovar Typhi Ty2
uuccaggccgccagc

SEQ ID NO: 3679129 - RNA, 13 nt, Salmonella enterica enterica serovar Typhi Ty2
uuccaggcgaacc

SEQ ID NO: 3679130 - RNA, 17 nt, Salmonella enterica enterica serovar Typhi Ty2
uuccagguugugacgaa

SEQ ID NO: 3679131 - RNA, 14 nt, Salmonella enterica enterica serovar Typhi Ty2
uuccaguaauuuca

SEQ ID NO: 3679132 - RNA, 18 nt, Salmonella enterica enterica serovar Typhi Ty2
uuccaguagucgcgccau

SEQ ID NO: 3679133 - RNA, 13 nt, Salmonella enterica enterica serovar Typhi Ty2
uuccaguccacgu

SEQ ID NO: 3679134 - RNA, 20 nt, Salmonella enterica enterica serovar Typhi Ty2
uuccaguugcgcuacuuuau

SEQ ID NO: 3679135 - RNA, 17 nt, Salmonella enterica enterica serovar Typhi Ty2
uuccaguugcggcauca

SEQ ID NO: 3679136 - RNA, 15 nt, Salmonella enterica enterica serovar Typhi Ty2
uuccaguuucucaaa

SEQ ID NO: 3679137 - RNA, 17 nt, Salmonella enterica enterica serovar Typhi Ty2
uuccaguuucucaaaca

SEQ ID NO: 3679138 - RNA, 16 nt, Salmonella enterica enterica serovar Typhi Ty2
uuccaucagccaggcg

SEQ ID NO: 3679139 - RNA, 19 nt, Salmonella enterica enterica serovar Typhi Ty2
uuccauggcaaaauucgua

SEQ ID NO: 3679140 - RNA, 17 nt, Salmonella enterica enterica serovar Typhi Ty2
uuccauuagcuguuguu

SEQ ID NO: 3679141 - RNA, 14 nt, Salmonella enterica enterica serovar Typhi Ty2
uuccauucacacaa

SEQ ID NO: 3679142 - RNA, 19 nt, Salmonella enterica enterica serovar Typhi Ty2
uuccauucggcgaaagaag

SEQ ID NO: 3679143 - RNA, 13 nt, Salmonella enterica enterica serovar Typhi Ty2
uuccauuuuucag

SEQ ID NO: 3679144 - RNA, 19 nt, Salmonella enterica enterica serovar Typhi Ty2
uucccaacaaugccacgcc

SEQ ID NO: 3679145 - RNA, 15 nt, Salmonella enterica enterica serovar Typhi Ty2
uucccaacuguauuu

SEQ ID NO: 3679146 - RNA, 16 nt, Salmonella enterica enterica serovar Typhi Ty2
uucccaagucacgccc

SEQ ID NO: 3679147 - RNA, 14 nt, Salmonella enterica enterica serovar Typhi Ty2
uucccaauaguuua

SEQ ID NO: 3679148 - RNA, 14 nt, Salmonella enterica enterica serovar Typhi Ty2
uucccacagucggc

SEQ ID NO: 3679149 - RNA, 16 nt, Salmonella enterica enterica serovar Typhi Ty2
uucccacuccgcccag

SEQ ID NO: 3679150 - RNA, 14 nt, Salmonella enterica enterica serovar Typhi Ty2
uucccacugcgccg

SEQ ID NO: 3679151 - RNA, 12 nt, Salmonella enterica enterica serovar Typhi Ty2
uucccagcgccc

SEQ ID NO: 3679152 - RNA, 18 nt, Salmonella enterica enterica serovar Typhi Ty2
uucccagcgggaacauca

SEQ ID NO: 3679153 - RNA, 14 nt, Salmonella enterica enterica serovar Typhi Ty2
uucccaucgcuuug

SEQ ID NO: 3679154 - RNA, 16 nt, Salmonella enterica enterica serovar Typhi Ty2
uucccaucgcuuugca

SEQ ID NO: 3679155 - RNA, 20 nt, Salmonella enterica enterica serovar Typhi Ty2
uucccaucgcuuugcagaaa

SEQ ID NO: 3679156 - RNA, 23 nt, Salmonella enterica enterica serovar Typhi Ty2
uucccauugggccagcagcgcau

SEQ ID NO: 3679157 - RNA, 19 nt, Salmonella enterica enterica serovar Typhi Ty2
uuccccaaugaucaauggc

SEQ ID NO: 3679158 - RNA, 15 nt, Salmonella enterica enterica serovar Typhi Ty2
uuccccaccaggaau

SEQ ID NO: 3679159 - RNA, 14 nt, Salmonella enterica enterica serovar Typhi Ty2
uuccccacgccauc

SEQ ID NO: 3679160 - RNA, 17 nt, Salmonella enterica enterica serovar Typhi Ty2
uucccccauccgcgccg

SEQ ID NO: 3679161 - RNA, 15 nt, Salmonella enterica enterica serovar Typhi Ty2
uuccccgaguaacac

SEQ ID NO: 3679162 - RNA, 20 nt, Salmonella enterica enterica serovar Typhi Ty2
uuccccgaucagaaaaccuu

SEQ ID NO: 3679163 - RNA, 19 nt, Salmonella enterica enterica serovar Typhi Ty2
uuccccgccgcacacgccg

SEQ ID NO: 3679164 - RNA, 12 nt, Salmonella enterica enterica serovar Typhi Ty2
uuccccguggcc

SEQ ID NO: 3679165 - RNA, 15 nt, Salmonella enterica enterica serovar Typhi Ty2
uuccccugccagacg

SEQ ID NO: 3679166 - RNA, 20 nt, Salmonella enterica enterica serovar Typhi Ty2
uuccccuuuaggcggcgccg

SEQ ID NO: 3679167 - RNA, 14 nt, Salmonella enterica enterica serovar Typhi Ty2
uucccgaaaggaag

SEQ ID NO: 3679168 - RNA, 11 nt, Salmonella enterica enterica serovar Typhi Ty2
uucccgagcgg

SEQ ID NO: 3679169 - RNA, 16 nt, Salmonella enterica enterica serovar Typhi Ty2
uucccgauuccguguc

SEQ ID NO: 3679170 - RNA, 23 nt, Salmonella enterica enterica serovar Typhi Ty2
uucccgcaccgcgaugcugcucu

SEQ ID NO: 3679171 - RNA, 16 nt, Salmonella enterica enterica serovar Typhi Ty2
uucccgccgcaauucc

SEQ ID NO: 3679172 - RNA, 13 nt, Salmonella enterica enterica serovar Typhi Ty2
uucccgcgccagc

SEQ ID NO: 3679173 - RNA, 17 nt, Salmonella enterica enterica serovar Typhi Ty2
uucccgcgccagcgucg

SEQ ID NO: 3679174 - RNA, 17 nt, Salmonella enterica enterica serovar Typhi Ty2
uucccgcuauagaaugc

SEQ ID NO: 3679175 - RNA, 23 nt, Salmonella enterica enterica serovar Typhi Ty2
uucccgcuauagaaugcaagcag

SEQ ID NO: 3679176 - RNA, 13 nt, Salmonella enterica enterica serovar Typhi Ty2
uucccgcuggcug

SEQ ID NO: 3679177 - RNA, 17 nt, Salmonella enterica enterica serovar Typhi Ty2
uucccgcugguugccuu

SEQ ID NO: 3679178 - RNA, 15 nt, Salmonella enterica enterica serovar Typhi Ty2
uucccggaaaaguau

SEQ ID NO: 3679179 - RNA, 15 nt, Salmonella enterica enterica serovar Typhi Ty2
uucccggaucgcuaa

SEQ ID NO: 3679180 - RNA, 16 nt, Salmonella enterica enterica serovar Typhi Ty2
uucccugacgcgcagc

SEQ ID NO: 3679181 - RNA, 15 nt, Salmonella enterica enterica serovar Typhi Ty2
uucccuuaucugcaa

SEQ ID NO: 3679182 - RNA, 16 nt, Salmonella enterica enterica serovar Typhi Ty2
uucccuuccagcgacg

SEQ ID NO: 3679183 - RNA, 15 nt, Salmonella enterica enterica serovar Typhi Ty2
uuccgcaauacagcc

SEQ ID NO: 3679184 - RNA, 22 nt, Salmonella enterica enterica serovar Typhi Ty2
uuccgcagccaacaacaggccg

SEQ ID NO: 3679185 - RNA, 14 nt, Salmonella enterica enterica serovar Typhi Ty2
uuccgcagccagaa

SEQ ID NO: 3679186 - RNA, 20 nt, Salmonella enterica enterica serovar Typhi Ty2
uuccgcaggggauucugcca

SEQ ID NO: 3679187 - RNA, 16 nt, Salmonella enterica enterica serovar Typhi Ty2
uuccgccaccacgccc

SEQ ID NO: 3679188 - RNA, 19 nt, Salmonella enterica enterica serovar Typhi Ty2
uuccgccaccagauaguca

SEQ ID NO: 3679189 - RNA, 14 nt, Salmonella enterica enterica serovar Typhi Ty2
uuccgccagacuca

SEQ ID NO: 3679190 - RNA, 21 nt, Salmonella enterica enterica serovar Typhi Ty2
uuccgccagcgccagcagcag

SEQ ID NO: 3679191 - RNA, 19 nt, Salmonella enterica enterica serovar Typhi Ty2
uuccgccaugaaaaaaacg

SEQ ID NO: 3679192 - RNA, 16 nt, Salmonella enterica enterica serovar Typhi Ty2
uuccgcccaagaacau

SEQ ID NO: 3679193 - RNA, 13 nt, Salmonella enterica enterica serovar Typhi Ty2
uuccgccccgccu

SEQ ID NO: 3679194 - RNA, 19 nt, Salmonella enterica enterica serovar Typhi Ty2
uuccgccgcgguauucaua

SEQ ID NO: 3679195 - RNA, 14 nt, Salmonella enterica enterica serovar Typhi Ty2
uuccgcgcaaauac

SEQ ID NO: 3679196 - RNA, 20 nt, Salmonella enterica enterica serovar Typhi Ty2
uuccgcggagagaucgacag

SEQ ID NO: 3679197 - RNA, 15 nt, Salmonella enterica enterica serovar Typhi Ty2
uuccgcuggaauaaa

SEQ ID NO: 3679198 - RNA, 15 nt, Salmonella enterica enterica serovar Typhi Ty2
uuccgcuuccagaau

SEQ ID NO: 3679199 - RNA, 18 nt, Salmonella enterica enterica serovar Typhi Ty2
uuccgcuuuuccugccag

SEQ ID NO: 3679200 - RNA, 14 nt, Salmonella enterica enterica serovar Typhi Ty2
uuccggauaacgcg

SEQ ID NO: 3679201 - RNA, 12 nt, Salmonella enterica enterica serovar Typhi Ty2
uuccggcagacg

SEQ ID NO: 3679202 - RNA, 16 nt, Salmonella enterica enterica serovar Typhi Ty2
uuccggcgaaaaaccg

SEQ ID NO: 3679203 - RNA, 17 nt, Salmonella enterica enterica serovar Typhi Ty2
uuccggcggucagccag

SEQ ID NO: 3679204 - RNA, 18 nt, Salmonella enterica enterica serovar Typhi Ty2
uuccggcggucagccagc

SEQ ID NO: 3679205 - RNA, 17 nt, Salmonella enterica enterica serovar Typhi Ty2
uuccggcucgccaaacg

SEQ ID NO: 3679206 - RNA, 22 nt, Salmonella enterica enterica serovar Typhi Ty2
uuccggcuucguuaagcgguuu

SEQ ID NO: 3679207 - RNA, 14 nt, Salmonella enterica enterica serovar Typhi Ty2
uuccggugugacca

SEQ ID NO: 3679208 - RNA, 14 nt, Salmonella enterica enterica serovar Typhi Ty2
uuccgguuccggcg

SEQ ID NO: 3679209 - RNA, 14 nt, Salmonella enterica enterica serovar Typhi Ty2
uuccgucaugguga

SEQ ID NO: 3679210 - RNA, 23 nt, Salmonella enterica enterica serovar Typhi Ty2
uuccguuaauggaggcagugaaa

SEQ ID NO: 3679211 - RNA, 13 nt, Salmonella enterica enterica serovar Typhi Ty2
uuccguuagcucu

SEQ ID NO: 3679212 - RNA, 15 nt, Salmonella enterica enterica serovar Typhi Ty2
uuccuaacccuucau

SEQ ID NO: 3679213 - RNA, 16 nt, Salmonella enterica enterica serovar Typhi Ty2
uuccucagaaagcguu

SEQ ID NO: 3679214 - RNA, 12 nt, Salmonella enterica enterica serovar Typhi Ty2
uuccucccggug

SEQ ID NO: 3679215 - RNA, 20 nt, Salmonella enterica enterica serovar Typhi Ty2
uuccucuaaaugggcaggag

SEQ ID NO: 3679216 - RNA, 17 nt, Salmonella enterica enterica serovar Typhi Ty2
uuccugaguuuaugagg

SEQ ID NO: 3679217 - RNA, 16 nt, Salmonella enterica enterica serovar Typhi Ty2
uuccugauuaauauga

SEQ ID NO: 3679218 - RNA, 21 nt, Salmonella enterica enterica serovar Typhi Ty2
uuccugcgcugucaccagcag

SEQ ID NO: 3679219 - RNA, 21 nt, Salmonella enterica enterica serovar Typhi Ty2
uuccuggauguccgacgccgc

SEQ ID NO: 3679220 - RNA, 14 nt, Salmonella enterica enterica serovar Typhi Ty2
uuccuggcuugcca

SEQ ID NO: 3679221 - RNA, 11 nt, Salmonella enterica enterica serovar Typhi Ty2
uuccugucaac

SEQ ID NO: 3679222 - RNA, 12 nt, Salmonella enterica enterica serovar Typhi Ty2
uuccuuccggcg

SEQ ID NO: 3679223 - RNA, 16 nt, Salmonella enterica enterica serovar Typhi Ty2
uuccuuguuccaccug

SEQ ID NO: 3679224 - RNA, 12 nt, Salmonella enterica enterica serovar Typhi Ty2
uuccuuucugcg

SEQ ID NO: 3679225 - RNA, 15 nt, Salmonella enterica enterica serovar Typhi Ty2
uuccuuugccuuucu

SEQ ID NO: 3679226 - RNA, 12 nt, Salmonella enterica enterica serovar Typhi Ty2
uuccuuuuucag

SEQ ID NO: 3679227 - RNA, 18 nt, Salmonella enterica enterica serovar Typhi Ty2
uucgaaacaggaaaaaca

SEQ ID NO: 3679228 - RNA, 16 nt, Salmonella enterica enterica serovar Typhi Ty2
uucgaaccugcgacca

SEQ ID NO: 3679229 - RNA, 22 nt, Salmonella enterica enterica serovar Typhi Ty2
uucgaacgaaaaaagcgccccu

SEQ ID NO: 3679230 - RNA, 18 nt, Salmonella enterica enterica serovar Typhi Ty2
uucgaacgccgacaucac

SEQ ID NO: 3679231 - RNA, 22 nt, Salmonella enterica enterica serovar Typhi Ty2
uucgacaagaagauuucuuaau

SEQ ID NO: 3679232 - RNA, 21 nt, Salmonella enterica enterica serovar Typhi Ty2
uucgacaauguccgccagacu

SEQ ID NO: 3679233 - RNA, 12 nt, Salmonella enterica enterica serovar Typhi Ty2
uucgacaucuuc

SEQ ID NO: 3679234 - RNA, 22 nt, Salmonella enterica enterica serovar Typhi Ty2
uucgaccccaaccgagcagcuu

SEQ ID NO: 3679235 - RNA, 23 nt, Salmonella enterica enterica serovar Typhi Ty2
uucgaccgacgcguuuuccagca

SEQ ID NO: 3679236 - RNA, 16 nt, Salmonella enterica enterica serovar Typhi Ty2
uucgacgauaaaaaaa

SEQ ID NO: 3679237 - RNA, 16 nt, Salmonella enterica enterica serovar Typhi Ty2
uucgacggagauuaac

SEQ ID NO: 3679238 - RNA, 23 nt, Salmonella enterica enterica serovar Typhi Ty2
uucgacgggacgaauuuccagcg

SEQ ID NO: 3679239 - RNA, 13 nt, Salmonella enterica enterica serovar Typhi Ty2
uucgacuguuguu

SEQ ID NO: 3679240 - RNA, 23 nt, Salmonella enterica enterica serovar Typhi Ty2
uucgauaaacucaaucaggcuau

SEQ ID NO: 3679241 - RNA, 17 nt, Salmonella enterica enterica serovar Typhi Ty2
uucgauaaccaccagcg

SEQ ID NO: 3679242 - RNA, 21 nt, Salmonella enterica enterica serovar Typhi Ty2
uucgauagcguuuuccagcuc

SEQ ID NO: 3679243 - RNA, 15 nt, Salmonella enterica enterica serovar Typhi Ty2
uucgaugaaaaagag

SEQ ID NO: 3679244 - RNA, 14 nt, Salmonella enterica enterica serovar Typhi Ty2
uucgaugcgcucau

SEQ ID NO: 3679245 - RNA, 20 nt, Salmonella enterica enterica serovar Typhi Ty2
uucgauuguugacugccagc

SEQ ID NO: 3679246 - RNA, 21 nt, Salmonella enterica enterica serovar Typhi Ty2
uucgcaaccuaaccaaacaga

SEQ ID NO: 3679247 - RNA, 18 nt, Salmonella enterica enterica serovar Typhi Ty2
uucgcagcgauauuucuc

SEQ ID NO: 3679248 - RNA, 19 nt, Salmonella enterica enterica serovar Typhi Ty2
uucgcauguugacugcgcu

SEQ ID NO: 3679249 - RNA, 22 nt, Salmonella enterica enterica serovar Typhi Ty2
uucgccaaagcagugaaucccc

SEQ ID NO: 3679250 - RNA, 17 nt, Salmonella enterica enterica serovar Typhi Ty2
uucgccacgcucacuuu

SEQ ID NO: 3679251 - RNA, 19 nt, Salmonella enterica enterica serovar Typhi Ty2
uucgccagcgcaucgauau

SEQ ID NO: 3679252 - RNA, 22 nt, Salmonella enterica enterica serovar Typhi Ty2
uucgccauucccgcgacgucaa

SEQ ID NO: 3679253 - RNA, 13 nt, Salmonella enterica enterica serovar Typhi Ty2
uucgcccacgccc

SEQ ID NO: 3679254 - RNA, 13 nt, Salmonella enterica enterica serovar Typhi Ty2
uucgcccagucau

SEQ ID NO: 3679255 - RNA, 14 nt, Salmonella enterica enterica serovar Typhi Ty2
uucgcccagucauc

SEQ ID NO: 3679256 - RNA, 19 nt, Salmonella enterica enterica serovar Typhi Ty2
uucgcccauugccacccau

SEQ ID NO: 3679257 - RNA, 14 nt, Salmonella enterica enterica serovar Typhi Ty2
uucgcccggcagga

SEQ ID NO: 3679258 - RNA, 16 nt, Salmonella enterica enterica serovar Typhi Ty2
uucgcccggcgccagc

SEQ ID NO: 3679259 - RNA, 16 nt, Salmonella enterica enterica serovar Typhi Ty2
uucgccgucaccugaa

SEQ ID NO: 3679260 - RNA, 17 nt, Salmonella enterica enterica serovar Typhi Ty2
uucgccucccucacccu

SEQ ID NO: 3679261 - RNA, 14 nt, Salmonella enterica enterica serovar Typhi Ty2
uucgccugaacagg

SEQ ID NO: 3679262 - RNA, 18 nt, Salmonella enterica enterica serovar Typhi Ty2
uucgcgaaucgcuucacg

SEQ ID NO: 3679263 - RNA, 17 nt, Salmonella enterica enterica serovar Typhi Ty2
uucgcgaugcucaacca

SEQ ID NO: 3679264 - RNA, 18 nt, Salmonella enterica enterica serovar Typhi Ty2
uuacacugauaccccagc

SEQ ID NO: 3679265 - RNA, 19 nt, Salmonella enterica enterica serovar Typhi Ty2
uuacacugauaccccagcg

SEQ ID NO: 3679266 - RNA, 22 nt, Salmonella enterica enterica serovar Typhi Ty2
uuacaggcauccgugaccugcu

SEQ ID NO: 3679267 - RNA, 19 nt, Salmonella enterica enterica serovar Typhi Ty2
uuacaggccggacaggcga

SEQ ID NO: 3679268 - RNA, 20 nt, Salmonella enterica enterica serovar Typhi Ty2
uuacaggcgcaucagaaaaa

SEQ ID NO: 3679269 - RNA, 12 nt, Salmonella enterica enterica serovar Typhi Ty2
uuacaggcugga

SEQ ID NO: 3679270 - RNA, 23 nt, Salmonella enterica enterica serovar Typhi Ty2
uuacaggugccuggguuccaggc

SEQ ID NO: 3679271 - RNA, 15 nt, Salmonella enterica enterica serovar Typhi Ty2
uuacaucaauaaaca

SEQ ID NO: 3679272 - RNA, 15 nt, Salmonella enterica enterica serovar Typhi Ty2
uuacauuuuccaugc

SEQ ID NO: 3679273 - RNA, 14 nt, Salmonella enterica enterica serovar Typhi Ty2
uuaccaaucugcgu

SEQ ID NO: 3679274 - RNA, 18 nt, Salmonella enterica enterica serovar Typhi Ty2
uuaccacgguaacgccuu

SEQ ID NO: 3679275 - RNA, 22 nt, Salmonella enterica enterica serovar Typhi Ty2
uuaccagaccggcaucucaucu

SEQ ID NO: 3679276 - RNA, 21 nt, Salmonella enterica enterica serovar Typhi Ty2
uuaccaguugaccaaacagca

SEQ ID NO: 3679277 - RNA, 13 nt, Salmonella enterica enterica serovar Typhi Ty2
uuacccacuguau

SEQ ID NO: 3679278 - RNA, 13 nt, Salmonella enterica enterica serovar Typhi Ty2
uuacccagccuga

SEQ ID NO: 3679279 - RNA, 20 nt, Salmonella enterica enterica serovar Typhi Ty2
uuacccauacaguacagacu

SEQ ID NO: 3679280 - RNA, 18 nt, Salmonella enterica enterica serovar Typhi Ty2
uuacccgggccaucuuuu

SEQ ID NO: 3679281 - RNA, 20 nt, Salmonella enterica enterica serovar Typhi Ty2
uuacccuucagauaucccau

SEQ ID NO: 3679282 - RNA, 18 nt, Salmonella enterica enterica serovar Typhi Ty2
uuacccuucaugcagccc

SEQ ID NO: 3679283 - RNA, 14 nt, Salmonella enterica enterica serovar Typhi Ty2
uuaccgcaucgccc

SEQ ID NO: 3679284 - RNA, 20 nt, Salmonella enterica enterica serovar Typhi Ty2
uuaccgccagauggcgucac

SEQ ID NO: 3679285 - RNA, 15 nt, Salmonella enterica enterica serovar Typhi Ty2
uuaccgccagcggcg

SEQ ID NO: 3679286 - RNA, 15 nt, Salmonella enterica enterica serovar Typhi Ty2
uuaccggcuggaagc

SEQ ID NO: 3679287 - RNA, 20 nt, Salmonella enterica enterica serovar Typhi Ty2
uuaccgggcaaacggcacua

SEQ ID NO: 3679288 - RNA, 14 nt, Salmonella enterica enterica serovar Typhi Ty2
uuaccgggcaucug

SEQ ID NO: 3679289 - RNA, 13 nt, Salmonella enterica enterica serovar Typhi Ty2
uuaccguaaaaug

SEQ ID NO: 3679290 - RNA, 21 nt, Salmonella enterica enterica serovar Typhi Ty2
uuaccguaaaaugcuggugca

SEQ ID NO: 3679291 - RNA, 20 nt, Salmonella enterica enterica serovar Typhi Ty2
uuaccguaucccaccauaaa

SEQ ID NO: 3679292 - RNA, 19 nt, Salmonella enterica enterica serovar Typhi Ty2
uuaccguaugcaaaaggca

SEQ ID NO: 3679293 - RNA, 13 nt, Salmonella enterica enterica serovar Typhi Ty2
uuaccuaccaguu

SEQ ID NO: 3679294 - RNA, 19 nt, Salmonella enterica enterica serovar Typhi Ty2
uuaccuacgcgauaaaaaa

SEQ ID NO: 3679295 - RNA, 23 nt, Salmonella enterica enterica serovar Typhi Ty2
uuaccuucauuguccucggcaac

SEQ ID NO: 3679296 - RNA, 16 nt, Salmonella enterica enterica serovar Typhi Ty2
uuaccuuguucuucca

SEQ ID NO: 3679297 - RNA, 17 nt, Salmonella enterica enterica serovar Typhi Ty2
uuaccuuguucuuccau

SEQ ID NO: 3679298 - RNA, 22 nt, Salmonella enterica enterica serovar Typhi Ty2
uuacgaccgcagaaacagauag

SEQ ID NO: 3679299 - RNA, 21 nt, Salmonella enterica enterica serovar Typhi Ty2
uuacgacgauaaggccaauau

SEQ ID NO: 3679300 - RNA, 20 nt, Salmonella enterica enterica serovar Typhi Ty2
uuacgagugcguucuuccac

SEQ ID NO: 3679301 - RNA, 17 nt, Salmonella enterica enterica serovar Typhi Ty2
uuacgcacgccagauaa

SEQ ID NO: 3679302 - RNA, 13 nt, Salmonella enterica enterica serovar Typhi Ty2
uuacgcacuuuua

SEQ ID NO: 3679303 - RNA, 18 nt, Salmonella enterica enterica serovar Typhi Ty2
uuacgcagcaagaacaga

SEQ ID NO: 3679304 - RNA, 13 nt, Salmonella enterica enterica serovar Typhi Ty2
uuacgcaggcuug

SEQ ID NO: 3679305 - RNA, 20 nt, Salmonella enterica enterica serovar Typhi Ty2
uuacgccauaaaaagcguac

SEQ ID NO: 3679306 - RNA, 19 nt, Salmonella enterica enterica serovar Typhi Ty2
uuacgcguuacgcccugug

SEQ ID NO: 3679307 - RNA, 17 nt, Salmonella enterica enterica serovar Typhi Ty2
uuacgcuauagcuauca

SEQ ID NO: 3679308 - RNA, 21 nt, Salmonella enterica enterica serovar Typhi Ty2
uuacgcucgucaaacaguuca

SEQ ID NO: 3679309 - RNA, 19 nt, Salmonella enterica enterica serovar Typhi Ty2
uuacgcugguuugugugca

SEQ ID NO: 3679310 - RNA, 23 nt, Salmonella enterica enterica serovar Typhi Ty2
uuacgcuuaauggcgucaaucaa

SEQ ID NO: 3679311 - RNA, 18 nt, Salmonella enterica enterica serovar Typhi Ty2
uuacgcuuccugccguga

SEQ ID NO: 3679312 - RNA, 15 nt, Salmonella enterica enterica serovar Typhi Ty2
uuacggaaaaaauac

SEQ ID NO: 3679313 - RNA, 14 nt, Salmonella enterica enterica serovar Typhi Ty2
uuacggacugcggc

SEQ ID NO: 3679314 - RNA, 16 nt, Salmonella enterica enterica serovar Typhi Ty2
uuauauucuucgccca

SEQ ID NO: 3679315 - RNA, 24 nt, Salmonella enterica enterica serovar Typhi Ty2
uuauauugcguaaaaacccuuuca

SEQ ID NO: 3679316 - RNA, 12 nt, Salmonella enterica enterica serovar Typhi Ty2
uuauauuuaaaa

SEQ ID NO: 3679317 - RNA, 16 nt, Salmonella enterica enterica serovar Typhi Ty2
uuauauuuaaaauucc

SEQ ID NO: 3679318 - RNA, 19 nt, Salmonella enterica enterica serovar Typhi Ty2
uuaucaacaaauuccggca

SEQ ID NO: 3679319 - RNA, 14 nt, Salmonella enterica enterica serovar Typhi Ty2
uuaucaagccuaca

SEQ ID NO: 3679320 - RNA, 23 nt, Salmonella enterica enterica serovar Typhi Ty2
uuaucaccaaguagacagagaag

SEQ ID NO: 3679321 - RNA, 23 nt, Salmonella enterica enterica serovar Typhi Ty2
uuaucacugguuauaugaauaaa

SEQ ID NO: 3679322 - RNA, 21 nt, Salmonella enterica enterica serovar Typhi Ty2
uuaucaggccgacaaaugacg

SEQ ID NO: 3679323 - RNA, 11 nt, Salmonella enterica enterica serovar Typhi Ty2
uuaucaggccu

SEQ ID NO: 3679324 - RNA, 19 nt, Salmonella enterica enterica serovar Typhi Ty2
uuaucaggccuacauccgg

SEQ ID NO: 3679325 - RNA, 21 nt, Salmonella enterica enterica serovar Typhi Ty2
uuaucaggccuaccaucgcgc

SEQ ID NO: 3679326 - RNA, 21 nt, Salmonella enterica enterica serovar Typhi Ty2
uuaucaggcgacccauaacgg

SEQ ID NO: 3679327 - RNA, 13 nt, Salmonella enterica enterica serovar Typhi Ty2
uuaucaugcgcca

SEQ ID NO: 3679328 - RNA, 16 nt, Salmonella enterica enterica serovar Typhi Ty2
uuaucauucacuuuca

SEQ ID NO: 3679329 - RNA, 14 nt, Salmonella enterica enterica serovar Typhi Ty2
uuauccaaauccuu

SEQ ID NO: 3679330 - RNA, 11 nt, Salmonella enterica enterica serovar Typhi Ty2
uuauccagcaa

SEQ ID NO: 3679331 - RNA, 17 nt, Salmonella enterica enterica serovar Typhi Ty2
uuauccauguuuguuua

SEQ ID NO: 3679332 - RNA, 18 nt, Salmonella enterica enterica serovar Typhi Ty2
uuauccgcagauccagca

SEQ ID NO: 3679333 - RNA, 21 nt, Salmonella enterica enterica serovar Typhi Ty2
uuauccgccagcgcaacgcgc

SEQ ID NO: 3679334 - RNA, 14 nt, Salmonella enterica enterica serovar Typhi Ty2
uuauccggccuaca

SEQ ID NO: 3679335 - RNA, 18 nt, Salmonella enterica enterica serovar Typhi Ty2
uuauccggccuacgcuua

SEQ ID NO: 3679336 - RNA, 22 nt, Salmonella enterica enterica serovar Typhi Ty2
uuauccggcuuacggcuauucc

SEQ ID NO: 3679337 - RNA, 16 nt, Salmonella enterica enterica serovar Typhi Ty2
uuauccguuauuuaau

SEQ ID NO: 3679338 - RNA, 16 nt, Salmonella enterica enterica serovar Typhi Ty2
uuauccuccagccagc

SEQ ID NO: 3679339 - RNA, 22 nt, Salmonella enterica enterica serovar Typhi Ty2
uuauccuccgaacaggcguuug

SEQ ID NO: 3679340 - RNA, 17 nt, Salmonella enterica enterica serovar Typhi Ty2
uuauccugcaaauagcg

SEQ ID NO: 3679341 - RNA, 13 nt, Salmonella enterica enterica serovar Typhi Ty2
uuauccugcacga

SEQ ID NO: 3679342 - RNA, 22 nt, Salmonella enterica enterica serovar Typhi Ty2
uuaucgaaauagcggugaacuu

SEQ ID NO: 3679343 - RNA, 13 nt, Salmonella enterica enterica serovar Typhi Ty2
uuaucgacgcuau

SEQ ID NO: 3679344 - RNA, 15 nt, Salmonella enterica enterica serovar Typhi Ty2
uuaucgccaaagaua

SEQ ID NO: 3679345 - RNA, 17 nt, Salmonella enterica enterica serovar Typhi Ty2
uuaucgccgaucacaaa

SEQ ID NO: 3679346 - RNA, 13 nt, Salmonella enterica enterica serovar Typhi Ty2
uuaucgccugggg

SEQ ID NO: 3679347 - RNA, 16 nt, Salmonella enterica enterica serovar Typhi Ty2
uuaucgcgcuggcagu

SEQ ID NO: 3679348 - RNA, 12 nt, Salmonella enterica enterica serovar Typhi Ty2
uuaucgcuauca

SEQ ID NO: 3679349 - RNA, 23 nt, Salmonella enterica enterica serovar Typhi Ty2
uuaucgggccuacgagauaaaaa

SEQ ID NO: 3679350 - RNA, 21 nt, Salmonella enterica enterica serovar Typhi Ty2
uuaucgguaaugauaucgccc

SEQ ID NO: 3679351 - RNA, 19 nt, Salmonella enterica enterica serovar Typhi Ty2
uuaucuggcgcaaccggcg

SEQ ID NO: 3679352 - RNA, 17 nt, Salmonella enterica enterica serovar Typhi Ty2
uuaucuguaauuauaaa

SEQ ID NO: 3679353 - RNA, 11 nt, Salmonella enterica enterica serovar Typhi Ty2
uuaucuuccac

SEQ ID NO: 3679354 - RNA, 20 nt, Salmonella enterica enterica serovar Typhi Ty2
uuaucuuccacgguaaaaca

SEQ ID NO: 3679355 - RNA, 13 nt, Salmonella enterica enterica serovar Typhi Ty2
uuaucuuccggca

SEQ ID NO: 3679356 - RNA, 18 nt, Salmonella enterica enterica serovar Typhi Ty2
uuaucuucggucgagcuu

SEQ ID NO: 3679357 - RNA, 20 nt, Salmonella enterica enterica serovar Typhi Ty2
uuaucuugagucaaaagauu

SEQ ID NO: 3679358 - RNA, 16 nt, Salmonella enterica enterica serovar Typhi Ty2
uuaucuuuaaauuuca

SEQ ID NO: 3679359 - RNA, 22 nt, Salmonella enterica enterica serovar Typhi Ty2
uuaucuuuaccagggaauauga

SEQ ID NO: 3679360 - RNA, 17 nt, Salmonella enterica enterica serovar Typhi Ty2
uuaucuuuuacgcuguc

SEQ ID NO: 3679361 - RNA, 14 nt, Salmonella enterica enterica serovar Typhi Ty2
uuaugaaugacagu

SEQ ID NO: 3679362 - RNA, 19 nt, Salmonella enterica enterica serovar Typhi Ty2
uuaugaccauacugcucaa

SEQ ID NO: 3679363 - RNA, 16 nt, Salmonella enterica enterica serovar Typhi Ty2
uuaugacggggaacag

SEQ ID NO: 3679364 - RNA, 17 nt, Salmonella enterica enterica serovar Typhi Ty2
uuaugauuuuaacauca

SEQ ID NO: 3679365 - RNA, 13 nt, Salmonella enterica enterica serovar Typhi Ty2
uuaugcacgcuau

SEQ ID NO: 3679366 - RNA, 13 nt, Salmonella enterica enterica serovar Typhi Ty2
uuaugcaguuccg

SEQ ID NO: 3679367 - RNA, 20 nt, Salmonella enterica enterica serovar Typhi Ty2
uuaugcaucuggucagguga

SEQ ID NO: 3679368 - RNA, 17 nt, Salmonella enterica enterica serovar Typhi Ty2
uuaugccccauauaagg

SEQ ID NO: 3679369 - RNA, 11 nt, Salmonella enterica enterica serovar Typhi Ty2
uuaugccucuu

SEQ ID NO: 3679370 - RNA, 18 nt, Salmonella enterica enterica serovar Typhi Ty2
uuaugcggcgcuuccaga

SEQ ID NO: 3679371 - RNA, 15 nt, Salmonella enterica enterica serovar Typhi Ty2
uuaugcgguucuccc

SEQ ID NO: 3679372 - RNA, 21 nt, Salmonella enterica enterica serovar Typhi Ty2
uuaugcgucaaaguugcauca

SEQ ID NO: 3679373 - RNA, 22 nt, Salmonella enterica enterica serovar Typhi Ty2
uuaugcgucaaaguugcaucaa

SEQ ID NO: 3679374 - RNA, 22 nt, Salmonella enterica enterica serovar Typhi Ty2
uuaugcguuuuuaucuuucuuu

SEQ ID NO: 3679375 - RNA, 14 nt, Salmonella enterica enterica serovar Typhi Ty2
uuaugcugccagcg

SEQ ID NO: 3679376 - RNA, 16 nt, Salmonella enterica enterica serovar Typhi Ty2
uuaugggaggauacug

SEQ ID NO: 3679377 - RNA, 23 nt, Salmonella enterica enterica serovar Typhi Ty2
uuauguagccagccauggcccuu

SEQ ID NO: 3679378 - RNA, 15 nt, Salmonella enterica enterica serovar Typhi Ty2
uuaugucauuuauuu

SEQ ID NO: 3679379 - RNA, 17 nt, Salmonella enterica enterica serovar Typhi Ty2
uuauguuugcugauaag

SEQ ID NO: 3679380 - RNA, 18 nt, Salmonella enterica enterica serovar Typhi Ty2
uuauuaaagccccuuccu

SEQ ID NO: 3679381 - RNA, 13 nt, Salmonella enterica enterica serovar Typhi Ty2
uuauuaacgugcu

SEQ ID NO: 3679382 - RNA, 14 nt, Salmonella enterica enterica serovar Typhi Ty2
uuauuacagacagu

SEQ ID NO: 3679383 - RNA, 12 nt, Salmonella enterica enterica serovar Typhi Ty2
uuauuaccaaug

SEQ ID NO: 3679384 - RNA, 20 nt, Salmonella enterica enterica serovar Typhi Ty2
uuauuacgcaagaucacaua

SEQ ID NO: 3679385 - RNA, 22 nt, Salmonella enterica enterica serovar Typhi Ty2
uuauuauagcuauggucacuuu

SEQ ID NO: 3679386 - RNA, 12 nt, Salmonella enterica enterica serovar Typhi Ty2
uuauucaucgau

SEQ ID NO: 3679387 - RNA, 15 nt, Salmonella enterica enterica serovar Typhi Ty2
uuauucaucuccucu

SEQ ID NO: 3679388 - RNA, 15 nt, Salmonella enterica enterica serovar Typhi Ty2
uuauuccgaauacgg

SEQ ID NO: 3679389 - RNA, 19 nt, Salmonella enterica enterica serovar Typhi Ty2
uuauuccuuaucacauuuu

SEQ ID NO: 3679390 - RNA, 23 nt, Salmonella enterica enterica serovar Typhi Ty2
uuauucgccuuucacgcguucaa

SEQ ID NO: 3679391 - RNA, 17 nt, Salmonella enterica enterica serovar Typhi Ty2
uuauucggucagauaaa

SEQ ID NO: 3679392 - RNA, 20 nt, Salmonella enterica enterica serovar Typhi Ty2
uuauucggucagauaaauaa

SEQ ID NO: 3679393 - RNA, 23 nt, Salmonella enterica enterica serovar Typhi Ty2
uuauugaccaucgccagccauuc

SEQ ID NO: 3679394 - RNA, 15 nt, Salmonella enterica enterica serovar Typhi Ty2
uuauugagauaauuu

SEQ ID NO: 3679395 - RNA, 17 nt, Salmonella enterica enterica serovar Typhi Ty2
uuauugaguuaccguuu

SEQ ID NO: 3679396 - RNA, 18 nt, Salmonella enterica enterica serovar Typhi Ty2
uuauugccacgccauacg

SEQ ID NO: 3679397 - RNA, 22 nt, Salmonella enterica enterica serovar Typhi Ty2
uuauugcuguaggcacuuucca

SEQ ID NO: 3679398 - RNA, 11 nt, Salmonella enterica enterica serovar Typhi Ty2
uuauugugcac

SEQ ID NO: 3679399 - RNA, 22 nt, Salmonella enterica enterica serovar Typhi Ty2
uuauuuaaaaaggaaagauuac

SEQ ID NO: 3679400 - RNA, 15 nt, Salmonella enterica enterica serovar Typhi Ty2
uuauuuaacgccagu

SEQ ID NO: 3679401 - RNA, 15 nt, Salmonella enterica enterica serovar Typhi Ty2
uuauuuaauugcuau

SEQ ID NO: 3679402 - RNA, 21 nt, Salmonella enterica enterica serovar Typhi Ty2
uuauuucaggaauacauuaac

SEQ ID NO: 3679403 - RNA, 12 nt, Salmonella enterica enterica serovar Typhi Ty2
uuauuugaauag

SEQ ID NO: 3679404 - RNA, 21 nt, Salmonella enterica enterica serovar Typhi Ty2
uuauuugaauagucaaccguu

SEQ ID NO: 3679405 - RNA, 11 nt, Salmonella enterica enterica serovar Typhi Ty2
uuauuuuaaau

SEQ ID NO: 3679406 - RNA, 20 nt, Salmonella enterica enterica serovar Typhi Ty2
uuauuuuccugaaaaaauuc

SEQ ID NO: 3679407 - RNA, 21 nt, Salmonella enterica enterica serovar Typhi Ty2
uuauuuuccugaaaaaauucc

SEQ ID NO: 3679408 - RNA, 13 nt, Salmonella enterica enterica serovar Typhi Ty2
uuauuuuuaauug

SEQ ID NO: 3679409 - RNA, 12 nt, Salmonella enterica enterica serovar Typhi Ty2
uuauuuuuucau

SEQ ID NO: 3679410 - RNA, 12 nt, Salmonella enterica enterica serovar Typhi Ty2
uucaaaaaagag

SEQ ID NO: 3679411 - RNA, 13 nt, Salmonella enterica enterica serovar Typhi Ty2
uucaaaaucaaac

SEQ ID NO: 3679412 - RNA, 14 nt, Salmonella enterica enterica serovar Typhi Ty2
uucaaaaucaaaca

SEQ ID NO: 3679413 - RNA, 19 nt, Salmonella enterica enterica serovar Typhi Ty2
uucaacagcucgccaugca

SEQ ID NO: 3679414 - RNA, 15 nt, Salmonella enterica enterica serovar Typhi Ty2
uucaaccacgccaac

SEQ ID NO: 3679415 - RNA, 23 nt, Salmonella enterica enterica serovar Typhi Ty2
uucaaccagccgaucagcgccau

SEQ ID NO: 3679416 - RNA, 15 nt, Salmonella enterica enterica serovar Typhi Ty2
uucaaccguuucuuu

SEQ ID NO: 3679417 - RNA, 18 nt, Salmonella enterica enterica serovar Typhi Ty2
uucaaccucacuguugau

SEQ ID NO: 3679418 - RNA, 15 nt, Salmonella enterica enterica serovar Typhi Ty2
uucaaccuccugcaa

SEQ ID NO: 3679419 - RNA, 16 nt, Salmonella enterica enterica serovar Typhi Ty2
uucaaccuccugcaau

SEQ ID NO: 3679420 - RNA, 20 nt, Salmonella enterica enterica serovar Typhi Ty2
uucaacgaaugccugcauau

SEQ ID NO: 3679421 - RNA, 17 nt, Salmonella enterica enterica serovar Typhi Ty2
uucaacgcguugccuga

SEQ ID NO: 3679422 - RNA, 18 nt, Salmonella enterica enterica serovar Typhi Ty2
uucaacgugcaucuccuc

SEQ ID NO: 3679423 - RNA, 12 nt, Salmonella enterica enterica serovar Typhi Ty2
uucaagcaauaa

SEQ ID NO: 3679424 - RNA, 18 nt, Salmonella enterica enterica serovar Typhi Ty2
uucaagcccgugcuuagc

SEQ ID NO: 3679425 - RNA, 16 nt, Salmonella enterica enterica serovar Typhi Ty2
uucaagcuggugcuuu

SEQ ID NO: 3679426 - RNA, 23 nt, Salmonella enterica enterica serovar Typhi Ty2
uucaaggcucaauacgcauaaug

SEQ ID NO: 3679427 - RNA, 17 nt, Salmonella enterica enterica serovar Typhi Ty2
uucaaguuuagaaaaaa

SEQ ID NO: 3679428 - RNA, 18 nt, Salmonella enterica enterica serovar Typhi Ty2
uucaaguuuagaaaaaau

SEQ ID NO: 3679429 - RNA, 21 nt, Salmonella enterica enterica serovar Typhi Ty2
uucaaguuuagaaaaaauuaa

SEQ ID NO: 3679430 - RNA, 22 nt, Salmonella enterica enterica serovar Typhi Ty2
uucaaguuuagaaaaaauuaaa

SEQ ID NO: 3679431 - RNA, 21 nt, Salmonella enterica enterica serovar Typhi Ty2
uucaauaaauugaaauucuau

SEQ ID NO: 3679432 - RNA, 20 nt, Salmonella enterica enterica serovar Typhi Ty2
uucaauaagcgguaauaauu

SEQ ID NO: 3679433 - RNA, 20 nt, Salmonella enterica enterica serovar Typhi Ty2
uucaauaaguuagcuuuuuu

SEQ ID NO: 3679434 - RNA, 14 nt, Salmonella enterica enterica serovar Typhi Ty2
uucaauaauaaaac

SEQ ID NO: 3679435 - RNA, 20 nt, Salmonella enterica enterica serovar Typhi Ty2
uucaauaauauuaucauaau

SEQ ID NO: 3679436 - RNA, 21 nt, Salmonella enterica enterica serovar Typhi Ty2
uucaauaauggcgcgaaaaca

SEQ ID NO: 3679437 - RNA, 16 nt, Salmonella enterica enterica serovar Typhi Ty2
uucaauagguugaaag

SEQ ID NO: 3679438 - RNA, 21 nt, Salmonella enterica enterica serovar Typhi Ty2
uucaauauagccguggcuggc

SEQ ID NO: 3679439 - RNA, 15 nt, Salmonella enterica enterica serovar Typhi Ty2
uucaauaugccaggc

SEQ ID NO: 3679440 - RNA, 20 nt, Salmonella enterica enterica serovar Typhi Ty2
uucaauauugaacauuuuuu

SEQ ID NO: 3679441 - RNA, 22 nt, Salmonella enterica enterica serovar Typhi Ty2
uucaaucacugaugccacaccc

SEQ ID NO: 3679442 - RNA, 18 nt, Salmonella enterica enterica serovar Typhi Ty2
uucaaucagcacgcgguc

SEQ ID NO: 3679443 - RNA, 17 nt, Salmonella enterica enterica serovar Typhi Ty2
uucaaucaucauauccc

SEQ ID NO: 3679444 - RNA, 18 nt, Salmonella enterica enterica serovar Typhi Ty2
uucaaucgcgcccgccau

SEQ ID NO: 3679445 - RNA, 19 nt, Salmonella enterica enterica serovar Typhi Ty2
uucaaucuggugacgauga

SEQ ID NO: 3679446 - RNA, 15 nt, Salmonella enterica enterica serovar Typhi Ty2
uucaaugaacaauaa

SEQ ID NO: 3679447 - RNA, 16 nt, Salmonella enterica enterica serovar Typhi Ty2
uucaaugccaugcugg

SEQ ID NO: 3679448 - RNA, 14 nt, Salmonella enterica enterica serovar Typhi Ty2
uucaaugcccaggc

SEQ ID NO: 3679449 - RNA, 17 nt, Salmonella enterica enterica serovar Typhi Ty2
uucaauggguuaugggu

SEQ ID NO: 3679450 - RNA, 19 nt, Salmonella enterica enterica serovar Typhi Ty2
uucaauuagcgccuccccu

SEQ ID NO: 3679451 - RNA, 21 nt, Salmonella enterica enterica serovar Typhi Ty2
uucacaaccuccacgcccagc

SEQ ID NO: 3679452 - RNA, 17 nt, Salmonella enterica enterica serovar Typhi Ty2
uucacaauacagaacau

SEQ ID NO: 3679453 - RNA, 20 nt, Salmonella enterica enterica serovar Typhi Ty2
uucacaccgccgccagccau

SEQ ID NO: 3679454 - RNA, 20 nt, Salmonella enterica enterica serovar Typhi Ty2
uucacaccguuauccggcaa

SEQ ID NO: 3679455 - RNA, 21 nt, Salmonella enterica enterica serovar Typhi Ty2
uucacaccuuuauauuuuucc

SEQ ID NO: 3679456 - RNA, 19 nt, Salmonella enterica enterica serovar Typhi Ty2
uucacacugcgccgccagc

SEQ ID NO: 3679457 - RNA, 13 nt, Salmonella enterica enterica serovar Typhi Ty2
uucacauauauuu

SEQ ID NO: 3679458 - RNA, 16 nt, Salmonella enterica enterica serovar Typhi Ty2
uucaccagacgcuggc

SEQ ID NO: 3679459 - RNA, 22 nt, Salmonella enterica enterica serovar Typhi Ty2
uucaccauuaauacccauagua

SEQ ID NO: 3679460 - RNA, 20 nt, Salmonella enterica enterica serovar Typhi Ty2
uucacccagacugugauggc

SEQ ID NO: 3679461 - RNA, 15 nt, Salmonella enterica enterica serovar Typhi Ty2
uucacccauugaacc

SEQ ID NO: 3679462 - RNA, 19 nt, Salmonella enterica enterica serovar Typhi Ty2
uucaccccagcgguaaaau

SEQ ID NO: 3679463 - RNA, 13 nt, Salmonella enterica enterica serovar Typhi Ty2
uucacccccaucg

SEQ ID NO: 3679464 - RNA, 17 nt, Salmonella enterica enterica serovar Typhi Ty2
uucacccuauaagcugc

SEQ ID NO: 3679465 - RNA, 15 nt, Salmonella enterica enterica serovar Typhi Ty2
uucaccgccucaucg

SEQ ID NO: 3679466 - RNA, 21 nt, Salmonella enterica enterica serovar Typhi Ty2
uucaccggauacccagccaca

SEQ ID NO: 3679467 - RNA, 12 nt, Salmonella enterica enterica serovar Typhi Ty2
uucaccggcguu

SEQ ID NO: 3679468 - RNA, 10 nt, Salmonella enterica enterica serovar Typhi Ty2
uucaccgugu

SEQ ID NO: 3679469 - RNA, 20 nt, Salmonella enterica enterica serovar Typhi Ty2
uucaccguuuaaaaacauca

SEQ ID NO: 3679470 - RNA, 13 nt, Salmonella enterica enterica serovar Typhi Ty2
uucaccucccugc

SEQ ID NO: 3679471 - RNA, 14 nt, Salmonella enterica enterica serovar Typhi Ty2
uucaccucccugca

SEQ ID NO: 3679472 - RNA, 20 nt, Salmonella enterica enterica serovar Typhi Ty2
uucaccucccugcaacagca

SEQ ID NO: 3679473 - RNA, 14 nt, Salmonella enterica enterica serovar Typhi Ty2
uucaccuuuccagu

SEQ ID NO: 3679474 - RNA, 19 nt, Salmonella enterica enterica serovar Typhi Ty2
uucacgacgcucauuaacg

SEQ ID NO: 3679475 - RNA, 19 nt, Salmonella enterica enterica serovar Typhi Ty2
uucacgagcggucaggcca

SEQ ID NO: 3679476 - RNA, 16 nt, Salmonella enterica enterica serovar Typhi Ty2
uucacgaucaucgcau

SEQ ID NO: 3679477 - RNA, 19 nt, Salmonella enterica enterica serovar Typhi Ty2
uucacgcauugccacagcc

SEQ ID NO: 3679478 - RNA, 18 nt, Salmonella enterica enterica serovar Typhi Ty2
uucacgccauugccagga

SEQ ID NO: 3679479 - RNA, 19 nt, Salmonella enterica enterica serovar Typhi Ty2
uucacgccauugccaggac

SEQ ID NO: 3679480 - RNA, 20 nt, Salmonella enterica enterica serovar Typhi Ty2
uucacgccgccauccggcaa

SEQ ID NO: 3679481 - RNA, 20 nt, Salmonella enterica enterica serovar Typhi Ty2
uucacgccuuuugacgcuuc

SEQ ID NO: 3679482 - RNA, 19 nt, Salmonella enterica enterica serovar Typhi Ty2
uucacggcgguucaucgga

SEQ ID NO: 3679483 - RNA, 15 nt, Salmonella enterica enterica serovar Typhi Ty2
uucacguuuuccagg

SEQ ID NO: 3679484 - RNA, 18 nt, Salmonella enterica enterica serovar Typhi Ty2
uucacguuuuccaggugc

SEQ ID NO: 3679485 - RNA, 18 nt, Salmonella enterica enterica serovar Typhi Ty2
uucacuccuaagagaaaa

SEQ ID NO: 3679486 - RNA, 16 nt, Salmonella enterica enterica serovar Typhi Ty2
uucacuuuaaagccca

SEQ ID NO: 3679487 - RNA, 17 nt, Salmonella enterica enterica serovar Typhi Ty2
uucacuuuaccaggcau

SEQ ID NO: 3679488 - RNA, 19 nt, Salmonella enterica enterica serovar Typhi Ty2
uucagaaauguauucuccc

SEQ ID NO: 3679489 - RNA, 15 nt, Salmonella enterica enterica serovar Typhi Ty2
uucagaacguccaac

SEQ ID NO: 3679490 - RNA, 19 nt, Salmonella enterica enterica serovar Typhi Ty2
uucagaauacgaccucaaa

SEQ ID NO: 3679491 - RNA, 16 nt, Salmonella enterica enterica serovar Typhi Ty2
uucagaccauagucca

SEQ ID NO: 3679492 - RNA, 19 nt, Salmonella enterica enterica serovar Typhi Ty2
uucagaccuuuuacuucac

SEQ ID NO: 3679493 - RNA, 12 nt, Salmonella enterica enterica serovar Typhi Ty2
uucagacgucau

SEQ ID NO: 3679494 - RNA, 20 nt, Salmonella enterica enterica serovar Typhi Ty2
uucagagcguccacgccauc

SEQ ID NO: 3679495 - RNA, 22 nt, Salmonella enterica enterica serovar Typhi Ty2
uucagagcguccacgccaucau

SEQ ID NO: 3679496 - RNA, 16 nt, Salmonella enterica enterica serovar Typhi Ty2
uucagauaauucuaaa

SEQ ID NO: 3679497 - RNA, 14 nt, Salmonella enterica enterica serovar Typhi Ty2
uucagauaucccau

SEQ ID NO: 3679498 - RNA, 22 nt, Salmonella enterica enterica serovar Typhi Ty2
uucagauaucccaugaaacucg

SEQ ID NO: 3679499 - RNA, 19 nt, Salmonella enterica enterica serovar Typhi Ty2
uucagauggugauagcgcg

SEQ ID NO: 3679500 - RNA, 23 nt, Salmonella enterica enterica serovar Typhi Ty2
uucagcaauuacccgguguuuuu

SEQ ID NO: 3679501 - RNA, 13 nt, Salmonella enterica enterica serovar Typhi Ty2
uucagcacccagc

SEQ ID NO: 3679502 - RNA, 19 nt, Salmonella enterica enterica serovar Typhi Ty2
uucagcacgcuuacccagc

SEQ ID NO: 3679503 - RNA, 22 nt, Salmonella enterica enterica serovar Typhi Ty2
uucagcagcgcccagccaaagc

SEQ ID NO: 3679504 - RNA, 16 nt, Salmonella enterica enterica serovar Typhi Ty2
uucagcauccuccggc

SEQ ID NO: 3679505 - RNA, 14 nt, Salmonella enterica enterica serovar Typhi Ty2
uucagcauuggcau

SEQ ID NO: 3679506 - RNA, 18 nt, Salmonella enterica enterica serovar Typhi Ty2
uucagcccguucucgccg

SEQ ID NO: 3679507 - RNA, 13 nt, Salmonella enterica enterica serovar Typhi Ty2
uucagccugaagc

SEQ ID NO: 3679508 - RNA, 17 nt, Salmonella enterica enterica serovar Typhi Ty2
uucagccugugcaacca

SEQ ID NO: 3679509 - RNA, 16 nt, Salmonella enterica enterica serovar Typhi Ty2
uucagccuuuucauau

SEQ ID NO: 3679510 - RNA, 17 nt, Salmonella enterica enterica serovar Typhi Ty2
uucagcgacaggcuguc

SEQ ID NO: 3679511 - RNA, 18 nt, Salmonella enterica enterica serovar Typhi Ty2
uucagcgccagauaguca

SEQ ID NO: 3679512 - RNA, 15 nt, Salmonella enterica enterica serovar Typhi Ty2
uucagcgccugaaug

SEQ ID NO: 3679513 - RNA, 22 nt, Salmonella enterica enterica serovar Typhi Ty2
uucagcggcuugucauccugcu

SEQ ID NO: 3679514 - RNA, 23 nt, Salmonella enterica enterica serovar Typhi Ty2
uucagcguaccgaagaacauaaa

SEQ ID NO: 3679515 - RNA, 22 nt, Salmonella enterica enterica serovar Typhi Ty2
uucagcucgcaggccauaaaac

SEQ ID NO: 3679516 - RNA, 14 nt, Salmonella enterica enterica serovar Typhi Ty2
uucagcucuucaau

SEQ ID NO: 3679517 - RNA, 23 nt, Salmonella enterica enterica serovar Typhi Ty2
uucagcuucagucauaauccuuc

SEQ ID NO: 3679518 - RNA, 15 nt, Salmonella enterica enterica serovar Typhi Ty2
uucagcuucugucag

SEQ ID NO: 3679519 - RNA, 18 nt, Salmonella enterica enterica serovar Typhi Ty2
uucagcuucugucagccu

SEQ ID NO: 3679520 - RNA, 14 nt, Salmonella enterica enterica serovar Typhi Ty2
uucaggaauacauu

SEQ ID NO: 3679521 - RNA, 19 nt, Salmonella enterica enterica serovar Typhi Ty2
uucaggauuuacugagcgc

SEQ ID NO: 3679522 - RNA, 14 nt, Salmonella enterica enterica serovar Typhi Ty2
uucaggccgccagc

SEQ ID NO: 3679523 - RNA, 17 nt, Salmonella enterica enterica serovar Typhi Ty2
uucaggccgccagcaaa

SEQ ID NO: 3679524 - RNA, 15 nt, Salmonella enterica enterica serovar Typhi Ty2
uucaggcgcugucug

SEQ ID NO: 3679525 - RNA, 23 nt, Salmonella enterica enterica serovar Typhi Ty2
uucaggcugccaaccagcgcuuu

SEQ ID NO: 3679526 - RNA, 23 nt, Salmonella enterica enterica serovar Typhi Ty2
uucagggcuuauucaagcaacug

SEQ ID NO: 3679527 - RNA, 23 nt, Salmonella enterica enterica serovar Typhi Ty2
uucagggggccacuuacggacaa

SEQ ID NO: 3679528 - RNA, 14 nt, Salmonella enterica enterica serovar Typhi Ty2
uucaggggucccca

SEQ ID NO: 3679529 - RNA, 15 nt, Salmonella enterica enterica serovar Typhi Ty2
uucagguauugguau

SEQ ID NO: 3679530 - RNA, 22 nt, Salmonella enterica enterica serovar Typhi Ty2
uucaggucuggauuacaaaaau

SEQ ID NO: 3679531 - RNA, 20 nt, Salmonella enterica enterica serovar Typhi Ty2
uucagguuuugcugaucaau

SEQ ID NO: 3679532 - RNA, 16 nt, Salmonella enterica enterica serovar Typhi Ty2
uucaguacugacgcaa

SEQ ID NO: 3679533 - RNA, 22 nt, Salmonella enterica enterica serovar Typhi Ty2
uucagucuaauuuauuaacccu

SEQ ID NO: 3679534 - RNA, 21 nt, Salmonella enterica enterica serovar Typhi Ty2
uucagucuacuacacacuuac

SEQ ID NO: 3679535 - RNA, 13 nt, Salmonella enterica enterica serovar Typhi Ty2
uucagugccaucc

SEQ ID NO: 3679536 - RNA, 23 nt, Salmonella enterica enterica serovar Typhi Ty2
uucagugccugauagcgcugugc

SEQ ID NO: 3679537 - RNA, 20 nt, Salmonella enterica enterica serovar Typhi Ty2
uucaguggcuaauuucaauu

SEQ ID NO: 3679538 - RNA, 23 nt, Salmonella enterica enterica serovar Typhi Ty2
uucaguggucaggcgaccaauau

SEQ ID NO: 3679539 - RNA, 20 nt, Salmonella enterica enterica serovar Typhi Ty2
uucaguuaaauaaacaaaaa

SEQ ID NO: 3679540 - RNA, 20 nt, Salmonella enterica enterica serovar Typhi Ty2
uucaguugcccauuuuccuc

SEQ ID NO: 3679541 - RNA, 13 nt, Salmonella enterica enterica serovar Typhi Ty2
uucauaaaagauc

SEQ ID NO: 3679542 - RNA, 21 nt, Salmonella enterica enterica serovar Typhi Ty2
uucauaaagugccagggcgga

SEQ ID NO: 3679543 - RNA, 12 nt, Salmonella enterica enterica serovar Typhi Ty2
uucauaaauacg

SEQ ID NO: 3679544 - RNA, 22 nt, Salmonella enterica enterica serovar Typhi Ty2
uucauaacgaccuuuacugaca

SEQ ID NO: 3679545 - RNA, 14 nt, Salmonella enterica enterica serovar Typhi Ty2
uucauagaaccacu

SEQ ID NO: 3679546 - RNA, 15 nt, Salmonella enterica enterica serovar Typhi Ty2
uucauagaaccacuu

SEQ ID NO: 3679547 - RNA, 19 nt, Salmonella enterica enterica serovar Typhi Ty2
uucauaguuugcauaaccg

SEQ ID NO: 3679548 - RNA, 21 nt, Salmonella enterica enterica serovar Typhi Ty2
uucauauagucauaauacuca

SEQ ID NO: 3679549 - RNA, 23 nt, Salmonella enterica enterica serovar Typhi Ty2
uucauauuauuauauagacuccg

SEQ ID NO: 3679550 - RNA, 16 nt, Salmonella enterica enterica serovar Typhi Ty2
uucaucaaagaaaacc

SEQ ID NO: 3679551 - RNA, 13 nt, Salmonella enterica enterica serovar Typhi Ty2
uucaucaaauaag

SEQ ID NO: 3679552 - RNA, 21 nt, Salmonella enterica enterica serovar Typhi Ty2
uucaucaggcaauaaacauca

SEQ ID NO: 3679553 - RNA, 16 nt, Salmonella enterica enterica serovar Typhi Ty2
uucaucaggccugcaa

SEQ ID NO: 3679554 - RNA, 13 nt, Salmonella enterica enterica serovar Typhi Ty2
uucaucaggcuga

SEQ ID NO: 3679555 - RNA, 22 nt, Salmonella enterica enterica serovar Typhi Ty2
uucauccauauaucugaauaga

SEQ ID NO: 3679556 - RNA, 19 nt, Salmonella enterica enterica serovar Typhi Ty2
uucaucccacucaaucauu

SEQ ID NO: 3679557 - RNA, 14 nt, Salmonella enterica enterica serovar Typhi Ty2
uucauccucaacca

SEQ ID NO: 3679558 - RNA, 18 nt, Salmonella enterica enterica serovar Typhi Ty2
uucaucgauggcgccagc

SEQ ID NO: 3679559 - RNA, 20 nt, Salmonella enterica enterica serovar Typhi Ty2
uucaucgccacaugcggcag

SEQ ID NO: 3679560 - RNA, 16 nt, Salmonella enterica enterica serovar Typhi Ty2
uucaucgccgauuccu

SEQ ID NO: 3679561 - RNA, 20 nt, Salmonella enterica enterica serovar Typhi Ty2
uucaucgccgauuccugcug

SEQ ID NO: 3679562 - RNA, 14 nt, Salmonella enterica enterica serovar Typhi Ty2
uucaucgccgcgac

SEQ ID NO: 3679563 - RNA, 12 nt, Salmonella enterica enterica serovar Typhi Ty2
uucaucgcuuuu

SEQ ID NO: 3679564 - RNA, 21 nt, Salmonella enterica enterica serovar Typhi Ty2
uucaucgcuuuuaccaggaau

SEQ ID NO: 3679565 - RNA, 19 nt, Salmonella enterica enterica serovar Typhi Ty2
uucaucgguaauauuaagg

SEQ ID NO: 3679566 - RNA, 16 nt, Salmonella enterica enterica serovar Typhi Ty2
uucaucuaucgccagc

SEQ ID NO: 3679567 - RNA, 15 nt, Salmonella enterica enterica serovar Typhi Ty2
uucaucuuccgggac

SEQ ID NO: 3679568 - RNA, 12 nt, Salmonella enterica enterica serovar Typhi Ty2
uucaucuucuuu

SEQ ID NO: 3679569 - RNA, 18 nt, Salmonella enterica enterica serovar Typhi Ty2
uucaucuuuuaaaaucag

SEQ ID NO: 3679570 - RNA, 21 nt, Salmonella enterica enterica serovar Typhi Ty2
uucaugaaacucgcguagcgu

SEQ ID NO: 3679571 - RNA, 18 nt, Salmonella enterica enterica serovar Typhi Ty2
uucaugaaucaucacaau

SEQ ID NO: 3679572 - RNA, 16 nt, Salmonella enterica enterica serovar Typhi Ty2
uucaugauacccagcg

SEQ ID NO: 3679573 - RNA, 18 nt, Salmonella enterica enterica serovar Typhi Ty2
uucaugaucuuuccuuuu

SEQ ID NO: 3679574 - RNA, 16 nt, Salmonella enterica enterica serovar Typhi Ty2
uucaugcacaaaaccc

SEQ ID NO: 3679575 - RNA, 18 nt, Salmonella enterica enterica serovar Typhi Ty2
uucaugcacgaugguauc

SEQ ID NO: 3679576 - RNA, 14 nt, Salmonella enterica enterica serovar Typhi Ty2
uucaugcagccaua

SEQ ID NO: 3679577 - RNA, 17 nt, Salmonella enterica enterica serovar Typhi Ty2
uucaugcagcccgcacu

SEQ ID NO: 3679578 - RNA, 19 nt, Salmonella enterica enterica serovar Typhi Ty2
uucaugccauacuccugcc

SEQ ID NO: 3679579 - RNA, 15 nt, Salmonella enterica enterica serovar Typhi Ty2
uucaugcuucucaaa

SEQ ID NO: 3679580 - RNA, 20 nt, Salmonella enterica enterica serovar Typhi Ty2
uucauggcgcgacauggcga

SEQ ID NO: 3679581 - RNA, 19 nt, Salmonella enterica enterica serovar Typhi Ty2
uucaugguaaaauccuuuu

SEQ ID NO: 3679582 - RNA, 22 nt, Salmonella enterica enterica serovar Typhi Ty2
uucauguuucgacaguuucuuc

SEQ ID NO: 3679583 - RNA, 19 nt, Salmonella enterica enterica serovar Typhi Ty2
uucauuacagguguuaauc

SEQ ID NO: 3679584 - RNA, 15 nt, Salmonella enterica enterica serovar Typhi Ty2
uucauuacgccuguc

SEQ ID NO: 3679585 - RNA, 21 nt, Salmonella enterica enterica serovar Typhi Ty2
uucauucacccaauaaauaau

SEQ ID NO: 3679586 - RNA, 16 nt, Salmonella enterica enterica serovar Typhi Ty2
uucauucgccaccagg

SEQ ID NO: 3679587 - RNA, 19 nt, Salmonella enterica enterica serovar Typhi Ty2
uucauucgccaccaggcuc

SEQ ID NO: 3679588 - RNA, 18 nt, Salmonella enterica enterica serovar Typhi Ty2
uucauugucucuguuuuu

SEQ ID NO: 3679589 - RNA, 15 nt, Salmonella enterica enterica serovar Typhi Ty2
uucauuucaauguaa

SEQ ID NO: 3679590 - RNA, 16 nt, Salmonella enterica enterica serovar Typhi Ty2
uucauuucacuuguuc

SEQ ID NO: 3679591 - RNA, 14 nt, Salmonella enterica enterica serovar Typhi Ty2
ugguacguccaucc

SEQ ID NO: 3679592 - RNA, 14 nt, Salmonella enterica enterica serovar Typhi Ty2
ugguacucaacauc

SEQ ID NO: 3679593 - RNA, 16 nt, Salmonella enterica enterica serovar Typhi Ty2
ugguacuuuucaucca

SEQ ID NO: 3679594 - RNA, 15 nt, Salmonella enterica enterica serovar Typhi Ty2
ugguagacaggcugg

SEQ ID NO: 3679595 - RNA, 15 nt, Salmonella enterica enterica serovar Typhi Ty2
ugguagacccggcau

SEQ ID NO: 3679596 - RNA, 23 nt, Salmonella enterica enterica serovar Typhi Ty2
ugguagagguugcggauaugcgu

SEQ ID NO: 3679597 - RNA, 15 nt, Salmonella enterica enterica serovar Typhi Ty2
ugguagcccucgcaa

SEQ ID NO: 3679598 - RNA, 16 nt, Salmonella enterica enterica serovar Typhi Ty2
ugguaggccugauaag

SEQ ID NO: 3679599 - RNA, 16 nt, Salmonella enterica enterica serovar Typhi Ty2
ugguaguaagucagcu

SEQ ID NO: 3679600 - RNA, 21 nt, Salmonella enterica enterica serovar Typhi Ty2
ugguagucguuauaauccuga

SEQ ID NO: 3679601 - RNA, 16 nt, Salmonella enterica enterica serovar Typhi Ty2
ugguauaggccaggcu

SEQ ID NO: 3679602 - RNA, 22 nt, Salmonella enterica enterica serovar Typhi Ty2
ugguaucaaaaagcgcagaccc

SEQ ID NO: 3679603 - RNA, 19 nt, Salmonella enterica enterica serovar Typhi Ty2
ugguaugcggcuaauacgc

SEQ ID NO: 3679604 - RNA, 15 nt, Salmonella enterica enterica serovar Typhi Ty2
uggucaccaugacgc

SEQ ID NO: 3679605 - RNA, 23 nt, Salmonella enterica enterica serovar Typhi Ty2
uggucaccaugacgcagggcaau

SEQ ID NO: 3679606 - RNA, 22 nt, Salmonella enterica enterica serovar Typhi Ty2
uggucagacgcucagccuuaua

SEQ ID NO: 3679607 - RNA, 12 nt, Salmonella enterica enterica serovar Typhi Ty2
uggucagcgcaa

SEQ ID NO: 3679608 - RNA, 12 nt, Salmonella enterica enterica serovar Typhi Ty2
uggucagcgcgc

SEQ ID NO: 3679609 - RNA, 20 nt, Salmonella enterica enterica serovar Typhi Ty2
uggucagcucacgcgccagc

SEQ ID NO: 3679610 - RNA, 15 nt, Salmonella enterica enterica serovar Typhi Ty2
uggucaggcuaaaug

SEQ ID NO: 3679611 - RNA, 20 nt, Salmonella enterica enterica serovar Typhi Ty2
uggucaguagcguucuuucc

SEQ ID NO: 3679612 - RNA, 14 nt, Salmonella enterica enterica serovar Typhi Ty2
uggucaucgaaggc

SEQ ID NO: 3679613 - RNA, 21 nt, Salmonella enterica enterica serovar Typhi Ty2
uggucauuaggcguaauuauu

SEQ ID NO: 3679614 - RNA, 15 nt, Salmonella enterica enterica serovar Typhi Ty2
uggucgagauacugc

SEQ ID NO: 3679615 - RNA, 19 nt, Salmonella enterica enterica serovar Typhi Ty2
uggucgcuaacccaggccg

SEQ ID NO: 3679616 - RNA, 19 nt, Salmonella enterica enterica serovar Typhi Ty2
uggucggacgggcccuggc

SEQ ID NO: 3679617 - RNA, 22 nt, Salmonella enterica enterica serovar Typhi Ty2
uggucggcaaucaccugcauca

SEQ ID NO: 3679618 - RNA, 15 nt, Salmonella enterica enterica serovar Typhi Ty2
uggucgguguucaua

SEQ ID NO: 3679619 - RNA, 16 nt, Salmonella enterica enterica serovar Typhi Ty2
uggucgguguucauau

SEQ ID NO: 3679620 - RNA, 16 nt, Salmonella enterica enterica serovar Typhi Ty2
uggucuccaguaucag

SEQ ID NO: 3679621 - RNA, 23 nt, Salmonella enterica enterica serovar Typhi Ty2
uggucucucgugcaggccggaua

SEQ ID NO: 3679622 - RNA, 18 nt, Salmonella enterica enterica serovar Typhi Ty2
uggugaaaaaucauuauc

SEQ ID NO: 3679623 - RNA, 24 nt, Salmonella enterica enterica serovar Typhi Ty2
uggugaaaaucgugguuagacauc

SEQ ID NO: 3679624 - RNA, 18 nt, Salmonella enterica enterica serovar Typhi Ty2
uggugaaacguguuuauc

SEQ ID NO: 3679625 - RNA, 16 nt, Salmonella enterica enterica serovar Typhi Ty2
uggugaccgccagaug

SEQ ID NO: 3679626 - RNA, 19 nt, Salmonella enterica enterica serovar Typhi Ty2
uggugagguugagauccug

SEQ ID NO: 3679627 - RNA, 16 nt, Salmonella enterica enterica serovar Typhi Ty2
uggugaguggccuguc

SEQ ID NO: 3679628 - RNA, 20 nt, Salmonella enterica enterica serovar Typhi Ty2
uggugauagcgcgccagcac

SEQ ID NO: 3679629 - RNA, 17 nt, Salmonella enterica enterica serovar Typhi Ty2
uggugauauaaacgggc

SEQ ID NO: 3679630 - RNA, 16 nt, Salmonella enterica enterica serovar Typhi Ty2
uggugaugaucgcggu

SEQ ID NO: 3679631 - RNA, 15 nt, Salmonella enterica enterica serovar Typhi Ty2
uggugcagccgccau

SEQ ID NO: 3679632 - RNA, 21 nt, Salmonella enterica enterica serovar Typhi Ty2
uggugcagccgccaucgcuga

SEQ ID NO: 3679633 - RNA, 12 nt, Salmonella enterica enterica serovar Typhi Ty2
uggugcaucugg

SEQ ID NO: 3679634 - RNA, 23 nt, Salmonella enterica enterica serovar Typhi Ty2
uggugcggcgcacugccugaugg

SEQ ID NO: 3679635 - RNA, 15 nt, Salmonella enterica enterica serovar Typhi Ty2
uggugcguccgguag

SEQ ID NO: 3679636 - RNA, 21 nt, Salmonella enterica enterica serovar Typhi Ty2
uggugcugugccugccugugg

SEQ ID NO: 3679637 - RNA, 18 nt, Salmonella enterica enterica serovar Typhi Ty2
ugguggauauccagcaua

SEQ ID NO: 3679638 - RNA, 16 nt, Salmonella enterica enterica serovar Typhi Ty2
ugguggcgaauacugu

SEQ ID NO: 3679639 - RNA, 19 nt, Salmonella enterica enterica serovar Typhi Ty2
ugguggcuauagcucaguu

SEQ ID NO: 3679640 - RNA, 21 nt, Salmonella enterica enterica serovar Typhi Ty2
uggugggacuguucagcugac

SEQ ID NO: 3679641 - RNA, 22 nt, Salmonella enterica enterica serovar Typhi Ty2
ugguggucggcaaucaccugca

SEQ ID NO: 3679642 - RNA, 14 nt, Salmonella enterica enterica serovar Typhi Ty2
ugguggucuauggu

SEQ ID NO: 3679643 - RNA, 22 nt, Salmonella enterica enterica serovar Typhi Ty2
ugguggugccguuacuguuuua

SEQ ID NO: 3679644 - RNA, 19 nt, Salmonella enterica enterica serovar Typhi Ty2
uggugucaaucgccugcug

SEQ ID NO: 3679645 - RNA, 18 nt, Salmonella enterica enterica serovar Typhi Ty2
uggugucucgucgccagg

SEQ ID NO: 3679646 - RNA, 15 nt, Salmonella enterica enterica serovar Typhi Ty2
uggugugaacaucac

SEQ ID NO: 3679647 - RNA, 20 nt, Salmonella enterica enterica serovar Typhi Ty2
ugguuaaauuaaauaacaaa

SEQ ID NO: 3679648 - RNA, 16 nt, Salmonella enterica enterica serovar Typhi Ty2
ugguuaaccaccagcg

SEQ ID NO: 3679649 - RNA, 15 nt, Salmonella enterica enterica serovar Typhi Ty2
ugguuaaugaccugc

SEQ ID NO: 3679650 - RNA, 18 nt, Salmonella enterica enterica serovar Typhi Ty2
ugguuagaauaccugccu

SEQ ID NO: 3679651 - RNA, 16 nt, Salmonella enterica enterica serovar Typhi Ty2
ugguuagccauuucgc

SEQ ID NO: 3679652 - RNA, 13 nt, Salmonella enterica enterica serovar Typhi Ty2
ugguuagcgcucu

SEQ ID NO: 3679653 - RNA, 14 nt, Salmonella enterica enterica serovar Typhi Ty2
ugguuauccagcaa

SEQ ID NO: 3679654 - RNA, 15 nt, Salmonella enterica enterica serovar Typhi Ty2
ugguuauccagcaac

SEQ ID NO: 3679655 - RNA, 17 nt, Salmonella enterica enterica serovar Typhi Ty2
ugguuauccagcaggua

SEQ ID NO: 3679656 - RNA, 22 nt, Salmonella enterica enterica serovar Typhi Ty2
ugguucauagaguguuggucuu

SEQ ID NO: 3679657 - RNA, 23 nt, Salmonella enterica enterica serovar Typhi Ty2
ugguucaugcuuccaaagagcug

SEQ ID NO: 3679658 - RNA, 15 nt, Salmonella enterica enterica serovar Typhi Ty2
ugguucccgccacug

SEQ ID NO: 3679659 - RNA, 16 nt, Salmonella enterica enterica serovar Typhi Ty2
ugguucgcauaauauc

SEQ ID NO: 3679660 - RNA, 14 nt, Salmonella enterica enterica serovar Typhi Ty2
ugguucugccagaa

SEQ ID NO: 3679661 - RNA, 20 nt, Salmonella enterica enterica serovar Typhi Ty2
ugguucugccagaacguuga

SEQ ID NO: 3679662 - RNA, 18 nt, Salmonella enterica enterica serovar Typhi Ty2
ugguugaaccgacggugc

SEQ ID NO: 3679663 - RNA, 16 nt, Salmonella enterica enterica serovar Typhi Ty2
ugguugagauccauaa

SEQ ID NO: 3679664 - RNA, 23 nt, Salmonella enterica enterica serovar Typhi Ty2
ugguugugccaguaaucccgguc

SEQ ID NO: 3679665 - RNA, 22 nt, Salmonella enterica enterica serovar Typhi Ty2
ugguuuaucgccgauugagggg

SEQ ID NO: 3679666 - RNA, 20 nt, Salmonella enterica enterica serovar Typhi Ty2
ugguuuauguaauuugcaaa

SEQ ID NO: 3679667 - RNA, 20 nt, Salmonella enterica enterica serovar Typhi Ty2
ugguuucaugcaucauugaa

SEQ ID NO: 3679668 - RNA, 19 nt, Salmonella enterica enterica serovar Typhi Ty2
ugguuucccugaccaguug

SEQ ID NO: 3679669 - RNA, 16 nt, Salmonella enterica enterica serovar Typhi Ty2
ugguuucgcggugaaa

SEQ ID NO: 3679670 - RNA, 12 nt, Salmonella enterica enterica serovar Typhi Ty2
ugguuucuuuua

SEQ ID NO: 3679671 - RNA, 23 nt, Salmonella enterica enterica serovar Typhi Ty2
ugguuuuagcuuaucccauugcg

SEQ ID NO: 3679672 - RNA, 20 nt, Salmonella enterica enterica serovar Typhi Ty2
ugguuuuaucuguaauuaua

SEQ ID NO: 3679673 - RNA, 16 nt, Salmonella enterica enterica serovar Typhi Ty2
aaagcaaucgccagcg

SEQ ID NO: 3679674 - RNA, 17 nt, Salmonella enterica enterica serovar Typhi Ty2
aaagcaaucgccagcgc

SEQ ID NO: 3679675 - RNA, 18 nt, Salmonella enterica enterica serovar Typhi Ty2
aaagcaaucgccagcgcc

SEQ ID NO: 3679676 - RNA, 21 nt, Salmonella enterica enterica serovar Typhi Ty2
aaagcacaucagcaaaugaac

SEQ ID NO: 3679677 - RNA, 17 nt, Salmonella enterica enterica serovar Typhi Ty2
aaagcacggguagcuag

SEQ ID NO: 3679678 - RNA, 17 nt, Salmonella enterica enterica serovar Typhi Ty2
aaagcacuucucgcgca

SEQ ID NO: 3679679 - RNA, 23 nt, Salmonella enterica enterica serovar Typhi Ty2
aaagcagcagugaggauaaggca

SEQ ID NO: 3679680 - RNA, 12 nt, Salmonella enterica enterica serovar Typhi Ty2
aaagcagugcag

SEQ ID NO: 3679681 - RNA, 14 nt, Salmonella enterica enterica serovar Typhi Ty2
aaagcauaaccaaa

SEQ ID NO: 3679682 - RNA, 15 nt, Salmonella enterica enterica serovar Typhi Ty2
aaagcauuaaaucau

SEQ ID NO: 3679683 - RNA, 17 nt, Salmonella enterica enterica serovar Typhi Ty2
aaagccagauaaagcag

SEQ ID NO: 3679684 - RNA, 15 nt, Salmonella enterica enterica serovar Typhi Ty2
aaagccaggccgcca

SEQ ID NO: 3679685 - RNA, 20 nt, Salmonella enterica enterica serovar Typhi Ty2
aaagccaguuucucuucuuu

SEQ ID NO: 3679686 - RNA, 16 nt, Salmonella enterica enterica serovar Typhi Ty2
aaagccaucaauccau

SEQ ID NO: 3679687 - RNA, 21 nt, Salmonella enterica enterica serovar Typhi Ty2
aaagcccagcacggcaagcgc

SEQ ID NO: 3679688 - RNA, 18 nt, Salmonella enterica enterica serovar Typhi Ty2
aaagcccaucaccgccag

SEQ ID NO: 3679689 - RNA, 13 nt, Salmonella enterica enterica serovar Typhi Ty2
aaagcccaucagc

SEQ ID NO: 3679690 - RNA, 16 nt, Salmonella enterica enterica serovar Typhi Ty2
aaagcccaucagcgcc

SEQ ID NO: 3679691 - RNA, 12 nt, Salmonella enterica enterica serovar Typhi Ty2
aaagccccggcu

SEQ ID NO: 3679692 - RNA, 14 nt, Salmonella enterica enterica serovar Typhi Ty2
aaagccccggcuca

SEQ ID NO: 3679693 - RNA, 23 nt, Salmonella enterica enterica serovar Typhi Ty2
aaagccccuuccucgggaggggc

SEQ ID NO: 3679694 - RNA, 13 nt, Salmonella enterica enterica serovar Typhi Ty2
aaagccgaccugg

SEQ ID NO: 3679695 - RNA, 18 nt, Salmonella enterica enterica serovar Typhi Ty2
aaagccgaugacaucuca

SEQ ID NO: 3679696 - RNA, 22 nt, Salmonella enterica enterica serovar Typhi Ty2
aaagccgcccugcggacaggcg

SEQ ID NO: 3679697 - RNA, 19 nt, Salmonella enterica enterica serovar Typhi Ty2
aaagccggaugugagcgca

SEQ ID NO: 3679698 - RNA, 21 nt, Salmonella enterica enterica serovar Typhi Ty2
aaagccggcggaaaaaagcag

SEQ ID NO: 3679699 - RNA, 20 nt, Salmonella enterica enterica serovar Typhi Ty2
aaagccguauuuuauuuuuc

SEQ ID NO: 3679700 - RNA, 19 nt, Salmonella enterica enterica serovar Typhi Ty2
aaagcgaauaacauaauau

SEQ ID NO: 3679701 - RNA, 12 nt, Salmonella enterica enterica serovar Typhi Ty2
aaagcgaauacu

SEQ ID NO: 3679702 - RNA, 18 nt, Salmonella enterica enterica serovar Typhi Ty2
aaagcgaauacuccugca

SEQ ID NO: 3679703 - RNA, 14 nt, Salmonella enterica enterica serovar Typhi Ty2
aaagcgaccucuug

SEQ ID NO: 3679704 - RNA, 19 nt, Salmonella enterica enterica serovar Typhi Ty2
aaagcgacucauccacaua

SEQ ID NO: 3679705 - RNA, 22 nt, Salmonella enterica enterica serovar Typhi Ty2
aaagcgcgagggauuaucuuua

SEQ ID NO: 3679706 - RNA, 21 nt, Salmonella enterica enterica serovar Typhi Ty2
aaagcgcgccgaaaauauaca

SEQ ID NO: 3679707 - RNA, 23 nt, Salmonella enterica enterica serovar Typhi Ty2
aaagcgcgcugauacuuauuacg

SEQ ID NO: 3679708 - RNA, 22 nt, Salmonella enterica enterica serovar Typhi Ty2
aaagcgcucguuauaauugccc

SEQ ID NO: 3679709 - RNA, 14 nt, Salmonella enterica enterica serovar Typhi Ty2
aaagcggacacugu

SEQ ID NO: 3679710 - RNA, 16 nt, Salmonella enterica enterica serovar Typhi Ty2
aaagcggcacaaauaa

SEQ ID NO: 3679711 - RNA, 22 nt, Salmonella enterica enterica serovar Typhi Ty2
aaagcggcgaauauagcuaaug

SEQ ID NO: 3679712 - RNA, 15 nt, Salmonella enterica enterica serovar Typhi Ty2
aaagcguugcaaccc

SEQ ID NO: 3679713 - RNA, 15 nt, Salmonella enterica enterica serovar Typhi Ty2
aaagcguuucaucau

SEQ ID NO: 3679714 - RNA, 17 nt, Salmonella enterica enterica serovar Typhi Ty2
aaagcuauucacaccuu

SEQ ID NO: 3679715 - RNA, 23 nt, Salmonella enterica enterica serovar Typhi Ty2
aaagcuccggacgcaccagccag

SEQ ID NO: 3679716 - RNA, 15 nt, Salmonella enterica enterica serovar Typhi Ty2
aaagcugcaccagga

SEQ ID NO: 3679717 - RNA, 22 nt, Salmonella enterica enterica serovar Typhi Ty2
aaagcuggccuucagguuuuua

SEQ ID NO: 3679718 - RNA, 20 nt, Salmonella enterica enterica serovar Typhi Ty2
aaagcugguauugaauauuu

SEQ ID NO: 3679719 - RNA, 13 nt, Salmonella enterica enterica serovar Typhi Ty2
aaagcuguagcau

SEQ ID NO: 3679720 - RNA, 19 nt, Salmonella enterica enterica serovar Typhi Ty2
aaagcuguugugucccggc

SEQ ID NO: 3679721 - RNA, 16 nt, Salmonella enterica enterica serovar Typhi Ty2
aaaggagccuuacggc

SEQ ID NO: 3679722 - RNA, 13 nt, Salmonella enterica enterica serovar Typhi Ty2
aaaggcagaagaa

SEQ ID NO: 3679723 - RNA, 16 nt, Salmonella enterica enterica serovar Typhi Ty2
aaaggcauuaagucau

SEQ ID NO: 3679724 - RNA, 23 nt, Salmonella enterica enterica serovar Typhi Ty2
aaaggcguagaucucuaucggca

SEQ ID NO: 3679725 - RNA, 12 nt, Salmonella enterica enterica serovar Typhi Ty2
aaaggcguauuc

SEQ ID NO: 3679726 - RNA, 22 nt, Salmonella enterica enterica serovar Typhi Ty2
aaaggcguguguuuagauaaca

SEQ ID NO: 3679727 - RNA, 15 nt, Salmonella enterica enterica serovar Typhi Ty2
aaaggcuuguuuagc

SEQ ID NO: 3679728 - RNA, 12 nt, Salmonella enterica enterica serovar Typhi Ty2
aaaggcuuuaaa

SEQ ID NO: 3679729 - RNA, 16 nt, Salmonella enterica enterica serovar Typhi Ty2
aaagggaaaagccauu

SEQ ID NO: 3679730 - RNA, 14 nt, Salmonella enterica enterica serovar Typhi Ty2
aaaggggagggcaa

SEQ ID NO: 3679731 - RNA, 18 nt, Salmonella enterica enterica serovar Typhi Ty2
aaaggggaucguguaaca

SEQ ID NO: 3679732 - RNA, 22 nt, Salmonella enterica enterica serovar Typhi Ty2
aaaggggccugcacaauaccaa

SEQ ID NO: 3679733 - RNA, 23 nt, Salmonella enterica enterica serovar Typhi Ty2
aaaggggccugcacaauaccaau

SEQ ID NO: 3679734 - RNA, 20 nt, Salmonella enterica enterica serovar Typhi Ty2
aaaggguaacgggacacugc

SEQ ID NO: 3679735 - RNA, 17 nt, Salmonella enterica enterica serovar Typhi Ty2
aaagguuucggcgauca

SEQ ID NO: 3679736 - RNA, 22 nt, Salmonella enterica enterica serovar Typhi Ty2
aaaguacaucauuggcccggcg

SEQ ID NO: 3679737 - RNA, 19 nt, Salmonella enterica enterica serovar Typhi Ty2
aaaguaccaaaacagaaaa

SEQ ID NO: 3679738 - RNA, 23 nt, Salmonella enterica enterica serovar Typhi Ty2
aaaguaccagcgcgaacauuaca

SEQ ID NO: 3679739 - RNA, 18 nt, Salmonella enterica enterica serovar Typhi Ty2
aaaguacuucacaaucag

SEQ ID NO: 3679740 - RNA, 22 nt, Salmonella enterica enterica serovar Typhi Ty2
aaaguacuucacaaucagcgca

SEQ ID NO: 3679741 - RNA, 12 nt, Salmonella enterica enterica serovar Typhi Ty2
aaaguagccaau

SEQ ID NO: 3679742 - RNA, 20 nt, Salmonella enterica enterica serovar Typhi Ty2
aaagucaacugcucuaccaa

SEQ ID NO: 3679743 - RNA, 17 nt, Salmonella enterica enterica serovar Typhi Ty2
aaagucggccauuuuuu

SEQ ID NO: 3679744 - RNA, 19 nt, Salmonella enterica enterica serovar Typhi Ty2
aaagugaaggccagacuua

SEQ ID NO: 3679745 - RNA, 21 nt, Salmonella enterica enterica serovar Typhi Ty2
aaagugauuauaaaucaauag

SEQ ID NO: 3679746 - RNA, 14 nt, Salmonella enterica enterica serovar Typhi Ty2
aaaguuaaucagcg

SEQ ID NO: 3679747 - RNA, 19 nt, Salmonella enterica enterica serovar Typhi Ty2
aaaguuagccccuuaucaa

SEQ ID NO: 3679748 - RNA, 12 nt, Salmonella enterica enterica serovar Typhi Ty2
aaaguuauuaca

SEQ ID NO: 3679749 - RNA, 16 nt, Salmonella enterica enterica serovar Typhi Ty2
aaaguuauuuuuucuu

SEQ ID NO: 3679750 - RNA, 15 nt, Salmonella enterica enterica serovar Typhi Ty2
aaaguugcaucaaga

SEQ ID NO: 3679751 - RNA, 16 nt, Salmonella enterica enterica serovar Typhi Ty2
aaaguuuauuugaaua

SEQ ID NO: 3679752 - RNA, 12 nt, Salmonella enterica enterica serovar Typhi Ty2
aaaguuucagga

SEQ ID NO: 3679753 - RNA, 23 nt, Salmonella enterica enterica serovar Typhi Ty2
aaauaaaaaccgccucaggcgca

SEQ ID NO: 3679754 - RNA, 14 nt, Salmonella enterica enterica serovar Typhi Ty2
aaauaaaaauuccc

SEQ ID NO: 3679755 - RNA, 13 nt, Salmonella enterica enterica serovar Typhi Ty2
ucggcagcgccag

SEQ ID NO: 3679756 - RNA, 12 nt, Salmonella enterica enterica serovar Typhi Ty2
ucggcagcgcga

SEQ ID NO: 3679757 - RNA, 21 nt, Salmonella enterica enterica serovar Typhi Ty2
ucggcagcgucaggcuuaucg

SEQ ID NO: 3679758 - RNA, 21 nt, Salmonella enterica enterica serovar Typhi Ty2
ucggcauacaccgccagcguc

SEQ ID NO: 3679759 - RNA, 20 nt, Salmonella enterica enterica serovar Typhi Ty2
ucggcauagcgggagauuga

SEQ ID NO: 3679760 - RNA, 21 nt, Salmonella enterica enterica serovar Typhi Ty2
ucggcauaggcuauugccuca

SEQ ID NO: 3679761 - RNA, 13 nt, Salmonella enterica enterica serovar Typhi Ty2
ucggcauaucgcc

SEQ ID NO: 3679762 - RNA, 21 nt, Salmonella enterica enterica serovar Typhi Ty2
ucggcaucgggauuuacaacc

SEQ ID NO: 3679763 - RNA, 17 nt, Salmonella enterica enterica serovar Typhi Ty2
ucggcaugcaucucuuc

SEQ ID NO: 3679764 - RNA, 16 nt, Salmonella enterica enterica serovar Typhi Ty2
ucggcaugccacuggg

SEQ ID NO: 3679765 - RNA, 18 nt, Salmonella enterica enterica serovar Typhi Ty2
ucggccaaccgccacaau

SEQ ID NO: 3679766 - RNA, 14 nt, Salmonella enterica enterica serovar Typhi Ty2
ucggccagcaggcg

SEQ ID NO: 3679767 - RNA, 20 nt, Salmonella enterica enterica serovar Typhi Ty2
ucggccagcgaaaaccagcg

SEQ ID NO: 3679768 - RNA, 15 nt, Salmonella enterica enterica serovar Typhi Ty2
ucggccagcgccagc

SEQ ID NO: 3679769 - RNA, 16 nt, Salmonella enterica enterica serovar Typhi Ty2
ucggccauauccagcc

SEQ ID NO: 3679770 - RNA, 22 nt, Salmonella enterica enterica serovar Typhi Ty2
ucggccucgcuggucagcgcaa

SEQ ID NO: 3679771 - RNA, 23 nt, Salmonella enterica enterica serovar Typhi Ty2
ucggccugaccauggaguuucag

SEQ ID NO: 3679772 - RNA, 16 nt, Salmonella enterica enterica serovar Typhi Ty2
ucggccuguucuuuuu

SEQ ID NO: 3679773 - RNA, 23 nt, Salmonella enterica enterica serovar Typhi Ty2
ucggcgaccagcagcgcggcgua

SEQ ID NO: 3679774 - RNA, 20 nt, Salmonella enterica enterica serovar Typhi Ty2
ucggcgacuggaacaggcca

SEQ ID NO: 3679775 - RNA, 15 nt, Salmonella enterica enterica serovar Typhi Ty2
ucggcgacuuucacg

SEQ ID NO: 3679776 - RNA, 13 nt, Salmonella enterica enterica serovar Typhi Ty2
ucggcgauaaacc

SEQ ID NO: 3679777 - RNA, 13 nt, Salmonella enterica enterica serovar Typhi Ty2
ucggcgauauagc

SEQ ID NO: 3679778 - RNA, 18 nt, Salmonella enterica enterica serovar Typhi Ty2
ucggcgauugucaucauu

SEQ ID NO: 3679779 - RNA, 22 nt, Salmonella enterica enterica serovar Typhi Ty2
ucggcgcaaccauuaccgcuaa

SEQ ID NO: 3679780 - RNA, 23 nt, Salmonella enterica enterica serovar Typhi Ty2
ucggcgcagggaucguuuuucuu

SEQ ID NO: 3679781 - RNA, 17 nt, Salmonella enterica enterica serovar Typhi Ty2
ucggcgggaucuccaga

SEQ ID NO: 3679782 - RNA, 17 nt, Salmonella enterica enterica serovar Typhi Ty2
ucggcggucgcggcaau

SEQ ID NO: 3679783 - RNA, 20 nt, Salmonella enterica enterica serovar Typhi Ty2
ucggcgucaacguuuuucag

SEQ ID NO: 3679784 - RNA, 13 nt, Salmonella enterica enterica serovar Typhi Ty2
ucggcgucauccc

SEQ ID NO: 3679785 - RNA, 18 nt, Salmonella enterica enterica serovar Typhi Ty2
ucggcgucgcgaauaauu

SEQ ID NO: 3679786 - RNA, 22 nt, Salmonella enterica enterica serovar Typhi Ty2
ucggcgucgcgaauaauuauuu

SEQ ID NO: 3679787 - RNA, 19 nt, Salmonella enterica enterica serovar Typhi Ty2
ucggcgucgugcugggcgc

SEQ ID NO: 3679788 - RNA, 18 nt, Salmonella enterica enterica serovar Typhi Ty2
ucggcgucugcgcgcugg

SEQ ID NO: 3679789 - RNA, 13 nt, Salmonella enterica enterica serovar Typhi Ty2
ucggcgucuggag

SEQ ID NO: 3679790 - RNA, 20 nt, Salmonella enterica enterica serovar Typhi Ty2
ucggcguguagccaaucagc

SEQ ID NO: 3679791 - RNA, 13 nt, Salmonella enterica enterica serovar Typhi Ty2
ucggcucagcaau

SEQ ID NO: 3679792 - RNA, 18 nt, Salmonella enterica enterica serovar Typhi Ty2
ucggcuccaauauuucag

SEQ ID NO: 3679793 - RNA, 12 nt, Salmonella enterica enterica serovar Typhi Ty2
ucggcuggcagc

SEQ ID NO: 3679794 - RNA, 22 nt, Salmonella enterica enterica serovar Typhi Ty2
ucggcuggcauuuuuauuuaac

SEQ ID NO: 3679795 - RNA, 19 nt, Salmonella enterica enterica serovar Typhi Ty2
ucggcuuugacguaauacc

SEQ ID NO: 3679796 - RNA, 14 nt, Salmonella enterica enterica serovar Typhi Ty2
ucggcuuuuuucaa

SEQ ID NO: 3679797 - RNA, 22 nt, Salmonella enterica enterica serovar Typhi Ty2
ucgggaaguccuucuccuucgc

SEQ ID NO: 3679798 - RNA, 19 nt, Salmonella enterica enterica serovar Typhi Ty2
ucgggagcagugauuaugc

SEQ ID NO: 3679799 - RNA, 23 nt, Salmonella enterica enterica serovar Typhi Ty2
ucgggauugccgccgcgcuggug

SEQ ID NO: 3679800 - RNA, 16 nt, Salmonella enterica enterica serovar Typhi Ty2
ucggggucuuccagca

SEQ ID NO: 3679801 - RNA, 23 nt, Salmonella enterica enterica serovar Typhi Ty2
ucgggugagacgcagccucucuu

SEQ ID NO: 3679802 - RNA, 19 nt, Salmonella enterica enterica serovar Typhi Ty2
ucgggugauaaaauaaaca

SEQ ID NO: 3679803 - RNA, 21 nt, Salmonella enterica enterica serovar Typhi Ty2
ucggguucacuuuaccaggca

SEQ ID NO: 3679804 - RNA, 20 nt, Salmonella enterica enterica serovar Typhi Ty2
ucguucacguaaucgccgug

SEQ ID NO: 3679805 - RNA, 15 nt, Salmonella enterica enterica serovar Typhi Ty2
ucguuccgccaggcg

SEQ ID NO: 3679806 - RNA, 22 nt, Salmonella enterica enterica serovar Typhi Ty2
ucguucgauagcguuuuccagc

SEQ ID NO: 3679807 - RNA, 22 nt, Salmonella enterica enterica serovar Typhi Ty2
ucguucgcccuucaucuuccag

SEQ ID NO: 3679808 - RNA, 15 nt, Salmonella enterica enterica serovar Typhi Ty2
ucguugccagcggcc

SEQ ID NO: 3679809 - RNA, 14 nt, Salmonella enterica enterica serovar Typhi Ty2
ucguugccauuggu

SEQ ID NO: 3679810 - RNA, 12 nt, Salmonella enterica enterica serovar Typhi Ty2
ucguugcgccug

SEQ ID NO: 3679811 - RNA, 21 nt, Salmonella enterica enterica serovar Typhi Ty2
ucguuggcauggucagcauaa

SEQ ID NO: 3679812 - RNA, 24 nt, Salmonella enterica enterica serovar Typhi Ty2
ucguuguccacuguucguccauaa

SEQ ID NO: 3679813 - RNA, 20 nt, Salmonella enterica enterica serovar Typhi Ty2
ucguuuacaccuauuccucc

SEQ ID NO: 3679814 - RNA, 14 nt, Salmonella enterica enterica serovar Typhi Ty2
ucguuuccagcgaa

SEQ ID NO: 3679815 - RNA, 13 nt, Salmonella enterica enterica serovar Typhi Ty2
ucguuucuacaau

SEQ ID NO: 3679816 - RNA, 15 nt, Salmonella enterica enterica serovar Typhi Ty2
ucguuugcaguuccg

SEQ ID NO: 3679817 - RNA, 17 nt, Salmonella enterica enterica serovar Typhi Ty2
ucguuugcaguuccgca

SEQ ID NO: 3679818 - RNA, 22 nt, Salmonella enterica enterica serovar Typhi Ty2
ucguuugcgcgcacguugggca

SEQ ID NO: 3679819 - RNA, 17 nt, Salmonella enterica enterica serovar Typhi Ty2
ucguuuuugucuccuca

SEQ ID NO: 3679820 - RNA, 17 nt, Salmonella enterica enterica serovar Typhi Ty2
ucguuuuuguuuaaaaa

SEQ ID NO: 3679821 - RNA, 11 nt, Salmonella enterica enterica serovar Typhi Ty2
ucuaaaaagga

SEQ ID NO: 3679822 - RNA, 12 nt, Salmonella enterica enterica serovar Typhi Ty2
ucuaaaaaggaa

SEQ ID NO: 3679823 - RNA, 23 nt, Salmonella enterica enterica serovar Typhi Ty2
ucuaaagagacagaaucaggcca

SEQ ID NO: 3679824 - RNA, 23 nt, Salmonella enterica enterica serovar Typhi Ty2
ucuaaaucuacccaauugaauuu

SEQ ID NO: 3679825 - RNA, 21 nt, Salmonella enterica enterica serovar Typhi Ty2
ucuaacgcaacggaaggaaau

SEQ ID NO: 3679826 - RNA, 21 nt, Salmonella enterica enterica serovar Typhi Ty2
ucuaauugacggccaccauga

SEQ ID NO: 3679827 - RNA, 20 nt, Salmonella enterica enterica serovar Typhi Ty2
ucuacaguuugucaucaguc

SEQ ID NO: 3679828 - RNA, 15 nt, Salmonella enterica enterica serovar Typhi Ty2
ucuacaucaagagaa

SEQ ID NO: 3679829 - RNA, 20 nt, Salmonella enterica enterica serovar Typhi Ty2
ucuacaugcccuucuuuaau

SEQ ID NO: 3679830 - RNA, 20 nt, Salmonella enterica enterica serovar Typhi Ty2
ucuaccaacugagcuaacga

SEQ ID NO: 3679831 - RNA, 18 nt, Salmonella enterica enterica serovar Typhi Ty2
ucuaccacgcugccgccg

SEQ ID NO: 3679832 - RNA, 15 nt, Salmonella enterica enterica serovar Typhi Ty2
ucuacgcgccagcag

SEQ ID NO: 3679833 - RNA, 16 nt, Salmonella enterica enterica serovar Typhi Ty2
ucuacggccacaaaac

SEQ ID NO: 3679834 - RNA, 16 nt, Salmonella enterica enterica serovar Typhi Ty2
ucuacugguuaaggau

SEQ ID NO: 3679835 - RNA, 15 nt, Salmonella enterica enterica serovar Typhi Ty2
ucuacuguuauugac

SEQ ID NO: 3679836 - RNA, 20 nt, Salmonella enterica enterica serovar Typhi Ty2
ucuacuuuccugaagguaga

SEQ ID NO: 3679837 - RNA, 13 nt, Salmonella enterica enterica serovar Typhi Ty2
ucuaggcgcugcu

SEQ ID NO: 3679838 - RNA, 22 nt, Salmonella enterica enterica serovar Typhi Ty2
ucuaucacuucaauguuagcau

SEQ ID NO: 3679839 - RNA, 21 nt, Salmonella enterica enterica serovar Typhi Ty2
ucuauccacuggguaaggcgc

SEQ ID NO: 3679840 - RNA, 22 nt, Salmonella enterica enterica serovar Typhi Ty2
ucuauccagacguuggauaaca

SEQ ID NO: 3679841 - RNA, 14 nt, Salmonella enterica enterica serovar Typhi Ty2
ucuaucgccagcgc

SEQ ID NO: 3679842 - RNA, 14 nt, Salmonella enterica enterica serovar Typhi Ty2
ucuaucgccuggag

SEQ ID NO: 3679843 - RNA, 16 nt, Salmonella enterica enterica serovar Typhi Ty2
ucuaucggcaaaccau

SEQ ID NO: 3679844 - RNA, 17 nt, Salmonella enterica enterica serovar Typhi Ty2
ucuaucuguaacuucgg

SEQ ID NO: 3679845 - RNA, 19 nt, Salmonella enterica enterica serovar Typhi Ty2
ucuaucuguuuuaauuccu

SEQ ID NO: 3679846 - RNA, 13 nt, Salmonella enterica enterica serovar Typhi Ty2
ucuaucuuuucaa

SEQ ID NO: 3679847 - RNA, 17 nt, Salmonella enterica enterica serovar Typhi Ty2
ucuaugaaugccggaug

SEQ ID NO: 3679848 - RNA, 13 nt, Salmonella enterica enterica serovar Typhi Ty2
ucuaugcaaaaga

SEQ ID NO: 3679849 - RNA, 14 nt, Salmonella enterica enterica serovar Typhi Ty2
ucuaugcgcuaugu

SEQ ID NO: 3679850 - RNA, 16 nt, Salmonella enterica enterica serovar Typhi Ty2
ucuauuaaaucagaua

SEQ ID NO: 3679851 - RNA, 11 nt, Salmonella enterica enterica serovar Typhi Ty2
ucuauuauuga

SEQ ID NO: 3679852 - RNA, 13 nt, Salmonella enterica enterica serovar Typhi Ty2
ucuauugauuggc

SEQ ID NO: 3679853 - RNA, 23 nt, Salmonella enterica enterica serovar Typhi Ty2
ucuauugauuggcaagaauuauu

SEQ ID NO: 3679854 - RNA, 16 nt, Salmonella enterica enterica serovar Typhi Ty2
ucuauuuauugaagau

SEQ ID NO: 3679855 - RNA, 14 nt, Salmonella enterica enterica serovar Typhi Ty2
ucucaaaaaauauc

SEQ ID NO: 3679856 - RNA, 16 nt, Salmonella enterica enterica serovar Typhi Ty2
ucucaaaggccugcau

SEQ ID NO: 3679857 - RNA, 16 nt, Salmonella enterica enterica serovar Typhi Ty2
ucucaauaaaaugucu

SEQ ID NO: 3679858 - RNA, 19 nt, Salmonella enterica enterica serovar Typhi Ty2
ucucaauaucguugccgcc

SEQ ID NO: 3679859 - RNA, 13 nt, Salmonella enterica enterica serovar Typhi Ty2
ucucaaugaacag

SEQ ID NO: 3679860 - RNA, 13 nt, Salmonella enterica enterica serovar Typhi Ty2
ucucacacauugg

SEQ ID NO: 3679861 - RNA, 22 nt, Salmonella enterica enterica serovar Typhi Ty2
ucucaccgccuaggccagugcc

SEQ ID NO: 3679862 - RNA, 14 nt, Salmonella enterica enterica serovar Typhi Ty2
ucucagauaauagc

SEQ ID NO: 3679863 - RNA, 23 nt, Salmonella enterica enterica serovar Typhi Ty2
ucucaggguguuuuuauacaucc

SEQ ID NO: 3679864 - RNA, 19 nt, Salmonella enterica enterica serovar Typhi Ty2
ucucauaaaacauuccuga

SEQ ID NO: 3679865 - RNA, 18 nt, Salmonella enterica enterica serovar Typhi Ty2
ucucauaaacgccuggag

SEQ ID NO: 3679866 - RNA, 12 nt, Salmonella enterica enterica serovar Typhi Ty2
ucucauccagcu

SEQ ID NO: 3679867 - RNA, 19 nt, Salmonella enterica enterica serovar Typhi Ty2
ucucauccagcuugccguc

SEQ ID NO: 3679868 - RNA, 16 nt, Salmonella enterica enterica serovar Typhi Ty2
ucucaucugaugauua

SEQ ID NO: 3679869 - RNA, 15 nt, Salmonella enterica enterica serovar Typhi Ty2
ucucauugaucaguu

SEQ ID NO: 3679870 - RNA, 18 nt, Salmonella enterica enterica serovar Typhi Ty2
ucucauuuucuuuacgcu

SEQ ID NO: 3679871 - RNA, 19 nt, Salmonella enterica enterica serovar Typhi Ty2
ucuccagaucgcauaaaau

SEQ ID NO: 3679872 - RNA, 22 nt, Salmonella enterica enterica serovar Typhi Ty2
ucuccagggcaacggccagcgc

SEQ ID NO: 3679873 - RNA, 15 nt, Salmonella enterica enterica serovar Typhi Ty2
ucuccaguaucagcg

SEQ ID NO: 3679874 - RNA, 15 nt, Salmonella enterica enterica serovar Typhi Ty2
ucucccaaaugaaaa

SEQ ID NO: 3679875 - RNA, 12 nt, Salmonella enterica enterica serovar Typhi Ty2
ucucccagcaug

SEQ ID NO: 3679876 - RNA, 18 nt, Salmonella enterica enterica serovar Typhi Ty2
ucucccgaucuucugaug

SEQ ID NO: 3679877 - RNA, 20 nt, Salmonella enterica enterica serovar Typhi Ty2
ucucccguuuguauaaauua

SEQ ID NO: 3679878 - RNA, 15 nt, Salmonella enterica enterica serovar Typhi Ty2
ucucccuccccauuc

SEQ ID NO: 3679879 - RNA, 13 nt, Salmonella enterica enterica serovar Typhi Ty2
ucucccuggcagu

SEQ ID NO: 3679880 - RNA, 19 nt, Salmonella enterica enterica serovar Typhi Ty2
ucuccgacauuguucuaaa

SEQ ID NO: 3679881 - RNA, 15 nt, Salmonella enterica enterica serovar Typhi Ty2
ucuccgccgccuggc

SEQ ID NO: 3679882 - RNA, 21 nt, Salmonella enterica enterica serovar Typhi Ty2
ucuccggcacauucaccacgc

SEQ ID NO: 3679883 - RNA, 19 nt, Salmonella enterica enterica serovar Typhi Ty2
ucuccggcagcgaauguau

SEQ ID NO: 3679884 - RNA, 23 nt, Salmonella enterica enterica serovar Typhi Ty2
ucuccggcagcguauugagcugg

SEQ ID NO: 3679885 - RNA, 19 nt, Salmonella enterica enterica serovar Typhi Ty2
ucuccgggaaaaacguguc

SEQ ID NO: 3679886 - RNA, 22 nt, Salmonella enterica enterica serovar Typhi Ty2
ucugcuccgcgccgaaauuuuc

SEQ ID NO: 3679887 - RNA, 16 nt, Salmonella enterica enterica serovar Typhi Ty2
ucugcugaaaugccug

SEQ ID NO: 3679888 - RNA, 23 nt, Salmonella enterica enterica serovar Typhi Ty2
ucugcugacacccucugcgccuu

SEQ ID NO: 3679889 - RNA, 22 nt, Salmonella enterica enterica serovar Typhi Ty2
ucugcugaugcugguuuuagcu

SEQ ID NO: 3679890 - RNA, 14 nt, Salmonella enterica enterica serovar Typhi Ty2
ucugcugccagcgc

SEQ ID NO: 3679891 - RNA, 19 nt, Salmonella enterica enterica serovar Typhi Ty2
ucugcugccucaucaauuc

SEQ ID NO: 3679892 - RNA, 21 nt, Salmonella enterica enterica serovar Typhi Ty2
ucugcugggcgauuucacgaa

SEQ ID NO: 3679893 - RNA, 16 nt, Salmonella enterica enterica serovar Typhi Ty2
ucugcuguuccuucag

SEQ ID NO: 3679894 - RNA, 20 nt, Salmonella enterica enterica serovar Typhi Ty2
ucugcuuaugaucgcccagc

SEQ ID NO: 3679895 - RNA, 14 nt, Salmonella enterica enterica serovar Typhi Ty2
ucugcuuccagaau

SEQ ID NO: 3679896 - RNA, 18 nt, Salmonella enterica enterica serovar Typhi Ty2
ucugcuugagcaggcaga

SEQ ID NO: 3679897 - RNA, 23 nt, Salmonella enterica enterica serovar Typhi Ty2
ucugcuuuuugauacagcagcac

SEQ ID NO: 3679898 - RNA, 19 nt, Salmonella enterica enterica serovar Typhi Ty2
ucuggaaagcgccucgcaa

SEQ ID NO: 3679899 - RNA, 19 nt, Salmonella enterica enterica serovar Typhi Ty2
ucuggacgggccgccaucu

SEQ ID NO: 3679900 - RNA, 17 nt, Salmonella enterica enterica serovar Typhi Ty2
ucuggauagucuucaag

SEQ ID NO: 3679901 - RNA, 17 nt, Salmonella enterica enterica serovar Typhi Ty2
ucuggauuacaaaaaua

SEQ ID NO: 3679902 - RNA, 15 nt, Salmonella enterica enterica serovar Typhi Ty2
ucuggcacagggcaa

SEQ ID NO: 3679903 - RNA, 15 nt, Salmonella enterica enterica serovar Typhi Ty2
ucuggccucuuauca

SEQ ID NO: 3679904 - RNA, 18 nt, Salmonella enterica enterica serovar Typhi Ty2
ucuggcgacuaaccagcg

SEQ ID NO: 3679905 - RNA, 14 nt, Salmonella enterica enterica serovar Typhi Ty2
ucuggcgagaacac

SEQ ID NO: 3679906 - RNA, 23 nt, Salmonella enterica enterica serovar Typhi Ty2
ucuggcgcagauacgcgucaaag

SEQ ID NO: 3679907 - RNA, 14 nt, Salmonella enterica enterica serovar Typhi Ty2
ucuggcggcguaau

SEQ ID NO: 3679908 - RNA, 20 nt, Salmonella enterica enterica serovar Typhi Ty2
ucuggcgugccgggcuggcg

SEQ ID NO: 3679909 - RNA, 14 nt, Salmonella enterica enterica serovar Typhi Ty2
ucuggcucagacca

SEQ ID NO: 3679910 - RNA, 13 nt, Salmonella enterica enterica serovar Typhi Ty2
ucuggcucccgca

SEQ ID NO: 3679911 - RNA, 17 nt, Salmonella enterica enterica serovar Typhi Ty2
ucuggguaacgcucuua

SEQ ID NO: 3679912 - RNA, 18 nt, Salmonella enterica enterica serovar Typhi Ty2
ucuggguuagcuguaucc

SEQ ID NO: 3679913 - RNA, 15 nt, Salmonella enterica enterica serovar Typhi Ty2
ucugguaucgagugg

SEQ ID NO: 3679914 - RNA, 20 nt, Salmonella enterica enterica serovar Typhi Ty2
ucuggucagcgaugacgccu

SEQ ID NO: 3679915 - RNA, 22 nt, Salmonella enterica enterica serovar Typhi Ty2
ucuggucauggcuuagcgccag

SEQ ID NO: 3679916 - RNA, 19 nt, Salmonella enterica enterica serovar Typhi Ty2
ucugguuucccugccucaa

SEQ ID NO: 3679917 - RNA, 21 nt, Salmonella enterica enterica serovar Typhi Ty2
ucuguaagagacugacaauga

SEQ ID NO: 3679918 - RNA, 15 nt, Salmonella enterica enterica serovar Typhi Ty2
ucuguaauuauaaau

SEQ ID NO: 3679919 - RNA, 21 nt, Salmonella enterica enterica serovar Typhi Ty2
ucuguaauucucccaaauuuu

SEQ ID NO: 3679920 - RNA, 21 nt, Salmonella enterica enterica serovar Typhi Ty2
ucuguacagcgucgacagccc

SEQ ID NO: 3679921 - RNA, 15 nt, Salmonella enterica enterica serovar Typhi Ty2
ucuguaccaccagaa

SEQ ID NO: 3679922 - RNA, 18 nt, Salmonella enterica enterica serovar Typhi Ty2
ucuguacgcugaauaacc

SEQ ID NO: 3679923 - RNA, 16 nt, Salmonella enterica enterica serovar Typhi Ty2
ucuguacggcauauuc

SEQ ID NO: 3679924 - RNA, 13 nt, Salmonella enterica enterica serovar Typhi Ty2
ucuguaggccgga

SEQ ID NO: 3679925 - RNA, 20 nt, Salmonella enterica enterica serovar Typhi Ty2
ucuguaggccggauaagcgg

SEQ ID NO: 3679926 - RNA, 20 nt, Salmonella enterica enterica serovar Typhi Ty2
ucuguaggccugauaagcgc

SEQ ID NO: 3679927 - RNA, 13 nt, Salmonella enterica enterica serovar Typhi Ty2
ucuguauaaaaua

SEQ ID NO: 3679928 - RNA, 18 nt, Salmonella enterica enterica serovar Typhi Ty2
ucuguauaaaauauuugg

SEQ ID NO: 3679929 - RNA, 13 nt, Salmonella enterica enterica serovar Typhi Ty2
ucuguauuuaaua

SEQ ID NO: 3679930 - RNA, 19 nt, Salmonella enterica enterica serovar Typhi Ty2
ucuguccgaugagaaguag

SEQ ID NO: 3679931 - RNA, 19 nt, Salmonella enterica enterica serovar Typhi Ty2
ucuguccgcuuuuuuauug

SEQ ID NO: 3679932 - RNA, 18 nt, Salmonella enterica enterica serovar Typhi Ty2
ucugucucaauaaaaugu

SEQ ID NO: 3679933 - RNA, 16 nt, Salmonella enterica enterica serovar Typhi Ty2
ucugugaaaguuucag

SEQ ID NO: 3679934 - RNA, 19 nt, Salmonella enterica enterica serovar Typhi Ty2
ucugugaaaguuucaggau

SEQ ID NO: 3679935 - RNA, 16 nt, Salmonella enterica enterica serovar Typhi Ty2
ucugugagugcgccag

SEQ ID NO: 3679936 - RNA, 23 nt, Salmonella enterica enterica serovar Typhi Ty2
ucuguggccgcgcauguuugccu

SEQ ID NO: 3679937 - RNA, 19 nt, Salmonella enterica enterica serovar Typhi Ty2
ucuguggggcuuaacccac

SEQ ID NO: 3679938 - RNA, 22 nt, Salmonella enterica enterica serovar Typhi Ty2
ucugugucguccaggccugaua

SEQ ID NO: 3679939 - RNA, 15 nt, Salmonella enterica enterica serovar Typhi Ty2
ucuguguugaauaaa

SEQ ID NO: 3679940 - RNA, 14 nt, Salmonella enterica enterica serovar Typhi Ty2
ucuguuauauauuu

SEQ ID NO: 3679941 - RNA, 23 nt, Salmonella enterica enterica serovar Typhi Ty2
ucuguuaucaggcguagagaggc

SEQ ID NO: 3679942 - RNA, 13 nt, Salmonella enterica enterica serovar Typhi Ty2
ucuguuaucugga

SEQ ID NO: 3679943 - RNA, 11 nt, Salmonella enterica enterica serovar Typhi Ty2
ucuguuauuuc

SEQ ID NO: 3679944 - RNA, 21 nt, Salmonella enterica enterica serovar Typhi Ty2
ucuguucuacuacagaaagcc

SEQ ID NO: 3679945 - RNA, 23 nt, Salmonella enterica enterica serovar Typhi Ty2
ucuguucuacuacagaaagccau

SEQ ID NO: 3679946 - RNA, 15 nt, Salmonella enterica enterica serovar Typhi Ty2
ucuguugcgccaggg

SEQ ID NO: 3679947 - RNA, 21 nt, Salmonella enterica enterica serovar Typhi Ty2
ucuguuucaguucggagauca

SEQ ID NO: 3679948 - RNA, 22 nt, Salmonella enterica enterica serovar Typhi Ty2
ucuguuucaguucggagaucag

SEQ ID NO: 3679949 - RNA, 14 nt, Salmonella enterica enterica serovar Typhi Ty2
ucuguuuguucgca

SEQ ID NO: 3679950 - RNA, 14 nt, Salmonella enterica enterica serovar Typhi Ty2
ucuuaaaucaugaa

SEQ ID NO: 3679951 - RNA, 19 nt, Salmonella enterica enterica serovar Typhi Ty2
ucuuaauuccucagaaucc

SEQ ID NO: 3679952 - RNA, 16 nt, Salmonella enterica enterica serovar Typhi Ty2
ucuuacacuuagcaca

SEQ ID NO: 3679953 - RNA, 16 nt, Salmonella enterica enterica serovar Typhi Ty2
ucuuacagggcgaugc

SEQ ID NO: 3679954 - RNA, 13 nt, Salmonella enterica enterica serovar Typhi Ty2
ucuuaccacgccg

SEQ ID NO: 3679955 - RNA, 21 nt, Salmonella enterica enterica serovar Typhi Ty2
ucuuaccaggucuuaccuauu

SEQ ID NO: 3679956 - RNA, 16 nt, Salmonella enterica enterica serovar Typhi Ty2
ucuuacggauaaaaac

SEQ ID NO: 3679957 - RNA, 22 nt, Salmonella enterica enterica serovar Typhi Ty2
ucuuacguugcauuuaucaauc

SEQ ID NO: 3679958 - RNA, 20 nt, Salmonella enterica enterica serovar Typhi Ty2
ucuuacuaauaaauauucau

SEQ ID NO: 3679959 - RNA, 21 nt, Salmonella enterica enterica serovar Typhi Ty2
ucuuacuaauaaauauucauc

SEQ ID NO: 3679960 - RNA, 16 nt, Salmonella enterica enterica serovar Typhi Ty2
ucuuacugaccggccc

SEQ ID NO: 3679961 - RNA, 23 nt, Salmonella enterica enterica serovar Typhi Ty2
ucuuagaauagaaucaauuucuc

SEQ ID NO: 3679962 - RNA, 24 nt, Salmonella enterica enterica serovar Typhi Ty2
ucuuagguucguagcgcaaauauc

SEQ ID NO: 3679963 - RNA, 14 nt, Salmonella enterica enterica serovar Typhi Ty2
ucuuaguaacauaa

SEQ ID NO: 3679964 - RNA, 12 nt, Salmonella enterica enterica serovar Typhi Ty2
ucuuauccgacu

SEQ ID NO: 3679965 - RNA, 21 nt, Salmonella enterica enterica serovar Typhi Ty2
ucuuauccgcuuuuaaacggc

SEQ ID NO: 3679966 - RNA, 15 nt, Salmonella enterica enterica serovar Typhi Ty2
ucuuauccggccugc

SEQ ID NO: 3679967 - RNA, 15 nt, Salmonella enterica enterica serovar Typhi Ty2
ucuuaugccgcuuuu

SEQ ID NO: 3679968 - RNA, 18 nt, Salmonella enterica enterica serovar Typhi Ty2
ucuugugaguaauaauca

SEQ ID NO: 3679969 - RNA, 21 nt, Salmonella enterica enterica serovar Typhi Ty2
ucuugugcuuccagcuccauc

SEQ ID NO: 3679970 - RNA, 13 nt, Salmonella enterica enterica serovar Typhi Ty2
ucuuguggaacac

SEQ ID NO: 3679971 - RNA, 14 nt, Salmonella enterica enterica serovar Typhi Ty2
ucuuuaaauuucag

SEQ ID NO: 3679972 - RNA, 14 nt, Salmonella enterica enterica serovar Typhi Ty2
ucuuuaauacgcgu

SEQ ID NO: 3679973 - RNA, 18 nt, Salmonella enterica enterica serovar Typhi Ty2
ucuuuacgcuaucgggcg

SEQ ID NO: 3679974 - RNA, 15 nt, Salmonella enterica enterica serovar Typhi Ty2
ucuuuacuaauaccu

SEQ ID NO: 3679975 - RNA, 17 nt, Salmonella enterica enterica serovar Typhi Ty2
ucuuuagauaauuucgc

SEQ ID NO: 3679976 - RNA, 21 nt, Salmonella enterica enterica serovar Typhi Ty2
ucuuuagcgcuaauuccuguc

SEQ ID NO: 3679977 - RNA, 16 nt, Salmonella enterica enterica serovar Typhi Ty2
ucuuuauccugaagau

SEQ ID NO: 3679978 - RNA, 21 nt, Salmonella enterica enterica serovar Typhi Ty2
ucuuuaucuucugcugcuccc

SEQ ID NO: 3679979 - RNA, 17 nt, Salmonella enterica enterica serovar Typhi Ty2
ucuuucauuucugccug

SEQ ID NO: 3679980 - RNA, 14 nt, Salmonella enterica enterica serovar Typhi Ty2
ucuuucauuuuacc

SEQ ID NO: 3679981 - RNA, 13 nt, Salmonella enterica enterica serovar Typhi Ty2
ucuuucccggcaa

SEQ ID NO: 3679982 - RNA, 13 nt, Salmonella enterica enterica serovar Typhi Ty2
ucuuucccuuuuu

SEQ ID NO: 3679983 - RNA, 21 nt, Salmonella enterica enterica serovar Typhi Ty2
ucuuucugaaacggaucaaaa

SEQ ID NO: 3679984 - RNA, 18 nt, Salmonella enterica enterica serovar Typhi Ty2
ucuuucugcgcacgagug

SEQ ID NO: 3679985 - RNA, 14 nt, Salmonella enterica enterica serovar Typhi Ty2
ucuuucuuuuuaua

SEQ ID NO: 3679986 - RNA, 15 nt, Salmonella enterica enterica serovar Typhi Ty2
ucuuugaccagcgac

SEQ ID NO: 3679987 - RNA, 20 nt, Salmonella enterica enterica serovar Typhi Ty2
ucuuugaccagcgacgauga

SEQ ID NO: 3679988 - RNA, 20 nt, Salmonella enterica enterica serovar Typhi Ty2
ucuuugcagcuccuuuuaau

SEQ ID NO: 3679989 - RNA, 17 nt, Salmonella enterica enterica serovar Typhi Ty2
ucuuugccaaacugcug

SEQ ID NO: 3679990 - RNA, 22 nt, Salmonella enterica enterica serovar Typhi Ty2
ucuuugcuuuguaaagcgccau

SEQ ID NO: 3679991 - RNA, 15 nt, Salmonella enterica enterica serovar Typhi Ty2
ucuuuggacggcauc

SEQ ID NO: 3679992 - RNA, 22 nt, Salmonella enterica enterica serovar Typhi Ty2
ucuuuggccaguaucgcgccgc

SEQ ID NO: 3679993 - RNA, 12 nt, Salmonella enterica enterica serovar Typhi Ty2
ucuuuggcgauu

SEQ ID NO: 3679994 - RNA, 17 nt, Salmonella enterica enterica serovar Typhi Ty2
ucuuuguccugaaggac

SEQ ID NO: 3679995 - RNA, 15 nt, Salmonella enterica enterica serovar Typhi Ty2
ucuuuuaacauaagu

SEQ ID NO: 3679996 - RNA, 15 nt, Salmonella enterica enterica serovar Typhi Ty2
ucuuuuaauuuucug

SEQ ID NO: 3679997 - RNA, 15 nt, Salmonella enterica enterica serovar Typhi Ty2
ucuuuuauauguuga

SEQ ID NO: 3679998 - RNA, 20 nt, Salmonella enterica enterica serovar Typhi Ty2
ucuuuuaucguugcuucgcg

SEQ ID NO: 3679999 - RNA, 12 nt, Salmonella enterica enterica serovar Typhi Ty2
ucuuuuauuauu

SEQ ID NO: 3680000 - RNA, 13 nt, Salmonella enterica enterica serovar Typhi Ty2
ucuuuucaauaaa

SEQ ID NO: 3680001 - RNA, 20 nt, Salmonella enterica enterica serovar Typhi Ty2
ucuuuugucguccccuggac

SEQ ID NO: 3680002 - RNA, 17 nt, Salmonella enterica enterica serovar Typhi Ty2
ucuuuuguuuuucucuu

SEQ ID NO: 3680003 - RNA, 23 nt, Salmonella enterica enterica serovar Typhi Ty2
ucuuuuucgaucagcauaucgau

SEQ ID NO: 3680004 - RNA, 11 nt, Salmonella enterica enterica serovar Typhi Ty2
ugaaaaaaacg

SEQ ID NO: 3680005 - RNA, 13 nt, Salmonella enterica enterica serovar Typhi Ty2
ugaaaaaacgggc

SEQ ID NO: 3680006 - RNA, 13 nt, Salmonella enterica enterica serovar Typhi Ty2
ugaaaaacgggag

SEQ ID NO: 3680007 - RNA, 11 nt, Salmonella enterica enterica serovar Typhi Ty2
ugaaaaagaau

SEQ ID NO: 3680008 - RNA, 16 nt, Salmonella enterica enterica serovar Typhi Ty2
ugaaaaauauaaaaag

SEQ ID NO: 3680009 - RNA, 13 nt, Salmonella enterica enterica serovar Typhi Ty2
ugaaaaauguuca

SEQ ID NO: 3680010 - RNA, 13 nt, Salmonella enterica enterica serovar Typhi Ty2
ugaaaacaccagg

SEQ ID NO: 3680011 - RNA, 23 nt, Salmonella enterica enterica serovar Typhi Ty2
ugaaaacaggccugcggaaaaag

SEQ ID NO: 3680012 - RNA, 24 nt, Salmonella enterica enterica serovar Typhi Ty2
ugaaaaccacaaucacagcgcaga

SEQ ID NO: 3680013 - RNA, 18 nt, Salmonella enterica enterica serovar Typhi Ty2
ugaaaaccaggaaccgcg

SEQ ID NO: 3680014 - RNA, 14 nt, Salmonella enterica enterica serovar Typhi Ty2
ugaaaacgaaucuc

SEQ ID NO: 3680015 - RNA, 21 nt, Salmonella enterica enterica serovar Typhi Ty2
ugaaaacgcagccccaguugg

SEQ ID NO: 3680016 - RNA, 15 nt, Salmonella enterica enterica serovar Typhi Ty2
ugaaaacggcaucaa

SEQ ID NO: 3680017 - RNA, 17 nt, Salmonella enterica enterica serovar Typhi Ty2
ugaaaacucacgcccgc

SEQ ID NO: 3680018 - RNA, 19 nt, Salmonella enterica enterica serovar Typhi Ty2
ugaaaacucggcgggguuu

SEQ ID NO: 3680019 - RNA, 22 nt, Salmonella enterica enterica serovar Typhi Ty2
ugaaaacucggcgggguuuuuu

SEQ ID NO: 3680020 - RNA, 13 nt, Salmonella enterica enterica serovar Typhi Ty2
ugaaaagauaaag

SEQ ID NO: 3680021 - RNA, 12 nt, Salmonella enterica enterica serovar Typhi Ty2
ugaaaagggacu

SEQ ID NO: 3680022 - RNA, 15 nt, Salmonella enterica enterica serovar Typhi Ty2
ugaaaaucaaaaaca

SEQ ID NO: 3680023 - RNA, 21 nt, Salmonella enterica enterica serovar Typhi Ty2
ugaaaaugcguccagaggauc

SEQ ID NO: 3680024 - RNA, 23 nt, Salmonella enterica enterica serovar Typhi Ty2
ugaaaaugugguauuaacccaga

SEQ ID NO: 3680025 - RNA, 18 nt, Salmonella enterica enterica serovar Typhi Ty2
ugaaacccauaauaauga

SEQ ID NO: 3680026 - RNA, 14 nt, Salmonella enterica enterica serovar Typhi Ty2
ugaaaccccaaauc

SEQ ID NO: 3680027 - RNA, 20 nt, Salmonella enterica enterica serovar Typhi Ty2
ugaaaccccaaaucagcaaa

SEQ ID NO: 3680028 - RNA, 12 nt, Salmonella enterica enterica serovar Typhi Ty2
ugaaacccgcca

SEQ ID NO: 3680029 - RNA, 22 nt, Salmonella enterica enterica serovar Typhi Ty2
ugaaaccggcgcgccuuccagc

SEQ ID NO: 3680030 - RNA, 17 nt, Salmonella enterica enterica serovar Typhi Ty2
ugaaacgcccuucccag

SEQ ID NO: 3680031 - RNA, 21 nt, Salmonella enterica enterica serovar Typhi Ty2
ugaaacgccguuuguuuauug

SEQ ID NO: 3680032 - RNA, 18 nt, Salmonella enterica enterica serovar Typhi Ty2
ugaaacguguuuaucccc

SEQ ID NO: 3680033 - RNA, 17 nt, Salmonella enterica enterica serovar Typhi Ty2
ugaaacucgccaugcca

SEQ ID NO: 3680034 - RNA, 19 nt, Salmonella enterica enterica serovar Typhi Ty2
ugaaacucgccaugccauc

SEQ ID NO: 3680035 - RNA, 21 nt, Salmonella enterica enterica serovar Typhi Ty2
ugaaacucgccaugccaucgg

SEQ ID NO: 3680036 - RNA, 18 nt, Salmonella enterica enterica serovar Typhi Ty2
ugaaacugaaccaacagc

SEQ ID NO: 3680037 - RNA, 15 nt, Salmonella enterica enterica serovar Typhi Ty2
ugaaagaaaucaccg

SEQ ID NO: 3680038 - RNA, 14 nt, Salmonella enterica enterica serovar Typhi Ty2
ugaaagauuauuuu

SEQ ID NO: 3680039 - RNA, 12 nt, Salmonella enterica enterica serovar Typhi Ty2
ugaaagcgcaaa

SEQ ID NO: 3680040 - RNA, 18 nt, Salmonella enterica enterica serovar Typhi Ty2
ugaaaggaagugcaacug

SEQ ID NO: 3680041 - RNA, 18 nt, Salmonella enterica enterica serovar Typhi Ty2
ugaaaggcuugcaggaug

SEQ ID NO: 3680042 - RNA, 12 nt, Salmonella enterica enterica serovar Typhi Ty2
ugaaaggguggg

SEQ ID NO: 3680043 - RNA, 16 nt, Salmonella enterica enterica serovar Typhi Ty2
ugaaauaacagacucc

SEQ ID NO: 3680044 - RNA, 19 nt, Salmonella enterica enterica serovar Typhi Ty2
ugaaauaauuguguaaucu

SEQ ID NO: 3680045 - RNA, 21 nt, Salmonella enterica enterica serovar Typhi Ty2
ugaaauaauuguguaaucuuu

SEQ ID NO: 3680046 - RNA, 14 nt, Salmonella enterica enterica serovar Typhi Ty2
ugaaauacagccag

SEQ ID NO: 3680047 - RNA, 18 nt, Salmonella enterica enterica serovar Typhi Ty2
ugaaauacagccagguug

SEQ ID NO: 3680048 - RNA, 16 nt, Salmonella enterica enterica serovar Typhi Ty2
ugaaauccggcuuuga

SEQ ID NO: 3680049 - RNA, 12 nt, Salmonella enterica enterica serovar Typhi Ty2
ugaaauccucua

SEQ ID NO: 3680050 - RNA, 20 nt, Salmonella enterica enterica serovar Typhi Ty2
ugaaaucgccuguuaauggu

SEQ ID NO: 3680051 - RNA, 21 nt, Salmonella enterica enterica serovar Typhi Ty2
ugaaucccccugccacaaccg

SEQ ID NO: 3680052 - RNA, 21 nt, Salmonella enterica enterica serovar Typhi Ty2
ugaaucgccgucagugagccc

SEQ ID NO: 3680053 - RNA, 18 nt, Salmonella enterica enterica serovar Typhi Ty2
ugaaucguagcgugcgca

SEQ ID NO: 3680054 - RNA, 24 nt, Salmonella enterica enterica serovar Typhi Ty2
ugaaucuggucggugauauauuca

SEQ ID NO: 3680055 - RNA, 22 nt, Salmonella enterica enterica serovar Typhi Ty2
ugaaugccccagcgcugcugua

SEQ ID NO: 3680056 - RNA, 17 nt, Salmonella enterica enterica serovar Typhi Ty2
ugaaugcccuuuuccag

SEQ ID NO: 3680057 - RNA, 18 nt, Salmonella enterica enterica serovar Typhi Ty2
ugaaugcccuuuuccaga

SEQ ID NO: 3680058 - RNA, 16 nt, Salmonella enterica enterica serovar Typhi Ty2
ugaaugccggauggcg

SEQ ID NO: 3680059 - RNA, 20 nt, Salmonella enterica enterica serovar Typhi Ty2
ugaaugcucucauauuccag

SEQ ID NO: 3680060 - RNA, 21 nt, Salmonella enterica enterica serovar Typhi Ty2
ugaaugcucucauauuccagc

SEQ ID NO: 3680061 - RNA, 18 nt, Salmonella enterica enterica serovar Typhi Ty2
ugaauggcggagaucucc

SEQ ID NO: 3680062 - RNA, 20 nt, Salmonella enterica enterica serovar Typhi Ty2
ugaauggcggagaucuccag

SEQ ID NO: 3680063 - RNA, 18 nt, Salmonella enterica enterica serovar Typhi Ty2
ugaauugccauuguucgc

SEQ ID NO: 3680064 - RNA, 17 nt, Salmonella enterica enterica serovar Typhi Ty2
ugaauugcgguuuaucc

SEQ ID NO: 3680065 - RNA, 22 nt, Salmonella enterica enterica serovar Typhi Ty2
ugaauuuaauggucuuaaaugc

SEQ ID NO: 3680066 - RNA, 14 nt, Salmonella enterica enterica serovar Typhi Ty2
ugaauuucucgcca

SEQ ID NO: 3680067 - RNA, 22 nt, Salmonella enterica enterica serovar Typhi Ty2
ugaauuuuagauccccaaacug

SEQ ID NO: 3680068 - RNA, 15 nt, Salmonella enterica enterica serovar Typhi Ty2
ugaauuuuauuagua

SEQ ID NO: 3680069 - RNA, 16 nt, Salmonella enterica enterica serovar Typhi Ty2
ugacaaaaauuaaaac

SEQ ID NO: 3680070 - RNA, 23 nt, Salmonella enterica enterica serovar Typhi Ty2
ugacaaacucacguuccccagca

SEQ ID NO: 3680071 - RNA, 20 nt, Salmonella enterica enterica serovar Typhi Ty2
ugacaaauuguuuaaaaaca

SEQ ID NO: 3680072 - RNA, 22 nt, Salmonella enterica enterica serovar Typhi Ty2
ugacaaauuguuuaaaaacagg

SEQ ID NO: 3680073 - RNA, 13 nt, Salmonella enterica enterica serovar Typhi Ty2
ugacaaccugccg

SEQ ID NO: 3680074 - RNA, 13 nt, Salmonella enterica enterica serovar Typhi Ty2
ugacaauacugca

SEQ ID NO: 3680075 - RNA, 16 nt, Salmonella enterica enterica serovar Typhi Ty2
ugacaaucucaauacc

SEQ ID NO: 3680076 - RNA, 21 nt, Salmonella enterica enterica serovar Typhi Ty2
ugacaaucuccuccggcuuca

SEQ ID NO: 3680077 - RNA, 11 nt, Salmonella enterica enterica serovar Typhi Ty2
ugacacagcgu

SEQ ID NO: 3680078 - RNA, 19 nt, Salmonella enterica enterica serovar Typhi Ty2
ugacacagcguacaauggc

SEQ ID NO: 3680079 - RNA, 23 nt, Salmonella enterica enterica serovar Typhi Ty2
ugacacccaucgcgacaucgccu

SEQ ID NO: 3680080 - RNA, 20 nt, Salmonella enterica enterica serovar Typhi Ty2
ugacacggaacaacggcaca

SEQ ID NO: 3680081 - RNA, 21 nt, Salmonella enterica enterica serovar Typhi Ty2
ugacacuauauugcgaauaaa

SEQ ID NO: 3680082 - RNA, 13 nt, Salmonella enterica enterica serovar Typhi Ty2
ugacacucaucca

SEQ ID NO: 3680083 - RNA, 16 nt, Salmonella enterica enterica serovar Typhi Ty2
ugacacucauccagac

SEQ ID NO: 3680084 - RNA, 14 nt, Salmonella enterica enterica serovar Typhi Ty2
ugacacugauauac

SEQ ID NO: 3680085 - RNA, 21 nt, Salmonella enterica enterica serovar Typhi Ty2
ugacacuguagcaacugccag

SEQ ID NO: 3680086 - RNA, 21 nt, Salmonella enterica enterica serovar Typhi Ty2
ugacagcaaguugcgccacug

SEQ ID NO: 3680087 - RNA, 19 nt, Salmonella enterica enterica serovar Typhi Ty2
ugacagcacaauuccggcc

SEQ ID NO: 3680088 - RNA, 18 nt, Salmonella enterica enterica serovar Typhi Ty2
ugacagcacauagccuaa

SEQ ID NO: 3680089 - RNA, 18 nt, Salmonella enterica enterica serovar Typhi Ty2
ugacagcaucgauuccgc

SEQ ID NO: 3680090 - RNA, 19 nt, Salmonella enterica enterica serovar Typhi Ty2
ugacagcaucgauuccgcc

SEQ ID NO: 3680091 - RNA, 19 nt, Salmonella enterica enterica serovar Typhi Ty2
ugacagccaaacugcugua

SEQ ID NO: 3680092 - RNA, 18 nt, Salmonella enterica enterica serovar Typhi Ty2
ugacauagcauaauaaug

SEQ ID NO: 3680093 - RNA, 18 nt, Salmonella enterica enterica serovar Typhi Ty2
ugacaucccccucuugcc

SEQ ID NO: 3680094 - RNA, 18 nt, Salmonella enterica enterica serovar Typhi Ty2
ugacaucucaucggcuuu

SEQ ID NO: 3680095 - RNA, 17 nt, Salmonella enterica enterica serovar Typhi Ty2
ugacauuacccggccag

SEQ ID NO: 3680096 - RNA, 19 nt, Salmonella enterica enterica serovar Typhi Ty2
ugacauucugacggcccuu

SEQ ID NO: 3680097 - RNA, 13 nt, Salmonella enterica enterica serovar Typhi Ty2
ugaccaacaacag

SEQ ID NO: 3680098 - RNA, 17 nt, Salmonella enterica enterica serovar Typhi Ty2
ugaccaacaacagauau

SEQ ID NO: 3680099 - RNA, 19 nt, Salmonella enterica enterica serovar Typhi Ty2
ugaccaacaucauuauucc

SEQ ID NO: 3680100 - RNA, 18 nt, Salmonella enterica enterica serovar Typhi Ty2
ugaccaagcgucagcaug

SEQ ID NO: 3680101 - RNA, 20 nt, Salmonella enterica enterica serovar Typhi Ty2
ugaccaagcgucagcauggu

SEQ ID NO: 3680102 - RNA, 21 nt, Salmonella enterica enterica serovar Typhi Ty2
ugaccaauguuaauaagcaga

SEQ ID NO: 3680103 - RNA, 15 nt, Salmonella enterica enterica serovar Typhi Ty2
ugaccacauuuucuc

SEQ ID NO: 3680104 - RNA, 15 nt, Salmonella enterica enterica serovar Typhi Ty2
ugaccaccagcgcga

SEQ ID NO: 3680105 - RNA, 13 nt, Salmonella enterica enterica serovar Typhi Ty2
ugaccaccgcauc

SEQ ID NO: 3680106 - RNA, 14 nt, Salmonella enterica enterica serovar Typhi Ty2
ugaccaccgcaucg

SEQ ID NO: 3680107 - RNA, 15 nt, Salmonella enterica enterica serovar Typhi Ty2
ugaccacggcgucaa

SEQ ID NO: 3680108 - RNA, 12 nt, Salmonella enterica enterica serovar Typhi Ty2
ugaccagcgccc

SEQ ID NO: 3680109 - RNA, 21 nt, Salmonella enterica enterica serovar Typhi Ty2
ugaccagcugacgacgccagc

SEQ ID NO: 3680110 - RNA, 17 nt, Salmonella enterica enterica serovar Typhi Ty2
ugaccagggcaaauuau

SEQ ID NO: 3680111 - RNA, 19 nt, Salmonella enterica enterica serovar Typhi Ty2
ugaccaggucgccagcggg

SEQ ID NO: 3680112 - RNA, 17 nt, Salmonella enterica enterica serovar Typhi Ty2
ugaccauauaugaaauc

SEQ ID NO: 3680113 - RNA, 18 nt, Salmonella enterica enterica serovar Typhi Ty2
ugaccauauaugaaaucg

SEQ ID NO: 3680114 - RNA, 15 nt, Salmonella enterica enterica serovar Typhi Ty2
ugaccaucaaauaau

SEQ ID NO: 3680115 - RNA, 16 nt, Salmonella enterica enterica serovar Typhi Ty2
ugaccaucgccagcca

SEQ ID NO: 3680116 - RNA, 16 nt, Salmonella enterica enterica serovar Typhi Ty2
ugaccaugcauauaag

SEQ ID NO: 3680117 - RNA, 17 nt, Salmonella enterica enterica serovar Typhi Ty2
ugaccaugccacaacag

SEQ ID NO: 3680118 - RNA, 19 nt, Salmonella enterica enterica serovar Typhi Ty2
ugaccauuaccauuccuca

SEQ ID NO: 3680119 - RNA, 13 nt, Salmonella enterica enterica serovar Typhi Ty2
ugaccccggccuc

SEQ ID NO: 3680120 - RNA, 13 nt, Salmonella enterica enterica serovar Typhi Ty2
ugacccgcagcaa

SEQ ID NO: 3680121 - RNA, 14 nt, Salmonella enterica enterica serovar Typhi Ty2
ugacccgcagcaau

SEQ ID NO: 3680122 - RNA, 22 nt, Salmonella enterica enterica serovar Typhi Ty2
ugaccgauauagccacucacgg

SEQ ID NO: 3680123 - RNA, 16 nt, Salmonella enterica enterica serovar Typhi Ty2
ugaccgcacagcagac

SEQ ID NO: 3680124 - RNA, 22 nt, Salmonella enterica enterica serovar Typhi Ty2
ugaccgccccguaucauuaggc

SEQ ID NO: 3680125 - RNA, 23 nt, Salmonella enterica enterica serovar Typhi Ty2
ugaccgccgucauagcaggagau

SEQ ID NO: 3680126 - RNA, 19 nt, Salmonella enterica enterica serovar Typhi Ty2
ugaccgcuucgccuucgcc

SEQ ID NO: 3680127 - RNA, 21 nt, Salmonella enterica enterica serovar Typhi Ty2
ugaccgggcucacgcuggugc

SEQ ID NO: 3680128 - RNA, 18 nt, Salmonella enterica enterica serovar Typhi Ty2
ugaccgguaagcccaugg

SEQ ID NO: 3680129 - RNA, 22 nt, Salmonella enterica enterica serovar Typhi Ty2
ugaccguuaguaaucggaucaa

SEQ ID NO: 3680130 - RNA, 17 nt, Salmonella enterica enterica serovar Typhi Ty2
ugaccucaauccgugcc

SEQ ID NO: 3680131 - RNA, 11 nt, Salmonella enterica enterica serovar Typhi Ty2
ugaccugaaua

SEQ ID NO: 3680132 - RNA, 15 nt, Salmonella enterica enterica serovar Typhi Ty2
ugaccugcccauccu

SEQ ID NO: 3680133 - RNA, 19 nt, Salmonella enterica enterica serovar Typhi Ty2
ugagccgaaauccaccagc

SEQ ID NO: 3680134 - RNA, 20 nt, Salmonella enterica enterica serovar Typhi Ty2
ugagccgaaauccaccagcg

SEQ ID NO: 3680135 - RNA, 21 nt, Salmonella enterica enterica serovar Typhi Ty2
ugagccuaaaacauuaaucgc

SEQ ID NO: 3680136 - RNA, 19 nt, Salmonella enterica enterica serovar Typhi Ty2
ugagcgaauccccgggaac

SEQ ID NO: 3680137 - RNA, 16 nt, Salmonella enterica enterica serovar Typhi Ty2
ugagcgagaauuuuau

SEQ ID NO: 3680138 - RNA, 20 nt, Salmonella enterica enterica serovar Typhi Ty2
ugagcgagucagacaccagc

SEQ ID NO: 3680139 - RNA, 22 nt, Salmonella enterica enterica serovar Typhi Ty2
ugagcgcagcgacuucaggcgu

SEQ ID NO: 3680140 - RNA, 17 nt, Salmonella enterica enterica serovar Typhi Ty2
ugagcgcagugaccagc

SEQ ID NO: 3680141 - RNA, 18 nt, Salmonella enterica enterica serovar Typhi Ty2
ugagcgcagugaccagca

SEQ ID NO: 3680142 - RNA, 23 nt, Salmonella enterica enterica serovar Typhi Ty2
ugagcgcgaggcauaccgcccag

SEQ ID NO: 3680143 - RNA, 18 nt, Salmonella enterica enterica serovar Typhi Ty2
ugagcgcuugcugcguaa

SEQ ID NO: 3680144 - RNA, 18 nt, Salmonella enterica enterica serovar Typhi Ty2
ugagcggcucauccagca

SEQ ID NO: 3680145 - RNA, 19 nt, Salmonella enterica enterica serovar Typhi Ty2
ugagcggcucauccagcaa

SEQ ID NO: 3680146 - RNA, 12 nt, Salmonella enterica enterica serovar Typhi Ty2
ugagcgggccgu

SEQ ID NO: 3680147 - RNA, 18 nt, Salmonella enterica enterica serovar Typhi Ty2
ugagcguagaccgcccag

SEQ ID NO: 3680148 - RNA, 20 nt, Salmonella enterica enterica serovar Typhi Ty2
ugagcguagaccgcccagga

SEQ ID NO: 3680149 - RNA, 23 nt, Salmonella enterica enterica serovar Typhi Ty2
ugagcgucacgccaucagggacg

SEQ ID NO: 3680150 - RNA, 16 nt, Salmonella enterica enterica serovar Typhi Ty2
ugagcgucaggccauc

SEQ ID NO: 3680151 - RNA, 13 nt, Salmonella enterica enterica serovar Typhi Ty2
ugagcgucaucgg

SEQ ID NO: 3680152 - RNA, 14 nt, Salmonella enterica enterica serovar Typhi Ty2
ugagcgucgccaga

SEQ ID NO: 3680153 - RNA, 19 nt, Salmonella enterica enterica serovar Typhi Ty2
ugagcguuacgggaacaga

SEQ ID NO: 3680154 - RNA, 11 nt, Salmonella enterica enterica serovar Typhi Ty2
ugagcuaauca

SEQ ID NO: 3680155 - RNA, 18 nt, Salmonella enterica enterica serovar Typhi Ty2
ugagcuaaucacccacuu

SEQ ID NO: 3680156 - RNA, 17 nt, Salmonella enterica enterica serovar Typhi Ty2
ugagcuaucugucugcu

SEQ ID NO: 3680157 - RNA, 19 nt, Salmonella enterica enterica serovar Typhi Ty2
ugagcucguuauaagcuuu

SEQ ID NO: 3680158 - RNA, 13 nt, Salmonella enterica enterica serovar Typhi Ty2
ugagcucuuucug

SEQ ID NO: 3680159 - RNA, 22 nt, Salmonella enterica enterica serovar Typhi Ty2
ugagcugcugcuugcuuuucau

SEQ ID NO: 3680160 - RNA, 16 nt, Salmonella enterica enterica serovar Typhi Ty2
ugagcuucaccgccag

SEQ ID NO: 3680161 - RNA, 24 nt, Salmonella enterica enterica serovar Typhi Ty2
ugaggaaaaagcgcacuuuccaua

SEQ ID NO: 3680162 - RNA, 15 nt, Salmonella enterica enterica serovar Typhi Ty2
ugaggauauugguau

SEQ ID NO: 3680163 - RNA, 17 nt, Salmonella enterica enterica serovar Typhi Ty2
ugaggccguuauuguca

SEQ ID NO: 3680164 - RNA, 21 nt, Salmonella enterica enterica serovar Typhi Ty2
ugaggccguuuuuuuguuuua

SEQ ID NO: 3680165 - RNA, 19 nt, Salmonella enterica enterica serovar Typhi Ty2
ugaggccuguuucuuacca

SEQ ID NO: 3680166 - RNA, 15 nt, Salmonella enterica enterica serovar Typhi Ty2
ugaggcuugcagcau

SEQ ID NO: 3680167 - RNA, 19 nt, Salmonella enterica enterica serovar Typhi Ty2
ugaggcuuugagcgucagc

SEQ ID NO: 3680168 - RNA, 16 nt, Salmonella enterica enterica serovar Typhi Ty2
ugagggcgauaauccg

SEQ ID NO: 3680169 - RNA, 21 nt, Salmonella enterica enterica serovar Typhi Ty2
ugagggcgauaauccgcucca

SEQ ID NO: 3680170 - RNA, 20 nt, Salmonella enterica enterica serovar Typhi Ty2
ugagguggccgagaggcuga

SEQ ID NO: 3680171 - RNA, 20 nt, Salmonella enterica enterica serovar Typhi Ty2
ugagguugagauccugaucc

SEQ ID NO: 3680172 - RNA, 15 nt, Salmonella enterica enterica serovar Typhi Ty2
ugagguuucagcacc

SEQ ID NO: 3680173 - RNA, 16 nt, Salmonella enterica enterica serovar Typhi Ty2
ugagguuucagcaccu

SEQ ID NO: 3680174 - RNA, 22 nt, Salmonella enterica enterica serovar Typhi Ty2
ugaguaacguuaauacaucaug

SEQ ID NO: 3680175 - RNA, 17 nt, Salmonella enterica enterica serovar Typhi Ty2
ugaguaucgggauggcg

SEQ ID NO: 3680176 - RNA, 20 nt, Salmonella enterica enterica serovar Typhi Ty2
ugaguauuaacgugauggcg

SEQ ID NO: 3680177 - RNA, 23 nt, Salmonella enterica enterica serovar Typhi Ty2
ugagucagaaacggccuggcccg

SEQ ID NO: 3680178 - RNA, 19 nt, Salmonella enterica enterica serovar Typhi Ty2
ugaguccauaccguuucaa

SEQ ID NO: 3680179 - RNA, 15 nt, Salmonella enterica enterica serovar Typhi Ty2
ugagucuugccuguc

SEQ ID NO: 3680180 - RNA, 14 nt, Salmonella enterica enterica serovar Typhi Ty2
ugaguguuacucuu

SEQ ID NO: 3680181 - RNA, 15 nt, Salmonella enterica enterica serovar Typhi Ty2
ugaguuaacgacugc

SEQ ID NO: 3680182 - RNA, 17 nt, Salmonella enterica enterica serovar Typhi Ty2
ugaguuugucauccaga

SEQ ID NO: 3680183 - RNA, 22 nt, Salmonella enterica enterica serovar Typhi Ty2
ugaguuuuaacgaaggauuuau

SEQ ID NO: 3680184 - RNA, 18 nt, Salmonella enterica enterica serovar Typhi Ty2
ugauaaaacgcaggcagu

SEQ ID NO: 3680185 - RNA, 13 nt, Salmonella enterica enterica serovar Typhi Ty2
ugauaaagcgcuc

SEQ ID NO: 3680186 - RNA, 20 nt, Salmonella enterica enterica serovar Typhi Ty2
ugauaaagcuuucaucuuua

SEQ ID NO: 3680187 - RNA, 14 nt, Salmonella enterica enterica serovar Typhi Ty2
ugauaaaggccggc

SEQ ID NO: 3680188 - RNA, 16 nt, Salmonella enterica enterica serovar Typhi Ty2
ugauaaauguuuacuu

SEQ ID NO: 3680189 - RNA, 15 nt, Salmonella enterica enterica serovar Typhi Ty2
ugauaaccgccgcca

SEQ ID NO: 3680190 - RNA, 21 nt, Salmonella enterica enterica serovar Typhi Ty2
ugauaacgauaagugaagcgu

SEQ ID NO: 3680191 - RNA, 18 nt, Salmonella enterica enterica serovar Typhi Ty2
ugauaagcauagcgccau

SEQ ID NO: 3680192 - RNA, 13 nt, Salmonella enterica enterica serovar Typhi Ty2
ugauaagcgcagc

SEQ ID NO: 3680193 - RNA, 18 nt, Salmonella enterica enterica serovar Typhi Ty2
ugauaagcgcagcgccau

SEQ ID NO: 3680194 - RNA, 18 nt, Salmonella enterica enterica serovar Typhi Ty2
ugauaagcguagcgccau

SEQ ID NO: 3680195 - RNA, 21 nt, Salmonella enterica enterica serovar Typhi Ty2
ugauaagcguagcgccaucag

SEQ ID NO: 3680196 - RNA, 18 nt, Salmonella enterica enterica serovar Typhi Ty2
ugauaagcuaguaaagaa

SEQ ID NO: 3680197 - RNA, 13 nt, Salmonella enterica enterica serovar Typhi Ty2
ugauaauaugcuc

SEQ ID NO: 3680198 - RNA, 22 nt, Salmonella enterica enterica serovar Typhi Ty2
ugauaauaugcucaacuuccag

SEQ ID NO: 3680199 - RNA, 15 nt, Salmonella enterica enterica serovar Typhi Ty2
ugauaaucaauggcc

SEQ ID NO: 3680200 - RNA, 23 nt, Salmonella enterica enterica serovar Typhi Ty2
ugauaaucaauggccuugccagc

SEQ ID NO: 3680201 - RNA, 22 nt, Salmonella enterica enterica serovar Typhi Ty2
ugauaauguuggauuauacauu

SEQ ID NO: 3680202 - RNA, 18 nt, Salmonella enterica enterica serovar Typhi Ty2
ugauaauuguuaauuauu

SEQ ID NO: 3680203 - RNA, 22 nt, Salmonella enterica enterica serovar Typhi Ty2
ugauacagaaaaccggcaaaua

SEQ ID NO: 3680204 - RNA, 15 nt, Salmonella enterica enterica serovar Typhi Ty2
ugauaccccagcgau

SEQ ID NO: 3680205 - RNA, 14 nt, Salmonella enterica enterica serovar Typhi Ty2
ugauaccggaggag

SEQ ID NO: 3680206 - RNA, 16 nt, Salmonella enterica enterica serovar Typhi Ty2
ugauaccuaaacgcgu

SEQ ID NO: 3680207 - RNA, 14 nt, Salmonella enterica enterica serovar Typhi Ty2
ugauaccuauuuaa

SEQ ID NO: 3680208 - RNA, 16 nt, Salmonella enterica enterica serovar Typhi Ty2
ugauaccuauuuaaua

SEQ ID NO: 3680209 - RNA, 19 nt, Salmonella enterica enterica serovar Typhi Ty2
ugauacgcggcugaugcag

SEQ ID NO: 3680210 - RNA, 19 nt, Salmonella enterica enterica serovar Typhi Ty2
ugauacgcgucaaauagag

SEQ ID NO: 3680211 - RNA, 21 nt, Salmonella enterica enterica serovar Typhi Ty2
ugauacggcgugaucacuccc

SEQ ID NO: 3680212 - RNA, 14 nt, Salmonella enterica enterica serovar Typhi Ty2
ugauacucaucaua

SEQ ID NO: 3680213 - RNA, 21 nt, Salmonella enterica enterica serovar Typhi Ty2
ugauacuguacgcccagccgu

SEQ ID NO: 3680214 - RNA, 16 nt, Salmonella enterica enterica serovar Typhi Ty2
ugauagacguaaugau

SEQ ID NO: 3680215 - RNA, 21 nt, Salmonella enterica enterica serovar Typhi Ty2
ugauggcuggcgucgccaaag

SEQ ID NO: 3680216 - RNA, 15 nt, Salmonella enterica enterica serovar Typhi Ty2
ugauguacaggugaa

SEQ ID NO: 3680217 - RNA, 21 nt, Salmonella enterica enterica serovar Typhi Ty2
ugauguccagcgcgccggaua

SEQ ID NO: 3680218 - RNA, 13 nt, Salmonella enterica enterica serovar Typhi Ty2
ugaugugauggug

SEQ ID NO: 3680219 - RNA, 20 nt, Salmonella enterica enterica serovar Typhi Ty2
ugaugugauuaaacgcaacg

SEQ ID NO: 3680220 - RNA, 20 nt, Salmonella enterica enterica serovar Typhi Ty2
ugaugugauuuuugacccgc

SEQ ID NO: 3680221 - RNA, 17 nt, Salmonella enterica enterica serovar Typhi Ty2
ugauguuuuuaaaagaa

SEQ ID NO: 3680222 - RNA, 12 nt, Salmonella enterica enterica serovar Typhi Ty2
ugauuacaaaau

SEQ ID NO: 3680223 - RNA, 20 nt, Salmonella enterica enterica serovar Typhi Ty2
ugauuacggaacaaaacgga

SEQ ID NO: 3680224 - RNA, 19 nt, Salmonella enterica enterica serovar Typhi Ty2
ugauuaucacccacaggag

SEQ ID NO: 3680225 - RNA, 21 nt, Salmonella enterica enterica serovar Typhi Ty2
ugauuaucacccacaggagcc

SEQ ID NO: 3680226 - RNA, 18 nt, Salmonella enterica enterica serovar Typhi Ty2
ugauuauuguuaaaaaga

SEQ ID NO: 3680227 - RNA, 19 nt, Salmonella enterica enterica serovar Typhi Ty2
ugauucauucccauacugc

SEQ ID NO: 3680228 - RNA, 14 nt, Salmonella enterica enterica serovar Typhi Ty2
ugauucggguaaac

SEQ ID NO: 3680229 - RNA, 21 nt, Salmonella enterica enterica serovar Typhi Ty2
ugauucguuuuuacacugaag

SEQ ID NO: 3680230 - RNA, 18 nt, Salmonella enterica enterica serovar Typhi Ty2
ugauucugugaugaugcg

SEQ ID NO: 3680231 - RNA, 20 nt, Salmonella enterica enterica serovar Typhi Ty2
ugauugacuaucagccgcga

SEQ ID NO: 3680232 - RNA, 13 nt, Salmonella enterica enterica serovar Typhi Ty2
ugauugauuuugu

SEQ ID NO: 3680233 - RNA, 14 nt, Salmonella enterica enterica serovar Typhi Ty2
ugauugcaagaaua

SEQ ID NO: 3680234 - RNA, 22 nt, Salmonella enterica enterica serovar Typhi Ty2
ugauugcauaucgcuaaaccaa

SEQ ID NO: 3680235 - RNA, 14 nt, Salmonella enterica enterica serovar Typhi Ty2
ugauugccaucgcu

SEQ ID NO: 3680236 - RNA, 17 nt, Salmonella enterica enterica serovar Typhi Ty2
ugauugccggaugacgc

SEQ ID NO: 3680237 - RNA, 16 nt, Salmonella enterica enterica serovar Typhi Ty2
ugauugcgacaggcug

SEQ ID NO: 3680238 - RNA, 22 nt, Salmonella enterica enterica serovar Typhi Ty2
ugauugcgacaggcugccgaca

SEQ ID NO: 3680239 - RNA, 22 nt, Salmonella enterica enterica serovar Typhi Ty2
ugauugcuggcagaugaacaua

SEQ ID NO: 3680240 - RNA, 23 nt, Salmonella enterica enterica serovar Typhi Ty2
ugauuggcaagaauuauuucagg

SEQ ID NO: 3680241 - RNA, 20 nt, Salmonella enterica enterica serovar Typhi Ty2
ugauuuaaaaaaggccgcuu

SEQ ID NO: 3680242 - RNA, 14 nt, Salmonella enterica enterica serovar Typhi Ty2
ugauuuacuccaaa

SEQ ID NO: 3680243 - RNA, 17 nt, Salmonella enterica enterica serovar Typhi Ty2
ugauuuacuccaaaaau

SEQ ID NO: 3680244 - RNA, 15 nt, Salmonella enterica enterica serovar Typhi Ty2
ugauuuauuuugaau

SEQ ID NO: 3680245 - RNA, 19 nt, Salmonella enterica enterica serovar Typhi Ty2
ugauuucgacgauaaaaaa

SEQ ID NO: 3680246 - RNA, 18 nt, Salmonella enterica enterica serovar Typhi Ty2
ugauuucgccccacuggc

SEQ ID NO: 3680247 - RNA, 20 nt, Salmonella enterica enterica serovar Typhi Ty2
ugauuucgccccacuggccc

SEQ ID NO: 3680248 - RNA, 18 nt, Salmonella enterica enterica serovar Typhi Ty2
ugauuugcuuuauuuguu

SEQ ID NO: 3680249 - RNA, 19 nt, Salmonella enterica enterica serovar Typhi Ty2
ugauuuguuuuuuauauuu

SEQ ID NO: 3680250 - RNA, 21 nt, Salmonella enterica enterica serovar Typhi Ty2
ugauuuuaacaucaccuuuca

SEQ ID NO: 3680251 - RNA, 13 nt, Salmonella enterica enterica serovar Typhi Ty2
ugauuuuaugaug

SEQ ID NO: 3680252 - RNA, 14 nt, Salmonella enterica enterica serovar Typhi Ty2
ugauuuuaugaugc

SEQ ID NO: 3680253 - RNA, 23 nt, Salmonella enterica enterica serovar Typhi Ty2
ugauuuuuaccgccgguuuaucc

SEQ ID NO: 3680254 - RNA, 20 nt, Salmonella enterica enterica serovar Typhi Ty2
ugauuuuuuugcuggccguc

SEQ ID NO: 3680255 - RNA, 14 nt, Salmonella enterica enterica serovar Typhi Ty2
ugcaaaagaaaaaa

SEQ ID NO: 3680256 - RNA, 21 nt, Salmonella enterica enterica serovar Typhi Ty2
ugcaaaccggguaacaacauu

SEQ ID NO: 3680257 - RNA, 11 nt, Salmonella enterica enterica serovar Typhi Ty2
ugcaaacguag

SEQ ID NO: 3680258 - RNA, 22 nt, Salmonella enterica enterica serovar Typhi Ty2
ugcaaagacagcaggcuuugcu

SEQ ID NO: 3680259 - RNA, 11 nt, Salmonella enterica enterica serovar Typhi Ty2
ugcaaauacca

SEQ ID NO: 3680260 - RNA, 17 nt, Salmonella enterica enterica serovar Typhi Ty2
ugcaaauaccacaucag

SEQ ID NO: 3680261 - RNA, 20 nt, Salmonella enterica enterica serovar Typhi Ty2
ugcaaauacugcuuuuccgg

SEQ ID NO: 3680262 - RNA, 21 nt, Salmonella enterica enterica serovar Typhi Ty2
ugcaaauccaucucaggccga

SEQ ID NO: 3680263 - RNA, 21 nt, Salmonella enterica enterica serovar Typhi Ty2
ugcaaaucugccgucaucgac

SEQ ID NO: 3680264 - RNA, 14 nt, Salmonella enterica enterica serovar Typhi Ty2
ugcaaaugucagau

SEQ ID NO: 3680265 - RNA, 21 nt, Salmonella enterica enterica serovar Typhi Ty2
ugcaacagaagaguuaacuuc

SEQ ID NO: 3680266 - RNA, 22 nt, Salmonella enterica enterica serovar Typhi Ty2
ugcaacagaagaguuaacuucu

SEQ ID NO: 3680267 - RNA, 19 nt, Salmonella enterica enterica serovar Typhi Ty2
ugcaacagcaccagcaggu

SEQ ID NO: 3680268 - RNA, 16 nt, Salmonella enterica enterica serovar Typhi Ty2
ugcaacaugcccaguu

SEQ ID NO: 3680269 - RNA, 19 nt, Salmonella enterica enterica serovar Typhi Ty2
ugcaacauugcaggucugg

SEQ ID NO: 3680270 - RNA, 14 nt, Salmonella enterica enterica serovar Typhi Ty2
ugcaaccccuugcg

SEQ ID NO: 3680271 - RNA, 17 nt, Salmonella enterica enterica serovar Typhi Ty2
ugcaacgccagaugcgu

SEQ ID NO: 3680272 - RNA, 21 nt, Salmonella enterica enterica serovar Typhi Ty2
ugcaacgcuuuagugccgcca

SEQ ID NO: 3680273 - RNA, 17 nt, Salmonella enterica enterica serovar Typhi Ty2
ugcaacugcgcggcaau

SEQ ID NO: 3680274 - RNA, 17 nt, Salmonella enterica enterica serovar Typhi Ty2
ugcaagaacgggcugcg

SEQ ID NO: 3680275 - RNA, 13 nt, Salmonella enterica enterica serovar Typhi Ty2
ugcaagagaaaua

SEQ ID NO: 3680276 - RNA, 19 nt, Salmonella enterica enterica serovar Typhi Ty2
ugcaagccugauacuuuua

SEQ ID NO: 3680277 - RNA, 20 nt, Salmonella enterica enterica serovar Typhi Ty2
ugcaaguugcaagucaccau

SEQ ID NO: 3680278 - RNA, 17 nt, Salmonella enterica enterica serovar Typhi Ty2
ugcaauaccggcugcuu

SEQ ID NO: 3680279 - RNA, 20 nt, Salmonella enterica enterica serovar Typhi Ty2
ugcaauaccgggauuguaua

SEQ ID NO: 3680280 - RNA, 17 nt, Salmonella enterica enterica serovar Typhi Ty2
ugcaauacuacgcaccg

SEQ ID NO: 3680281 - RNA, 18 nt, Salmonella enterica enterica serovar Typhi Ty2
ugcaauaucccucgaagu

SEQ ID NO: 3680282 - RNA, 12 nt, Salmonella enterica enterica serovar Typhi Ty2
ugcaaucagauu

SEQ ID NO: 3680283 - RNA, 13 nt, Salmonella enterica enterica serovar Typhi Ty2
ugcaaucagcgaa

SEQ ID NO: 3680284 - RNA, 20 nt, Salmonella enterica enterica serovar Typhi Ty2
ugcaaucagcgaaggcaacu

SEQ ID NO: 3680285 - RNA, 23 nt, Salmonella enterica enterica serovar Typhi Ty2
ugcaaucagcgaaggcaacugau

SEQ ID NO: 3680286 - RNA, 18 nt, Salmonella enterica enterica serovar Typhi Ty2
ugcaaucuuuacccggcg

SEQ ID NO: 3680287 - RNA, 17 nt, Salmonella enterica enterica serovar Typhi Ty2
ugcaaugcagaugcuca

SEQ ID NO: 3680288 - RNA, 16 nt, Salmonella enterica enterica serovar Typhi Ty2
ugcaauguucaauauc

SEQ ID NO: 3680289 - RNA, 19 nt, Salmonella enterica enterica serovar Typhi Ty2
ugcaauuccggcgaaaaac

SEQ ID NO: 3680290 - RNA, 20 nt, Salmonella enterica enterica serovar Typhi Ty2
ugcaauuccggcgaaaaacc

SEQ ID NO: 3680291 - RNA, 17 nt, Salmonella enterica enterica serovar Typhi Ty2
ugcaauucggcggcaau

SEQ ID NO: 3680292 - RNA, 16 nt, Salmonella enterica enterica serovar Typhi Ty2
ugcaauuguuccugcg

SEQ ID NO: 3680293 - RNA, 20 nt, Salmonella enterica enterica serovar Typhi Ty2
ugcaauuguuccugcgucgg

SEQ ID NO: 3680294 - RNA, 13 nt, Salmonella enterica enterica serovar Typhi Ty2
ugcacaaaauacu

SEQ ID NO: 3680295 - RNA, 16 nt, Salmonella enterica enterica serovar Typhi Ty2
ugcacaaaauacuguu

SEQ ID NO: 3680296 - RNA, 22 nt, Salmonella enterica enterica serovar Typhi Ty2
ugcacaacauuccgcuuccaga

SEQ ID NO: 3680297 - RNA, 15 nt, Salmonella enterica enterica serovar Typhi Ty2
ugcauauuauucaug

SEQ ID NO: 3680298 - RNA, 23 nt, Salmonella enterica enterica serovar Typhi Ty2
ugcaucagaacaaacuuauccca

SEQ ID NO: 3680299 - RNA, 18 nt, Salmonella enterica enterica serovar Typhi Ty2
ugcauccgcgcuuucugg

SEQ ID NO: 3680300 - RNA, 17 nt, Salmonella enterica enterica serovar Typhi Ty2
ugcaucucuucaaacaa

SEQ ID NO: 3680301 - RNA, 20 nt, Salmonella enterica enterica serovar Typhi Ty2
ugcaucuugaaugauuuugu

SEQ ID NO: 3680302 - RNA, 18 nt, Salmonella enterica enterica serovar Typhi Ty2
ugcaugcgcuggacuggg

SEQ ID NO: 3680303 - RNA, 17 nt, Salmonella enterica enterica serovar Typhi Ty2
ugcauggcagauaaacc

SEQ ID NO: 3680304 - RNA, 23 nt, Salmonella enterica enterica serovar Typhi Ty2
ugcauggccggucuuaugcugcc

SEQ ID NO: 3680305 - RNA, 18 nt, Salmonella enterica enterica serovar Typhi Ty2
ugcaugggauacgccagc

SEQ ID NO: 3680306 - RNA, 14 nt, Salmonella enterica enterica serovar Typhi Ty2
ugcaugguagucgu

SEQ ID NO: 3680307 - RNA, 20 nt, Salmonella enterica enterica serovar Typhi Ty2
ugcauuauuuuagugaaaaa

SEQ ID NO: 3680308 - RNA, 14 nt, Salmonella enterica enterica serovar Typhi Ty2
ugcauucaggccuc

SEQ ID NO: 3680309 - RNA, 19 nt, Salmonella enterica enterica serovar Typhi Ty2
ugcauucaggccucugcuu

SEQ ID NO: 3680310 - RNA, 20 nt, Salmonella enterica enterica serovar Typhi Ty2
ugcauucaggccucugcuuu

SEQ ID NO: 3680311 - RNA, 14 nt, Salmonella enterica enterica serovar Typhi Ty2
ugcauuccaggugu

SEQ ID NO: 3680312 - RNA, 15 nt, Salmonella enterica enterica serovar Typhi Ty2
ugcauucgcccgcaa

SEQ ID NO: 3680313 - RNA, 13 nt, Salmonella enterica enterica serovar Typhi Ty2
ugcauucgcuccu

SEQ ID NO: 3680314 - RNA, 15 nt, Salmonella enterica enterica serovar Typhi Ty2
ugcauugauaggcug

SEQ ID NO: 3680315 - RNA, 15 nt, Salmonella enterica enterica serovar Typhi Ty2
ugcauugcuuuuagu

SEQ ID NO: 3680316 - RNA, 13 nt, Salmonella enterica enterica serovar Typhi Ty2
ugcauuggccagc

SEQ ID NO: 3680317 - RNA, 18 nt, Salmonella enterica enterica serovar Typhi Ty2
ugcauuguacuuuuaaau

SEQ ID NO: 3680318 - RNA, 16 nt, Salmonella enterica enterica serovar Typhi Ty2
ugcauuguccgcauuc

SEQ ID NO: 3680319 - RNA, 17 nt, Salmonella enterica enterica serovar Typhi Ty2
ugcauuguccgcauucu

SEQ ID NO: 3680320 - RNA, 20 nt, Salmonella enterica enterica serovar Typhi Ty2
ugcauuuaucaaucugcuuu

SEQ ID NO: 3680321 - RNA, 17 nt, Salmonella enterica enterica serovar Typhi Ty2
ugcauuucuuguugacg

SEQ ID NO: 3680322 - RNA, 17 nt, Salmonella enterica enterica serovar Typhi Ty2
ugcauuuucaccuggau

SEQ ID NO: 3680323 - RNA, 21 nt, Salmonella enterica enterica serovar Typhi Ty2
ugccaaaagguuagguuaaau

SEQ ID NO: 3680324 - RNA, 13 nt, Salmonella enterica enterica serovar Typhi Ty2
ugccaaacugcug

SEQ ID NO: 3680325 - RNA, 16 nt, Salmonella enterica enterica serovar Typhi Ty2
ugccaaacugcuggaa

SEQ ID NO: 3680326 - RNA, 18 nt, Salmonella enterica enterica serovar Typhi Ty2
ugccaaauguauacuccc

SEQ ID NO: 3680327 - RNA, 21 nt, Salmonella enterica enterica serovar Typhi Ty2
ugccaagcguaguacguucca

SEQ ID NO: 3680328 - RNA, 13 nt, Salmonella enterica enterica serovar Typhi Ty2
ugccaaugaaaua

SEQ ID NO: 3680329 - RNA, 14 nt, Salmonella enterica enterica serovar Typhi Ty2
ugccaaugaaauaa

SEQ ID NO: 3680330 - RNA, 23 nt, Salmonella enterica enterica serovar Typhi Ty2
ugccaauggcgauaaaaauaucc

SEQ ID NO: 3680331 - RNA, 22 nt, Salmonella enterica enterica serovar Typhi Ty2
ugccacaaccgcccccaacuga

SEQ ID NO: 3680332 - RNA, 23 nt, Salmonella enterica enterica serovar Typhi Ty2
ugccacaacgccugaugcugcgc

SEQ ID NO: 3680333 - RNA, 22 nt, Salmonella enterica enterica serovar Typhi Ty2
ugccacacccugagcgccgcca

SEQ ID NO: 3680334 - RNA, 17 nt, Salmonella enterica enterica serovar Typhi Ty2
ugccacacucucuccag

SEQ ID NO: 3680335 - RNA, 15 nt, Salmonella enterica enterica serovar Typhi Ty2
ugccacagccucagc

SEQ ID NO: 3680336 - RNA, 17 nt, Salmonella enterica enterica serovar Typhi Ty2
ugccacaggccaacaua

SEQ ID NO: 3680337 - RNA, 14 nt, Salmonella enterica enterica serovar Typhi Ty2
ugccaccagcgcca

SEQ ID NO: 3680338 - RNA, 20 nt, Salmonella enterica enterica serovar Typhi Ty2
ugccacgaacgauauaaaaa

SEQ ID NO: 3680339 - RNA, 14 nt, Salmonella enterica enterica serovar Typhi Ty2
ugccacuacgcagc

SEQ ID NO: 3680340 - RNA, 19 nt, Salmonella enterica enterica serovar Typhi Ty2
ugccacuauagaugaugga

SEQ ID NO: 3680341 - RNA, 20 nt, Salmonella enterica enterica serovar Typhi Ty2
ugccacuggguuucccauug

SEQ ID NO: 3680342 - RNA, 16 nt, Salmonella enterica enterica serovar Typhi Ty2
ugccacuguucagaaa

SEQ ID NO: 3680343 - RNA, 14 nt, Salmonella enterica enterica serovar Typhi Ty2
ugccagaagagaau

SEQ ID NO: 3680344 - RNA, 17 nt, Salmonella enterica enterica serovar Typhi Ty2
ugccagacgggccaggc

SEQ ID NO: 3680345 - RNA, 11 nt, Salmonella enterica enterica serovar Typhi Ty2
ugccagagaga

SEQ ID NO: 3680346 - RNA, 12 nt, Salmonella enterica enterica serovar Typhi Ty2
ugccagcaccag

SEQ ID NO: 3680347 - RNA, 13 nt, Salmonella enterica enterica serovar Typhi Ty2
ugccagcaccagc

SEQ ID NO: 3680348 - RNA, 14 nt, Salmonella enterica enterica serovar Typhi Ty2
ugccagcaccagca

SEQ ID NO: 3680349 - RNA, 16 nt, Salmonella enterica enterica serovar Typhi Ty2
ugccagccauagccca

SEQ ID NO: 3680350 - RNA, 15 nt, Salmonella enterica enterica serovar Typhi Ty2
ugccagcccaauauc

SEQ ID NO: 3680351 - RNA, 19 nt, Salmonella enterica enterica serovar Typhi Ty2
ugccagcgcccuauccagc

SEQ ID NO: 3680352 - RNA, 14 nt, Salmonella enterica enterica serovar Typhi Ty2
ugccagcgucgcug

SEQ ID NO: 3680353 - RNA, 16 nt, Salmonella enterica enterica serovar Typhi Ty2
ugccagcucaaaugac

SEQ ID NO: 3680354 - RNA, 11 nt, Salmonella enterica enterica serovar Typhi Ty2
ugccagggugc

SEQ ID NO: 3680355 - RNA, 14 nt, Salmonella enterica enterica serovar Typhi Ty2
ugccaggguucaac

SEQ ID NO: 3680356 - RNA, 14 nt, Salmonella enterica enterica serovar Typhi Ty2
ugccagguuauuuc

SEQ ID NO: 3680357 - RNA, 12 nt, Salmonella enterica enterica serovar Typhi Ty2
ugccaguaacgu

SEQ ID NO: 3680358 - RNA, 19 nt, Salmonella enterica enterica serovar Typhi Ty2
ugccaguaacguucuucga

SEQ ID NO: 3680359 - RNA, 17 nt, Salmonella enterica enterica serovar Typhi Ty2
ugccaguaacucaucgc

SEQ ID NO: 3680360 - RNA, 15 nt, Salmonella enterica enterica serovar Typhi Ty2
ugccaguacagcagc

SEQ ID NO: 3680361 - RNA, 17 nt, Salmonella enterica enterica serovar Typhi Ty2
ugccaguaccgccgccg

SEQ ID NO: 3680362 - RNA, 23 nt, Salmonella enterica enterica serovar Typhi Ty2
ugccaguagcggaauaucuuccc

SEQ ID NO: 3680363 - RNA, 15 nt, Salmonella enterica enterica serovar Typhi Ty2
ugccaguagcugcuc

SEQ ID NO: 3680364 - RNA, 16 nt, Salmonella enterica enterica serovar Typhi Ty2
ugccaguuucucaaag

SEQ ID NO: 3680365 - RNA, 18 nt, Salmonella enterica enterica serovar Typhi Ty2
ugccauaaaaacaauaaa

SEQ ID NO: 3680366 - RNA, 15 nt, Salmonella enterica enterica serovar Typhi Ty2
ugccauaaaaugcug

SEQ ID NO: 3680367 - RNA, 22 nt, Salmonella enterica enterica serovar Typhi Ty2
ugccauaaucgauauaauuuua

SEQ ID NO: 3680368 - RNA, 17 nt, Salmonella enterica enterica serovar Typhi Ty2
ugccauacuguuuauca

SEQ ID NO: 3680369 - RNA, 13 nt, Salmonella enterica enterica serovar Typhi Ty2
ugccauauucaac

SEQ ID NO: 3680370 - RNA, 20 nt, Salmonella enterica enterica serovar Typhi Ty2
ugccauauuguucaguuuca

SEQ ID NO: 3680371 - RNA, 21 nt, Salmonella enterica enterica serovar Typhi Ty2
ugccauauuguucaguuucaa

SEQ ID NO: 3680372 - RNA, 21 nt, Salmonella enterica enterica serovar Typhi Ty2
ugccaucaggcaguuuauccg

SEQ ID NO: 3680373 - RNA, 18 nt, Salmonella enterica enterica serovar Typhi Ty2
ugccaucaucaguaacac

SEQ ID NO: 3680374 - RNA, 19 nt, Salmonella enterica enterica serovar Typhi Ty2
ugccaucaucaguaacacc

SEQ ID NO: 3680375 - RNA, 16 nt, Salmonella enterica enterica serovar Typhi Ty2
ugccaucccauguuga

SEQ ID NO: 3680376 - RNA, 23 nt, Salmonella enterica enterica serovar Typhi Ty2
ugccaucgaccgauugggcucag

SEQ ID NO: 3680377 - RNA, 12 nt, Salmonella enterica enterica serovar Typhi Ty2
ugccaucgacgc

SEQ ID NO: 3680378 - RNA, 19 nt, Salmonella enterica enterica serovar Typhi Ty2
ugccaucgacgcgcaucac

SEQ ID NO: 3680379 - RNA, 23 nt, Salmonella enterica enterica serovar Typhi Ty2
ugccgccgucaucugcgccgaca

SEQ ID NO: 3680380 - RNA, 16 nt, Salmonella enterica enterica serovar Typhi Ty2
ugccgccgucgcggcu

SEQ ID NO: 3680381 - RNA, 22 nt, Salmonella enterica enterica serovar Typhi Ty2
ugccgccuccagcauacugaug

SEQ ID NO: 3680382 - RNA, 14 nt, Salmonella enterica enterica serovar Typhi Ty2
ugccgcgaucgcgg

SEQ ID NO: 3680383 - RNA, 15 nt, Salmonella enterica enterica serovar Typhi Ty2
ugccgcgaucgcggc

SEQ ID NO: 3680384 - RNA, 17 nt, Salmonella enterica enterica serovar Typhi Ty2
ugccgcgcccagcgccg

SEQ ID NO: 3680385 - RNA, 16 nt, Salmonella enterica enterica serovar Typhi Ty2
ugccgcguuacucggc

SEQ ID NO: 3680386 - RNA, 15 nt, Salmonella enterica enterica serovar Typhi Ty2
ugccgcugcugccuu

SEQ ID NO: 3680387 - RNA, 16 nt, Salmonella enterica enterica serovar Typhi Ty2
ugccgcugcuggcguu

SEQ ID NO: 3680388 - RNA, 22 nt, Salmonella enterica enterica serovar Typhi Ty2
ugccgcuggugcuacgggcgcu

SEQ ID NO: 3680389 - RNA, 16 nt, Salmonella enterica enterica serovar Typhi Ty2
ugccgcuuauccggcc

SEQ ID NO: 3680390 - RNA, 17 nt, Salmonella enterica enterica serovar Typhi Ty2
ugccgcuuccaguccag

SEQ ID NO: 3680391 - RNA, 16 nt, Salmonella enterica enterica serovar Typhi Ty2
ugccggaacucagcua

SEQ ID NO: 3680392 - RNA, 13 nt, Salmonella enterica enterica serovar Typhi Ty2
ugccggaagggau

SEQ ID NO: 3680393 - RNA, 14 nt, Salmonella enterica enterica serovar Typhi Ty2
ugccggacgcggcu

SEQ ID NO: 3680394 - RNA, 20 nt, Salmonella enterica enterica serovar Typhi Ty2
ugccggacgcggcuuauccg

SEQ ID NO: 3680395 - RNA, 13 nt, Salmonella enterica enterica serovar Typhi Ty2
ugccggauggcac

SEQ ID NO: 3680396 - RNA, 19 nt, Salmonella enterica enterica serovar Typhi Ty2
ugccggauggcgcuaaugc

SEQ ID NO: 3680397 - RNA, 17 nt, Salmonella enterica enterica serovar Typhi Ty2
ugccggauggcggcgua

SEQ ID NO: 3680398 - RNA, 17 nt, Salmonella enterica enterica serovar Typhi Ty2
ugccggauggcggcgug

SEQ ID NO: 3680399 - RNA, 14 nt, Salmonella enterica enterica serovar Typhi Ty2
ugccggauggcguu

SEQ ID NO: 3680400 - RNA, 13 nt, Salmonella enterica enterica serovar Typhi Ty2
ugccggcaucauu

SEQ ID NO: 3680401 - RNA, 17 nt, Salmonella enterica enterica serovar Typhi Ty2
ugccggcuuuccgcacc

SEQ ID NO: 3680402 - RNA, 23 nt, Salmonella enterica enterica serovar Typhi Ty2
ugccgggacuuuaaacgucaugc

SEQ ID NO: 3680403 - RNA, 14 nt, Salmonella enterica enterica serovar Typhi Ty2
ugccgggcaaaaaa

SEQ ID NO: 3680404 - RNA, 20 nt, Salmonella enterica enterica serovar Typhi Ty2
ugccgggcaaaaaacggaac

SEQ ID NO: 3680405 - RNA, 21 nt, Salmonella enterica enterica serovar Typhi Ty2
ugccgggcauaaacuaauccc

SEQ ID NO: 3680406 - RNA, 13 nt, Salmonella enterica enterica serovar Typhi Ty2
ugccgggccuggc

SEQ ID NO: 3680407 - RNA, 15 nt, Salmonella enterica enterica serovar Typhi Ty2
ugccgguuaacucuu

SEQ ID NO: 3680408 - RNA, 19 nt, Salmonella enterica enterica serovar Typhi Ty2
ugccgguuuuagcaaugau

SEQ ID NO: 3680409 - RNA, 23 nt, Salmonella enterica enterica serovar Typhi Ty2
ugccgguuuuagcaaugaugaug

SEQ ID NO: 3680410 - RNA, 18 nt, Salmonella enterica enterica serovar Typhi Ty2
ugccgguuuuugaaccau

SEQ ID NO: 3680411 - RNA, 22 nt, Salmonella enterica enterica serovar Typhi Ty2
ugccguaaauugaguggacauc

SEQ ID NO: 3680412 - RNA, 21 nt, Salmonella enterica enterica serovar Typhi Ty2
ugccguagaaaaugcgcuggg

SEQ ID NO: 3680413 - RNA, 17 nt, Salmonella enterica enterica serovar Typhi Ty2
ugccguagaacagcaug

SEQ ID NO: 3680414 - RNA, 23 nt, Salmonella enterica enterica serovar Typhi Ty2
ugccguagcgcgcuuccugccag

SEQ ID NO: 3680415 - RNA, 20 nt, Salmonella enterica enterica serovar Typhi Ty2
ugccgucaacacgcagaccc

SEQ ID NO: 3680416 - RNA, 18 nt, Salmonella enterica enterica serovar Typhi Ty2
ugccgucaauuuuaagaa

SEQ ID NO: 3680417 - RNA, 20 nt, Salmonella enterica enterica serovar Typhi Ty2
ugccguccauccggcguaau

SEQ ID NO: 3680418 - RNA, 18 nt, Salmonella enterica enterica serovar Typhi Ty2
ugccguccggcaucacaa

SEQ ID NO: 3680419 - RNA, 21 nt, Salmonella enterica enterica serovar Typhi Ty2
ugccgucggcaauuaacauuu

SEQ ID NO: 3680420 - RNA, 20 nt, Salmonella enterica enterica serovar Typhi Ty2
ugccgucguacucaccaguc

SEQ ID NO: 3680421 - RNA, 18 nt, Salmonella enterica enterica serovar Typhi Ty2
ugccgugaauauucagau

SEQ ID NO: 3680422 - RNA, 16 nt, Salmonella enterica enterica serovar Typhi Ty2
ugccgugaggcugaag

SEQ ID NO: 3680423 - RNA, 12 nt, Salmonella enterica enterica serovar Typhi Ty2
ugccgugccggg

SEQ ID NO: 3680424 - RNA, 22 nt, Salmonella enterica enterica serovar Typhi Ty2
ugccgugcgccgacaucgccac

SEQ ID NO: 3680425 - RNA, 14 nt, Salmonella enterica enterica serovar Typhi Ty2
ugccguuaacugcu

SEQ ID NO: 3680426 - RNA, 17 nt, Salmonella enterica enterica serovar Typhi Ty2
ugccguuaacugcugcu

SEQ ID NO: 3680427 - RNA, 15 nt, Salmonella enterica enterica serovar Typhi Ty2
ugccguuaauaaugu

SEQ ID NO: 3680428 - RNA, 14 nt, Salmonella enterica enterica serovar Typhi Ty2
ugccguuggcgcga

SEQ ID NO: 3680429 - RNA, 18 nt, Salmonella enterica enterica serovar Typhi Ty2
ugccguuguugucaauau

SEQ ID NO: 3680430 - RNA, 17 nt, Salmonella enterica enterica serovar Typhi Ty2
ugccguuuuccagccgu

SEQ ID NO: 3680431 - RNA, 18 nt, Salmonella enterica enterica serovar Typhi Ty2
ugccguuuuucucaucaa

SEQ ID NO: 3680432 - RNA, 17 nt, Salmonella enterica enterica serovar Typhi Ty2
ugccuaaaccuucgcuu

SEQ ID NO: 3680433 - RNA, 12 nt, Salmonella enterica enterica serovar Typhi Ty2
ugccuaaagaaa

SEQ ID NO: 3680434 - RNA, 14 nt, Salmonella enterica enterica serovar Typhi Ty2
ugccuaaagaaaaa

SEQ ID NO: 3680435 - RNA, 19 nt, Salmonella enterica enterica serovar Typhi Ty2
ugccuaacuggaaaaagac

SEQ ID NO: 3680436 - RNA, 18 nt, Salmonella enterica enterica serovar Typhi Ty2
ugccuaagauggcgccuu

SEQ ID NO: 3680437 - RNA, 17 nt, Salmonella enterica enterica serovar Typhi Ty2
ugccuauucaccagacu

SEQ ID NO: 3680438 - RNA, 16 nt, Salmonella enterica enterica serovar Typhi Ty2
ugccucacccugaaau

SEQ ID NO: 3680439 - RNA, 20 nt, Salmonella enterica enterica serovar Typhi Ty2
ugccucggguggcaucugau

SEQ ID NO: 3680440 - RNA, 22 nt, Salmonella enterica enterica serovar Typhi Ty2
ugccucgucuugauuucaggug

SEQ ID NO: 3680441 - RNA, 19 nt, Salmonella enterica enterica serovar Typhi Ty2
ugccucuggccaguuucaa

SEQ ID NO: 3680442 - RNA, 17 nt, Salmonella enterica enterica serovar Typhi Ty2
ugccugacagcaaugag

SEQ ID NO: 3680443 - RNA, 15 nt, Salmonella enterica enterica serovar Typhi Ty2
ugccugacgccugaa

SEQ ID NO: 3680444 - RNA, 22 nt, Salmonella enterica enterica serovar Typhi Ty2
ugccugauggcgcuacgcuuau

SEQ ID NO: 3680445 - RNA, 14 nt, Salmonella enterica enterica serovar Typhi Ty2
ugccugccgccucc

SEQ ID NO: 3680446 - RNA, 22 nt, Salmonella enterica enterica serovar Typhi Ty2
ugccugccgucgcggcuuucag

SEQ ID NO: 3680447 - RNA, 15 nt, Salmonella enterica enterica serovar Typhi Ty2
ugccugcgccauguu

SEQ ID NO: 3680448 - RNA, 15 nt, Salmonella enterica enterica serovar Typhi Ty2
ugccugcuucagaca

SEQ ID NO: 3680449 - RNA, 22 nt, Salmonella enterica enterica serovar Typhi Ty2
ugccuggcaacaugaccagcgc

SEQ ID NO: 3680450 - RNA, 12 nt, Salmonella enterica enterica serovar Typhi Ty2
ugccuggccucc

SEQ ID NO: 3680451 - RNA, 17 nt, Salmonella enterica enterica serovar Typhi Ty2
ugccuggguuccaggcg

SEQ ID NO: 3680452 - RNA, 17 nt, Salmonella enterica enterica serovar Typhi Ty2
ugccuguagcagcgcca

SEQ ID NO: 3680453 - RNA, 13 nt, Salmonella enterica enterica serovar Typhi Ty2
ugccugucacgca

SEQ ID NO: 3680454 - RNA, 18 nt, Salmonella enterica enterica serovar Typhi Ty2
ugccuguguaucgcccug

SEQ ID NO: 3680455 - RNA, 22 nt, Salmonella enterica enterica serovar Typhi Ty2
ugccuguguucguggacgagca

SEQ ID NO: 3680456 - RNA, 15 nt, Salmonella enterica enterica serovar Typhi Ty2
ugccuucaaauauau

SEQ ID NO: 3680457 - RNA, 21 nt, Salmonella enterica enterica serovar Typhi Ty2
ugccuuccacggcgaucacuu

SEQ ID NO: 3680458 - RNA, 17 nt, Salmonella enterica enterica serovar Typhi Ty2
ugccuuccaggcgguga

SEQ ID NO: 3680459 - RNA, 10 nt, Salmonella enterica enterica serovar Typhi Ty2
ugccuucgau

SEQ ID NO: 3680460 - RNA, 14 nt, Salmonella enterica enterica serovar Typhi Ty2
ugccuucgccgccg

SEQ ID NO: 3680461 - RNA, 23 nt, Salmonella enterica enterica serovar Typhi Ty2
ugcgccgccauccggccuguaag

SEQ ID NO: 3680462 - RNA, 15 nt, Salmonella enterica enterica serovar Typhi Ty2
ugcgccgucaggcuu

SEQ ID NO: 3680463 - RNA, 21 nt, Salmonella enterica enterica serovar Typhi Ty2
ugcgccgugaaauauccuccg

SEQ ID NO: 3680464 - RNA, 14 nt, Salmonella enterica enterica serovar Typhi Ty2
ugcgccugucucca

SEQ ID NO: 3680465 - RNA, 16 nt, Salmonella enterica enterica serovar Typhi Ty2
ugcgccugucuccagc

SEQ ID NO: 3680466 - RNA, 21 nt, Salmonella enterica enterica serovar Typhi Ty2
ugcgccuguuagggcgcggcu

SEQ ID NO: 3680467 - RNA, 16 nt, Salmonella enterica enterica serovar Typhi Ty2
ugcgccuguugacgcg

SEQ ID NO: 3680468 - RNA, 20 nt, Salmonella enterica enterica serovar Typhi Ty2
ugcgccuuauccggcgugua

SEQ ID NO: 3680469 - RNA, 12 nt, Salmonella enterica enterica serovar Typhi Ty2
ugcgccuuccag

SEQ ID NO: 3680470 - RNA, 13 nt, Salmonella enterica enterica serovar Typhi Ty2
ugcgccuuccagu

SEQ ID NO: 3680471 - RNA, 19 nt, Salmonella enterica enterica serovar Typhi Ty2
ugcgcgacgacgccagcca

SEQ ID NO: 3680472 - RNA, 14 nt, Salmonella enterica enterica serovar Typhi Ty2
ugcgcgauguucau

SEQ ID NO: 3680473 - RNA, 16 nt, Salmonella enterica enterica serovar Typhi Ty2
ugcgcgcaucgggccg

SEQ ID NO: 3680474 - RNA, 16 nt, Salmonella enterica enterica serovar Typhi Ty2
ugcgcgccgacaggcu

SEQ ID NO: 3680475 - RNA, 14 nt, Salmonella enterica enterica serovar Typhi Ty2
ugcgcgccuucgaa

SEQ ID NO: 3680476 - RNA, 18 nt, Salmonella enterica enterica serovar Typhi Ty2
ugcgcgcgaugcugcucc

SEQ ID NO: 3680477 - RNA, 19 nt, Salmonella enterica enterica serovar Typhi Ty2
ugcgcgcgaugcugcucca

SEQ ID NO: 3680478 - RNA, 22 nt, Salmonella enterica enterica serovar Typhi Ty2
ugcgcgcgugaccccaggcaua

SEQ ID NO: 3680479 - RNA, 23 nt, Salmonella enterica enterica serovar Typhi Ty2
ugcgcgcuggugucgccguggaa

SEQ ID NO: 3680480 - RNA, 16 nt, Salmonella enterica enterica serovar Typhi Ty2
ugcgcgcuucuucaug

SEQ ID NO: 3680481 - RNA, 23 nt, Salmonella enterica enterica serovar Typhi Ty2
ugcgcggaauagcggcuaaucac

SEQ ID NO: 3680482 - RNA, 19 nt, Salmonella enterica enterica serovar Typhi Ty2
ugcgcggcaauuuccgcug

SEQ ID NO: 3680483 - RNA, 17 nt, Salmonella enterica enterica serovar Typhi Ty2
ugcgcggcgaaaaagcc

SEQ ID NO: 3680484 - RNA, 22 nt, Salmonella enterica enterica serovar Typhi Ty2
ugcgcguaaacgcaacaccauc

SEQ ID NO: 3680485 - RNA, 14 nt, Salmonella enterica enterica serovar Typhi Ty2
ugcgcguaaauuuc

SEQ ID NO: 3680486 - RNA, 20 nt, Salmonella enterica enterica serovar Typhi Ty2
ugcgcguaaauuucacuuau

SEQ ID NO: 3680487 - RNA, 20 nt, Salmonella enterica enterica serovar Typhi Ty2
ugcgcgucccucuccagggc

SEQ ID NO: 3680488 - RNA, 18 nt, Salmonella enterica enterica serovar Typhi Ty2
ugcgcguuuagcgccagc

SEQ ID NO: 3680489 - RNA, 16 nt, Salmonella enterica enterica serovar Typhi Ty2
ugcgcuaacuggccaa

SEQ ID NO: 3680490 - RNA, 23 nt, Salmonella enterica enterica serovar Typhi Ty2
ugcgcuaagcguuacggaaaaaa

SEQ ID NO: 3680491 - RNA, 15 nt, Salmonella enterica enterica serovar Typhi Ty2
ugcgcuacuucaggg

SEQ ID NO: 3680492 - RNA, 15 nt, Salmonella enterica enterica serovar Typhi Ty2
ugcgcuauuacucuu

SEQ ID NO: 3680493 - RNA, 22 nt, Salmonella enterica enterica serovar Typhi Ty2
ugcgcucacgcuuauccggccu

SEQ ID NO: 3680494 - RNA, 14 nt, Salmonella enterica enterica serovar Typhi Ty2
ugcgcucaggguca

SEQ ID NO: 3680495 - RNA, 16 nt, Salmonella enterica enterica serovar Typhi Ty2
ugcgcucagggucaga

SEQ ID NO: 3680496 - RNA, 14 nt, Salmonella enterica enterica serovar Typhi Ty2
ugcgcuccggcgcu

SEQ ID NO: 3680497 - RNA, 15 nt, Salmonella enterica enterica serovar Typhi Ty2
ugcgcuccugcuccc

SEQ ID NO: 3680498 - RNA, 17 nt, Salmonella enterica enterica serovar Typhi Ty2
ugcgcucuaucaccgcc

SEQ ID NO: 3680499 - RNA, 15 nt, Salmonella enterica enterica serovar Typhi Ty2
ugcgcugcgcgcgau

SEQ ID NO: 3680500 - RNA, 17 nt, Salmonella enterica enterica serovar Typhi Ty2
ugcgcugcggccagacc

SEQ ID NO: 3680501 - RNA, 15 nt, Salmonella enterica enterica serovar Typhi Ty2
ugcgcuggaacugau

SEQ ID NO: 3680502 - RNA, 19 nt, Salmonella enterica enterica serovar Typhi Ty2
ugcgcuggaacugaucgug

SEQ ID NO: 3680503 - RNA, 14 nt, Salmonella enterica enterica serovar Typhi Ty2
ugcgcuggacuggg

SEQ ID NO: 3680504 - RNA, 18 nt, Salmonella enterica enterica serovar Typhi Ty2
ugcgcugguuggcgcgcu

SEQ ID NO: 3680505 - RNA, 16 nt, Salmonella enterica enterica serovar Typhi Ty2
ugcgcugucaccagca

SEQ ID NO: 3680506 - RNA, 16 nt, Salmonella enterica enterica serovar Typhi Ty2
ugcgcuuaccgggccu

SEQ ID NO: 3680507 - RNA, 20 nt, Salmonella enterica enterica serovar Typhi Ty2
ugcgcuuaucaggccuacaa

SEQ ID NO: 3680508 - RNA, 19 nt, Salmonella enterica enterica serovar Typhi Ty2
ugcgcuuaucaggccuacg

SEQ ID NO: 3680509 - RNA, 19 nt, Salmonella enterica enterica serovar Typhi Ty2
ugcgcuuauccggccuacg

SEQ ID NO: 3680510 - RNA, 17 nt, Salmonella enterica enterica serovar Typhi Ty2
ugcgcuucgaugcguuc

SEQ ID NO: 3680511 - RNA, 22 nt, Salmonella enterica enterica serovar Typhi Ty2
ugcgcuucgaugcguucaaaaa

SEQ ID NO: 3680512 - RNA, 16 nt, Salmonella enterica enterica serovar Typhi Ty2
ugcgcuuuacuguucc

SEQ ID NO: 3680513 - RNA, 20 nt, Salmonella enterica enterica serovar Typhi Ty2
ugcgcuuuaugcccuucgac

SEQ ID NO: 3680514 - RNA, 21 nt, Salmonella enterica enterica serovar Typhi Ty2
ugcgcuuuccgccaugaaaaa

SEQ ID NO: 3680515 - RNA, 16 nt, Salmonella enterica enterica serovar Typhi Ty2
ugcggaaccgcccauc

SEQ ID NO: 3680516 - RNA, 21 nt, Salmonella enterica enterica serovar Typhi Ty2
ugcggaaccgcccaucaacac

SEQ ID NO: 3680517 - RNA, 18 nt, Salmonella enterica enterica serovar Typhi Ty2
ugcggacaggcgaaauaa

SEQ ID NO: 3680518 - RNA, 20 nt, Salmonella enterica enterica serovar Typhi Ty2
ugcggacgcagcucauaccc

SEQ ID NO: 3680519 - RNA, 17 nt, Salmonella enterica enterica serovar Typhi Ty2
ugcggauaguccugcgc

SEQ ID NO: 3680520 - RNA, 15 nt, Salmonella enterica enterica serovar Typhi Ty2
ugcggaugcgccauc

SEQ ID NO: 3680521 - RNA, 21 nt, Salmonella enterica enterica serovar Typhi Ty2
ugcggcaauggccgcagcgcc

SEQ ID NO: 3680522 - RNA, 18 nt, Salmonella enterica enterica serovar Typhi Ty2
ugcggcaauggcucaggc

SEQ ID NO: 3680523 - RNA, 13 nt, Salmonella enterica enterica serovar Typhi Ty2
ugcggcaucagau

SEQ ID NO: 3680524 - RNA, 22 nt, Salmonella enterica enterica serovar Typhi Ty2
ugcggcgaaacagaguaacccg

SEQ ID NO: 3680525 - RNA, 11 nt, Salmonella enterica enterica serovar Typhi Ty2
ugcggcgacuu

SEQ ID NO: 3680526 - RNA, 22 nt, Salmonella enterica enterica serovar Typhi Ty2
ugcggcgaggaguaguuaaaaa

SEQ ID NO: 3680527 - RNA, 17 nt, Salmonella enterica enterica serovar Typhi Ty2
ugcggcgcgcccggcaa

SEQ ID NO: 3680528 - RNA, 15 nt, Salmonella enterica enterica serovar Typhi Ty2
ugcggcgcuuccaga

SEQ ID NO: 3680529 - RNA, 18 nt, Salmonella enterica enterica serovar Typhi Ty2
ugcggcguguuguaaaac

SEQ ID NO: 3680530 - RNA, 15 nt, Salmonella enterica enterica serovar Typhi Ty2
ugcggcuuacccuga

SEQ ID NO: 3680531 - RNA, 16 nt, Salmonella enterica enterica serovar Typhi Ty2
ugcggcuucagcgaca

SEQ ID NO: 3680532 - RNA, 15 nt, Salmonella enterica enterica serovar Typhi Ty2
ugcggcuuucaucau

SEQ ID NO: 3680533 - RNA, 20 nt, Salmonella enterica enterica serovar Typhi Ty2
ugcggcuuugcgccggcagu

SEQ ID NO: 3680534 - RNA, 23 nt, Salmonella enterica enterica serovar Typhi Ty2
ugcgggaaauaccauccgcgccg

SEQ ID NO: 3680535 - RNA, 16 nt, Salmonella enterica enterica serovar Typhi Ty2
ugcgggacgcaucauc

SEQ ID NO: 3680536 - RNA, 18 nt, Salmonella enterica enterica serovar Typhi Ty2
ugcgggcaugggaaauaa

SEQ ID NO: 3680537 - RNA, 15 nt, Salmonella enterica enterica serovar Typhi Ty2
ugcgggccagcagcc

SEQ ID NO: 3680538 - RNA, 15 nt, Salmonella enterica enterica serovar Typhi Ty2
ugcgguaccgcguua

SEQ ID NO: 3680539 - RNA, 21 nt, Salmonella enterica enterica serovar Typhi Ty2
ugcgguggccgacuuaucgac

SEQ ID NO: 3680540 - RNA, 18 nt, Salmonella enterica enterica serovar Typhi Ty2
ugcgguuacguccggcau

SEQ ID NO: 3680541 - RNA, 19 nt, Salmonella enterica enterica serovar Typhi Ty2
ugcgguuauaauaauaauu

SEQ ID NO: 3680542 - RNA, 23 nt, Salmonella enterica enterica serovar Typhi Ty2
ugcgguuuacgccaugcaucaau

SEQ ID NO: 3680543 - RNA, 20 nt, Salmonella enterica enterica serovar Typhi Ty2
ugcugaaaugauaagugaua

SEQ ID NO: 3680544 - RNA, 21 nt, Salmonella enterica enterica serovar Typhi Ty2
ugcugaacacaaugaauccuc

SEQ ID NO: 3680545 - RNA, 16 nt, Salmonella enterica enterica serovar Typhi Ty2
ugcugaagauaaaauu

SEQ ID NO: 3680546 - RNA, 20 nt, Salmonella enterica enterica serovar Typhi Ty2
ugcugaagcagauacugcgc

SEQ ID NO: 3680547 - RNA, 17 nt, Salmonella enterica enterica serovar Typhi Ty2
ugcugaauagccagccc

SEQ ID NO: 3680548 - RNA, 19 nt, Salmonella enterica enterica serovar Typhi Ty2
ugcugaauauuaucggcgu

SEQ ID NO: 3680549 - RNA, 21 nt, Salmonella enterica enterica serovar Typhi Ty2
ugcugacaaaauaaagugaaa

SEQ ID NO: 3680550 - RNA, 16 nt, Salmonella enterica enterica serovar Typhi Ty2
ugcugacaaucugcug

SEQ ID NO: 3680551 - RNA, 18 nt, Salmonella enterica enterica serovar Typhi Ty2
ugcugacaaucugcugga

SEQ ID NO: 3680552 - RNA, 17 nt, Salmonella enterica enterica serovar Typhi Ty2
ugcugacacccucugcg

SEQ ID NO: 3680553 - RNA, 19 nt, Salmonella enterica enterica serovar Typhi Ty2
ugcugacacccucugcgcc

SEQ ID NO: 3680554 - RNA, 23 nt, Salmonella enterica enterica serovar Typhi Ty2
ugcugacaucucuuuuaauuuuc

SEQ ID NO: 3680555 - RNA, 13 nt, Salmonella enterica enterica serovar Typhi Ty2
ugcugauccugua

SEQ ID NO: 3680556 - RNA, 14 nt, Salmonella enterica enterica serovar Typhi Ty2
ugcugaugcugguu

SEQ ID NO: 3680557 - RNA, 20 nt, Salmonella enterica enterica serovar Typhi Ty2
ugcugaugcuguaggccggg

SEQ ID NO: 3680558 - RNA, 18 nt, Salmonella enterica enterica serovar Typhi Ty2
ugcugcaaauugauacca

SEQ ID NO: 3680559 - RNA, 16 nt, Salmonella enterica enterica serovar Typhi Ty2
ugcugcaacgacgcgg

SEQ ID NO: 3680560 - RNA, 16 nt, Salmonella enterica enterica serovar Typhi Ty2
ugcugcacauucaggu

SEQ ID NO: 3680561 - RNA, 14 nt, Salmonella enterica enterica serovar Typhi Ty2
ugcugcaccgcauc

SEQ ID NO: 3680562 - RNA, 16 nt, Salmonella enterica enterica serovar Typhi Ty2
ugcugccacgucacgc

SEQ ID NO: 3680563 - RNA, 15 nt, Salmonella enterica enterica serovar Typhi Ty2
ugcugccagcgccgc

SEQ ID NO: 3680564 - RNA, 14 nt, Salmonella enterica enterica serovar Typhi Ty2
ugcugccucaucaa

SEQ ID NO: 3680565 - RNA, 22 nt, Salmonella enterica enterica serovar Typhi Ty2
ugcugcggcacgaaaaauaaaa

SEQ ID NO: 3680566 - RNA, 22 nt, Salmonella enterica enterica serovar Typhi Ty2
ugcugcgguuauaauaauaauu

SEQ ID NO: 3680567 - RNA, 15 nt, Salmonella enterica enterica serovar Typhi Ty2
ugcugcucccucacg

SEQ ID NO: 3680568 - RNA, 17 nt, Salmonella enterica enterica serovar Typhi Ty2
ugcugcucgcuaugaaa

SEQ ID NO: 3680569 - RNA, 22 nt, Salmonella enterica enterica serovar Typhi Ty2
ugcuggauucucucccaggcau

SEQ ID NO: 3680570 - RNA, 12 nt, Salmonella enterica enterica serovar Typhi Ty2
ugcuggccgcgu

SEQ ID NO: 3680571 - RNA, 18 nt, Salmonella enterica enterica serovar Typhi Ty2
ugcuggccuguucaagug

SEQ ID NO: 3680572 - RNA, 20 nt, Salmonella enterica enterica serovar Typhi Ty2
ugcuggcgaaccaccagccg

SEQ ID NO: 3680573 - RNA, 14 nt, Salmonella enterica enterica serovar Typhi Ty2
ugcuggcgaugagu

SEQ ID NO: 3680574 - RNA, 20 nt, Salmonella enterica enterica serovar Typhi Ty2
ugcuggcgcgucacaacagc

SEQ ID NO: 3680575 - RNA, 23 nt, Salmonella enterica enterica serovar Typhi Ty2
ugcuggcgcgucacaacagccgg

SEQ ID NO: 3680576 - RNA, 15 nt, Salmonella enterica enterica serovar Typhi Ty2
ugcuggcggcaaggc

SEQ ID NO: 3680577 - RNA, 13 nt, Salmonella enterica enterica serovar Typhi Ty2
ugcuggcggccgu

SEQ ID NO: 3680578 - RNA, 13 nt, Salmonella enterica enterica serovar Typhi Ty2
ugcuggcugaaau

SEQ ID NO: 3680579 - RNA, 22 nt, Salmonella enterica enterica serovar Typhi Ty2
ugcugguagagcaucgcggcau

SEQ ID NO: 3680580 - RNA, 19 nt, Salmonella enterica enterica serovar Typhi Ty2
ugcuggugaagacgcugca

SEQ ID NO: 3680581 - RNA, 16 nt, Salmonella enterica enterica serovar Typhi Ty2
ugcuggugaccgccuu

SEQ ID NO: 3680582 - RNA, 15 nt, Salmonella enterica enterica serovar Typhi Ty2
ugcuggugcgccugu

SEQ ID NO: 3680583 - RNA, 14 nt, Salmonella enterica enterica serovar Typhi Ty2
ugcugguggugggc

SEQ ID NO: 3680584 - RNA, 14 nt, Salmonella enterica enterica serovar Typhi Ty2
ugcugguugucuca

SEQ ID NO: 3680585 - RNA, 17 nt, Salmonella enterica enterica serovar Typhi Ty2
ugcuguaaguuuccguc

SEQ ID NO: 3680586 - RNA, 17 nt, Salmonella enterica enterica serovar Typhi Ty2
ugcuguacauauccagu

SEQ ID NO: 3680587 - RNA, 13 nt, Salmonella enterica enterica serovar Typhi Ty2
ugcuguagcacau

SEQ ID NO: 3680588 - RNA, 22 nt, Salmonella enterica enterica serovar Typhi Ty2
ugcuguagcugcccggauaacc

SEQ ID NO: 3680589 - RNA, 16 nt, Salmonella enterica enterica serovar Typhi Ty2
ugcuguaggccgggua

SEQ ID NO: 3680590 - RNA, 22 nt, Salmonella enterica enterica serovar Typhi Ty2
ugcuguauaaacucagcaauau

SEQ ID NO: 3680591 - RNA, 20 nt, Salmonella enterica enterica serovar Typhi Ty2
ugcuguccggcugcauauac

SEQ ID NO: 3680592 - RNA, 18 nt, Salmonella enterica enterica serovar Typhi Ty2
ugcugucgcccauugaaa

SEQ ID NO: 3680593 - RNA, 14 nt, Salmonella enterica enterica serovar Typhi Ty2
ugcugucuauuguc

SEQ ID NO: 3680594 - RNA, 17 nt, Salmonella enterica enterica serovar Typhi Ty2
ugcugucuauugucccg

SEQ ID NO: 3680595 - RNA, 20 nt, Salmonella enterica enterica serovar Typhi Ty2
ugcugugacaucgccccggc

SEQ ID NO: 3680596 - RNA, 14 nt, Salmonella enterica enterica serovar Typhi Ty2
ugcugugcauaaau

SEQ ID NO: 3680597 - RNA, 14 nt, Salmonella enterica enterica serovar Typhi Ty2
ugcugugcauaucu

SEQ ID NO: 3680598 - RNA, 16 nt, Salmonella enterica enterica serovar Typhi Ty2
ugcugugccugccugu

SEQ ID NO: 3680599 - RNA, 22 nt, Salmonella enterica enterica serovar Typhi Ty2
ugcuguggauuuauggcgucac

SEQ ID NO: 3680600 - RNA, 14 nt, Salmonella enterica enterica serovar Typhi Ty2
ugcuguucuucccu

SEQ ID NO: 3680601 - RNA, 17 nt, Salmonella enterica enterica serovar Typhi Ty2
ugcuguuuauggcgcuu

SEQ ID NO: 3680602 - RNA, 21 nt, Salmonella enterica enterica serovar Typhi Ty2
ugcuguuuuuuguugauuuua

SEQ ID NO: 3680603 - RNA, 15 nt, Salmonella enterica enterica serovar Typhi Ty2
ugcuuaaaggcggca

SEQ ID NO: 3680604 - RNA, 13 nt, Salmonella enterica enterica serovar Typhi Ty2
ugcuuaacuucug

SEQ ID NO: 3680605 - RNA, 21 nt, Salmonella enterica enterica serovar Typhi Ty2
ugcuuaauauccaguugcgcc

SEQ ID NO: 3680606 - RNA, 13 nt, Salmonella enterica enterica serovar Typhi Ty2
ugcuuaccagacc

SEQ ID NO: 3680607 - RNA, 20 nt, Salmonella enterica enterica serovar Typhi Ty2
ugcuuaccaucuggccuacg

SEQ ID NO: 3680608 - RNA, 17 nt, Salmonella enterica enterica serovar Typhi Ty2
ugcuuaccgcaucgccc

SEQ ID NO: 3680609 - RNA, 19 nt, Salmonella enterica enterica serovar Typhi Ty2
ugcuuaccguuuaccucau

SEQ ID NO: 3680610 - RNA, 19 nt, Salmonella enterica enterica serovar Typhi Ty2
ugcuuaccuuguucuucca

SEQ ID NO: 3680611 - RNA, 18 nt, Salmonella enterica enterica serovar Typhi Ty2
ugcuuaucgauaucugcc

SEQ ID NO: 3680612 - RNA, 17 nt, Salmonella enterica enterica serovar Typhi Ty2
ugcuuaugaucgcccag

SEQ ID NO: 3680613 - RNA, 18 nt, Salmonella enterica enterica serovar Typhi Ty2
ugcuuauugucgccgccg

SEQ ID NO: 3680614 - RNA, 18 nt, Salmonella enterica enterica serovar Typhi Ty2
ugcuucaacggugcugag

SEQ ID NO: 3680615 - RNA, 20 nt, Salmonella enterica enterica serovar Typhi Ty2
ugcuucaccucagcaaaauc

SEQ ID NO: 3680616 - RNA, 18 nt, Salmonella enterica enterica serovar Typhi Ty2
ugcuucacggaaggggcc

SEQ ID NO: 3680617 - RNA, 21 nt, Salmonella enterica enterica serovar Typhi Ty2
ugcuucacgggguugaaguag

SEQ ID NO: 3680618 - RNA, 20 nt, Salmonella enterica enterica serovar Typhi Ty2
ugcuucacguuuuccaggug

SEQ ID NO: 3680619 - RNA, 20 nt, Salmonella enterica enterica serovar Typhi Ty2
ugcuucagacaacgccgccu

SEQ ID NO: 3680620 - RNA, 18 nt, Salmonella enterica enterica serovar Typhi Ty2
ugcuucagguuaagugac

SEQ ID NO: 3680621 - RNA, 22 nt, Salmonella enterica enterica serovar Typhi Ty2
ugcuucaugcacaaaacccgca

SEQ ID NO: 3680622 - RNA, 15 nt, Salmonella enterica enterica serovar Typhi Ty2
ugcuuccaaagagcu

SEQ ID NO: 3680623 - RNA, 13 nt, Salmonella enterica enterica serovar Typhi Ty2
ugcuuccagcucc

SEQ ID NO: 3680624 - RNA, 19 nt, Salmonella enterica enterica serovar Typhi Ty2
ugcuuccagcuccauccac

SEQ ID NO: 3680625 - RNA, 19 nt, Salmonella enterica enterica serovar Typhi Ty2
uggauuccuccaauucagg

SEQ ID NO: 3680626 - RNA, 19 nt, Salmonella enterica enterica serovar Typhi Ty2
uggauuucacgaucaucgc

SEQ ID NO: 3680627 - RNA, 18 nt, Salmonella enterica enterica serovar Typhi Ty2
uggauuuuugacuaaagu

SEQ ID NO: 3680628 - RNA, 21 nt, Salmonella enterica enterica serovar Typhi Ty2
uggcaaaaaaggccagacuca

SEQ ID NO: 3680629 - RNA, 18 nt, Salmonella enterica enterica serovar Typhi Ty2
uggcaaaaacaccuaacc

SEQ ID NO: 3680630 - RNA, 16 nt, Salmonella enterica enterica serovar Typhi Ty2
uggcaaaacgcaucca

SEQ ID NO: 3680631 - RNA, 17 nt, Salmonella enterica enterica serovar Typhi Ty2
uggcaaaacgcauccag

SEQ ID NO: 3680632 - RNA, 20 nt, Salmonella enterica enterica serovar Typhi Ty2
uggcaaaaggggcguuucuc

SEQ ID NO: 3680633 - RNA, 14 nt, Salmonella enterica enterica serovar Typhi Ty2
uggcaaaauccaac

SEQ ID NO: 3680634 - RNA, 20 nt, Salmonella enterica enterica serovar Typhi Ty2
uggcaaaaucguuaaccagc

SEQ ID NO: 3680635 - RNA, 20 nt, Salmonella enterica enterica serovar Typhi Ty2
uggcaacauagcaucguuac

SEQ ID NO: 3680636 - RNA, 22 nt, Salmonella enterica enterica serovar Typhi Ty2
uggcaacauagcaucguuaccg

SEQ ID NO: 3680637 - RNA, 19 nt, Salmonella enterica enterica serovar Typhi Ty2
uggcaacccguaccuccag

SEQ ID NO: 3680638 - RNA, 17 nt, Salmonella enterica enterica serovar Typhi Ty2
uggcaacggcagccagc

SEQ ID NO: 3680639 - RNA, 13 nt, Salmonella enterica enterica serovar Typhi Ty2
uggcaagaaucac

SEQ ID NO: 3680640 - RNA, 17 nt, Salmonella enterica enterica serovar Typhi Ty2
uggcaagaauuauuuca

SEQ ID NO: 3680641 - RNA, 19 nt, Salmonella enterica enterica serovar Typhi Ty2
uggcaagaauuauuucagg

SEQ ID NO: 3680642 - RNA, 17 nt, Salmonella enterica enterica serovar Typhi Ty2
uggcaagauuaaccagc

SEQ ID NO: 3680643 - RNA, 17 nt, Salmonella enterica enterica serovar Typhi Ty2
uggcaagcgcuaagcaa

SEQ ID NO: 3680644 - RNA, 21 nt, Salmonella enterica enterica serovar Typhi Ty2
uggcaaguaugaaaagcgcgu

SEQ ID NO: 3680645 - RNA, 20 nt, Salmonella enterica enterica serovar Typhi Ty2
uggcaaucaaauccagcuca

SEQ ID NO: 3680646 - RNA, 22 nt, Salmonella enterica enterica serovar Typhi Ty2
uggcaaucaaauccagcucagu

SEQ ID NO: 3680647 - RNA, 16 nt, Salmonella enterica enterica serovar Typhi Ty2
uggcaauggcggcgga

SEQ ID NO: 3680648 - RNA, 17 nt, Salmonella enterica enterica serovar Typhi Ty2
uggcaauuaaauuagaa

SEQ ID NO: 3680649 - RNA, 14 nt, Salmonella enterica enterica serovar Typhi Ty2
uggcacagcgcagc

SEQ ID NO: 3680650 - RNA, 13 nt, Salmonella enterica enterica serovar Typhi Ty2
uggcacgcuggua

SEQ ID NO: 3680651 - RNA, 13 nt, Salmonella enterica enterica serovar Typhi Ty2
uggcacuggcagc

SEQ ID NO: 3680652 - RNA, 21 nt, Salmonella enterica enterica serovar Typhi Ty2
uggcacuggcagccucguccu

SEQ ID NO: 3680653 - RNA, 15 nt, Salmonella enterica enterica serovar Typhi Ty2
uggcacuucgcgcca

SEQ ID NO: 3680654 - RNA, 16 nt, Salmonella enterica enterica serovar Typhi Ty2
uggcagaccguggccg

SEQ ID NO: 3680655 - RNA, 15 nt, Salmonella enterica enterica serovar Typhi Ty2
uggcagauaaaccac

SEQ ID NO: 3680656 - RNA, 17 nt, Salmonella enterica enterica serovar Typhi Ty2
uggcagccccugaaaua

SEQ ID NO: 3680657 - RNA, 16 nt, Salmonella enterica enterica serovar Typhi Ty2
uggcagccucguccug

SEQ ID NO: 3680658 - RNA, 23 nt, Salmonella enterica enterica serovar Typhi Ty2
uggcagccucguccugcaauuug

SEQ ID NO: 3680659 - RNA, 19 nt, Salmonella enterica enterica serovar Typhi Ty2
uggcagcggcaguaaauuu

SEQ ID NO: 3680660 - RNA, 13 nt, Salmonella enterica enterica serovar Typhi Ty2
uggcagcggcuga

SEQ ID NO: 3680661 - RNA, 12 nt, Salmonella enterica enterica serovar Typhi Ty2
uggcaggccucu

SEQ ID NO: 3680662 - RNA, 12 nt, Salmonella enterica enterica serovar Typhi Ty2
uggcagggcuga

SEQ ID NO: 3680663 - RNA, 17 nt, Salmonella enterica enterica serovar Typhi Ty2
uggcaguacagggcgau

SEQ ID NO: 3680664 - RNA, 22 nt, Salmonella enterica enterica serovar Typhi Ty2
uggcaguauaaauaccuuauuc

SEQ ID NO: 3680665 - RNA, 16 nt, Salmonella enterica enterica serovar Typhi Ty2
uggcaguuugcgcuga

SEQ ID NO: 3680666 - RNA, 19 nt, Salmonella enterica enterica serovar Typhi Ty2
uggcauaaccgcagcgcgg

SEQ ID NO: 3680667 - RNA, 20 nt, Salmonella enterica enterica serovar Typhi Ty2
uggcauagccugauauccac

SEQ ID NO: 3680668 - RNA, 20 nt, Salmonella enterica enterica serovar Typhi Ty2
uggcauauuugccccuuccg

SEQ ID NO: 3680669 - RNA, 19 nt, Salmonella enterica enterica serovar Typhi Ty2
uggcaucauaaaaggcauc

SEQ ID NO: 3680670 - RNA, 15 nt, Salmonella enterica enterica serovar Typhi Ty2
uggcaucaucaaacg

SEQ ID NO: 3680671 - RNA, 17 nt, Salmonella enterica enterica serovar Typhi Ty2
uggcaucugaucuacaa

SEQ ID NO: 3680672 - RNA, 14 nt, Salmonella enterica enterica serovar Typhi Ty2
uggcaucuuaucag

SEQ ID NO: 3680673 - RNA, 24 nt, Salmonella enterica enterica serovar Typhi Ty2
uggcaugcccggugauauuguguu

SEQ ID NO: 3680674 - RNA, 23 nt, Salmonella enterica enterica serovar Typhi Ty2
uggcauguucccaugucagcgca

SEQ ID NO: 3680675 - RNA, 18 nt, Salmonella enterica enterica serovar Typhi Ty2
uggcauuacgcuggcccc

SEQ ID NO: 3680676 - RNA, 20 nt, Salmonella enterica enterica serovar Typhi Ty2
uggcauugccggaaaccaac

SEQ ID NO: 3680677 - RNA, 13 nt, Salmonella enterica enterica serovar Typhi Ty2
uggccaaauaacc

SEQ ID NO: 3680678 - RNA, 14 nt, Salmonella enterica enterica serovar Typhi Ty2
uggccaaucagcgg

SEQ ID NO: 3680679 - RNA, 16 nt, Salmonella enterica enterica serovar Typhi Ty2
uggccaaucagcgggu

SEQ ID NO: 3680680 - RNA, 15 nt, Salmonella enterica enterica serovar Typhi Ty2
uggccacaucguuac

SEQ ID NO: 3680681 - RNA, 17 nt, Salmonella enterica enterica serovar Typhi Ty2
uggccacaucguuaccc

SEQ ID NO: 3680682 - RNA, 15 nt, Salmonella enterica enterica serovar Typhi Ty2
uggccaccuuuacgg

SEQ ID NO: 3680683 - RNA, 22 nt, Salmonella enterica enterica serovar Typhi Ty2
uggccaccuuuacgguggccuu

SEQ ID NO: 3680684 - RNA, 21 nt, Salmonella enterica enterica serovar Typhi Ty2
uggccacggagugcgcggcga

SEQ ID NO: 3680685 - RNA, 19 nt, Salmonella enterica enterica serovar Typhi Ty2
uggccacguagccgucggc

SEQ ID NO: 3680686 - RNA, 19 nt, Salmonella enterica enterica serovar Typhi Ty2
uggccaggaauaaagguca

SEQ ID NO: 3680687 - RNA, 12 nt, Salmonella enterica enterica serovar Typhi Ty2
uggccaggcuuu

SEQ ID NO: 3680688 - RNA, 17 nt, Salmonella enterica enterica serovar Typhi Ty2
uggccagggcaggcagu

SEQ ID NO: 3680689 - RNA, 21 nt, Salmonella enterica enterica serovar Typhi Ty2
uggccaguaucgcgccgccaa

SEQ ID NO: 3680690 - RNA, 13 nt, Salmonella enterica enterica serovar Typhi Ty2
uggccaguuucaa

SEQ ID NO: 3680691 - RNA, 17 nt, Salmonella enterica enterica serovar Typhi Ty2
uggccauauuuuuucag

SEQ ID NO: 3680692 - RNA, 21 nt, Salmonella enterica enterica serovar Typhi Ty2
uggccauauuuuuucaggaag

SEQ ID NO: 3680693 - RNA, 12 nt, Salmonella enterica enterica serovar Typhi Ty2
uggccaucaggu

SEQ ID NO: 3680694 - RNA, 20 nt, Salmonella enterica enterica serovar Typhi Ty2
uggccaugccuaaaccgaca

SEQ ID NO: 3680695 - RNA, 17 nt, Salmonella enterica enterica serovar Typhi Ty2
uggcccagcuaaaccac

SEQ ID NO: 3680696 - RNA, 19 nt, Salmonella enterica enterica serovar Typhi Ty2
uggcccauuuuggccgcuu

SEQ ID NO: 3680697 - RNA, 14 nt, Salmonella enterica enterica serovar Typhi Ty2
uggccccugagcaa

SEQ ID NO: 3680698 - RNA, 14 nt, Salmonella enterica enterica serovar Typhi Ty2
uggcccucccuggc

SEQ ID NO: 3680699 - RNA, 15 nt, Salmonella enterica enterica serovar Typhi Ty2
uggcccugcaucagc

SEQ ID NO: 3680700 - RNA, 15 nt, Salmonella enterica enterica serovar Typhi Ty2
uggccgaauagcuga

SEQ ID NO: 3680701 - RNA, 21 nt, Salmonella enterica enterica serovar Typhi Ty2
uggccgagaguccagcgccag

SEQ ID NO: 3680702 - RNA, 22 nt, Salmonella enterica enterica serovar Typhi Ty2
uggccgauaugaauaauuucgg

SEQ ID NO: 3680703 - RNA, 17 nt, Salmonella enterica enterica serovar Typhi Ty2
uggccgcuauccucgcc

SEQ ID NO: 3680704 - RNA, 17 nt, Salmonella enterica enterica serovar Typhi Ty2
uggccgcugaccacggc

SEQ ID NO: 3680705 - RNA, 18 nt, Salmonella enterica enterica serovar Typhi Ty2
uggccgggauauccugcu

SEQ ID NO: 3680706 - RNA, 14 nt, Salmonella enterica enterica serovar Typhi Ty2
uggccguggugaag

SEQ ID NO: 3680707 - RNA, 15 nt, Salmonella enterica enterica serovar Typhi Ty2
uggcgucccuuuccc

SEQ ID NO: 3680708 - RNA, 20 nt, Salmonella enterica enterica serovar Typhi Ty2
uggcgucgacgugucuaugc

SEQ ID NO: 3680709 - RNA, 15 nt, Salmonella enterica enterica serovar Typhi Ty2
uggcguggccaagau

SEQ ID NO: 3680710 - RNA, 20 nt, Salmonella enterica enterica serovar Typhi Ty2
uggcguuaccggcaggcugg

SEQ ID NO: 3680711 - RNA, 16 nt, Salmonella enterica enterica serovar Typhi Ty2
uggcguuccacccagu

SEQ ID NO: 3680712 - RNA, 17 nt, Salmonella enterica enterica serovar Typhi Ty2
uggcuaaucgccacgac

SEQ ID NO: 3680713 - RNA, 20 nt, Salmonella enterica enterica serovar Typhi Ty2
uggcuauagcucaguuggua

SEQ ID NO: 3680714 - RNA, 15 nt, Salmonella enterica enterica serovar Typhi Ty2
uggcuaucggccuga

SEQ ID NO: 3680715 - RNA, 19 nt, Salmonella enterica enterica serovar Typhi Ty2
uggcuauuuuuugcuggcg

SEQ ID NO: 3680716 - RNA, 20 nt, Salmonella enterica enterica serovar Typhi Ty2
uggcucaagauucaguucca

SEQ ID NO: 3680717 - RNA, 17 nt, Salmonella enterica enterica serovar Typhi Ty2
uggcucaaggauauugc

SEQ ID NO: 3680718 - RNA, 17 nt, Salmonella enterica enterica serovar Typhi Ty2
uggcucaauccaggugg

SEQ ID NO: 3680719 - RNA, 21 nt, Salmonella enterica enterica serovar Typhi Ty2
uggcucccgaacgauaauucg

SEQ ID NO: 3680720 - RNA, 15 nt, Salmonella enterica enterica serovar Typhi Ty2
uggcucccgcagcca

SEQ ID NO: 3680721 - RNA, 19 nt, Salmonella enterica enterica serovar Typhi Ty2
uggcucccgcagccacucc

SEQ ID NO: 3680722 - RNA, 22 nt, Salmonella enterica enterica serovar Typhi Ty2
uggcucggccugucgcgaccau

SEQ ID NO: 3680723 - RNA, 18 nt, Salmonella enterica enterica serovar Typhi Ty2
uggcucggcgucaucccg

SEQ ID NO: 3680724 - RNA, 13 nt, Salmonella enterica enterica serovar Typhi Ty2
uggcugagaaaaa

SEQ ID NO: 3680725 - RNA, 16 nt, Salmonella enterica enterica serovar Typhi Ty2
uggcugcgauaaugaa

SEQ ID NO: 3680726 - RNA, 21 nt, Salmonella enterica enterica serovar Typhi Ty2
uggcugcgcgucccucuccag

SEQ ID NO: 3680727 - RNA, 15 nt, Salmonella enterica enterica serovar Typhi Ty2
uggcuggcauauugc

SEQ ID NO: 3680728 - RNA, 14 nt, Salmonella enterica enterica serovar Typhi Ty2
uggcuggcgucccg

SEQ ID NO: 3680729 - RNA, 17 nt, Salmonella enterica enterica serovar Typhi Ty2
uggcugguggccuucgg

SEQ ID NO: 3680730 - RNA, 17 nt, Salmonella enterica enterica serovar Typhi Ty2
uggcugucggcagaacc

SEQ ID NO: 3680731 - RNA, 16 nt, Salmonella enterica enterica serovar Typhi Ty2
uggcugugcgugaccc

SEQ ID NO: 3680732 - RNA, 12 nt, Salmonella enterica enterica serovar Typhi Ty2
uggcuguuuccc

SEQ ID NO: 3680733 - RNA, 14 nt, Salmonella enterica enterica serovar Typhi Ty2
uggcuuaacucacc

SEQ ID NO: 3680734 - RNA, 17 nt, Salmonella enterica enterica serovar Typhi Ty2
uggcuuaccguaugcaa

SEQ ID NO: 3680735 - RNA, 16 nt, Salmonella enterica enterica serovar Typhi Ty2
uggcuuaccugcucug

SEQ ID NO: 3680736 - RNA, 17 nt, Salmonella enterica enterica serovar Typhi Ty2
uggcuuaccuucggccu

SEQ ID NO: 3680737 - RNA, 16 nt, Salmonella enterica enterica serovar Typhi Ty2
uggcuuccguccccag

SEQ ID NO: 3680738 - RNA, 18 nt, Salmonella enterica enterica serovar Typhi Ty2
uggcuuccguccccagcc

SEQ ID NO: 3680739 - RNA, 15 nt, Salmonella enterica enterica serovar Typhi Ty2
ucacguagcggcgcg

SEQ ID NO: 3680740 - RNA, 19 nt, Salmonella enterica enterica serovar Typhi Ty2
ucacguagcguaucagacu

SEQ ID NO: 3680741 - RNA, 19 nt, Salmonella enterica enterica serovar Typhi Ty2
ucacguccugguuaccgcg

SEQ ID NO: 3680742 - RNA, 22 nt, Salmonella enterica enterica serovar Typhi Ty2
ucacgucgcgaagcugugcguu

SEQ ID NO: 3680743 - RNA, 15 nt, Salmonella enterica enterica serovar Typhi Ty2
ucacguuuacuaaaa

SEQ ID NO: 3680744 - RNA, 14 nt, Salmonella enterica enterica serovar Typhi Ty2
ucacguuuuuacuc

SEQ ID NO: 3680745 - RNA, 14 nt, Salmonella enterica enterica serovar Typhi Ty2
ucacuaaaccagcu

SEQ ID NO: 3680746 - RNA, 18 nt, Salmonella enterica enterica serovar Typhi Ty2
ucacuaauccccauuuuu

SEQ ID NO: 3680747 - RNA, 18 nt, Salmonella enterica enterica serovar Typhi Ty2
ucacuacccggaggcaau

SEQ ID NO: 3680748 - RNA, 19 nt, Salmonella enterica enterica serovar Typhi Ty2
ucacuacccggaggcaaua

SEQ ID NO: 3680749 - RNA, 22 nt, Salmonella enterica enterica serovar Typhi Ty2
ucacuaggcguuagaauaacgu

SEQ ID NO: 3680750 - RNA, 18 nt, Salmonella enterica enterica serovar Typhi Ty2
ucacuccuuagauuaauc

SEQ ID NO: 3680751 - RNA, 12 nt, Salmonella enterica enterica serovar Typhi Ty2
ucacugccgccc

SEQ ID NO: 3680752 - RNA, 18 nt, Salmonella enterica enterica serovar Typhi Ty2
ucacugccguacaaaccg

SEQ ID NO: 3680753 - RNA, 17 nt, Salmonella enterica enterica serovar Typhi Ty2
ucacuggcggcaagcug

SEQ ID NO: 3680754 - RNA, 19 nt, Salmonella enterica enterica serovar Typhi Ty2
ucacuggcggcaagcugcu

SEQ ID NO: 3680755 - RNA, 18 nt, Salmonella enterica enterica serovar Typhi Ty2
ucacuguuaucgccauua

SEQ ID NO: 3680756 - RNA, 14 nt, Salmonella enterica enterica serovar Typhi Ty2
ucacuuaucccugc

SEQ ID NO: 3680757 - RNA, 21 nt, Salmonella enterica enterica serovar Typhi Ty2
ucacuuccgccaccacgccca

SEQ ID NO: 3680758 - RNA, 23 nt, Salmonella enterica enterica serovar Typhi Ty2
ucacuucugaguucggcaugggg

SEQ ID NO: 3680759 - RNA, 17 nt, Salmonella enterica enterica serovar Typhi Ty2
ucacuuguucaauauuc

SEQ ID NO: 3680760 - RNA, 20 nt, Salmonella enterica enterica serovar Typhi Ty2
ucacuuucagauuuuuaaug

SEQ ID NO: 3680761 - RNA, 15 nt, Salmonella enterica enterica serovar Typhi Ty2
ucacuuucaucagag

SEQ ID NO: 3680762 - RNA, 22 nt, Salmonella enterica enterica serovar Typhi Ty2
ucacuuucccggaaaaguauuc

SEQ ID NO: 3680763 - RNA, 16 nt, Salmonella enterica enterica serovar Typhi Ty2
ucacuuuccgaaucag

SEQ ID NO: 3680764 - RNA, 19 nt, Salmonella enterica enterica serovar Typhi Ty2
ucacuuuccgaaucaggcg

SEQ ID NO: 3680765 - RNA, 19 nt, Salmonella enterica enterica serovar Typhi Ty2
ucacuuuugccgguugcca

SEQ ID NO: 3680766 - RNA, 23 nt, Salmonella enterica enterica serovar Typhi Ty2
ucagaaacaacacaaaucgggcg

SEQ ID NO: 3680767 - RNA, 15 nt, Salmonella enterica enterica serovar Typhi Ty2
ucagaaauaaaacca

SEQ ID NO: 3680768 - RNA, 19 nt, Salmonella enterica enterica serovar Typhi Ty2
ucagaaccucaucccggcu

SEQ ID NO: 3680769 - RNA, 16 nt, Salmonella enterica enterica serovar Typhi Ty2
ucagaaccugcgauac

SEQ ID NO: 3680770 - RNA, 15 nt, Salmonella enterica enterica serovar Typhi Ty2
ucagaacugauaguu

SEQ ID NO: 3680771 - RNA, 18 nt, Salmonella enterica enterica serovar Typhi Ty2
ucagaagcuucgcgaacu

SEQ ID NO: 3680772 - RNA, 20 nt, Salmonella enterica enterica serovar Typhi Ty2
ucagaauacagaauccggcg

SEQ ID NO: 3680773 - RNA, 20 nt, Salmonella enterica enterica serovar Typhi Ty2
ucagaauaccgcguccuucu

SEQ ID NO: 3680774 - RNA, 19 nt, Salmonella enterica enterica serovar Typhi Ty2
ucagaauauccgguacacc

SEQ ID NO: 3680775 - RNA, 20 nt, Salmonella enterica enterica serovar Typhi Ty2
ucagaauuuuuaaccaucac

SEQ ID NO: 3680776 - RNA, 22 nt, Salmonella enterica enterica serovar Typhi Ty2
ucagacacaauauugcugugcu

SEQ ID NO: 3680777 - RNA, 20 nt, Salmonella enterica enterica serovar Typhi Ty2
ucagacacauucugugaucc

SEQ ID NO: 3680778 - RNA, 19 nt, Salmonella enterica enterica serovar Typhi Ty2
ucagacaccagcccuggcu

SEQ ID NO: 3680779 - RNA, 11 nt, Salmonella enterica enterica serovar Typhi Ty2
ucagacaggcc

SEQ ID NO: 3680780 - RNA, 21 nt, Salmonella enterica enterica serovar Typhi Ty2
ucagacauauacucuucgcca

SEQ ID NO: 3680781 - RNA, 23 nt, Salmonella enterica enterica serovar Typhi Ty2
ucagaccagaaucccacggagaa

SEQ ID NO: 3680782 - RNA, 19 nt, Salmonella enterica enterica serovar Typhi Ty2
ucagaccauaguccaugcc

SEQ ID NO: 3680783 - RNA, 20 nt, Salmonella enterica enterica serovar Typhi Ty2
ucagaccggcaaucaauaca

SEQ ID NO: 3680784 - RNA, 21 nt, Salmonella enterica enterica serovar Typhi Ty2
ucagaccgugcuuuugcagau

SEQ ID NO: 3680785 - RNA, 16 nt, Salmonella enterica enterica serovar Typhi Ty2
ucagacgaccauccac

SEQ ID NO: 3680786 - RNA, 12 nt, Salmonella enterica enterica serovar Typhi Ty2
ucagacgcauca

SEQ ID NO: 3680787 - RNA, 16 nt, Salmonella enterica enterica serovar Typhi Ty2
ucagacgcgcagugug

SEQ ID NO: 3680788 - RNA, 13 nt, Salmonella enterica enterica serovar Typhi Ty2
ucagacgcugguu

SEQ ID NO: 3680789 - RNA, 15 nt, Salmonella enterica enterica serovar Typhi Ty2
ucagacgcugguugu

SEQ ID NO: 3680790 - RNA, 18 nt, Salmonella enterica enterica serovar Typhi Ty2
ucagacguagcgccauca

SEQ ID NO: 3680791 - RNA, 20 nt, Salmonella enterica enterica serovar Typhi Ty2
ucagacucucaaugcccauc

SEQ ID NO: 3680792 - RNA, 22 nt, Salmonella enterica enterica serovar Typhi Ty2
ucagagcgucuuuuauccccac

SEQ ID NO: 3680793 - RNA, 22 nt, Salmonella enterica enterica serovar Typhi Ty2
ucagaggccuuuugcagcagcg

SEQ ID NO: 3680794 - RNA, 21 nt, Salmonella enterica enterica serovar Typhi Ty2
ucagauaaacagguaaaacaa

SEQ ID NO: 3680795 - RNA, 20 nt, Salmonella enterica enterica serovar Typhi Ty2
ucagauaaagcuucugcgcc

SEQ ID NO: 3680796 - RNA, 15 nt, Salmonella enterica enterica serovar Typhi Ty2
ucagauaauucuaaa

SEQ ID NO: 3680797 - RNA, 23 nt, Salmonella enterica enterica serovar Typhi Ty2
ucagauaggcgcgaaaugucccg

SEQ ID NO: 3680798 - RNA, 15 nt, Salmonella enterica enterica serovar Typhi Ty2
ucagauauuccagcg

SEQ ID NO: 3680799 - RNA, 18 nt, Salmonella enterica enterica serovar Typhi Ty2
ucagauccaacgcggaaa

SEQ ID NO: 3680800 - RNA, 17 nt, Salmonella enterica enterica serovar Typhi Ty2
ucagaucuuauaugagc

SEQ ID NO: 3680801 - RNA, 13 nt, Salmonella enterica enterica serovar Typhi Ty2
ucagauuacccuc

SEQ ID NO: 3680802 - RNA, 19 nt, Salmonella enterica enterica serovar Typhi Ty2
ucagauugaucaucaccga

SEQ ID NO: 3680803 - RNA, 11 nt, Salmonella enterica enterica serovar Typhi Ty2
ucagcaaaaac

SEQ ID NO: 3680804 - RNA, 22 nt, Salmonella enterica enterica serovar Typhi Ty2
ucagcaaaauaccggcagcggu

SEQ ID NO: 3680805 - RNA, 17 nt, Salmonella enterica enterica serovar Typhi Ty2
ucagcaaaauggcaauu

SEQ ID NO: 3680806 - RNA, 20 nt, Salmonella enterica enterica serovar Typhi Ty2
ucagcaaacggcuggauaac

SEQ ID NO: 3680807 - RNA, 18 nt, Salmonella enterica enterica serovar Typhi Ty2
ucagcaacccuuuuucaa

SEQ ID NO: 3680808 - RNA, 18 nt, Salmonella enterica enterica serovar Typhi Ty2
ucagcaacggaagcugac

SEQ ID NO: 3680809 - RNA, 13 nt, Salmonella enterica enterica serovar Typhi Ty2
ucagcaacugcgu

SEQ ID NO: 3680810 - RNA, 13 nt, Salmonella enterica enterica serovar Typhi Ty2
ucagcaagaaguu

SEQ ID NO: 3680811 - RNA, 16 nt, Salmonella enterica enterica serovar Typhi Ty2
ucagcaagaaguuccg

SEQ ID NO: 3680812 - RNA, 15 nt, Salmonella enterica enterica serovar Typhi Ty2
ucagcaauauuuugu

SEQ ID NO: 3680813 - RNA, 17 nt, Salmonella enterica enterica serovar Typhi Ty2
ucagcaauuaacaaaua

SEQ ID NO: 3680814 - RNA, 18 nt, Salmonella enterica enterica serovar Typhi Ty2
ucagcaauuaacaaauaa

SEQ ID NO: 3680815 - RNA, 20 nt, Salmonella enterica enterica serovar Typhi Ty2
ucagcaauuucucgcccgcc

SEQ ID NO: 3680816 - RNA, 16 nt, Salmonella enterica enterica serovar Typhi Ty2
ucagcacacuacacag

SEQ ID NO: 3680817 - RNA, 22 nt, Salmonella enterica enterica serovar Typhi Ty2
ucagcacaucagccguaucuuc

SEQ ID NO: 3680818 - RNA, 18 nt, Salmonella enterica enterica serovar Typhi Ty2
ucagcaccuccagcgccu

SEQ ID NO: 3680819 - RNA, 14 nt, Salmonella enterica enterica serovar Typhi Ty2
ucagcagcaccacu

SEQ ID NO: 3680820 - RNA, 18 nt, Salmonella enterica enterica serovar Typhi Ty2
ucagcagcaccgguuuuu

SEQ ID NO: 3680821 - RNA, 19 nt, Salmonella enterica enterica serovar Typhi Ty2
ucagcagccgggccagacg

SEQ ID NO: 3680822 - RNA, 16 nt, Salmonella enterica enterica serovar Typhi Ty2
ucagcagcgauagacu

SEQ ID NO: 3680823 - RNA, 19 nt, Salmonella enterica enterica serovar Typhi Ty2
ucagcaggauagcgaccag

SEQ ID NO: 3680824 - RNA, 21 nt, Salmonella enterica enterica serovar Typhi Ty2
ucagcauaauauccugcaccg

SEQ ID NO: 3680825 - RNA, 20 nt, Salmonella enterica enterica serovar Typhi Ty2
ucagcauauccagcgccugc

SEQ ID NO: 3680826 - RNA, 15 nt, Salmonella enterica enterica serovar Typhi Ty2
ucagcaucuccuggc

SEQ ID NO: 3680827 - RNA, 21 nt, Salmonella enterica enterica serovar Typhi Ty2
ucagcauguaccauugucaaa

SEQ ID NO: 3680828 - RNA, 19 nt, Salmonella enterica enterica serovar Typhi Ty2
ucagcauguuucuccugcc

SEQ ID NO: 3680829 - RNA, 23 nt, Salmonella enterica enterica serovar Typhi Ty2
ucagcauuacccccgccauaaug

SEQ ID NO: 3680830 - RNA, 18 nt, Salmonella enterica enterica serovar Typhi Ty2
ucagccaaacuccucacu

SEQ ID NO: 3680831 - RNA, 16 nt, Salmonella enterica enterica serovar Typhi Ty2
ucagccacgacgcuca

SEQ ID NO: 3680832 - RNA, 19 nt, Salmonella enterica enterica serovar Typhi Ty2
ucagccacgguucacggcc

SEQ ID NO: 3680833 - RNA, 18 nt, Salmonella enterica enterica serovar Typhi Ty2
ucagccacuucuuccagc

SEQ ID NO: 3680834 - RNA, 18 nt, Salmonella enterica enterica serovar Typhi Ty2
ucagccagcguaccagcg

SEQ ID NO: 3680835 - RNA, 23 nt, Salmonella enterica enterica serovar Typhi Ty2
ucagcccccaguuuuugaacaua

SEQ ID NO: 3680836 - RNA, 17 nt, Salmonella enterica enterica serovar Typhi Ty2
ucagcccgcaaaggacc

SEQ ID NO: 3680837 - RNA, 21 nt, Salmonella enterica enterica serovar Typhi Ty2
ucagcccuaucgcugcgcugc

SEQ ID NO: 3680838 - RNA, 18 nt, Salmonella enterica enterica serovar Typhi Ty2
ucagccgcgcauagcugg

SEQ ID NO: 3680839 - RNA, 22 nt, Salmonella enterica enterica serovar Typhi Ty2
ucagccugaaagauuauuuuau

SEQ ID NO: 3680840 - RNA, 13 nt, Salmonella enterica enterica serovar Typhi Ty2
ucagccugcuaca

SEQ ID NO: 3680841 - RNA, 18 nt, Salmonella enterica enterica serovar Typhi Ty2
ucagccugugcaaccagc

SEQ ID NO: 3680842 - RNA, 16 nt, Salmonella enterica enterica serovar Typhi Ty2
ucagccuuaaucaacu

SEQ ID NO: 3680843 - RNA, 14 nt, Salmonella enterica enterica serovar Typhi Ty2
ucagccuuuucaua

SEQ ID NO: 3680844 - RNA, 17 nt, Salmonella enterica enterica serovar Typhi Ty2
ucagcgaauaucucuau

SEQ ID NO: 3680845 - RNA, 20 nt, Salmonella enterica enterica serovar Typhi Ty2
ucagcgaccgucguguuacc

SEQ ID NO: 3680846 - RNA, 14 nt, Salmonella enterica enterica serovar Typhi Ty2
ucagcgaugacgcc

SEQ ID NO: 3680847 - RNA, 16 nt, Salmonella enterica enterica serovar Typhi Ty2
ucagcgauucaaacuc

SEQ ID NO: 3680848 - RNA, 15 nt, Salmonella enterica enterica serovar Typhi Ty2
ucagcgcauguuagc

SEQ ID NO: 3680849 - RNA, 14 nt, Salmonella enterica enterica serovar Typhi Ty2
ucagcgccaccaca

SEQ ID NO: 3680850 - RNA, 15 nt, Salmonella enterica enterica serovar Typhi Ty2
ucagcgccaccacaa

SEQ ID NO: 3680851 - RNA, 21 nt, Salmonella enterica enterica serovar Typhi Ty2
ucagcgccacgcccaacauaa

SEQ ID NO: 3680852 - RNA, 18 nt, Salmonella enterica enterica serovar Typhi Ty2
ucagcgccauugcuagga

SEQ ID NO: 3680853 - RNA, 13 nt, Salmonella enterica enterica serovar Typhi Ty2
ucagcgcgccaau

SEQ ID NO: 3680854 - RNA, 17 nt, Salmonella enterica enterica serovar Typhi Ty2
ucagcgcgccaauggcc

SEQ ID NO: 3680855 - RNA, 19 nt, Salmonella enterica enterica serovar Typhi Ty2
ucagcgcgccgcgcagcau

SEQ ID NO: 3680856 - RNA, 17 nt, Salmonella enterica enterica serovar Typhi Ty2
ucagcgcgcuccagacc

SEQ ID NO: 3680857 - RNA, 13 nt, Salmonella enterica enterica serovar Typhi Ty2
ucagcgcggcaag

SEQ ID NO: 3680858 - RNA, 19 nt, Salmonella enterica enterica serovar Typhi Ty2
ucagcgcggcagccggaac

SEQ ID NO: 3680859 - RNA, 22 nt, Salmonella enterica enterica serovar Typhi Ty2
ucagcgcguccuccaacgugca

SEQ ID NO: 3680860 - RNA, 20 nt, Salmonella enterica enterica serovar Typhi Ty2
ucagcgcguuuuccaucauc

SEQ ID NO: 3680861 - RNA, 18 nt, Salmonella enterica enterica serovar Typhi Ty2
ucagcgcuaccagcgcgg

SEQ ID NO: 3680862 - RNA, 15 nt, Salmonella enterica enterica serovar Typhi Ty2
ucagcggcagcucug

SEQ ID NO: 3680863 - RNA, 14 nt, Salmonella enterica enterica serovar Typhi Ty2
ucagcggccagggc

SEQ ID NO: 3680864 - RNA, 15 nt, Salmonella enterica enterica serovar Typhi Ty2
ucagcggccagggca

SEQ ID NO: 3680865 - RNA, 23 nt, Salmonella enterica enterica serovar Typhi Ty2
ucagcggcugacacucauccaga

SEQ ID NO: 3680866 - RNA, 13 nt, Salmonella enterica enterica serovar Typhi Ty2
ucagcgguuguuc

SEQ ID NO: 3680867 - RNA, 21 nt, Salmonella enterica enterica serovar Typhi Ty2
ucagcguaauuaagccgggua

SEQ ID NO: 3680868 - RNA, 16 nt, Salmonella enterica enterica serovar Typhi Ty2
ucagcguaccgaagaa

SEQ ID NO: 3680869 - RNA, 17 nt, Salmonella enterica enterica serovar Typhi Ty2
ucagcgucggugaagaa

SEQ ID NO: 3680870 - RNA, 15 nt, Salmonella enterica enterica serovar Typhi Ty2
ucagcgucuauagau

SEQ ID NO: 3680871 - RNA, 14 nt, Salmonella enterica enterica serovar Typhi Ty2
ucagcgucuuucuu

SEQ ID NO: 3680872 - RNA, 13 nt, Salmonella enterica enterica serovar Typhi Ty2
ucagcgugccggu

SEQ ID NO: 3680873 - RNA, 18 nt, Salmonella enterica enterica serovar Typhi Ty2
ucagcguugucccgccuu

SEQ ID NO: 3680874 - RNA, 17 nt, Salmonella enterica enterica serovar Typhi Ty2
ucagcucacgcgccagc

SEQ ID NO: 3680875 - RNA, 22 nt, Salmonella enterica enterica serovar Typhi Ty2
ucagcuccucgcgaaucucaau

SEQ ID NO: 3680876 - RNA, 22 nt, Salmonella enterica enterica serovar Typhi Ty2
ucagcuccuuucggacuuccug

SEQ ID NO: 3680877 - RNA, 18 nt, Salmonella enterica enterica serovar Typhi Ty2
ucagcucgcaggccauaa

SEQ ID NO: 3680878 - RNA, 13 nt, Salmonella enterica enterica serovar Typhi Ty2
ucagcucgcugcc

SEQ ID NO: 3680879 - RNA, 13 nt, Salmonella enterica enterica serovar Typhi Ty2
ucagcucuucaau

SEQ ID NO: 3680880 - RNA, 19 nt, Salmonella enterica enterica serovar Typhi Ty2
ucagcugaacagucccacc

SEQ ID NO: 3680881 - RNA, 20 nt, Salmonella enterica enterica serovar Typhi Ty2
ucagcugaacagucccacca

SEQ ID NO: 3680882 - RNA, 18 nt, Salmonella enterica enterica serovar Typhi Ty2
ucagcugacaaugugccg

SEQ ID NO: 3680883 - RNA, 13 nt, Salmonella enterica enterica serovar Typhi Ty2
ucaggaaaacaaa

SEQ ID NO: 3680884 - RNA, 14 nt, Salmonella enterica enterica serovar Typhi Ty2
ucaggaaccacauc

SEQ ID NO: 3680885 - RNA, 18 nt, Salmonella enterica enterica serovar Typhi Ty2
ucaggaaccacauccacc

SEQ ID NO: 3680886 - RNA, 23 nt, Salmonella enterica enterica serovar Typhi Ty2
ucaggaacgcggcgccgaagcag

SEQ ID NO: 3680887 - RNA, 18 nt, Salmonella enterica enterica serovar Typhi Ty2
ucaggaagcccugaaacu

SEQ ID NO: 3680888 - RNA, 23 nt, Salmonella enterica enterica serovar Typhi Ty2
ucaggaauaacaucguaaaucaa

SEQ ID NO: 3680889 - RNA, 15 nt, Salmonella enterica enterica serovar Typhi Ty2
ucaggaaugccacga

SEQ ID NO: 3680890 - RNA, 22 nt, Salmonella enterica enterica serovar Typhi Ty2
ucaggaauuuaucaacaaauuc

SEQ ID NO: 3680891 - RNA, 13 nt, Salmonella enterica enterica serovar Typhi Ty2
ucaggacaucaaa

SEQ ID NO: 3680892 - RNA, 21 nt, Salmonella enterica enterica serovar Typhi Ty2
ucaggacuagcgcgauuuucu

SEQ ID NO: 3680893 - RNA, 19 nt, Salmonella enterica enterica serovar Typhi Ty2
ucaggagcaugguccggug

SEQ ID NO: 3680894 - RNA, 16 nt, Salmonella enterica enterica serovar Typhi Ty2
ucaggaggccugaaua

SEQ ID NO: 3680895 - RNA, 18 nt, Salmonella enterica enterica serovar Typhi Ty2
ucaggauaaaauccugca

SEQ ID NO: 3680896 - RNA, 14 nt, Salmonella enterica enterica serovar Typhi Ty2
ucaggauauucgcc

SEQ ID NO: 3680897 - RNA, 18 nt, Salmonella enterica enterica serovar Typhi Ty2
ucaggaucaaaaucgcgc

SEQ ID NO: 3680898 - RNA, 22 nt, Salmonella enterica enterica serovar Typhi Ty2
ucaggaugcugauuaaugauuu

SEQ ID NO: 3680899 - RNA, 17 nt, Salmonella enterica enterica serovar Typhi Ty2
ucaggcaaaaaaaaacc

SEQ ID NO: 3680900 - RNA, 17 nt, Salmonella enterica enterica serovar Typhi Ty2
ucaggcaauaaacauca

SEQ ID NO: 3680901 - RNA, 20 nt, Salmonella enterica enterica serovar Typhi Ty2
ucaggcaauaaacaucagcc

SEQ ID NO: 3680902 - RNA, 22 nt, Salmonella enterica enterica serovar Typhi Ty2
ucaggcaauaaacaucagccau

SEQ ID NO: 3680903 - RNA, 22 nt, Salmonella enterica enterica serovar Typhi Ty2
ucauaaauguacugcaauaacc

SEQ ID NO: 3680904 - RNA, 17 nt, Salmonella enterica enterica serovar Typhi Ty2
ucauaacgaccaaacaa

SEQ ID NO: 3680905 - RNA, 21 nt, Salmonella enterica enterica serovar Typhi Ty2
ucauaacgccgaugccgccga

SEQ ID NO: 3680906 - RNA, 13 nt, Salmonella enterica enterica serovar Typhi Ty2
ucauaaucaacgu

SEQ ID NO: 3680907 - RNA, 23 nt, Salmonella enterica enterica serovar Typhi Ty2
ucauaaucgcgauacugccgccc

SEQ ID NO: 3680908 - RNA, 12 nt, Salmonella enterica enterica serovar Typhi Ty2
ucauaaugccca

SEQ ID NO: 3680909 - RNA, 20 nt, Salmonella enterica enterica serovar Typhi Ty2
ucauaaugucccugccacgc

SEQ ID NO: 3680910 - RNA, 15 nt, Salmonella enterica enterica serovar Typhi Ty2
ucauaauuaaaaagg

SEQ ID NO: 3680911 - RNA, 13 nt, Salmonella enterica enterica serovar Typhi Ty2
ucauacccuucca

SEQ ID NO: 3680912 - RNA, 14 nt, Salmonella enterica enterica serovar Typhi Ty2
ucauacuauuuccu

SEQ ID NO: 3680913 - RNA, 20 nt, Salmonella enterica enterica serovar Typhi Ty2
ucauagacgcgguuaucucu

SEQ ID NO: 3680914 - RNA, 22 nt, Salmonella enterica enterica serovar Typhi Ty2
ucauagacugcgcuuaacgcuu

SEQ ID NO: 3680915 - RNA, 16 nt, Salmonella enterica enterica serovar Typhi Ty2
ucauagccgacccgca

SEQ ID NO: 3680916 - RNA, 18 nt, Salmonella enterica enterica serovar Typhi Ty2
ucauagccgacccgcauc

SEQ ID NO: 3680917 - RNA, 22 nt, Salmonella enterica enterica serovar Typhi Ty2
ucauagccgacccgcaucgccg

SEQ ID NO: 3680918 - RNA, 20 nt, Salmonella enterica enterica serovar Typhi Ty2
ucauagccgcuuuccgccgc

SEQ ID NO: 3680919 - RNA, 22 nt, Salmonella enterica enterica serovar Typhi Ty2
ucauagcgccccaguaacgugc

SEQ ID NO: 3680920 - RNA, 22 nt, Salmonella enterica enterica serovar Typhi Ty2
ucauagcggcuaccgcguaaug

SEQ ID NO: 3680921 - RNA, 20 nt, Salmonella enterica enterica serovar Typhi Ty2
ucauaggacugaucccacuu

SEQ ID NO: 3680922 - RNA, 15 nt, Salmonella enterica enterica serovar Typhi Ty2
ucauaggugaacaug

SEQ ID NO: 3680923 - RNA, 16 nt, Salmonella enterica enterica serovar Typhi Ty2
ucauaguuuuccagcc

SEQ ID NO: 3680924 - RNA, 21 nt, Salmonella enterica enterica serovar Typhi Ty2
ucauaucccggcugacauaau

SEQ ID NO: 3680925 - RNA, 21 nt, Salmonella enterica enterica serovar Typhi Ty2
ucauauggaagcuguuaauuu

SEQ ID NO: 3680926 - RNA, 15 nt, Salmonella enterica enterica serovar Typhi Ty2
ucauaugugccgaug

SEQ ID NO: 3680927 - RNA, 18 nt, Salmonella enterica enterica serovar Typhi Ty2
ucauaugugccgauggcg

SEQ ID NO: 3680928 - RNA, 19 nt, Salmonella enterica enterica serovar Typhi Ty2
ucauauuacauagaaaaua

SEQ ID NO: 3680929 - RNA, 20 nt, Salmonella enterica enterica serovar Typhi Ty2
ucauauuacauagaaaauau

SEQ ID NO: 3680930 - RNA, 13 nt, Salmonella enterica enterica serovar Typhi Ty2
ucauauuccagcc

SEQ ID NO: 3680931 - RNA, 17 nt, Salmonella enterica enterica serovar Typhi Ty2
ucauauugcccaucgcg

SEQ ID NO: 3680932 - RNA, 13 nt, Salmonella enterica enterica serovar Typhi Ty2
ucaucaaaaaggc

SEQ ID NO: 3680933 - RNA, 20 nt, Salmonella enterica enterica serovar Typhi Ty2
ucaucaaaaucaucgccacg

SEQ ID NO: 3680934 - RNA, 15 nt, Salmonella enterica enterica serovar Typhi Ty2
ucaucaaacgauacc

SEQ ID NO: 3680935 - RNA, 13 nt, Salmonella enterica enterica serovar Typhi Ty2
ucaucaaauuauc

SEQ ID NO: 3680936 - RNA, 14 nt, Salmonella enterica enterica serovar Typhi Ty2
ucaucaaccaugau

SEQ ID NO: 3680937 - RNA, 20 nt, Salmonella enterica enterica serovar Typhi Ty2
ucaucaaccaugaucaccau

SEQ ID NO: 3680938 - RNA, 21 nt, Salmonella enterica enterica serovar Typhi Ty2
ucaucaauggauuuauggcac

SEQ ID NO: 3680939 - RNA, 16 nt, Salmonella enterica enterica serovar Typhi Ty2
ucaucaccagcagcag

SEQ ID NO: 3680940 - RNA, 13 nt, Salmonella enterica enterica serovar Typhi Ty2
ucaucacccaguc

SEQ ID NO: 3680941 - RNA, 20 nt, Salmonella enterica enterica serovar Typhi Ty2
ucaucagaccgagacccagc

SEQ ID NO: 3680942 - RNA, 21 nt, Salmonella enterica enterica serovar Typhi Ty2
ucaucagaccgugaauaagau

SEQ ID NO: 3680943 - RNA, 18 nt, Salmonella enterica enterica serovar Typhi Ty2
ucaucagaucaugaggau

SEQ ID NO: 3680944 - RNA, 10 nt, Salmonella enterica enterica serovar Typhi Ty2
ucaucagcac

SEQ ID NO: 3680945 - RNA, 15 nt, Salmonella enterica enterica serovar Typhi Ty2
ucaucagcacaaaau

SEQ ID NO: 3680946 - RNA, 19 nt, Salmonella enterica enterica serovar Typhi Ty2
ucaucagcacaaaauccca

SEQ ID NO: 3680947 - RNA, 22 nt, Salmonella enterica enterica serovar Typhi Ty2
ucaucagccguuacuuccccca

SEQ ID NO: 3680948 - RNA, 13 nt, Salmonella enterica enterica serovar Typhi Ty2
ucaucagcgccau

SEQ ID NO: 3680949 - RNA, 15 nt, Salmonella enterica enterica serovar Typhi Ty2
ucaucaggcaauaaa

SEQ ID NO: 3680950 - RNA, 19 nt, Salmonella enterica enterica serovar Typhi Ty2
ucaucaggcaauaaacauc

SEQ ID NO: 3680951 - RNA, 21 nt, Salmonella enterica enterica serovar Typhi Ty2
ucaucaggccugcaaaccucu

SEQ ID NO: 3680952 - RNA, 15 nt, Salmonella enterica enterica serovar Typhi Ty2
ucaucaggccugggc

SEQ ID NO: 3680953 - RNA, 14 nt, Salmonella enterica enterica serovar Typhi Ty2
ucaucaggcgugcc

SEQ ID NO: 3680954 - RNA, 21 nt, Salmonella enterica enterica serovar Typhi Ty2
ucaucagggcguaagcgcguu

SEQ ID NO: 3680955 - RNA, 16 nt, Salmonella enterica enterica serovar Typhi Ty2
ucaucaguaacacccg

SEQ ID NO: 3680956 - RNA, 13 nt, Salmonella enterica enterica serovar Typhi Ty2
ucaucaguaacug

SEQ ID NO: 3680957 - RNA, 14 nt, Salmonella enterica enterica serovar Typhi Ty2
ucaucaguaacuga

SEQ ID NO: 3680958 - RNA, 15 nt, Salmonella enterica enterica serovar Typhi Ty2
ucaucaguuuaaccg

SEQ ID NO: 3680959 - RNA, 14 nt, Salmonella enterica enterica serovar Typhi Ty2
ucaucauaauucag

SEQ ID NO: 3680960 - RNA, 18 nt, Salmonella enterica enterica serovar Typhi Ty2
ucaucaucggcacagcca

SEQ ID NO: 3680961 - RNA, 21 nt, Salmonella enterica enterica serovar Typhi Ty2
ucaucaucucugucgaccauc

SEQ ID NO: 3680962 - RNA, 15 nt, Salmonella enterica enterica serovar Typhi Ty2
ucaucaugcugcuga

SEQ ID NO: 3680963 - RNA, 22 nt, Salmonella enterica enterica serovar Typhi Ty2
ucaucaugcugcugauccuguu

SEQ ID NO: 3680964 - RNA, 19 nt, Salmonella enterica enterica serovar Typhi Ty2
ucaucauggacagauuucc

SEQ ID NO: 3680965 - RNA, 17 nt, Salmonella enterica enterica serovar Typhi Ty2
ucaucauuaccuuuucc

SEQ ID NO: 3680966 - RNA, 19 nt, Salmonella enterica enterica serovar Typhi Ty2
ucaucauugcgccaagacc

SEQ ID NO: 3680967 - RNA, 18 nt, Salmonella enterica enterica serovar Typhi Ty2
ucauccaacugcgccuga

SEQ ID NO: 3680968 - RNA, 15 nt, Salmonella enterica enterica serovar Typhi Ty2
ucauccaccuuaucc

SEQ ID NO: 3680969 - RNA, 14 nt, Salmonella enterica enterica serovar Typhi Ty2
ucauccagaaaaug

SEQ ID NO: 3680970 - RNA, 11 nt, Salmonella enterica enterica serovar Typhi Ty2
ucauccagcaa

SEQ ID NO: 3680971 - RNA, 24 nt, Salmonella enterica enterica serovar Typhi Ty2
ucauccagcgaaccuuccaucgca

SEQ ID NO: 3680972 - RNA, 20 nt, Salmonella enterica enterica serovar Typhi Ty2
ucauccagucagcaauuaac

SEQ ID NO: 3680973 - RNA, 17 nt, Salmonella enterica enterica serovar Typhi Ty2
ucaucccacgucgccuu

SEQ ID NO: 3680974 - RNA, 17 nt, Salmonella enterica enterica serovar Typhi Ty2
ucauccccagcaucaug

SEQ ID NO: 3680975 - RNA, 21 nt, Salmonella enterica enterica serovar Typhi Ty2
ucaucccgcccagcaacacag

SEQ ID NO: 3680976 - RNA, 21 nt, Salmonella enterica enterica serovar Typhi Ty2
ucaucccgcgccaauaacgca

SEQ ID NO: 3680977 - RNA, 16 nt, Salmonella enterica enterica serovar Typhi Ty2
ucauccgaccacggcc

SEQ ID NO: 3680978 - RNA, 19 nt, Salmonella enterica enterica serovar Typhi Ty2
ucauccgcccggcaucaag

SEQ ID NO: 3680979 - RNA, 21 nt, Salmonella enterica enterica serovar Typhi Ty2
ucauccggcguugcgccgcca

SEQ ID NO: 3680980 - RNA, 17 nt, Salmonella enterica enterica serovar Typhi Ty2
ucauccgggcauaaaaa

SEQ ID NO: 3680981 - RNA, 18 nt, Salmonella enterica enterica serovar Typhi Ty2
ucauccggguuaaaccag

SEQ ID NO: 3680982 - RNA, 19 nt, Salmonella enterica enterica serovar Typhi Ty2
ucauccggguuaaaccagc

SEQ ID NO: 3680983 - RNA, 23 nt, Salmonella enterica enterica serovar Typhi Ty2
ucauccugacaggccggauuagc

SEQ ID NO: 3680984 - RNA, 22 nt, Salmonella enterica enterica serovar Typhi Ty2
ucauccuuacuucgauggccuc

SEQ ID NO: 3680985 - RNA, 17 nt, Salmonella enterica enterica serovar Typhi Ty2
ucauucgucaaauucac

SEQ ID NO: 3680986 - RNA, 22 nt, Salmonella enterica enterica serovar Typhi Ty2
ucauucuccgggauagcaaucu

SEQ ID NO: 3680987 - RNA, 20 nt, Salmonella enterica enterica serovar Typhi Ty2
ucauugacccucccugcgcu

SEQ ID NO: 3680988 - RNA, 21 nt, Salmonella enterica enterica serovar Typhi Ty2
ucauugaugaugaagcugcag

SEQ ID NO: 3680989 - RNA, 18 nt, Salmonella enterica enterica serovar Typhi Ty2
ucauugcgaucuccuuua

SEQ ID NO: 3680990 - RNA, 20 nt, Salmonella enterica enterica serovar Typhi Ty2
ucauugcgccagcuuucggc

SEQ ID NO: 3680991 - RNA, 19 nt, Salmonella enterica enterica serovar Typhi Ty2
ucauugcgcuaaaauccac

SEQ ID NO: 3680992 - RNA, 16 nt, Salmonella enterica enterica serovar Typhi Ty2
ucauugcguucaggcg

SEQ ID NO: 3680993 - RNA, 20 nt, Salmonella enterica enterica serovar Typhi Ty2
ucauuggaagagacacgcug

SEQ ID NO: 3680994 - RNA, 19 nt, Salmonella enterica enterica serovar Typhi Ty2
ucauugucggaacgcugua

SEQ ID NO: 3680995 - RNA, 18 nt, Salmonella enterica enterica serovar Typhi Ty2
ucauuguguacauccaga

SEQ ID NO: 3680996 - RNA, 22 nt, Salmonella enterica enterica serovar Typhi Ty2
ucauuuaccagugcuaaaauua

SEQ ID NO: 3680997 - RNA, 18 nt, Salmonella enterica enterica serovar Typhi Ty2
ucauuucugccugcuuca

SEQ ID NO: 3680998 - RNA, 13 nt, Salmonella enterica enterica serovar Typhi Ty2
ucauuucuuuaau

SEQ ID NO: 3680999 - RNA, 18 nt, Salmonella enterica enterica serovar Typhi Ty2
ucauuuuaucgauaauau

SEQ ID NO: 3681000 - RNA, 21 nt, Salmonella enterica enterica serovar Typhi Ty2
ucauuuucaugauauucuguc

SEQ ID NO: 3681001 - RNA, 20 nt, Salmonella enterica enterica serovar Typhi Ty2
uccaaaacgaacaggccgcc

SEQ ID NO: 3681002 - RNA, 12 nt, Salmonella enterica enterica serovar Typhi Ty2
uccaaaauaaua

SEQ ID NO: 3681003 - RNA, 23 nt, Salmonella enterica enterica serovar Typhi Ty2
uccaaacuggcugugccaauaac

SEQ ID NO: 3681004 - RNA, 15 nt, Salmonella enterica enterica serovar Typhi Ty2
uccaacagcgacgcc

SEQ ID NO: 3681005 - RNA, 17 nt, Salmonella enterica enterica serovar Typhi Ty2
uccaacuggcuuucauc

SEQ ID NO: 3681006 - RNA, 16 nt, Salmonella enterica enterica serovar Typhi Ty2
uccaacuguacgccac

SEQ ID NO: 3681007 - RNA, 15 nt, Salmonella enterica enterica serovar Typhi Ty2
uccaauaaacgccag

SEQ ID NO: 3681008 - RNA, 16 nt, Salmonella enterica enterica serovar Typhi Ty2
uccaauaauggagaug

SEQ ID NO: 3681009 - RNA, 20 nt, Salmonella enterica enterica serovar Typhi Ty2
uccaauauuuauuuaauguu

SEQ ID NO: 3681010 - RNA, 19 nt, Salmonella enterica enterica serovar Typhi Ty2
uccaaucucuuuugcggcg

SEQ ID NO: 3681011 - RNA, 21 nt, Salmonella enterica enterica serovar Typhi Ty2
uccacaaacuccagacgauga

SEQ ID NO: 3681012 - RNA, 20 nt, Salmonella enterica enterica serovar Typhi Ty2
uccacaaauagcauggcgug

SEQ ID NO: 3681013 - RNA, 13 nt, Salmonella enterica enterica serovar Typhi Ty2
uccacaaccggcu

SEQ ID NO: 3681014 - RNA, 13 nt, Salmonella enterica enterica serovar Typhi Ty2
uccacaaucaauu

SEQ ID NO: 3681015 - RNA, 17 nt, Salmonella enterica enterica serovar Typhi Ty2
uccacaccggcgcauac

SEQ ID NO: 3681016 - RNA, 13 nt, Salmonella enterica enterica serovar Typhi Ty2
uccacaccguuac

SEQ ID NO: 3681017 - RNA, 21 nt, Salmonella enterica enterica serovar Typhi Ty2
uccacaccguuacgaccccau

SEQ ID NO: 3681018 - RNA, 15 nt, Salmonella enterica enterica serovar Typhi Ty2
uccacagauagucgc

SEQ ID NO: 3681019 - RNA, 16 nt, Salmonella enterica enterica serovar Typhi Ty2
uccacagcgaauuccg

SEQ ID NO: 3681020 - RNA, 20 nt, Salmonella enterica enterica serovar Typhi Ty2
uccacagguuaucgccgccc

SEQ ID NO: 3681021 - RNA, 15 nt, Salmonella enterica enterica serovar Typhi Ty2
uccacauaaaguagc

SEQ ID NO: 3681022 - RNA, 13 nt, Salmonella enterica enterica serovar Typhi Ty2
uccacauccagcg

SEQ ID NO: 3681023 - RNA, 18 nt, Salmonella enterica enterica serovar Typhi Ty2
uccacauccagcgccagc

SEQ ID NO: 3681024 - RNA, 14 nt, Salmonella enterica enterica serovar Typhi Ty2
uccacauuccagac

SEQ ID NO: 3681025 - RNA, 19 nt, Salmonella enterica enterica serovar Typhi Ty2
uccacauucguaacaugcu

SEQ ID NO: 3681026 - RNA, 16 nt, Salmonella enterica enterica serovar Typhi Ty2
uccaccaaccaggcaa

SEQ ID NO: 3681027 - RNA, 12 nt, Salmonella enterica enterica serovar Typhi Ty2
uccaccagaacc

SEQ ID NO: 3681028 - RNA, 13 nt, Salmonella enterica enterica serovar Typhi Ty2
uccaccagcccau

SEQ ID NO: 3681029 - RNA, 13 nt, Salmonella enterica enterica serovar Typhi Ty2
uccaccagcgcca

SEQ ID NO: 3681030 - RNA, 16 nt, Salmonella enterica enterica serovar Typhi Ty2
uccaccagcuuaucug

SEQ ID NO: 3681031 - RNA, 18 nt, Salmonella enterica enterica serovar Typhi Ty2
uccaccaggcaugcagcu

SEQ ID NO: 3681032 - RNA, 14 nt, Salmonella enterica enterica serovar Typhi Ty2
uccacccaguucau

SEQ ID NO: 3681033 - RNA, 12 nt, Salmonella enterica enterica serovar Typhi Ty2
uccaccgccaga

SEQ ID NO: 3681034 - RNA, 19 nt, Salmonella enterica enterica serovar Typhi Ty2
uccaccgccagacgcccca

SEQ ID NO: 3681035 - RNA, 15 nt, Salmonella enterica enterica serovar Typhi Ty2
uccaccuaugcggau

SEQ ID NO: 3681036 - RNA, 15 nt, Salmonella enterica enterica serovar Typhi Ty2
uccaccucuucugca

SEQ ID NO: 3681037 - RNA, 18 nt, Salmonella enterica enterica serovar Typhi Ty2
uccaccuggcccugcauc

SEQ ID NO: 3681038 - RNA, 19 nt, Salmonella enterica enterica serovar Typhi Ty2
uccaccuucucuuuaugcg

SEQ ID NO: 3681039 - RNA, 20 nt, Salmonella enterica enterica serovar Typhi Ty2
uccacgcuauaaaguagcca

SEQ ID NO: 3681040 - RNA, 21 nt, Salmonella enterica enterica serovar Typhi Ty2
uccacggcgcuccugucaggc

SEQ ID NO: 3681041 - RNA, 11 nt, Salmonella enterica enterica serovar Typhi Ty2
uccacggcgug

SEQ ID NO: 3681042 - RNA, 10 nt, Salmonella enterica enterica serovar Typhi Ty2
uccacgguuc

SEQ ID NO: 3681043 - RNA, 21 nt, Salmonella enterica enterica serovar Typhi Ty2
uccacgucauaacgcgcauuc

SEQ ID NO: 3681044 - RNA, 19 nt, Salmonella enterica enterica serovar Typhi Ty2
uccacgucgcacgccauca

SEQ ID NO: 3681045 - RNA, 15 nt, Salmonella enterica enterica serovar Typhi Ty2
uccacucacccggca

SEQ ID NO: 3681046 - RNA, 20 nt, Salmonella enterica enterica serovar Typhi Ty2
uccacugagcuucaccgcca

SEQ ID NO: 3681047 - RNA, 15 nt, Salmonella enterica enterica serovar Typhi Ty2
uccacugguuguccg

SEQ ID NO: 3681048 - RNA, 17 nt, Salmonella enterica enterica serovar Typhi Ty2
uccacuuucagcggcuu

SEQ ID NO: 3681049 - RNA, 21 nt, Salmonella enterica enterica serovar Typhi Ty2
uccacuuucucggcuuuccag

SEQ ID NO: 3681050 - RNA, 23 nt, Salmonella enterica enterica serovar Typhi Ty2
uccacuuucucggcuuuccagcu

SEQ ID NO: 3681051 - RNA, 24 nt, Salmonella enterica enterica serovar Typhi Ty2
uccagaacgaauuuacucgccaau

SEQ ID NO: 3681052 - RNA, 19 nt, Salmonella enterica enterica serovar Typhi Ty2
uccagaacugcgaaaucac

SEQ ID NO: 3681053 - RNA, 12 nt, Salmonella enterica enterica serovar Typhi Ty2
uccagaagaucu

SEQ ID NO: 3681054 - RNA, 20 nt, Salmonella enterica enterica serovar Typhi Ty2
uccagaauguuccugcaaua

SEQ ID NO: 3681055 - RNA, 18 nt, Salmonella enterica enterica serovar Typhi Ty2
uccagacaggacgccagc

SEQ ID NO: 3681056 - RNA, 22 nt, Salmonella enterica enterica serovar Typhi Ty2
uccagaccaaacaugcggcuuu

SEQ ID NO: 3681057 - RNA, 14 nt, Salmonella enterica enterica serovar Typhi Ty2
uccagaccaagauc

SEQ ID NO: 3681058 - RNA, 14 nt, Salmonella enterica enterica serovar Typhi Ty2
uccagaccaccagc

SEQ ID NO: 3681059 - RNA, 21 nt, Salmonella enterica enterica serovar Typhi Ty2
uccagacccagacggcgauac

SEQ ID NO: 3681060 - RNA, 19 nt, Salmonella enterica enterica serovar Typhi Ty2
uccagacggcgcuguuguu

SEQ ID NO: 3681061 - RNA, 15 nt, Salmonella enterica enterica serovar Typhi Ty2
uccagacguugcucu

SEQ ID NO: 3681062 - RNA, 12 nt, Salmonella enterica enterica serovar Typhi Ty2
uccagacuacgg

SEQ ID NO: 3681063 - RNA, 17 nt, Salmonella enterica enterica serovar Typhi Ty2
uccagaggcauuauugc

SEQ ID NO: 3681064 - RNA, 15 nt, Salmonella enterica enterica serovar Typhi Ty2
uccagaggcguugcc

SEQ ID NO: 3681065 - RNA, 18 nt, Salmonella enterica enterica serovar Typhi Ty2
uccagaguacauucucuu

SEQ ID NO: 3681066 - RNA, 15 nt, Salmonella enterica enterica serovar Typhi Ty2
uccagauaauccagc

SEQ ID NO: 3681067 - RNA, 14 nt, Salmonella enterica enterica serovar Typhi Ty2
uccaguucauaagu

SEQ ID NO: 3681068 - RNA, 18 nt, Salmonella enterica enterica serovar Typhi Ty2
uccaguucauaagucauc

SEQ ID NO: 3681069 - RNA, 22 nt, Salmonella enterica enterica serovar Typhi Ty2
uccaguucaucuacacgcacuu

SEQ ID NO: 3681070 - RNA, 14 nt, Salmonella enterica enterica serovar Typhi Ty2
uccaguugcauaca

SEQ ID NO: 3681071 - RNA, 16 nt, Salmonella enterica enterica serovar Typhi Ty2
uccaguugcauacaua

SEQ ID NO: 3681072 - RNA, 17 nt, Salmonella enterica enterica serovar Typhi Ty2
uccaguugcccucuuua

SEQ ID NO: 3681073 - RNA, 19 nt, Salmonella enterica enterica serovar Typhi Ty2
uccaguugcggcaucagau

SEQ ID NO: 3681074 - RNA, 13 nt, Salmonella enterica enterica serovar Typhi Ty2
uccaguuuuuucc

SEQ ID NO: 3681075 - RNA, 14 nt, Salmonella enterica enterica serovar Typhi Ty2
uccauaaauaacau

SEQ ID NO: 3681076 - RNA, 16 nt, Salmonella enterica enterica serovar Typhi Ty2
uccauaaauaacauuu

SEQ ID NO: 3681077 - RNA, 19 nt, Salmonella enterica enterica serovar Typhi Ty2
uccauaaauaacauuucag

SEQ ID NO: 3681078 - RNA, 20 nt, Salmonella enterica enterica serovar Typhi Ty2
uccauacacugcauaaauau

SEQ ID NO: 3681079 - RNA, 13 nt, Salmonella enterica enterica serovar Typhi Ty2
uccauacauccau

SEQ ID NO: 3681080 - RNA, 22 nt, Salmonella enterica enterica serovar Typhi Ty2
uccauaccggacuccaggcaac

SEQ ID NO: 3681081 - RNA, 23 nt, Salmonella enterica enterica serovar Typhi Ty2
uccauaccguuucaacugccccu

SEQ ID NO: 3681082 - RNA, 12 nt, Salmonella enterica enterica serovar Typhi Ty2
uccauauuuauc

SEQ ID NO: 3681083 - RNA, 19 nt, Salmonella enterica enterica serovar Typhi Ty2
uccaucacgguaaaccugu

SEQ ID NO: 3681084 - RNA, 13 nt, Salmonella enterica enterica serovar Typhi Ty2
uccaucacuccuu

SEQ ID NO: 3681085 - RNA, 14 nt, Salmonella enterica enterica serovar Typhi Ty2
uccaucagccaggc

SEQ ID NO: 3681086 - RNA, 13 nt, Salmonella enterica enterica serovar Typhi Ty2
uccaucagcgcgg

SEQ ID NO: 3681087 - RNA, 14 nt, Salmonella enterica enterica serovar Typhi Ty2
uccaucccccugcc

SEQ ID NO: 3681088 - RNA, 14 nt, Salmonella enterica enterica serovar Typhi Ty2
uccaucgaauaaag

SEQ ID NO: 3681089 - RNA, 22 nt, Salmonella enterica enterica serovar Typhi Ty2
uccaucggcccacgcgcagaga

SEQ ID NO: 3681090 - RNA, 15 nt, Salmonella enterica enterica serovar Typhi Ty2
uccaucgguucucug

SEQ ID NO: 3681091 - RNA, 17 nt, Salmonella enterica enterica serovar Typhi Ty2
uccaucgguucucugcc

SEQ ID NO: 3681092 - RNA, 17 nt, Salmonella enterica enterica serovar Typhi Ty2
uccaugagaagaaaaag

SEQ ID NO: 3681093 - RNA, 21 nt, Salmonella enterica enterica serovar Typhi Ty2
uccaugaugaagauauucacu

SEQ ID NO: 3681094 - RNA, 13 nt, Salmonella enterica enterica serovar Typhi Ty2
uccaugcccacac

SEQ ID NO: 3681095 - RNA, 13 nt, Salmonella enterica enterica serovar Typhi Ty2
uccaugccggcuu

SEQ ID NO: 3681096 - RNA, 21 nt, Salmonella enterica enterica serovar Typhi Ty2
uccaugccggcuuuccgcacc

SEQ ID NO: 3681097 - RNA, 17 nt, Salmonella enterica enterica serovar Typhi Ty2
uccaugccuuuggccug

SEQ ID NO: 3681098 - RNA, 22 nt, Salmonella enterica enterica serovar Typhi Ty2
uccaugcgauacguaggccuga

SEQ ID NO: 3681099 - RNA, 14 nt, Salmonella enterica enterica serovar Typhi Ty2
uccauggcaaaauu

SEQ ID NO: 3681100 - RNA, 20 nt, Salmonella enterica enterica serovar Typhi Ty2
uccauggcaaaauucguauu

SEQ ID NO: 3681101 - RNA, 23 nt, Salmonella enterica enterica serovar Typhi Ty2
uccauggucagacgcucagccuu

SEQ ID NO: 3681102 - RNA, 21 nt, Salmonella enterica enterica serovar Typhi Ty2
uccauuaaaugcgccagcggc

SEQ ID NO: 3681103 - RNA, 20 nt, Salmonella enterica enterica serovar Typhi Ty2
uccauuaaauuacuuguuga

SEQ ID NO: 3681104 - RNA, 20 nt, Salmonella enterica enterica serovar Typhi Ty2
uccauuaagucgaugaauga

SEQ ID NO: 3681105 - RNA, 19 nt, Salmonella enterica enterica serovar Typhi Ty2
uccauuacucucauguuca

SEQ ID NO: 3681106 - RNA, 16 nt, Salmonella enterica enterica serovar Typhi Ty2
uccauuagcgccugau

SEQ ID NO: 3681107 - RNA, 16 nt, Salmonella enterica enterica serovar Typhi Ty2
uccauuccagaacgaa

SEQ ID NO: 3681108 - RNA, 22 nt, Salmonella enterica enterica serovar Typhi Ty2
uccauucucaucagaccgugaa

SEQ ID NO: 3681109 - RNA, 16 nt, Salmonella enterica enterica serovar Typhi Ty2
uccauugcgagaaaaa

SEQ ID NO: 3681110 - RNA, 18 nt, Salmonella enterica enterica serovar Typhi Ty2
uccauugcgagaaaaaac

SEQ ID NO: 3681111 - RNA, 17 nt, Salmonella enterica enterica serovar Typhi Ty2
uccauuuuaaauacacc

SEQ ID NO: 3681112 - RNA, 18 nt, Salmonella enterica enterica serovar Typhi Ty2
uccauuuuggggaaaaua

SEQ ID NO: 3681113 - RNA, 20 nt, Salmonella enterica enterica serovar Typhi Ty2
uccauuuuucagauaacgaa

SEQ ID NO: 3681114 - RNA, 17 nt, Salmonella enterica enterica serovar Typhi Ty2
uccauuuuuuaucugac

SEQ ID NO: 3681115 - RNA, 20 nt, Salmonella enterica enterica serovar Typhi Ty2
ucccaaccaguaugaccguu

SEQ ID NO: 3681116 - RNA, 18 nt, Salmonella enterica enterica serovar Typhi Ty2
ucccaacccgaccaggac

SEQ ID NO: 3681117 - RNA, 16 nt, Salmonella enterica enterica serovar Typhi Ty2
ucccaauaccggcgua

SEQ ID NO: 3681118 - RNA, 17 nt, Salmonella enterica enterica serovar Typhi Ty2
ucccaaugcggaaacca

SEQ ID NO: 3681119 - RNA, 13 nt, Salmonella enterica enterica serovar Typhi Ty2
ucccaauucgugu

SEQ ID NO: 3681120 - RNA, 14 nt, Salmonella enterica enterica serovar Typhi Ty2
ucccacaccacacg

SEQ ID NO: 3681121 - RNA, 22 nt, Salmonella enterica enterica serovar Typhi Ty2
ucccacaccacacgcuuauccu

SEQ ID NO: 3681122 - RNA, 13 nt, Salmonella enterica enterica serovar Typhi Ty2
ucccaccacgcag

SEQ ID NO: 3681123 - RNA, 13 nt, Salmonella enterica enterica serovar Typhi Ty2
ucccaccgggcca

SEQ ID NO: 3681124 - RNA, 14 nt, Salmonella enterica enterica serovar Typhi Ty2
ucccacgacauguu

SEQ ID NO: 3681125 - RNA, 17 nt, Salmonella enterica enterica serovar Typhi Ty2
ucccacgggcgcaccau

SEQ ID NO: 3681126 - RNA, 14 nt, Salmonella enterica enterica serovar Typhi Ty2
ucccacucuuccag

SEQ ID NO: 3681127 - RNA, 16 nt, Salmonella enterica enterica serovar Typhi Ty2
ucccacugcacgccag

SEQ ID NO: 3681128 - RNA, 17 nt, Salmonella enterica enterica serovar Typhi Ty2
ucccacugcacgccagg

SEQ ID NO: 3681129 - RNA, 20 nt, Salmonella enterica enterica serovar Typhi Ty2
ucccacuuaggcagccaggc

SEQ ID NO: 3681130 - RNA, 16 nt, Salmonella enterica enterica serovar Typhi Ty2
ucccagaauccgcgca

SEQ ID NO: 3681131 - RNA, 13 nt, Salmonella enterica enterica serovar Typhi Ty2
ucccagacaaaau

SEQ ID NO: 3681132 - RNA, 13 nt, Salmonella enterica enterica serovar Typhi Ty2
ucccagaccauuc

SEQ ID NO: 3681133 - RNA, 19 nt, Salmonella enterica enterica serovar Typhi Ty2
ucccagauuaaaucauccu

SEQ ID NO: 3681134 - RNA, 15 nt, Salmonella enterica enterica serovar Typhi Ty2
ucccagccccacauu

SEQ ID NO: 3681135 - RNA, 14 nt, Salmonella enterica enterica serovar Typhi Ty2
ucccagccgggcag

SEQ ID NO: 3681136 - RNA, 21 nt, Salmonella enterica enterica serovar Typhi Ty2
ucccagccgggcaggaaaagc

SEQ ID NO: 3681137 - RNA, 19 nt, Salmonella enterica enterica serovar Typhi Ty2
ucccagccuuccuggucug

SEQ ID NO: 3681138 - RNA, 22 nt, Salmonella enterica enterica serovar Typhi Ty2
ucccagccuuccuggucugcca

SEQ ID NO: 3681139 - RNA, 16 nt, Salmonella enterica enterica serovar Typhi Ty2
ucccaggcgcgcagcu

SEQ ID NO: 3681140 - RNA, 19 nt, Salmonella enterica enterica serovar Typhi Ty2
ucccaggcgcgcagcugcc

SEQ ID NO: 3681141 - RNA, 18 nt, Salmonella enterica enterica serovar Typhi Ty2
ucccagucauccgguuca

SEQ ID NO: 3681142 - RNA, 14 nt, Salmonella enterica enterica serovar Typhi Ty2
ucccaguggcgucg

SEQ ID NO: 3681143 - RNA, 13 nt, Salmonella enterica enterica serovar Typhi Ty2
ucccagugucaac

SEQ ID NO: 3681144 - RNA, 16 nt, Salmonella enterica enterica serovar Typhi Ty2
ucccagugucaacugc

SEQ ID NO: 3681145 - RNA, 17 nt, Salmonella enterica enterica serovar Typhi Ty2
ucccaguuggcagggcu

SEQ ID NO: 3681146 - RNA, 23 nt, Salmonella enterica enterica serovar Typhi Ty2
ucccauaccuguaucaaaccaac

SEQ ID NO: 3681147 - RNA, 18 nt, Salmonella enterica enterica serovar Typhi Ty2
ucccauauuuuuucugcc

SEQ ID NO: 3681148 - RNA, 14 nt, Salmonella enterica enterica serovar Typhi Ty2
ucccauguugcgcc

SEQ ID NO: 3681149 - RNA, 13 nt, Salmonella enterica enterica serovar Typhi Ty2
ucccguuucagug

SEQ ID NO: 3681150 - RNA, 18 nt, Salmonella enterica enterica serovar Typhi Ty2
ucccguuuucgucccagc

SEQ ID NO: 3681151 - RNA, 17 nt, Salmonella enterica enterica serovar Typhi Ty2
ucccuaagccggcaggc

SEQ ID NO: 3681152 - RNA, 13 nt, Salmonella enterica enterica serovar Typhi Ty2
ucccuaauaaaau

SEQ ID NO: 3681153 - RNA, 19 nt, Salmonella enterica enterica serovar Typhi Ty2
ucccuacucucgcaugggg

SEQ ID NO: 3681154 - RNA, 14 nt, Salmonella enterica enterica serovar Typhi Ty2
ucccucaccucccc

SEQ ID NO: 3681155 - RNA, 14 nt, Salmonella enterica enterica serovar Typhi Ty2
ucccucgaaguauu

SEQ ID NO: 3681156 - RNA, 12 nt, Salmonella enterica enterica serovar Typhi Ty2
ucccucgccccg

SEQ ID NO: 3681157 - RNA, 12 nt, Salmonella enterica enterica serovar Typhi Ty2
ucccucuccagg

SEQ ID NO: 3681158 - RNA, 16 nt, Salmonella enterica enterica serovar Typhi Ty2
ucccucugaaacgcuu

SEQ ID NO: 3681159 - RNA, 13 nt, Salmonella enterica enterica serovar Typhi Ty2
ucccugacgcgca

SEQ ID NO: 3681160 - RNA, 16 nt, Salmonella enterica enterica serovar Typhi Ty2
ucccugagucuugccu

SEQ ID NO: 3681161 - RNA, 15 nt, Salmonella enterica enterica serovar Typhi Ty2
ucccugcaacgccug

SEQ ID NO: 3681162 - RNA, 15 nt, Salmonella enterica enterica serovar Typhi Ty2
ucccugcauucuuuc

SEQ ID NO: 3681163 - RNA, 16 nt, Salmonella enterica enterica serovar Typhi Ty2
ucccuggauaaaauau

SEQ ID NO: 3681164 - RNA, 17 nt, Salmonella enterica enterica serovar Typhi Ty2
ucccuggauaaaauauc

SEQ ID NO: 3681165 - RNA, 10 nt, Salmonella enterica enterica serovar Typhi Ty2
ucccuggccg

SEQ ID NO: 3681166 - RNA, 17 nt, Salmonella enterica enterica serovar Typhi Ty2
ucccuggcgugucauca

SEQ ID NO: 3681167 - RNA, 12 nt, Salmonella enterica enterica serovar Typhi Ty2
ucccuguucaaa

SEQ ID NO: 3681168 - RNA, 17 nt, Salmonella enterica enterica serovar Typhi Ty2
ucccuuccgccaccagg

SEQ ID NO: 3681169 - RNA, 18 nt, Salmonella enterica enterica serovar Typhi Ty2
ucccuuccgccaccaggu

SEQ ID NO: 3681170 - RNA, 20 nt, Salmonella enterica enterica serovar Typhi Ty2
ucccuuccgccaccagguuc

SEQ ID NO: 3681171 - RNA, 16 nt, Salmonella enterica enterica serovar Typhi Ty2
ucccuucucgcuaaua

SEQ ID NO: 3681172 - RNA, 12 nt, Salmonella enterica enterica serovar Typhi Ty2
ucccuucuuuua

SEQ ID NO: 3681173 - RNA, 14 nt, Salmonella enterica enterica serovar Typhi Ty2
ucccuucuuuuacu

SEQ ID NO: 3681174 - RNA, 15 nt, Salmonella enterica enterica serovar Typhi Ty2
ucccuucuuuuacug

SEQ ID NO: 3681175 - RNA, 16 nt, Salmonella enterica enterica serovar Typhi Ty2
ucccuuucaaaaaaga

SEQ ID NO: 3681176 - RNA, 11 nt, Salmonella enterica enterica serovar Typhi Ty2
uccgaauaauc

SEQ ID NO: 3681177 - RNA, 21 nt, Salmonella enterica enterica serovar Typhi Ty2
uccgaauauuuagcuuuucgg

SEQ ID NO: 3681178 - RNA, 14 nt, Salmonella enterica enterica serovar Typhi Ty2
uccgacaaccggcu

SEQ ID NO: 3681179 - RNA, 16 nt, Salmonella enterica enterica serovar Typhi Ty2
uccgacacgcacaucc

SEQ ID NO: 3681180 - RNA, 16 nt, Salmonella enterica enterica serovar Typhi Ty2
uccgacaugacgucgc

SEQ ID NO: 3681181 - RNA, 13 nt, Salmonella enterica enterica serovar Typhi Ty2
uccgacauuagcg

SEQ ID NO: 3681182 - RNA, 14 nt, Salmonella enterica enterica serovar Typhi Ty2
uccgacauuguucu

SEQ ID NO: 3681183 - RNA, 21 nt, Salmonella enterica enterica serovar Typhi Ty2
uccgacguuugcguaaagcug

SEQ ID NO: 3681184 - RNA, 18 nt, Salmonella enterica enterica serovar Typhi Ty2
uccgagacucaaagaaaa

SEQ ID NO: 3681185 - RNA, 23 nt, Salmonella enterica enterica serovar Typhi Ty2
uccgaggcguaucccaguaaaua

SEQ ID NO: 3681186 - RNA, 20 nt, Salmonella enterica enterica serovar Typhi Ty2
uccgaucuacgcuauuucca

SEQ ID NO: 3681187 - RNA, 22 nt, Salmonella enterica enterica serovar Typhi Ty2
uccgaugcgcuuuacugucgcu

SEQ ID NO: 3681188 - RNA, 23 nt, Salmonella enterica enterica serovar Typhi Ty2
uccgcaaagcccaucagcgccag

SEQ ID NO: 3681189 - RNA, 11 nt, Salmonella enterica enterica serovar Typhi Ty2
uccgcaauaag

SEQ ID NO: 3681190 - RNA, 16 nt, Salmonella enterica enterica serovar Typhi Ty2
uccgcaauaagugcau

SEQ ID NO: 3681191 - RNA, 18 nt, Salmonella enterica enterica serovar Typhi Ty2
uccgcaaucacauacagc

SEQ ID NO: 3681192 - RNA, 22 nt, Salmonella enterica enterica serovar Typhi Ty2
uccgcaaucacauacagcacuu

SEQ ID NO: 3681193 - RNA, 15 nt, Salmonella enterica enterica serovar Typhi Ty2
uccgcaauccuggcu

SEQ ID NO: 3681194 - RNA, 16 nt, Salmonella enterica enterica serovar Typhi Ty2
uccgcaauuuccugau

SEQ ID NO: 3681195 - RNA, 14 nt, Salmonella enterica enterica serovar Typhi Ty2
uccgcacgcgcgcc

SEQ ID NO: 3681196 - RNA, 16 nt, Salmonella enterica enterica serovar Typhi Ty2
uccgcacgcgcgcccu

SEQ ID NO: 3681197 - RNA, 15 nt, Salmonella enterica enterica serovar Typhi Ty2
uccgcagauccagca

SEQ ID NO: 3681198 - RNA, 15 nt, Salmonella enterica enterica serovar Typhi Ty2
uccgcaggagagcca

SEQ ID NO: 3681199 - RNA, 22 nt, Salmonella enterica enterica serovar Typhi Ty2
uccgcaggggauucugccaucg

SEQ ID NO: 3681200 - RNA, 14 nt, Salmonella enterica enterica serovar Typhi Ty2
uccgcauucuaaau

SEQ ID NO: 3681201 - RNA, 16 nt, Salmonella enterica enterica serovar Typhi Ty2
uccgccacgcucgcug

SEQ ID NO: 3681202 - RNA, 19 nt, Salmonella enterica enterica serovar Typhi Ty2
uccgccagauacaaaucuc

SEQ ID NO: 3681203 - RNA, 15 nt, Salmonella enterica enterica serovar Typhi Ty2
uccgccagcaacacu

SEQ ID NO: 3681204 - RNA, 16 nt, Salmonella enterica enterica serovar Typhi Ty2
uccgccagcaacacuu

SEQ ID NO: 3681205 - RNA, 18 nt, Salmonella enterica enterica serovar Typhi Ty2
uccgccagcaaugccgcc

SEQ ID NO: 3681206 - RNA, 16 nt, Salmonella enterica enterica serovar Typhi Ty2
uccgccagccgccauu

SEQ ID NO: 3681207 - RNA, 13 nt, Salmonella enterica enterica serovar Typhi Ty2
uccgccagcgccu

SEQ ID NO: 3681208 - RNA, 16 nt, Salmonella enterica enterica serovar Typhi Ty2
uccgccaggcccauga

SEQ ID NO: 3681209 - RNA, 18 nt, Salmonella enterica enterica serovar Typhi Ty2
uccgccagguauucuaac

SEQ ID NO: 3681210 - RNA, 14 nt, Salmonella enterica enterica serovar Typhi Ty2
uccgccauaucccc

SEQ ID NO: 3681211 - RNA, 23 nt, Salmonella enterica enterica serovar Typhi Ty2
uccgccaucgccucgauaaacau

SEQ ID NO: 3681212 - RNA, 15 nt, Salmonella enterica enterica serovar Typhi Ty2
uccgccaugguuggg

SEQ ID NO: 3681213 - RNA, 17 nt, Salmonella enterica enterica serovar Typhi Ty2
uccgcccaagaacauga

SEQ ID NO: 3681214 - RNA, 14 nt, Salmonella enterica enterica serovar Typhi Ty2
uccgcccacccagc

SEQ ID NO: 3681215 - RNA, 14 nt, Salmonella enterica enterica serovar Typhi Ty2
uccgcccaggcggg

SEQ ID NO: 3681216 - RNA, 14 nt, Salmonella enterica enterica serovar Typhi Ty2
uccgccccgccuuc

SEQ ID NO: 3681217 - RNA, 16 nt, Salmonella enterica enterica serovar Typhi Ty2
uccgccgccgccaucg

SEQ ID NO: 3681218 - RNA, 14 nt, Salmonella enterica enterica serovar Typhi Ty2
uccgccucguguaa

SEQ ID NO: 3681219 - RNA, 14 nt, Salmonella enterica enterica serovar Typhi Ty2
uccgccugcugcgc

SEQ ID NO: 3681220 - RNA, 18 nt, Salmonella enterica enterica serovar Typhi Ty2
uccgccuggaacccaggc

SEQ ID NO: 3681221 - RNA, 22 nt, Salmonella enterica enterica serovar Typhi Ty2
uccgccuggaacccaggcaccu

SEQ ID NO: 3681222 - RNA, 15 nt, Salmonella enterica enterica serovar Typhi Ty2
uccgccuuugacgcc

SEQ ID NO: 3681223 - RNA, 21 nt, Salmonella enterica enterica serovar Typhi Ty2
uccgcgacguacuggaacagu

SEQ ID NO: 3681224 - RNA, 15 nt, Salmonella enterica enterica serovar Typhi Ty2
uccgcgagcagccaa

SEQ ID NO: 3681225 - RNA, 17 nt, Salmonella enterica enterica serovar Typhi Ty2
uccgcgccgagugcuug

SEQ ID NO: 3681226 - RNA, 19 nt, Salmonella enterica enterica serovar Typhi Ty2
uccgcgccgagugcuugca

SEQ ID NO: 3681227 - RNA, 15 nt, Salmonella enterica enterica serovar Typhi Ty2
uccgcgccgccgccg

SEQ ID NO: 3681228 - RNA, 14 nt, Salmonella enterica enterica serovar Typhi Ty2
uccgcgcgacggua

SEQ ID NO: 3681229 - RNA, 15 nt, Salmonella enterica enterica serovar Typhi Ty2
uccgcgcucauacga

SEQ ID NO: 3681230 - RNA, 12 nt, Salmonella enterica enterica serovar Typhi Ty2
uccgcgcugaug

SEQ ID NO: 3681231 - RNA, 15 nt, Salmonella enterica enterica serovar Typhi Ty2
uccgcgcugaugguu

SEQ ID NO: 3681232 - RNA, 19 nt, Salmonella enterica enterica serovar Typhi Ty2
uccgucagcgaaucgaucu

SEQ ID NO: 3681233 - RNA, 23 nt, Salmonella enterica enterica serovar Typhi Ty2
uccgucagcgucacguuauacca

SEQ ID NO: 3681234 - RNA, 22 nt, Salmonella enterica enterica serovar Typhi Ty2
uccgucauguagcaaauuucau

SEQ ID NO: 3681235 - RNA, 19 nt, Salmonella enterica enterica serovar Typhi Ty2
uccgucggcuggaagccuu

SEQ ID NO: 3681236 - RNA, 18 nt, Salmonella enterica enterica serovar Typhi Ty2
uccgucgugccuuucagg

SEQ ID NO: 3681237 - RNA, 15 nt, Salmonella enterica enterica serovar Typhi Ty2
uccgucguguagccu

SEQ ID NO: 3681238 - RNA, 20 nt, Salmonella enterica enterica serovar Typhi Ty2
uccgucguuaaucagcgcgg

SEQ ID NO: 3681239 - RNA, 13 nt, Salmonella enterica enterica serovar Typhi Ty2
uccgugaccugcu

SEQ ID NO: 3681240 - RNA, 14 nt, Salmonella enterica enterica serovar Typhi Ty2
uccguuaagcccug

SEQ ID NO: 3681241 - RNA, 19 nt, Salmonella enterica enterica serovar Typhi Ty2
uccguuaccccuuuuucaa

SEQ ID NO: 3681242 - RNA, 17 nt, Salmonella enterica enterica serovar Typhi Ty2
uccguuagcucuuucau

SEQ ID NO: 3681243 - RNA, 17 nt, Salmonella enterica enterica serovar Typhi Ty2
uccguucaucggcauac

SEQ ID NO: 3681244 - RNA, 21 nt, Salmonella enterica enterica serovar Typhi Ty2
uccguugccacccaaugaucc

SEQ ID NO: 3681245 - RNA, 18 nt, Salmonella enterica enterica serovar Typhi Ty2
uccguuuguaacauauuu

SEQ ID NO: 3681246 - RNA, 23 nt, Salmonella enterica enterica serovar Typhi Ty2
uccuaccacgccgcuacugccgc

SEQ ID NO: 3681247 - RNA, 22 nt, Salmonella enterica enterica serovar Typhi Ty2
uccuauuugcuugugacggcaa

SEQ ID NO: 3681248 - RNA, 20 nt, Salmonella enterica enterica serovar Typhi Ty2
uccucaauauugucuucguc

SEQ ID NO: 3681249 - RNA, 19 nt, Salmonella enterica enterica serovar Typhi Ty2
uccucacaaacggcaucga

SEQ ID NO: 3681250 - RNA, 22 nt, Salmonella enterica enterica serovar Typhi Ty2
uccucaccguagcuccagaccu

SEQ ID NO: 3681251 - RNA, 16 nt, Salmonella enterica enterica serovar Typhi Ty2
uccucauacagcccgc

SEQ ID NO: 3681252 - RNA, 16 nt, Salmonella enterica enterica serovar Typhi Ty2
uccucauucagcggcu

SEQ ID NO: 3681253 - RNA, 17 nt, Salmonella enterica enterica serovar Typhi Ty2
uccuccaacgugcagau

SEQ ID NO: 3681254 - RNA, 19 nt, Salmonella enterica enterica serovar Typhi Ty2
uccuccggcguaaaggcuu

SEQ ID NO: 3681255 - RNA, 23 nt, Salmonella enterica enterica serovar Typhi Ty2
uccuccggcguaaaggcuuguuu

SEQ ID NO: 3681256 - RNA, 14 nt, Salmonella enterica enterica serovar Typhi Ty2
uccucgaucgccug

SEQ ID NO: 3681257 - RNA, 19 nt, Salmonella enterica enterica serovar Typhi Ty2
uccucgucgcgcgccgccu

SEQ ID NO: 3681258 - RNA, 15 nt, Salmonella enterica enterica serovar Typhi Ty2
uccucuauccagacg

SEQ ID NO: 3681259 - RNA, 19 nt, Salmonella enterica enterica serovar Typhi Ty2
uccucuuccgacaaaccuu

SEQ ID NO: 3681260 - RNA, 14 nt, Salmonella enterica enterica serovar Typhi Ty2
uccucuuucaaccu

SEQ ID NO: 3681261 - RNA, 13 nt, Salmonella enterica enterica serovar Typhi Ty2
uccucuuucccuu

SEQ ID NO: 3681262 - RNA, 18 nt, Salmonella enterica enterica serovar Typhi Ty2
uccucuuucccuuuuuaa

SEQ ID NO: 3681263 - RNA, 19 nt, Salmonella enterica enterica serovar Typhi Ty2
uccucuuuucgaacgccga

SEQ ID NO: 3681264 - RNA, 21 nt, Salmonella enterica enterica serovar Typhi Ty2
uccucuuuucgaacgccgaca

SEQ ID NO: 3681265 - RNA, 16 nt, Salmonella enterica enterica serovar Typhi Ty2
uccugaaaaaauuccc

SEQ ID NO: 3681266 - RNA, 15 nt, Salmonella enterica enterica serovar Typhi Ty2
uccugaaucgccguc

SEQ ID NO: 3681267 - RNA, 17 nt, Salmonella enterica enterica serovar Typhi Ty2
uccugaccaugccacaa

SEQ ID NO: 3681268 - RNA, 21 nt, Salmonella enterica enterica serovar Typhi Ty2
uccugaccaugccacaacaga

SEQ ID NO: 3681269 - RNA, 19 nt, Salmonella enterica enterica serovar Typhi Ty2
uccugagcagacauauuuu

SEQ ID NO: 3681270 - RNA, 13 nt, Salmonella enterica enterica serovar Typhi Ty2
uccugagcgaaug

SEQ ID NO: 3681271 - RNA, 22 nt, Salmonella enterica enterica serovar Typhi Ty2
uccugagcgaauguauaaucca

SEQ ID NO: 3681272 - RNA, 22 nt, Salmonella enterica enterica serovar Typhi Ty2
uccugaguaaagccugcccugc

SEQ ID NO: 3681273 - RNA, 19 nt, Salmonella enterica enterica serovar Typhi Ty2
uccugauagcaaucauccu

SEQ ID NO: 3681274 - RNA, 13 nt, Salmonella enterica enterica serovar Typhi Ty2
uccugauccggcu

SEQ ID NO: 3681275 - RNA, 17 nt, Salmonella enterica enterica serovar Typhi Ty2
uccugaucuucaaccuc

SEQ ID NO: 3681276 - RNA, 17 nt, Salmonella enterica enterica serovar Typhi Ty2
uccugaugauggaaaac

SEQ ID NO: 3681277 - RNA, 14 nt, Salmonella enterica enterica serovar Typhi Ty2
uccugauuuuacug

SEQ ID NO: 3681278 - RNA, 17 nt, Salmonella enterica enterica serovar Typhi Ty2
uccugcaacagcaccag

SEQ ID NO: 3681279 - RNA, 19 nt, Salmonella enterica enterica serovar Typhi Ty2
uccugcaacagcaccagca

SEQ ID NO: 3681280 - RNA, 13 nt, Salmonella enterica enterica serovar Typhi Ty2
uccugcagcgcca

SEQ ID NO: 3681281 - RNA, 17 nt, Salmonella enterica enterica serovar Typhi Ty2
uccugcaggcggcaaaa

SEQ ID NO: 3681282 - RNA, 20 nt, Salmonella enterica enterica serovar Typhi Ty2
uccugcaucgacauccgauu

SEQ ID NO: 3681283 - RNA, 11 nt, Salmonella enterica enterica serovar Typhi Ty2
uccugccagac

SEQ ID NO: 3681284 - RNA, 20 nt, Salmonella enterica enterica serovar Typhi Ty2
uccugccagccgcucugcug

SEQ ID NO: 3681285 - RNA, 21 nt, Salmonella enterica enterica serovar Typhi Ty2
uccugccgcaaacgccugcuc

SEQ ID NO: 3681286 - RNA, 22 nt, Salmonella enterica enterica serovar Typhi Ty2
uccugccgccgcaccacugcug

SEQ ID NO: 3681287 - RNA, 18 nt, Salmonella enterica enterica serovar Typhi Ty2
uccugcgccggacgccac

SEQ ID NO: 3681288 - RNA, 17 nt, Salmonella enterica enterica serovar Typhi Ty2
uccugcgcggauaccgg

SEQ ID NO: 3681289 - RNA, 19 nt, Salmonella enterica enterica serovar Typhi Ty2
uccugcgcugucaccagca

SEQ ID NO: 3681290 - RNA, 22 nt, Salmonella enterica enterica serovar Typhi Ty2
uccugcgcuuuuugcuucgcca

SEQ ID NO: 3681291 - RNA, 15 nt, Salmonella enterica enterica serovar Typhi Ty2
uccugcggcaguucu

SEQ ID NO: 3681292 - RNA, 19 nt, Salmonella enterica enterica serovar Typhi Ty2
uccugcggguucaucgcca

SEQ ID NO: 3681293 - RNA, 22 nt, Salmonella enterica enterica serovar Typhi Ty2
uccugcgugccguugaccagcu

SEQ ID NO: 3681294 - RNA, 20 nt, Salmonella enterica enterica serovar Typhi Ty2
uccugcucaugcgagguaua

SEQ ID NO: 3681295 - RNA, 17 nt, Salmonella enterica enterica serovar Typhi Ty2
uccugcuccaugcuguc

SEQ ID NO: 3681296 - RNA, 21 nt, Salmonella enterica enterica serovar Typhi Ty2
uccugcuccugcggcguggaa

SEQ ID NO: 3681297 - RNA, 21 nt, Salmonella enterica enterica serovar Typhi Ty2
uccugcuugcgguuacgcagc

SEQ ID NO: 3681298 - RNA, 14 nt, Salmonella enterica enterica serovar Typhi Ty2
uccuggauuugcug

SEQ ID NO: 3681299 - RNA, 13 nt, Salmonella enterica enterica serovar Typhi Ty2
uccuggcuucaac

SEQ ID NO: 3681300 - RNA, 14 nt, Salmonella enterica enterica serovar Typhi Ty2
uccuggcuugccag

SEQ ID NO: 3681301 - RNA, 21 nt, Salmonella enterica enterica serovar Typhi Ty2
uccugggcaaaauagcccggc

SEQ ID NO: 3681302 - RNA, 22 nt, Salmonella enterica enterica serovar Typhi Ty2
uccugggcaaaauagcccggcu

SEQ ID NO: 3681303 - RNA, 20 nt, Salmonella enterica enterica serovar Typhi Ty2
uccugguaacggcacugcuu

SEQ ID NO: 3681304 - RNA, 21 nt, Salmonella enterica enterica serovar Typhi Ty2
uccuggugcgacaccacgcag

SEQ ID NO: 3681305 - RNA, 15 nt, Salmonella enterica enterica serovar Typhi Ty2
uccuggugugguuau

SEQ ID NO: 3681306 - RNA, 19 nt, Salmonella enterica enterica serovar Typhi Ty2
uccuguaaaaaauccagcg

SEQ ID NO: 3681307 - RNA, 15 nt, Salmonella enterica enterica serovar Typhi Ty2
uccuguaacaacugu

SEQ ID NO: 3681308 - RNA, 22 nt, Salmonella enterica enterica serovar Typhi Ty2
uccuguaacaacuguuuuucac

SEQ ID NO: 3681309 - RNA, 22 nt, Salmonella enterica enterica serovar Typhi Ty2
uccuguagcgucuuuugaguga

SEQ ID NO: 3681310 - RNA, 12 nt, Salmonella enterica enterica serovar Typhi Ty2
uccugucccugc

SEQ ID NO: 3681311 - RNA, 13 nt, Salmonella enterica enterica serovar Typhi Ty2
uccugucccugcc

SEQ ID NO: 3681312 - RNA, 15 nt, Salmonella enterica enterica serovar Typhi Ty2
uccugucccugccag

SEQ ID NO: 3681313 - RNA, 16 nt, Salmonella enterica enterica serovar Typhi Ty2
ucgauaagccagcgau

SEQ ID NO: 3681314 - RNA, 15 nt, Salmonella enterica enterica serovar Typhi Ty2
ucgauaaucccggcg

SEQ ID NO: 3681315 - RNA, 23 nt, Salmonella enterica enterica serovar Typhi Ty2
ucgauaaucgguagcacuuuaaa

SEQ ID NO: 3681316 - RNA, 18 nt, Salmonella enterica enterica serovar Typhi Ty2
ucgauacgcugaagcuug

SEQ ID NO: 3681317 - RNA, 22 nt, Salmonella enterica enterica serovar Typhi Ty2
ucgauacucacgacuuucacca

SEQ ID NO: 3681318 - RNA, 13 nt, Salmonella enterica enterica serovar Typhi Ty2
ucgauagcaggca

SEQ ID NO: 3681319 - RNA, 14 nt, Salmonella enterica enterica serovar Typhi Ty2
ucgauagcauuuuu

SEQ ID NO: 3681320 - RNA, 16 nt, Salmonella enterica enterica serovar Typhi Ty2
ucgauagcgccgcauc

SEQ ID NO: 3681321 - RNA, 19 nt, Salmonella enterica enterica serovar Typhi Ty2
ucgauagcguuuuccagcu

SEQ ID NO: 3681322 - RNA, 17 nt, Salmonella enterica enterica serovar Typhi Ty2
ucgauauacuccgcgac

SEQ ID NO: 3681323 - RNA, 21 nt, Salmonella enterica enterica serovar Typhi Ty2
ucgauauaucgcgucaucaaa

SEQ ID NO: 3681324 - RNA, 15 nt, Salmonella enterica enterica serovar Typhi Ty2
ucgauaucugccugc

SEQ ID NO: 3681325 - RNA, 17 nt, Salmonella enterica enterica serovar Typhi Ty2
ucgauaucugccugcag

SEQ ID NO: 3681326 - RNA, 19 nt, Salmonella enterica enterica serovar Typhi Ty2
ucgaucacccacaucagcg

SEQ ID NO: 3681327 - RNA, 15 nt, Salmonella enterica enterica serovar Typhi Ty2
ucgaucagcuggcuu

SEQ ID NO: 3681328 - RNA, 17 nt, Salmonella enterica enterica serovar Typhi Ty2
ucgauccacuucccauu

SEQ ID NO: 3681329 - RNA, 15 nt, Salmonella enterica enterica serovar Typhi Ty2
ucgauccccaacgac

SEQ ID NO: 3681330 - RNA, 17 nt, Salmonella enterica enterica serovar Typhi Ty2
ucgauccccucuuccau

SEQ ID NO: 3681331 - RNA, 22 nt, Salmonella enterica enterica serovar Typhi Ty2
ucgauccccucuuccaucagcc

SEQ ID NO: 3681332 - RNA, 20 nt, Salmonella enterica enterica serovar Typhi Ty2
ucgauccgcaucagcaacgc

SEQ ID NO: 3681333 - RNA, 23 nt, Salmonella enterica enterica serovar Typhi Ty2
ucgauccgguuacucgcaucgaa

SEQ ID NO: 3681334 - RNA, 12 nt, Salmonella enterica enterica serovar Typhi Ty2
ucgaucgucggg

SEQ ID NO: 3681335 - RNA, 15 nt, Salmonella enterica enterica serovar Typhi Ty2
ucgaugaaaaagagg

SEQ ID NO: 3681336 - RNA, 21 nt, Salmonella enterica enterica serovar Typhi Ty2
ucgaugagcucguuauaagcu

SEQ ID NO: 3681337 - RNA, 18 nt, Salmonella enterica enterica serovar Typhi Ty2
ucgaugcccguugucaca

SEQ ID NO: 3681338 - RNA, 12 nt, Salmonella enterica enterica serovar Typhi Ty2
ucgauggcagug

SEQ ID NO: 3681339 - RNA, 16 nt, Salmonella enterica enterica serovar Typhi Ty2
ucgauggccucaucau

SEQ ID NO: 3681340 - RNA, 14 nt, Salmonella enterica enterica serovar Typhi Ty2
ucgaugucgucgau

SEQ ID NO: 3681341 - RNA, 17 nt, Salmonella enterica enterica serovar Typhi Ty2
ucgauuaaacgccuggg

SEQ ID NO: 3681342 - RNA, 23 nt, Salmonella enterica enterica serovar Typhi Ty2
ucgauuagaccguaaauccuaac

SEQ ID NO: 3681343 - RNA, 19 nt, Salmonella enterica enterica serovar Typhi Ty2
ucgauuaguccgucgggga

SEQ ID NO: 3681344 - RNA, 21 nt, Salmonella enterica enterica serovar Typhi Ty2
ucgauuuaaugcuguaaaaga

SEQ ID NO: 3681345 - RNA, 21 nt, Salmonella enterica enterica serovar Typhi Ty2
ucgauuuccgguuccagcggc

SEQ ID NO: 3681346 - RNA, 16 nt, Salmonella enterica enterica serovar Typhi Ty2
ucgauuuuagcgcauc

SEQ ID NO: 3681347 - RNA, 22 nt, Salmonella enterica enterica serovar Typhi Ty2
ucgauuuucugcucaauauuau

SEQ ID NO: 3681348 - RNA, 18 nt, Salmonella enterica enterica serovar Typhi Ty2
ucgauuuuucaucuucag

SEQ ID NO: 3681349 - RNA, 20 nt, Salmonella enterica enterica serovar Typhi Ty2
ucgcaaaauagcgguucaau

SEQ ID NO: 3681350 - RNA, 13 nt, Salmonella enterica enterica serovar Typhi Ty2
ucgcaaacgccag

SEQ ID NO: 3681351 - RNA, 17 nt, Salmonella enterica enterica serovar Typhi Ty2
ucgcaaacggaauaaac

SEQ ID NO: 3681352 - RNA, 21 nt, Salmonella enterica enterica serovar Typhi Ty2
ucgcaaagaaaucaacgaauu

SEQ ID NO: 3681353 - RNA, 14 nt, Salmonella enterica enterica serovar Typhi Ty2
ucgcaaauaaucuu

SEQ ID NO: 3681354 - RNA, 12 nt, Salmonella enterica enterica serovar Typhi Ty2
ucgcaacgccgc

SEQ ID NO: 3681355 - RNA, 20 nt, Salmonella enterica enterica serovar Typhi Ty2
ucgcaacgccggugccugcc

SEQ ID NO: 3681356 - RNA, 22 nt, Salmonella enterica enterica serovar Typhi Ty2
ucgcaacgcuuaucagucccca

SEQ ID NO: 3681357 - RNA, 20 nt, Salmonella enterica enterica serovar Typhi Ty2
ucgcaagacgaaaaaugaau

SEQ ID NO: 3681358 - RNA, 20 nt, Salmonella enterica enterica serovar Typhi Ty2
ucgcaaggcgcgauccgccc

SEQ ID NO: 3681359 - RNA, 15 nt, Salmonella enterica enterica serovar Typhi Ty2
ucgcaauauucaugc

SEQ ID NO: 3681360 - RNA, 13 nt, Salmonella enterica enterica serovar Typhi Ty2
ucgcaaugccacc

SEQ ID NO: 3681361 - RNA, 14 nt, Salmonella enterica enterica serovar Typhi Ty2
ucgcaaugccacca

SEQ ID NO: 3681362 - RNA, 17 nt, Salmonella enterica enterica serovar Typhi Ty2
ucgcaccauagcagcca

SEQ ID NO: 3681363 - RNA, 18 nt, Salmonella enterica enterica serovar Typhi Ty2
ucgcacgccucuggcgua

SEQ ID NO: 3681364 - RNA, 21 nt, Salmonella enterica enterica serovar Typhi Ty2
ucgcacgucgucguuuguagg

SEQ ID NO: 3681365 - RNA, 15 nt, Salmonella enterica enterica serovar Typhi Ty2
ucgcagaccauccau

SEQ ID NO: 3681366 - RNA, 21 nt, Salmonella enterica enterica serovar Typhi Ty2
ucgcagccacccuggcauaug

SEQ ID NO: 3681367 - RNA, 16 nt, Salmonella enterica enterica serovar Typhi Ty2
ucgcagccuuuggcaa

SEQ ID NO: 3681368 - RNA, 13 nt, Salmonella enterica enterica serovar Typhi Ty2
ucgcagcgcaggu

SEQ ID NO: 3681369 - RNA, 21 nt, Salmonella enterica enterica serovar Typhi Ty2
ucgcaggccaaacagcggcuc

SEQ ID NO: 3681370 - RNA, 13 nt, Salmonella enterica enterica serovar Typhi Ty2
ucgcaggccauaa

SEQ ID NO: 3681371 - RNA, 20 nt, Salmonella enterica enterica serovar Typhi Ty2
ucgcagggcugcuggugcgc

SEQ ID NO: 3681372 - RNA, 17 nt, Salmonella enterica enterica serovar Typhi Ty2
ucgcauaaaauuauaaa

SEQ ID NO: 3681373 - RNA, 13 nt, Salmonella enterica enterica serovar Typhi Ty2
ucgcauaacuucg

SEQ ID NO: 3681374 - RNA, 15 nt, Salmonella enterica enterica serovar Typhi Ty2
ucgcauccuccaucc

SEQ ID NO: 3681375 - RNA, 17 nt, Salmonella enterica enterica serovar Typhi Ty2
ucgcauuuaaucgccug

SEQ ID NO: 3681376 - RNA, 21 nt, Salmonella enterica enterica serovar Typhi Ty2
ucgccaaaacccagaaucagu

SEQ ID NO: 3681377 - RNA, 16 nt, Salmonella enterica enterica serovar Typhi Ty2
ucgccaaaccagaccc

SEQ ID NO: 3681378 - RNA, 15 nt, Salmonella enterica enterica serovar Typhi Ty2
ucgccaaagauauag

SEQ ID NO: 3681379 - RNA, 14 nt, Salmonella enterica enterica serovar Typhi Ty2
ucgccaaagcagcu

SEQ ID NO: 3681380 - RNA, 15 nt, Salmonella enterica enterica serovar Typhi Ty2
ucgccaaagcgcugc

SEQ ID NO: 3681381 - RNA, 16 nt, Salmonella enterica enterica serovar Typhi Ty2
ucgccaaagcguaaac

SEQ ID NO: 3681382 - RNA, 20 nt, Salmonella enterica enterica serovar Typhi Ty2
ucgccaaagucauugcugcc

SEQ ID NO: 3681383 - RNA, 22 nt, Salmonella enterica enterica serovar Typhi Ty2
ucgccaacaccgauccgaagaa

SEQ ID NO: 3681384 - RNA, 21 nt, Salmonella enterica enterica serovar Typhi Ty2
ucgccaauaauuaguuuuacc

SEQ ID NO: 3681385 - RNA, 19 nt, Salmonella enterica enterica serovar Typhi Ty2
ucgccacaugcggcaggcu

SEQ ID NO: 3681386 - RNA, 14 nt, Salmonella enterica enterica serovar Typhi Ty2
ucgccaccaccagc

SEQ ID NO: 3681387 - RNA, 16 nt, Salmonella enterica enterica serovar Typhi Ty2
ucgccaccagcgauau

SEQ ID NO: 3681388 - RNA, 17 nt, Salmonella enterica enterica serovar Typhi Ty2
ucgccaccaugcugguu

SEQ ID NO: 3681389 - RNA, 23 nt, Salmonella enterica enterica serovar Typhi Ty2
ucgccacccggcuuuuuuauugc

SEQ ID NO: 3681390 - RNA, 13 nt, Salmonella enterica enterica serovar Typhi Ty2
ucgccaccgcauu

SEQ ID NO: 3681391 - RNA, 22 nt, Salmonella enterica enterica serovar Typhi Ty2
ucgccacguauuucgcagcggu

SEQ ID NO: 3681392 - RNA, 17 nt, Salmonella enterica enterica serovar Typhi Ty2
ucgccagaaggcaggcu

SEQ ID NO: 3681393 - RNA, 17 nt, Salmonella enterica enterica serovar Typhi Ty2
ucgccagacccagcgcu

SEQ ID NO: 3681394 - RNA, 18 nt, Salmonella enterica enterica serovar Typhi Ty2
ucgccagaucgaacagcg

SEQ ID NO: 3681395 - RNA, 20 nt, Salmonella enterica enterica serovar Typhi Ty2
ucgcgcagauagagcgccug

SEQ ID NO: 3681396 - RNA, 17 nt, Salmonella enterica enterica serovar Typhi Ty2
ucgcgcagcaaaucagc

SEQ ID NO: 3681397 - RNA, 12 nt, Salmonella enterica enterica serovar Typhi Ty2
ucgcgcagcagg

SEQ ID NO: 3681398 - RNA, 16 nt, Salmonella enterica enterica serovar Typhi Ty2
ucgcgcagcgugaaac

SEQ ID NO: 3681399 - RNA, 15 nt, Salmonella enterica enterica serovar Typhi Ty2
ucgcgcauccgggcc

SEQ ID NO: 3681400 - RNA, 19 nt, Salmonella enterica enterica serovar Typhi Ty2
ucgcgccaccugcacggcg

SEQ ID NO: 3681401 - RNA, 13 nt, Salmonella enterica enterica serovar Typhi Ty2
ucgcgccagcgac

SEQ ID NO: 3681402 - RNA, 17 nt, Salmonella enterica enterica serovar Typhi Ty2
ucgcgcccuccuccagc

SEQ ID NO: 3681403 - RNA, 21 nt, Salmonella enterica enterica serovar Typhi Ty2
ucgcgccggacagcagcauau

SEQ ID NO: 3681404 - RNA, 17 nt, Salmonella enterica enterica serovar Typhi Ty2
ucgcgccgugcccagca

SEQ ID NO: 3681405 - RNA, 15 nt, Salmonella enterica enterica serovar Typhi Ty2
ucgcgccuccccugc

SEQ ID NO: 3681406 - RNA, 16 nt, Salmonella enterica enterica serovar Typhi Ty2
ucgcgccuccccugcc

SEQ ID NO: 3681407 - RNA, 22 nt, Salmonella enterica enterica serovar Typhi Ty2
ucgcgcgccgcuuccggcaggu

SEQ ID NO: 3681408 - RNA, 16 nt, Salmonella enterica enterica serovar Typhi Ty2
ucgcgcggcauggaug

SEQ ID NO: 3681409 - RNA, 20 nt, Salmonella enterica enterica serovar Typhi Ty2
ucgcgcggcgguucauccug

SEQ ID NO: 3681410 - RNA, 16 nt, Salmonella enterica enterica serovar Typhi Ty2
ucgcgcguccacggcg

SEQ ID NO: 3681411 - RNA, 14 nt, Salmonella enterica enterica serovar Typhi Ty2
ucgcgcuauaucag

SEQ ID NO: 3681412 - RNA, 20 nt, Salmonella enterica enterica serovar Typhi Ty2
ucgcgcugauauuuuuacug

SEQ ID NO: 3681413 - RNA, 13 nt, Salmonella enterica enterica serovar Typhi Ty2
ucgcgcugcgcag

SEQ ID NO: 3681414 - RNA, 16 nt, Salmonella enterica enterica serovar Typhi Ty2
ucgcgcugcgcaggcg

SEQ ID NO: 3681415 - RNA, 19 nt, Salmonella enterica enterica serovar Typhi Ty2
ucgcgcugucugccggcgu

SEQ ID NO: 3681416 - RNA, 21 nt, Salmonella enterica enterica serovar Typhi Ty2
ucgcgcuuacacagacugcuu

SEQ ID NO: 3681417 - RNA, 15 nt, Salmonella enterica enterica serovar Typhi Ty2
ucgcgcuuauccgca

SEQ ID NO: 3681418 - RNA, 17 nt, Salmonella enterica enterica serovar Typhi Ty2
ucgcggaauuucaggaa

SEQ ID NO: 3681419 - RNA, 18 nt, Salmonella enterica enterica serovar Typhi Ty2
ucgcggaauuucaggaag

SEQ ID NO: 3681420 - RNA, 13 nt, Salmonella enterica enterica serovar Typhi Ty2
ucgcggccagaua

SEQ ID NO: 3681421 - RNA, 20 nt, Salmonella enterica enterica serovar Typhi Ty2
ucgcggcuuuuuucuccagu

SEQ ID NO: 3681422 - RNA, 20 nt, Salmonella enterica enterica serovar Typhi Ty2
ucgcggguaaacucacccag

SEQ ID NO: 3681423 - RNA, 14 nt, Salmonella enterica enterica serovar Typhi Ty2
ucgcgguaaaaagc

SEQ ID NO: 3681424 - RNA, 19 nt, Salmonella enterica enterica serovar Typhi Ty2
ucgcgguaacggccuggcu

SEQ ID NO: 3681425 - RNA, 13 nt, Salmonella enterica enterica serovar Typhi Ty2
ucgcggugaaaga

SEQ ID NO: 3681426 - RNA, 17 nt, Salmonella enterica enterica serovar Typhi Ty2
ucgcggugaucccaggc

SEQ ID NO: 3681427 - RNA, 17 nt, Salmonella enterica enterica serovar Typhi Ty2
ucgcgguugacgcugcu

SEQ ID NO: 3681428 - RNA, 16 nt, Salmonella enterica enterica serovar Typhi Ty2
ucgcguacagcgccau

SEQ ID NO: 3681429 - RNA, 21 nt, Salmonella enterica enterica serovar Typhi Ty2
ucgcguacagcgccaugaaga

SEQ ID NO: 3681430 - RNA, 19 nt, Salmonella enterica enterica serovar Typhi Ty2
ucgcgucgccaucaggcag

SEQ ID NO: 3681431 - RNA, 16 nt, Salmonella enterica enterica serovar Typhi Ty2
ucgcgucuacgucagg

SEQ ID NO: 3681432 - RNA, 12 nt, Salmonella enterica enterica serovar Typhi Ty2
ucgcguuacggc

SEQ ID NO: 3681433 - RNA, 15 nt, Salmonella enterica enterica serovar Typhi Ty2
ucgcuaacccaggcc

SEQ ID NO: 3681434 - RNA, 14 nt, Salmonella enterica enterica serovar Typhi Ty2
ucgcuaauaaauuc

SEQ ID NO: 3681435 - RNA, 20 nt, Salmonella enterica enterica serovar Typhi Ty2
ucgcuacaaccagcgcggcc

SEQ ID NO: 3681436 - RNA, 22 nt, Salmonella enterica enterica serovar Typhi Ty2
ucgcuaccacagaaaucgccgg

SEQ ID NO: 3681437 - RNA, 19 nt, Salmonella enterica enterica serovar Typhi Ty2
ucgcuaccuuuuuucagua

SEQ ID NO: 3681438 - RNA, 15 nt, Salmonella enterica enterica serovar Typhi Ty2
ucgcuacugcaucug

SEQ ID NO: 3681439 - RNA, 16 nt, Salmonella enterica enterica serovar Typhi Ty2
ucgcuauauacccccu

SEQ ID NO: 3681440 - RNA, 17 nt, Salmonella enterica enterica serovar Typhi Ty2
ucgcuauauugcugcgc

SEQ ID NO: 3681441 - RNA, 13 nt, Salmonella enterica enterica serovar Typhi Ty2
ucgcuauccagca

SEQ ID NO: 3681442 - RNA, 22 nt, Salmonella enterica enterica serovar Typhi Ty2
ucgcuauccgcauauguuuagu

SEQ ID NO: 3681443 - RNA, 22 nt, Salmonella enterica enterica serovar Typhi Ty2
ucgcuaucugacagccaaacug

SEQ ID NO: 3681444 - RNA, 14 nt, Salmonella enterica enterica serovar Typhi Ty2
ucgcucaucaggcg

SEQ ID NO: 3681445 - RNA, 16 nt, Salmonella enterica enterica serovar Typhi Ty2
ucgcucaucucaagcc

SEQ ID NO: 3681446 - RNA, 16 nt, Salmonella enterica enterica serovar Typhi Ty2
ucgcuccggaacgcga

SEQ ID NO: 3681447 - RNA, 21 nt, Salmonella enterica enterica serovar Typhi Ty2
ucgcuccucagcgcuuaccac

SEQ ID NO: 3681448 - RNA, 11 nt, Salmonella enterica enterica serovar Typhi Ty2
ucgcuccuccc

SEQ ID NO: 3681449 - RNA, 17 nt, Salmonella enterica enterica serovar Typhi Ty2
ucgcucuauauccugcc

SEQ ID NO: 3681450 - RNA, 15 nt, Salmonella enterica enterica serovar Typhi Ty2
ucgcucuaucgccug

SEQ ID NO: 3681451 - RNA, 17 nt, Salmonella enterica enterica serovar Typhi Ty2
ucgcucucuuucaccag

SEQ ID NO: 3681452 - RNA, 18 nt, Salmonella enterica enterica serovar Typhi Ty2
ucgcucuuucucgggcgu

SEQ ID NO: 3681453 - RNA, 17 nt, Salmonella enterica enterica serovar Typhi Ty2
ucgcugaauaaugccuu

SEQ ID NO: 3681454 - RNA, 18 nt, Salmonella enterica enterica serovar Typhi Ty2
ucgcugaauuucucguga

SEQ ID NO: 3681455 - RNA, 17 nt, Salmonella enterica enterica serovar Typhi Ty2
ucgcugacauugcuacg

SEQ ID NO: 3681456 - RNA, 21 nt, Salmonella enterica enterica serovar Typhi Ty2
ucgcugacgccgaccaccgcc

SEQ ID NO: 3681457 - RNA, 16 nt, Salmonella enterica enterica serovar Typhi Ty2
ucgcugccgaccuggc

SEQ ID NO: 3681458 - RNA, 15 nt, Salmonella enterica enterica serovar Typhi Ty2
ucgcugcugcuuuuu

SEQ ID NO: 3681459 - RNA, 18 nt, Salmonella enterica enterica serovar Typhi Ty2
ucgcuggucagcgcaauc

SEQ ID NO: 3681460 - RNA, 17 nt, Salmonella enterica enterica serovar Typhi Ty2
ucgcuggugugcagcca

SEQ ID NO: 3681461 - RNA, 18 nt, Salmonella enterica enterica serovar Typhi Ty2
ucgcuguauuucccucuc

SEQ ID NO: 3681462 - RNA, 14 nt, Salmonella enterica enterica serovar Typhi Ty2
ucgcuguccgggua

SEQ ID NO: 3681463 - RNA, 20 nt, Salmonella enterica enterica serovar Typhi Ty2
ucgcugucggucagauucag

SEQ ID NO: 3681464 - RNA, 13 nt, Salmonella enterica enterica serovar Typhi Ty2
ucgcuguggccag

SEQ ID NO: 3681465 - RNA, 15 nt, Salmonella enterica enterica serovar Typhi Ty2
ucgcuguggccaggc

SEQ ID NO: 3681466 - RNA, 19 nt, Salmonella enterica enterica serovar Typhi Ty2
ucgcugugguuuauccgca

SEQ ID NO: 3681467 - RNA, 20 nt, Salmonella enterica enterica serovar Typhi Ty2
ucgcuuaaacauauacugcu

SEQ ID NO: 3681468 - RNA, 23 nt, Salmonella enterica enterica serovar Typhi Ty2
ucgcuuaaauggcgaaagugaac

SEQ ID NO: 3681469 - RNA, 22 nt, Salmonella enterica enterica serovar Typhi Ty2
ucgcuuaacggcccaggcaucg

SEQ ID NO: 3681470 - RNA, 16 nt, Salmonella enterica enterica serovar Typhi Ty2
ucgcuuacgcggcgcg

SEQ ID NO: 3681471 - RNA, 13 nt, Salmonella enterica enterica serovar Typhi Ty2
ucgcuuaucuggc

SEQ ID NO: 3681472 - RNA, 21 nt, Salmonella enterica enterica serovar Typhi Ty2
ucgcuucaaucgugguuggca

SEQ ID NO: 3681473 - RNA, 14 nt, Salmonella enterica enterica serovar Typhi Ty2
ucgcuuccagcgcc

SEQ ID NO: 3681474 - RNA, 19 nt, Salmonella enterica enterica serovar Typhi Ty2
ucgcuugcccagcauauua

SEQ ID NO: 3681475 - RNA, 23 nt, Salmonella enterica enterica serovar Typhi Ty2
ucgcuuguugacgacuuuugcaa

SEQ ID NO: 3681476 - RNA, 17 nt, Salmonella enterica enterica serovar Typhi Ty2
ucgcuuuacccgggcca

SEQ ID NO: 3681477 - RNA, 18 nt, Salmonella enterica enterica serovar Typhi Ty2
uugccacauuucccgagc

SEQ ID NO: 3681478 - RNA, 16 nt, Salmonella enterica enterica serovar Typhi Ty2
uugccacgccauacgu

SEQ ID NO: 3681479 - RNA, 20 nt, Salmonella enterica enterica serovar Typhi Ty2
uugccacuacgcagcuccag

SEQ ID NO: 3681480 - RNA, 13 nt, Salmonella enterica enterica serovar Typhi Ty2
uugccacuggccu

SEQ ID NO: 3681481 - RNA, 20 nt, Salmonella enterica enterica serovar Typhi Ty2
uugccacuggcuuuccugau

SEQ ID NO: 3681482 - RNA, 20 nt, Salmonella enterica enterica serovar Typhi Ty2
uugccagagagaugccgccg

SEQ ID NO: 3681483 - RNA, 19 nt, Salmonella enterica enterica serovar Typhi Ty2
uugccagagccccaaugcu

SEQ ID NO: 3681484 - RNA, 17 nt, Salmonella enterica enterica serovar Typhi Ty2
uugccagcggccagggc

SEQ ID NO: 3681485 - RNA, 22 nt, Salmonella enterica enterica serovar Typhi Ty2
uugccauaaauacaauucaacu

SEQ ID NO: 3681486 - RNA, 15 nt, Salmonella enterica enterica serovar Typhi Ty2
uugccauauugccgc

SEQ ID NO: 3681487 - RNA, 22 nt, Salmonella enterica enterica serovar Typhi Ty2
uugccaucggauauauuuuacc

SEQ ID NO: 3681488 - RNA, 13 nt, Salmonella enterica enterica serovar Typhi Ty2
uugccauucgcca

SEQ ID NO: 3681489 - RNA, 15 nt, Salmonella enterica enterica serovar Typhi Ty2
uugccccgcuuucag

SEQ ID NO: 3681490 - RNA, 24 nt, Salmonella enterica enterica serovar Typhi Ty2
uugccccgcuuucagcguugcagc

SEQ ID NO: 3681491 - RNA, 23 nt, Salmonella enterica enterica serovar Typhi Ty2
uugccccguggcgggaugcccca

SEQ ID NO: 3681492 - RNA, 22 nt, Salmonella enterica enterica serovar Typhi Ty2
uugccccucccugaaucauauu

SEQ ID NO: 3681493 - RNA, 23 nt, Salmonella enterica enterica serovar Typhi Ty2
uugcccgcaggcuuccagauaca

SEQ ID NO: 3681494 - RNA, 22 nt, Salmonella enterica enterica serovar Typhi Ty2
uugcccggccguuaccguggcg

SEQ ID NO: 3681495 - RNA, 20 nt, Salmonella enterica enterica serovar Typhi Ty2
uugcccgguggcgcugcgcu

SEQ ID NO: 3681496 - RNA, 18 nt, Salmonella enterica enterica serovar Typhi Ty2
uugcccuggaauuuuucc

SEQ ID NO: 3681497 - RNA, 17 nt, Salmonella enterica enterica serovar Typhi Ty2
uugccgacagaacugau

SEQ ID NO: 3681498 - RNA, 22 nt, Salmonella enterica enterica serovar Typhi Ty2
uugccgcaauugguaauuaaag

SEQ ID NO: 3681499 - RNA, 14 nt, Salmonella enterica enterica serovar Typhi Ty2
uugccgcaggcaac

SEQ ID NO: 3681500 - RNA, 12 nt, Salmonella enterica enterica serovar Typhi Ty2
uugccgccauca

SEQ ID NO: 3681501 - RNA, 23 nt, Salmonella enterica enterica serovar Typhi Ty2
uugccgccuugguugccgcauaa

SEQ ID NO: 3681502 - RNA, 24 nt, Salmonella enterica enterica serovar Typhi Ty2
uugccgcgccagacgccauaucgc

SEQ ID NO: 3681503 - RNA, 20 nt, Salmonella enterica enterica serovar Typhi Ty2
uugccgcgcggauucuccag

SEQ ID NO: 3681504 - RNA, 20 nt, Salmonella enterica enterica serovar Typhi Ty2
uugccggauggcacugcgcu

SEQ ID NO: 3681505 - RNA, 17 nt, Salmonella enterica enterica serovar Typhi Ty2
uugccggauggcgcuuu

SEQ ID NO: 3681506 - RNA, 17 nt, Salmonella enterica enterica serovar Typhi Ty2
uugccgguuaacucuuu

SEQ ID NO: 3681507 - RNA, 21 nt, Salmonella enterica enterica serovar Typhi Ty2
uugccgguuuuuuuuugccug

SEQ ID NO: 3681508 - RNA, 23 nt, Salmonella enterica enterica serovar Typhi Ty2
uugccgucaaacgcuaucaccgc

SEQ ID NO: 3681509 - RNA, 23 nt, Salmonella enterica enterica serovar Typhi Ty2
uugccgucgccggaaugcgaaua

SEQ ID NO: 3681510 - RNA, 18 nt, Salmonella enterica enterica serovar Typhi Ty2
uugccgugaauauucaga

SEQ ID NO: 3681511 - RNA, 18 nt, Salmonella enterica enterica serovar Typhi Ty2
uugccguuaacugcugcu

SEQ ID NO: 3681512 - RNA, 19 nt, Salmonella enterica enterica serovar Typhi Ty2
uugccucgucuugauuuca

SEQ ID NO: 3681513 - RNA, 13 nt, Salmonella enterica enterica serovar Typhi Ty2
uugccugauggcg

SEQ ID NO: 3681514 - RNA, 13 nt, Salmonella enterica enterica serovar Typhi Ty2
uugccuuccugau

SEQ ID NO: 3681515 - RNA, 15 nt, Salmonella enterica enterica serovar Typhi Ty2
uugccuuucagaucg

SEQ ID NO: 3681516 - RNA, 17 nt, Salmonella enterica enterica serovar Typhi Ty2
uugcgacaaccuguagg

SEQ ID NO: 3681517 - RNA, 21 nt, Salmonella enterica enterica serovar Typhi Ty2
uugcgacaagcucauuuccca

SEQ ID NO: 3681518 - RNA, 19 nt, Salmonella enterica enterica serovar Typhi Ty2
uugcgacuguucaucaaag

SEQ ID NO: 3681519 - RNA, 20 nt, Salmonella enterica enterica serovar Typhi Ty2
uugcgauuuguccgcugcug

SEQ ID NO: 3681520 - RNA, 21 nt, Salmonella enterica enterica serovar Typhi Ty2
uugcgcagcaacgucucgaca

SEQ ID NO: 3681521 - RNA, 16 nt, Salmonella enterica enterica serovar Typhi Ty2
uugcgccagcccggcg

SEQ ID NO: 3681522 - RNA, 14 nt, Salmonella enterica enterica serovar Typhi Ty2
uugcgccagcgcca

SEQ ID NO: 3681523 - RNA, 22 nt, Salmonella enterica enterica serovar Typhi Ty2
uugcgccauccuuaauugccgc

SEQ ID NO: 3681524 - RNA, 13 nt, Salmonella enterica enterica serovar Typhi Ty2
aaaaaaacgcauu

SEQ ID NO: 3681525 - RNA, 13 nt, Salmonella enterica enterica serovar Typhi Ty2
aaaaaaacgccgc

SEQ ID NO: 3681526 - RNA, 10 nt, Salmonella enterica enterica serovar Typhi Ty2
aaaaaacagg

SEQ ID NO: 3681527 - RNA, 15 nt, Salmonella enterica enterica serovar Typhi Ty2
aaaaaacauauaauu

SEQ ID NO: 3681528 - RNA, 12 nt, Salmonella enterica enterica serovar Typhi Ty2
aaaaaacaucau

SEQ ID NO: 3681529 - RNA, 19 nt, Salmonella enterica enterica serovar Typhi Ty2
aaaaaaccggcaacucgcc

SEQ ID NO: 3681530 - RNA, 17 nt, Salmonella enterica enterica serovar Typhi Ty2
aaaaaacggaaccaaaa

SEQ ID NO: 3681531 - RNA, 11 nt, Salmonella enterica enterica serovar Typhi Ty2
aaaaaagagaa

SEQ ID NO: 3681532 - RNA, 13 nt, Salmonella enterica enterica serovar Typhi Ty2
aaaaaagagaagc

SEQ ID NO: 3681533 - RNA, 20 nt, Salmonella enterica enterica serovar Typhi Ty2
aaaaaagccguauuuuauuu

SEQ ID NO: 3681534 - RNA, 22 nt, Salmonella enterica enterica serovar Typhi Ty2
aaaaaagcugcgaucaaguuuu

SEQ ID NO: 3681535 - RNA, 21 nt, Salmonella enterica enterica serovar Typhi Ty2
aaaaaagucacuuacuuucuu

SEQ ID NO: 3681536 - RNA, 18 nt, Salmonella enterica enterica serovar Typhi Ty2
aaaaaaguuauuuuuucu

SEQ ID NO: 3681537 - RNA, 13 nt, Salmonella enterica enterica serovar Typhi Ty2
aaaaaauaucucu

SEQ ID NO: 3681538 - RNA, 16 nt, Salmonella enterica enterica serovar Typhi Ty2
aaaaaaugagaacacc

SEQ ID NO: 3681539 - RNA, 12 nt, Salmonella enterica enterica serovar Typhi Ty2
aaaaaauuacga

SEQ ID NO: 3681540 - RNA, 11 nt, Salmonella enterica enterica serovar Typhi Ty2
aaaaacaaggg

SEQ ID NO: 3681541 - RNA, 16 nt, Salmonella enterica enterica serovar Typhi Ty2
aaaaacacuggcgcuc

SEQ ID NO: 3681542 - RNA, 11 nt, Salmonella enterica enterica serovar Typhi Ty2
aaaaacaucau

SEQ ID NO: 3681543 - RNA, 17 nt, Salmonella enterica enterica serovar Typhi Ty2
aaaacugucccugaugu

SEQ ID NO: 3681544 - RNA, 14 nt, Salmonella enterica enterica serovar Typhi Ty2
aaaacuuauuuuau

SEQ ID NO: 3681545 - RNA, 19 nt, Salmonella enterica enterica serovar Typhi Ty2
aaaacuuuaacacuaacua

SEQ ID NO: 3681546 - RNA, 13 nt, Salmonella enterica enterica serovar Typhi Ty2
aaaagaaaaaacu

SEQ ID NO: 3681547 - RNA, 20 nt, Salmonella enterica enterica serovar Typhi Ty2
aaaagaaaaaacuuauuucu

SEQ ID NO: 3681548 - RNA, 15 nt, Salmonella enterica enterica serovar Typhi Ty2
aaaagaaaaaaguga

SEQ ID NO: 3681549 - RNA, 11 nt, Salmonella enterica enterica serovar Typhi Ty2
aaaagaaaaca

SEQ ID NO: 3681550 - RNA, 11 nt, Salmonella enterica enterica serovar Typhi Ty2
aaaagaaacug

SEQ ID NO: 3681551 - RNA, 15 nt, Salmonella enterica enterica serovar Typhi Ty2
aaaagaacucacuca

SEQ ID NO: 3681552 - RNA, 21 nt, Salmonella enterica enterica serovar Typhi Ty2
aaaagaauagccggauaaaau

SEQ ID NO: 3681553 - RNA, 23 nt, Salmonella enterica enterica serovar Typhi Ty2
aaaagaaugucccaguaauaucg

SEQ ID NO: 3681554 - RNA, 20 nt, Salmonella enterica enterica serovar Typhi Ty2
aaaagaccauccgguuuuaa

SEQ ID NO: 3681555 - RNA, 17 nt, Salmonella enterica enterica serovar Typhi Ty2
aaaagagcuuauuuuga

SEQ ID NO: 3681556 - RNA, 15 nt, Salmonella enterica enterica serovar Typhi Ty2
aaaagaguaaaguua

SEQ ID NO: 3681557 - RNA, 23 nt, Salmonella enterica enterica serovar Typhi Ty2
aaaagaguaaaguuauucacgua

SEQ ID NO: 3681558 - RNA, 15 nt, Salmonella enterica enterica serovar Typhi Ty2
aaaagauaaaaaaau

SEQ ID NO: 3681559 - RNA, 17 nt, Salmonella enterica enterica serovar Typhi Ty2
aaaagauauuauaaaau

SEQ ID NO: 3681560 - RNA, 13 nt, Salmonella enterica enterica serovar Typhi Ty2
aaaagcaaagagg

SEQ ID NO: 3681561 - RNA, 13 nt, Salmonella enterica enterica serovar Typhi Ty2
aaaagcaauaauc

SEQ ID NO: 3681562 - RNA, 17 nt, Salmonella enterica enterica serovar Typhi Ty2
aaaagcagaggccugaa

SEQ ID NO: 3681563 - RNA, 11 nt, Salmonella enterica enterica serovar Typhi Ty2
aaaagcagcau

SEQ ID NO: 3681564 - RNA, 18 nt, Salmonella enterica enterica serovar Typhi Ty2
aaaagcaucguaccuuca

SEQ ID NO: 3681565 - RNA, 18 nt, Salmonella enterica enterica serovar Typhi Ty2
aaaagccaagcacaaaaa

SEQ ID NO: 3681566 - RNA, 19 nt, Salmonella enterica enterica serovar Typhi Ty2
aaaagccacgcaagcagca

SEQ ID NO: 3681567 - RNA, 17 nt, Salmonella enterica enterica serovar Typhi Ty2
aaaagccagauaaagca

SEQ ID NO: 3681568 - RNA, 22 nt, Salmonella enterica enterica serovar Typhi Ty2
aaaagccagcacggcuucacgu

SEQ ID NO: 3681569 - RNA, 16 nt, Salmonella enterica enterica serovar Typhi Ty2
aaaagccgugaauaaa

SEQ ID NO: 3681570 - RNA, 14 nt, Salmonella enterica enterica serovar Typhi Ty2
aaaagcgacgcugu

SEQ ID NO: 3681571 - RNA, 15 nt, Salmonella enterica enterica serovar Typhi Ty2
aaaagcgccccuggg

SEQ ID NO: 3681572 - RNA, 15 nt, Salmonella enterica enterica serovar Typhi Ty2
aaaagcgcgggcugg

SEQ ID NO: 3681573 - RNA, 14 nt, Salmonella enterica enterica serovar Typhi Ty2
aaaagcggauaaga

SEQ ID NO: 3681574 - RNA, 19 nt, Salmonella enterica enterica serovar Typhi Ty2
aaaagcugcgaucaaguuu

SEQ ID NO: 3681575 - RNA, 12 nt, Salmonella enterica enterica serovar Typhi Ty2
aaaagcugguau

SEQ ID NO: 3681576 - RNA, 22 nt, Salmonella enterica enterica serovar Typhi Ty2
aaaagcugguauugaauauuug

SEQ ID NO: 3681577 - RNA, 19 nt, Salmonella enterica enterica serovar Typhi Ty2
aaaagcuguagcauaaaug

SEQ ID NO: 3681578 - RNA, 20 nt, Salmonella enterica enterica serovar Typhi Ty2
aaaagcuguagcauaaaugc

SEQ ID NO: 3681579 - RNA, 18 nt, Salmonella enterica enterica serovar Typhi Ty2
aaaaggcgguucccgggc

SEQ ID NO: 3681580 - RNA, 21 nt, Salmonella enterica enterica serovar Typhi Ty2
aaaaggucgacauuuaaugag

SEQ ID NO: 3681581 - RNA, 20 nt, Salmonella enterica enterica serovar Typhi Ty2
aaaagguuagguuaaauagu

SEQ ID NO: 3681582 - RNA, 23 nt, Salmonella enterica enterica serovar Typhi Ty2
aaaaguaucucgccaguaaagac

SEQ ID NO: 3681583 - RNA, 19 nt, Salmonella enterica enterica serovar Typhi Ty2
aaaaguguguaccagcagc

SEQ ID NO: 3681584 - RNA, 18 nt, Salmonella enterica enterica serovar Typhi Ty2
aaaauaaaauuauauucu

SEQ ID NO: 3681585 - RNA, 18 nt, Salmonella enterica enterica serovar Typhi Ty2
aaaauaaacacuaaauca

SEQ ID NO: 3681586 - RNA, 21 nt, Salmonella enterica enterica serovar Typhi Ty2
aaaauaacaauauuaaauaaa

SEQ ID NO: 3681587 - RNA, 13 nt, Salmonella enterica enterica serovar Typhi Ty2
aaaauaauaaaaa

SEQ ID NO: 3681588 - RNA, 17 nt, Salmonella enterica enterica serovar Typhi Ty2
aaaauaauaaucguuuu

SEQ ID NO: 3681589 - RNA, 13 nt, Salmonella enterica enterica serovar Typhi Ty2
aaaauaauaggua

SEQ ID NO: 3681590 - RNA, 13 nt, Salmonella enterica enterica serovar Typhi Ty2
aaaauaauccgcu

SEQ ID NO: 3681591 - RNA, 15 nt, Salmonella enterica enterica serovar Typhi Ty2
aaaauaccccagcgc

SEQ ID NO: 3681592 - RNA, 13 nt, Salmonella enterica enterica serovar Typhi Ty2
aaaauacccgacc

SEQ ID NO: 3681593 - RNA, 14 nt, Salmonella enterica enterica serovar Typhi Ty2
aaaauaccggcagc

SEQ ID NO: 3681594 - RNA, 17 nt, Salmonella enterica enterica serovar Typhi Ty2
aaaauacuuccauuccc

SEQ ID NO: 3681595 - RNA, 21 nt, Salmonella enterica enterica serovar Typhi Ty2
aaaauagcccggcuucccauc

SEQ ID NO: 3681596 - RNA, 23 nt, Salmonella enterica enterica serovar Typhi Ty2
aaaauagccgaaacuuauacuga

SEQ ID NO: 3681597 - RNA, 10 nt, Salmonella enterica enterica serovar Typhi Ty2
aaaauagcgg

SEQ ID NO: 3681598 - RNA, 15 nt, Salmonella enterica enterica serovar Typhi Ty2
aaaauagcuggcugu

SEQ ID NO: 3681599 - RNA, 17 nt, Salmonella enterica enterica serovar Typhi Ty2
aaaauaguucagcgcag

SEQ ID NO: 3681600 - RNA, 19 nt, Salmonella enterica enterica serovar Typhi Ty2
aaaauauccgccaucgaca

SEQ ID NO: 3681601 - RNA, 24 nt, Salmonella enterica enterica serovar Typhi Ty2
aaaauaucggccugaaugcucuca

SEQ ID NO: 3681602 - RNA, 13 nt, Salmonella enterica enterica serovar Typhi Ty2
aaaaucaccacac

SEQ ID NO: 3681603 - RNA, 23 nt, Salmonella enterica enterica serovar Typhi Ty2
aaaaucacgcuggauaagacgac

SEQ ID NO: 3681604 - RNA, 21 nt, Salmonella enterica enterica serovar Typhi Ty2
aaaaucacuaagaccagcauc

SEQ ID NO: 3681605 - RNA, 19 nt, Salmonella enterica enterica serovar Typhi Ty2
aaaauccggaucaucuuuu

SEQ ID NO: 3681606 - RNA, 18 nt, Salmonella enterica enterica serovar Typhi Ty2
aaaauccuucuuccauuc

SEQ ID NO: 3681607 - RNA, 19 nt, Salmonella enterica enterica serovar Typhi Ty2
aaaauccuuguugauaaaa

SEQ ID NO: 3681608 - RNA, 22 nt, Salmonella enterica enterica serovar Typhi Ty2
aaaauccuuuuucaugcaauaa

SEQ ID NO: 3681609 - RNA, 22 nt, Salmonella enterica enterica serovar Typhi Ty2
aaaaucggggucuuccagcaga

SEQ ID NO: 3681610 - RNA, 19 nt, Salmonella enterica enterica serovar Typhi Ty2
aaaaucguuaaccagcggc

SEQ ID NO: 3681611 - RNA, 14 nt, Salmonella enterica enterica serovar Typhi Ty2
aaaaugaauaccaa

SEQ ID NO: 3681612 - RNA, 16 nt, Salmonella enterica enterica serovar Typhi Ty2
aaaaugaugcaacaug

SEQ ID NO: 3681613 - RNA, 14 nt, Salmonella enterica enterica serovar Typhi Ty2
aaaaugccccacga

SEQ ID NO: 3681614 - RNA, 21 nt, Salmonella enterica enterica serovar Typhi Ty2
aaaauggaugcgcccacaaug

SEQ ID NO: 3681615 - RNA, 17 nt, Salmonella enterica enterica serovar Typhi Ty2
aaaauggcaaguaaaau

SEQ ID NO: 3681616 - RNA, 21 nt, Salmonella enterica enterica serovar Typhi Ty2
aaaauggcaaguaaaauagcc

SEQ ID NO: 3681617 - RNA, 23 nt, Salmonella enterica enterica serovar Typhi Ty2
aaaauggggaucgucugcaaaac

SEQ ID NO: 3681618 - RNA, 19 nt, Salmonella enterica enterica serovar Typhi Ty2
aaaauggucugccaguagc

SEQ ID NO: 3681619 - RNA, 13 nt, Salmonella enterica enterica serovar Typhi Ty2
aaaauguucaugu

SEQ ID NO: 3681620 - RNA, 22 nt, Salmonella enterica enterica serovar Typhi Ty2
aaaauguuuuuguuguuaauuu

SEQ ID NO: 3681621 - RNA, 22 nt, Salmonella enterica enterica serovar Typhi Ty2
aaaauuaacgacaaaaauacca

SEQ ID NO: 3681622 - RNA, 14 nt, Salmonella enterica enterica serovar Typhi Ty2
aaaauuaaucccaa

SEQ ID NO: 3681623 - RNA, 21 nt, Salmonella enterica enterica serovar Typhi Ty2
aaaauuaaucccaacccgacc

SEQ ID NO: 3681624 - RNA, 19 nt, Salmonella enterica enterica serovar Typhi Ty2
aaaauuaugaauaaccauc

SEQ ID NO: 3681625 - RNA, 13 nt, Salmonella enterica enterica serovar Typhi Ty2
aaacgcacccgcg

SEQ ID NO: 3681626 - RNA, 15 nt, Salmonella enterica enterica serovar Typhi Ty2
aaacgcagcaaacgc

SEQ ID NO: 3681627 - RNA, 23 nt, Salmonella enterica enterica serovar Typhi Ty2
aaacgccauugcgaacaucacga

SEQ ID NO: 3681628 - RNA, 15 nt, Salmonella enterica enterica serovar Typhi Ty2
aaacgccgaagccag

SEQ ID NO: 3681629 - RNA, 22 nt, Salmonella enterica enterica serovar Typhi Ty2
aaacgccgauggcgccagauac

SEQ ID NO: 3681630 - RNA, 16 nt, Salmonella enterica enterica serovar Typhi Ty2
aaacgccgcagaaaau

SEQ ID NO: 3681631 - RNA, 15 nt, Salmonella enterica enterica serovar Typhi Ty2
aaacgccgucacaaa

SEQ ID NO: 3681632 - RNA, 14 nt, Salmonella enterica enterica serovar Typhi Ty2
aaacgccucauccg

SEQ ID NO: 3681633 - RNA, 12 nt, Salmonella enterica enterica serovar Typhi Ty2
aaacgccuguaa

SEQ ID NO: 3681634 - RNA, 15 nt, Salmonella enterica enterica serovar Typhi Ty2
aaacgcgcuaucaac

SEQ ID NO: 3681635 - RNA, 17 nt, Salmonella enterica enterica serovar Typhi Ty2
aaacgcggacauauuuu

SEQ ID NO: 3681636 - RNA, 23 nt, Salmonella enterica enterica serovar Typhi Ty2
aaacgcgucuucaucagccagca

SEQ ID NO: 3681637 - RNA, 16 nt, Salmonella enterica enterica serovar Typhi Ty2
aaacgcuauuuaaccc

SEQ ID NO: 3681638 - RNA, 13 nt, Salmonella enterica enterica serovar Typhi Ty2
aaacgcugcgcaa

SEQ ID NO: 3681639 - RNA, 12 nt, Salmonella enterica enterica serovar Typhi Ty2
aaacgcuuuuuu

SEQ ID NO: 3681640 - RNA, 14 nt, Salmonella enterica enterica serovar Typhi Ty2
aaacggcccggcgu

SEQ ID NO: 3681641 - RNA, 17 nt, Salmonella enterica enterica serovar Typhi Ty2
aaacggccugcgcugga

SEQ ID NO: 3681642 - RNA, 20 nt, Salmonella enterica enterica serovar Typhi Ty2
aaacggcuuuaauaccccug

SEQ ID NO: 3681643 - RNA, 14 nt, Salmonella enterica enterica serovar Typhi Ty2
aaacgggcgcggca

SEQ ID NO: 3681644 - RNA, 18 nt, Salmonella enterica enterica serovar Typhi Ty2
aaacgggugagacauguu

SEQ ID NO: 3681645 - RNA, 15 nt, Salmonella enterica enterica serovar Typhi Ty2
aaacgguaugaaaca

SEQ ID NO: 3681646 - RNA, 16 nt, Salmonella enterica enterica serovar Typhi Ty2
aaacguaccugagaga

SEQ ID NO: 3681647 - RNA, 18 nt, Salmonella enterica enterica serovar Typhi Ty2
aacagccauuuuaaaaau

SEQ ID NO: 3681648 - RNA, 16 nt, Salmonella enterica enterica serovar Typhi Ty2
aacagcccgauaaaca

SEQ ID NO: 3681649 - RNA, 20 nt, Salmonella enterica enterica serovar Typhi Ty2
aacagcgaucacgccgucca

SEQ ID NO: 3681650 - RNA, 23 nt, Salmonella enterica enterica serovar Typhi Ty2
aacagcgaucacgccguccagca

SEQ ID NO: 3681651 - RNA, 15 nt, Salmonella enterica enterica serovar Typhi Ty2
aacagcgccaucagg

SEQ ID NO: 3681652 - RNA, 17 nt, Salmonella enterica enterica serovar Typhi Ty2
aacagcgccaucaggaa

SEQ ID NO: 3681653 - RNA, 20 nt, Salmonella enterica enterica serovar Typhi Ty2
aacagcgccggcagcaguuc

SEQ ID NO: 3681654 - RNA, 19 nt, Salmonella enterica enterica serovar Typhi Ty2
aacagcgcuaucaggaaga

SEQ ID NO: 3681655 - RNA, 12 nt, Salmonella enterica enterica serovar Typhi Ty2
aacagcgcucca

SEQ ID NO: 3681656 - RNA, 18 nt, Salmonella enterica enterica serovar Typhi Ty2
aacagcgcugguagcacc

SEQ ID NO: 3681657 - RNA, 21 nt, Salmonella enterica enterica serovar Typhi Ty2
aacagcgggguaaagccuuua

SEQ ID NO: 3681658 - RNA, 15 nt, Salmonella enterica enterica serovar Typhi Ty2
aacaggccugcggaa

SEQ ID NO: 3681659 - RNA, 21 nt, Salmonella enterica enterica serovar Typhi Ty2
aacaggccugcggaaaaaguc

SEQ ID NO: 3681660 - RNA, 13 nt, Salmonella enterica enterica serovar Typhi Ty2
aacaggcgaaaac

SEQ ID NO: 3681661 - RNA, 23 nt, Salmonella enterica enterica serovar Typhi Ty2
aacaggcgcaggcauuaaaaaaa

SEQ ID NO: 3681662 - RNA, 23 nt, Salmonella enterica enterica serovar Typhi Ty2
aacaggcugcguaacgcgccgga

SEQ ID NO: 3681663 - RNA, 22 nt, Salmonella enterica enterica serovar Typhi Ty2
aacaggcugucugccaugccuu

SEQ ID NO: 3681664 - RNA, 15 nt, Salmonella enterica enterica serovar Typhi Ty2
aacaggcuucccaau

SEQ ID NO: 3681665 - RNA, 19 nt, Salmonella enterica enterica serovar Typhi Ty2
aacaggcuuuauacaguaa

SEQ ID NO: 3681666 - RNA, 16 nt, Salmonella enterica enterica serovar Typhi Ty2
aacaggcuuuucaggc

SEQ ID NO: 3681667 - RNA, 19 nt, Salmonella enterica enterica serovar Typhi Ty2
aacaggcuuuucaggcugu

SEQ ID NO: 3681668 - RNA, 20 nt, Salmonella enterica enterica serovar Typhi Ty2
aacagggcggccuccuggcu

SEQ ID NO: 3681669 - RNA, 16 nt, Salmonella enterica enterica serovar Typhi Ty2
aacagguacuuaccca

SEQ ID NO: 3681670 - RNA, 17 nt, Salmonella enterica enterica serovar Typhi Ty2
aacagguaguuaccgua

SEQ ID NO: 3681671 - RNA, 13 nt, Salmonella enterica enterica serovar Typhi Ty2
aacaggucacaug

SEQ ID NO: 3681672 - RNA, 15 nt, Salmonella enterica enterica serovar Typhi Ty2
aacaguaccugauaa

SEQ ID NO: 3681673 - RNA, 19 nt, Salmonella enterica enterica serovar Typhi Ty2
aacaguaccugauaaaauu

SEQ ID NO: 3681674 - RNA, 17 nt, Salmonella enterica enterica serovar Typhi Ty2
aacagucgcgccgugcc

SEQ ID NO: 3681675 - RNA, 22 nt, Salmonella enterica enterica serovar Typhi Ty2
aacagucgcgccgugcccagca

SEQ ID NO: 3681676 - RNA, 16 nt, Salmonella enterica enterica serovar Typhi Ty2
aacagugacaaacuca

SEQ ID NO: 3681677 - RNA, 22 nt, Salmonella enterica enterica serovar Typhi Ty2
aacagugggcuaugaagagaaa

SEQ ID NO: 3681678 - RNA, 19 nt, Salmonella enterica enterica serovar Typhi Ty2
aacaguucaaacggcccgg

SEQ ID NO: 3681679 - RNA, 22 nt, Salmonella enterica enterica serovar Typhi Ty2
aacaguucauuucaggcaaagg

SEQ ID NO: 3681680 - RNA, 16 nt, Salmonella enterica enterica serovar Typhi Ty2
aacaguuuuuccuuuc

SEQ ID NO: 3681681 - RNA, 17 nt, Salmonella enterica enterica serovar Typhi Ty2
aacaguuuuuccuuucu

SEQ ID NO: 3681682 - RNA, 13 nt, Salmonella enterica enterica serovar Typhi Ty2
aacauaaacaaug

SEQ ID NO: 3681683 - RNA, 14 nt, Salmonella enterica enterica serovar Typhi Ty2
aacauaaccggaau

SEQ ID NO: 3681684 - RNA, 17 nt, Salmonella enterica enterica serovar Typhi Ty2
aacauagcaucguuacc

SEQ ID NO: 3681685 - RNA, 17 nt, Salmonella enterica enterica serovar Typhi Ty2
aacauagcuaaauaaaa

SEQ ID NO: 3681686 - RNA, 21 nt, Salmonella enterica enterica serovar Typhi Ty2
aacauagcuaaauaaaaauaa

SEQ ID NO: 3681687 - RNA, 18 nt, Salmonella enterica enterica serovar Typhi Ty2
aacauagcuuacuuuuag

SEQ ID NO: 3681688 - RNA, 12 nt, Salmonella enterica enterica serovar Typhi Ty2
aacauauauauc

SEQ ID NO: 3681689 - RNA, 12 nt, Salmonella enterica enterica serovar Typhi Ty2
aacauaucgccg

SEQ ID NO: 3681690 - RNA, 13 nt, Salmonella enterica enterica serovar Typhi Ty2
aacauauuuuuau

SEQ ID NO: 3681691 - RNA, 22 nt, Salmonella enterica enterica serovar Typhi Ty2
aacauauuuuuaugcacgcuau

SEQ ID NO: 3681692 - RNA, 19 nt, Salmonella enterica enterica serovar Typhi Ty2
aacauauuuuucacacaua

SEQ ID NO: 3681693 - RNA, 23 nt, Salmonella enterica enterica serovar Typhi Ty2
aacauauuuuucacacauaagca

SEQ ID NO: 3681694 - RNA, 16 nt, Salmonella enterica enterica serovar Typhi Ty2
aacaucaccuuucauu

SEQ ID NO: 3681695 - RNA, 19 nt, Salmonella enterica enterica serovar Typhi Ty2
aacaucagaaaaaagccaa

SEQ ID NO: 3681696 - RNA, 22 nt, Salmonella enterica enterica serovar Typhi Ty2
aacaucagacaguacggaugau

SEQ ID NO: 3681697 - RNA, 16 nt, Salmonella enterica enterica serovar Typhi Ty2
aacaucagccagcagc

SEQ ID NO: 3681698 - RNA, 14 nt, Salmonella enterica enterica serovar Typhi Ty2
aacaucagcgcuac

SEQ ID NO: 3681699 - RNA, 15 nt, Salmonella enterica enterica serovar Typhi Ty2
aacaucagcgcuacc

SEQ ID NO: 3681700 - RNA, 20 nt, Salmonella enterica enterica serovar Typhi Ty2
aacaucagcgcuaccagcgc

SEQ ID NO: 3681701 - RNA, 19 nt, Salmonella enterica enterica serovar Typhi Ty2
aacaucaucaggccugacu

SEQ ID NO: 3681702 - RNA, 12 nt, Salmonella enterica enterica serovar Typhi Ty2
aacaucauuauu

SEQ ID NO: 3681703 - RNA, 23 nt, Salmonella enterica enterica serovar Typhi Ty2
aacaucauucccguaucuucaug

SEQ ID NO: 3681704 - RNA, 16 nt, Salmonella enterica enterica serovar Typhi Ty2
aacaucccagaaaaug

SEQ ID NO: 3681705 - RNA, 18 nt, Salmonella enterica enterica serovar Typhi Ty2
aacauccucuccugaagc

SEQ ID NO: 3681706 - RNA, 19 nt, Salmonella enterica enterica serovar Typhi Ty2
aacauccuggguuugcuga

SEQ ID NO: 3681707 - RNA, 17 nt, Salmonella enterica enterica serovar Typhi Ty2
aacaucgcaaaauuccg

SEQ ID NO: 3681708 - RNA, 19 nt, Salmonella enterica enterica serovar Typhi Ty2
aacaucgguuuguucauau

SEQ ID NO: 3681709 - RNA, 16 nt, Salmonella enterica enterica serovar Typhi Ty2
aacaucguaaaucaaa

SEQ ID NO: 3681710 - RNA, 16 nt, Salmonella enterica enterica serovar Typhi Ty2
aacaugaccagcgcaa

SEQ ID NO: 3681711 - RNA, 12 nt, Salmonella enterica enterica serovar Typhi Ty2
aacaugcauauu

SEQ ID NO: 3681712 - RNA, 14 nt, Salmonella enterica enterica serovar Typhi Ty2
aacaugcccaguuu

SEQ ID NO: 3681713 - RNA, 19 nt, Salmonella enterica enterica serovar Typhi Ty2
aacaugccugauggcgcug

SEQ ID NO: 3681714 - RNA, 14 nt, Salmonella enterica enterica serovar Typhi Ty2
aacauggggagcag

SEQ ID NO: 3681715 - RNA, 19 nt, Salmonella enterica enterica serovar Typhi Ty2
aacauguccuacacucaau

SEQ ID NO: 3681716 - RNA, 19 nt, Salmonella enterica enterica serovar Typhi Ty2
aacauuacaauguacagaa

SEQ ID NO: 3681717 - RNA, 18 nt, Salmonella enterica enterica serovar Typhi Ty2
aacauuauuaaaaugucu

SEQ ID NO: 3681718 - RNA, 13 nt, Salmonella enterica enterica serovar Typhi Ty2
aacauucagguuc

SEQ ID NO: 3681719 - RNA, 19 nt, Salmonella enterica enterica serovar Typhi Ty2
aacauuccgcccaagaaca

SEQ ID NO: 3681720 - RNA, 22 nt, Salmonella enterica enterica serovar Typhi Ty2
aacauugaggcuacccagacaa

SEQ ID NO: 3681721 - RNA, 14 nt, Salmonella enterica enterica serovar Typhi Ty2
aacauugcaggucu

SEQ ID NO: 3681722 - RNA, 21 nt, Salmonella enterica enterica serovar Typhi Ty2
aacauuggaaaacuccagcag

SEQ ID NO: 3681723 - RNA, 15 nt, Salmonella enterica enterica serovar Typhi Ty2
aacauuuaagauuua

SEQ ID NO: 3681724 - RNA, 14 nt, Salmonella enterica enterica serovar Typhi Ty2
aaccaaaugcccag

SEQ ID NO: 3681725 - RNA, 12 nt, Salmonella enterica enterica serovar Typhi Ty2
aaccaaugcagc

SEQ ID NO: 3681726 - RNA, 16 nt, Salmonella enterica enterica serovar Typhi Ty2
aaccacaugaccagcg

SEQ ID NO: 3681727 - RNA, 13 nt, Salmonella enterica enterica serovar Typhi Ty2
aaccaccagcagu

SEQ ID NO: 3681728 - RNA, 21 nt, Salmonella enterica enterica serovar Typhi Ty2
aaccaccggcgcgccagcgca

SEQ ID NO: 3681729 - RNA, 13 nt, Salmonella enterica enterica serovar Typhi Ty2
aaccacgaaaauu

SEQ ID NO: 3681730 - RNA, 17 nt, Salmonella enterica enterica serovar Typhi Ty2
aaccacgccaaccaucg

SEQ ID NO: 3681731 - RNA, 20 nt, Salmonella enterica enterica serovar Typhi Ty2
aaccacgccauggccgcagc

SEQ ID NO: 3681732 - RNA, 15 nt, Salmonella enterica enterica serovar Typhi Ty2
aaccacgccgucgcg

SEQ ID NO: 3681733 - RNA, 19 nt, Salmonella enterica enterica serovar Typhi Ty2
aaccacggauaagccagcc

SEQ ID NO: 3681734 - RNA, 13 nt, Salmonella enterica enterica serovar Typhi Ty2
aaccacuucugac

SEQ ID NO: 3681735 - RNA, 22 nt, Salmonella enterica enterica serovar Typhi Ty2
aaccagaaaaccgacagcaaua

SEQ ID NO: 3681736 - RNA, 17 nt, Salmonella enterica enterica serovar Typhi Ty2
aaccagcaaugagacaa

SEQ ID NO: 3681737 - RNA, 15 nt, Salmonella enterica enterica serovar Typhi Ty2
aaccagcaguccugc

SEQ ID NO: 3681738 - RNA, 17 nt, Salmonella enterica enterica serovar Typhi Ty2
aaccagcauaauauuca

SEQ ID NO: 3681739 - RNA, 22 nt, Salmonella enterica enterica serovar Typhi Ty2
aaccagcgccgccagauaaagc

SEQ ID NO: 3681740 - RNA, 17 nt, Salmonella enterica enterica serovar Typhi Ty2
aaccagcgcggccagaa

SEQ ID NO: 3681741 - RNA, 21 nt, Salmonella enterica enterica serovar Typhi Ty2
aaccagcgcuucgccugccgg

SEQ ID NO: 3681742 - RNA, 15 nt, Salmonella enterica enterica serovar Typhi Ty2
aaccagcuauccagu

SEQ ID NO: 3681743 - RNA, 15 nt, Salmonella enterica enterica serovar Typhi Ty2
aaccagcuuuucauu

SEQ ID NO: 3681744 - RNA, 23 nt, Salmonella enterica enterica serovar Typhi Ty2
aaccaggauucaacgcgugaucc

SEQ ID NO: 3681745 - RNA, 20 nt, Salmonella enterica enterica serovar Typhi Ty2
aaccaggcgaaccccaugcc

SEQ ID NO: 3681746 - RNA, 16 nt, Salmonella enterica enterica serovar Typhi Ty2
aaccagggaggacgca

SEQ ID NO: 3681747 - RNA, 18 nt, Salmonella enterica enterica serovar Typhi Ty2
aaccaguugccaggguuc

SEQ ID NO: 3681748 - RNA, 17 nt, Salmonella enterica enterica serovar Typhi Ty2
aaccauaaacaaaacaa

SEQ ID NO: 3681749 - RNA, 15 nt, Salmonella enterica enterica serovar Typhi Ty2
aaccaucaaaaaaaa

SEQ ID NO: 3681750 - RNA, 15 nt, Salmonella enterica enterica serovar Typhi Ty2
aaccauucaaauuca

SEQ ID NO: 3681751 - RNA, 20 nt, Salmonella enterica enterica serovar Typhi Ty2
aaccauucccgauaaugacc

SEQ ID NO: 3681752 - RNA, 17 nt, Salmonella enterica enterica serovar Typhi Ty2
aaccauuucuccugcau

SEQ ID NO: 3681753 - RNA, 14 nt, Salmonella enterica enterica serovar Typhi Ty2
aacccaccagcgcc

SEQ ID NO: 3681754 - RNA, 15 nt, Salmonella enterica enterica serovar Typhi Ty2
aacccaccagcgcca

SEQ ID NO: 3681755 - RNA, 19 nt, Salmonella enterica enterica serovar Typhi Ty2
aacccaccagcgccaggcc

SEQ ID NO: 3681756 - RNA, 15 nt, Salmonella enterica enterica serovar Typhi Ty2
aacccacgacgcggu

SEQ ID NO: 3681757 - RNA, 19 nt, Salmonella enterica enterica serovar Typhi Ty2
aacccacgacgcgguaccc

SEQ ID NO: 3681758 - RNA, 18 nt, Salmonella enterica enterica serovar Typhi Ty2
aacccagauaucagucug

SEQ ID NO: 3681759 - RNA, 21 nt, Salmonella enterica enterica serovar Typhi Ty2
aacccagcaaaucgcccauca

SEQ ID NO: 3681760 - RNA, 17 nt, Salmonella enterica enterica serovar Typhi Ty2
aacccauauuccugcgg

SEQ ID NO: 3681761 - RNA, 19 nt, Salmonella enterica enterica serovar Typhi Ty2
aacccauauucgucuucau

SEQ ID NO: 3681762 - RNA, 17 nt, Salmonella enterica enterica serovar Typhi Ty2
aacccauuggcgaggaa

SEQ ID NO: 3681763 - RNA, 22 nt, Salmonella enterica enterica serovar Typhi Ty2
aaccccaggucagcaguuuuuc

SEQ ID NO: 3681764 - RNA, 16 nt, Salmonella enterica enterica serovar Typhi Ty2
aaccccgauaaaccag

SEQ ID NO: 3681765 - RNA, 22 nt, Salmonella enterica enterica serovar Typhi Ty2
aaccccggaaugugaaauacag

SEQ ID NO: 3681766 - RNA, 18 nt, Salmonella enterica enterica serovar Typhi Ty2
aaccccguggugacacaa

SEQ ID NO: 3681767 - RNA, 16 nt, Salmonella enterica enterica serovar Typhi Ty2
aacccgaucgccaucc

SEQ ID NO: 3681768 - RNA, 16 nt, Salmonella enterica enterica serovar Typhi Ty2
aacccgauucugccag

SEQ ID NO: 3681769 - RNA, 13 nt, Salmonella enterica enterica serovar Typhi Ty2
aacccgccgccau

SEQ ID NO: 3681770 - RNA, 17 nt, Salmonella enterica enterica serovar Typhi Ty2
aacccgccucaaacgcc

SEQ ID NO: 3681771 - RNA, 15 nt, Salmonella enterica enterica serovar Typhi Ty2
aacccgccuucaguc

SEQ ID NO: 3681772 - RNA, 14 nt, Salmonella enterica enterica serovar Typhi Ty2
aacccggcugccau

SEQ ID NO: 3681773 - RNA, 21 nt, Salmonella enterica enterica serovar Typhi Ty2
aacccguuaaauaccagcacc

SEQ ID NO: 3681774 - RNA, 21 nt, Salmonella enterica enterica serovar Typhi Ty2
aacccuauugccacaauauca

SEQ ID NO: 3681775 - RNA, 19 nt, Salmonella enterica enterica serovar Typhi Ty2
aacccucgaaugugaauuc

SEQ ID NO: 3681776 - RNA, 21 nt, Salmonella enterica enterica serovar Typhi Ty2
aacccuucauaggugaacaug

SEQ ID NO: 3681777 - RNA, 21 nt, Salmonella enterica enterica serovar Typhi Ty2
aaccgaacaauaugcgcauca

SEQ ID NO: 3681778 - RNA, 19 nt, Salmonella enterica enterica serovar Typhi Ty2
aaccgacaauauucgccgc

SEQ ID NO: 3681779 - RNA, 18 nt, Salmonella enterica enterica serovar Typhi Ty2
aaccgacuaucagaaaaa

SEQ ID NO: 3681780 - RNA, 15 nt, Salmonella enterica enterica serovar Typhi Ty2
aaccgauaaucacca

SEQ ID NO: 3681781 - RNA, 13 nt, Salmonella enterica enterica serovar Typhi Ty2
aaccgaucuccca

SEQ ID NO: 3681782 - RNA, 15 nt, Salmonella enterica enterica serovar Typhi Ty2
aaccgcaaaugccau

SEQ ID NO: 3681783 - RNA, 13 nt, Salmonella enterica enterica serovar Typhi Ty2
aaccgcagaaaaa

SEQ ID NO: 3681784 - RNA, 17 nt, Salmonella enterica enterica serovar Typhi Ty2
aaccgcagaaaaagccc

SEQ ID NO: 3681785 - RNA, 19 nt, Salmonella enterica enterica serovar Typhi Ty2
aaccgcagaaaaagccccc

SEQ ID NO: 3681786 - RNA, 13 nt, Salmonella enterica enterica serovar Typhi Ty2
aaccgccagcagu

SEQ ID NO: 3681787 - RNA, 14 nt, Salmonella enterica enterica serovar Typhi Ty2
aaccgccagucacc

SEQ ID NO: 3681788 - RNA, 19 nt, Salmonella enterica enterica serovar Typhi Ty2
aaccgcccaucaacaccag

SEQ ID NO: 3681789 - RNA, 15 nt, Salmonella enterica enterica serovar Typhi Ty2
aaccgcccccaacug

SEQ ID NO: 3681790 - RNA, 21 nt, Salmonella enterica enterica serovar Typhi Ty2
aaccgcccgcggcgaucacca

SEQ ID NO: 3681791 - RNA, 14 nt, Salmonella enterica enterica serovar Typhi Ty2
aaccgcgcguaaau

SEQ ID NO: 3681792 - RNA, 18 nt, Salmonella enterica enterica serovar Typhi Ty2
aaccgcggucggcaggcg

SEQ ID NO: 3681793 - RNA, 23 nt, Salmonella enterica enterica serovar Typhi Ty2
aaccgcuaaugaggaaaaagccg

SEQ ID NO: 3681794 - RNA, 15 nt, Salmonella enterica enterica serovar Typhi Ty2
aaccgcuacccggca

SEQ ID NO: 3681795 - RNA, 19 nt, Salmonella enterica enterica serovar Typhi Ty2
aaccgcuucgaaguuuuga

SEQ ID NO: 3681796 - RNA, 15 nt, Salmonella enterica enterica serovar Typhi Ty2
aaccgcuuuuccugc

SEQ ID NO: 3681797 - RNA, 20 nt, Salmonella enterica enterica serovar Typhi Ty2
aaccggaccagcacaaaaaa

SEQ ID NO: 3681798 - RNA, 16 nt, Salmonella enterica enterica serovar Typhi Ty2
aaccggcaaccaaagu

SEQ ID NO: 3681799 - RNA, 23 nt, Salmonella enterica enterica serovar Typhi Ty2
aaccggcaacucgccgguuuuuu

SEQ ID NO: 3681800 - RNA, 21 nt, Salmonella enterica enterica serovar Typhi Ty2
aaccggcacauccagcgccug

SEQ ID NO: 3681801 - RNA, 15 nt, Salmonella enterica enterica serovar Typhi Ty2
aaccggcaugaagac

SEQ ID NO: 3681802 - RNA, 13 nt, Salmonella enterica enterica serovar Typhi Ty2
aaccggccccauc

SEQ ID NO: 3681803 - RNA, 17 nt, Salmonella enterica enterica serovar Typhi Ty2
aaccggccccaucgccg

SEQ ID NO: 3681804 - RNA, 23 nt, Salmonella enterica enterica serovar Typhi Ty2
aaccggcgauguuggcgcccuga

SEQ ID NO: 3681805 - RNA, 16 nt, Salmonella enterica enterica serovar Typhi Ty2
aaccggguugcggaag

SEQ ID NO: 3681806 - RNA, 19 nt, Salmonella enterica enterica serovar Typhi Ty2
aaccggucagguagcagac

SEQ ID NO: 3681807 - RNA, 20 nt, Salmonella enterica enterica serovar Typhi Ty2
aaccggucagguagcagacc

SEQ ID NO: 3681808 - RNA, 20 nt, Salmonella enterica enterica serovar Typhi Ty2
aaccguaaacgccugcacca

SEQ ID NO: 3681809 - RNA, 14 nt, Salmonella enterica enterica serovar Typhi Ty2
aaccguagcguugc

SEQ ID NO: 3681810 - RNA, 22 nt, Salmonella enterica enterica serovar Typhi Ty2
aaccguaucacuguaaaaggga

SEQ ID NO: 3681811 - RNA, 16 nt, Salmonella enterica enterica serovar Typhi Ty2
aaccguccacauccag

SEQ ID NO: 3681812 - RNA, 21 nt, Salmonella enterica enterica serovar Typhi Ty2
aaccgucgggcgucgccugcc

SEQ ID NO: 3681813 - RNA, 15 nt, Salmonella enterica enterica serovar Typhi Ty2
aaccgugcuucacgg

SEQ ID NO: 3681814 - RNA, 14 nt, Salmonella enterica enterica serovar Typhi Ty2
aaccguuaugaauc

SEQ ID NO: 3681815 - RNA, 21 nt, Salmonella enterica enterica serovar Typhi Ty2
aaccguucaucuaucgccagc

SEQ ID NO: 3681816 - RNA, 16 nt, Salmonella enterica enterica serovar Typhi Ty2
aaccguucuuccuggg

SEQ ID NO: 3681817 - RNA, 16 nt, Salmonella enterica enterica serovar Typhi Ty2
aaccguugcgcccauc

SEQ ID NO: 3681818 - RNA, 17 nt, Salmonella enterica enterica serovar Typhi Ty2
aaccguugcgcccauca

SEQ ID NO: 3681819 - RNA, 22 nt, Salmonella enterica enterica serovar Typhi Ty2
aaccguuuuaccuucugccgcg

SEQ ID NO: 3681820 - RNA, 12 nt, Salmonella enterica enterica serovar Typhi Ty2
aaccuaaaaacc

SEQ ID NO: 3681821 - RNA, 13 nt, Salmonella enterica enterica serovar Typhi Ty2
aaccuaaccaaac

SEQ ID NO: 3681822 - RNA, 15 nt, Salmonella enterica enterica serovar Typhi Ty2
aaccuauugaaaaua

SEQ ID NO: 3681823 - RNA, 22 nt, Salmonella enterica enterica serovar Typhi Ty2
aaccuauugaaaauaaaugaua

SEQ ID NO: 3681824 - RNA, 16 nt, Salmonella enterica enterica serovar Typhi Ty2
aaccuauuuugcaaaa

SEQ ID NO: 3681825 - RNA, 19 nt, Salmonella enterica enterica serovar Typhi Ty2
aaccucaccguccgccagg

SEQ ID NO: 3681826 - RNA, 20 nt, Salmonella enterica enterica serovar Typhi Ty2
aaccucaucccggcuuaaau

SEQ ID NO: 3681827 - RNA, 13 nt, Salmonella enterica enterica serovar Typhi Ty2
aaccucccgccgg

SEQ ID NO: 3681828 - RNA, 19 nt, Salmonella enterica enterica serovar Typhi Ty2
aaccuccggcuaugccgga

SEQ ID NO: 3681829 - RNA, 20 nt, Salmonella enterica enterica serovar Typhi Ty2
aaccuccggcuaugccggag

SEQ ID NO: 3681830 - RNA, 17 nt, Salmonella enterica enterica serovar Typhi Ty2
aaccucggcuugcuuca

SEQ ID NO: 3681831 - RNA, 20 nt, Salmonella enterica enterica serovar Typhi Ty2
aaccucggcuugcuucaucu

SEQ ID NO: 3681832 - RNA, 12 nt, Salmonella enterica enterica serovar Typhi Ty2
aaccugaacaau

SEQ ID NO: 3681833 - RNA, 15 nt, Salmonella enterica enterica serovar Typhi Ty2
aaccugagaauauua

SEQ ID NO: 3681834 - RNA, 13 nt, Salmonella enterica enterica serovar Typhi Ty2
aaccugagcgcga

SEQ ID NO: 3681835 - RNA, 14 nt, Salmonella enterica enterica serovar Typhi Ty2
aaccugauauugcg

SEQ ID NO: 3681836 - RNA, 13 nt, Salmonella enterica enterica serovar Typhi Ty2
aaccugccacagg

SEQ ID NO: 3681837 - RNA, 21 nt, Salmonella enterica enterica serovar Typhi Ty2
aaccugcgccgcgauaaagaa

SEQ ID NO: 3681838 - RNA, 16 nt, Salmonella enterica enterica serovar Typhi Ty2
aaccugcucucgggca

SEQ ID NO: 3681839 - RNA, 14 nt, Salmonella enterica enterica serovar Typhi Ty2
aaccugguaugaua

SEQ ID NO: 3681840 - RNA, 18 nt, Salmonella enterica enterica serovar Typhi Ty2
aaccuguaggccggauaa

SEQ ID NO: 3681841 - RNA, 15 nt, Salmonella enterica enterica serovar Typhi Ty2
aaccuguaucugcug

SEQ ID NO: 3681842 - RNA, 13 nt, Salmonella enterica enterica serovar Typhi Ty2
aaccugucaguac

SEQ ID NO: 3681843 - RNA, 20 nt, Salmonella enterica enterica serovar Typhi Ty2
aaccuuccaucgcauccucg

SEQ ID NO: 3681844 - RNA, 15 nt, Salmonella enterica enterica serovar Typhi Ty2
aaccuucgcuuuuaa

SEQ ID NO: 3681845 - RNA, 19 nt, Salmonella enterica enterica serovar Typhi Ty2
aaccuucgcuuuuaaaacu

SEQ ID NO: 3681846 - RNA, 12 nt, Salmonella enterica enterica serovar Typhi Ty2
aaccuugcgccu

SEQ ID NO: 3681847 - RNA, 14 nt, Salmonella enterica enterica serovar Typhi Ty2
aaccuuugcugacg

SEQ ID NO: 3681848 - RNA, 12 nt, Salmonella enterica enterica serovar Typhi Ty2
aacgaaacucag

SEQ ID NO: 3681849 - RNA, 14 nt, Salmonella enterica enterica serovar Typhi Ty2
aacgaaucgaaucg

SEQ ID NO: 3681850 - RNA, 13 nt, Salmonella enterica enterica serovar Typhi Ty2
aacgaauuuaaau

SEQ ID NO: 3681851 - RNA, 20 nt, Salmonella enterica enterica serovar Typhi Ty2
aacgaauuuaaauagcaauu

SEQ ID NO: 3681852 - RNA, 17 nt, Salmonella enterica enterica serovar Typhi Ty2
aacgacaaaaauaccac

SEQ ID NO: 3681853 - RNA, 15 nt, Salmonella enterica enterica serovar Typhi Ty2
aacgacccaucaaua

SEQ ID NO: 3681854 - RNA, 21 nt, Salmonella enterica enterica serovar Typhi Ty2
aacgacuacguucaucaggca

SEQ ID NO: 3681855 - RNA, 21 nt, Salmonella enterica enterica serovar Typhi Ty2
aacgacuacuuccagaccacu

SEQ ID NO: 3681856 - RNA, 16 nt, Salmonella enterica enterica serovar Typhi Ty2
aacgacuuauuugcuc

SEQ ID NO: 3681857 - RNA, 22 nt, Salmonella enterica enterica serovar Typhi Ty2
aacgagaauggaugugaauaaa

SEQ ID NO: 3681858 - RNA, 13 nt, Salmonella enterica enterica serovar Typhi Ty2
aacgagauucaau

SEQ ID NO: 3681859 - RNA, 14 nt, Salmonella enterica enterica serovar Typhi Ty2
aacgauaauucgcc

SEQ ID NO: 3681860 - RNA, 19 nt, Salmonella enterica enterica serovar Typhi Ty2
aacgauacagcacggcagu

SEQ ID NO: 3681861 - RNA, 16 nt, Salmonella enterica enterica serovar Typhi Ty2
aacgaucccuaauaaa

SEQ ID NO: 3681862 - RNA, 17 nt, Salmonella enterica enterica serovar Typhi Ty2
aacgaucuggucgccaa

SEQ ID NO: 3681863 - RNA, 15 nt, Salmonella enterica enterica serovar Typhi Ty2
aacgaugaccauaaa

SEQ ID NO: 3681864 - RNA, 23 nt, Salmonella enterica enterica serovar Typhi Ty2
aacgaugaccauaaaugaaaugc

SEQ ID NO: 3681865 - RNA, 19 nt, Salmonella enterica enterica serovar Typhi Ty2
aacgaugaugaaaaagaau

SEQ ID NO: 3681866 - RNA, 22 nt, Salmonella enterica enterica serovar Typhi Ty2
aacgauguaaaaccuggcacuu

SEQ ID NO: 3681867 - RNA, 16 nt, Salmonella enterica enterica serovar Typhi Ty2
aacgauguaucgcgcg

SEQ ID NO: 3681868 - RNA, 18 nt, Salmonella enterica enterica serovar Typhi Ty2
aacgauucguaaauugac

SEQ ID NO: 3681869 - RNA, 11 nt, Salmonella enterica enterica serovar Typhi Ty2
aacgcaaccgu

SEQ ID NO: 3681870 - RNA, 18 nt, Salmonella enterica enterica serovar Typhi Ty2
aacgcacccgcgcaggcg

SEQ ID NO: 3681871 - RNA, 19 nt, Salmonella enterica enterica serovar Typhi Ty2
aacgcacguacggaaggua

SEQ ID NO: 3681872 - RNA, 19 nt, Salmonella enterica enterica serovar Typhi Ty2
aacgcagaagacagaagcu

SEQ ID NO: 3681873 - RNA, 18 nt, Salmonella enterica enterica serovar Typhi Ty2
aacgcagcgcgcguagca

SEQ ID NO: 3681874 - RNA, 15 nt, Salmonella enterica enterica serovar Typhi Ty2
aacgcauaaaaacgu

SEQ ID NO: 3681875 - RNA, 15 nt, Salmonella enterica enterica serovar Typhi Ty2
aacgcauauccagca

SEQ ID NO: 3681876 - RNA, 18 nt, Salmonella enterica enterica serovar Typhi Ty2
aacgcaucaaauaccuuu

SEQ ID NO: 3681877 - RNA, 22 nt, Salmonella enterica enterica serovar Typhi Ty2
aacgcaucaaauaccuuuucau

SEQ ID NO: 3681878 - RNA, 18 nt, Salmonella enterica enterica serovar Typhi Ty2
aacgcaucacaugcggga

SEQ ID NO: 3681879 - RNA, 18 nt, Salmonella enterica enterica serovar Typhi Ty2
aacgcauccagccacgua

SEQ ID NO: 3681880 - RNA, 16 nt, Salmonella enterica enterica serovar Typhi Ty2
aacgcauccagcguca

SEQ ID NO: 3681881 - RNA, 20 nt, Salmonella enterica enterica serovar Typhi Ty2
aacgcaucgcugcgcuuaca

SEQ ID NO: 3681882 - RNA, 22 nt, Salmonella enterica enterica serovar Typhi Ty2
aacgcaucgcugcgcuuacaca

SEQ ID NO: 3681883 - RNA, 15 nt, Salmonella enterica enterica serovar Typhi Ty2
aacgccaacgcccgg

SEQ ID NO: 3681884 - RNA, 18 nt, Salmonella enterica enterica serovar Typhi Ty2
aacgccaaucacuuuacu

SEQ ID NO: 3681885 - RNA, 21 nt, Salmonella enterica enterica serovar Typhi Ty2
aacgccaccgccaccugcccu

SEQ ID NO: 3681886 - RNA, 21 nt, Salmonella enterica enterica serovar Typhi Ty2
aacgccagaccgacgccaacc

SEQ ID NO: 3681887 - RNA, 19 nt, Salmonella enterica enterica serovar Typhi Ty2
aacgccagcgauuugccgc

SEQ ID NO: 3681888 - RNA, 17 nt, Salmonella enterica enterica serovar Typhi Ty2
aacgccaucagcaaaau

SEQ ID NO: 3681889 - RNA, 13 nt, Salmonella enterica enterica serovar Typhi Ty2
aacgccaucagcc

SEQ ID NO: 3681890 - RNA, 22 nt, Salmonella enterica enterica serovar Typhi Ty2
aacgccaugcucauccaacugc

SEQ ID NO: 3681891 - RNA, 20 nt, Salmonella enterica enterica serovar Typhi Ty2
aacgcccgauagcguaaaga

SEQ ID NO: 3681892 - RNA, 20 nt, Salmonella enterica enterica serovar Typhi Ty2
aacgcccgccgcgaccagca

SEQ ID NO: 3681893 - RNA, 21 nt, Salmonella enterica enterica serovar Typhi Ty2
aacgcccggcgcgacaccuuc

SEQ ID NO: 3681894 - RNA, 20 nt, Salmonella enterica enterica serovar Typhi Ty2
aacgcccucaaguaaaaugc

SEQ ID NO: 3681895 - RNA, 14 nt, Salmonella enterica enterica serovar Typhi Ty2
aacgccgaagccag

SEQ ID NO: 3681896 - RNA, 15 nt, Salmonella enterica enterica serovar Typhi Ty2
aacgccgaagccagc

SEQ ID NO: 3681897 - RNA, 17 nt, Salmonella enterica enterica serovar Typhi Ty2
aacgccgaagccagcgc

SEQ ID NO: 3681898 - RNA, 20 nt, Salmonella enterica enterica serovar Typhi Ty2
aacgccgaccacuucaacgc

SEQ ID NO: 3681899 - RNA, 19 nt, Salmonella enterica enterica serovar Typhi Ty2
aacgccgcacacucauuuu

SEQ ID NO: 3681900 - RNA, 17 nt, Salmonella enterica enterica serovar Typhi Ty2
aacgccgccgcaaggcg

SEQ ID NO: 3681901 - RNA, 16 nt, Salmonella enterica enterica serovar Typhi Ty2
aacgccgccugcgcca

SEQ ID NO: 3681902 - RNA, 20 nt, Salmonella enterica enterica serovar Typhi Ty2
aacgccgcuuuaccgccuuc

SEQ ID NO: 3681903 - RNA, 17 nt, Salmonella enterica enterica serovar Typhi Ty2
aacgccggauuccagaa

SEQ ID NO: 3681904 - RNA, 20 nt, Salmonella enterica enterica serovar Typhi Ty2
aacgccggucguggcgauca

SEQ ID NO: 3681905 - RNA, 18 nt, Salmonella enterica enterica serovar Typhi Ty2
aacgccgguuccaacagc

SEQ ID NO: 3681906 - RNA, 14 nt, Salmonella enterica enterica serovar Typhi Ty2
aacgccgugaacgc

SEQ ID NO: 3681907 - RNA, 13 nt, Salmonella enterica enterica serovar Typhi Ty2
aacgccguuacca

SEQ ID NO: 3681908 - RNA, 16 nt, Salmonella enterica enterica serovar Typhi Ty2
aacgccguuaccagca

SEQ ID NO: 3681909 - RNA, 17 nt, Salmonella enterica enterica serovar Typhi Ty2
aacgccguuaccagcau

SEQ ID NO: 3681910 - RNA, 18 nt, Salmonella enterica enterica serovar Typhi Ty2
aacgccguuaccagcauc

SEQ ID NO: 3681911 - RNA, 23 nt, Salmonella enterica enterica serovar Typhi Ty2
aacgccuccauuuuggggaaaau

SEQ ID NO: 3681912 - RNA, 14 nt, Salmonella enterica enterica serovar Typhi Ty2
aacgccugauccgg

SEQ ID NO: 3681913 - RNA, 19 nt, Salmonella enterica enterica serovar Typhi Ty2
aacgccugaugcugcgcau

SEQ ID NO: 3681914 - RNA, 16 nt, Salmonella enterica enterica serovar Typhi Ty2
aacgccuucguccgga

SEQ ID NO: 3681915 - RNA, 13 nt, Salmonella enterica enterica serovar Typhi Ty2
aacgcgaaaauac

SEQ ID NO: 3681916 - RNA, 21 nt, Salmonella enterica enterica serovar Typhi Ty2
aacgcgaaaauaccccagcgc

SEQ ID NO: 3681917 - RNA, 14 nt, Salmonella enterica enterica serovar Typhi Ty2
aacgcgacaacgcc

SEQ ID NO: 3681918 - RNA, 14 nt, Salmonella enterica enterica serovar Typhi Ty2
aacgcgaccagcgc

SEQ ID NO: 3681919 - RNA, 19 nt, Salmonella enterica enterica serovar Typhi Ty2
aacgcgagaagaagaauua

SEQ ID NO: 3681920 - RNA, 23 nt, Salmonella enterica enterica serovar Typhi Ty2
aacgcgagaagaagaauuauuau

SEQ ID NO: 3681921 - RNA, 14 nt, Salmonella enterica enterica serovar Typhi Ty2
aacgcgcaaaacuc

SEQ ID NO: 3681922 - RNA, 13 nt, Salmonella enterica enterica serovar Typhi Ty2
aacgcgccacgcg

SEQ ID NO: 3681923 - RNA, 15 nt, Salmonella enterica enterica serovar Typhi Ty2
aacgcgcucgccagc

SEQ ID NO: 3681924 - RNA, 17 nt, Salmonella enterica enterica serovar Typhi Ty2
aacgcgcucgccagcgc

SEQ ID NO: 3681925 - RNA, 18 nt, Salmonella enterica enterica serovar Typhi Ty2
aacgcgguaaauuccgca

SEQ ID NO: 3681926 - RNA, 20 nt, Salmonella enterica enterica serovar Typhi Ty2
aacgcguacggcuucaaucg

SEQ ID NO: 3681927 - RNA, 16 nt, Salmonella enterica enterica serovar Typhi Ty2
aacgcgucuucaucag

SEQ ID NO: 3681928 - RNA, 19 nt, Salmonella enterica enterica serovar Typhi Ty2
aacgcgucuucaucagcca

SEQ ID NO: 3681929 - RNA, 22 nt, Salmonella enterica enterica serovar Typhi Ty2
aacgcgucuucaucagccagca

SEQ ID NO: 3681930 - RNA, 21 nt, Salmonella enterica enterica serovar Typhi Ty2
aacgcuaucaccgccgcccgu

SEQ ID NO: 3681931 - RNA, 13 nt, Salmonella enterica enterica serovar Typhi Ty2
aacgcuaugcgcc

SEQ ID NO: 3681932 - RNA, 15 nt, Salmonella enterica enterica serovar Typhi Ty2
aacgcucgcgcauga

SEQ ID NO: 3681933 - RNA, 20 nt, Salmonella enterica enterica serovar Typhi Ty2
aacgcucuuaccgcuaaaau

SEQ ID NO: 3681934 - RNA, 22 nt, Salmonella enterica enterica serovar Typhi Ty2
aacgcucuuaccgcuaaaauac

SEQ ID NO: 3681935 - RNA, 22 nt, Salmonella enterica enterica serovar Typhi Ty2
aacgcugcauccuguaccacca

SEQ ID NO: 3681936 - RNA, 14 nt, Salmonella enterica enterica serovar Typhi Ty2
aacgcugcgcaaca

SEQ ID NO: 3681937 - RNA, 17 nt, Salmonella enterica enterica serovar Typhi Ty2
aacgcugcgccgcgcca

SEQ ID NO: 3681938 - RNA, 14 nt, Salmonella enterica enterica serovar Typhi Ty2
aacgcuggccgcaa

SEQ ID NO: 3681939 - RNA, 18 nt, Salmonella enterica enterica serovar Typhi Ty2
aacgcuggugcugugccu

SEQ ID NO: 3681940 - RNA, 15 nt, Salmonella enterica enterica serovar Typhi Ty2
aacgcuuaaucccuu

SEQ ID NO: 3681941 - RNA, 21 nt, Salmonella enterica enterica serovar Typhi Ty2
aacgcuucacaaccugaaaga

SEQ ID NO: 3681942 - RNA, 17 nt, Salmonella enterica enterica serovar Typhi Ty2
aacgcuuuguacagaca

SEQ ID NO: 3681943 - RNA, 13 nt, Salmonella enterica enterica serovar Typhi Ty2
aacggaaccaaau

SEQ ID NO: 3681944 - RNA, 16 nt, Salmonella enterica enterica serovar Typhi Ty2
aacggaauaaacgaga

SEQ ID NO: 3681945 - RNA, 22 nt, Salmonella enterica enterica serovar Typhi Ty2
aacggaauggcacagcgcagca

SEQ ID NO: 3681946 - RNA, 22 nt, Salmonella enterica enterica serovar Typhi Ty2
aacggaccggcaaucgccugca

SEQ ID NO: 3681947 - RNA, 20 nt, Salmonella enterica enterica serovar Typhi Ty2
aacggaugcgccaucccaug

SEQ ID NO: 3681948 - RNA, 22 nt, Salmonella enterica enterica serovar Typhi Ty2
aacggcaacaguaccugauaaa

SEQ ID NO: 3681949 - RNA, 20 nt, Salmonella enterica enterica serovar Typhi Ty2
aacggcaauuuuuacaaauu

SEQ ID NO: 3681950 - RNA, 17 nt, Salmonella enterica enterica serovar Typhi Ty2
aacggcgacaagaauau

SEQ ID NO: 3681951 - RNA, 13 nt, Salmonella enterica enterica serovar Typhi Ty2
aacggcgagcuuu

SEQ ID NO: 3681952 - RNA, 11 nt, Salmonella enterica enterica serovar Typhi Ty2
aacggcgauca

SEQ ID NO: 3681953 - RNA, 23 nt, Salmonella enterica enterica serovar Typhi Ty2
aacggcggaaccauuuuccccag

SEQ ID NO: 3681954 - RNA, 17 nt, Salmonella enterica enterica serovar Typhi Ty2
aacggcugacgcccauc

SEQ ID NO: 3681955 - RNA, 18 nt, Salmonella enterica enterica serovar Typhi Ty2
aacggcugacgcccauca

SEQ ID NO: 3681956 - RNA, 17 nt, Salmonella enterica enterica serovar Typhi Ty2
aacggcuuuccagcagc

SEQ ID NO: 3681957 - RNA, 21 nt, Salmonella enterica enterica serovar Typhi Ty2
aacggcuuuccagcagccaga

SEQ ID NO: 3681958 - RNA, 22 nt, Salmonella enterica enterica serovar Typhi Ty2
aacgggacggcggccagcauuu

SEQ ID NO: 3681959 - RNA, 14 nt, Salmonella enterica enterica serovar Typhi Ty2
aacgggccacugcu

SEQ ID NO: 3681960 - RNA, 15 nt, Salmonella enterica enterica serovar Typhi Ty2
aacgggcccggcuuu

SEQ ID NO: 3681961 - RNA, 19 nt, Salmonella enterica enterica serovar Typhi Ty2
aacgggcguugcucaaugg

SEQ ID NO: 3681962 - RNA, 19 nt, Salmonella enterica enterica serovar Typhi Ty2
aacggguuugauugccauc

SEQ ID NO: 3681963 - RNA, 16 nt, Salmonella enterica enterica serovar Typhi Ty2
aacgguaaguugaaag

SEQ ID NO: 3681964 - RNA, 23 nt, Salmonella enterica enterica serovar Typhi Ty2
aacgguccagguucaucacuuuc

SEQ ID NO: 3681965 - RNA, 16 nt, Salmonella enterica enterica serovar Typhi Ty2
aacgguucauccagca

SEQ ID NO: 3681966 - RNA, 19 nt, Salmonella enterica enterica serovar Typhi Ty2
aacgguuuugcgcugguac

SEQ ID NO: 3681967 - RNA, 14 nt, Salmonella enterica enterica serovar Typhi Ty2
aacguaaauaccca

SEQ ID NO: 3681968 - RNA, 21 nt, Salmonella enterica enterica serovar Typhi Ty2
aacguaacuugauuccuggcu

SEQ ID NO: 3681969 - RNA, 19 nt, Salmonella enterica enterica serovar Typhi Ty2
aacguaaucaucaugcugc

SEQ ID NO: 3681970 - RNA, 15 nt, Salmonella enterica enterica serovar Typhi Ty2
aacguaccugagaga

SEQ ID NO: 3681971 - RNA, 23 nt, Salmonella enterica enterica serovar Typhi Ty2
aacguacggguguccgguagcgu

SEQ ID NO: 3681972 - RNA, 13 nt, Salmonella enterica enterica serovar Typhi Ty2
aacguagcgcguc

SEQ ID NO: 3681973 - RNA, 14 nt, Salmonella enterica enterica serovar Typhi Ty2
aacguagcgucauc

SEQ ID NO: 3681974 - RNA, 12 nt, Salmonella enterica enterica serovar Typhi Ty2
aacguauuauua

SEQ ID NO: 3681975 - RNA, 19 nt, Salmonella enterica enterica serovar Typhi Ty2
aacguauuucuuuugccau

SEQ ID NO: 3681976 - RNA, 21 nt, Salmonella enterica enterica serovar Typhi Ty2
aacgucaccucaucaacgcca

SEQ ID NO: 3681977 - RNA, 11 nt, Salmonella enterica enterica serovar Typhi Ty2
aacgucaguac

SEQ ID NO: 3681978 - RNA, 18 nt, Salmonella enterica enterica serovar Typhi Ty2
aacgucaguggaaaacag

SEQ ID NO: 3681979 - RNA, 21 nt, Salmonella enterica enterica serovar Typhi Ty2
aacgucaguggaaaacagcau

SEQ ID NO: 3681980 - RNA, 15 nt, Salmonella enterica enterica serovar Typhi Ty2
aacguccagcggcca

SEQ ID NO: 3681981 - RNA, 17 nt, Salmonella enterica enterica serovar Typhi Ty2
aacgucgcguacaccuu

SEQ ID NO: 3681982 - RNA, 13 nt, Salmonella enterica enterica serovar Typhi Ty2
aacgugccacagu

SEQ ID NO: 3681983 - RNA, 21 nt, Salmonella enterica enterica serovar Typhi Ty2
aacgugcgguauaucacgcca

SEQ ID NO: 3681984 - RNA, 21 nt, Salmonella enterica enterica serovar Typhi Ty2
aacgugcuggauggcagacaa

SEQ ID NO: 3681985 - RNA, 18 nt, Salmonella enterica enterica serovar Typhi Ty2
aacguggcggcagagcca

SEQ ID NO: 3681986 - RNA, 22 nt, Salmonella enterica enterica serovar Typhi Ty2
aacguguuacguuuaaaccaug

SEQ ID NO: 3681987 - RNA, 23 nt, Salmonella enterica enterica serovar Typhi Ty2
aacguguuacguuuaaaccaugc

SEQ ID NO: 3681988 - RNA, 22 nt, Salmonella enterica enterica serovar Typhi Ty2
aacguguuuucgauuucauuca

SEQ ID NO: 3681989 - RNA, 18 nt, Salmonella enterica enterica serovar Typhi Ty2
aacguuaccgcagcgaau

SEQ ID NO: 3681990 - RNA, 12 nt, Salmonella enterica enterica serovar Typhi Ty2
aacguucaaaau

SEQ ID NO: 3681991 - RNA, 16 nt, Salmonella enterica enterica serovar Typhi Ty2
aacguucaaaaucaaa

SEQ ID NO: 3681992 - RNA, 18 nt, Salmonella enterica enterica serovar Typhi Ty2
aacguugacguuucaguc

SEQ ID NO: 3681993 - RNA, 15 nt, Salmonella enterica enterica serovar Typhi Ty2
aacguuguauaaaca

SEQ ID NO: 3681994 - RNA, 16 nt, Salmonella enterica enterica serovar Typhi Ty2
aacguuguccagcaga

SEQ ID NO: 3681995 - RNA, 22 nt, Salmonella enterica enterica serovar Typhi Ty2
aacguuucauggaaaucaagcg

SEQ ID NO: 3681996 - RNA, 18 nt, Salmonella enterica enterica serovar Typhi Ty2
aacguuuguaacagcagg

SEQ ID NO: 3681997 - RNA, 18 nt, Salmonella enterica enterica serovar Typhi Ty2
aacguuuugugucaaaaa

SEQ ID NO: 3681998 - RNA, 13 nt, Salmonella enterica enterica serovar Typhi Ty2
aacuacucguaau

SEQ ID NO: 3681999 - RNA, 22 nt, Salmonella enterica enterica serovar Typhi Ty2
aacuacucguaaucuaaaauua

SEQ ID NO: 3682000 - RNA, 21 nt, Salmonella enterica enterica serovar Typhi Ty2
aacuauaauugcuuuuuucca

SEQ ID NO: 3682001 - RNA, 15 nt, Salmonella enterica enterica serovar Typhi Ty2
aacuaugcaaaacgu

SEQ ID NO: 3682002 - RNA, 17 nt, Salmonella enterica enterica serovar Typhi Ty2
aacuaugccagaauaca

SEQ ID NO: 3682003 - RNA, 21 nt, Salmonella enterica enterica serovar Typhi Ty2
aacuaugccagaauacaccgc

SEQ ID NO: 3682004 - RNA, 22 nt, Salmonella enterica enterica serovar Typhi Ty2
aacuauguacgccaagcugcaa

SEQ ID NO: 3682005 - RNA, 12 nt, Salmonella enterica enterica serovar Typhi Ty2
aacuaugugggc

SEQ ID NO: 3682006 - RNA, 19 nt, Salmonella enterica enterica serovar Typhi Ty2
aacuauuaauucuuuuaac

SEQ ID NO: 3682007 - RNA, 20 nt, Salmonella enterica enterica serovar Typhi Ty2
aacuauugcugccccggcgc

SEQ ID NO: 3682008 - RNA, 12 nt, Salmonella enterica enterica serovar Typhi Ty2
aacucagcaaua

SEQ ID NO: 3682009 - RNA, 20 nt, Salmonella enterica enterica serovar Typhi Ty2
aacucagcaauauuuuguag

SEQ ID NO: 3682010 - RNA, 12 nt, Salmonella enterica enterica serovar Typhi Ty2
aacucaggaaau

SEQ ID NO: 3682011 - RNA, 13 nt, Salmonella enterica enterica serovar Typhi Ty2
aacucaucacagc

SEQ ID NO: 3682012 - RNA, 15 nt, Salmonella enterica enterica serovar Typhi Ty2
aacucaucaugauau

SEQ ID NO: 3682013 - RNA, 17 nt, Salmonella enterica enterica serovar Typhi Ty2
aacucaucaugauauaa

SEQ ID NO: 3682014 - RNA, 14 nt, Salmonella enterica enterica serovar Typhi Ty2
aacucaucgccagc

SEQ ID NO: 3682015 - RNA, 18 nt, Salmonella enterica enterica serovar Typhi Ty2
aacucaucggaacaguaa

SEQ ID NO: 3682016 - RNA, 23 nt, Salmonella enterica enterica serovar Typhi Ty2
aacucaugacuucacacuguggu

SEQ ID NO: 3682017 - RNA, 21 nt, Salmonella enterica enterica serovar Typhi Ty2
aacuccggacguacccaggcg

SEQ ID NO: 3682018 - RNA, 21 nt, Salmonella enterica enterica serovar Typhi Ty2
aacuccucacugcguaaaauc

SEQ ID NO: 3682019 - RNA, 21 nt, Salmonella enterica enterica serovar Typhi Ty2
aacuccuccgggaaaacauca

SEQ ID NO: 3682020 - RNA, 16 nt, Salmonella enterica enterica serovar Typhi Ty2
aacuccugggcaaaau

SEQ ID NO: 3682021 - RNA, 16 nt, Salmonella enterica enterica serovar Typhi Ty2
aacucgcacaguacac

SEQ ID NO: 3682022 - RNA, 18 nt, Salmonella enterica enterica serovar Typhi Ty2
aacucgcuguggccaggc

SEQ ID NO: 3682023 - RNA, 17 nt, Salmonella enterica enterica serovar Typhi Ty2
aacucggcagcgcgaca

SEQ ID NO: 3682024 - RNA, 21 nt, Salmonella enterica enterica serovar Typhi Ty2
aacucggcgggguuuuuuuau

SEQ ID NO: 3682025 - RNA, 19 nt, Salmonella enterica enterica serovar Typhi Ty2
aacucugcgacgccaggcg

SEQ ID NO: 3682026 - RNA, 21 nt, Salmonella enterica enterica serovar Typhi Ty2
aacucuuccgggcugacauaa

SEQ ID NO: 3682027 - RNA, 23 nt, Salmonella enterica enterica serovar Typhi Ty2
aacucuuucagaccauaguccau

SEQ ID NO: 3682028 - RNA, 21 nt, Salmonella enterica enterica serovar Typhi Ty2
aacucuuuuucagcaaauaca

SEQ ID NO: 3682029 - RNA, 19 nt, Salmonella enterica enterica serovar Typhi Ty2
aacugaaccaacagcuggg

SEQ ID NO: 3682030 - RNA, 13 nt, Salmonella enterica enterica serovar Typhi Ty2
aacugacaauuuc

SEQ ID NO: 3682031 - RNA, 18 nt, Salmonella enterica enterica serovar Typhi Ty2
aacugaccauauaugaaa

SEQ ID NO: 3682032 - RNA, 14 nt, Salmonella enterica enterica serovar Typhi Ty2
aacugacgaccggg

SEQ ID NO: 3682033 - RNA, 17 nt, Salmonella enterica enterica serovar Typhi Ty2
aacugacgcgccuguaa

SEQ ID NO: 3682034 - RNA, 19 nt, Salmonella enterica enterica serovar Typhi Ty2
aacugacuccagcugguau

SEQ ID NO: 3682035 - RNA, 17 nt, Salmonella enterica enterica serovar Typhi Ty2
aacugagacucagcagc

SEQ ID NO: 3682036 - RNA, 15 nt, Salmonella enterica enterica serovar Typhi Ty2
aacugagcgccaauu

SEQ ID NO: 3682037 - RNA, 21 nt, Salmonella enterica enterica serovar Typhi Ty2
aacugauaacgauaagugaag

SEQ ID NO: 3682038 - RNA, 10 nt, Salmonella enterica enterica serovar Typhi Ty2
aacugcacca

SEQ ID NO: 3682039 - RNA, 19 nt, Salmonella enterica enterica serovar Typhi Ty2
aacugccccuugucguaau

SEQ ID NO: 3682040 - RNA, 17 nt, Salmonella enterica enterica serovar Typhi Ty2
aacugcgaaaucaccga

SEQ ID NO: 3682041 - RNA, 20 nt, Salmonella enterica enterica serovar Typhi Ty2
aacugcgaguucaccaguuu

SEQ ID NO: 3682042 - RNA, 16 nt, Salmonella enterica enterica serovar Typhi Ty2
aacugcgccaaaucgg

SEQ ID NO: 3682043 - RNA, 15 nt, Salmonella enterica enterica serovar Typhi Ty2
aacugcgccugaaga

SEQ ID NO: 3682044 - RNA, 16 nt, Salmonella enterica enterica serovar Typhi Ty2
aacugcgccugcauau

SEQ ID NO: 3682045 - RNA, 17 nt, Salmonella enterica enterica serovar Typhi Ty2
aacugcgcggcaaugag

SEQ ID NO: 3682046 - RNA, 14 nt, Salmonella enterica enterica serovar Typhi Ty2
aacugcggccagac

SEQ ID NO: 3682047 - RNA, 20 nt, Salmonella enterica enterica serovar Typhi Ty2
aacugcggcuauauaaaauc

SEQ ID NO: 3682048 - RNA, 18 nt, Salmonella enterica enterica serovar Typhi Ty2
aacugcgguaaauaaugc

SEQ ID NO: 3682049 - RNA, 16 nt, Salmonella enterica enterica serovar Typhi Ty2
aacugcucguaaagca

SEQ ID NO: 3682050 - RNA, 16 nt, Salmonella enterica enterica serovar Typhi Ty2
aacugcucuaccaacu

SEQ ID NO: 3682051 - RNA, 15 nt, Salmonella enterica enterica serovar Typhi Ty2
aacugcugccgcagc

SEQ ID NO: 3682052 - RNA, 18 nt, Salmonella enterica enterica serovar Typhi Ty2
aacugcugcgcgugcugu

SEQ ID NO: 3682053 - RNA, 14 nt, Salmonella enterica enterica serovar Typhi Ty2
aacugcuguagcac

SEQ ID NO: 3682054 - RNA, 19 nt, Salmonella enterica enterica serovar Typhi Ty2
aacuggcaagcgcuaagca

SEQ ID NO: 3682055 - RNA, 19 nt, Salmonella enterica enterica serovar Typhi Ty2
aacuggcgcaucuggucau

SEQ ID NO: 3682056 - RNA, 16 nt, Salmonella enterica enterica serovar Typhi Ty2
aacuggcgccggaguc

SEQ ID NO: 3682057 - RNA, 16 nt, Salmonella enterica enterica serovar Typhi Ty2
aacugggcgauaaagu

SEQ ID NO: 3682058 - RNA, 16 nt, Salmonella enterica enterica serovar Typhi Ty2
aacuggguaugcagug

SEQ ID NO: 3682059 - RNA, 19 nt, Salmonella enterica enterica serovar Typhi Ty2
aacugggugccgugaauau

SEQ ID NO: 3682060 - RNA, 22 nt, Salmonella enterica enterica serovar Typhi Ty2
aacuggucgcucuauuccaacu

SEQ ID NO: 3682061 - RNA, 13 nt, Salmonella enterica enterica serovar Typhi Ty2
aacuggugaaaca

SEQ ID NO: 3682062 - RNA, 17 nt, Salmonella enterica enterica serovar Typhi Ty2
aacuggugaaacagguu

SEQ ID NO: 3682063 - RNA, 15 nt, Salmonella enterica enterica serovar Typhi Ty2
aacuguauccguaau

SEQ ID NO: 3682064 - RNA, 14 nt, Salmonella enterica enterica serovar Typhi Ty2
aacugucgccgcua

SEQ ID NO: 3682065 - RNA, 23 nt, Salmonella enterica enterica serovar Typhi Ty2
aacugucguauuuauuuucugaa

SEQ ID NO: 3682066 - RNA, 14 nt, Salmonella enterica enterica serovar Typhi Ty2
aacugucugaauca

SEQ ID NO: 3682067 - RNA, 13 nt, Salmonella enterica enterica serovar Typhi Ty2
aacuguuaucaua

SEQ ID NO: 3682068 - RNA, 22 nt, Salmonella enterica enterica serovar Typhi Ty2
aacuguuuuaccaaaucaauag

SEQ ID NO: 3682069 - RNA, 18 nt, Salmonella enterica enterica serovar Typhi Ty2
aacuuacaagugucguga

SEQ ID NO: 3682070 - RNA, 16 nt, Salmonella enterica enterica serovar Typhi Ty2
aacuuauuucuaucgc

SEQ ID NO: 3682071 - RNA, 17 nt, Salmonella enterica enterica serovar Typhi Ty2
aacuuauuuuauuuuua

SEQ ID NO: 3682072 - RNA, 18 nt, Salmonella enterica enterica serovar Typhi Ty2
aacuuauuuuauuuuuau

SEQ ID NO: 3682073 - RNA, 18 nt, Salmonella enterica enterica serovar Typhi Ty2
aacuucaauucagaaagu

SEQ ID NO: 3682074 - RNA, 22 nt, Salmonella enterica enterica serovar Typhi Ty2
aacuucacgccaucgacaaagg

SEQ ID NO: 3682075 - RNA, 21 nt, Salmonella enterica enterica serovar Typhi Ty2
aacuuccaccaccuccugcug

SEQ ID NO: 3682076 - RNA, 18 nt, Salmonella enterica enterica serovar Typhi Ty2
aacuucgcgguuagaaag

SEQ ID NO: 3682077 - RNA, 19 nt, Salmonella enterica enterica serovar Typhi Ty2
aacuucuccgccaucaguu

SEQ ID NO: 3682078 - RNA, 17 nt, Salmonella enterica enterica serovar Typhi Ty2
aacuucucgcaggccaa

SEQ ID NO: 3682079 - RNA, 15 nt, Salmonella enterica enterica serovar Typhi Ty2
aacuugauuccuggc

SEQ ID NO: 3682080 - RNA, 13 nt, Salmonella enterica enterica serovar Typhi Ty2
aacuuguaaaaau

SEQ ID NO: 3682081 - RNA, 22 nt, Salmonella enterica enterica serovar Typhi Ty2
aacuuguaaaaaugccugugcc

SEQ ID NO: 3682082 - RNA, 21 nt, Salmonella enterica enterica serovar Typhi Ty2
aacuuuaucaccagcgauuac

SEQ ID NO: 3682083 - RNA, 21 nt, Salmonella enterica enterica serovar Typhi Ty2
aacuuuaucgcgcggcgaugu

SEQ ID NO: 3682084 - RNA, 13 nt, Salmonella enterica enterica serovar Typhi Ty2
aacuuucagaaua

SEQ ID NO: 3682085 - RNA, 15 nt, Salmonella enterica enterica serovar Typhi Ty2
aacuuucagaauaau

SEQ ID NO: 3682086 - RNA, 12 nt, Salmonella enterica enterica serovar Typhi Ty2
aacuuucauuuc

SEQ ID NO: 3682087 - RNA, 16 nt, Salmonella enterica enterica serovar Typhi Ty2
aacuuuuaauuuuuau

SEQ ID NO: 3682088 - RNA, 16 nt, Salmonella enterica enterica serovar Typhi Ty2
aacuuuuggugcccau

SEQ ID NO: 3682089 - RNA, 15 nt, Salmonella enterica enterica serovar Typhi Ty2
aacuuuuucgaugau

SEQ ID NO: 3682090 - RNA, 17 nt, Salmonella enterica enterica serovar Typhi Ty2
aagaaaaaacuggugca

SEQ ID NO: 3682091 - RNA, 12 nt, Salmonella enterica enterica serovar Typhi Ty2
aagaaaccauua

SEQ ID NO: 3682092 - RNA, 14 nt, Salmonella enterica enterica serovar Typhi Ty2
aagaaacgccgacc

SEQ ID NO: 3682093 - RNA, 22 nt, Salmonella enterica enterica serovar Typhi Ty2
aagaaacgccgcgcaaagcaau

SEQ ID NO: 3682094 - RNA, 15 nt, Salmonella enterica enterica serovar Typhi Ty2
aagaaauguccauaa

SEQ ID NO: 3682095 - RNA, 17 nt, Salmonella enterica enterica serovar Typhi Ty2
aagaaauugggcuucca

SEQ ID NO: 3682096 - RNA, 14 nt, Salmonella enterica enterica serovar Typhi Ty2
aagaacagcgucgc

SEQ ID NO: 3682097 - RNA, 14 nt, Salmonella enterica enterica serovar Typhi Ty2
aagaacaugacggc

SEQ ID NO: 3682098 - RNA, 22 nt, Salmonella enterica enterica serovar Typhi Ty2
aagaaccgacugucgaaaccag

SEQ ID NO: 3682099 - RNA, 15 nt, Salmonella enterica enterica serovar Typhi Ty2
aagaacguguuuuuc

SEQ ID NO: 3682100 - RNA, 16 nt, Salmonella enterica enterica serovar Typhi Ty2
aagaacguucaugcgu

SEQ ID NO: 3682101 - RNA, 22 nt, Salmonella enterica enterica serovar Typhi Ty2
aagaacugcaaauaccacauca

SEQ ID NO: 3682102 - RNA, 12 nt, Salmonella enterica enterica serovar Typhi Ty2
aagaagaauuau

SEQ ID NO: 3682103 - RNA, 17 nt, Salmonella enterica enterica serovar Typhi Ty2
aagaagguuaauauaca

SEQ ID NO: 3682104 - RNA, 18 nt, Salmonella enterica enterica serovar Typhi Ty2
aagaagucagugcugagc

SEQ ID NO: 3682105 - RNA, 15 nt, Salmonella enterica enterica serovar Typhi Ty2
aagaagucugugaga

SEQ ID NO: 3682106 - RNA, 13 nt, Salmonella enterica enterica serovar Typhi Ty2
aagaauacccuuu

SEQ ID NO: 3682107 - RNA, 17 nt, Salmonella enterica enterica serovar Typhi Ty2
aagaauacccuuuacac

SEQ ID NO: 3682108 - RNA, 21 nt, Salmonella enterica enterica serovar Typhi Ty2
aagaauagcgcuuuccugcgu

SEQ ID NO: 3682109 - RNA, 12 nt, Salmonella enterica enterica serovar Typhi Ty2
aagaauaugaga

SEQ ID NO: 3682110 - RNA, 17 nt, Salmonella enterica enterica serovar Typhi Ty2
aagaaucgccagucgca

SEQ ID NO: 3682111 - RNA, 14 nt, Salmonella enterica enterica serovar Typhi Ty2
aagaaugaaaaaaa

SEQ ID NO: 3682112 - RNA, 16 nt, Salmonella enterica enterica serovar Typhi Ty2
aagaaugcgcgucagg

SEQ ID NO: 3682113 - RNA, 17 nt, Salmonella enterica enterica serovar Typhi Ty2
aagaauguccaucucuu

SEQ ID NO: 3682114 - RNA, 17 nt, Salmonella enterica enterica serovar Typhi Ty2
aagaauuauuaccaaug

SEQ ID NO: 3682115 - RNA, 20 nt, Salmonella enterica enterica serovar Typhi Ty2
aagaauuauuaucaauuuca

SEQ ID NO: 3682116 - RNA, 22 nt, Salmonella enterica enterica serovar Typhi Ty2
aagaauuauuaucaauuucaua

SEQ ID NO: 3682117 - RNA, 14 nt, Salmonella enterica enterica serovar Typhi Ty2
aagaauucgcaaug

SEQ ID NO: 3682118 - RNA, 19 nt, Salmonella enterica enterica serovar Typhi Ty2
aagaauuucgcgaauaauc

SEQ ID NO: 3682119 - RNA, 16 nt, Salmonella enterica enterica serovar Typhi Ty2
aagaauuugaacucuu

SEQ ID NO: 3682120 - RNA, 20 nt, Salmonella enterica enterica serovar Typhi Ty2
aagaauuugaacucuuucag

SEQ ID NO: 3682121 - RNA, 16 nt, Salmonella enterica enterica serovar Typhi Ty2
aagacaacguaaacgg

SEQ ID NO: 3682122 - RNA, 16 nt, Salmonella enterica enterica serovar Typhi Ty2
aagacaccccagccua

SEQ ID NO: 3682123 - RNA, 23 nt, Salmonella enterica enterica serovar Typhi Ty2
aagacaugaucuuaccucuccug

SEQ ID NO: 3682124 - RNA, 16 nt, Salmonella enterica enterica serovar Typhi Ty2
aagacauggaguucca

SEQ ID NO: 3682125 - RNA, 14 nt, Salmonella enterica enterica serovar Typhi Ty2
aagacauucacaua

SEQ ID NO: 3682126 - RNA, 23 nt, Salmonella enterica enterica serovar Typhi Ty2
aagacauucacauauauuucugu

SEQ ID NO: 3682127 - RNA, 18 nt, Salmonella enterica enterica serovar Typhi Ty2
aagaccaugaacaccuca

SEQ ID NO: 3682128 - RNA, 14 nt, Salmonella enterica enterica serovar Typhi Ty2
aagacccgaaccug

SEQ ID NO: 3682129 - RNA, 16 nt, Salmonella enterica enterica serovar Typhi Ty2
aagaccgacaucgcca

SEQ ID NO: 3682130 - RNA, 15 nt, Salmonella enterica enterica serovar Typhi Ty2
aagaccuccgcccgg

SEQ ID NO: 3682131 - RNA, 21 nt, Salmonella enterica enterica serovar Typhi Ty2
aagacgaaaaaugaauaccaa

SEQ ID NO: 3682132 - RNA, 16 nt, Salmonella enterica enterica serovar Typhi Ty2
aagacgaauaaggaau

SEQ ID NO: 3682133 - RNA, 19 nt, Salmonella enterica enterica serovar Typhi Ty2
aagacgcucgacguccagc

SEQ ID NO: 3682134 - RNA, 16 nt, Salmonella enterica enterica serovar Typhi Ty2
aagacgguaaucagac

SEQ ID NO: 3682135 - RNA, 17 nt, Salmonella enterica enterica serovar Typhi Ty2
aagacgguuauuuuuca

SEQ ID NO: 3682136 - RNA, 20 nt, Salmonella enterica enterica serovar Typhi Ty2
aagacgguuauuuuucagau

SEQ ID NO: 3682137 - RNA, 20 nt, Salmonella enterica enterica serovar Typhi Ty2
aagacgguuucagugauaaa

SEQ ID NO: 3682138 - RNA, 15 nt, Salmonella enterica enterica serovar Typhi Ty2
aagacuacgcaaaaa

SEQ ID NO: 3682139 - RNA, 19 nt, Salmonella enterica enterica serovar Typhi Ty2
aagacugauuuaucaccca

SEQ ID NO: 3682140 - RNA, 18 nt, Salmonella enterica enterica serovar Typhi Ty2
aagacugcuccggcaaga

SEQ ID NO: 3682141 - RNA, 13 nt, Salmonella enterica enterica serovar Typhi Ty2
aagacuggcaacc

SEQ ID NO: 3682142 - RNA, 15 nt, Salmonella enterica enterica serovar Typhi Ty2
aagacuuagcccugg

SEQ ID NO: 3682143 - RNA, 16 nt, Salmonella enterica enterica serovar Typhi Ty2
aagagaaacauacugu

SEQ ID NO: 3682144 - RNA, 17 nt, Salmonella enterica enterica serovar Typhi Ty2
aagagaacguucguugu

SEQ ID NO: 3682145 - RNA, 12 nt, Salmonella enterica enterica serovar Typhi Ty2
aagagagcaaca

SEQ ID NO: 3682146 - RNA, 14 nt, Salmonella enterica enterica serovar Typhi Ty2
aagagagugagaaa

SEQ ID NO: 3682147 - RNA, 19 nt, Salmonella enterica enterica serovar Typhi Ty2
aagagauggaaugagcauc

SEQ ID NO: 3682148 - RNA, 23 nt, Salmonella enterica enterica serovar Typhi Ty2
aagagcggcgaguuguuucaaca

SEQ ID NO: 3682149 - RNA, 21 nt, Salmonella enterica enterica serovar Typhi Ty2
aagagcguccaguccuguccc

SEQ ID NO: 3682150 - RNA, 20 nt, Salmonella enterica enterica serovar Typhi Ty2
aagagcguuacccagacagc

SEQ ID NO: 3682151 - RNA, 21 nt, Salmonella enterica enterica serovar Typhi Ty2
aagaggcauaaaaaaaagccg

SEQ ID NO: 3682152 - RNA, 15 nt, Salmonella enterica enterica serovar Typhi Ty2
aagagguauccugaa

SEQ ID NO: 3682153 - RNA, 14 nt, Salmonella enterica enterica serovar Typhi Ty2
aagauaaaaagaca

SEQ ID NO: 3682154 - RNA, 15 nt, Salmonella enterica enterica serovar Typhi Ty2
aagauaaaaagacag

SEQ ID NO: 3682155 - RNA, 17 nt, Salmonella enterica enterica serovar Typhi Ty2
aagauaaaaagacagau

SEQ ID NO: 3682156 - RNA, 12 nt, Salmonella enterica enterica serovar Typhi Ty2
aagauaaaaaua

SEQ ID NO: 3682157 - RNA, 16 nt, Salmonella enterica enterica serovar Typhi Ty2
aagauaaacagcagcg

SEQ ID NO: 3682158 - RNA, 23 nt, Salmonella enterica enterica serovar Typhi Ty2
aagauaauguccccuaaauaauu

SEQ ID NO: 3682159 - RNA, 22 nt, Salmonella enterica enterica serovar Typhi Ty2
aagauauugucgcccugcaauu

SEQ ID NO: 3682160 - RNA, 22 nt, Salmonella enterica enterica serovar Typhi Ty2
aagauauuuuguuuuaaauuca

SEQ ID NO: 3682161 - RNA, 21 nt, Salmonella enterica enterica serovar Typhi Ty2
aagaucccagggcggcgucgc

SEQ ID NO: 3682162 - RNA, 21 nt, Salmonella enterica enterica serovar Typhi Ty2
aagaucccgaccaguuuuugc

SEQ ID NO: 3682163 - RNA, 21 nt, Salmonella enterica enterica serovar Typhi Ty2
aagaucgcauuuaaucgccug

SEQ ID NO: 3682164 - RNA, 18 nt, Salmonella enterica enterica serovar Typhi Ty2
aagaucgccaagcuguga

SEQ ID NO: 3682165 - RNA, 19 nt, Salmonella enterica enterica serovar Typhi Ty2
aagaucgcggggcaacaga

SEQ ID NO: 3682166 - RNA, 16 nt, Salmonella enterica enterica serovar Typhi Ty2
aagaucguuauccagc

SEQ ID NO: 3682167 - RNA, 19 nt, Salmonella enterica enterica serovar Typhi Ty2
aagaucguuauccagcagc

SEQ ID NO: 3682168 - RNA, 22 nt, Salmonella enterica enterica serovar Typhi Ty2
aagaucguuauccagcagccac

SEQ ID NO: 3682169 - RNA, 15 nt, Salmonella enterica enterica serovar Typhi Ty2
aagaugcuacccguc

SEQ ID NO: 3682170 - RNA, 11 nt, Salmonella enterica enterica serovar Typhi Ty2
aagauguagac

SEQ ID NO: 3682171 - RNA, 15 nt, Salmonella enterica enterica serovar Typhi Ty2
aagauguagucgccu

SEQ ID NO: 3682172 - RNA, 19 nt, Salmonella enterica enterica serovar Typhi Ty2
aagaugugccacuccgcca

SEQ ID NO: 3682173 - RNA, 16 nt, Salmonella enterica enterica serovar Typhi Ty2
aagauuaaccagcagu

SEQ ID NO: 3682174 - RNA, 20 nt, Salmonella enterica enterica serovar Typhi Ty2
aagauuaauugauuacaaag

SEQ ID NO: 3682175 - RNA, 19 nt, Salmonella enterica enterica serovar Typhi Ty2
aagauuagccccagcgcca

SEQ ID NO: 3682176 - RNA, 12 nt, Salmonella enterica enterica serovar Typhi Ty2
aagauuccagau

SEQ ID NO: 3682177 - RNA, 18 nt, Salmonella enterica enterica serovar Typhi Ty2
aagauugauuuauucacu

SEQ ID NO: 3682178 - RNA, 20 nt, Salmonella enterica enterica serovar Typhi Ty2
aagauugcgcagggucuggu

SEQ ID NO: 3682179 - RNA, 16 nt, Salmonella enterica enterica serovar Typhi Ty2
aagcaaaaaucaccac

SEQ ID NO: 3682180 - RNA, 20 nt, Salmonella enterica enterica serovar Typhi Ty2
aagcaacugauuaaucugcc

SEQ ID NO: 3682181 - RNA, 23 nt, Salmonella enterica enterica serovar Typhi Ty2
aagcaacugggcuugcauugcuu

SEQ ID NO: 3682182 - RNA, 20 nt, Salmonella enterica enterica serovar Typhi Ty2
aagcaacuguagaaugcuau

SEQ ID NO: 3682183 - RNA, 19 nt, Salmonella enterica enterica serovar Typhi Ty2
aagcaauauggcugcgaua

SEQ ID NO: 3682184 - RNA, 17 nt, Salmonella enterica enterica serovar Typhi Ty2
aagcaauccauuuuaaa

SEQ ID NO: 3682185 - RNA, 21 nt, Salmonella enterica enterica serovar Typhi Ty2
aagcaauccauuuuaaauaca

SEQ ID NO: 3682186 - RNA, 15 nt, Salmonella enterica enterica serovar Typhi Ty2
aagcaaucgccagcg

SEQ ID NO: 3682187 - RNA, 14 nt, Salmonella enterica enterica serovar Typhi Ty2
aagcaaugccagaa

SEQ ID NO: 3682188 - RNA, 16 nt, Salmonella enterica enterica serovar Typhi Ty2
aagcaauuaauauuua

SEQ ID NO: 3682189 - RNA, 19 nt, Salmonella enterica enterica serovar Typhi Ty2
aagcacaucagcaaaugaa

SEQ ID NO: 3682190 - RNA, 21 nt, Salmonella enterica enterica serovar Typhi Ty2
aagcacgggcuugaauaacau

SEQ ID NO: 3682191 - RNA, 19 nt, Salmonella enterica enterica serovar Typhi Ty2
aagcacucguaagaggcgu

SEQ ID NO: 3682192 - RNA, 18 nt, Salmonella enterica enterica serovar Typhi Ty2
aagcagaacguagcccau

SEQ ID NO: 3682193 - RNA, 14 nt, Salmonella enterica enterica serovar Typhi Ty2
aagcagacgcucga

SEQ ID NO: 3682194 - RNA, 12 nt, Salmonella enterica enterica serovar Typhi Ty2
aagcagcgacaa

SEQ ID NO: 3682195 - RNA, 23 nt, Salmonella enterica enterica serovar Typhi Ty2
aagcagcgccuguaaacguuccu

SEQ ID NO: 3682196 - RNA, 20 nt, Salmonella enterica enterica serovar Typhi Ty2
aagcagcugcugguaccuuu

SEQ ID NO: 3682197 - RNA, 23 nt, Salmonella enterica enterica serovar Typhi Ty2
aagcagcuuaucuuuacgcuugu

SEQ ID NO: 3682198 - RNA, 12 nt, Salmonella enterica enterica serovar Typhi Ty2
aagcagcuugcu

SEQ ID NO: 3682199 - RNA, 13 nt, Salmonella enterica enterica serovar Typhi Ty2
aagcagucccgcc

SEQ ID NO: 3682200 - RNA, 15 nt, Salmonella enterica enterica serovar Typhi Ty2
aagcagugaaucccc

SEQ ID NO: 3682201 - RNA, 15 nt, Salmonella enterica enterica serovar Typhi Ty2
aagcaguuccagcau

SEQ ID NO: 3682202 - RNA, 15 nt, Salmonella enterica enterica serovar Typhi Ty2
aagcauaaaaagacg

SEQ ID NO: 3682203 - RNA, 14 nt, Salmonella enterica enterica serovar Typhi Ty2
aagcauaccuucac

SEQ ID NO: 3682204 - RNA, 17 nt, Salmonella enterica enterica serovar Typhi Ty2
aagcauagcgccuucag

SEQ ID NO: 3682205 - RNA, 19 nt, Salmonella enterica enterica serovar Typhi Ty2
aagcauagcgccuucaggc

SEQ ID NO: 3682206 - RNA, 18 nt, Salmonella enterica enterica serovar Typhi Ty2
aagcauggcguuaaugcg

SEQ ID NO: 3682207 - RNA, 13 nt, Salmonella enterica enterica serovar Typhi Ty2
aagcauuagcgcc

SEQ ID NO: 3682208 - RNA, 15 nt, Salmonella enterica enterica serovar Typhi Ty2
aagccaaaauuuuca

SEQ ID NO: 3682209 - RNA, 13 nt, Salmonella enterica enterica serovar Typhi Ty2
aagccacacugca

SEQ ID NO: 3682210 - RNA, 21 nt, Salmonella enterica enterica serovar Typhi Ty2
aagccacuugaaguaugaaag

SEQ ID NO: 3682211 - RNA, 15 nt, Salmonella enterica enterica serovar Typhi Ty2
aagccaggcuuuaaa

SEQ ID NO: 3682212 - RNA, 20 nt, Salmonella enterica enterica serovar Typhi Ty2
aagccagguugcgcccggcg

SEQ ID NO: 3682213 - RNA, 13 nt, Salmonella enterica enterica serovar Typhi Ty2
aagccagguuuuc

SEQ ID NO: 3682214 - RNA, 18 nt, Salmonella enterica enterica serovar Typhi Ty2
aagcccaacuacacucuu

SEQ ID NO: 3682215 - RNA, 18 nt, Salmonella enterica enterica serovar Typhi Ty2
aagccccccgcacagcac

SEQ ID NO: 3682216 - RNA, 16 nt, Salmonella enterica enterica serovar Typhi Ty2
aagcccggccacagcg

SEQ ID NO: 3682217 - RNA, 15 nt, Salmonella enterica enterica serovar Typhi Ty2
aagccgaccuuauuc

SEQ ID NO: 3682218 - RNA, 19 nt, Salmonella enterica enterica serovar Typhi Ty2
aagccgccauccggcauuu

SEQ ID NO: 3682219 - RNA, 19 nt, Salmonella enterica enterica serovar Typhi Ty2
aagccggcaggcagcgcca

SEQ ID NO: 3682220 - RNA, 16 nt, Salmonella enterica enterica serovar Typhi Ty2
aagccggcggaaaaaa

SEQ ID NO: 3682221 - RNA, 22 nt, Salmonella enterica enterica serovar Typhi Ty2
aagccggcggaaaaaagcagca

SEQ ID NO: 3682222 - RNA, 22 nt, Salmonella enterica enterica serovar Typhi Ty2
aagccguauuuuauuuuucaau

SEQ ID NO: 3682223 - RNA, 15 nt, Salmonella enterica enterica serovar Typhi Ty2
aagccgucggcgcca

SEQ ID NO: 3682224 - RNA, 19 nt, Salmonella enterica enterica serovar Typhi Ty2
aagccugauacuuuuacuc

SEQ ID NO: 3682225 - RNA, 22 nt, Salmonella enterica enterica serovar Typhi Ty2
aagccugauggcgcuucgcuua

SEQ ID NO: 3682226 - RNA, 12 nt, Salmonella enterica enterica serovar Typhi Ty2
aagccuuucugu

SEQ ID NO: 3682227 - RNA, 23 nt, Salmonella enterica enterica serovar Typhi Ty2
aagccuuucuguucuuugauuag

SEQ ID NO: 3682228 - RNA, 12 nt, Salmonella enterica enterica serovar Typhi Ty2
aagcgaaaauaa

SEQ ID NO: 3682229 - RNA, 15 nt, Salmonella enterica enterica serovar Typhi Ty2
aagcgaagagagauc

SEQ ID NO: 3682230 - RNA, 23 nt, Salmonella enterica enterica serovar Typhi Ty2
aagcgaauacuccugcaacagaa

SEQ ID NO: 3682231 - RNA, 17 nt, Salmonella enterica enterica serovar Typhi Ty2
aagcgaauccagcgccg

SEQ ID NO: 3682232 - RNA, 14 nt, Salmonella enterica enterica serovar Typhi Ty2
aagcgaaugcuguc

SEQ ID NO: 3682233 - RNA, 17 nt, Salmonella enterica enterica serovar Typhi Ty2
aagcgaccagcgcgcca

SEQ ID NO: 3682234 - RNA, 20 nt, Salmonella enterica enterica serovar Typhi Ty2
aagcgacgcgcgguugcggc

SEQ ID NO: 3682235 - RNA, 17 nt, Salmonella enterica enterica serovar Typhi Ty2
aagcgagguaaaaagcg

SEQ ID NO: 3682236 - RNA, 23 nt, Salmonella enterica enterica serovar Typhi Ty2
aagcgauguauuuauccacgccg

SEQ ID NO: 3682237 - RNA, 18 nt, Salmonella enterica enterica serovar Typhi Ty2
aagcgauuuauccaccgc

SEQ ID NO: 3682238 - RNA, 20 nt, Salmonella enterica enterica serovar Typhi Ty2
aagcgauuuauccaccgcca

SEQ ID NO: 3682239 - RNA, 17 nt, Salmonella enterica enterica serovar Typhi Ty2
aagcgcaaaauagcagc

SEQ ID NO: 3682240 - RNA, 17 nt, Salmonella enterica enterica serovar Typhi Ty2
aagcgcaaacuuccaca

SEQ ID NO: 3682241 - RNA, 13 nt, Salmonella enterica enterica serovar Typhi Ty2
aagcgcagcgcca

SEQ ID NO: 3682242 - RNA, 20 nt, Salmonella enterica enterica serovar Typhi Ty2
aagcgcagcgccauccggca

SEQ ID NO: 3682243 - RNA, 13 nt, Salmonella enterica enterica serovar Typhi Ty2
aagcgcagcguca

SEQ ID NO: 3682244 - RNA, 22 nt, Salmonella enterica enterica serovar Typhi Ty2
aagcgcaggugcgauacggcuu

SEQ ID NO: 3682245 - RNA, 23 nt, Salmonella enterica enterica serovar Typhi Ty2
aagcgccagauaugaucgaaaau

SEQ ID NO: 3682246 - RNA, 15 nt, Salmonella enterica enterica serovar Typhi Ty2
aagcgccaucaggca

SEQ ID NO: 3682247 - RNA, 15 nt, Salmonella enterica enterica serovar Typhi Ty2
aagcgcccguagcuc

SEQ ID NO: 3682248 - RNA, 23 nt, Salmonella enterica enterica serovar Typhi Ty2
aagcgccggaugaggacauaaac

SEQ ID NO: 3682249 - RNA, 16 nt, Salmonella enterica enterica serovar Typhi Ty2
aagcgccuguucaaca

SEQ ID NO: 3682250 - RNA, 18 nt, Salmonella enterica enterica serovar Typhi Ty2
aagcgccuguucaacaug

SEQ ID NO: 3682251 - RNA, 14 nt, Salmonella enterica enterica serovar Typhi Ty2
aagcgcggcagcag

SEQ ID NO: 3682252 - RNA, 20 nt, Salmonella enterica enterica serovar Typhi Ty2
aagcgcgguaaauuucuuga

SEQ ID NO: 3682253 - RNA, 19 nt, Salmonella enterica enterica serovar Typhi Ty2
aagcgcucaagcggcacca

SEQ ID NO: 3682254 - RNA, 19 nt, Salmonella enterica enterica serovar Typhi Ty2
aagcgcucaugccacgcca

SEQ ID NO: 3682255 - RNA, 14 nt, Salmonella enterica enterica serovar Typhi Ty2
aagcgcugccgcaa

SEQ ID NO: 3682256 - RNA, 18 nt, Salmonella enterica enterica serovar Typhi Ty2
aagcgcuuuggucaggcu

SEQ ID NO: 3682257 - RNA, 23 nt, Salmonella enterica enterica serovar Typhi Ty2
aagcggaaaggacguucuucucc

SEQ ID NO: 3682258 - RNA, 20 nt, Salmonella enterica enterica serovar Typhi Ty2
aagcggaccaaugcuggcag

SEQ ID NO: 3682259 - RNA, 17 nt, Salmonella enterica enterica serovar Typhi Ty2
aagcggauaagauagca

SEQ ID NO: 3682260 - RNA, 20 nt, Salmonella enterica enterica serovar Typhi Ty2
aagcggcaagccgaucagcg

SEQ ID NO: 3682261 - RNA, 14 nt, Salmonella enterica enterica serovar Typhi Ty2
aagcggcacaaaua

SEQ ID NO: 3682262 - RNA, 14 nt, Salmonella enterica enterica serovar Typhi Ty2
aagcggcagcgcca

SEQ ID NO: 3682263 - RNA, 13 nt, Salmonella enterica enterica serovar Typhi Ty2
aagcgguaaaucg

SEQ ID NO: 3682264 - RNA, 18 nt, Salmonella enterica enterica serovar Typhi Ty2
aagcgguguaaaagccag

SEQ ID NO: 3682265 - RNA, 23 nt, Salmonella enterica enterica serovar Typhi Ty2
aagcguaacagcgcuaucaggaa

SEQ ID NO: 3682266 - RNA, 12 nt, Salmonella enterica enterica serovar Typhi Ty2
aagcguaagcgu

SEQ ID NO: 3682267 - RNA, 19 nt, Salmonella enterica enterica serovar Typhi Ty2
aagcguagcgcauccggca

SEQ ID NO: 3682268 - RNA, 13 nt, Salmonella enterica enterica serovar Typhi Ty2
aagcguagcgcca

SEQ ID NO: 3682269 - RNA, 16 nt, Salmonella enterica enterica serovar Typhi Ty2
aagcguagcgccauca

SEQ ID NO: 3682270 - RNA, 19 nt, Salmonella enterica enterica serovar Typhi Ty2
aagcgucaguaaaagcccg

SEQ ID NO: 3682271 - RNA, 15 nt, Salmonella enterica enterica serovar Typhi Ty2
aagcgucauccggca

SEQ ID NO: 3682272 - RNA, 22 nt, Salmonella enterica enterica serovar Typhi Ty2
aagcgucucagauggaaaaaaa

SEQ ID NO: 3682273 - RNA, 21 nt, Salmonella enterica enterica serovar Typhi Ty2
aagcgucuuuaaagccuucau

SEQ ID NO: 3682274 - RNA, 15 nt, Salmonella enterica enterica serovar Typhi Ty2
aagcguuaaugcguu

SEQ ID NO: 3682275 - RNA, 22 nt, Salmonella enterica enterica serovar Typhi Ty2
aagcguuaaugcguuuacacag

SEQ ID NO: 3682276 - RNA, 18 nt, Salmonella enterica enterica serovar Typhi Ty2
aagcguuacggaaaaaau

SEQ ID NO: 3682277 - RNA, 20 nt, Salmonella enterica enterica serovar Typhi Ty2
aagcguuacggaaaaaauac

SEQ ID NO: 3682278 - RNA, 21 nt, Salmonella enterica enterica serovar Typhi Ty2
aagcguuacggaaaaaauacu

SEQ ID NO: 3682279 - RNA, 12 nt, Salmonella enterica enterica serovar Typhi Ty2
aagcguuccagu

SEQ ID NO: 3682280 - RNA, 19 nt, Salmonella enterica enterica serovar Typhi Ty2
aagcguugccguaggcaac

SEQ ID NO: 3682281 - RNA, 16 nt, Salmonella enterica enterica serovar Typhi Ty2
aagcguuguaacaaac

SEQ ID NO: 3682282 - RNA, 22 nt, Salmonella enterica enterica serovar Typhi Ty2
aagcguuguaacaaaccgguaa

SEQ ID NO: 3682283 - RNA, 21 nt, Salmonella enterica enterica serovar Typhi Ty2
aagcguuuaauuccaucggca

SEQ ID NO: 3682284 - RNA, 14 nt, Salmonella enterica enterica serovar Typhi Ty2
aagcguuuccagag

SEQ ID NO: 3682285 - RNA, 22 nt, Salmonella enterica enterica serovar Typhi Ty2
aagcguuuccagaguacauucu

SEQ ID NO: 3682286 - RNA, 15 nt, Salmonella enterica enterica serovar Typhi Ty2
aagcguuucucuugu

SEQ ID NO: 3682287 - RNA, 18 nt, Salmonella enterica enterica serovar Typhi Ty2
aagcuaauccccagcgcu

SEQ ID NO: 3682288 - RNA, 20 nt, Salmonella enterica enterica serovar Typhi Ty2
aagcuaguaaagaaauuuug

SEQ ID NO: 3682289 - RNA, 20 nt, Salmonella enterica enterica serovar Typhi Ty2
aagcuauccucuuuuaucac

SEQ ID NO: 3682290 - RNA, 22 nt, Salmonella enterica enterica serovar Typhi Ty2
aagcuauuacaaaaaucaugcc

SEQ ID NO: 3682291 - RNA, 17 nt, Salmonella enterica enterica serovar Typhi Ty2
aagcuauuccuguauaa

SEQ ID NO: 3682292 - RNA, 18 nt, Salmonella enterica enterica serovar Typhi Ty2
aagcucaacgcaggcugg

SEQ ID NO: 3682293 - RNA, 13 nt, Salmonella enterica enterica serovar Typhi Ty2
aagcucagcggca

SEQ ID NO: 3682294 - RNA, 21 nt, Salmonella enterica enterica serovar Typhi Ty2
aagcucauuucccaauaguuu

SEQ ID NO: 3682295 - RNA, 15 nt, Salmonella enterica enterica serovar Typhi Ty2
aagcugaccagggca

SEQ ID NO: 3682296 - RNA, 22 nt, Salmonella enterica enterica serovar Typhi Ty2
aagcugagaaaagggcgcacca

SEQ ID NO: 3682297 - RNA, 13 nt, Salmonella enterica enterica serovar Typhi Ty2
aagcugauauuuu

SEQ ID NO: 3682298 - RNA, 17 nt, Salmonella enterica enterica serovar Typhi Ty2
aagcugcaccaggagca

SEQ ID NO: 3682299 - RNA, 19 nt, Salmonella enterica enterica serovar Typhi Ty2
aagcugcggcccagauaac

SEQ ID NO: 3682300 - RNA, 18 nt, Salmonella enterica enterica serovar Typhi Ty2
aagcuggauaccgcgcca

SEQ ID NO: 3682301 - RNA, 21 nt, Salmonella enterica enterica serovar Typhi Ty2
aagcuggauaccgcgccagcg

SEQ ID NO: 3682302 - RNA, 20 nt, Salmonella enterica enterica serovar Typhi Ty2
aagcugggcgucaacgugaa

SEQ ID NO: 3682303 - RNA, 21 nt, Salmonella enterica enterica serovar Typhi Ty2
aagcugguggcgaguccugcc

SEQ ID NO: 3682304 - RNA, 22 nt, Salmonella enterica enterica serovar Typhi Ty2
aagcugguggcgaguccugccg

SEQ ID NO: 3682305 - RNA, 23 nt, Salmonella enterica enterica serovar Typhi Ty2
aagcugguuaaugaccugccgcg

SEQ ID NO: 3682306 - RNA, 19 nt, Salmonella enterica enterica serovar Typhi Ty2
aagcuguaacacugccgaa

SEQ ID NO: 3682307 - RNA, 20 nt, Salmonella enterica enterica serovar Typhi Ty2
aagcuguuccggcuucguua

SEQ ID NO: 3682308 - RNA, 21 nt, Salmonella enterica enterica serovar Typhi Ty2
aagcuguuucuccguuguugc

SEQ ID NO: 3682309 - RNA, 13 nt, Salmonella enterica enterica serovar Typhi Ty2
aagcuuguagaaa

SEQ ID NO: 3682310 - RNA, 18 nt, Salmonella enterica enterica serovar Typhi Ty2
aagcuuucaucuuuaaaa

SEQ ID NO: 3682311 - RNA, 17 nt, Salmonella enterica enterica serovar Typhi Ty2
aagcuuugcguaaaaaa

SEQ ID NO: 3682312 - RNA, 19 nt, Salmonella enterica enterica serovar Typhi Ty2
aagcuuugcguaaaaaaca

SEQ ID NO: 3682313 - RNA, 23 nt, Salmonella enterica enterica serovar Typhi Ty2
aagcuuuuucugcgugagccgga

SEQ ID NO: 3682314 - RNA, 22 nt, Salmonella enterica enterica serovar Typhi Ty2
aaggaaacuuauuucaacuuau

SEQ ID NO: 3682315 - RNA, 13 nt, Salmonella enterica enterica serovar Typhi Ty2
aaggaaauauuaa

SEQ ID NO: 3682316 - RNA, 15 nt, Salmonella enterica enterica serovar Typhi Ty2
aaggaaauauuaauu

SEQ ID NO: 3682317 - RNA, 11 nt, Salmonella enterica enterica serovar Typhi Ty2
aaggaaauuca

SEQ ID NO: 3682318 - RNA, 13 nt, Salmonella enterica enterica serovar Typhi Ty2
aaggaagggcgcu

SEQ ID NO: 3682319 - RNA, 19 nt, Salmonella enterica enterica serovar Typhi Ty2
aaggaauuaugcagacgcu

SEQ ID NO: 3682320 - RNA, 16 nt, Salmonella enterica enterica serovar Typhi Ty2
aaggacaggugcgcug

SEQ ID NO: 3682321 - RNA, 18 nt, Salmonella enterica enterica serovar Typhi Ty2
aaggauauguauuuguuc

SEQ ID NO: 3682322 - RNA, 12 nt, Salmonella enterica enterica serovar Typhi Ty2
aaggauauugcc

SEQ ID NO: 3682323 - RNA, 23 nt, Salmonella enterica enterica serovar Typhi Ty2
aaggaugaacucuaugcaaaaga

SEQ ID NO: 3682324 - RNA, 17 nt, Salmonella enterica enterica serovar Typhi Ty2
aaggaugacuaaucaau

SEQ ID NO: 3682325 - RNA, 20 nt, Salmonella enterica enterica serovar Typhi Ty2
aaggauuauuggcaucauaa

SEQ ID NO: 3682326 - RNA, 16 nt, Salmonella enterica enterica serovar Typhi Ty2
aaggcaacgccgccag

SEQ ID NO: 3682327 - RNA, 17 nt, Salmonella enterica enterica serovar Typhi Ty2
aaggcaccgguuuuuga

SEQ ID NO: 3682328 - RNA, 21 nt, Salmonella enterica enterica serovar Typhi Ty2
aaggcaccguuucuuugcugc

SEQ ID NO: 3682329 - RNA, 17 nt, Salmonella enterica enterica serovar Typhi Ty2
aaggcacgcuccugcuc

SEQ ID NO: 3682330 - RNA, 11 nt, Salmonella enterica enterica serovar Typhi Ty2
aaggcagccaa

SEQ ID NO: 3682331 - RNA, 20 nt, Salmonella enterica enterica serovar Typhi Ty2
aaggcaucguugagaaaacc

SEQ ID NO: 3682332 - RNA, 22 nt, Salmonella enterica enterica serovar Typhi Ty2
aaggcauuaagucauaccuguu

SEQ ID NO: 3682333 - RNA, 23 nt, Salmonella enterica enterica serovar Typhi Ty2
aaggcauuauguuuugaacauau

SEQ ID NO: 3682334 - RNA, 19 nt, Salmonella enterica enterica serovar Typhi Ty2
aaggcauuucaaucgccac

SEQ ID NO: 3682335 - RNA, 17 nt, Salmonella enterica enterica serovar Typhi Ty2
aaggccaaguuuagaaa

SEQ ID NO: 3682336 - RNA, 11 nt, Salmonella enterica enterica serovar Typhi Ty2
aaggccagacu

SEQ ID NO: 3682337 - RNA, 22 nt, Salmonella enterica enterica serovar Typhi Ty2
aaggccagacucaucgccgcaa

SEQ ID NO: 3682338 - RNA, 18 nt, Salmonella enterica enterica serovar Typhi Ty2
aaggccgauaaagcguuu

SEQ ID NO: 3682339 - RNA, 20 nt, Salmonella enterica enterica serovar Typhi Ty2
aaggccgcuuucgcggccuu

SEQ ID NO: 3682340 - RNA, 23 nt, Salmonella enterica enterica serovar Typhi Ty2
aaggccuggcugagaaaaauacg

SEQ ID NO: 3682341 - RNA, 19 nt, Salmonella enterica enterica serovar Typhi Ty2
aaggcgaacuccagcgcga

SEQ ID NO: 3682342 - RNA, 23 nt, Salmonella enterica enterica serovar Typhi Ty2
aaggcgacgaugugcauaaccgc

SEQ ID NO: 3682343 - RNA, 17 nt, Salmonella enterica enterica serovar Typhi Ty2
aaggcgacgcuucacgu

SEQ ID NO: 3682344 - RNA, 12 nt, Salmonella enterica enterica serovar Typhi Ty2
aaggcgcagccg

SEQ ID NO: 3682345 - RNA, 16 nt, Salmonella enterica enterica serovar Typhi Ty2
aaggcgcagccgccau

SEQ ID NO: 3682346 - RNA, 17 nt, Salmonella enterica enterica serovar Typhi Ty2
aaggcgcgauccgccca

SEQ ID NO: 3682347 - RNA, 15 nt, Salmonella enterica enterica serovar Typhi Ty2
aaggcgcuagccgca

SEQ ID NO: 3682348 - RNA, 22 nt, Salmonella enterica enterica serovar Typhi Ty2
aaggcgcuugugauaucugacu

SEQ ID NO: 3682349 - RNA, 23 nt, Salmonella enterica enterica serovar Typhi Ty2
aaggcggacaacgcauauuauga

SEQ ID NO: 3682350 - RNA, 17 nt, Salmonella enterica enterica serovar Typhi Ty2
aaggcggcaaagauaau

SEQ ID NO: 3682351 - RNA, 22 nt, Salmonella enterica enterica serovar Typhi Ty2
aaggcguaagucguaccggcgc

SEQ ID NO: 3682352 - RNA, 20 nt, Salmonella enterica enterica serovar Typhi Ty2
aaggcuaccgggcaaacauu

SEQ ID NO: 3682353 - RNA, 20 nt, Salmonella enterica enterica serovar Typhi Ty2
aaggcuaccgguugcguagc

SEQ ID NO: 3682354 - RNA, 14 nt, Salmonella enterica enterica serovar Typhi Ty2
aaggcuccauauca

SEQ ID NO: 3682355 - RNA, 15 nt, Salmonella enterica enterica serovar Typhi Ty2
aaggcucucuuacca

SEQ ID NO: 3682356 - RNA, 18 nt, Salmonella enterica enterica serovar Typhi Ty2
aaggcugcgcguuuucau

SEQ ID NO: 3682357 - RNA, 17 nt, Salmonella enterica enterica serovar Typhi Ty2
aaggcuggcacguucuc

SEQ ID NO: 3682358 - RNA, 22 nt, Salmonella enterica enterica serovar Typhi Ty2
aagggaagaucauuaucaauag

SEQ ID NO: 3682359 - RNA, 17 nt, Salmonella enterica enterica serovar Typhi Ty2
aagggaggugcucuccc

SEQ ID NO: 3682360 - RNA, 21 nt, Salmonella enterica enterica serovar Typhi Ty2
aagggaucgauaauugcucac

SEQ ID NO: 3682361 - RNA, 15 nt, Salmonella enterica enterica serovar Typhi Ty2
aagggcaauaucaug

SEQ ID NO: 3682362 - RNA, 14 nt, Salmonella enterica enterica serovar Typhi Ty2
aagggcaccugggc

SEQ ID NO: 3682363 - RNA, 14 nt, Salmonella enterica enterica serovar Typhi Ty2
aagggcgcugccag

SEQ ID NO: 3682364 - RNA, 18 nt, Salmonella enterica enterica serovar Typhi Ty2
aaggggauaacaaccagg

SEQ ID NO: 3682365 - RNA, 22 nt, Salmonella enterica enterica serovar Typhi Ty2
aaggggcaggcgucaaaacagg

SEQ ID NO: 3682366 - RNA, 15 nt, Salmonella enterica enterica serovar Typhi Ty2
aaggggccguagaaa

SEQ ID NO: 3682367 - RNA, 11 nt, Salmonella enterica enterica serovar Typhi Ty2
aagguaacuau

SEQ ID NO: 3682368 - RNA, 14 nt, Salmonella enterica enterica serovar Typhi Ty2
aagguaauuuucac

SEQ ID NO: 3682369 - RNA, 15 nt, Salmonella enterica enterica serovar Typhi Ty2
aagguauugauuuuu

SEQ ID NO: 3682370 - RNA, 17 nt, Salmonella enterica enterica serovar Typhi Ty2
aagguauugauuuuuaa

SEQ ID NO: 3682371 - RNA, 21 nt, Salmonella enterica enterica serovar Typhi Ty2
aaggucagguuaugcgcgcca

SEQ ID NO: 3682372 - RNA, 13 nt, Salmonella enterica enterica serovar Typhi Ty2
aagguccagggaa

SEQ ID NO: 3682373 - RNA, 23 nt, Salmonella enterica enterica serovar Typhi Ty2
aaggucugacaacuauugcugcc

SEQ ID NO: 3682374 - RNA, 14 nt, Salmonella enterica enterica serovar Typhi Ty2
aaggugagaaaaag

SEQ ID NO: 3682375 - RNA, 14 nt, Salmonella enterica enterica serovar Typhi Ty2
aaggugagcucuuu

SEQ ID NO: 3682376 - RNA, 21 nt, Salmonella enterica enterica serovar Typhi Ty2
aaggugaguuucgcaucagga

SEQ ID NO: 3682377 - RNA, 15 nt, Salmonella enterica enterica serovar Typhi Ty2
aagguuauccgccgg

SEQ ID NO: 3682378 - RNA, 18 nt, Salmonella enterica enterica serovar Typhi Ty2
aagguuaugcagcaugau

SEQ ID NO: 3682379 - RNA, 13 nt, Salmonella enterica enterica serovar Typhi Ty2
aagguugccgcaa

SEQ ID NO: 3682380 - RNA, 17 nt, Salmonella enterica enterica serovar Typhi Ty2
aagguuugcugcgucac

SEQ ID NO: 3682381 - RNA, 13 nt, Salmonella enterica enterica serovar Typhi Ty2
aagguuuuucccg

SEQ ID NO: 3682382 - RNA, 13 nt, Salmonella enterica enterica serovar Typhi Ty2
aaguaaaagccgu

SEQ ID NO: 3682383 - RNA, 14 nt, Salmonella enterica enterica serovar Typhi Ty2
aaguaagcgccagc

SEQ ID NO: 3682384 - RNA, 13 nt, Salmonella enterica enterica serovar Typhi Ty2
aaguaaggcauga

SEQ ID NO: 3682385 - RNA, 13 nt, Salmonella enterica enterica serovar Typhi Ty2
aaguaauaaaaua

SEQ ID NO: 3682386 - RNA, 21 nt, Salmonella enterica enterica serovar Typhi Ty2
aaguaauucuucgaaugucuc

SEQ ID NO: 3682387 - RNA, 19 nt, Salmonella enterica enterica serovar Typhi Ty2
aaguaauuuccauauuuau

SEQ ID NO: 3682388 - RNA, 18 nt, Salmonella enterica enterica serovar Typhi Ty2
aaguaccaaaacagaaaa

SEQ ID NO: 3682389 - RNA, 22 nt, Salmonella enterica enterica serovar Typhi Ty2
aaguaccagcgcgaacauuaca

SEQ ID NO: 3682390 - RNA, 20 nt, Salmonella enterica enterica serovar Typhi Ty2
aaguacgccugaaaacagaa

SEQ ID NO: 3682391 - RNA, 14 nt, Salmonella enterica enterica serovar Typhi Ty2
aaguagaucaccag

SEQ ID NO: 3682392 - RNA, 15 nt, Salmonella enterica enterica serovar Typhi Ty2
aaguagcagagaaaa

SEQ ID NO: 3682393 - RNA, 15 nt, Salmonella enterica enterica serovar Typhi Ty2
aaguagcugaaaauc

SEQ ID NO: 3682394 - RNA, 23 nt, Salmonella enterica enterica serovar Typhi Ty2
aaguaguuggugggugaugacgg

SEQ ID NO: 3682395 - RNA, 12 nt, Salmonella enterica enterica serovar Typhi Ty2
aaguauaaagcu

SEQ ID NO: 3682396 - RNA, 16 nt, Salmonella enterica enterica serovar Typhi Ty2
aaguauaaucauaccg

SEQ ID NO: 3682397 - RNA, 17 nt, Salmonella enterica enterica serovar Typhi Ty2
aaguaucagcgcgcuuu

SEQ ID NO: 3682398 - RNA, 16 nt, Salmonella enterica enterica serovar Typhi Ty2
aagucaaaauaaaauu

SEQ ID NO: 3682399 - RNA, 21 nt, Salmonella enterica enterica serovar Typhi Ty2
aagucaacugcucuaccaacu

SEQ ID NO: 3682400 - RNA, 14 nt, Salmonella enterica enterica serovar Typhi Ty2
aagucaccaucagu

SEQ ID NO: 3682401 - RNA, 12 nt, Salmonella enterica enterica serovar Typhi Ty2
aagucagacaag

SEQ ID NO: 3682402 - RNA, 21 nt, Salmonella enterica enterica serovar Typhi Ty2
aagucagcucgguggcgguau

SEQ ID NO: 3682403 - RNA, 16 nt, Salmonella enterica enterica serovar Typhi Ty2
aagucauaccuguucc

SEQ ID NO: 3682404 - RNA, 15 nt, Salmonella enterica enterica serovar Typhi Ty2
aagucaucaauugcu

SEQ ID NO: 3682405 - RNA, 18 nt, Salmonella enterica enterica serovar Typhi Ty2
aagucaucugccaguuau

SEQ ID NO: 3682406 - RNA, 19 nt, Salmonella enterica enterica serovar Typhi Ty2
aagucaucuguucaacuuu

SEQ ID NO: 3682407 - RNA, 15 nt, Salmonella enterica enterica serovar Typhi Ty2
aagucccagaaagua

SEQ ID NO: 3682408 - RNA, 16 nt, Salmonella enterica enterica serovar Typhi Ty2
aagucccuggcgcgcc

SEQ ID NO: 3682409 - RNA, 17 nt, Salmonella enterica enterica serovar Typhi Ty2
aaguccguauuauccac

SEQ ID NO: 3682410 - RNA, 23 nt, Salmonella enterica enterica serovar Typhi Ty2
aaguccuucuccuucgccaaaau

SEQ ID NO: 3682411 - RNA, 15 nt, Salmonella enterica enterica serovar Typhi Ty2
aaguccuucuucccc

SEQ ID NO: 3682412 - RNA, 17 nt, Salmonella enterica enterica serovar Typhi Ty2
aaguccuucuucccccu

SEQ ID NO: 3682413 - RNA, 20 nt, Salmonella enterica enterica serovar Typhi Ty2
aagucgaaauuuucuucuuc

SEQ ID NO: 3682414 - RNA, 18 nt, Salmonella enterica enterica serovar Typhi Ty2
aagucgaugaaugacgag

SEQ ID NO: 3682415 - RNA, 18 nt, Salmonella enterica enterica serovar Typhi Ty2
aagucgccacccggcuuu

SEQ ID NO: 3682416 - RNA, 13 nt, Salmonella enterica enterica serovar Typhi Ty2
aagucgcgcauaa

SEQ ID NO: 3682417 - RNA, 17 nt, Salmonella enterica enterica serovar Typhi Ty2
aagucgggaaagggcgg

SEQ ID NO: 3682418 - RNA, 18 nt, Salmonella enterica enterica serovar Typhi Ty2
aagucggggcguaaaaau

SEQ ID NO: 3682419 - RNA, 18 nt, Salmonella enterica enterica serovar Typhi Ty2
aagucucaggagugaaca

SEQ ID NO: 3682420 - RNA, 22 nt, Salmonella enterica enterica serovar Typhi Ty2
aagucucagggagaacucaucu

SEQ ID NO: 3682421 - RNA, 18 nt, Salmonella enterica enterica serovar Typhi Ty2
aagucugagcgcaaacau

SEQ ID NO: 3682422 - RNA, 21 nt, Salmonella enterica enterica serovar Typhi Ty2
aagucugugagaaaagcgaaa

SEQ ID NO: 3682423 - RNA, 21 nt, Salmonella enterica enterica serovar Typhi Ty2
aagugaagaaucuguauaaaa

SEQ ID NO: 3682424 - RNA, 23 nt, Salmonella enterica enterica serovar Typhi Ty2
aagugauacaugcuacaggcaag

SEQ ID NO: 3682425 - RNA, 21 nt, Salmonella enterica enterica serovar Typhi Ty2
aagugauacggcgugaucacu

SEQ ID NO: 3682426 - RNA, 22 nt, Salmonella enterica enterica serovar Typhi Ty2
aagugccagggcggaagcagau

SEQ ID NO: 3682427 - RNA, 18 nt, Salmonella enterica enterica serovar Typhi Ty2
aagugguuaacagcgcag

SEQ ID NO: 3682428 - RNA, 14 nt, Salmonella enterica enterica serovar Typhi Ty2
aaguuaaaacgcca

SEQ ID NO: 3682429 - RNA, 21 nt, Salmonella enterica enterica serovar Typhi Ty2
aaguuacaggcuccaaguauu

SEQ ID NO: 3682430 - RNA, 16 nt, Salmonella enterica enterica serovar Typhi Ty2
aaguuauccagcgccc

SEQ ID NO: 3682431 - RNA, 18 nt, Salmonella enterica enterica serovar Typhi Ty2
aaguugacuuuuacgcca

SEQ ID NO: 3682432 - RNA, 15 nt, Salmonella enterica enterica serovar Typhi Ty2
aaguugaucauccuu

SEQ ID NO: 3682433 - RNA, 23 nt, Salmonella enterica enterica serovar Typhi Ty2
aaguugcucggcaauuucuuugu

SEQ ID NO: 3682434 - RNA, 15 nt, Salmonella enterica enterica serovar Typhi Ty2
aaguuuaauuccgaa

SEQ ID NO: 3682435 - RNA, 20 nt, Salmonella enterica enterica serovar Typhi Ty2
aaguuuagaaaaaauuaaaa

SEQ ID NO: 3682436 - RNA, 19 nt, Salmonella enterica enterica serovar Typhi Ty2
aaguuugaugcaaauguca

SEQ ID NO: 3682437 - RNA, 21 nt, Salmonella enterica enterica serovar Typhi Ty2
aaguuugaugcaaaugucaga

SEQ ID NO: 3682438 - RNA, 16 nt, Salmonella enterica enterica serovar Typhi Ty2
aaguuuuucauaucca

SEQ ID NO: 3682439 - RNA, 14 nt, Salmonella enterica enterica serovar Typhi Ty2
aauaaaaaaaccuc

SEQ ID NO: 3682440 - RNA, 13 nt, Salmonella enterica enterica serovar Typhi Ty2
aauaaaaauaauc

SEQ ID NO: 3682441 - RNA, 21 nt, Salmonella enterica enterica serovar Typhi Ty2
aauaaaacugccgucaauuuu

SEQ ID NO: 3682442 - RNA, 14 nt, Salmonella enterica enterica serovar Typhi Ty2
aauaaaauuauauu

SEQ ID NO: 3682443 - RNA, 22 nt, Salmonella enterica enterica serovar Typhi Ty2
aauaaacaccauacgacgaucc

SEQ ID NO: 3682444 - RNA, 22 nt, Salmonella enterica enterica serovar Typhi Ty2
aauaaacacgauggcaaauaau

SEQ ID NO: 3682445 - RNA, 22 nt, Salmonella enterica enterica serovar Typhi Ty2
aauaaacacuuugcgcggauua

SEQ ID NO: 3682446 - RNA, 14 nt, Salmonella enterica enterica serovar Typhi Ty2
aauaaacaucagcc

SEQ ID NO: 3682447 - RNA, 15 nt, Salmonella enterica enterica serovar Typhi Ty2
aauaaacaucagcca

SEQ ID NO: 3682448 - RNA, 11 nt, Salmonella enterica enterica serovar Typhi Ty2
aauaaacuccc

SEQ ID NO: 3682449 - RNA, 23 nt, Salmonella enterica enterica serovar Typhi Ty2
aauaaacuguccaguuuuugcau

SEQ ID NO: 3682450 - RNA, 18 nt, Salmonella enterica enterica serovar Typhi Ty2
aauaaagaaagcauuaaa

SEQ ID NO: 3682451 - RNA, 21 nt, Salmonella enterica enterica serovar Typhi Ty2
aauaaagaaagcauuaaauca

SEQ ID NO: 3682452 - RNA, 15 nt, Salmonella enterica enterica serovar Typhi Ty2
aauaaagacuggccc

SEQ ID NO: 3682453 - RNA, 15 nt, Salmonella enterica enterica serovar Typhi Ty2
aauaaagccgcccau

SEQ ID NO: 3682454 - RNA, 21 nt, Salmonella enterica enterica serovar Typhi Ty2
aauaaagcggucuuucaacau

SEQ ID NO: 3682455 - RNA, 20 nt, Salmonella enterica enterica serovar Typhi Ty2
aauaaaggcgcuguuggcau

SEQ ID NO: 3682456 - RNA, 14 nt, Salmonella enterica enterica serovar Typhi Ty2
aauaaagugcugaa

SEQ ID NO: 3682457 - RNA, 16 nt, Salmonella enterica enterica serovar Typhi Ty2
aauaaaguuuauuuga

SEQ ID NO: 3682458 - RNA, 19 nt, Salmonella enterica enterica serovar Typhi Ty2
aauaaauaguaaauagaaa

SEQ ID NO: 3682459 - RNA, 22 nt, Salmonella enterica enterica serovar Typhi Ty2
aauaaauaguaaauagaaaaua

SEQ ID NO: 3682460 - RNA, 14 nt, Salmonella enterica enterica serovar Typhi Ty2
aauaaauauucauc

SEQ ID NO: 3682461 - RNA, 20 nt, Salmonella enterica enterica serovar Typhi Ty2
aauaaauccaugagaagaaa

SEQ ID NO: 3682462 - RNA, 17 nt, Salmonella enterica enterica serovar Typhi Ty2
aauaaaugauauuuaaa

SEQ ID NO: 3682463 - RNA, 23 nt, Salmonella enterica enterica serovar Typhi Ty2
aauaaauucuuuacgcagcaaga

SEQ ID NO: 3682464 - RNA, 13 nt, Salmonella enterica enterica serovar Typhi Ty2
aauaacaaaugaa

SEQ ID NO: 3682465 - RNA, 14 nt, Salmonella enterica enterica serovar Typhi Ty2
aauaacaccacaac

SEQ ID NO: 3682466 - RNA, 23 nt, Salmonella enterica enterica serovar Typhi Ty2
aauaacagacuccgucucuuuau

SEQ ID NO: 3682467 - RNA, 20 nt, Salmonella enterica enterica serovar Typhi Ty2
aauaacaggaaucauucuau

SEQ ID NO: 3682468 - RNA, 14 nt, Salmonella enterica enterica serovar Typhi Ty2
aauaaccccagcug

SEQ ID NO: 3682469 - RNA, 12 nt, Salmonella enterica enterica serovar Typhi Ty2
aauaaccgccag

SEQ ID NO: 3682470 - RNA, 20 nt, Salmonella enterica enterica serovar Typhi Ty2
aauaaccggcagaccggaaa

SEQ ID NO: 3682471 - RNA, 17 nt, Salmonella enterica enterica serovar Typhi Ty2
aauaacgaacugauggc

SEQ ID NO: 3682472 - RNA, 20 nt, Salmonella enterica enterica serovar Typhi Ty2
aauaacgaacugauggcgcu

SEQ ID NO: 3682473 - RNA, 21 nt, Salmonella enterica enterica serovar Typhi Ty2
aauaacgaucuggucgccaag

SEQ ID NO: 3682474 - RNA, 15 nt, Salmonella enterica enterica serovar Typhi Ty2
aauaacgaugaugaa

SEQ ID NO: 3682475 - RNA, 20 nt, Salmonella enterica enterica serovar Typhi Ty2
aauaacgaugaugaaaaaga

SEQ ID NO: 3682476 - RNA, 13 nt, Salmonella enterica enterica serovar Typhi Ty2
aauaacguaaccg

SEQ ID NO: 3682477 - RNA, 16 nt, Salmonella enterica enterica serovar Typhi Ty2
aauaacgugucaggau

SEQ ID NO: 3682478 - RNA, 21 nt, Salmonella enterica enterica serovar Typhi Ty2
aauaacuauaauugcuuuuuu

SEQ ID NO: 3682479 - RNA, 17 nt, Salmonella enterica enterica serovar Typhi Ty2
aauaacugacagacuca

SEQ ID NO: 3682480 - RNA, 21 nt, Salmonella enterica enterica serovar Typhi Ty2
aauaacuuuuaauuuuuaugu

SEQ ID NO: 3682481 - RNA, 23 nt, Salmonella enterica enterica serovar Typhi Ty2
aauaacuuuuaauuuuuauguca

SEQ ID NO: 3682482 - RNA, 16 nt, Salmonella enterica enterica serovar Typhi Ty2
aauaagaacuuuauca

SEQ ID NO: 3682483 - RNA, 18 nt, Salmonella enterica enterica serovar Typhi Ty2
aauaagaagguuaauaua

SEQ ID NO: 3682484 - RNA, 20 nt, Salmonella enterica enterica serovar Typhi Ty2
aauaagacauggaguuccag

SEQ ID NO: 3682485 - RNA, 22 nt, Salmonella enterica enterica serovar Typhi Ty2
aauaagcagaacguagcccauu

SEQ ID NO: 3682486 - RNA, 22 nt, Salmonella enterica enterica serovar Typhi Ty2
aauaagccggaugcguguucag

SEQ ID NO: 3682487 - RNA, 23 nt, Salmonella enterica enterica serovar Typhi Ty2
aauaagcgccgaguagcugagcg

SEQ ID NO: 3682488 - RNA, 23 nt, Salmonella enterica enterica serovar Typhi Ty2
aauaagcuccgggacauccggau

SEQ ID NO: 3682489 - RNA, 17 nt, Salmonella enterica enterica serovar Typhi Ty2
aauaagguggcuaaccc

SEQ ID NO: 3682490 - RNA, 20 nt, Salmonella enterica enterica serovar Typhi Ty2
aauaauaaaacgacucauca

SEQ ID NO: 3682491 - RNA, 20 nt, Salmonella enterica enterica serovar Typhi Ty2
aauaauauguuccacaauca

SEQ ID NO: 3682492 - RNA, 13 nt, Salmonella enterica enterica serovar Typhi Ty2
aauaauauuauug

SEQ ID NO: 3682493 - RNA, 22 nt, Salmonella enterica enterica serovar Typhi Ty2
aauaaucaaccauacauccuga

SEQ ID NO: 3682494 - RNA, 11 nt, Salmonella enterica enterica serovar Typhi Ty2
aauaaucacug

SEQ ID NO: 3682495 - RNA, 23 nt, Salmonella enterica enterica serovar Typhi Ty2
aauaauccuucccgcuauagaau

SEQ ID NO: 3682496 - RNA, 15 nt, Salmonella enterica enterica serovar Typhi Ty2
aauaaucgaaauaaa

SEQ ID NO: 3682497 - RNA, 17 nt, Salmonella enterica enterica serovar Typhi Ty2
aauaaucgaaauaaagu

SEQ ID NO: 3682498 - RNA, 18 nt, Salmonella enterica enterica serovar Typhi Ty2
aauaaucgccgccgguaa

SEQ ID NO: 3682499 - RNA, 13 nt, Salmonella enterica enterica serovar Typhi Ty2
aauaaucgccggg

SEQ ID NO: 3682500 - RNA, 18 nt, Salmonella enterica enterica serovar Typhi Ty2
aauaaucgcgagaaaaua

SEQ ID NO: 3682501 - RNA, 20 nt, Salmonella enterica enterica serovar Typhi Ty2
aauaaucgcgagaaaauaga

SEQ ID NO: 3682502 - RNA, 19 nt, Salmonella enterica enterica serovar Typhi Ty2
aauaaugaagacguugaau

SEQ ID NO: 3682503 - RNA, 14 nt, Salmonella enterica enterica serovar Typhi Ty2
aauaaugcaaugcc

SEQ ID NO: 3682504 - RNA, 19 nt, Salmonella enterica enterica serovar Typhi Ty2
aauaauggagaugaaaaua

SEQ ID NO: 3682505 - RNA, 20 nt, Salmonella enterica enterica serovar Typhi Ty2
aauaauggcgcgaaaacagc

SEQ ID NO: 3682506 - RNA, 22 nt, Salmonella enterica enterica serovar Typhi Ty2
aauaauggcgcgaaaacagcug

SEQ ID NO: 3682507 - RNA, 14 nt, Salmonella enterica enterica serovar Typhi Ty2
aauaauguaaaaaa

SEQ ID NO: 3682508 - RNA, 15 nt, Salmonella enterica enterica serovar Typhi Ty2
aauaauugagcgcaa

SEQ ID NO: 3682509 - RNA, 23 nt, Salmonella enterica enterica serovar Typhi Ty2
aauaauugcgguggcgcaaaucg

SEQ ID NO: 3682510 - RNA, 15 nt, Salmonella enterica enterica serovar Typhi Ty2
aauaauuucuucuuu

SEQ ID NO: 3682511 - RNA, 16 nt, Salmonella enterica enterica serovar Typhi Ty2
aauaauuuuagaaaua

SEQ ID NO: 3682512 - RNA, 17 nt, Salmonella enterica enterica serovar Typhi Ty2
aauaauuuuagaaauag

SEQ ID NO: 3682513 - RNA, 14 nt, Salmonella enterica enterica serovar Typhi Ty2
aauaauuuuguuaa

SEQ ID NO: 3682514 - RNA, 24 nt, Salmonella enterica enterica serovar Typhi Ty2
aauacaauccgccgcaauagccaa

SEQ ID NO: 3682515 - RNA, 16 nt, Salmonella enterica enterica serovar Typhi Ty2
aauacaauucaacuca

SEQ ID NO: 3682516 - RNA, 19 nt, Salmonella enterica enterica serovar Typhi Ty2
aauacaauucaacucacua

SEQ ID NO: 3682517 - RNA, 17 nt, Salmonella enterica enterica serovar Typhi Ty2
aauacaccgccauauau

SEQ ID NO: 3682518 - RNA, 20 nt, Salmonella enterica enterica serovar Typhi Ty2
aauacaccgccauauauuua

SEQ ID NO: 3682519 - RNA, 17 nt, Salmonella enterica enterica serovar Typhi Ty2
aauacacgauaaaccuc

SEQ ID NO: 3682520 - RNA, 20 nt, Salmonella enterica enterica serovar Typhi Ty2
aauacacgguaaauucuuua

SEQ ID NO: 3682521 - RNA, 21 nt, Salmonella enterica enterica serovar Typhi Ty2
aauacagccagguugccagaa

SEQ ID NO: 3682522 - RNA, 23 nt, Salmonella enterica enterica serovar Typhi Ty2
aauacaggguuugucagcauaaa

SEQ ID NO: 3682523 - RNA, 20 nt, Salmonella enterica enterica serovar Typhi Ty2
aauacaucgccaccaccagc

SEQ ID NO: 3682524 - RNA, 22 nt, Salmonella enterica enterica serovar Typhi Ty2
aauaccaaagcccgcaaacaga

SEQ ID NO: 3682525 - RNA, 13 nt, Salmonella enterica enterica serovar Typhi Ty2
aauaccaauaaga

SEQ ID NO: 3682526 - RNA, 13 nt, Salmonella enterica enterica serovar Typhi Ty2
aauaccacaaauu

SEQ ID NO: 3682527 - RNA, 21 nt, Salmonella enterica enterica serovar Typhi Ty2
aauaccacuucggcagaaaaa

SEQ ID NO: 3682528 - RNA, 14 nt, Salmonella enterica enterica serovar Typhi Ty2
aauaccagcggcaa

SEQ ID NO: 3682529 - RNA, 18 nt, Salmonella enterica enterica serovar Typhi Ty2
aauaccagcguaauccuc

SEQ ID NO: 3682530 - RNA, 19 nt, Salmonella enterica enterica serovar Typhi Ty2
aauaccaggcggcuuuuuc

SEQ ID NO: 3682531 - RNA, 19 nt, Salmonella enterica enterica serovar Typhi Ty2
aauacccaggccaucagaa

SEQ ID NO: 3682532 - RNA, 18 nt, Salmonella enterica enterica serovar Typhi Ty2
aauacccauuucuucuuc

SEQ ID NO: 3682533 - RNA, 22 nt, Salmonella enterica enterica serovar Typhi Ty2
aauaccccaggggcauauauua

SEQ ID NO: 3682534 - RNA, 18 nt, Salmonella enterica enterica serovar Typhi Ty2
aauacccgacucuuuuuu

SEQ ID NO: 3682535 - RNA, 11 nt, Salmonella enterica enterica serovar Typhi Ty2
aauaccgccca

SEQ ID NO: 3682536 - RNA, 13 nt, Salmonella enterica enterica serovar Typhi Ty2
aauaccgcccauc

SEQ ID NO: 3682537 - RNA, 16 nt, Salmonella enterica enterica serovar Typhi Ty2
aauaccggauaugcau

SEQ ID NO: 3682538 - RNA, 17 nt, Salmonella enterica enterica serovar Typhi Ty2
aauaccgguuauccaua

SEQ ID NO: 3682539 - RNA, 20 nt, Salmonella enterica enterica serovar Typhi Ty2
aauaccgguuauccauauga

SEQ ID NO: 3682540 - RNA, 17 nt, Salmonella enterica enterica serovar Typhi Ty2
aauaccguaagaccaga

SEQ ID NO: 3682541 - RNA, 14 nt, Salmonella enterica enterica serovar Typhi Ty2
aauaccgugcagga

SEQ ID NO: 3682542 - RNA, 19 nt, Salmonella enterica enterica serovar Typhi Ty2
aauaccuuaguaaaaccga

SEQ ID NO: 3682543 - RNA, 18 nt, Salmonella enterica enterica serovar Typhi Ty2
aauaccuuauucagccca

SEQ ID NO: 3682544 - RNA, 18 nt, Salmonella enterica enterica serovar Typhi Ty2
aauacgagugacauuauu

SEQ ID NO: 3682545 - RNA, 20 nt, Salmonella enterica enterica serovar Typhi Ty2
aauacgagugacauuauuca

SEQ ID NO: 3682546 - RNA, 23 nt, Salmonella enterica enterica serovar Typhi Ty2
aauacgcggcacguuuuccaggu

SEQ ID NO: 3682547 - RNA, 18 nt, Salmonella enterica enterica serovar Typhi Ty2
aauacgcgucuguagcgc

SEQ ID NO: 3682548 - RNA, 20 nt, Salmonella enterica enterica serovar Typhi Ty2
aauacgcuccagcuggcugg

SEQ ID NO: 3682549 - RNA, 14 nt, Salmonella enterica enterica serovar Typhi Ty2
aauacgcugaacuu

SEQ ID NO: 3682550 - RNA, 17 nt, Salmonella enterica enterica serovar Typhi Ty2
aauacggagcaaaaaau

SEQ ID NO: 3682551 - RNA, 24 nt, Salmonella enterica enterica serovar Typhi Ty2
aauacgguuagccagugggcguca

SEQ ID NO: 3682552 - RNA, 17 nt, Salmonella enterica enterica serovar Typhi Ty2
aauacguuuauucuuuu

SEQ ID NO: 3682553 - RNA, 18 nt, Salmonella enterica enterica serovar Typhi Ty2
aauacguuuauucuuuuc

SEQ ID NO: 3682554 - RNA, 22 nt, Salmonella enterica enterica serovar Typhi Ty2
aauacuacugguggaauaaaua

SEQ ID NO: 3682555 - RNA, 21 nt, Salmonella enterica enterica serovar Typhi Ty2
aauacuccugcaacagaagag

SEQ ID NO: 3682556 - RNA, 20 nt, Salmonella enterica enterica serovar Typhi Ty2
aauacugaagucgaaauuuu

SEQ ID NO: 3682557 - RNA, 19 nt, Salmonella enterica enterica serovar Typhi Ty2
aauacuggaccccagauaa

SEQ ID NO: 3682558 - RNA, 14 nt, Salmonella enterica enterica serovar Typhi Ty2
aauacuuaaaccug

SEQ ID NO: 3682559 - RNA, 14 nt, Salmonella enterica enterica serovar Typhi Ty2
aauacuuccugcuc

SEQ ID NO: 3682560 - RNA, 13 nt, Salmonella enterica enterica serovar Typhi Ty2
aauacuuuuuuag

SEQ ID NO: 3682561 - RNA, 12 nt, Salmonella enterica enterica serovar Typhi Ty2
aauagaaaauaa

SEQ ID NO: 3682562 - RNA, 15 nt, Salmonella enterica enterica serovar Typhi Ty2
aauagaacccaaagc

SEQ ID NO: 3682563 - RNA, 18 nt, Salmonella enterica enterica serovar Typhi Ty2
aauagaauaggaaauaau

SEQ ID NO: 3682564 - RNA, 14 nt, Salmonella enterica enterica serovar Typhi Ty2
aauagacagugauu

SEQ ID NO: 3682565 - RNA, 19 nt, Salmonella enterica enterica serovar Typhi Ty2
aauagacgagcgaaaaacu

SEQ ID NO: 3682566 - RNA, 21 nt, Salmonella enterica enterica serovar Typhi Ty2
aauagacuucacuuucccgga

SEQ ID NO: 3682567 - RNA, 13 nt, Salmonella enterica enterica serovar Typhi Ty2
aauagagaaaaua

SEQ ID NO: 3682568 - RNA, 19 nt, Salmonella enterica enterica serovar Typhi Ty2
aauagagaaaauaacaaua

SEQ ID NO: 3682569 - RNA, 17 nt, Salmonella enterica enterica serovar Typhi Ty2
aauagagaaaucaacga

SEQ ID NO: 3682570 - RNA, 17 nt, Salmonella enterica enterica serovar Typhi Ty2
aauagagagaaucgggu

SEQ ID NO: 3682571 - RNA, 17 nt, Salmonella enterica enterica serovar Typhi Ty2
aauagaggaaauaacau

SEQ ID NO: 3682572 - RNA, 15 nt, Salmonella enterica enterica serovar Typhi Ty2
aauagaguaaugaca

SEQ ID NO: 3682573 - RNA, 18 nt, Salmonella enterica enterica serovar Typhi Ty2
aauagauaugaaagaagg

SEQ ID NO: 3682574 - RNA, 20 nt, Salmonella enterica enterica serovar Typhi Ty2
aauagaugcgucgcauccuu

SEQ ID NO: 3682575 - RNA, 15 nt, Salmonella enterica enterica serovar Typhi Ty2
aauagcagcguuuug

SEQ ID NO: 3682576 - RNA, 19 nt, Salmonella enterica enterica serovar Typhi Ty2
aauagcauuaagcugauau

SEQ ID NO: 3682577 - RNA, 20 nt, Salmonella enterica enterica serovar Typhi Ty2
aauagccagaaugccagcgc

SEQ ID NO: 3682578 - RNA, 21 nt, Salmonella enterica enterica serovar Typhi Ty2
aauagccagaaugccagcgcc

SEQ ID NO: 3682579 - RNA, 13 nt, Salmonella enterica enterica serovar Typhi Ty2
aauagccagcccc

SEQ ID NO: 3682580 - RNA, 15 nt, Salmonella enterica enterica serovar Typhi Ty2
aauagccagccccag

SEQ ID NO: 3682581 - RNA, 18 nt, Salmonella enterica enterica serovar Typhi Ty2
aauagccccggucaacgc

SEQ ID NO: 3682582 - RNA, 14 nt, Salmonella enterica enterica serovar Typhi Ty2
aauagccggauaaa

SEQ ID NO: 3682583 - RNA, 19 nt, Salmonella enterica enterica serovar Typhi Ty2
aauagccugggcaaggcug

SEQ ID NO: 3682584 - RNA, 14 nt, Salmonella enterica enterica serovar Typhi Ty2
aauagcgccagaca

SEQ ID NO: 3682585 - RNA, 11 nt, Salmonella enterica enterica serovar Typhi Ty2
aauagcgcugc

SEQ ID NO: 3682586 - RNA, 13 nt, Salmonella enterica enterica serovar Typhi Ty2
aauagcggcacag

SEQ ID NO: 3682587 - RNA, 14 nt, Salmonella enterica enterica serovar Typhi Ty2
aauagcggcacaga

SEQ ID NO: 3682588 - RNA, 15 nt, Salmonella enterica enterica serovar Typhi Ty2
aauagcggcuaauca

SEQ ID NO: 3682589 - RNA, 12 nt, Salmonella enterica enterica serovar Typhi Ty2
aauagcugaaaa

SEQ ID NO: 3682590 - RNA, 15 nt, Salmonella enterica enterica serovar Typhi Ty2
aauagcuggcugucu

SEQ ID NO: 3682591 - RNA, 17 nt, Salmonella enterica enterica serovar Typhi Ty2
aauagcuggcugucuuc

SEQ ID NO: 3682592 - RNA, 22 nt, Salmonella enterica enterica serovar Typhi Ty2
aauagcuuuuuacucagggcaa

SEQ ID NO: 3682593 - RNA, 22 nt, Salmonella enterica enterica serovar Typhi Ty2
aauaggccggagaaaagaccag

SEQ ID NO: 3682594 - RNA, 14 nt, Salmonella enterica enterica serovar Typhi Ty2
aauagggcuuacgg

SEQ ID NO: 3682595 - RNA, 13 nt, Salmonella enterica enterica serovar Typhi Ty2
aauagguugaaag

SEQ ID NO: 3682596 - RNA, 18 nt, Salmonella enterica enterica serovar Typhi Ty2
aauaguaaauagaaaaua

SEQ ID NO: 3682597 - RNA, 21 nt, Salmonella enterica enterica serovar Typhi Ty2
aauaguauccauaauuuuccc

SEQ ID NO: 3682598 - RNA, 22 nt, Salmonella enterica enterica serovar Typhi Ty2
aauagugcggccaaauugcucg

SEQ ID NO: 3682599 - RNA, 21 nt, Salmonella enterica enterica serovar Typhi Ty2
aauagugggguguaaagucgg

SEQ ID NO: 3682600 - RNA, 15 nt, Salmonella enterica enterica serovar Typhi Ty2
aauaguucagcgcag

SEQ ID NO: 3682601 - RNA, 17 nt, Salmonella enterica enterica serovar Typhi Ty2
aauauaaccaauuuaaa

SEQ ID NO: 3682602 - RNA, 12 nt, Salmonella enterica enterica serovar Typhi Ty2
aauauaagaucu

SEQ ID NO: 3682603 - RNA, 19 nt, Salmonella enterica enterica serovar Typhi Ty2
aauauaauccuuguccaug

SEQ ID NO: 3682604 - RNA, 12 nt, Salmonella enterica enterica serovar Typhi Ty2
aauauacauuca

SEQ ID NO: 3682605 - RNA, 18 nt, Salmonella enterica enterica serovar Typhi Ty2
aauauacauucauuuuau

SEQ ID NO: 3682606 - RNA, 16 nt, Salmonella enterica enterica serovar Typhi Ty2
aauauacuuaucggcg

SEQ ID NO: 3682607 - RNA, 15 nt, Salmonella enterica enterica serovar Typhi Ty2
aauauaguuagaaaa

SEQ ID NO: 3682608 - RNA, 18 nt, Salmonella enterica enterica serovar Typhi Ty2
aauauaguuagaaaauac

SEQ ID NO: 3682609 - RNA, 19 nt, Salmonella enterica enterica serovar Typhi Ty2
aauauaguuagaaaauacu

SEQ ID NO: 3682610 - RNA, 17 nt, Salmonella enterica enterica serovar Typhi Ty2
aauauaucaggcugagc

SEQ ID NO: 3682611 - RNA, 23 nt, Salmonella enterica enterica serovar Typhi Ty2
aauauaucuguuccacagaucua

SEQ ID NO: 3682612 - RNA, 16 nt, Salmonella enterica enterica serovar Typhi Ty2
aauauaugaaccaaga

SEQ ID NO: 3682613 - RNA, 17 nt, Salmonella enterica enterica serovar Typhi Ty2
aauauaugacaacacuc

SEQ ID NO: 3682614 - RNA, 11 nt, Salmonella enterica enterica serovar Typhi Ty2
aauauaugagc

SEQ ID NO: 3682615 - RNA, 15 nt, Salmonella enterica enterica serovar Typhi Ty2
aauauauucaucuuu

SEQ ID NO: 3682616 - RNA, 23 nt, Salmonella enterica enterica serovar Typhi Ty2
aauaucaauucaacacuuagaac

SEQ ID NO: 3682617 - RNA, 20 nt, Salmonella enterica enterica serovar Typhi Ty2
aauaucagccauuaaccaga

SEQ ID NO: 3682618 - RNA, 21 nt, Salmonella enterica enterica serovar Typhi Ty2
aauaucauccgguaucaugcu

SEQ ID NO: 3682619 - RNA, 20 nt, Salmonella enterica enterica serovar Typhi Ty2
aauaucauucgcgucauacu

SEQ ID NO: 3682620 - RNA, 20 nt, Salmonella enterica enterica serovar Typhi Ty2
aauaucauugaggucuuugc

SEQ ID NO: 3682621 - RNA, 20 nt, Salmonella enterica enterica serovar Typhi Ty2
aauauccauuugcgacauca

SEQ ID NO: 3682622 - RNA, 23 nt, Salmonella enterica enterica serovar Typhi Ty2
aauauccccaucccagaccauuc

SEQ ID NO: 3682623 - RNA, 19 nt, Salmonella enterica enterica serovar Typhi Ty2
aauauccgccccgcuggcu

SEQ ID NO: 3682624 - RNA, 19 nt, Salmonella enterica enterica serovar Typhi Ty2
aauauccgguacaccaacu

SEQ ID NO: 3682625 - RNA, 15 nt, Salmonella enterica enterica serovar Typhi Ty2
aauauccuccggcau

SEQ ID NO: 3682626 - RNA, 14 nt, Salmonella enterica enterica serovar Typhi Ty2
aauauccuccggcg

SEQ ID NO: 3682627 - RNA, 12 nt, Salmonella enterica enterica serovar Typhi Ty2
aauauccugcgg

SEQ ID NO: 3682628 - RNA, 14 nt, Salmonella enterica enterica serovar Typhi Ty2
aauauccugugucg

SEQ ID NO: 3682629 - RNA, 12 nt, Salmonella enterica enterica serovar Typhi Ty2
aauauccuucag

SEQ ID NO: 3682630 - RNA, 18 nt, Salmonella enterica enterica serovar Typhi Ty2
aauaucgauagcauuuuu

SEQ ID NO: 3682631 - RNA, 21 nt, Salmonella enterica enterica serovar Typhi Ty2
aauaucgcggaaauucacuuc

SEQ ID NO: 3682632 - RNA, 17 nt, Salmonella enterica enterica serovar Typhi Ty2
aauaucggguauccauu

SEQ ID NO: 3682633 - RNA, 22 nt, Salmonella enterica enterica serovar Typhi Ty2
aauaucucccguuuguauaaau

SEQ ID NO: 3682634 - RNA, 21 nt, Salmonella enterica enterica serovar Typhi Ty2
aauaucuguuucauggagauc

SEQ ID NO: 3682635 - RNA, 14 nt, Salmonella enterica enterica serovar Typhi Ty2
aauaugaaagagaa

SEQ ID NO: 3682636 - RNA, 15 nt, Salmonella enterica enterica serovar Typhi Ty2
aauaugaaagagaaa

SEQ ID NO: 3682637 - RNA, 11 nt, Salmonella enterica enterica serovar Typhi Ty2
aauaugaaauu

SEQ ID NO: 3682638 - RNA, 14 nt, Salmonella enterica enterica serovar Typhi Ty2
aauaugaauauccg

SEQ ID NO: 3682639 - RNA, 23 nt, Salmonella enterica enterica serovar Typhi Ty2
aauaugauauguguaucuugcuu

SEQ ID NO: 3682640 - RNA, 16 nt, Salmonella enterica enterica serovar Typhi Ty2
aauaugaucugcacaa

SEQ ID NO: 3682641 - RNA, 14 nt, Salmonella enterica enterica serovar Typhi Ty2
aauaugauuuaaaa

SEQ ID NO: 3682642 - RNA, 17 nt, Salmonella enterica enterica serovar Typhi Ty2
aauaugauuuaaaaaag

SEQ ID NO: 3682643 - RNA, 15 nt, Salmonella enterica enterica serovar Typhi Ty2
aauaugccagauauu

SEQ ID NO: 3682644 - RNA, 13 nt, Salmonella enterica enterica serovar Typhi Ty2
aauaugccaggcu

SEQ ID NO: 3682645 - RNA, 18 nt, Salmonella enterica enterica serovar Typhi Ty2
aauaugccaggcuuccug

SEQ ID NO: 3682646 - RNA, 15 nt, Salmonella enterica enterica serovar Typhi Ty2
aauaugcgcaaucac

SEQ ID NO: 3682647 - RNA, 17 nt, Salmonella enterica enterica serovar Typhi Ty2
aauaugcggcgccauca

SEQ ID NO: 3682648 - RNA, 17 nt, Salmonella enterica enterica serovar Typhi Ty2
aauaugcgucagauaaa

SEQ ID NO: 3682649 - RNA, 15 nt, Salmonella enterica enterica serovar Typhi Ty2
aauaugcgucagcgc

SEQ ID NO: 3682650 - RNA, 17 nt, Salmonella enterica enterica serovar Typhi Ty2
aauaugcuggcuuaacu

SEQ ID NO: 3682651 - RNA, 20 nt, Salmonella enterica enterica serovar Typhi Ty2
aauaugcuguuuauggcgcu

SEQ ID NO: 3682652 - RNA, 13 nt, Salmonella enterica enterica serovar Typhi Ty2
aauauggaauauc

SEQ ID NO: 3682653 - RNA, 22 nt, Salmonella enterica enterica serovar Typhi Ty2
aauauggugaguaauaacaaaa

SEQ ID NO: 3682654 - RNA, 21 nt, Salmonella enterica enterica serovar Typhi Ty2
aauauuaaggccgaauuugaa

SEQ ID NO: 3682655 - RNA, 20 nt, Salmonella enterica enterica serovar Typhi Ty2
aauauuagcgguacucuuuu

SEQ ID NO: 3682656 - RNA, 22 nt, Salmonella enterica enterica serovar Typhi Ty2
aauauuauugacgcuuucuucc

SEQ ID NO: 3682657 - RNA, 17 nt, Salmonella enterica enterica serovar Typhi Ty2
aauauucacgcgaauuc

SEQ ID NO: 3682658 - RNA, 14 nt, Salmonella enterica enterica serovar Typhi Ty2
aauauucagcacau

SEQ ID NO: 3682659 - RNA, 14 nt, Salmonella enterica enterica serovar Typhi Ty2
aauauucauuucca

SEQ ID NO: 3682660 - RNA, 12 nt, Salmonella enterica enterica serovar Typhi Ty2
aauauucgcgcc

SEQ ID NO: 3682661 - RNA, 19 nt, Salmonella enterica enterica serovar Typhi Ty2
aauauucgcuucuucggca

SEQ ID NO: 3682662 - RNA, 16 nt, Salmonella enterica enterica serovar Typhi Ty2
aauauugaacauuuuu

SEQ ID NO: 3682663 - RNA, 18 nt, Salmonella enterica enterica serovar Typhi Ty2
aauauugccgccauuauu

SEQ ID NO: 3682664 - RNA, 15 nt, Salmonella enterica enterica serovar Typhi Ty2
aauauuuaacacauu

SEQ ID NO: 3682665 - RNA, 19 nt, Salmonella enterica enterica serovar Typhi Ty2
aauauuuauuuaauguuuc

SEQ ID NO: 3682666 - RNA, 17 nt, Salmonella enterica enterica serovar Typhi Ty2
aauauuugaucacauca

SEQ ID NO: 3682667 - RNA, 13 nt, Salmonella enterica enterica serovar Typhi Ty2
aauauuuugcugg

SEQ ID NO: 3682668 - RNA, 11 nt, Salmonella enterica enterica serovar Typhi Ty2
aauauuuuucc

SEQ ID NO: 3682669 - RNA, 12 nt, Salmonella enterica enterica serovar Typhi Ty2
aauauuuuuccg

SEQ ID NO: 3682670 - RNA, 21 nt, Salmonella enterica enterica serovar Typhi Ty2
aauauuuuuccgcggagagau

SEQ ID NO: 3682671 - RNA, 17 nt, Salmonella enterica enterica serovar Typhi Ty2
aaucaaaaaguuaugcu

SEQ ID NO: 3682672 - RNA, 12 nt, Salmonella enterica enterica serovar Typhi Ty2
aaucaaacucac

SEQ ID NO: 3682673 - RNA, 20 nt, Salmonella enterica enterica serovar Typhi Ty2
aaucaacauuauuaaaaugu

SEQ ID NO: 3682674 - RNA, 13 nt, Salmonella enterica enterica serovar Typhi Ty2
aaucaaccauaca

SEQ ID NO: 3682675 - RNA, 18 nt, Salmonella enterica enterica serovar Typhi Ty2
aaucaacgccgccaggau

SEQ ID NO: 3682676 - RNA, 15 nt, Salmonella enterica enterica serovar Typhi Ty2
aaucaacguagaauc

SEQ ID NO: 3682677 - RNA, 18 nt, Salmonella enterica enterica serovar Typhi Ty2
aaucaacuccauaauuug

SEQ ID NO: 3682678 - RNA, 13 nt, Salmonella enterica enterica serovar Typhi Ty2
aaucaagauuaau

SEQ ID NO: 3682679 - RNA, 15 nt, Salmonella enterica enterica serovar Typhi Ty2
aaucaauacugccau

SEQ ID NO: 3682680 - RNA, 22 nt, Salmonella enterica enterica serovar Typhi Ty2
aaucaauggccuugccagcgag

SEQ ID NO: 3682681 - RNA, 17 nt, Salmonella enterica enterica serovar Typhi Ty2
aaucacaaaauggcuga

SEQ ID NO: 3682682 - RNA, 14 nt, Salmonella enterica enterica serovar Typhi Ty2
aaucacaaagccgu

SEQ ID NO: 3682683 - RNA, 16 nt, Salmonella enterica enterica serovar Typhi Ty2
aaucacaaagccgucg

SEQ ID NO: 3682684 - RNA, 17 nt, Salmonella enterica enterica serovar Typhi Ty2
aaucacaacguaaucau

SEQ ID NO: 3682685 - RNA, 16 nt, Salmonella enterica enterica serovar Typhi Ty2
aaucacauacagcacu

SEQ ID NO: 3682686 - RNA, 20 nt, Salmonella enterica enterica serovar Typhi Ty2
aaucacauacagcacuuccc

SEQ ID NO: 3682687 - RNA, 17 nt, Salmonella enterica enterica serovar Typhi Ty2
aaucacauccgccagcg

SEQ ID NO: 3682688 - RNA, 20 nt, Salmonella enterica enterica serovar Typhi Ty2
aaucaccacguaacucggca

SEQ ID NO: 3682689 - RNA, 16 nt, Salmonella enterica enterica serovar Typhi Ty2
aaucaccugcaucacg

SEQ ID NO: 3682690 - RNA, 14 nt, Salmonella enterica enterica serovar Typhi Ty2
aaucacgcaucacu

SEQ ID NO: 3682691 - RNA, 18 nt, Salmonella enterica enterica serovar Typhi Ty2
aaucacgcaucacuuuug

SEQ ID NO: 3682692 - RNA, 15 nt, Salmonella enterica enterica serovar Typhi Ty2
aaucacgccgaugac

SEQ ID NO: 3682693 - RNA, 14 nt, Salmonella enterica enterica serovar Typhi Ty2
aaucacgcggcgcu

SEQ ID NO: 3682694 - RNA, 23 nt, Salmonella enterica enterica serovar Typhi Ty2
aaucacgcguaucuggucaucgu

SEQ ID NO: 3682695 - RNA, 20 nt, Salmonella enterica enterica serovar Typhi Ty2
aaucacguuuugcagcgcca

SEQ ID NO: 3682696 - RNA, 18 nt, Salmonella enterica enterica serovar Typhi Ty2
aaucacuaagaccagcau

SEQ ID NO: 3682697 - RNA, 15 nt, Salmonella enterica enterica serovar Typhi Ty2
aaucacuacggguuu

SEQ ID NO: 3682698 - RNA, 14 nt, Salmonella enterica enterica serovar Typhi Ty2
aaucacugacggaa

SEQ ID NO: 3682699 - RNA, 18 nt, Salmonella enterica enterica serovar Typhi Ty2
aaucacugccgccacgcc

SEQ ID NO: 3682700 - RNA, 16 nt, Salmonella enterica enterica serovar Typhi Ty2
aaucacuuaucaaacc

SEQ ID NO: 3682701 - RNA, 20 nt, Salmonella enterica enterica serovar Typhi Ty2
aaucacuuaucaaaccagcu

SEQ ID NO: 3682702 - RNA, 15 nt, Salmonella enterica enterica serovar Typhi Ty2
aaucagaagaaauau

SEQ ID NO: 3682703 - RNA, 14 nt, Salmonella enterica enterica serovar Typhi Ty2
aaucagaauaccgc

SEQ ID NO: 3682704 - RNA, 21 nt, Salmonella enterica enterica serovar Typhi Ty2
aaucagacuaucuucgauaaa

SEQ ID NO: 3682705 - RNA, 22 nt, Salmonella enterica enterica serovar Typhi Ty2
aaucagauacggcuccagcaca

SEQ ID NO: 3682706 - RNA, 13 nt, Salmonella enterica enterica serovar Typhi Ty2
aaucagaugcuca

SEQ ID NO: 3682707 - RNA, 17 nt, Salmonella enterica enterica serovar Typhi Ty2
aaucagauugccacagg

SEQ ID NO: 3682708 - RNA, 21 nt, Salmonella enterica enterica serovar Typhi Ty2
aaucagauugccacaggacca

SEQ ID NO: 3682709 - RNA, 11 nt, Salmonella enterica enterica serovar Typhi Ty2
aaucagcagcg

SEQ ID NO: 3682710 - RNA, 23 nt, Salmonella enterica enterica serovar Typhi Ty2
aaucagccaaagcgagguaaaaa

SEQ ID NO: 3682711 - RNA, 18 nt, Salmonella enterica enterica serovar Typhi Ty2
aaucagccacggcaacgc

SEQ ID NO: 3682712 - RNA, 15 nt, Salmonella enterica enterica serovar Typhi Ty2
aaucaggacaucaaa

SEQ ID NO: 3682713 - RNA, 23 nt, Salmonella enterica enterica serovar Typhi Ty2
aaucaggcacaacccaaaggcca

SEQ ID NO: 3682714 - RNA, 17 nt, Salmonella enterica enterica serovar Typhi Ty2
aaucaggugaauaccaa

SEQ ID NO: 3682715 - RNA, 13 nt, Salmonella enterica enterica serovar Typhi Ty2
aaucauaccagcg

SEQ ID NO: 3682716 - RNA, 16 nt, Salmonella enterica enterica serovar Typhi Ty2
aaucauauaagaaaua

SEQ ID NO: 3682717 - RNA, 13 nt, Salmonella enterica enterica serovar Typhi Ty2
aaucaucagaauc

SEQ ID NO: 3682718 - RNA, 22 nt, Salmonella enterica enterica serovar Typhi Ty2
aaucaucagaccgauaaauacc

SEQ ID NO: 3682719 - RNA, 16 nt, Salmonella enterica enterica serovar Typhi Ty2
aaucaucaggcuggcg

SEQ ID NO: 3682720 - RNA, 14 nt, Salmonella enterica enterica serovar Typhi Ty2
aaucaucauauccc

SEQ ID NO: 3682721 - RNA, 13 nt, Salmonella enterica enterica serovar Typhi Ty2
aaucaucaucagg

SEQ ID NO: 3682722 - RNA, 17 nt, Salmonella enterica enterica serovar Typhi Ty2
aaucauccugauuuuac

SEQ ID NO: 3682723 - RNA, 22 nt, Salmonella enterica enterica serovar Typhi Ty2
aaucaucgaggccaccaaaaau

SEQ ID NO: 3682724 - RNA, 23 nt, Salmonella enterica enterica serovar Typhi Ty2
aaucaucgcgcugauauuuuuac

SEQ ID NO: 3682725 - RNA, 14 nt, Salmonella enterica enterica serovar Typhi Ty2
aaucauuaauacac

SEQ ID NO: 3682726 - RNA, 13 nt, Salmonella enterica enterica serovar Typhi Ty2
aaucauuaucacu

SEQ ID NO: 3682727 - RNA, 18 nt, Salmonella enterica enterica serovar Typhi Ty2
aaucauuuagucgauggu

SEQ ID NO: 3682728 - RNA, 19 nt, Salmonella enterica enterica serovar Typhi Ty2
aaucauuuguacaaaaaau

SEQ ID NO: 3682729 - RNA, 14 nt, Salmonella enterica enterica serovar Typhi Ty2
aauccaaauccgca

SEQ ID NO: 3682730 - RNA, 21 nt, Salmonella enterica enterica serovar Typhi Ty2
aauccacggguuacaacugcg

SEQ ID NO: 3682731 - RNA, 21 nt, Salmonella enterica enterica serovar Typhi Ty2
aauccacuggucgucugaaag

SEQ ID NO: 3682732 - RNA, 22 nt, Salmonella enterica enterica serovar Typhi Ty2
aauccagaauguuccugcaaua

SEQ ID NO: 3682733 - RNA, 14 nt, Salmonella enterica enterica serovar Typhi Ty2
aauccagcaggcug

SEQ ID NO: 3682734 - RNA, 17 nt, Salmonella enterica enterica serovar Typhi Ty2
aauccagcuacuggcca

SEQ ID NO: 3682735 - RNA, 14 nt, Salmonella enterica enterica serovar Typhi Ty2
aauccaggaauuuu

SEQ ID NO: 3682736 - RNA, 17 nt, Salmonella enterica enterica serovar Typhi Ty2
aauccaggaauuuuccc

SEQ ID NO: 3682737 - RNA, 12 nt, Salmonella enterica enterica serovar Typhi Ty2
aauccaggugga

SEQ ID NO: 3682738 - RNA, 13 nt, Salmonella enterica enterica serovar Typhi Ty2
aauccagguggau

SEQ ID NO: 3682739 - RNA, 17 nt, Salmonella enterica enterica serovar Typhi Ty2
aauccaugagaagaaaa

SEQ ID NO: 3682740 - RNA, 17 nt, Salmonella enterica enterica serovar Typhi Ty2
aaucccaccaauugcca

SEQ ID NO: 3682741 - RNA, 15 nt, Salmonella enterica enterica serovar Typhi Ty2
aaucccauuagccac

SEQ ID NO: 3682742 - RNA, 19 nt, Salmonella enterica enterica serovar Typhi Ty2
aauccccagcgcuccacca

SEQ ID NO: 3682743 - RNA, 23 nt, Salmonella enterica enterica serovar Typhi Ty2
aaucccccggaucaccggcauuu

SEQ ID NO: 3682744 - RNA, 20 nt, Salmonella enterica enterica serovar Typhi Ty2
aauccccggcgaaagaaaau

SEQ ID NO: 3682745 - RNA, 23 nt, Salmonella enterica enterica serovar Typhi Ty2
aaucccgaaucacuuacuaaggu

SEQ ID NO: 3682746 - RNA, 19 nt, Salmonella enterica enterica serovar Typhi Ty2
aaucccuggcgaauaaaau

SEQ ID NO: 3682747 - RNA, 13 nt, Salmonella enterica enterica serovar Typhi Ty2
aaucccuucuuuu

SEQ ID NO: 3682748 - RNA, 14 nt, Salmonella enterica enterica serovar Typhi Ty2
aaucccuucuuuua

SEQ ID NO: 3682749 - RNA, 20 nt, Salmonella enterica enterica serovar Typhi Ty2
aaucccuucuuuuacugccc

SEQ ID NO: 3682750 - RNA, 17 nt, Salmonella enterica enterica serovar Typhi Ty2
aauccgacgcuucaaag

SEQ ID NO: 3682751 - RNA, 19 nt, Salmonella enterica enterica serovar Typhi Ty2
aauccgcuaacgaugucau

SEQ ID NO: 3682752 - RNA, 21 nt, Salmonella enterica enterica serovar Typhi Ty2
aauccggcugccugccggauu

SEQ ID NO: 3682753 - RNA, 23 nt, Salmonella enterica enterica serovar Typhi Ty2
aauccgugcccgaaucgccgcuu

SEQ ID NO: 3682754 - RNA, 18 nt, Salmonella enterica enterica serovar Typhi Ty2
aauccgugcguaaaauau

SEQ ID NO: 3682755 - RNA, 16 nt, Salmonella enterica enterica serovar Typhi Ty2
aauccguuaagcccug

SEQ ID NO: 3682756 - RNA, 17 nt, Salmonella enterica enterica serovar Typhi Ty2
aauccguuaagcccuga

SEQ ID NO: 3682757 - RNA, 21 nt, Salmonella enterica enterica serovar Typhi Ty2
aauccucuaccggaaaacagc

SEQ ID NO: 3682758 - RNA, 15 nt, Salmonella enterica enterica serovar Typhi Ty2
aauccugcacccgcc

SEQ ID NO: 3682759 - RNA, 15 nt, Salmonella enterica enterica serovar Typhi Ty2
aauccugcgcuggcu

SEQ ID NO: 3682760 - RNA, 17 nt, Salmonella enterica enterica serovar Typhi Ty2
aauccugucgucaccag

SEQ ID NO: 3682761 - RNA, 13 nt, Salmonella enterica enterica serovar Typhi Ty2
aauccuuccuuuc

SEQ ID NO: 3682762 - RNA, 23 nt, Salmonella enterica enterica serovar Typhi Ty2
aauccuucuaccuucacccccau

SEQ ID NO: 3682763 - RNA, 12 nt, Salmonella enterica enterica serovar Typhi Ty2
aauccuucuucc

SEQ ID NO: 3682764 - RNA, 16 nt, Salmonella enterica enterica serovar Typhi Ty2
aauccuucuuccauuc

SEQ ID NO: 3682765 - RNA, 18 nt, Salmonella enterica enterica serovar Typhi Ty2
aauccuuguccauguaaa

SEQ ID NO: 3682766 - RNA, 23 nt, Salmonella enterica enterica serovar Typhi Ty2
aauccuuguccauguaaacucca

SEQ ID NO: 3682767 - RNA, 19 nt, Salmonella enterica enterica serovar Typhi Ty2
aauccuuuauuuaauugcu

SEQ ID NO: 3682768 - RNA, 14 nt, Salmonella enterica enterica serovar Typhi Ty2
aaucgacaauccgc

SEQ ID NO: 3682769 - RNA, 21 nt, Salmonella enterica enterica serovar Typhi Ty2
aaucgacaugucggcgaaaau

SEQ ID NO: 3682770 - RNA, 14 nt, Salmonella enterica enterica serovar Typhi Ty2
aaucgagaucagac

SEQ ID NO: 3682771 - RNA, 13 nt, Salmonella enterica enterica serovar Typhi Ty2
aaucgagcccaga

SEQ ID NO: 3682772 - RNA, 14 nt, Salmonella enterica enterica serovar Typhi Ty2
aaucgauaagccag

SEQ ID NO: 3682773 - RNA, 19 nt, Salmonella enterica enterica serovar Typhi Ty2
aaucgauauaauuuuauua

SEQ ID NO: 3682774 - RNA, 15 nt, Salmonella enterica enterica serovar Typhi Ty2
aaucgauggugccga

SEQ ID NO: 3682775 - RNA, 14 nt, Salmonella enterica enterica serovar Typhi Ty2
aaucgauuuucucc

SEQ ID NO: 3682776 - RNA, 19 nt, Salmonella enterica enterica serovar Typhi Ty2
aaucgcaucauaaauggcu

SEQ ID NO: 3682777 - RNA, 16 nt, Salmonella enterica enterica serovar Typhi Ty2
aaucgccagcaucggc

SEQ ID NO: 3682778 - RNA, 23 nt, Salmonella enterica enterica serovar Typhi Ty2
aaucgccagcaucggcagcgcca

SEQ ID NO: 3682779 - RNA, 21 nt, Salmonella enterica enterica serovar Typhi Ty2
aaucgccaucagcgcgaaaau

SEQ ID NO: 3682780 - RNA, 20 nt, Salmonella enterica enterica serovar Typhi Ty2
aaucgccccauuggcgucga

SEQ ID NO: 3682781 - RNA, 19 nt, Salmonella enterica enterica serovar Typhi Ty2
aaucgccgauauggucgcu

SEQ ID NO: 3682782 - RNA, 15 nt, Salmonella enterica enterica serovar Typhi Ty2
aaucgccgccgccag

SEQ ID NO: 3682783 - RNA, 16 nt, Salmonella enterica enterica serovar Typhi Ty2
aaucgccgggcggcgc

SEQ ID NO: 3682784 - RNA, 20 nt, Salmonella enterica enterica serovar Typhi Ty2
aaucgccgggcggcgcagcg

SEQ ID NO: 3682785 - RNA, 14 nt, Salmonella enterica enterica serovar Typhi Ty2
aaucgccgucagug

SEQ ID NO: 3682786 - RNA, 14 nt, Salmonella enterica enterica serovar Typhi Ty2
aaucgccucaacca

SEQ ID NO: 3682787 - RNA, 22 nt, Salmonella enterica enterica serovar Typhi Ty2
aaucgccucuucgaccgucgcg

SEQ ID NO: 3682788 - RNA, 20 nt, Salmonella enterica enterica serovar Typhi Ty2
aaucgccugcuguacuuuug

SEQ ID NO: 3682789 - RNA, 17 nt, Salmonella enterica enterica serovar Typhi Ty2
aaucgcgaauaaaugag

SEQ ID NO: 3682790 - RNA, 18 nt, Salmonella enterica enterica serovar Typhi Ty2
aaucgcgauccagcccca

SEQ ID NO: 3682791 - RNA, 19 nt, Salmonella enterica enterica serovar Typhi Ty2
aaucgcgguaaaaagcuga

SEQ ID NO: 3682792 - RNA, 12 nt, Salmonella enterica enterica serovar Typhi Ty2
aaucgcguucgc

SEQ ID NO: 3682793 - RNA, 14 nt, Salmonella enterica enterica serovar Typhi Ty2
aaucgcguucgcgg

SEQ ID NO: 3682794 - RNA, 18 nt, Salmonella enterica enterica serovar Typhi Ty2
aaucgcuaaacauauacc

SEQ ID NO: 3682795 - RNA, 19 nt, Salmonella enterica enterica serovar Typhi Ty2
aaucgcuaaacauauaccg

SEQ ID NO: 3682796 - RNA, 16 nt, Salmonella enterica enterica serovar Typhi Ty2
aaucgcuaaggcggca

SEQ ID NO: 3682797 - RNA, 21 nt, Salmonella enterica enterica serovar Typhi Ty2
aaucgcucacccgauaaaauc

SEQ ID NO: 3682798 - RNA, 13 nt, Salmonella enterica enterica serovar Typhi Ty2
aaucgcuucacgg

SEQ ID NO: 3682799 - RNA, 11 nt, Salmonella enterica enterica serovar Typhi Ty2
aaucggcaccu

SEQ ID NO: 3682800 - RNA, 20 nt, Salmonella enterica enterica serovar Typhi Ty2
aaucggccagcgaaaaccag

SEQ ID NO: 3682801 - RNA, 18 nt, Salmonella enterica enterica serovar Typhi Ty2
aaucggcgucuggagcgu

SEQ ID NO: 3682802 - RNA, 19 nt, Salmonella enterica enterica serovar Typhi Ty2
aaucggcuaguaauaccag

SEQ ID NO: 3682803 - RNA, 13 nt, Salmonella enterica enterica serovar Typhi Ty2
aaucggcuucucc

SEQ ID NO: 3682804 - RNA, 17 nt, Salmonella enterica enterica serovar Typhi Ty2
aaucgguuaugcgauuu

SEQ ID NO: 3682805 - RNA, 14 nt, Salmonella enterica enterica serovar Typhi Ty2
aaucgucacagacc

SEQ ID NO: 3682806 - RNA, 14 nt, Salmonella enterica enterica serovar Typhi Ty2
aaucgucaucagau

SEQ ID NO: 3682807 - RNA, 18 nt, Salmonella enterica enterica serovar Typhi Ty2
aaucgucgaggaagcugc

SEQ ID NO: 3682808 - RNA, 20 nt, Salmonella enterica enterica serovar Typhi Ty2
aaucgucguuccgccaggcg

SEQ ID NO: 3682809 - RNA, 16 nt, Salmonella enterica enterica serovar Typhi Ty2
aaucgucucucauccg

SEQ ID NO: 3682810 - RNA, 19 nt, Salmonella enterica enterica serovar Typhi Ty2
aaucguucgccagugacaa

SEQ ID NO: 3682811 - RNA, 21 nt, Salmonella enterica enterica serovar Typhi Ty2
aaucguucuugcacaauacuu

SEQ ID NO: 3682812 - RNA, 14 nt, Salmonella enterica enterica serovar Typhi Ty2
aaucguuuuaugcc

SEQ ID NO: 3682813 - RNA, 16 nt, Salmonella enterica enterica serovar Typhi Ty2
aaucuaagagccuguc

SEQ ID NO: 3682814 - RNA, 18 nt, Salmonella enterica enterica serovar Typhi Ty2
aaucuaagagccuguccc

SEQ ID NO: 3682815 - RNA, 23 nt, Salmonella enterica enterica serovar Typhi Ty2
aaucuaccauugauaccaauaaa

SEQ ID NO: 3682816 - RNA, 17 nt, Salmonella enterica enterica serovar Typhi Ty2
aaucucaauaccacgcc

SEQ ID NO: 3682817 - RNA, 17 nt, Salmonella enterica enterica serovar Typhi Ty2
aaucucacugcccauuc

SEQ ID NO: 3682818 - RNA, 22 nt, Salmonella enterica enterica serovar Typhi Ty2
aaucucagauaauagcugcggc

SEQ ID NO: 3682819 - RNA, 22 nt, Salmonella enterica enterica serovar Typhi Ty2
aaucuccuccggcuucagcaac

SEQ ID NO: 3682820 - RNA, 19 nt, Salmonella enterica enterica serovar Typhi Ty2
aaucucgugaucgccaaag

SEQ ID NO: 3682821 - RNA, 15 nt, Salmonella enterica enterica serovar Typhi Ty2
aaucucuacacaacg

SEQ ID NO: 3682822 - RNA, 17 nt, Salmonella enterica enterica serovar Typhi Ty2
aaucucuucccagcgca

SEQ ID NO: 3682823 - RNA, 23 nt, Salmonella enterica enterica serovar Typhi Ty2
aaucugacgcauccgcuucucua

SEQ ID NO: 3682824 - RNA, 21 nt, Salmonella enterica enterica serovar Typhi Ty2
aaucugcauguaguaagccau

SEQ ID NO: 3682825 - RNA, 19 nt, Salmonella enterica enterica serovar Typhi Ty2
aaucugccaucagcaccuu

SEQ ID NO: 3682826 - RNA, 15 nt, Salmonella enterica enterica serovar Typhi Ty2
aaucugccgucaucg

SEQ ID NO: 3682827 - RNA, 23 nt, Salmonella enterica enterica serovar Typhi Ty2
aaucuggcgcaaaugggccuacg

SEQ ID NO: 3682828 - RNA, 19 nt, Salmonella enterica enterica serovar Typhi Ty2
aaucuggucggugauauau

SEQ ID NO: 3682829 - RNA, 21 nt, Salmonella enterica enterica serovar Typhi Ty2
aaucuggugauaaagcagacc

SEQ ID NO: 3682830 - RNA, 14 nt, Salmonella enterica enterica serovar Typhi Ty2
aaucuguuccagcg

SEQ ID NO: 3682831 - RNA, 22 nt, Salmonella enterica enterica serovar Typhi Ty2
aaucuguuccagcgagcaggaa

SEQ ID NO: 3682832 - RNA, 17 nt, Salmonella enterica enterica serovar Typhi Ty2
aaucuguucguugcugu

SEQ ID NO: 3682833 - RNA, 20 nt, Salmonella enterica enterica serovar Typhi Ty2
aaucuguuucaguucggaga

SEQ ID NO: 3682834 - RNA, 15 nt, Salmonella enterica enterica serovar Typhi Ty2
aaucuuaccuguucc

SEQ ID NO: 3682835 - RNA, 12 nt, Salmonella enterica enterica serovar Typhi Ty2
aaucuucgcggc

SEQ ID NO: 3682836 - RNA, 14 nt, Salmonella enterica enterica serovar Typhi Ty2
aaucuugcguacca

SEQ ID NO: 3682837 - RNA, 16 nt, Salmonella enterica enterica serovar Typhi Ty2
aaucuuuccagcucca

SEQ ID NO: 3682838 - RNA, 13 nt, Salmonella enterica enterica serovar Typhi Ty2
aaucuuugccgca

SEQ ID NO: 3682839 - RNA, 12 nt, Salmonella enterica enterica serovar Typhi Ty2
aaucuuuuauau

SEQ ID NO: 3682840 - RNA, 20 nt, Salmonella enterica enterica serovar Typhi Ty2
aaucuuuuauauguugaaua

SEQ ID NO: 3682841 - RNA, 22 nt, Salmonella enterica enterica serovar Typhi Ty2
aaucuuuuauauguugaauauu

SEQ ID NO: 3682842 - RNA, 14 nt, Salmonella enterica enterica serovar Typhi Ty2
aaugaaaaaaaaau

SEQ ID NO: 3682843 - RNA, 12 nt, Salmonella enterica enterica serovar Typhi Ty2
aaugaaaucguc

SEQ ID NO: 3682844 - RNA, 22 nt, Salmonella enterica enterica serovar Typhi Ty2
aaugaaaugcccauaaagaaau

SEQ ID NO: 3682845 - RNA, 16 nt, Salmonella enterica enterica serovar Typhi Ty2
aaugaagcauaaaaag

SEQ ID NO: 3682846 - RNA, 18 nt, Salmonella enterica enterica serovar Typhi Ty2
aaugaagcauaaaaagac

SEQ ID NO: 3682847 - RNA, 13 nt, Salmonella enterica enterica serovar Typhi Ty2
aaugaagcgcguu

SEQ ID NO: 3682848 - RNA, 18 nt, Salmonella enterica enterica serovar Typhi Ty2
aaugaagcggaaaggacg

SEQ ID NO: 3682849 - RNA, 14 nt, Salmonella enterica enterica serovar Typhi Ty2
aaugaagcgucgcg

SEQ ID NO: 3682850 - RNA, 18 nt, Salmonella enterica enterica serovar Typhi Ty2
aaugaauuauuuuuucau

SEQ ID NO: 3682851 - RNA, 22 nt, Salmonella enterica enterica serovar Typhi Ty2
aaugaauuauuuuuucaugacu

SEQ ID NO: 3682852 - RNA, 17 nt, Salmonella enterica enterica serovar Typhi Ty2
aaugaauugaacuaaaa

SEQ ID NO: 3682853 - RNA, 13 nt, Salmonella enterica enterica serovar Typhi Ty2
aaugacaaaaauu

SEQ ID NO: 3682854 - RNA, 21 nt, Salmonella enterica enterica serovar Typhi Ty2
aaugaccacaccgucaacauc

SEQ ID NO: 3682855 - RNA, 15 nt, Salmonella enterica enterica serovar Typhi Ty2
aaugaccagaucaac

SEQ ID NO: 3682856 - RNA, 14 nt, Salmonella enterica enterica serovar Typhi Ty2
aaugaccagcgccc

SEQ ID NO: 3682857 - RNA, 15 nt, Salmonella enterica enterica serovar Typhi Ty2
aaugaccagcgccca

SEQ ID NO: 3682858 - RNA, 20 nt, Salmonella enterica enterica serovar Typhi Ty2
aaugaccauuaacgccagcg

SEQ ID NO: 3682859 - RNA, 18 nt, Salmonella enterica enterica serovar Typhi Ty2
aaugacgagcagguuacu

SEQ ID NO: 3682860 - RNA, 11 nt, Salmonella enterica enterica serovar Typhi Ty2
aaugacgcccu

SEQ ID NO: 3682861 - RNA, 12 nt, Salmonella enterica enterica serovar Typhi Ty2
aaugacgcccug

SEQ ID NO: 3682862 - RNA, 13 nt, Salmonella enterica enterica serovar Typhi Ty2
aaugacgcccugc

SEQ ID NO: 3682863 - RNA, 15 nt, Salmonella enterica enterica serovar Typhi Ty2
aaugacggaccaaca

SEQ ID NO: 3682864 - RNA, 13 nt, Salmonella enterica enterica serovar Typhi Ty2
aaugacuuuuuau

SEQ ID NO: 3682865 - RNA, 14 nt, Salmonella enterica enterica serovar Typhi Ty2
aaugagaaaaggaa

SEQ ID NO: 3682866 - RNA, 17 nt, Salmonella enterica enterica serovar Typhi Ty2
aaugagagacggagaaa

SEQ ID NO: 3682867 - RNA, 15 nt, Salmonella enterica enterica serovar Typhi Ty2
aaugagcaucuaccc

SEQ ID NO: 3682868 - RNA, 13 nt, Salmonella enterica enterica serovar Typhi Ty2
aaugagcgucgcc

SEQ ID NO: 3682869 - RNA, 22 nt, Salmonella enterica enterica serovar Typhi Ty2
aaugaguagaacguauuauuau

SEQ ID NO: 3682870 - RNA, 15 nt, Salmonella enterica enterica serovar Typhi Ty2
aaugauaaugccgcu

SEQ ID NO: 3682871 - RNA, 18 nt, Salmonella enterica enterica serovar Typhi Ty2
aaugauaccaauuugagc

SEQ ID NO: 3682872 - RNA, 18 nt, Salmonella enterica enterica serovar Typhi Ty2
aaugauauuuaaaacugg

SEQ ID NO: 3682873 - RNA, 12 nt, Salmonella enterica enterica serovar Typhi Ty2
aaugaucagaac

SEQ ID NO: 3682874 - RNA, 19 nt, Salmonella enterica enterica serovar Typhi Ty2
aaugaucagaacucacaua

SEQ ID NO: 3682875 - RNA, 12 nt, Salmonella enterica enterica serovar Typhi Ty2
aaugaucagacg

SEQ ID NO: 3682876 - RNA, 19 nt, Salmonella enterica enterica serovar Typhi Ty2
aaugaucguaugcagccag

SEQ ID NO: 3682877 - RNA, 14 nt, Salmonella enterica enterica serovar Typhi Ty2
aaugaugacucauu

SEQ ID NO: 3682878 - RNA, 21 nt, Salmonella enterica enterica serovar Typhi Ty2
aaugaugacucauuaaaaaaa

SEQ ID NO: 3682879 - RNA, 22 nt, Salmonella enterica enterica serovar Typhi Ty2
aaugaugacucauuaaaaaaac

SEQ ID NO: 3682880 - RNA, 12 nt, Salmonella enterica enterica serovar Typhi Ty2
aaugaugggguc

SEQ ID NO: 3682881 - RNA, 12 nt, Salmonella enterica enterica serovar Typhi Ty2
aaugauuaaaau

SEQ ID NO: 3682882 - RNA, 16 nt, Salmonella enterica enterica serovar Typhi Ty2
aaugauuaaaauaaau

SEQ ID NO: 3682883 - RNA, 17 nt, Salmonella enterica enterica serovar Typhi Ty2
aaugauuacggaacaaa

SEQ ID NO: 3682884 - RNA, 13 nt, Salmonella enterica enterica serovar Typhi Ty2
aaugauuugcuuu

SEQ ID NO: 3682885 - RNA, 23 nt, Salmonella enterica enterica serovar Typhi Ty2
aaugauuuuguguauauauugca

SEQ ID NO: 3682886 - RNA, 15 nt, Salmonella enterica enterica serovar Typhi Ty2
aaugcacaauacgcc

SEQ ID NO: 3682887 - RNA, 16 nt, Salmonella enterica enterica serovar Typhi Ty2
aaugcaggcguuuuau

SEQ ID NO: 3682888 - RNA, 18 nt, Salmonella enterica enterica serovar Typhi Ty2
aaugcauagccccagcgc

SEQ ID NO: 3682889 - RNA, 19 nt, Salmonella enterica enterica serovar Typhi Ty2
aaugcauagccccagcgca

SEQ ID NO: 3682890 - RNA, 19 nt, Salmonella enterica enterica serovar Typhi Ty2
aaugcauggcagauaaacc

SEQ ID NO: 3682891 - RNA, 21 nt, Salmonella enterica enterica serovar Typhi Ty2
aaugcauggcagauaaaccac

SEQ ID NO: 3682892 - RNA, 19 nt, Salmonella enterica enterica serovar Typhi Ty2
aaugcauugauaggcugcu

SEQ ID NO: 3682893 - RNA, 14 nt, Salmonella enterica enterica serovar Typhi Ty2
aaugcauuggccag

SEQ ID NO: 3682894 - RNA, 18 nt, Salmonella enterica enterica serovar Typhi Ty2
aaugccacgauccccguc

SEQ ID NO: 3682895 - RNA, 23 nt, Salmonella enterica enterica serovar Typhi Ty2
aaugccagaaaucgcucaugcgc

SEQ ID NO: 3682896 - RNA, 13 nt, Salmonella enterica enterica serovar Typhi Ty2
aaugccagcgccg

SEQ ID NO: 3682897 - RNA, 19 nt, Salmonella enterica enterica serovar Typhi Ty2
aaugccauaauuuauccuc

SEQ ID NO: 3682898 - RNA, 23 nt, Salmonella enterica enterica serovar Typhi Ty2
aaugccauauuuuuccagcgccu

SEQ ID NO: 3682899 - RNA, 13 nt, Salmonella enterica enterica serovar Typhi Ty2
aaugccaugcugg

SEQ ID NO: 3682900 - RNA, 12 nt, Salmonella enterica enterica serovar Typhi Ty2
aaugcccaaaau

SEQ ID NO: 3682901 - RNA, 19 nt, Salmonella enterica enterica serovar Typhi Ty2
aaugcccagcgcaaucacg

SEQ ID NO: 3682902 - RNA, 14 nt, Salmonella enterica enterica serovar Typhi Ty2
aaugcccagcgccg

SEQ ID NO: 3682903 - RNA, 14 nt, Salmonella enterica enterica serovar Typhi Ty2
aaugcccaggcggc

SEQ ID NO: 3682904 - RNA, 16 nt, Salmonella enterica enterica serovar Typhi Ty2
aaugcccaggcggcgg

SEQ ID NO: 3682905 - RNA, 15 nt, Salmonella enterica enterica serovar Typhi Ty2
aaugcccccucggca

SEQ ID NO: 3682906 - RNA, 17 nt, Salmonella enterica enterica serovar Typhi Ty2
aaugcccgguauuuuuu

SEQ ID NO: 3682907 - RNA, 21 nt, Salmonella enterica enterica serovar Typhi Ty2
aaugcccgucucauuucugga

SEQ ID NO: 3682908 - RNA, 20 nt, Salmonella enterica enterica serovar Typhi Ty2
aaugccgccguacaaacccu

SEQ ID NO: 3682909 - RNA, 22 nt, Salmonella enterica enterica serovar Typhi Ty2
aaugccgggcaaaaaacggaac

SEQ ID NO: 3682910 - RNA, 13 nt, Salmonella enterica enterica serovar Typhi Ty2
aaugccuguuuau

SEQ ID NO: 3682911 - RNA, 14 nt, Salmonella enterica enterica serovar Typhi Ty2
aaugccuuccugug

SEQ ID NO: 3682912 - RNA, 15 nt, Salmonella enterica enterica serovar Typhi Ty2
aaugcgacagcgaca

SEQ ID NO: 3682913 - RNA, 13 nt, Salmonella enterica enterica serovar Typhi Ty2
aaugcgcacgcca

SEQ ID NO: 3682914 - RNA, 16 nt, Salmonella enterica enterica serovar Typhi Ty2
aaugcgccagcggcca

SEQ ID NO: 3682915 - RNA, 22 nt, Salmonella enterica enterica serovar Typhi Ty2
aaugcgcgcggcuaccggacug

SEQ ID NO: 3682916 - RNA, 21 nt, Salmonella enterica enterica serovar Typhi Ty2
aaugcgcgugcgguuuuccug

SEQ ID NO: 3682917 - RNA, 15 nt, Salmonella enterica enterica serovar Typhi Ty2
aaugcgcuagcuggc

SEQ ID NO: 3682918 - RNA, 21 nt, Salmonella enterica enterica serovar Typhi Ty2
aaugcguccgccagaugcacc

SEQ ID NO: 3682919 - RNA, 20 nt, Salmonella enterica enterica serovar Typhi Ty2
aaugcgucggcaccauuccc

SEQ ID NO: 3682920 - RNA, 20 nt, Salmonella enterica enterica serovar Typhi Ty2
aaugcucauuauuuggauua

SEQ ID NO: 3682921 - RNA, 15 nt, Salmonella enterica enterica serovar Typhi Ty2
aaugcuccaauaaau

SEQ ID NO: 3682922 - RNA, 18 nt, Salmonella enterica enterica serovar Typhi Ty2
aaugcuccaauaaauauu

SEQ ID NO: 3682923 - RNA, 13 nt, Salmonella enterica enterica serovar Typhi Ty2
aaugcuuuaaaug

SEQ ID NO: 3682924 - RNA, 15 nt, Salmonella enterica enterica serovar Typhi Ty2
aaugcuuucaauacu

SEQ ID NO: 3682925 - RNA, 13 nt, Salmonella enterica enterica serovar Typhi Ty2
aauggaaaauaau

SEQ ID NO: 3682926 - RNA, 14 nt, Salmonella enterica enterica serovar Typhi Ty2
aauggaaaauaaua

SEQ ID NO: 3682927 - RNA, 11 nt, Salmonella enterica enterica serovar Typhi Ty2
aauggagauga

SEQ ID NO: 3682928 - RNA, 18 nt, Salmonella enterica enterica serovar Typhi Ty2
aauggcaaguaaaauagc

SEQ ID NO: 3682929 - RNA, 16 nt, Salmonella enterica enterica serovar Typhi Ty2
aauggcaauggcggcg

SEQ ID NO: 3682930 - RNA, 18 nt, Salmonella enterica enterica serovar Typhi Ty2
aauggcaggcagcagaua

SEQ ID NO: 3682931 - RNA, 20 nt, Salmonella enterica enterica serovar Typhi Ty2
aauggccagaugaaacugca

SEQ ID NO: 3682932 - RNA, 16 nt, Salmonella enterica enterica serovar Typhi Ty2
aauggccgcagcgcca

SEQ ID NO: 3682933 - RNA, 17 nt, Salmonella enterica enterica serovar Typhi Ty2
aauggccgcagcgccau

SEQ ID NO: 3682934 - RNA, 12 nt, Salmonella enterica enterica serovar Typhi Ty2
aauggccgcccc

SEQ ID NO: 3682935 - RNA, 20 nt, Salmonella enterica enterica serovar Typhi Ty2
aauggcgacgaucagcgcca

SEQ ID NO: 3682936 - RNA, 14 nt, Salmonella enterica enterica serovar Typhi Ty2
aauggcgcgaaaac

SEQ ID NO: 3682937 - RNA, 19 nt, Salmonella enterica enterica serovar Typhi Ty2
aauggcgcgaaaacagcug

SEQ ID NO: 3682938 - RNA, 21 nt, Salmonella enterica enterica serovar Typhi Ty2
aauggcgcgucuuaaaauugc

SEQ ID NO: 3682939 - RNA, 15 nt, Salmonella enterica enterica serovar Typhi Ty2
aauggcgcguuuuau

SEQ ID NO: 3682940 - RNA, 19 nt, Salmonella enterica enterica serovar Typhi Ty2
aauggcgcguuuuaucaug

SEQ ID NO: 3682941 - RNA, 10 nt, Salmonella enterica enterica serovar Typhi Ty2
aauggcgcuc

SEQ ID NO: 3682942 - RNA, 16 nt, Salmonella enterica enterica serovar Typhi Ty2
aauggcgcucuuuucc

SEQ ID NO: 3682943 - RNA, 20 nt, Salmonella enterica enterica serovar Typhi Ty2
aauggcggagaucuccagau

SEQ ID NO: 3682944 - RNA, 16 nt, Salmonella enterica enterica serovar Typhi Ty2
aauggcguaaagaggg

SEQ ID NO: 3682945 - RNA, 15 nt, Salmonella enterica enterica serovar Typhi Ty2
aauggcguugcuggc

SEQ ID NO: 3682946 - RNA, 21 nt, Salmonella enterica enterica serovar Typhi Ty2
aauggcuaugccgacaggggg

SEQ ID NO: 3682947 - RNA, 19 nt, Salmonella enterica enterica serovar Typhi Ty2
aauggcucaacuccgccgg

SEQ ID NO: 3682948 - RNA, 21 nt, Salmonella enterica enterica serovar Typhi Ty2
aaugggaucuucaaugaacaa

SEQ ID NO: 3682949 - RNA, 16 nt, Salmonella enterica enterica serovar Typhi Ty2
aaugggcaggagauga

SEQ ID NO: 3682950 - RNA, 18 nt, Salmonella enterica enterica serovar Typhi Ty2
aauggggaucgucugcaa

SEQ ID NO: 3682951 - RNA, 23 nt, Salmonella enterica enterica serovar Typhi Ty2
aaugguauuaugcggaccgauag

SEQ ID NO: 3682952 - RNA, 18 nt, Salmonella enterica enterica serovar Typhi Ty2
aauggucccugauauaca

SEQ ID NO: 3682953 - RNA, 14 nt, Salmonella enterica enterica serovar Typhi Ty2
aauggucgcgccag

SEQ ID NO: 3682954 - RNA, 23 nt, Salmonella enterica enterica serovar Typhi Ty2
aaugguggucgcggccaccgcca

SEQ ID NO: 3682955 - RNA, 13 nt, Salmonella enterica enterica serovar Typhi Ty2
aaugguuauuaau

SEQ ID NO: 3682956 - RNA, 13 nt, Salmonella enterica enterica serovar Typhi Ty2
aaugguugcguuu

SEQ ID NO: 3682957 - RNA, 15 nt, Salmonella enterica enterica serovar Typhi Ty2
aaugguuucccaggu

SEQ ID NO: 3682958 - RNA, 12 nt, Salmonella enterica enterica serovar Typhi Ty2
aaugguuuugcc

SEQ ID NO: 3682959 - RNA, 17 nt, Salmonella enterica enterica serovar Typhi Ty2
aauguaaaaaaauaaaa

SEQ ID NO: 3682960 - RNA, 13 nt, Salmonella enterica enterica serovar Typhi Ty2
aauguaaaacuga

SEQ ID NO: 3682961 - RNA, 20 nt, Salmonella enterica enterica serovar Typhi Ty2
aauguaauucaccaaauccu

SEQ ID NO: 3682962 - RNA, 15 nt, Salmonella enterica enterica serovar Typhi Ty2
aauguacaucacauu

SEQ ID NO: 3682963 - RNA, 14 nt, Salmonella enterica enterica serovar Typhi Ty2
aauguacgccuaaa

SEQ ID NO: 3682964 - RNA, 12 nt, Salmonella enterica enterica serovar Typhi Ty2
aauguagcccca

SEQ ID NO: 3682965 - RNA, 13 nt, Salmonella enterica enterica serovar Typhi Ty2
aauguagcgcccu

SEQ ID NO: 3682966 - RNA, 22 nt, Salmonella enterica enterica serovar Typhi Ty2
aauguauaauccaacauuauca

SEQ ID NO: 3682967 - RNA, 22 nt, Salmonella enterica enterica serovar Typhi Ty2
aauguauucucccgucagcaac

SEQ ID NO: 3682968 - RNA, 14 nt, Salmonella enterica enterica serovar Typhi Ty2
aauguauuucagac

SEQ ID NO: 3682969 - RNA, 12 nt, Salmonella enterica enterica serovar Typhi Ty2
aaugucaucauc

SEQ ID NO: 3682970 - RNA, 20 nt, Salmonella enterica enterica serovar Typhi Ty2
aaugucaugacugguuuuuc

SEQ ID NO: 3682971 - RNA, 13 nt, Salmonella enterica enterica serovar Typhi Ty2
aauguccagcagu

SEQ ID NO: 3682972 - RNA, 17 nt, Salmonella enterica enterica serovar Typhi Ty2
aauguccauaaauagau

SEQ ID NO: 3682973 - RNA, 20 nt, Salmonella enterica enterica serovar Typhi Ty2
aaugucccaguaauaucgcc

SEQ ID NO: 3682974 - RNA, 16 nt, Salmonella enterica enterica serovar Typhi Ty2
aaugucgcaaucggcu

SEQ ID NO: 3682975 - RNA, 17 nt, Salmonella enterica enterica serovar Typhi Ty2
aaugucgcgucagguuu

SEQ ID NO: 3682976 - RNA, 21 nt, Salmonella enterica enterica serovar Typhi Ty2
aaugucguuacggcugaagcu

SEQ ID NO: 3682977 - RNA, 19 nt, Salmonella enterica enterica serovar Typhi Ty2
aaugucuggcgcuaaaauc

SEQ ID NO: 3682978 - RNA, 23 nt, Salmonella enterica enterica serovar Typhi Ty2
aaugucuuccuuuucuagccaau

SEQ ID NO: 3682979 - RNA, 18 nt, Salmonella enterica enterica serovar Typhi Ty2
aaugugaaauacagccag

SEQ ID NO: 3682980 - RNA, 16 nt, Salmonella enterica enterica serovar Typhi Ty2
aaugugauccgccccc

SEQ ID NO: 3682981 - RNA, 17 nt, Salmonella enterica enterica serovar Typhi Ty2
aauguuaauaagcagaa

SEQ ID NO: 3682982 - RNA, 15 nt, Salmonella enterica enterica serovar Typhi Ty2
aauguuagcgucugc

SEQ ID NO: 3682983 - RNA, 16 nt, Salmonella enterica enterica serovar Typhi Ty2
aauguuccgcagggga

SEQ ID NO: 3682984 - RNA, 21 nt, Salmonella enterica enterica serovar Typhi Ty2
aauguuuaaucggccagcgaa

SEQ ID NO: 3682985 - RNA, 22 nt, Salmonella enterica enterica serovar Typhi Ty2
aauguuuuuguuguuaauuuga

SEQ ID NO: 3682986 - RNA, 16 nt, Salmonella enterica enterica serovar Typhi Ty2
aauuaaaugcuugcuu

SEQ ID NO: 3682987 - RNA, 14 nt, Salmonella enterica enterica serovar Typhi Ty2
aauuaacaaauaaa

SEQ ID NO: 3682988 - RNA, 17 nt, Salmonella enterica enterica serovar Typhi Ty2
aauuaacauuuaagaaa

SEQ ID NO: 3682989 - RNA, 18 nt, Salmonella enterica enterica serovar Typhi Ty2
aauuaacgccgcgaggau

SEQ ID NO: 3682990 - RNA, 23 nt, Salmonella enterica enterica serovar Typhi Ty2
aauuaagcaauccauuuuaaaua

SEQ ID NO: 3682991 - RNA, 16 nt, Salmonella enterica enterica serovar Typhi Ty2
aauuaauauuuaacac

SEQ ID NO: 3682992 - RNA, 12 nt, Salmonella enterica enterica serovar Typhi Ty2
aauuaaucaggc

SEQ ID NO: 3682993 - RNA, 16 nt, Salmonella enterica enterica serovar Typhi Ty2
aauuaaugauuaaaau

SEQ ID NO: 3682994 - RNA, 17 nt, Salmonella enterica enterica serovar Typhi Ty2
aauuaaugauuaaaaua

SEQ ID NO: 3682995 - RNA, 23 nt, Salmonella enterica enterica serovar Typhi Ty2
aauuaaugugcguaaacaggcgc

SEQ ID NO: 3682996 - RNA, 16 nt, Salmonella enterica enterica serovar Typhi Ty2
aauuacagcucauaaa

SEQ ID NO: 3682997 - RNA, 16 nt, Salmonella enterica enterica serovar Typhi Ty2
aauuacgccauaaaaa

SEQ ID NO: 3682998 - RNA, 19 nt, Salmonella enterica enterica serovar Typhi Ty2
aauuacuaucuucaaagcc

SEQ ID NO: 3682999 - RNA, 12 nt, Salmonella enterica enterica serovar Typhi Ty2
aauuacuuauga

SEQ ID NO: 3683000 - RNA, 13 nt, Salmonella enterica enterica serovar Typhi Ty2
aauuacuuaugau

SEQ ID NO: 3683001 - RNA, 16 nt, Salmonella enterica enterica serovar Typhi Ty2
aauuacuuaugauaua

SEQ ID NO: 3683002 - RNA, 20 nt, Salmonella enterica enterica serovar Typhi Ty2
aauuagcgacauacauaacg

SEQ ID NO: 3683003 - RNA, 12 nt, Salmonella enterica enterica serovar Typhi Ty2
aauuauaaagca

SEQ ID NO: 3683004 - RNA, 17 nt, Salmonella enterica enterica serovar Typhi Ty2
aauuauacacucaacca

SEQ ID NO: 3683005 - RNA, 22 nt, Salmonella enterica enterica serovar Typhi Ty2
aauuauauugcguaaaaacccu

SEQ ID NO: 3683006 - RNA, 22 nt, Salmonella enterica enterica serovar Typhi Ty2
aauuaucuguugauaaaacacu

SEQ ID NO: 3683007 - RNA, 23 nt, Salmonella enterica enterica serovar Typhi Ty2
aauuaucuguugauaaaacacuc

SEQ ID NO: 3683008 - RNA, 16 nt, Salmonella enterica enterica serovar Typhi Ty2
aauuaugaccaauguu

SEQ ID NO: 3683009 - RNA, 18 nt, Salmonella enterica enterica serovar Typhi Ty2
aauuaugccugucaucau

SEQ ID NO: 3683010 - RNA, 20 nt, Salmonella enterica enterica serovar Typhi Ty2
aauuaugggauugcaaaaaa

SEQ ID NO: 3683011 - RNA, 15 nt, Salmonella enterica enterica serovar Typhi Ty2
aauuauuaaaucaau

SEQ ID NO: 3683012 - RNA, 14 nt, Salmonella enterica enterica serovar Typhi Ty2
aauuauuacagaca

SEQ ID NO: 3683013 - RNA, 14 nt, Salmonella enterica enterica serovar Typhi Ty2
aauuauuaccaaug

SEQ ID NO: 3683014 - RNA, 20 nt, Salmonella enterica enterica serovar Typhi Ty2
aauuauuuuuacuuaaaauu

SEQ ID NO: 3683015 - RNA, 12 nt, Salmonella enterica enterica serovar Typhi Ty2
aauuauuuuuca

SEQ ID NO: 3683016 - RNA, 18 nt, Salmonella enterica enterica serovar Typhi Ty2
aauuauuuuuucaugacu

SEQ ID NO: 3683017 - RNA, 12 nt, Salmonella enterica enterica serovar Typhi Ty2
aauucaaucacu

SEQ ID NO: 3683018 - RNA, 12 nt, Salmonella enterica enterica serovar Typhi Ty2
aauucaaugaga

SEQ ID NO: 3683019 - RNA, 15 nt, Salmonella enterica enterica serovar Typhi Ty2
aauucaccaaauccu

SEQ ID NO: 3683020 - RNA, 17 nt, Salmonella enterica enterica serovar Typhi Ty2
aauucaccaaauccuca

SEQ ID NO: 3683021 - RNA, 18 nt, Salmonella enterica enterica serovar Typhi Ty2
aauucacccguuauucau

SEQ ID NO: 3683022 - RNA, 19 nt, Salmonella enterica enterica serovar Typhi Ty2
aauucacccguuauucauu

SEQ ID NO: 3683023 - RNA, 18 nt, Salmonella enterica enterica serovar Typhi Ty2
aauucaccgcaugacaau

SEQ ID NO: 3683024 - RNA, 18 nt, Salmonella enterica enterica serovar Typhi Ty2
aauucacgcuucucuggc

SEQ ID NO: 3683025 - RNA, 22 nt, Salmonella enterica enterica serovar Typhi Ty2
aauucacguuccauuucagcga

SEQ ID NO: 3683026 - RNA, 23 nt, Salmonella enterica enterica serovar Typhi Ty2
aauucacuuccgucauguagcaa

SEQ ID NO: 3683027 - RNA, 21 nt, Salmonella enterica enterica serovar Typhi Ty2
aauucagaaaguuacuuucca

SEQ ID NO: 3683028 - RNA, 12 nt, Salmonella enterica enterica serovar Typhi Ty2
aauucagacuca

SEQ ID NO: 3683029 - RNA, 22 nt, Salmonella enterica enterica serovar Typhi Ty2
aauucagcauuaggcguaaaau

SEQ ID NO: 3683030 - RNA, 13 nt, Salmonella enterica enterica serovar Typhi Ty2
aauucagcgauau

SEQ ID NO: 3683031 - RNA, 19 nt, Salmonella enterica enterica serovar Typhi Ty2
aauucagcgucgagcaccu

SEQ ID NO: 3683032 - RNA, 15 nt, Salmonella enterica enterica serovar Typhi Ty2
aauucauaacaccaa

SEQ ID NO: 3683033 - RNA, 20 nt, Salmonella enterica enterica serovar Typhi Ty2
aauucauuacgaaguuuaau

SEQ ID NO: 3683034 - RNA, 15 nt, Salmonella enterica enterica serovar Typhi Ty2
aauuccaccaccucg

SEQ ID NO: 3683035 - RNA, 22 nt, Salmonella enterica enterica serovar Typhi Ty2
aauuccaggcccggugucagac

SEQ ID NO: 3683036 - RNA, 21 nt, Salmonella enterica enterica serovar Typhi Ty2
aauucccgccucggucaguau

SEQ ID NO: 3683037 - RNA, 21 nt, Salmonella enterica enterica serovar Typhi Ty2
aauuccgcaggagagccagaa

SEQ ID NO: 3683038 - RNA, 17 nt, Salmonella enterica enterica serovar Typhi Ty2
aauuccggcgaaaaacc

SEQ ID NO: 3683039 - RNA, 16 nt, Salmonella enterica enterica serovar Typhi Ty2
aauuccugacugcgcg

SEQ ID NO: 3683040 - RNA, 17 nt, Salmonella enterica enterica serovar Typhi Ty2
aauuccuuguuuuaacg

SEQ ID NO: 3683041 - RNA, 19 nt, Salmonella enterica enterica serovar Typhi Ty2
aauucgcguucagaaaugu

SEQ ID NO: 3683042 - RNA, 22 nt, Salmonella enterica enterica serovar Typhi Ty2
aauucguacguuuuuccauuca

SEQ ID NO: 3683043 - RNA, 18 nt, Salmonella enterica enterica serovar Typhi Ty2
aauucgucgccgccaaag

SEQ ID NO: 3683044 - RNA, 15 nt, Salmonella enterica enterica serovar Typhi Ty2
aauucuaugccaggc

SEQ ID NO: 3683045 - RNA, 16 nt, Salmonella enterica enterica serovar Typhi Ty2
aauucuaugccaggcg

SEQ ID NO: 3683046 - RNA, 22 nt, Salmonella enterica enterica serovar Typhi Ty2
aauucucacagaaucaucaggc

SEQ ID NO: 3683047 - RNA, 21 nt, Salmonella enterica enterica serovar Typhi Ty2
aauucugacgcagcuucugau

SEQ ID NO: 3683048 - RNA, 19 nt, Salmonella enterica enterica serovar Typhi Ty2
aauucugaucgauaaaagu

SEQ ID NO: 3683049 - RNA, 21 nt, Salmonella enterica enterica serovar Typhi Ty2
aauucuguaccaggacgcacc

SEQ ID NO: 3683050 - RNA, 23 nt, Salmonella enterica enterica serovar Typhi Ty2
aauucugucucaauaaaaugucu

SEQ ID NO: 3683051 - RNA, 19 nt, Salmonella enterica enterica serovar Typhi Ty2
aauucuuaacccacaagaa

SEQ ID NO: 3683052 - RNA, 14 nt, Salmonella enterica enterica serovar Typhi Ty2
aauugaauuauaau

SEQ ID NO: 3683053 - RNA, 17 nt, Salmonella enterica enterica serovar Typhi Ty2
aauugaauuauaauaaa

SEQ ID NO: 3683054 - RNA, 23 nt, Salmonella enterica enterica serovar Typhi Ty2
aauugaccguccccagccagaga

SEQ ID NO: 3683055 - RNA, 14 nt, Salmonella enterica enterica serovar Typhi Ty2
aauugacuggauuu

SEQ ID NO: 3683056 - RNA, 20 nt, Salmonella enterica enterica serovar Typhi Ty2
aauugacuggauuuuugacu

SEQ ID NO: 3683057 - RNA, 23 nt, Salmonella enterica enterica serovar Typhi Ty2
aauugacuggauuuuugacuaaa

SEQ ID NO: 3683058 - RNA, 21 nt, Salmonella enterica enterica serovar Typhi Ty2
aauugagcgcaaaacgcugcu

SEQ ID NO: 3683059 - RNA, 12 nt, Salmonella enterica enterica serovar Typhi Ty2
aauugaggccgu

SEQ ID NO: 3683060 - RNA, 18 nt, Salmonella enterica enterica serovar Typhi Ty2
aauugauaauaaccgucu

SEQ ID NO: 3683061 - RNA, 20 nt, Salmonella enterica enterica serovar Typhi Ty2
aauugcagggugcagcaaau

SEQ ID NO: 3683062 - RNA, 16 nt, Salmonella enterica enterica serovar Typhi Ty2
aauugccgucgccgga

SEQ ID NO: 3683063 - RNA, 11 nt, Salmonella enterica enterica serovar Typhi Ty2
aauugcgcauc

SEQ ID NO: 3683064 - RNA, 14 nt, Salmonella enterica enterica serovar Typhi Ty2
aauugcucugccag

SEQ ID NO: 3683065 - RNA, 16 nt, Salmonella enterica enterica serovar Typhi Ty2
aauuggaguuaucauu

SEQ ID NO: 3683066 - RNA, 13 nt, Salmonella enterica enterica serovar Typhi Ty2
aauugguagacgc

SEQ ID NO: 3683067 - RNA, 14 nt, Salmonella enterica enterica serovar Typhi Ty2
aauugguuauauua

SEQ ID NO: 3683068 - RNA, 16 nt, Salmonella enterica enterica serovar Typhi Ty2
aauugucagaaucaca

SEQ ID NO: 3683069 - RNA, 18 nt, Salmonella enterica enterica serovar Typhi Ty2
aauuguuacuuauagcug

SEQ ID NO: 3683070 - RNA, 17 nt, Salmonella enterica enterica serovar Typhi Ty2
aauuguuccuguaaagc

SEQ ID NO: 3683071 - RNA, 13 nt, Salmonella enterica enterica serovar Typhi Ty2
aauuuaaacaugu

SEQ ID NO: 3683072 - RNA, 12 nt, Salmonella enterica enterica serovar Typhi Ty2
aauuuaaacgga

SEQ ID NO: 3683073 - RNA, 18 nt, Salmonella enterica enterica serovar Typhi Ty2
aauuuaaccguuuuaccu

SEQ ID NO: 3683074 - RNA, 18 nt, Salmonella enterica enterica serovar Typhi Ty2
aauuuaagcuuaaugaua

SEQ ID NO: 3683075 - RNA, 19 nt, Salmonella enterica enterica serovar Typhi Ty2
aauuuaauauaugaaccaa

SEQ ID NO: 3683076 - RNA, 15 nt, Salmonella enterica enterica serovar Typhi Ty2
aauuuauaacguauc

SEQ ID NO: 3683077 - RNA, 14 nt, Salmonella enterica enterica serovar Typhi Ty2
aauuuaucaacaaa

SEQ ID NO: 3683078 - RNA, 14 nt, Salmonella enterica enterica serovar Typhi Ty2
aauuuaucagacaa

SEQ ID NO: 3683079 - RNA, 14 nt, Salmonella enterica enterica serovar Typhi Ty2
aauuuauccaguaa

SEQ ID NO: 3683080 - RNA, 13 nt, Salmonella enterica enterica serovar Typhi Ty2
aauuuaucugcgu

SEQ ID NO: 3683081 - RNA, 12 nt, Salmonella enterica enterica serovar Typhi Ty2
aauuuaugauuu

SEQ ID NO: 3683082 - RNA, 22 nt, Salmonella enterica enterica serovar Typhi Ty2
aauuuaugauuuuaacaucacc

SEQ ID NO: 3683083 - RNA, 20 nt, Salmonella enterica enterica serovar Typhi Ty2
aauuuauuacgaaguuuaau

SEQ ID NO: 3683084 - RNA, 16 nt, Salmonella enterica enterica serovar Typhi Ty2
aauuucacgcagcacg

SEQ ID NO: 3683085 - RNA, 17 nt, Salmonella enterica enterica serovar Typhi Ty2
aauuuccaguucaauca

SEQ ID NO: 3683086 - RNA, 19 nt, Salmonella enterica enterica serovar Typhi Ty2
aauuucccccacuucugac

SEQ ID NO: 3683087 - RNA, 20 nt, Salmonella enterica enterica serovar Typhi Ty2
aauuucccccacuucugaca

SEQ ID NO: 3683088 - RNA, 15 nt, Salmonella enterica enterica serovar Typhi Ty2
aauuuccgcagccag

SEQ ID NO: 3683089 - RNA, 18 nt, Salmonella enterica enterica serovar Typhi Ty2
aauuuccguagcgauaau

SEQ ID NO: 3683090 - RNA, 13 nt, Salmonella enterica enterica serovar Typhi Ty2
aauuucgcauaau

SEQ ID NO: 3683091 - RNA, 11 nt, Salmonella enterica enterica serovar Typhi Ty2
aauuugacgac

SEQ ID NO: 3683092 - RNA, 18 nt, Salmonella enterica enterica serovar Typhi Ty2
aauuugauuuauuuugaa

SEQ ID NO: 3683093 - RNA, 21 nt, Salmonella enterica enterica serovar Typhi Ty2
aauuugcuuucucgggccugu

SEQ ID NO: 3683094 - RNA, 17 nt, Salmonella enterica enterica serovar Typhi Ty2
aauuugucagacaugau

SEQ ID NO: 3683095 - RNA, 18 nt, Salmonella enterica enterica serovar Typhi Ty2
aauuugucguucacuugc

SEQ ID NO: 3683096 - RNA, 17 nt, Salmonella enterica enterica serovar Typhi Ty2
aauuuuaccauucagcu

SEQ ID NO: 3683097 - RNA, 12 nt, Salmonella enterica enterica serovar Typhi Ty2
aauuuucaacca

SEQ ID NO: 3683098 - RNA, 20 nt, Salmonella enterica enterica serovar Typhi Ty2
aauuuugauaagagaaaaua

SEQ ID NO: 3683099 - RNA, 19 nt, Salmonella enterica enterica serovar Typhi Ty2
aauuuugcaccaucaacgc

SEQ ID NO: 3683100 - RNA, 15 nt, Salmonella enterica enterica serovar Typhi Ty2
aauuuuugaucugcu

SEQ ID NO: 3683101 - RNA, 16 nt, Salmonella enterica enterica serovar Typhi Ty2
acaaaaaaaccgcuca

SEQ ID NO: 3683102 - RNA, 18 nt, Salmonella enterica enterica serovar Typhi Ty2
acaaaaaaacggccucaa

SEQ ID NO: 3683103 - RNA, 14 nt, Salmonella enterica enterica serovar Typhi Ty2
acaaaaccgcuaau

SEQ ID NO: 3683104 - RNA, 21 nt, Salmonella enterica enterica serovar Typhi Ty2
acaaaaccgcuaaugaggaaa

SEQ ID NO: 3683105 - RNA, 14 nt, Salmonella enterica enterica serovar Typhi Ty2
acaaaagaaagcaa

SEQ ID NO: 3683106 - RNA, 18 nt, Salmonella enterica enterica serovar Typhi Ty2
acaaaagaaagcaauagc

SEQ ID NO: 3683107 - RNA, 17 nt, Salmonella enterica enterica serovar Typhi Ty2
acaaaaggauacagcgc

SEQ ID NO: 3683108 - RNA, 23 nt, Salmonella enterica enterica serovar Typhi Ty2
acaaaaggcuggaacagauguuu

SEQ ID NO: 3683109 - RNA, 19 nt, Salmonella enterica enterica serovar Typhi Ty2
acaaaauaaagugaaauaa

SEQ ID NO: 3683110 - RNA, 14 nt, Salmonella enterica enterica serovar Typhi Ty2
acaaaaucauugcg

SEQ ID NO: 3683111 - RNA, 16 nt, Salmonella enterica enterica serovar Typhi Ty2
acaaaauucagacuca

SEQ ID NO: 3683112 - RNA, 16 nt, Salmonella enterica enterica serovar Typhi Ty2
acaaaauuuugcauaa

SEQ ID NO: 3683113 - RNA, 22 nt, Salmonella enterica enterica serovar Typhi Ty2
acaaaauuuugcauaaauaaug

SEQ ID NO: 3683114 - RNA, 12 nt, Salmonella enterica enterica serovar Typhi Ty2
acaaaauuuuuu

SEQ ID NO: 3683115 - RNA, 12 nt, Salmonella enterica enterica serovar Typhi Ty2
acaaacagcgcc

SEQ ID NO: 3683116 - RNA, 16 nt, Salmonella enterica enterica serovar Typhi Ty2
acaaacagugaaaaaa

SEQ ID NO: 3683117 - RNA, 16 nt, Salmonella enterica enterica serovar Typhi Ty2
acaaaccccacccacu

SEQ ID NO: 3683118 - RNA, 23 nt, Salmonella enterica enterica serovar Typhi Ty2
acaaaccgcgcgguuauaucucc

SEQ ID NO: 3683119 - RNA, 17 nt, Salmonella enterica enterica serovar Typhi Ty2
acaaacgccaggcgcug

SEQ ID NO: 3683120 - RNA, 22 nt, Salmonella enterica enterica serovar Typhi Ty2
acaaacucacguuccccagcac

SEQ ID NO: 3683121 - RNA, 16 nt, Salmonella enterica enterica serovar Typhi Ty2
acaaagaauucuucug

SEQ ID NO: 3683122 - RNA, 14 nt, Salmonella enterica enterica serovar Typhi Ty2
agaaucucugacag

SEQ ID NO: 3683123 - RNA, 14 nt, Salmonella enterica enterica serovar Typhi Ty2
agaaucuguuucag

SEQ ID NO: 3683124 - RNA, 15 nt, Salmonella enterica enterica serovar Typhi Ty2
agaaugcccagcaag

SEQ ID NO: 3683125 - RNA, 13 nt, Salmonella enterica enterica serovar Typhi Ty2
agaaugcccugcu

SEQ ID NO: 3683126 - RNA, 23 nt, Salmonella enterica enterica serovar Typhi Ty2
agaaugccgcccauccagagcag

SEQ ID NO: 3683127 - RNA, 18 nt, Salmonella enterica enterica serovar Typhi Ty2
agaaugcgagcaaaaccc

SEQ ID NO: 3683128 - RNA, 15 nt, Salmonella enterica enterica serovar Typhi Ty2
agaaugcuccauugc

SEQ ID NO: 3683129 - RNA, 16 nt, Salmonella enterica enterica serovar Typhi Ty2
agaauggccagcacaa

SEQ ID NO: 3683130 - RNA, 22 nt, Salmonella enterica enterica serovar Typhi Ty2
agaauggccagcacaauaacga

SEQ ID NO: 3683131 - RNA, 18 nt, Salmonella enterica enterica serovar Typhi Ty2
agaauguccaucucuuua

SEQ ID NO: 3683132 - RNA, 14 nt, Salmonella enterica enterica serovar Typhi Ty2
agaauguccccaua

SEQ ID NO: 3683133 - RNA, 14 nt, Salmonella enterica enterica serovar Typhi Ty2
agaaugucgccaua

SEQ ID NO: 3683134 - RNA, 17 nt, Salmonella enterica enterica serovar Typhi Ty2
agaauguguucucccug

SEQ ID NO: 3683135 - RNA, 20 nt, Salmonella enterica enterica serovar Typhi Ty2
agaauuauuaucaauuucau

SEQ ID NO: 3683136 - RNA, 14 nt, Salmonella enterica enterica serovar Typhi Ty2
agaauuauuucagg

SEQ ID NO: 3683137 - RNA, 12 nt, Salmonella enterica enterica serovar Typhi Ty2
agaauuuaucgc

SEQ ID NO: 3683138 - RNA, 16 nt, Salmonella enterica enterica serovar Typhi Ty2
agaauuugaacucuuu

SEQ ID NO: 3683139 - RNA, 23 nt, Salmonella enterica enterica serovar Typhi Ty2
agaauuuucacuuauaaauaaag

SEQ ID NO: 3683140 - RNA, 15 nt, Salmonella enterica enterica serovar Typhi Ty2
agacaaaauucagac

SEQ ID NO: 3683141 - RNA, 11 nt, Salmonella enterica enterica serovar Typhi Ty2
agacaaacagc

SEQ ID NO: 3683142 - RNA, 15 nt, Salmonella enterica enterica serovar Typhi Ty2
agacaaaguugacuu

SEQ ID NO: 3683143 - RNA, 11 nt, Salmonella enterica enterica serovar Typhi Ty2
agacaaauaac

SEQ ID NO: 3683144 - RNA, 10 nt, Salmonella enterica enterica serovar Typhi Ty2
agacaacauc

SEQ ID NO: 3683145 - RNA, 17 nt, Salmonella enterica enterica serovar Typhi Ty2
agacaagcaguucugaa

SEQ ID NO: 3683146 - RNA, 21 nt, Salmonella enterica enterica serovar Typhi Ty2
agacaaugcugacacugauau

SEQ ID NO: 3683147 - RNA, 22 nt, Salmonella enterica enterica serovar Typhi Ty2
agacaauugcugcguaacugcc

SEQ ID NO: 3683148 - RNA, 21 nt, Salmonella enterica enterica serovar Typhi Ty2
agacacaacgugccagaaaca

SEQ ID NO: 3683149 - RNA, 18 nt, Salmonella enterica enterica serovar Typhi Ty2
agacacaauauugcugug

SEQ ID NO: 3683150 - RNA, 14 nt, Salmonella enterica enterica serovar Typhi Ty2
agacaccccagccu

SEQ ID NO: 3683151 - RNA, 15 nt, Salmonella enterica enterica serovar Typhi Ty2
agacaccccagccua

SEQ ID NO: 3683152 - RNA, 13 nt, Salmonella enterica enterica serovar Typhi Ty2
agacacugcacca

SEQ ID NO: 3683153 - RNA, 11 nt, Salmonella enterica enterica serovar Typhi Ty2
agacagaacag

SEQ ID NO: 3683154 - RNA, 24 nt, Salmonella enterica enterica serovar Typhi Ty2
agacagaaucaggccauuaccgcc

SEQ ID NO: 3683155 - RNA, 16 nt, Salmonella enterica enterica serovar Typhi Ty2
agacagauaacaccag

SEQ ID NO: 3683156 - RNA, 16 nt, Salmonella enterica enterica serovar Typhi Ty2
agacagcauuuuucac

SEQ ID NO: 3683157 - RNA, 19 nt, Salmonella enterica enterica serovar Typhi Ty2
agacagcccuauaacagcg

SEQ ID NO: 3683158 - RNA, 16 nt, Salmonella enterica enterica serovar Typhi Ty2
agacagccgacggcaa

SEQ ID NO: 3683159 - RNA, 17 nt, Salmonella enterica enterica serovar Typhi Ty2
agacagccucucccgaa

SEQ ID NO: 3683160 - RNA, 14 nt, Salmonella enterica enterica serovar Typhi Ty2
agacaggacgccag

SEQ ID NO: 3683161 - RNA, 17 nt, Salmonella enterica enterica serovar Typhi Ty2
agacaggccagaauuca

SEQ ID NO: 3683162 - RNA, 19 nt, Salmonella enterica enterica serovar Typhi Ty2
agacaguacggaugaugua

SEQ ID NO: 3683163 - RNA, 22 nt, Salmonella enterica enterica serovar Typhi Ty2
agacaguguucccugcgcugga

SEQ ID NO: 3683164 - RNA, 21 nt, Salmonella enterica enterica serovar Typhi Ty2
agacauauacucuucgccauu

SEQ ID NO: 3683165 - RNA, 14 nt, Salmonella enterica enterica serovar Typhi Ty2
agacauccagcauu

SEQ ID NO: 3683166 - RNA, 21 nt, Salmonella enterica enterica serovar Typhi Ty2
agacauccccgccgagaaaau

SEQ ID NO: 3683167 - RNA, 12 nt, Salmonella enterica enterica serovar Typhi Ty2
agacaugaccgc

SEQ ID NO: 3683168 - RNA, 15 nt, Salmonella enterica enterica serovar Typhi Ty2
agacaugaucuuacc

SEQ ID NO: 3683169 - RNA, 19 nt, Salmonella enterica enterica serovar Typhi Ty2
agacaugccgccagaccaa

SEQ ID NO: 3683170 - RNA, 19 nt, Salmonella enterica enterica serovar Typhi Ty2
agacauucgcgcacggcgc

SEQ ID NO: 3683171 - RNA, 14 nt, Salmonella enterica enterica serovar Typhi Ty2
agacauucggaaug

SEQ ID NO: 3683172 - RNA, 12 nt, Salmonella enterica enterica serovar Typhi Ty2
agaccaauaaaa

SEQ ID NO: 3683173 - RNA, 23 nt, Salmonella enterica enterica serovar Typhi Ty2
agaccaauaagucccaucgagcc

SEQ ID NO: 3683174 - RNA, 12 nt, Salmonella enterica enterica serovar Typhi Ty2
agaccaauacga

SEQ ID NO: 3683175 - RNA, 15 nt, Salmonella enterica enterica serovar Typhi Ty2
agaccacgaaucagg

SEQ ID NO: 3683176 - RNA, 23 nt, Salmonella enterica enterica serovar Typhi Ty2
agaccacgaaucaggauauucgc

SEQ ID NO: 3683177 - RNA, 18 nt, Salmonella enterica enterica serovar Typhi Ty2
agaccagaaucccacgga

SEQ ID NO: 3683178 - RNA, 21 nt, Salmonella enterica enterica serovar Typhi Ty2
agaccagauuaaucagcagau

SEQ ID NO: 3683179 - RNA, 15 nt, Salmonella enterica enterica serovar Typhi Ty2
agaccaucaacagcg

SEQ ID NO: 3683180 - RNA, 23 nt, Salmonella enterica enterica serovar Typhi Ty2
agacccacauauugcgcuucacu

SEQ ID NO: 3683181 - RNA, 21 nt, Salmonella enterica enterica serovar Typhi Ty2
agacccgcaauaacgccgaua

SEQ ID NO: 3683182 - RNA, 17 nt, Salmonella enterica enterica serovar Typhi Ty2
agaccgacaucgccagu

SEQ ID NO: 3683183 - RNA, 14 nt, Salmonella enterica enterica serovar Typhi Ty2
agaccgacgccaac

SEQ ID NO: 3683184 - RNA, 13 nt, Salmonella enterica enterica serovar Typhi Ty2
agaccgauaaaua

SEQ ID NO: 3683185 - RNA, 18 nt, Salmonella enterica enterica serovar Typhi Ty2
agaccgccuaacagcgcc

SEQ ID NO: 3683186 - RNA, 18 nt, Salmonella enterica enterica serovar Typhi Ty2
agaccggaugauggccug

SEQ ID NO: 3683187 - RNA, 12 nt, Salmonella enterica enterica serovar Typhi Ty2
agaccggcacaa

SEQ ID NO: 3683188 - RNA, 18 nt, Salmonella enterica enterica serovar Typhi Ty2
agaccggcaucucaucuu

SEQ ID NO: 3683189 - RNA, 20 nt, Salmonella enterica enterica serovar Typhi Ty2
agaccggcgaaaucgugcgc

SEQ ID NO: 3683190 - RNA, 22 nt, Salmonella enterica enterica serovar Typhi Ty2
agaccuccgcccggugcucaau

SEQ ID NO: 3683191 - RNA, 18 nt, Salmonella enterica enterica serovar Typhi Ty2
agaccucugcuuugguuu

SEQ ID NO: 3683192 - RNA, 17 nt, Salmonella enterica enterica serovar Typhi Ty2
agaccuguaaaaaaacc

SEQ ID NO: 3683193 - RNA, 22 nt, Salmonella enterica enterica serovar Typhi Ty2
agacgaccauccaccagaaccu

SEQ ID NO: 3683194 - RNA, 18 nt, Salmonella enterica enterica serovar Typhi Ty2
agacgacgguuaaaaagu

SEQ ID NO: 3683195 - RNA, 15 nt, Salmonella enterica enterica serovar Typhi Ty2
agacgaugaauuccu

SEQ ID NO: 3683196 - RNA, 21 nt, Salmonella enterica enterica serovar Typhi Ty2
agacgcaguagcgcuuugaca

SEQ ID NO: 3683197 - RNA, 22 nt, Salmonella enterica enterica serovar Typhi Ty2
agacgccaacgucgacagacgc

SEQ ID NO: 3683198 - RNA, 18 nt, Salmonella enterica enterica serovar Typhi Ty2
agacgcccugcaaagcaa

SEQ ID NO: 3683199 - RNA, 16 nt, Salmonella enterica enterica serovar Typhi Ty2
agacgccgccgcaucc

SEQ ID NO: 3683200 - RNA, 17 nt, Salmonella enterica enterica serovar Typhi Ty2
agacgccgcgcugcggc

SEQ ID NO: 3683201 - RNA, 17 nt, Salmonella enterica enterica serovar Typhi Ty2
agacgccugggcauuug

SEQ ID NO: 3683202 - RNA, 18 nt, Salmonella enterica enterica serovar Typhi Ty2
agacgcgcuagcuucagg

SEQ ID NO: 3683203 - RNA, 16 nt, Salmonella enterica enterica serovar Typhi Ty2
agacgcguaaaucaga

SEQ ID NO: 3683204 - RNA, 20 nt, Salmonella enterica enterica serovar Typhi Ty2
agcaugaucauacugccgcc

SEQ ID NO: 3683205 - RNA, 14 nt, Salmonella enterica enterica serovar Typhi Ty2
agcaugcccgccag

SEQ ID NO: 3683206 - RNA, 16 nt, Salmonella enterica enterica serovar Typhi Ty2
agcaugggcuaaagca

SEQ ID NO: 3683207 - RNA, 13 nt, Salmonella enterica enterica serovar Typhi Ty2
agcauuauuuuua

SEQ ID NO: 3683208 - RNA, 15 nt, Salmonella enterica enterica serovar Typhi Ty2
agcauuauuuuuaac

SEQ ID NO: 3683209 - RNA, 19 nt, Salmonella enterica enterica serovar Typhi Ty2
agcauuauuuuuaaccgcc

SEQ ID NO: 3683210 - RNA, 14 nt, Salmonella enterica enterica serovar Typhi Ty2
agcauucuauuguu

SEQ ID NO: 3683211 - RNA, 23 nt, Salmonella enterica enterica serovar Typhi Ty2
agcauugccgucaaacgcuauca

SEQ ID NO: 3683212 - RNA, 18 nt, Salmonella enterica enterica serovar Typhi Ty2
agcauuggaaauucaggg

SEQ ID NO: 3683213 - RNA, 18 nt, Salmonella enterica enterica serovar Typhi Ty2
agcauuuccgcagccaac

SEQ ID NO: 3683214 - RNA, 12 nt, Salmonella enterica enterica serovar Typhi Ty2
agcauuuguagc

SEQ ID NO: 3683215 - RNA, 17 nt, Salmonella enterica enterica serovar Typhi Ty2
agcauuuuaagaaaauu

SEQ ID NO: 3683216 - RNA, 16 nt, Salmonella enterica enterica serovar Typhi Ty2
agccaaacaauauccc

SEQ ID NO: 3683217 - RNA, 12 nt, Salmonella enterica enterica serovar Typhi Ty2
agccaaacacuu

SEQ ID NO: 3683218 - RNA, 15 nt, Salmonella enterica enterica serovar Typhi Ty2
agccaaacacuuccc

SEQ ID NO: 3683219 - RNA, 19 nt, Salmonella enterica enterica serovar Typhi Ty2
agccaaacacuuccccugc

SEQ ID NO: 3683220 - RNA, 18 nt, Salmonella enterica enterica serovar Typhi Ty2
agccaaacuccucacugc

SEQ ID NO: 3683221 - RNA, 19 nt, Salmonella enterica enterica serovar Typhi Ty2
agccaaacucugaaaaaau

SEQ ID NO: 3683222 - RNA, 23 nt, Salmonella enterica enterica serovar Typhi Ty2
agccaaagauuagccccagcgcc

SEQ ID NO: 3683223 - RNA, 19 nt, Salmonella enterica enterica serovar Typhi Ty2
agccaaagcgagguaaaaa

SEQ ID NO: 3683224 - RNA, 19 nt, Salmonella enterica enterica serovar Typhi Ty2
agccaaauagcgccagaca

SEQ ID NO: 3683225 - RNA, 15 nt, Salmonella enterica enterica serovar Typhi Ty2
agccaacacauaagc

SEQ ID NO: 3683226 - RNA, 13 nt, Salmonella enterica enterica serovar Typhi Ty2
agccaacccacgc

SEQ ID NO: 3683227 - RNA, 20 nt, Salmonella enterica enterica serovar Typhi Ty2
agccaacguauaaaauggca

SEQ ID NO: 3683228 - RNA, 12 nt, Salmonella enterica enterica serovar Typhi Ty2
agccaauaauca

SEQ ID NO: 3683229 - RNA, 17 nt, Salmonella enterica enterica serovar Typhi Ty2
agccaauccagaauacc

SEQ ID NO: 3683230 - RNA, 17 nt, Salmonella enterica enterica serovar Typhi Ty2
agccacaagagcagcaa

SEQ ID NO: 3683231 - RNA, 16 nt, Salmonella enterica enterica serovar Typhi Ty2
agccacaaucugauaa

SEQ ID NO: 3683232 - RNA, 21 nt, Salmonella enterica enterica serovar Typhi Ty2
agccacacgacgguauuggua

SEQ ID NO: 3683233 - RNA, 22 nt, Salmonella enterica enterica serovar Typhi Ty2
agccacacugcaucgaaaucuc

SEQ ID NO: 3683234 - RNA, 23 nt, Salmonella enterica enterica serovar Typhi Ty2
agccacagcgguuagcggcaugu

SEQ ID NO: 3683235 - RNA, 22 nt, Salmonella enterica enterica serovar Typhi Ty2
agccacaugccuucuuuggugc

SEQ ID NO: 3683236 - RNA, 14 nt, Salmonella enterica enterica serovar Typhi Ty2
agccacccacggca

SEQ ID NO: 3683237 - RNA, 17 nt, Salmonella enterica enterica serovar Typhi Ty2
agccacccacugacgaa

SEQ ID NO: 3683238 - RNA, 15 nt, Salmonella enterica enterica serovar Typhi Ty2
agccaccccauuaau

SEQ ID NO: 3683239 - RNA, 15 nt, Salmonella enterica enterica serovar Typhi Ty2
agccacgcaagcagc

SEQ ID NO: 3683240 - RNA, 19 nt, Salmonella enterica enterica serovar Typhi Ty2
agccacgcccgccgccuga

SEQ ID NO: 3683241 - RNA, 17 nt, Salmonella enterica enterica serovar Typhi Ty2
agccacggcaacgccgu

SEQ ID NO: 3683242 - RNA, 13 nt, Salmonella enterica enterica serovar Typhi Ty2
agccacuauccag

SEQ ID NO: 3683243 - RNA, 18 nt, Salmonella enterica enterica serovar Typhi Ty2
agccacugcgccauuaac

SEQ ID NO: 3683244 - RNA, 19 nt, Salmonella enterica enterica serovar Typhi Ty2
agccacugcgccauuaacg

SEQ ID NO: 3683245 - RNA, 11 nt, Salmonella enterica enterica serovar Typhi Ty2
agccacuggcu

SEQ ID NO: 3683246 - RNA, 18 nt, Salmonella enterica enterica serovar Typhi Ty2
agccacuucaugcgcuuu

SEQ ID NO: 3683247 - RNA, 21 nt, Salmonella enterica enterica serovar Typhi Ty2
agccacuucuuccagcggcag

SEQ ID NO: 3683248 - RNA, 13 nt, Salmonella enterica enterica serovar Typhi Ty2
agccagaacagaa

SEQ ID NO: 3683249 - RNA, 15 nt, Salmonella enterica enterica serovar Typhi Ty2
agccagaacagaagu

SEQ ID NO: 3683250 - RNA, 23 nt, Salmonella enterica enterica serovar Typhi Ty2
agccagaaucagccgacggcgau

SEQ ID NO: 3683251 - RNA, 13 nt, Salmonella enterica enterica serovar Typhi Ty2
agccagacgccag

SEQ ID NO: 3683252 - RNA, 14 nt, Salmonella enterica enterica serovar Typhi Ty2
agccagacgcgcag

SEQ ID NO: 3683253 - RNA, 16 nt, Salmonella enterica enterica serovar Typhi Ty2
agccagacgcgcagca

SEQ ID NO: 3683254 - RNA, 22 nt, Salmonella enterica enterica serovar Typhi Ty2
agccagacgcuccgcaguaauc

SEQ ID NO: 3683255 - RNA, 23 nt, Salmonella enterica enterica serovar Typhi Ty2
agccagacgcuccgcaguaauca

SEQ ID NO: 3683256 - RNA, 20 nt, Salmonella enterica enterica serovar Typhi Ty2
agccagacgguuaagccggu

SEQ ID NO: 3683257 - RNA, 21 nt, Salmonella enterica enterica serovar Typhi Ty2
agccagauggauaaccugccg

SEQ ID NO: 3683258 - RNA, 14 nt, Salmonella enterica enterica serovar Typhi Ty2
agccagauggcugc

SEQ ID NO: 3683259 - RNA, 21 nt, Salmonella enterica enterica serovar Typhi Ty2
agccagauguaaucugacaga

SEQ ID NO: 3683260 - RNA, 13 nt, Salmonella enterica enterica serovar Typhi Ty2
agccagcagcuca

SEQ ID NO: 3683261 - RNA, 18 nt, Salmonella enterica enterica serovar Typhi Ty2
agccagcaucaugggcuc

SEQ ID NO: 3683262 - RNA, 16 nt, Salmonella enterica enterica serovar Typhi Ty2
agccagcauuuccagc

SEQ ID NO: 3683263 - RNA, 18 nt, Salmonella enterica enterica serovar Typhi Ty2
agccagcauuuccagcug

SEQ ID NO: 3683264 - RNA, 21 nt, Salmonella enterica enterica serovar Typhi Ty2
agccagccaaauagcgccaga

SEQ ID NO: 3683265 - RNA, 19 nt, Salmonella enterica enterica serovar Typhi Ty2
agccagccgccaaaaauau

SEQ ID NO: 3683266 - RNA, 15 nt, Salmonella enterica enterica serovar Typhi Ty2
agccagcgccccugc

SEQ ID NO: 3683267 - RNA, 20 nt, Salmonella enterica enterica serovar Typhi Ty2
agccagcguaaauagcccgg

SEQ ID NO: 3683268 - RNA, 23 nt, Salmonella enterica enterica serovar Typhi Ty2
agccagcguaaauagcccggauc

SEQ ID NO: 3683269 - RNA, 15 nt, Salmonella enterica enterica serovar Typhi Ty2
agccaggcaaagccc

SEQ ID NO: 3683270 - RNA, 14 nt, Salmonella enterica enterica serovar Typhi Ty2
agccaggcaccauc

SEQ ID NO: 3683271 - RNA, 15 nt, Salmonella enterica enterica serovar Typhi Ty2
agccaggccagcgcu

SEQ ID NO: 3683272 - RNA, 20 nt, Salmonella enterica enterica serovar Typhi Ty2
agccaggccgccagcaacgu

SEQ ID NO: 3683273 - RNA, 19 nt, Salmonella enterica enterica serovar Typhi Ty2
agccaggcuuuaaauucag

SEQ ID NO: 3683274 - RNA, 16 nt, Salmonella enterica enterica serovar Typhi Ty2
agccagguugccagaa

SEQ ID NO: 3683275 - RNA, 20 nt, Salmonella enterica enterica serovar Typhi Ty2
agccagguugccagaaacaa

SEQ ID NO: 3683276 - RNA, 13 nt, Salmonella enterica enterica serovar Typhi Ty2
agccagguugcgc

SEQ ID NO: 3683277 - RNA, 15 nt, Salmonella enterica enterica serovar Typhi Ty2
agccagguuuugcuc

SEQ ID NO: 3683278 - RNA, 16 nt, Salmonella enterica enterica serovar Typhi Ty2
agccaguagcugguga

SEQ ID NO: 3683279 - RNA, 19 nt, Salmonella enterica enterica serovar Typhi Ty2
agccaguagcuggugacuu

SEQ ID NO: 3683280 - RNA, 17 nt, Salmonella enterica enterica serovar Typhi Ty2
agccaguccugccacca

SEQ ID NO: 3683281 - RNA, 14 nt, Salmonella enterica enterica serovar Typhi Ty2
agccagucgccagg

SEQ ID NO: 3683282 - RNA, 17 nt, Salmonella enterica enterica serovar Typhi Ty2
agccagucgccaggcaa

SEQ ID NO: 3683283 - RNA, 20 nt, Salmonella enterica enterica serovar Typhi Ty2
agccagugggcgucaaaauc

SEQ ID NO: 3683284 - RNA, 22 nt, Salmonella enterica enterica serovar Typhi Ty2
agccaguucgccuucuucaucu

SEQ ID NO: 3683285 - RNA, 13 nt, Salmonella enterica enterica serovar Typhi Ty2
agccaguucucaa

SEQ ID NO: 3683286 - RNA, 16 nt, Salmonella enterica enterica serovar Typhi Ty2
agccaguucucuucuu

SEQ ID NO: 3683287 - RNA, 22 nt, Salmonella enterica enterica serovar Typhi Ty2
agccaguuguucgauaaccugu

SEQ ID NO: 3683288 - RNA, 19 nt, Salmonella enterica enterica serovar Typhi Ty2
agccauaaugcaaucaguu

SEQ ID NO: 3683289 - RNA, 20 nt, Salmonella enterica enterica serovar Typhi Ty2
agccauacauugaguaaaua

SEQ ID NO: 3683290 - RNA, 15 nt, Salmonella enterica enterica serovar Typhi Ty2
agccauagcagcaaa

SEQ ID NO: 3683291 - RNA, 14 nt, Salmonella enterica enterica serovar Typhi Ty2
agccaucaauccau

SEQ ID NO: 3683292 - RNA, 15 nt, Salmonella enterica enterica serovar Typhi Ty2
agccaucauuaccaa

SEQ ID NO: 3683293 - RNA, 21 nt, Salmonella enterica enterica serovar Typhi Ty2
agccaucccgcugaucgccgg

SEQ ID NO: 3683294 - RNA, 18 nt, Salmonella enterica enterica serovar Typhi Ty2
agccauccucacgcaacc

SEQ ID NO: 3683295 - RNA, 17 nt, Salmonella enterica enterica serovar Typhi Ty2
agccaucuucugcguca

SEQ ID NO: 3683296 - RNA, 19 nt, Salmonella enterica enterica serovar Typhi Ty2
agccaugcauaaugcagcc

SEQ ID NO: 3683297 - RNA, 15 nt, Salmonella enterica enterica serovar Typhi Ty2
agccaugccagcagu

SEQ ID NO: 3683298 - RNA, 17 nt, Salmonella enterica enterica serovar Typhi Ty2
agccaugccagcaguuu

SEQ ID NO: 3683299 - RNA, 15 nt, Salmonella enterica enterica serovar Typhi Ty2
agccaugccauugcu

SEQ ID NO: 3683300 - RNA, 22 nt, Salmonella enterica enterica serovar Typhi Ty2
agccaugcuauucagcaguuca

SEQ ID NO: 3683301 - RNA, 19 nt, Salmonella enterica enterica serovar Typhi Ty2
agccauguagaauagcgcc

SEQ ID NO: 3683302 - RNA, 14 nt, Salmonella enterica enterica serovar Typhi Ty2
agccauuaaagaag

SEQ ID NO: 3683303 - RNA, 14 nt, Salmonella enterica enterica serovar Typhi Ty2
agccauuaaccaga

SEQ ID NO: 3683304 - RNA, 16 nt, Salmonella enterica enterica serovar Typhi Ty2
agccauuaaugcaggc

SEQ ID NO: 3683305 - RNA, 18 nt, Salmonella enterica enterica serovar Typhi Ty2
agccauucauuaaaauug

SEQ ID NO: 3683306 - RNA, 15 nt, Salmonella enterica enterica serovar Typhi Ty2
agccauuuuaaaaau

SEQ ID NO: 3683307 - RNA, 17 nt, Salmonella enterica enterica serovar Typhi Ty2
agccauuuuaaaaauau

SEQ ID NO: 3683308 - RNA, 15 nt, Salmonella enterica enterica serovar Typhi Ty2
agcccaauacgccag

SEQ ID NO: 3683309 - RNA, 19 nt, Salmonella enterica enterica serovar Typhi Ty2
agcccaauacgccagccua

SEQ ID NO: 3683310 - RNA, 16 nt, Salmonella enterica enterica serovar Typhi Ty2
agcccaauaucccuau

SEQ ID NO: 3683311 - RNA, 14 nt, Salmonella enterica enterica serovar Typhi Ty2
agcccacacaucac

SEQ ID NO: 3683312 - RNA, 18 nt, Salmonella enterica enterica serovar Typhi Ty2
agcccacgcccugcaaug

SEQ ID NO: 3683313 - RNA, 14 nt, Salmonella enterica enterica serovar Typhi Ty2
agcccagcacggca

SEQ ID NO: 3683314 - RNA, 12 nt, Salmonella enterica enterica serovar Typhi Ty2
agcccagcgccg

SEQ ID NO: 3683315 - RNA, 14 nt, Salmonella enterica enterica serovar Typhi Ty2
agcccagcgccgca

SEQ ID NO: 3683316 - RNA, 12 nt, Salmonella enterica enterica serovar Typhi Ty2
agcccagcucag

SEQ ID NO: 3683317 - RNA, 17 nt, Salmonella enterica enterica serovar Typhi Ty2
agcccagcucauaggau

SEQ ID NO: 3683318 - RNA, 20 nt, Salmonella enterica enterica serovar Typhi Ty2
agcccaguaauauccccauc

SEQ ID NO: 3683319 - RNA, 21 nt, Salmonella enterica enterica serovar Typhi Ty2
agcccauaaagcacuggugga

SEQ ID NO: 3683320 - RNA, 16 nt, Salmonella enterica enterica serovar Typhi Ty2
agcccaucaccgccag

SEQ ID NO: 3683321 - RNA, 17 nt, Salmonella enterica enterica serovar Typhi Ty2
agcccaugauggugaac

SEQ ID NO: 3683322 - RNA, 20 nt, Salmonella enterica enterica serovar Typhi Ty2
agcccaugauggugaacaga

SEQ ID NO: 3683323 - RNA, 23 nt, Salmonella enterica enterica serovar Typhi Ty2
agcccaugauggugaacagaauc

SEQ ID NO: 3683324 - RNA, 14 nt, Salmonella enterica enterica serovar Typhi Ty2
agcccauggcaggc

SEQ ID NO: 3683325 - RNA, 12 nt, Salmonella enterica enterica serovar Typhi Ty2
agccccacgccc

SEQ ID NO: 3683326 - RNA, 13 nt, Salmonella enterica enterica serovar Typhi Ty2
agccccagcacca

SEQ ID NO: 3683327 - RNA, 13 nt, Salmonella enterica enterica serovar Typhi Ty2
agccccagcgcca

SEQ ID NO: 3683328 - RNA, 14 nt, Salmonella enterica enterica serovar Typhi Ty2
agccccaggccggu

SEQ ID NO: 3683329 - RNA, 21 nt, Salmonella enterica enterica serovar Typhi Ty2
agccccauaaccgaugcacau

SEQ ID NO: 3683330 - RNA, 23 nt, Salmonella enterica enterica serovar Typhi Ty2
agccccccgcacagcacauagaa

SEQ ID NO: 3683331 - RNA, 18 nt, Salmonella enterica enterica serovar Typhi Ty2
agccccuucgcuguccau

SEQ ID NO: 3683332 - RNA, 14 nt, Salmonella enterica enterica serovar Typhi Ty2
agcccgccagcacc

SEQ ID NO: 3683333 - RNA, 16 nt, Salmonella enterica enterica serovar Typhi Ty2
agcccgcccagcauua

SEQ ID NO: 3683334 - RNA, 17 nt, Salmonella enterica enterica serovar Typhi Ty2
agcccgcccagcauuac

SEQ ID NO: 3683335 - RNA, 21 nt, Salmonella enterica enterica serovar Typhi Ty2
agcccgccuccaccuuaucaa

SEQ ID NO: 3683336 - RNA, 20 nt, Salmonella enterica enterica serovar Typhi Ty2
agcccgcuucacgcgcggcu

SEQ ID NO: 3683337 - RNA, 21 nt, Salmonella enterica enterica serovar Typhi Ty2
agcccggaaauaaacgccagu

SEQ ID NO: 3683338 - RNA, 21 nt, Salmonella enterica enterica serovar Typhi Ty2
agcccggcauguccaucagau

SEQ ID NO: 3683339 - RNA, 18 nt, Salmonella enterica enterica serovar Typhi Ty2
agcccggcggaggccauu

SEQ ID NO: 3683340 - RNA, 21 nt, Salmonella enterica enterica serovar Typhi Ty2
agcccguccagauaaugauca

SEQ ID NO: 3683341 - RNA, 14 nt, Salmonella enterica enterica serovar Typhi Ty2
agcccgucccuucc

SEQ ID NO: 3683342 - RNA, 21 nt, Salmonella enterica enterica serovar Typhi Ty2
agcccuauuaggcacuaccac

SEQ ID NO: 3683343 - RNA, 13 nt, Salmonella enterica enterica serovar Typhi Ty2
agcccucuggcaa

SEQ ID NO: 3683344 - RNA, 23 nt, Salmonella enterica enterica serovar Typhi Ty2
agcccuuugagaaaacugcgccc

SEQ ID NO: 3683345 - RNA, 21 nt, Salmonella enterica enterica serovar Typhi Ty2
agccgaaacuuauacugauaa

SEQ ID NO: 3683346 - RNA, 14 nt, Salmonella enterica enterica serovar Typhi Ty2
agccgaccaccauc

SEQ ID NO: 3683347 - RNA, 21 nt, Salmonella enterica enterica serovar Typhi Ty2
agccgaccaucgcgccgcugg

SEQ ID NO: 3683348 - RNA, 13 nt, Salmonella enterica enterica serovar Typhi Ty2
agccgaccgccga

SEQ ID NO: 3683349 - RNA, 21 nt, Salmonella enterica enterica serovar Typhi Ty2
agccgaccuggcggucggcuu

SEQ ID NO: 3683350 - RNA, 13 nt, Salmonella enterica enterica serovar Typhi Ty2
agccgacgcucuu

SEQ ID NO: 3683351 - RNA, 16 nt, Salmonella enterica enterica serovar Typhi Ty2
agccgacuaucuucuu

SEQ ID NO: 3683352 - RNA, 15 nt, Salmonella enterica enterica serovar Typhi Ty2
agccgacuauuccgc

SEQ ID NO: 3683353 - RNA, 22 nt, Salmonella enterica enterica serovar Typhi Ty2
agccgaggcuuaauacggcaac

SEQ ID NO: 3683354 - RNA, 22 nt, Salmonella enterica enterica serovar Typhi Ty2
agccgauuuuucggcacgcugg

SEQ ID NO: 3683355 - RNA, 19 nt, Salmonella enterica enterica serovar Typhi Ty2
agccgcagaaccauuuccu

SEQ ID NO: 3683356 - RNA, 15 nt, Salmonella enterica enterica serovar Typhi Ty2
agccgccaccacaaa

SEQ ID NO: 3683357 - RNA, 20 nt, Salmonella enterica enterica serovar Typhi Ty2
agccgccaggcaaucagcag

SEQ ID NO: 3683358 - RNA, 21 nt, Salmonella enterica enterica serovar Typhi Ty2
agccgccauccggcacaguau

SEQ ID NO: 3683359 - RNA, 13 nt, Salmonella enterica enterica serovar Typhi Ty2
agccgccauuaau

SEQ ID NO: 3683360 - RNA, 14 nt, Salmonella enterica enterica serovar Typhi Ty2
agccgcccacaacc

SEQ ID NO: 3683361 - RNA, 18 nt, Salmonella enterica enterica serovar Typhi Ty2
agccgcccaucccuaaua

SEQ ID NO: 3683362 - RNA, 16 nt, Salmonella enterica enterica serovar Typhi Ty2
agccgcgcauagcugg

SEQ ID NO: 3683363 - RNA, 20 nt, Salmonella enterica enterica serovar Typhi Ty2
agccgcgccaucuccuccuc

SEQ ID NO: 3683364 - RNA, 21 nt, Salmonella enterica enterica serovar Typhi Ty2
agccgcgccguaacgcgaugc

SEQ ID NO: 3683365 - RNA, 11 nt, Salmonella enterica enterica serovar Typhi Ty2
agccgcugccu

SEQ ID NO: 3683366 - RNA, 17 nt, Salmonella enterica enterica serovar Typhi Ty2
agccggaaaagcgcugg

SEQ ID NO: 3683367 - RNA, 19 nt, Salmonella enterica enterica serovar Typhi Ty2
agccggaaucauucuacaa

SEQ ID NO: 3683368 - RNA, 13 nt, Salmonella enterica enterica serovar Typhi Ty2
agccggagccggu

SEQ ID NO: 3683369 - RNA, 11 nt, Salmonella enterica enterica serovar Typhi Ty2
agccggauaaa

SEQ ID NO: 3683370 - RNA, 18 nt, Salmonella enterica enterica serovar Typhi Ty2
agccggauaaaauuauuu

SEQ ID NO: 3683371 - RNA, 20 nt, Salmonella enterica enterica serovar Typhi Ty2
agccggauaagcguagcgcc

SEQ ID NO: 3683372 - RNA, 16 nt, Salmonella enterica enterica serovar Typhi Ty2
agccggcgauagcgcc

SEQ ID NO: 3683373 - RNA, 13 nt, Salmonella enterica enterica serovar Typhi Ty2
agccgggcaggaa

SEQ ID NO: 3683374 - RNA, 19 nt, Salmonella enterica enterica serovar Typhi Ty2
agccgguaaucacugccgc

SEQ ID NO: 3683375 - RNA, 19 nt, Salmonella enterica enterica serovar Typhi Ty2
agccguaacgagugaggac

SEQ ID NO: 3683376 - RNA, 16 nt, Salmonella enterica enterica serovar Typhi Ty2
agccguagcagaagac

SEQ ID NO: 3683377 - RNA, 17 nt, Salmonella enterica enterica serovar Typhi Ty2
agccguaucuuccggug

SEQ ID NO: 3683378 - RNA, 17 nt, Salmonella enterica enterica serovar Typhi Ty2
agccgucaaacaucgcg

SEQ ID NO: 3683379 - RNA, 21 nt, Salmonella enterica enterica serovar Typhi Ty2
agccgucgauaaaauccucua

SEQ ID NO: 3683380 - RNA, 22 nt, Salmonella enterica enterica serovar Typhi Ty2
agccgugaauggucacauucug

SEQ ID NO: 3683381 - RNA, 22 nt, Salmonella enterica enterica serovar Typhi Ty2
agccgugccugcuccgccaggg

SEQ ID NO: 3683382 - RNA, 15 nt, Salmonella enterica enterica serovar Typhi Ty2
agccguuaccgccga

SEQ ID NO: 3683383 - RNA, 17 nt, Salmonella enterica enterica serovar Typhi Ty2
agccguuaccgccgagc

SEQ ID NO: 3683384 - RNA, 16 nt, Salmonella enterica enterica serovar Typhi Ty2
agccguuacuuccccc

SEQ ID NO: 3683385 - RNA, 13 nt, Salmonella enterica enterica serovar Typhi Ty2
agccguucuccag

SEQ ID NO: 3683386 - RNA, 14 nt, Salmonella enterica enterica serovar Typhi Ty2
agccguuucuuguc

SEQ ID NO: 3683387 - RNA, 22 nt, Salmonella enterica enterica serovar Typhi Ty2
agccguuuuggcagcgcccgcu

SEQ ID NO: 3683388 - RNA, 23 nt, Salmonella enterica enterica serovar Typhi Ty2
agccuaaugggccagauucuuag

SEQ ID NO: 3683389 - RNA, 14 nt, Salmonella enterica enterica serovar Typhi Ty2
agccuaccugccgc

SEQ ID NO: 3683390 - RNA, 16 nt, Salmonella enterica enterica serovar Typhi Ty2
agccuaccugccgcca

SEQ ID NO: 3683391 - RNA, 13 nt, Salmonella enterica enterica serovar Typhi Ty2
agccuauuaucag

SEQ ID NO: 3683392 - RNA, 21 nt, Salmonella enterica enterica serovar Typhi Ty2
agccucauuuuugaguuuguc

SEQ ID NO: 3683393 - RNA, 22 nt, Salmonella enterica enterica serovar Typhi Ty2
agccucugauuucgacgauaaa

SEQ ID NO: 3683394 - RNA, 19 nt, Salmonella enterica enterica serovar Typhi Ty2
agccugaacgggugguuuc

SEQ ID NO: 3683395 - RNA, 22 nt, Salmonella enterica enterica serovar Typhi Ty2
agccugaagccagcaaucagcc

SEQ ID NO: 3683396 - RNA, 21 nt, Salmonella enterica enterica serovar Typhi Ty2
agccugacuacgucagauggg

SEQ ID NO: 3683397 - RNA, 18 nt, Salmonella enterica enterica serovar Typhi Ty2
agccugauacuuuuacuc

SEQ ID NO: 3683398 - RNA, 22 nt, Salmonella enterica enterica serovar Typhi Ty2
agccugccagcaacccaccugc

SEQ ID NO: 3683399 - RNA, 23 nt, Salmonella enterica enterica serovar Typhi Ty2
agccuggugcccaaccugcgcag

SEQ ID NO: 3683400 - RNA, 17 nt, Salmonella enterica enterica serovar Typhi Ty2
agccugugaucggagaa

SEQ ID NO: 3683401 - RNA, 20 nt, Salmonella enterica enterica serovar Typhi Ty2
agccugugcaaccagcucuu

SEQ ID NO: 3683402 - RNA, 15 nt, Salmonella enterica enterica serovar Typhi Ty2
agccugugcgccugc

SEQ ID NO: 3683403 - RNA, 18 nt, Salmonella enterica enterica serovar Typhi Ty2
agccugugcgccugcugc

SEQ ID NO: 3683404 - RNA, 17 nt, Salmonella enterica enterica serovar Typhi Ty2
agccuguuccagcugcg

SEQ ID NO: 3683405 - RNA, 20 nt, Salmonella enterica enterica serovar Typhi Ty2
agccuuacaggcgcaucaga

SEQ ID NO: 3683406 - RNA, 21 nt, Salmonella enterica enterica serovar Typhi Ty2
agccuuacaggcgcaucagaa

SEQ ID NO: 3683407 - RNA, 22 nt, Salmonella enterica enterica serovar Typhi Ty2
agccuuacaggcgcaucagaaa

SEQ ID NO: 3683408 - RNA, 23 nt, Salmonella enterica enterica serovar Typhi Ty2
agccuuacaggcgcaucagaaaa

SEQ ID NO: 3683409 - RNA, 15 nt, Salmonella enterica enterica serovar Typhi Ty2
agccuuagcgggagg

SEQ ID NO: 3683410 - RNA, 12 nt, Salmonella enterica enterica serovar Typhi Ty2
agccuuauaaga

SEQ ID NO: 3683411 - RNA, 16 nt, Salmonella enterica enterica serovar Typhi Ty2
agccuuauaagaacca

SEQ ID NO: 3683412 - RNA, 17 nt, Salmonella enterica enterica serovar Typhi Ty2
agccuuauaagaaccau

SEQ ID NO: 3683413 - RNA, 17 nt, Salmonella enterica enterica serovar Typhi Ty2
agccuucgccuucacgc

SEQ ID NO: 3683414 - RNA, 23 nt, Salmonella enterica enterica serovar Typhi Ty2
agccuucgccuucacgcauucuu

SEQ ID NO: 3683415 - RNA, 15 nt, Salmonella enterica enterica serovar Typhi Ty2
agccuucuccccuuc

SEQ ID NO: 3683416 - RNA, 22 nt, Salmonella enterica enterica serovar Typhi Ty2
agccuucuccccuucaucagua

SEQ ID NO: 3683417 - RNA, 12 nt, Salmonella enterica enterica serovar Typhi Ty2
agccuugcaucu

SEQ ID NO: 3683418 - RNA, 13 nt, Salmonella enterica enterica serovar Typhi Ty2
agccuugccgcaa

SEQ ID NO: 3683419 - RNA, 14 nt, Salmonella enterica enterica serovar Typhi Ty2
agccuugcgcuauu

SEQ ID NO: 3683420 - RNA, 15 nt, Salmonella enterica enterica serovar Typhi Ty2
agccuuuuucuuuca

SEQ ID NO: 3683421 - RNA, 19 nt, Salmonella enterica enterica serovar Typhi Ty2
agcgaaaauaaacgcuuga

SEQ ID NO: 3683422 - RNA, 23 nt, Salmonella enterica enterica serovar Typhi Ty2
agcgaacaguacggucaggcuca

SEQ ID NO: 3683423 - RNA, 13 nt, Salmonella enterica enterica serovar Typhi Ty2
agcgaacagucca

SEQ ID NO: 3683424 - RNA, 14 nt, Salmonella enterica enterica serovar Typhi Ty2
agcgaaccuuccau

SEQ ID NO: 3683425 - RNA, 17 nt, Salmonella enterica enterica serovar Typhi Ty2
agcgaacguccagcggc

SEQ ID NO: 3683426 - RNA, 13 nt, Salmonella enterica enterica serovar Typhi Ty2
agcgaacugauaa

SEQ ID NO: 3683427 - RNA, 22 nt, Salmonella enterica enterica serovar Typhi Ty2
agcgaaggggcgggcagcagca

SEQ ID NO: 3683428 - RNA, 15 nt, Salmonella enterica enterica serovar Typhi Ty2
agcgaauaacauaau

SEQ ID NO: 3683429 - RNA, 18 nt, Salmonella enterica enterica serovar Typhi Ty2
agcgaauaacauaauauu

SEQ ID NO: 3683430 - RNA, 20 nt, Salmonella enterica enterica serovar Typhi Ty2
agcgaauaaucccggcgcca

SEQ ID NO: 3683431 - RNA, 14 nt, Salmonella enterica enterica serovar Typhi Ty2
agcgaauagcggca

SEQ ID NO: 3683432 - RNA, 15 nt, Salmonella enterica enterica serovar Typhi Ty2
agcgaaugcgcgcca

SEQ ID NO: 3683433 - RNA, 22 nt, Salmonella enterica enterica serovar Typhi Ty2
agcgaauggcgugaagccauca

SEQ ID NO: 3683434 - RNA, 23 nt, Salmonella enterica enterica serovar Typhi Ty2
agcgaauguauuaacgcuuugcc

SEQ ID NO: 3683435 - RNA, 13 nt, Salmonella enterica enterica serovar Typhi Ty2
agcgacaaaugaa

SEQ ID NO: 3683436 - RNA, 17 nt, Salmonella enterica enterica serovar Typhi Ty2
agcgacacuccgcgcau

SEQ ID NO: 3683437 - RNA, 15 nt, Salmonella enterica enterica serovar Typhi Ty2
agcgacagcccggcg

SEQ ID NO: 3683438 - RNA, 22 nt, Salmonella enterica enterica serovar Typhi Ty2
agcgaccacgccaccgccgcca

SEQ ID NO: 3683439 - RNA, 20 nt, Salmonella enterica enterica serovar Typhi Ty2
agcgaccuguagaugaaacu

SEQ ID NO: 3683440 - RNA, 15 nt, Salmonella enterica enterica serovar Typhi Ty2
agcgacggcgcgcca

SEQ ID NO: 3683441 - RNA, 21 nt, Salmonella enterica enterica serovar Typhi Ty2
agcgacgguccuggccaggcu

SEQ ID NO: 3683442 - RNA, 21 nt, Salmonella enterica enterica serovar Typhi Ty2
agcgacguugucuucaucuau

SEQ ID NO: 3683443 - RNA, 23 nt, Salmonella enterica enterica serovar Typhi Ty2
agcgacucauucagcaacugcgu

SEQ ID NO: 3683444 - RNA, 12 nt, Salmonella enterica enterica serovar Typhi Ty2
agcgacugauaa

SEQ ID NO: 3683445 - RNA, 17 nt, Salmonella enterica enterica serovar Typhi Ty2
agcgacuugucggcaau

SEQ ID NO: 3683446 - RNA, 15 nt, Salmonella enterica enterica serovar Typhi Ty2
agcgagacuuuugcc

SEQ ID NO: 3683447 - RNA, 18 nt, Salmonella enterica enterica serovar Typhi Ty2
agcgagauaaccgggaau

SEQ ID NO: 3683448 - RNA, 13 nt, Salmonella enterica enterica serovar Typhi Ty2
agcgagaugaaaa

SEQ ID NO: 3683449 - RNA, 19 nt, Salmonella enterica enterica serovar Typhi Ty2
agcgagcgccugaugccgc

SEQ ID NO: 3683450 - RNA, 12 nt, Salmonella enterica enterica serovar Typhi Ty2
agcgagguaaaa

SEQ ID NO: 3683451 - RNA, 21 nt, Salmonella enterica enterica serovar Typhi Ty2
agcgaguacguaaugugaaaa

SEQ ID NO: 3683452 - RNA, 11 nt, Salmonella enterica enterica serovar Typhi Ty2
agcgagucaga

SEQ ID NO: 3683453 - RNA, 14 nt, Salmonella enterica enterica serovar Typhi Ty2
agcgauagacuguu

SEQ ID NO: 3683454 - RNA, 18 nt, Salmonella enterica enterica serovar Typhi Ty2
agcgauagucguugcgcc

SEQ ID NO: 3683455 - RNA, 22 nt, Salmonella enterica enterica serovar Typhi Ty2
agcgauauagcgcauagcggcc

SEQ ID NO: 3683456 - RNA, 15 nt, Salmonella enterica enterica serovar Typhi Ty2
agcgauauuucuccg

SEQ ID NO: 3683457 - RNA, 17 nt, Salmonella enterica enterica serovar Typhi Ty2
agcgaucauaagggagc

SEQ ID NO: 3683458 - RNA, 17 nt, Salmonella enterica enterica serovar Typhi Ty2
agcgaucgagauaagau

SEQ ID NO: 3683459 - RNA, 18 nt, Salmonella enterica enterica serovar Typhi Ty2
agcgaucgagauaagauc

SEQ ID NO: 3683460 - RNA, 23 nt, Salmonella enterica enterica serovar Typhi Ty2
agcgaucuccugcaguauuucag

SEQ ID NO: 3683461 - RNA, 23 nt, Salmonella enterica enterica serovar Typhi Ty2
agcgaucuggcggcgaaagagaa

SEQ ID NO: 3683462 - RNA, 23 nt, Salmonella enterica enterica serovar Typhi Ty2
agcgaugacgccugccagauagu

SEQ ID NO: 3683463 - RNA, 17 nt, Salmonella enterica enterica serovar Typhi Ty2
agcgaugagcgccagca

SEQ ID NO: 3683464 - RNA, 20 nt, Salmonella enterica enterica serovar Typhi Ty2
agcgaugagcgccagcaaca

SEQ ID NO: 3683465 - RNA, 13 nt, Salmonella enterica enterica serovar Typhi Ty2
agcgaugcgcgcg

SEQ ID NO: 3683466 - RNA, 17 nt, Salmonella enterica enterica serovar Typhi Ty2
agcgauuacgccagaca

SEQ ID NO: 3683467 - RNA, 17 nt, Salmonella enterica enterica serovar Typhi Ty2
agcgauugcgccagacc

SEQ ID NO: 3683468 - RNA, 14 nt, Salmonella enterica enterica serovar Typhi Ty2
agcgauuuauccac

SEQ ID NO: 3683469 - RNA, 12 nt, Salmonella enterica enterica serovar Typhi Ty2
agcgcaacgccu

SEQ ID NO: 3683470 - RNA, 16 nt, Salmonella enterica enterica serovar Typhi Ty2
agcgcaacgcgcauca

SEQ ID NO: 3683471 - RNA, 19 nt, Salmonella enterica enterica serovar Typhi Ty2
agcgcaauaacaauaaaga

SEQ ID NO: 3683472 - RNA, 18 nt, Salmonella enterica enterica serovar Typhi Ty2
agcgcagaagcagaccga

SEQ ID NO: 3683473 - RNA, 23 nt, Salmonella enterica enterica serovar Typhi Ty2
agcgcagaccgagcgcauguucu

SEQ ID NO: 3683474 - RNA, 18 nt, Salmonella enterica enterica serovar Typhi Ty2
agcgcagagugaccagcg

SEQ ID NO: 3683475 - RNA, 13 nt, Salmonella enterica enterica serovar Typhi Ty2
agcgcagcaacgg

SEQ ID NO: 3683476 - RNA, 16 nt, Salmonella enterica enterica serovar Typhi Ty2
agcgcagcgagaaagc

SEQ ID NO: 3683477 - RNA, 12 nt, Salmonella enterica enterica serovar Typhi Ty2
agcgcagcgcca

SEQ ID NO: 3683478 - RNA, 18 nt, Salmonella enterica enterica serovar Typhi Ty2
agcgcagcgccaucaggc

SEQ ID NO: 3683479 - RNA, 22 nt, Salmonella enterica enterica serovar Typhi Ty2
agcgcagcgccauugagcauuc

SEQ ID NO: 3683480 - RNA, 19 nt, Salmonella enterica enterica serovar Typhi Ty2
agcgcagucaaaacgacau

SEQ ID NO: 3683481 - RNA, 13 nt, Salmonella enterica enterica serovar Typhi Ty2
agcgcauagcugc

SEQ ID NO: 3683482 - RNA, 16 nt, Salmonella enterica enterica serovar Typhi Ty2
agcgcauccagcucuu

SEQ ID NO: 3683483 - RNA, 15 nt, Salmonella enterica enterica serovar Typhi Ty2
agcgcauccgguaaa

SEQ ID NO: 3683484 - RNA, 15 nt, Salmonella enterica enterica serovar Typhi Ty2
agcgcaugcccggua

SEQ ID NO: 3683485 - RNA, 14 nt, Salmonella enterica enterica serovar Typhi Ty2
agcgcauugacgau

SEQ ID NO: 3683486 - RNA, 20 nt, Salmonella enterica enterica serovar Typhi Ty2
agcgcauugcgccccagcac

SEQ ID NO: 3683487 - RNA, 16 nt, Salmonella enterica enterica serovar Typhi Ty2
agcgcauuugcggcgu

SEQ ID NO: 3683488 - RNA, 18 nt, Salmonella enterica enterica serovar Typhi Ty2
agcgcauuuuacugccgu

SEQ ID NO: 3683489 - RNA, 17 nt, Salmonella enterica enterica serovar Typhi Ty2
agcgccaaaaaauaacg

SEQ ID NO: 3683490 - RNA, 23 nt, Salmonella enterica enterica serovar Typhi Ty2
agcgccaaaaagaaaaaagugau

SEQ ID NO: 3683491 - RNA, 21 nt, Salmonella enterica enterica serovar Typhi Ty2
agcgccacaacguugaccgcu

SEQ ID NO: 3683492 - RNA, 17 nt, Salmonella enterica enterica serovar Typhi Ty2
agcgccacccauuuucc

SEQ ID NO: 3683493 - RNA, 17 nt, Salmonella enterica enterica serovar Typhi Ty2
agcgccacggagcauaa

SEQ ID NO: 3683494 - RNA, 15 nt, Salmonella enterica enterica serovar Typhi Ty2
agcgccagauaguca

SEQ ID NO: 3683495 - RNA, 13 nt, Salmonella enterica enterica serovar Typhi Ty2
agcgccagcagca

SEQ ID NO: 3683496 - RNA, 12 nt, Salmonella enterica enterica serovar Typhi Ty2
agcgccagcaug

SEQ ID NO: 3683497 - RNA, 19 nt, Salmonella enterica enterica serovar Typhi Ty2
agcgccagcccugcgauca

SEQ ID NO: 3683498 - RNA, 16 nt, Salmonella enterica enterica serovar Typhi Ty2
agcgccagcgccaccu

SEQ ID NO: 3683499 - RNA, 17 nt, Salmonella enterica enterica serovar Typhi Ty2
agcgccagcgccaccug

SEQ ID NO: 3683500 - RNA, 23 nt, Salmonella enterica enterica serovar Typhi Ty2
agcgccagcgguguuugccagac

SEQ ID NO: 3683501 - RNA, 14 nt, Salmonella enterica enterica serovar Typhi Ty2
agcgccagcuccau

SEQ ID NO: 3683502 - RNA, 12 nt, Salmonella enterica enterica serovar Typhi Ty2
agcgccaggcca

SEQ ID NO: 3683503 - RNA, 14 nt, Salmonella enterica enterica serovar Typhi Ty2
agcgccagugacgc

SEQ ID NO: 3683504 - RNA, 22 nt, Salmonella enterica enterica serovar Typhi Ty2
agcgccauaaaaaacaccuguc

SEQ ID NO: 3683505 - RNA, 18 nt, Salmonella enterica enterica serovar Typhi Ty2
agcgccauauaaauaggc

SEQ ID NO: 3683506 - RNA, 16 nt, Salmonella enterica enterica serovar Typhi Ty2
agcgccauauugcugu

SEQ ID NO: 3683507 - RNA, 17 nt, Salmonella enterica enterica serovar Typhi Ty2
agcgccaucaggcaaug

SEQ ID NO: 3683508 - RNA, 20 nt, Salmonella enterica enterica serovar Typhi Ty2
agcgccaucaggcacggcgu

SEQ ID NO: 3683509 - RNA, 19 nt, Salmonella enterica enterica serovar Typhi Ty2
agcgccaucaggcaugcca

SEQ ID NO: 3683510 - RNA, 21 nt, Salmonella enterica enterica serovar Typhi Ty2
agcgccaucaggcaugccaaa

SEQ ID NO: 3683511 - RNA, 13 nt, Salmonella enterica enterica serovar Typhi Ty2
agcgccauccggc

SEQ ID NO: 3683512 - RNA, 15 nt, Salmonella enterica enterica serovar Typhi Ty2
agcgccauccggcaa

SEQ ID NO: 3683513 - RNA, 20 nt, Salmonella enterica enterica serovar Typhi Ty2
agcgccauccggcacacaga

SEQ ID NO: 3683514 - RNA, 14 nt, Salmonella enterica enterica serovar Typhi Ty2
agcgccaucgggca

SEQ ID NO: 3683515 - RNA, 18 nt, Salmonella enterica enterica serovar Typhi Ty2
agcgccaucgggcauuua

SEQ ID NO: 3683516 - RNA, 14 nt, Salmonella enterica enterica serovar Typhi Ty2
agcgccaugaagau

SEQ ID NO: 3683517 - RNA, 13 nt, Salmonella enterica enterica serovar Typhi Ty2
agcgcccagcagc

SEQ ID NO: 3683518 - RNA, 17 nt, Salmonella enterica enterica serovar Typhi Ty2
agcgcccagcgccggau

SEQ ID NO: 3683519 - RNA, 21 nt, Salmonella enterica enterica serovar Typhi Ty2
agcgcccgcuguccgcccagu

SEQ ID NO: 3683520 - RNA, 16 nt, Salmonella enterica enterica serovar Typhi Ty2
agcgcccguccaugag

SEQ ID NO: 3683521 - RNA, 14 nt, Salmonella enterica enterica serovar Typhi Ty2
agcgccgcagggcg

SEQ ID NO: 3683522 - RNA, 20 nt, Salmonella enterica enterica serovar Typhi Ty2
agcgccgccagaaucaccuc

SEQ ID NO: 3683523 - RNA, 19 nt, Salmonella enterica enterica serovar Typhi Ty2
agcgccgcgcgaucaauca

SEQ ID NO: 3683524 - RNA, 15 nt, Salmonella enterica enterica serovar Typhi Ty2
agcgccggcagcagu

SEQ ID NO: 3683525 - RNA, 19 nt, Salmonella enterica enterica serovar Typhi Ty2
agcgccggcagcaguucuu

SEQ ID NO: 3683526 - RNA, 20 nt, Salmonella enterica enterica serovar Typhi Ty2
agcgccggcagcaguucuuc

SEQ ID NO: 3683527 - RNA, 18 nt, Salmonella enterica enterica serovar Typhi Ty2
agcgccguagcggcaggg

SEQ ID NO: 3683528 - RNA, 20 nt, Salmonella enterica enterica serovar Typhi Ty2
agcgccgucgccaucaccag

SEQ ID NO: 3683529 - RNA, 18 nt, Salmonella enterica enterica serovar Typhi Ty2
agcgccguuaacgcggcc

SEQ ID NO: 3683530 - RNA, 21 nt, Salmonella enterica enterica serovar Typhi Ty2
agcgccguuaacgcggccgua

SEQ ID NO: 3683531 - RNA, 15 nt, Salmonella enterica enterica serovar Typhi Ty2
agcgccuccggguuu

SEQ ID NO: 3683532 - RNA, 21 nt, Salmonella enterica enterica serovar Typhi Ty2
agcgccugaauguacgcauau

SEQ ID NO: 3683533 - RNA, 23 nt, Salmonella enterica enterica serovar Typhi Ty2
agcgccuggcgguaugaaagcca

SEQ ID NO: 3683534 - RNA, 14 nt, Salmonella enterica enterica serovar Typhi Ty2
agcgccuucaggca

SEQ ID NO: 3683535 - RNA, 19 nt, Salmonella enterica enterica serovar Typhi Ty2
agcgccuucaggcaucaga

SEQ ID NO: 3683536 - RNA, 23 nt, Salmonella enterica enterica serovar Typhi Ty2
agcgccuucaggcaucagauaaa

SEQ ID NO: 3683537 - RNA, 15 nt, Salmonella enterica enterica serovar Typhi Ty2
agcgccuuuuaaggu

SEQ ID NO: 3683538 - RNA, 16 nt, Salmonella enterica enterica serovar Typhi Ty2
agcgcgaacaggcugg

SEQ ID NO: 3683539 - RNA, 15 nt, Salmonella enterica enterica serovar Typhi Ty2
agcgcgaaucgccuc

SEQ ID NO: 3683540 - RNA, 23 nt, Salmonella enterica enterica serovar Typhi Ty2
agcgcgaauuuuauuaagcaggc

SEQ ID NO: 3683541 - RNA, 14 nt, Salmonella enterica enterica serovar Typhi Ty2
agcgcgacauagag

SEQ ID NO: 3683542 - RNA, 22 nt, Salmonella enterica enterica serovar Typhi Ty2
agcgcgaccagcgugaccggua

SEQ ID NO: 3683543 - RNA, 21 nt, Salmonella enterica enterica serovar Typhi Ty2
agcgcgaccaggaaaccggua

SEQ ID NO: 3683544 - RNA, 14 nt, Salmonella enterica enterica serovar Typhi Ty2
agcgcgaccgguuu

SEQ ID NO: 3683545 - RNA, 17 nt, Salmonella enterica enterica serovar Typhi Ty2
agcgcgagcgugaucuc

SEQ ID NO: 3683546 - RNA, 21 nt, Salmonella enterica enterica serovar Typhi Ty2
agcgcgauacgcagcaccgcc

SEQ ID NO: 3683547 - RNA, 21 nt, Salmonella enterica enterica serovar Typhi Ty2
agcgcgaucgccccgaccagg

SEQ ID NO: 3683548 - RNA, 22 nt, Salmonella enterica enterica serovar Typhi Ty2
agcgcgaucgccccgaccagga

SEQ ID NO: 3683549 - RNA, 17 nt, Salmonella enterica enterica serovar Typhi Ty2
agcgcgcagcugggccu

SEQ ID NO: 3683550 - RNA, 21 nt, Salmonella enterica enterica serovar Typhi Ty2
agcgcgccaauggccgccccc

SEQ ID NO: 3683551 - RNA, 18 nt, Salmonella enterica enterica serovar Typhi Ty2
agcgcgcccgccaccagc

SEQ ID NO: 3683552 - RNA, 19 nt, Salmonella enterica enterica serovar Typhi Ty2
agcgcgcccgccaccagca

SEQ ID NO: 3683553 - RNA, 20 nt, Salmonella enterica enterica serovar Typhi Ty2
agcgcgcccgccaccagcac

SEQ ID NO: 3683554 - RNA, 16 nt, Salmonella enterica enterica serovar Typhi Ty2
agcgcgccgucaucgc

SEQ ID NO: 3683555 - RNA, 19 nt, Salmonella enterica enterica serovar Typhi Ty2
agcgcgcgacaugcgucuu

SEQ ID NO: 3683556 - RNA, 18 nt, Salmonella enterica enterica serovar Typhi Ty2
agcgcgcgacccagcgca

SEQ ID NO: 3683557 - RNA, 12 nt, Salmonella enterica enterica serovar Typhi Ty2
agcgcgcgcaca

SEQ ID NO: 3683558 - RNA, 23 nt, Salmonella enterica enterica serovar Typhi Ty2
agcgcgcgcuaauuuucagggug

SEQ ID NO: 3683559 - RNA, 16 nt, Salmonella enterica enterica serovar Typhi Ty2
agcgcgcuccagacca

SEQ ID NO: 3683560 - RNA, 13 nt, Salmonella enterica enterica serovar Typhi Ty2
agcgcgcuggcaa

SEQ ID NO: 3683561 - RNA, 16 nt, Salmonella enterica enterica serovar Typhi Ty2
agcgcggcagcagcuu

SEQ ID NO: 3683562 - RNA, 19 nt, Salmonella enterica enterica serovar Typhi Ty2
agcgcggcauuaauuucuu

SEQ ID NO: 3683563 - RNA, 16 nt, Salmonella enterica enterica serovar Typhi Ty2
agcgcggccagcgccu

SEQ ID NO: 3683564 - RNA, 13 nt, Salmonella enterica enterica serovar Typhi Ty2
agcgcggcgccca

SEQ ID NO: 3683565 - RNA, 22 nt, Salmonella enterica enterica serovar Typhi Ty2
agcgcggcggcaacugagcgaa

SEQ ID NO: 3683566 - RNA, 19 nt, Salmonella enterica enterica serovar Typhi Ty2
agcgcggcgugaucaaauu

SEQ ID NO: 3683567 - RNA, 21 nt, Salmonella enterica enterica serovar Typhi Ty2
agcgcgguggcuuuuuccugc

SEQ ID NO: 3683568 - RNA, 21 nt, Salmonella enterica enterica serovar Typhi Ty2
agcgcguaaauaccuucuggc

SEQ ID NO: 3683569 - RNA, 15 nt, Salmonella enterica enterica serovar Typhi Ty2
agcgcgucagcgccu

SEQ ID NO: 3683570 - RNA, 18 nt, Salmonella enterica enterica serovar Typhi Ty2
agcgcgucguucacgcca

SEQ ID NO: 3683571 - RNA, 18 nt, Salmonella enterica enterica serovar Typhi Ty2
agcgcgucguugccuuug

SEQ ID NO: 3683572 - RNA, 14 nt, Salmonella enterica enterica serovar Typhi Ty2
agcgcguucagggu

SEQ ID NO: 3683573 - RNA, 22 nt, Salmonella enterica enterica serovar Typhi Ty2
agcgcguucgccgucacgccga

SEQ ID NO: 3683574 - RNA, 16 nt, Salmonella enterica enterica serovar Typhi Ty2
agcgcuaagcaacagu

SEQ ID NO: 3683575 - RNA, 16 nt, Salmonella enterica enterica serovar Typhi Ty2
agcgcuaauugugcgg

SEQ ID NO: 3683576 - RNA, 22 nt, Salmonella enterica enterica serovar Typhi Ty2
agcgcuacauccgccagccgcc

SEQ ID NO: 3683577 - RNA, 17 nt, Salmonella enterica enterica serovar Typhi Ty2
agcgcucaaauaaugca

SEQ ID NO: 3683578 - RNA, 18 nt, Salmonella enterica enterica serovar Typhi Ty2
agcgcucaaucagcgcuu

SEQ ID NO: 3683579 - RNA, 14 nt, Salmonella enterica enterica serovar Typhi Ty2
agcgcucaggcagc

SEQ ID NO: 3683580 - RNA, 18 nt, Salmonella enterica enterica serovar Typhi Ty2
agcgcuccgggguucuuu

SEQ ID NO: 3683581 - RNA, 19 nt, Salmonella enterica enterica serovar Typhi Ty2
agcgcugaggcgcuggcuu

SEQ ID NO: 3683582 - RNA, 19 nt, Salmonella enterica enterica serovar Typhi Ty2
agcgcugagucauccuucc

SEQ ID NO: 3683583 - RNA, 21 nt, Salmonella enterica enterica serovar Typhi Ty2
agcgcugcuguaacagacgca

SEQ ID NO: 3683584 - RNA, 19 nt, Salmonella enterica enterica serovar Typhi Ty2
agcgcuggagaaugggauu

SEQ ID NO: 3683585 - RNA, 17 nt, Salmonella enterica enterica serovar Typhi Ty2
agcgcuggcuggcgaca

SEQ ID NO: 3683586 - RNA, 23 nt, Salmonella enterica enterica serovar Typhi Ty2
agcgcuuaccacuuugcgcuccu

SEQ ID NO: 3683587 - RNA, 22 nt, Salmonella enterica enterica serovar Typhi Ty2
  misc_feature (9)..(9): n is a, c, g or u
agcgcuuanccgaccgacaaaa

SEQ ID NO: 3683588 - RNA, 22 nt, Salmonella enterica enterica serovar Typhi Ty2
agcgcuucuaacgaaacagauu

SEQ ID NO: 3683589 - RNA, 21 nt, Salmonella enterica enterica serovar Typhi Ty2
agcgcuuggcguauagccgcc

SEQ ID NO: 3683590 - RNA, 22 nt, Salmonella enterica enterica serovar Typhi Ty2
agcgcuuuccugcguauauuua

SEQ ID NO: 3683591 - RNA, 16 nt, Salmonella enterica enterica serovar Typhi Ty2
agcgcuuucuucuuca

SEQ ID NO: 3683592 - RNA, 16 nt, Salmonella enterica enterica serovar Typhi Ty2
agcgcuuugccgcugc

SEQ ID NO: 3683593 - RNA, 22 nt, Salmonella enterica enterica serovar Typhi Ty2
agcgcuuugccgcugcugccuu

SEQ ID NO: 3683594 - RNA, 16 nt, Salmonella enterica enterica serovar Typhi Ty2
agcgcuuuuuuuaugc

SEQ ID NO: 3683595 - RNA, 23 nt, Salmonella enterica enterica serovar Typhi Ty2
agcggaaaauauucagcacauca

SEQ ID NO: 3683596 - RNA, 20 nt, Salmonella enterica enterica serovar Typhi Ty2
agcggaaucgcuuccugggu

SEQ ID NO: 3683597 - RNA, 15 nt, Salmonella enterica enterica serovar Typhi Ty2
agcggacacccgcag

SEQ ID NO: 3683598 - RNA, 21 nt, Salmonella enterica enterica serovar Typhi Ty2
agcggacggcuaauaugccag

SEQ ID NO: 3683599 - RNA, 22 nt, Salmonella enterica enterica serovar Typhi Ty2
agcggaucgcguccauuacucu

SEQ ID NO: 3683600 - RNA, 17 nt, Salmonella enterica enterica serovar Typhi Ty2
agcggauggccugcuca

SEQ ID NO: 3683601 - RNA, 14 nt, Salmonella enterica enterica serovar Typhi Ty2
agcggauuaaaacg

SEQ ID NO: 3683602 - RNA, 17 nt, Salmonella enterica enterica serovar Typhi Ty2
agcggauuaaaacgcau

SEQ ID NO: 3683603 - RNA, 12 nt, Salmonella enterica enterica serovar Typhi Ty2
agcggauucuuc

SEQ ID NO: 3683604 - RNA, 18 nt, Salmonella enterica enterica serovar Typhi Ty2
agcggauugccgcgcuca

SEQ ID NO: 3683605 - RNA, 14 nt, Salmonella enterica enterica serovar Typhi Ty2
agcggcaacagcac

SEQ ID NO: 3683606 - RNA, 22 nt, Salmonella enterica enterica serovar Typhi Ty2
agcggcaaggaaaaccaguaac

SEQ ID NO: 3683607 - RNA, 15 nt, Salmonella enterica enterica serovar Typhi Ty2
agcggcaaucgccuc

SEQ ID NO: 3683608 - RNA, 22 nt, Salmonella enterica enterica serovar Typhi Ty2
agcggcagaucguuuacgaccu

SEQ ID NO: 3683609 - RNA, 19 nt, Salmonella enterica enterica serovar Typhi Ty2
agcggcaggauccccaucc

SEQ ID NO: 3683610 - RNA, 14 nt, Salmonella enterica enterica serovar Typhi Ty2
agcggcaguaaauu

SEQ ID NO: 3683611 - RNA, 14 nt, Salmonella enterica enterica serovar Typhi Ty2
agcggcagugauga

SEQ ID NO: 3683612 - RNA, 15 nt, Salmonella enterica enterica serovar Typhi Ty2
agcggcaucucgcca

SEQ ID NO: 3683613 - RNA, 15 nt, Salmonella enterica enterica serovar Typhi Ty2
agcggccagauggca

SEQ ID NO: 3683614 - RNA, 20 nt, Salmonella enterica enterica serovar Typhi Ty2
agcggccagauggcaaacgg

SEQ ID NO: 3683615 - RNA, 13 nt, Salmonella enterica enterica serovar Typhi Ty2
agcggccagggca

SEQ ID NO: 3683616 - RNA, 15 nt, Salmonella enterica enterica serovar Typhi Ty2
agcggcccgcgcuga

SEQ ID NO: 3683617 - RNA, 13 nt, Salmonella enterica enterica serovar Typhi Ty2
agcggccugucag

SEQ ID NO: 3683618 - RNA, 16 nt, Salmonella enterica enterica serovar Typhi Ty2
agcggcgcaggggcau

SEQ ID NO: 3683619 - RNA, 18 nt, Salmonella enterica enterica serovar Typhi Ty2
agcggcgccaucaccauc

SEQ ID NO: 3683620 - RNA, 22 nt, Salmonella enterica enterica serovar Typhi Ty2
agcggcgccgggaacuggcagc

SEQ ID NO: 3683621 - RNA, 16 nt, Salmonella enterica enterica serovar Typhi Ty2
agcggcgcgcuggcgc

SEQ ID NO: 3683622 - RNA, 14 nt, Salmonella enterica enterica serovar Typhi Ty2
agcggcggaaugcu

SEQ ID NO: 3683623 - RNA, 23 nt, Salmonella enterica enterica serovar Typhi Ty2
agcggcgggauuuuaagcaucca

SEQ ID NO: 3683624 - RNA, 20 nt, Salmonella enterica enterica serovar Typhi Ty2
agcggcggucugcgccugcu

SEQ ID NO: 3683625 - RNA, 17 nt, Salmonella enterica enterica serovar Typhi Ty2
agcggcguucaaaacgc

SEQ ID NO: 3683626 - RNA, 17 nt, Salmonella enterica enterica serovar Typhi Ty2
agcggcuaaucaccacc

SEQ ID NO: 3683627 - RNA, 16 nt, Salmonella enterica enterica serovar Typhi Ty2
agcggcucauccagca

SEQ ID NO: 3683628 - RNA, 18 nt, Salmonella enterica enterica serovar Typhi Ty2
agcggcugacacucaucc

SEQ ID NO: 3683629 - RNA, 22 nt, Salmonella enterica enterica serovar Typhi Ty2
agcggcugacacucauccagac

SEQ ID NO: 3683630 - RNA, 15 nt, Salmonella enterica enterica serovar Typhi Ty2
agcggcugcgccugu

SEQ ID NO: 3683631 - RNA, 13 nt, Salmonella enterica enterica serovar Typhi Ty2
agcggcuucgcca

SEQ ID NO: 3683632 - RNA, 20 nt, Salmonella enterica enterica serovar Typhi Ty2
agcgggcagcauugaccacc

SEQ ID NO: 3683633 - RNA, 19 nt, Salmonella enterica enterica serovar Typhi Ty2
agcgggccgguaacgccgu

SEQ ID NO: 3683634 - RNA, 19 nt, Salmonella enterica enterica serovar Typhi Ty2
agcgggcgcaguccagaug

SEQ ID NO: 3683635 - RNA, 13 nt, Salmonella enterica enterica serovar Typhi Ty2
agcgggggcgccu

SEQ ID NO: 3683636 - RNA, 13 nt, Salmonella enterica enterica serovar Typhi Ty2
agcggguaaacag

SEQ ID NO: 3683637 - RNA, 18 nt, Salmonella enterica enterica serovar Typhi Ty2
agcgggucccagaagaaa

SEQ ID NO: 3683638 - RNA, 11 nt, Salmonella enterica enterica serovar Typhi Ty2
agcgguaaaau

SEQ ID NO: 3683639 - RNA, 23 nt, Salmonella enterica enterica serovar Typhi Ty2
agcgguacccggucccuggcugg

SEQ ID NO: 3683640 - RNA, 23 nt, Salmonella enterica enterica serovar Typhi Ty2
agcgguacucuuuuuccgcgaga

SEQ ID NO: 3683641 - RNA, 18 nt, Salmonella enterica enterica serovar Typhi Ty2
agcgguaguuaagcguca

SEQ ID NO: 3683642 - RNA, 16 nt, Salmonella enterica enterica serovar Typhi Ty2
agcggucaucaaugau

SEQ ID NO: 3683643 - RNA, 20 nt, Salmonella enterica enterica serovar Typhi Ty2
agcggucggagguucgaauc

SEQ ID NO: 3683644 - RNA, 15 nt, Salmonella enterica enterica serovar Typhi Ty2
agcggucuuucaaca

SEQ ID NO: 3683645 - RNA, 23 nt, Salmonella enterica enterica serovar Typhi Ty2
agcgguugcauaaaauccuggua

SEQ ID NO: 3683646 - RNA, 22 nt, Salmonella enterica enterica serovar Typhi Ty2
agcgguuuuuuuguggccugcu

SEQ ID NO: 3683647 - RNA, 19 nt, Salmonella enterica enterica serovar Typhi Ty2
agcguaaauagcccggauc

SEQ ID NO: 3683648 - RNA, 15 nt, Salmonella enterica enterica serovar Typhi Ty2
agcguaauacaggcg

SEQ ID NO: 3683649 - RNA, 22 nt, Salmonella enterica enterica serovar Typhi Ty2
agcguaaugguggcaaccugac

SEQ ID NO: 3683650 - RNA, 19 nt, Salmonella enterica enterica serovar Typhi Ty2
agcguaauuucugguacca

SEQ ID NO: 3683651 - RNA, 12 nt, Salmonella enterica enterica serovar Typhi Ty2
agcguaccagcg

SEQ ID NO: 3683652 - RNA, 15 nt, Salmonella enterica enterica serovar Typhi Ty2
agcguagccugcaug

SEQ ID NO: 3683653 - RNA, 17 nt, Salmonella enterica enterica serovar Typhi Ty2
agcguagcgccaucagg

SEQ ID NO: 3683654 - RNA, 13 nt, Salmonella enterica enterica serovar Typhi Ty2
agcguaggguaga

SEQ ID NO: 3683655 - RNA, 20 nt, Salmonella enterica enterica serovar Typhi Ty2
agcguauaauuaagcugcga

SEQ ID NO: 3683656 - RNA, 12 nt, Salmonella enterica enterica serovar Typhi Ty2
agcguaucgccc

SEQ ID NO: 3683657 - RNA, 13 nt, Salmonella enterica enterica serovar Typhi Ty2
agcgucacaggcu

SEQ ID NO: 3683658 - RNA, 19 nt, Salmonella enterica enterica serovar Typhi Ty2
agcgucagacacaauauug

SEQ ID NO: 3683659 - RNA, 12 nt, Salmonella enterica enterica serovar Typhi Ty2
agcgucaggcca

SEQ ID NO: 3683660 - RNA, 21 nt, Salmonella enterica enterica serovar Typhi Ty2
agcgucaggcgaaguuccggg

SEQ ID NO: 3683661 - RNA, 17 nt, Salmonella enterica enterica serovar Typhi Ty2
agcgucaggcuuaucgu

SEQ ID NO: 3683662 - RNA, 22 nt, Salmonella enterica enterica serovar Typhi Ty2
agcgucagguagcccggcaggc

SEQ ID NO: 3683663 - RNA, 17 nt, Salmonella enterica enterica serovar Typhi Ty2
agcgucaguaaaagccc

SEQ ID NO: 3683664 - RNA, 15 nt, Salmonella enterica enterica serovar Typhi Ty2
agcgucauccggcaa

SEQ ID NO: 3683665 - RNA, 20 nt, Salmonella enterica enterica serovar Typhi Ty2
agcgucauccggcaaucaga

SEQ ID NO: 3683666 - RNA, 13 nt, Salmonella enterica enterica serovar Typhi Ty2
agcguccacgcca

SEQ ID NO: 3683667 - RNA, 22 nt, Salmonella enterica enterica serovar Typhi Ty2
agcguccagcagacucauggac

SEQ ID NO: 3683668 - RNA, 20 nt, Salmonella enterica enterica serovar Typhi Ty2
agcguccaguccugucccug

SEQ ID NO: 3683669 - RNA, 23 nt, Salmonella enterica enterica serovar Typhi Ty2
agcguccaguccugucccugcca

SEQ ID NO: 3683670 - RNA, 14 nt, Salmonella enterica enterica serovar Typhi Ty2
agcguccccggcga

SEQ ID NO: 3683671 - RNA, 21 nt, Salmonella enterica enterica serovar Typhi Ty2
agcguccgggcaagcccggua

SEQ ID NO: 3683672 - RNA, 19 nt, Salmonella enterica enterica serovar Typhi Ty2
agcguccguucugauacuc

SEQ ID NO: 3683673 - RNA, 22 nt, Salmonella enterica enterica serovar Typhi Ty2
agcgucgccagaaccccugcca

SEQ ID NO: 3683674 - RNA, 17 nt, Salmonella enterica enterica serovar Typhi Ty2
agcgucgcgauccugcc

SEQ ID NO: 3683675 - RNA, 16 nt, Salmonella enterica enterica serovar Typhi Ty2
agcgucucagcaggcg

SEQ ID NO: 3683676 - RNA, 22 nt, Salmonella enterica enterica serovar Typhi Ty2
agcgucuguuucaacgcaucca

SEQ ID NO: 3683677 - RNA, 20 nt, Salmonella enterica enterica serovar Typhi Ty2
agcgucuucuuaccgugucu

SEQ ID NO: 3683678 - RNA, 22 nt, Salmonella enterica enterica serovar Typhi Ty2
agcgugaaaagcuuagaacuca

SEQ ID NO: 3683679 - RNA, 18 nt, Salmonella enterica enterica serovar Typhi Ty2
agcgugacaguuaccccg

SEQ ID NO: 3683680 - RNA, 15 nt, Salmonella enterica enterica serovar Typhi Ty2
agcgugacccagaca

SEQ ID NO: 3683681 - RNA, 20 nt, Salmonella enterica enterica serovar Typhi Ty2
agcgugacgaccggcacggu

SEQ ID NO: 3683682 - RNA, 17 nt, Salmonella enterica enterica serovar Typhi Ty2
agcgugacggcaagcgg

SEQ ID NO: 3683683 - RNA, 12 nt, Salmonella enterica enterica serovar Typhi Ty2
agcgugauaauu

SEQ ID NO: 3683684 - RNA, 18 nt, Salmonella enterica enterica serovar Typhi Ty2
agcgugcaaccccuugcg

SEQ ID NO: 3683685 - RNA, 18 nt, Salmonella enterica enterica serovar Typhi Ty2
agcgugccuucaaauaua

SEQ ID NO: 3683686 - RNA, 19 nt, Salmonella enterica enterica serovar Typhi Ty2
agcguggacaaaucaucgg

SEQ ID NO: 3683687 - RNA, 17 nt, Salmonella enterica enterica serovar Typhi Ty2
agcgugucgcagauacg

SEQ ID NO: 3683688 - RNA, 20 nt, Salmonella enterica enterica serovar Typhi Ty2
agcguuacccagacagcaaa

SEQ ID NO: 3683689 - RNA, 21 nt, Salmonella enterica enterica serovar Typhi Ty2
agcguuacgggaacagaauua

SEQ ID NO: 3683690 - RNA, 15 nt, Salmonella enterica enterica serovar Typhi Ty2
agcguuacuggccuu

SEQ ID NO: 3683691 - RNA, 16 nt, Salmonella enterica enterica serovar Typhi Ty2
agcguuaucuggucgc

SEQ ID NO: 3683692 - RNA, 20 nt, Salmonella enterica enterica serovar Typhi Ty2
agcguucucacggucuccug

SEQ ID NO: 3683693 - RNA, 18 nt, Salmonella enterica enterica serovar Typhi Ty2
agcguucugcacgccggu

SEQ ID NO: 3683694 - RNA, 14 nt, Salmonella enterica enterica serovar Typhi Ty2
agcguuucaaccgc

SEQ ID NO: 3683695 - RNA, 15 nt, Salmonella enterica enterica serovar Typhi Ty2
agcuuacuuugcgcc

SEQ ID NO: 3683696 - RNA, 18 nt, Salmonella enterica enterica serovar Typhi Ty2
agcuuagaacucacgcuc

SEQ ID NO: 3683697 - RNA, 18 nt, Salmonella enterica enterica serovar Typhi Ty2
agcuuaggauucgccauu

SEQ ID NO: 3683698 - RNA, 14 nt, Salmonella enterica enterica serovar Typhi Ty2
agcuuauccugccc

SEQ ID NO: 3683699 - RNA, 23 nt, Salmonella enterica enterica serovar Typhi Ty2
agcuuaucgaacugugagccuaa

SEQ ID NO: 3683700 - RNA, 18 nt, Salmonella enterica enterica serovar Typhi Ty2
agcuuaucgccaaagaua

SEQ ID NO: 3683701 - RNA, 22 nt, Salmonella enterica enterica serovar Typhi Ty2
agcuuaucgccaaagauauagu

SEQ ID NO: 3683702 - RNA, 23 nt, Salmonella enterica enterica serovar Typhi Ty2
agcuuaucugaccaugccagcaa

SEQ ID NO: 3683703 - RNA, 16 nt, Salmonella enterica enterica serovar Typhi Ty2
agcuuauuccagucau

SEQ ID NO: 3683704 - RNA, 17 nt, Salmonella enterica enterica serovar Typhi Ty2
agcuuauuccagucauu

SEQ ID NO: 3683705 - RNA, 13 nt, Salmonella enterica enterica serovar Typhi Ty2
agcuucaugcgcc

SEQ ID NO: 3683706 - RNA, 22 nt, Salmonella enterica enterica serovar Typhi Ty2
agcuuccagcaaaccuuccgcc

SEQ ID NO: 3683707 - RNA, 17 nt, Salmonella enterica enterica serovar Typhi Ty2
agcuucgcccaggcggg

SEQ ID NO: 3683708 - RNA, 16 nt, Salmonella enterica enterica serovar Typhi Ty2
agcuugaaagcgcaaa

SEQ ID NO: 3683709 - RNA, 14 nt, Salmonella enterica enterica serovar Typhi Ty2
agcuugaucaucag

SEQ ID NO: 3683710 - RNA, 12 nt, Salmonella enterica enterica serovar Typhi Ty2
agcuugccgcca

SEQ ID NO: 3683711 - RNA, 22 nt, Salmonella enterica enterica serovar Typhi Ty2
agcuugccgccaauaggggcgg

SEQ ID NO: 3683712 - RNA, 15 nt, Salmonella enterica enterica serovar Typhi Ty2
agcuugccguagcgc

SEQ ID NO: 3683713 - RNA, 22 nt, Salmonella enterica enterica serovar Typhi Ty2
agcuugcgauccauauaaucaa

SEQ ID NO: 3683714 - RNA, 22 nt, Salmonella enterica enterica serovar Typhi Ty2
agcuuggccaguggggcugcug

SEQ ID NO: 3683715 - RNA, 20 nt, Salmonella enterica enterica serovar Typhi Ty2
agcuuggcggcuuccuguuu

SEQ ID NO: 3683716 - RNA, 21 nt, Salmonella enterica enterica serovar Typhi Ty2
agcuuguuguuuauccugcaa

SEQ ID NO: 3683717 - RNA, 16 nt, Salmonella enterica enterica serovar Typhi Ty2
agcuuugccacuggcu

SEQ ID NO: 3683718 - RNA, 20 nt, Salmonella enterica enterica serovar Typhi Ty2
agcuuuucauauagucauaa

SEQ ID NO: 3683719 - RNA, 22 nt, Salmonella enterica enterica serovar Typhi Ty2
agcuuuucaugacgcucuccuc

SEQ ID NO: 3683720 - RNA, 21 nt, Salmonella enterica enterica serovar Typhi Ty2
agcuuuuuacucagggcaaaa

SEQ ID NO: 3683721 - RNA, 15 nt, Salmonella enterica enterica serovar Typhi Ty2
agcuuuuuauuacuu

SEQ ID NO: 3683722 - RNA, 14 nt, Salmonella enterica enterica serovar Typhi Ty2
aggaaaaaugagac

SEQ ID NO: 3683723 - RNA, 13 nt, Salmonella enterica enterica serovar Typhi Ty2
aggaaaacgcuuc

SEQ ID NO: 3683724 - RNA, 22 nt, Salmonella enterica enterica serovar Typhi Ty2
aggaaaagaccauccgguuuua

SEQ ID NO: 3683725 - RNA, 14 nt, Salmonella enterica enterica serovar Typhi Ty2
aggaaaagcuguag

SEQ ID NO: 3683726 - RNA, 15 nt, Salmonella enterica enterica serovar Typhi Ty2
aggaaaagucauuuu

SEQ ID NO: 3683727 - RNA, 23 nt, Salmonella enterica enterica serovar Typhi Ty2
aggaaacauaaggguaagcaaua

SEQ ID NO: 3683728 - RNA, 12 nt, Salmonella enterica enterica serovar Typhi Ty2
aggaaaggcaga

SEQ ID NO: 3683729 - RNA, 12 nt, Salmonella enterica enterica serovar Typhi Ty2
aggaaauaacgu

SEQ ID NO: 3683730 - RNA, 14 nt, Salmonella enterica enterica serovar Typhi Ty2
aggaaauaacgugc

SEQ ID NO: 3683731 - RNA, 12 nt, Salmonella enterica enterica serovar Typhi Ty2
aggaaauccagc

SEQ ID NO: 3683732 - RNA, 21 nt, Salmonella enterica enterica serovar Typhi Ty2
aggaaauccagcagaauaaca

SEQ ID NO: 3683733 - RNA, 13 nt, Salmonella enterica enterica serovar Typhi Ty2
aggaaauucugac

SEQ ID NO: 3683734 - RNA, 14 nt, Salmonella enterica enterica serovar Typhi Ty2
aggaaauucugacg

SEQ ID NO: 3683735 - RNA, 14 nt, Salmonella enterica enterica serovar Typhi Ty2
aggaacagauacug

SEQ ID NO: 3683736 - RNA, 13 nt, Salmonella enterica enterica serovar Typhi Ty2
aggaacagugaca

SEQ ID NO: 3683737 - RNA, 18 nt, Salmonella enterica enterica serovar Typhi Ty2
aggaacagugacaaacuc

SEQ ID NO: 3683738 - RNA, 21 nt, Salmonella enterica enterica serovar Typhi Ty2
aggaacaucagccagcagcuc

SEQ ID NO: 3683739 - RNA, 18 nt, Salmonella enterica enterica serovar Typhi Ty2
aggaacaucgacccccac

SEQ ID NO: 3683740 - RNA, 20 nt, Salmonella enterica enterica serovar Typhi Ty2
aggaacaucgacccccaccu

SEQ ID NO: 3683741 - RNA, 18 nt, Salmonella enterica enterica serovar Typhi Ty2
aggaacgcgcagaccguu

SEQ ID NO: 3683742 - RNA, 23 nt, Salmonella enterica enterica serovar Typhi Ty2
aggaacgcgcagaccguuuucaa

SEQ ID NO: 3683743 - RNA, 18 nt, Salmonella enterica enterica serovar Typhi Ty2
aggaacugcggccagaca

SEQ ID NO: 3683744 - RNA, 22 nt, Salmonella enterica enterica serovar Typhi Ty2
aggaagacuauccagccaggga

SEQ ID NO: 3683745 - RNA, 14 nt, Salmonella enterica enterica serovar Typhi Ty2
aggaagacuucguu

SEQ ID NO: 3683746 - RNA, 22 nt, Salmonella enterica enterica serovar Typhi Ty2
aggaagcccucggcgaacaggc

SEQ ID NO: 3683747 - RNA, 19 nt, Salmonella enterica enterica serovar Typhi Ty2
aggaagcugcgcagcacuu

SEQ ID NO: 3683748 - RNA, 17 nt, Salmonella enterica enterica serovar Typhi Ty2
aggaaggaaacuuauuu

SEQ ID NO: 3683749 - RNA, 20 nt, Salmonella enterica enterica serovar Typhi Ty2
aggaaggcgguaagagagug

SEQ ID NO: 3683750 - RNA, 20 nt, Salmonella enterica enterica serovar Typhi Ty2
aggaaggucgcauccgcguu

SEQ ID NO: 3683751 - RNA, 20 nt, Salmonella enterica enterica serovar Typhi Ty2
aggaaggucuugauggcgau

SEQ ID NO: 3683752 - RNA, 22 nt, Salmonella enterica enterica serovar Typhi Ty2
aggaagucagcuuccugcacgc

SEQ ID NO: 3683753 - RNA, 22 nt, Salmonella enterica enterica serovar Typhi Ty2
aggaauaacaucguaaaucaaa

SEQ ID NO: 3683754 - RNA, 13 nt, Salmonella enterica enterica serovar Typhi Ty2
aggaauaacgcgc

SEQ ID NO: 3683755 - RNA, 20 nt, Salmonella enterica enterica serovar Typhi Ty2
aggaauacaaaaaagccgau

SEQ ID NO: 3683756 - RNA, 15 nt, Salmonella enterica enterica serovar Typhi Ty2
aggaauauaccauca

SEQ ID NO: 3683757 - RNA, 18 nt, Salmonella enterica enterica serovar Typhi Ty2
aggaaucgcuaaggcggc

SEQ ID NO: 3683758 - RNA, 14 nt, Salmonella enterica enterica serovar Typhi Ty2
aggaaugaaaacga

SEQ ID NO: 3683759 - RNA, 19 nt, Salmonella enterica enterica serovar Typhi Ty2
aggaaugaaaacgaaucga

SEQ ID NO: 3683760 - RNA, 17 nt, Salmonella enterica enterica serovar Typhi Ty2
aggaaugcccagcucag

SEQ ID NO: 3683761 - RNA, 20 nt, Salmonella enterica enterica serovar Typhi Ty2
aggaaugcccagcucagcuu

SEQ ID NO: 3683762 - RNA, 21 nt, Salmonella enterica enterica serovar Typhi Ty2
aggaauuuucccauaaaagag

SEQ ID NO: 3683763 - RNA, 22 nt, Salmonella enterica enterica serovar Typhi Ty2
aggaauuuucccauaaaagagc

SEQ ID NO: 3683764 - RNA, 14 nt, Salmonella enterica enterica serovar Typhi Ty2
aggacacaguaaug

SEQ ID NO: 3683765 - RNA, 20 nt, Salmonella enterica enterica serovar Typhi Ty2
aggacagacagacguugcgc

SEQ ID NO: 3683766 - RNA, 12 nt, Salmonella enterica enterica serovar Typhi Ty2
aggacaucaaag

SEQ ID NO: 3683767 - RNA, 16 nt, Salmonella enterica enterica serovar Typhi Ty2
aggacaucaaaggcag

SEQ ID NO: 3683768 - RNA, 14 nt, Salmonella enterica enterica serovar Typhi Ty2
aggaccaacaccag

SEQ ID NO: 3683769 - RNA, 14 nt, Salmonella enterica enterica serovar Typhi Ty2
aggacgccagugaa

SEQ ID NO: 3683770 - RNA, 16 nt, Salmonella enterica enterica serovar Typhi Ty2
aggacgggacuugaac

SEQ ID NO: 3683771 - RNA, 14 nt, Salmonella enterica enterica serovar Typhi Ty2
aggacguucuucuc

SEQ ID NO: 3683772 - RNA, 21 nt, Salmonella enterica enterica serovar Typhi Ty2
aggacugacggaagagcucga

SEQ ID NO: 3683773 - RNA, 17 nt, Salmonella enterica enterica serovar Typhi Ty2
aggacugauacagccaa

SEQ ID NO: 3683774 - RNA, 19 nt, Salmonella enterica enterica serovar Typhi Ty2
aggagagucgauacgcuga

SEQ ID NO: 3683775 - RNA, 14 nt, Salmonella enterica enterica serovar Typhi Ty2
aggagaugucccac

SEQ ID NO: 3683776 - RNA, 14 nt, Salmonella enterica enterica serovar Typhi Ty2
aggagcaaaccgac

SEQ ID NO: 3683777 - RNA, 23 nt, Salmonella enterica enterica serovar Typhi Ty2
aggccagaugguaagcauagcgc

SEQ ID NO: 3683778 - RNA, 16 nt, Salmonella enterica enterica serovar Typhi Ty2
aggccagcgucaccuc

SEQ ID NO: 3683779 - RNA, 20 nt, Salmonella enterica enterica serovar Typhi Ty2
aggccagcuacaccugggcu

SEQ ID NO: 3683780 - RNA, 23 nt, Salmonella enterica enterica serovar Typhi Ty2
aggccagugccaagcaacacggc

SEQ ID NO: 3683781 - RNA, 20 nt, Salmonella enterica enterica serovar Typhi Ty2
aggcccggcaaggaaggaaa

SEQ ID NO: 3683782 - RNA, 22 nt, Salmonella enterica enterica serovar Typhi Ty2
aggcccguucacguuuuuacuc

SEQ ID NO: 3683783 - RNA, 23 nt, Salmonella enterica enterica serovar Typhi Ty2
aggccgacaaaugacgucagcaa

SEQ ID NO: 3683784 - RNA, 16 nt, Salmonella enterica enterica serovar Typhi Ty2
aggccgcaaacagcac

SEQ ID NO: 3683785 - RNA, 14 nt, Salmonella enterica enterica serovar Typhi Ty2
aggccgccaaugac

SEQ ID NO: 3683786 - RNA, 15 nt, Salmonella enterica enterica serovar Typhi Ty2
aggccgccagcaaac

SEQ ID NO: 3683787 - RNA, 22 nt, Salmonella enterica enterica serovar Typhi Ty2
aggccgccgaggcuaagccaga

SEQ ID NO: 3683788 - RNA, 10 nt, Salmonella enterica enterica serovar Typhi Ty2
aggccgccgc

SEQ ID NO: 3683789 - RNA, 18 nt, Salmonella enterica enterica serovar Typhi Ty2
aggccgccgcacaggcga

SEQ ID NO: 3683790 - RNA, 16 nt, Salmonella enterica enterica serovar Typhi Ty2
aggccgcuuaauaaua

SEQ ID NO: 3683791 - RNA, 12 nt, Salmonella enterica enterica serovar Typhi Ty2
aggccggauaag

SEQ ID NO: 3683792 - RNA, 23 nt, Salmonella enterica enterica serovar Typhi Ty2
aggccggauaagagaauccgaca

SEQ ID NO: 3683793 - RNA, 18 nt, Salmonella enterica enterica serovar Typhi Ty2
aggccggauaagcaacgc

SEQ ID NO: 3683794 - RNA, 15 nt, Salmonella enterica enterica serovar Typhi Ty2
aggccggauaagccg

SEQ ID NO: 3683795 - RNA, 18 nt, Salmonella enterica enterica serovar Typhi Ty2
aggccggauaaggcgcag

SEQ ID NO: 3683796 - RNA, 21 nt, Salmonella enterica enterica serovar Typhi Ty2
aggccggcgaagauccgcuca

SEQ ID NO: 3683797 - RNA, 14 nt, Salmonella enterica enterica serovar Typhi Ty2
aggccgggaaaucu

SEQ ID NO: 3683798 - RNA, 21 nt, Salmonella enterica enterica serovar Typhi Ty2
aggccgguuguuuacacggca

SEQ ID NO: 3683799 - RNA, 14 nt, Salmonella enterica enterica serovar Typhi Ty2
aggccuacaagaau

SEQ ID NO: 3683800 - RNA, 16 nt, Salmonella enterica enterica serovar Typhi Ty2
aggccuacaaucgugu

SEQ ID NO: 3683801 - RNA, 13 nt, Salmonella enterica enterica serovar Typhi Ty2
aggccuaccagcc

SEQ ID NO: 3683802 - RNA, 20 nt, Salmonella enterica enterica serovar Typhi Ty2
aggccucguuuugcugccac

SEQ ID NO: 3683803 - RNA, 22 nt, Salmonella enterica enterica serovar Typhi Ty2
aggccucuuucaugcggucuuc

SEQ ID NO: 3683804 - RNA, 23 nt, Salmonella enterica enterica serovar Typhi Ty2
aggccugauaagacgcaucgcgu

SEQ ID NO: 3683805 - RNA, 18 nt, Salmonella enterica enterica serovar Typhi Ty2
aggccugcaaaccucucc

SEQ ID NO: 3683806 - RNA, 18 nt, Salmonella enterica enterica serovar Typhi Ty2
aggccugccggguuuaau

SEQ ID NO: 3683807 - RNA, 16 nt, Salmonella enterica enterica serovar Typhi Ty2
aggccugguuaacaau

SEQ ID NO: 3683808 - RNA, 18 nt, Salmonella enterica enterica serovar Typhi Ty2
aggccugguuaacaauau

SEQ ID NO: 3683809 - RNA, 17 nt, Salmonella enterica enterica serovar Typhi Ty2
aggccuuuucguacaug

SEQ ID NO: 3683810 - RNA, 18 nt, Salmonella enterica enterica serovar Typhi Ty2
aggccuuuugcagcagcg

SEQ ID NO: 3683811 - RNA, 21 nt, Salmonella enterica enterica serovar Typhi Ty2
aggcgaacauaagagauggaa

SEQ ID NO: 3683812 - RNA, 15 nt, Salmonella enterica enterica serovar Typhi Ty2
aggcgacaaucucac

SEQ ID NO: 3683813 - RNA, 18 nt, Salmonella enterica enterica serovar Typhi Ty2
aggcgaccaauauccgca

SEQ ID NO: 3683814 - RNA, 14 nt, Salmonella enterica enterica serovar Typhi Ty2
aggcgacccauaac

SEQ ID NO: 3683815 - RNA, 16 nt, Salmonella enterica enterica serovar Typhi Ty2
aggcgacgccgccauc

SEQ ID NO: 3683816 - RNA, 23 nt, Salmonella enterica enterica serovar Typhi Ty2
aggcgacuaccguucacggcgau

SEQ ID NO: 3683817 - RNA, 15 nt, Salmonella enterica enterica serovar Typhi Ty2
aggcgauagccccag

SEQ ID NO: 3683818 - RNA, 15 nt, Salmonella enterica enterica serovar Typhi Ty2
aggcgauagccgucc

SEQ ID NO: 3683819 - RNA, 21 nt, Salmonella enterica enterica serovar Typhi Ty2
aggcgauccuguucaaacauc

SEQ ID NO: 3683820 - RNA, 22 nt, Salmonella enterica enterica serovar Typhi Ty2
aggcgaucggcgugaauaaaau

SEQ ID NO: 3683821 - RNA, 13 nt, Salmonella enterica enterica serovar Typhi Ty2
aggcgcaaaacca

SEQ ID NO: 3683822 - RNA, 18 nt, Salmonella enterica enterica serovar Typhi Ty2
aggcgcaaaaccauacug

SEQ ID NO: 3683823 - RNA, 14 nt, Salmonella enterica enterica serovar Typhi Ty2
aggcgcaaaccggu

SEQ ID NO: 3683824 - RNA, 13 nt, Salmonella enterica enterica serovar Typhi Ty2
aggcgcagccgcc

SEQ ID NO: 3683825 - RNA, 14 nt, Salmonella enterica enterica serovar Typhi Ty2
aggcgcauaucgcc

SEQ ID NO: 3683826 - RNA, 15 nt, Salmonella enterica enterica serovar Typhi Ty2
aggcgcauaucgccc

SEQ ID NO: 3683827 - RNA, 15 nt, Salmonella enterica enterica serovar Typhi Ty2
aggcgcaucagaaaa

SEQ ID NO: 3683828 - RNA, 22 nt, Salmonella enterica enterica serovar Typhi Ty2
aggcgccgcucaucaccagcag

SEQ ID NO: 3683829 - RNA, 22 nt, Salmonella enterica enterica serovar Typhi Ty2
aggcgccucgcgcggcgguuca

SEQ ID NO: 3683830 - RNA, 21 nt, Salmonella enterica enterica serovar Typhi Ty2
aggcgcgaaaaauaggauggc

SEQ ID NO: 3683831 - RNA, 14 nt, Salmonella enterica enterica serovar Typhi Ty2
aggcgcgcagcugc

SEQ ID NO: 3683832 - RNA, 17 nt, Salmonella enterica enterica serovar Typhi Ty2
aggcgcgcagcugccac

SEQ ID NO: 3683833 - RNA, 17 nt, Salmonella enterica enterica serovar Typhi Ty2
aggcgcggucuggccug

SEQ ID NO: 3683834 - RNA, 17 nt, Salmonella enterica enterica serovar Typhi Ty2
aggcgcguuuacuggcg

SEQ ID NO: 3683835 - RNA, 18 nt, Salmonella enterica enterica serovar Typhi Ty2
aggcgcguuuacuggcga

SEQ ID NO: 3683836 - RNA, 21 nt, Salmonella enterica enterica serovar Typhi Ty2
aggcgcguuuacuggcgacga

SEQ ID NO: 3683837 - RNA, 18 nt, Salmonella enterica enterica serovar Typhi Ty2
aggcgcuaauuaauucua

SEQ ID NO: 3683838 - RNA, 21 nt, Salmonella enterica enterica serovar Typhi Ty2
aggcgcuaugcuuaccaucug

SEQ ID NO: 3683839 - RNA, 22 nt, Salmonella enterica enterica serovar Typhi Ty2
aggcgcucggccagauaacgcg

SEQ ID NO: 3683840 - RNA, 21 nt, Salmonella enterica enterica serovar Typhi Ty2
aggcgcugcguaguaccagua

SEQ ID NO: 3683841 - RNA, 21 nt, Salmonella enterica enterica serovar Typhi Ty2
aggcggaaaacauucgcccgu

SEQ ID NO: 3683842 - RNA, 20 nt, Salmonella enterica enterica serovar Typhi Ty2
aggcggauacagcggcgcgc

SEQ ID NO: 3683843 - RNA, 18 nt, Salmonella enterica enterica serovar Typhi Ty2
aggcggcggcgggaaguu

SEQ ID NO: 3683844 - RNA, 16 nt, Salmonella enterica enterica serovar Typhi Ty2
aggcggcuaccgccgu

SEQ ID NO: 3683845 - RNA, 18 nt, Salmonella enterica enterica serovar Typhi Ty2
aggcgggcuuuuuuugcc

SEQ ID NO: 3683846 - RNA, 16 nt, Salmonella enterica enterica serovar Typhi Ty2
aggcguaaaauugccg

SEQ ID NO: 3683847 - RNA, 14 nt, Salmonella enterica enterica serovar Typhi Ty2
aggcguaaccgcca

SEQ ID NO: 3683848 - RNA, 16 nt, Salmonella enterica enterica serovar Typhi Ty2
aggcguaaccgccauc

SEQ ID NO: 3683849 - RNA, 18 nt, Salmonella enterica enterica serovar Typhi Ty2
aggcgucauagccgcgcg

SEQ ID NO: 3683850 - RNA, 17 nt, Salmonella enterica enterica serovar Typhi Ty2
aggcgucgaccggucca

SEQ ID NO: 3683851 - RNA, 19 nt, Salmonella enterica enterica serovar Typhi Ty2
aggcgucgaccgguccacc

SEQ ID NO: 3683852 - RNA, 18 nt, Salmonella enterica enterica serovar Typhi Ty2
aggcgugccccgcaacgc

SEQ ID NO: 3683853 - RNA, 23 nt, Salmonella enterica enterica serovar Typhi Ty2
aggcgugcguauugccccgucag

SEQ ID NO: 3683854 - RNA, 21 nt, Salmonella enterica enterica serovar Typhi Ty2
aggcgugguggauauccagca

SEQ ID NO: 3683855 - RNA, 20 nt, Salmonella enterica enterica serovar Typhi Ty2
aggcguuaccgggcaaacgg

SEQ ID NO: 3683856 - RNA, 15 nt, Salmonella enterica enterica serovar Typhi Ty2
aggcguucaugccuu

SEQ ID NO: 3683857 - RNA, 18 nt, Salmonella enterica enterica serovar Typhi Ty2
aggcguugcuccagcagc

SEQ ID NO: 3683858 - RNA, 18 nt, Salmonella enterica enterica serovar Typhi Ty2
aggcguuuacgcugcuau

SEQ ID NO: 3683859 - RNA, 16 nt, Salmonella enterica enterica serovar Typhi Ty2
agggugaauaccagcg

SEQ ID NO: 3683860 - RNA, 14 nt, Salmonella enterica enterica serovar Typhi Ty2
agggugagagggga

SEQ ID NO: 3683861 - RNA, 15 nt, Salmonella enterica enterica serovar Typhi Ty2
agggugcaaagaaac

SEQ ID NO: 3683862 - RNA, 13 nt, Salmonella enterica enterica serovar Typhi Ty2
aggguugccagag

SEQ ID NO: 3683863 - RNA, 23 nt, Salmonella enterica enterica serovar Typhi Ty2
agguaaagccgccauccggcauu

SEQ ID NO: 3683864 - RNA, 20 nt, Salmonella enterica enterica serovar Typhi Ty2
agguaaaggucguuaggcca

SEQ ID NO: 3683865 - RNA, 13 nt, Salmonella enterica enterica serovar Typhi Ty2
agguaacauacaa

SEQ ID NO: 3683866 - RNA, 19 nt, Salmonella enterica enterica serovar Typhi Ty2
agguaacgcgaaaaaagau

SEQ ID NO: 3683867 - RNA, 22 nt, Salmonella enterica enterica serovar Typhi Ty2
agguaacugcacaagccccacg

SEQ ID NO: 3683868 - RNA, 16 nt, Salmonella enterica enterica serovar Typhi Ty2
agguacagaugcugua

SEQ ID NO: 3683869 - RNA, 14 nt, Salmonella enterica enterica serovar Typhi Ty2
agguacgcguuuca

SEQ ID NO: 3683870 - RNA, 22 nt, Salmonella enterica enterica serovar Typhi Ty2
agguacggggcaucuauuuaac

SEQ ID NO: 3683871 - RNA, 21 nt, Salmonella enterica enterica serovar Typhi Ty2
agguacugcauaauggcgacg

SEQ ID NO: 3683872 - RNA, 13 nt, Salmonella enterica enterica serovar Typhi Ty2
agguauccagcag

SEQ ID NO: 3683873 - RNA, 14 nt, Salmonella enterica enterica serovar Typhi Ty2
agguauccagcaga

SEQ ID NO: 3683874 - RNA, 14 nt, Salmonella enterica enterica serovar Typhi Ty2
agguauccgccaua

SEQ ID NO: 3683875 - RNA, 17 nt, Salmonella enterica enterica serovar Typhi Ty2
agguaugcuucagcguu

SEQ ID NO: 3683876 - RNA, 16 nt, Salmonella enterica enterica serovar Typhi Ty2
agguauguaguaaaua

SEQ ID NO: 3683877 - RNA, 14 nt, Salmonella enterica enterica serovar Typhi Ty2
agguauuaaauaca

SEQ ID NO: 3683878 - RNA, 18 nt, Salmonella enterica enterica serovar Typhi Ty2
agguauucuaacugauca

SEQ ID NO: 3683879 - RNA, 21 nt, Salmonella enterica enterica serovar Typhi Ty2
agguauugauuuuuaaaaugu

SEQ ID NO: 3683880 - RNA, 14 nt, Salmonella enterica enterica serovar Typhi Ty2
agguauuuagccac

SEQ ID NO: 3683881 - RNA, 18 nt, Salmonella enterica enterica serovar Typhi Ty2
aggucaucaccuccagca

SEQ ID NO: 3683882 - RNA, 19 nt, Salmonella enterica enterica serovar Typhi Ty2
aggucaucuuucagaugca

SEQ ID NO: 3683883 - RNA, 20 nt, Salmonella enterica enterica serovar Typhi Ty2
agguccagggaaaaauagcg

SEQ ID NO: 3683884 - RNA, 22 nt, Salmonella enterica enterica serovar Typhi Ty2
aggucgaaaacggccaauccug

SEQ ID NO: 3683885 - RNA, 14 nt, Salmonella enterica enterica serovar Typhi Ty2
aggucgacauuuaa

SEQ ID NO: 3683886 - RNA, 14 nt, Salmonella enterica enterica serovar Typhi Ty2
aggucggacguugc

SEQ ID NO: 3683887 - RNA, 15 nt, Salmonella enterica enterica serovar Typhi Ty2
aggucggguaagcgu

SEQ ID NO: 3683888 - RNA, 22 nt, Salmonella enterica enterica serovar Typhi Ty2
aggucguaaggauacucagcga

SEQ ID NO: 3683889 - RNA, 22 nt, Salmonella enterica enterica serovar Typhi Ty2
aggucguuaggccacuucacac

SEQ ID NO: 3683890 - RNA, 22 nt, Salmonella enterica enterica serovar Typhi Ty2
aggucguuucccccgcaacaaa

SEQ ID NO: 3683891 - RNA, 23 nt, Salmonella enterica enterica serovar Typhi Ty2
aggucugagauaauacauaucau

SEQ ID NO: 3683892 - RNA, 22 nt, Salmonella enterica enterica serovar Typhi Ty2
aggucuuuaucuaucaccgccu

SEQ ID NO: 3683893 - RNA, 17 nt, Salmonella enterica enterica serovar Typhi Ty2
aggugaaauaggggaga

SEQ ID NO: 3683894 - RNA, 19 nt, Salmonella enterica enterica serovar Typhi Ty2
aggugaacauuacaaugua

SEQ ID NO: 3683895 - RNA, 19 nt, Salmonella enterica enterica serovar Typhi Ty2
aggugacgccaugcaaaaa

SEQ ID NO: 3683896 - RNA, 17 nt, Salmonella enterica enterica serovar Typhi Ty2
aggugauguccagacca

SEQ ID NO: 3683897 - RNA, 17 nt, Salmonella enterica enterica serovar Typhi Ty2
aggugccuggguuccag

SEQ ID NO: 3683898 - RNA, 15 nt, Salmonella enterica enterica serovar Typhi Ty2
aggugcggcugggcg

SEQ ID NO: 3683899 - RNA, 19 nt, Salmonella enterica enterica serovar Typhi Ty2
aggugcggcugggcgaggc

SEQ ID NO: 3683900 - RNA, 14 nt, Salmonella enterica enterica serovar Typhi Ty2
aggugcuuaucuga

SEQ ID NO: 3683901 - RNA, 21 nt, Salmonella enterica enterica serovar Typhi Ty2
agguggcccauuuuggccgcu

SEQ ID NO: 3683902 - RNA, 17 nt, Salmonella enterica enterica serovar Typhi Ty2
agguggccgagaggcug

SEQ ID NO: 3683903 - RNA, 16 nt, Salmonella enterica enterica serovar Typhi Ty2
agguggguuccagcgc

SEQ ID NO: 3683904 - RNA, 20 nt, Salmonella enterica enterica serovar Typhi Ty2
agguguaaaccguuuuuccg

SEQ ID NO: 3683905 - RNA, 17 nt, Salmonella enterica enterica serovar Typhi Ty2
aggugucagauccuuca

SEQ ID NO: 3683906 - RNA, 22 nt, Salmonella enterica enterica serovar Typhi Ty2
aggugugguacggcuuucacac

SEQ ID NO: 3683907 - RNA, 22 nt, Salmonella enterica enterica serovar Typhi Ty2
agguguucagguaaaugaggac

SEQ ID NO: 3683908 - RNA, 17 nt, Salmonella enterica enterica serovar Typhi Ty2
agguguuuacgccgcca

SEQ ID NO: 3683909 - RNA, 15 nt, Salmonella enterica enterica serovar Typhi Ty2
agguuaaauagcagg

SEQ ID NO: 3683910 - RNA, 14 nt, Salmonella enterica enterica serovar Typhi Ty2
agguuaagccucac

SEQ ID NO: 3683911 - RNA, 14 nt, Salmonella enterica enterica serovar Typhi Ty2
agguuaauaacugc

SEQ ID NO: 3683912 - RNA, 16 nt, Salmonella enterica enterica serovar Typhi Ty2
agguuaauaacugcgc

SEQ ID NO: 3683913 - RNA, 21 nt, Salmonella enterica enterica serovar Typhi Ty2
agguuaauauacauucauuuu

SEQ ID NO: 3683914 - RNA, 16 nt, Salmonella enterica enterica serovar Typhi Ty2
agguuacguucaucag

SEQ ID NO: 3683915 - RNA, 13 nt, Salmonella enterica enterica serovar Typhi Ty2
agguuagcagcca

SEQ ID NO: 3683916 - RNA, 16 nt, Salmonella enterica enterica serovar Typhi Ty2
agguuagguuaaauag

SEQ ID NO: 3683917 - RNA, 14 nt, Salmonella enterica enterica serovar Typhi Ty2
agguuaguaaugcc

SEQ ID NO: 3683918 - RNA, 22 nt, Salmonella enterica enterica serovar Typhi Ty2
agguuauaaacccccuggccgg

SEQ ID NO: 3683919 - RNA, 17 nt, Salmonella enterica enterica serovar Typhi Ty2
agguuaucgccgcccgu

SEQ ID NO: 3683920 - RNA, 13 nt, Salmonella enterica enterica serovar Typhi Ty2
agguuaugcgcac

SEQ ID NO: 3683921 - RNA, 17 nt, Salmonella enterica enterica serovar Typhi Ty2
agguuauucagguggau

SEQ ID NO: 3683922 - RNA, 18 nt, Salmonella enterica enterica serovar Typhi Ty2
agguuauucagguggauc

SEQ ID NO: 3683923 - RNA, 19 nt, Salmonella enterica enterica serovar Typhi Ty2
agguucaauaugccaggca

SEQ ID NO: 3683924 - RNA, 19 nt, Salmonella enterica enterica serovar Typhi Ty2
agguucauauugcgccgca

SEQ ID NO: 3683925 - RNA, 15 nt, Salmonella enterica enterica serovar Typhi Ty2
agguugcgcccggcg

SEQ ID NO: 3683926 - RNA, 16 nt, Salmonella enterica enterica serovar Typhi Ty2
agguugcgcccggcgc

SEQ ID NO: 3683927 - RNA, 16 nt, Salmonella enterica enterica serovar Typhi Ty2
agguuguuuuauuacc

SEQ ID NO: 3683928 - RNA, 15 nt, Salmonella enterica enterica serovar Typhi Ty2
agguuuaaaccacuc

SEQ ID NO: 3683929 - RNA, 21 nt, Salmonella enterica enterica serovar Typhi Ty2
agguuuaauguugccguggca

SEQ ID NO: 3683930 - RNA, 15 nt, Salmonella enterica enterica serovar Typhi Ty2
agguuucuucaucaa

SEQ ID NO: 3683931 - RNA, 16 nt, Salmonella enterica enterica serovar Typhi Ty2
agguuucuucaucaaa

SEQ ID NO: 3683932 - RNA, 20 nt, Salmonella enterica enterica serovar Typhi Ty2
agguuugaccagauaaucaa

SEQ ID NO: 3683933 - RNA, 22 nt, Salmonella enterica enterica serovar Typhi Ty2
agguuugacucgcuacgcucgc

SEQ ID NO: 3683934 - RNA, 23 nt, Salmonella enterica enterica serovar Typhi Ty2
agguuuucuaucgcuuuaaucag

SEQ ID NO: 3683935 - RNA, 16 nt, Salmonella enterica enterica serovar Typhi Ty2
aguaaaaaaaccguau

SEQ ID NO: 3683936 - RNA, 16 nt, Salmonella enterica enterica serovar Typhi Ty2
aguaaaauuuuuuuca

SEQ ID NO: 3683937 - RNA, 18 nt, Salmonella enterica enterica serovar Typhi Ty2
aguaaacuuucagaccuu

SEQ ID NO: 3683938 - RNA, 17 nt, Salmonella enterica enterica serovar Typhi Ty2
aguaaagaaauuuugca

SEQ ID NO: 3683939 - RNA, 14 nt, Salmonella enterica enterica serovar Typhi Ty2
aguaaagauuuguu

SEQ ID NO: 3683940 - RNA, 15 nt, Salmonella enterica enterica serovar Typhi Ty2
aguaaaguuauucac

SEQ ID NO: 3683941 - RNA, 14 nt, Salmonella enterica enterica serovar Typhi Ty2
agucaaagguaaua

SEQ ID NO: 3683942 - RNA, 15 nt, Salmonella enterica enterica serovar Typhi Ty2
agucaaagguaauau

SEQ ID NO: 3683943 - RNA, 12 nt, Salmonella enterica enterica serovar Typhi Ty2
agucaaauucca

SEQ ID NO: 3683944 - RNA, 15 nt, Salmonella enterica enterica serovar Typhi Ty2
agucaaauuccagca

SEQ ID NO: 3683945 - RNA, 17 nt, Salmonella enterica enterica serovar Typhi Ty2
agucaaauuccagcaau

SEQ ID NO: 3683946 - RNA, 18 nt, Salmonella enterica enterica serovar Typhi Ty2
agucaauaagcuugcuuu

SEQ ID NO: 3683947 - RNA, 23 nt, Salmonella enterica enterica serovar Typhi Ty2
agucacccugcaacauuccuugc

SEQ ID NO: 3683948 - RNA, 20 nt, Salmonella enterica enterica serovar Typhi Ty2
agucacggcucgaucccgac

SEQ ID NO: 3683949 - RNA, 20 nt, Salmonella enterica enterica serovar Typhi Ty2
agucacuagcacuacggcaa

SEQ ID NO: 3683950 - RNA, 16 nt, Salmonella enterica enterica serovar Typhi Ty2
agucacuuacuuucuu

SEQ ID NO: 3683951 - RNA, 17 nt, Salmonella enterica enterica serovar Typhi Ty2
agucacuuacuuucuug

SEQ ID NO: 3683952 - RNA, 19 nt, Salmonella enterica enterica serovar Typhi Ty2
agucacuuacuuucuugcc

SEQ ID NO: 3683953 - RNA, 21 nt, Salmonella enterica enterica serovar Typhi Ty2
agucagacaaguagccugcca

SEQ ID NO: 3683954 - RNA, 15 nt, Salmonella enterica enterica serovar Typhi Ty2
agucagcaacaugga

SEQ ID NO: 3683955 - RNA, 14 nt, Salmonella enterica enterica serovar Typhi Ty2
agucagcaauuaac

SEQ ID NO: 3683956 - RNA, 17 nt, Salmonella enterica enterica serovar Typhi Ty2
agucagcgcgagcguga

SEQ ID NO: 3683957 - RNA, 19 nt, Salmonella enterica enterica serovar Typhi Ty2
agucagcuccuuucggacu

SEQ ID NO: 3683958 - RNA, 15 nt, Salmonella enterica enterica serovar Typhi Ty2
agucagucccgcgcu

SEQ ID NO: 3683959 - RNA, 15 nt, Salmonella enterica enterica serovar Typhi Ty2
agucaguuuaugacu

SEQ ID NO: 3683960 - RNA, 15 nt, Salmonella enterica enterica serovar Typhi Ty2
agucauaauuaaaaa

SEQ ID NO: 3683961 - RNA, 15 nt, Salmonella enterica enterica serovar Typhi Ty2
agucauaccuguucc

SEQ ID NO: 3683962 - RNA, 16 nt, Salmonella enterica enterica serovar Typhi Ty2
agucauaccuguuccu

SEQ ID NO: 3683963 - RNA, 17 nt, Salmonella enterica enterica serovar Typhi Ty2
agucauauuaucgcgcu

SEQ ID NO: 3683964 - RNA, 21 nt, Salmonella enterica enterica serovar Typhi Ty2
agucauauuaucgcgcugaau

SEQ ID NO: 3683965 - RNA, 14 nt, Salmonella enterica enterica serovar Typhi Ty2
agucaucaauugcu

SEQ ID NO: 3683966 - RNA, 15 nt, Salmonella enterica enterica serovar Typhi Ty2
agucaucauaauuca

SEQ ID NO: 3683967 - RNA, 19 nt, Salmonella enterica enterica serovar Typhi Ty2
agucauccgguucauaauc

SEQ ID NO: 3683968 - RNA, 13 nt, Salmonella enterica enterica serovar Typhi Ty2
agucaucugccag

SEQ ID NO: 3683969 - RNA, 16 nt, Salmonella enterica enterica serovar Typhi Ty2
agucaucugccaguua

SEQ ID NO: 3683970 - RNA, 18 nt, Salmonella enterica enterica serovar Typhi Ty2
agucaucugccaguuauc

SEQ ID NO: 3683971 - RNA, 18 nt, Salmonella enterica enterica serovar Typhi Ty2
agucaucuguucaacuuu

SEQ ID NO: 3683972 - RNA, 18 nt, Salmonella enterica enterica serovar Typhi Ty2
agucaugaaaucuaucug

SEQ ID NO: 3683973 - RNA, 14 nt, Salmonella enterica enterica serovar Typhi Ty2
agucauggcuuuua

SEQ ID NO: 3683974 - RNA, 15 nt, Salmonella enterica enterica serovar Typhi Ty2
agucauugacagcaa

SEQ ID NO: 3683975 - RNA, 12 nt, Salmonella enterica enterica serovar Typhi Ty2
aguccaaauaag

SEQ ID NO: 3683976 - RNA, 20 nt, Salmonella enterica enterica serovar Typhi Ty2
aguccaacaaggauauccgc

SEQ ID NO: 3683977 - RNA, 19 nt, Salmonella enterica enterica serovar Typhi Ty2
aguccacguuuuacuuccu

SEQ ID NO: 3683978 - RNA, 15 nt, Salmonella enterica enterica serovar Typhi Ty2
aguccacuuucugua

SEQ ID NO: 3683979 - RNA, 14 nt, Salmonella enterica enterica serovar Typhi Ty2
aguccagcagccau

SEQ ID NO: 3683980 - RNA, 21 nt, Salmonella enterica enterica serovar Typhi Ty2
aguccauaccguuucaacugc

SEQ ID NO: 3683981 - RNA, 13 nt, Salmonella enterica enterica serovar Typhi Ty2
aguccauauccgu

SEQ ID NO: 3683982 - RNA, 21 nt, Salmonella enterica enterica serovar Typhi Ty2
aguccauauccguacauaaca

SEQ ID NO: 3683983 - RNA, 16 nt, Salmonella enterica enterica serovar Typhi Ty2
aguccaugaugaagau

SEQ ID NO: 3683984 - RNA, 20 nt, Salmonella enterica enterica serovar Typhi Ty2
agucccgcgcuuuccagccc

SEQ ID NO: 3683985 - RNA, 15 nt, Salmonella enterica enterica serovar Typhi Ty2
agucccuaauagcgc

SEQ ID NO: 3683986 - RNA, 17 nt, Salmonella enterica enterica serovar Typhi Ty2
agucccuccgcuuccac

SEQ ID NO: 3683987 - RNA, 18 nt, Salmonella enterica enterica serovar Typhi Ty2
agucccuggcgcgccagc

SEQ ID NO: 3683988 - RNA, 22 nt, Salmonella enterica enterica serovar Typhi Ty2
aguccgaagaagcgugucucuu

SEQ ID NO: 3683989 - RNA, 16 nt, Salmonella enterica enterica serovar Typhi Ty2
aguccgcacgccugca

SEQ ID NO: 3683990 - RNA, 15 nt, Salmonella enterica enterica serovar Typhi Ty2
aguccgccguugaga

SEQ ID NO: 3683991 - RNA, 22 nt, Salmonella enterica enterica serovar Typhi Ty2
aguccgcuuuucguccccuaua

SEQ ID NO: 3683992 - RNA, 14 nt, Salmonella enterica enterica serovar Typhi Ty2
aguccggcgaaaaa

SEQ ID NO: 3683993 - RNA, 22 nt, Salmonella enterica enterica serovar Typhi Ty2
aguccgggcauaaccucuccuu

SEQ ID NO: 3683994 - RNA, 19 nt, Salmonella enterica enterica serovar Typhi Ty2
aguccgggccgugacacau

SEQ ID NO: 3683995 - RNA, 17 nt, Salmonella enterica enterica serovar Typhi Ty2
aguccgguauaaaacgu

SEQ ID NO: 3683996 - RNA, 17 nt, Salmonella enterica enterica serovar Typhi Ty2
aguccgguggcgaaaac

SEQ ID NO: 3683997 - RNA, 14 nt, Salmonella enterica enterica serovar Typhi Ty2
aguccgucagaaua

SEQ ID NO: 3683998 - RNA, 21 nt, Salmonella enterica enterica serovar Typhi Ty2
aguccguggagaguuuugccg

SEQ ID NO: 3683999 - RNA, 16 nt, Salmonella enterica enterica serovar Typhi Ty2
aguccucgcccacuuc

SEQ ID NO: 3684000 - RNA, 21 nt, Salmonella enterica enterica serovar Typhi Ty2
aguccucuaucuuuucaauca

SEQ ID NO: 3684001 - RNA, 22 nt, Salmonella enterica enterica serovar Typhi Ty2
aguccugaugauggaaaacgcg

SEQ ID NO: 3684002 - RNA, 21 nt, Salmonella enterica enterica serovar Typhi Ty2
aguccugcgcuuugacauugu

SEQ ID NO: 3684003 - RNA, 20 nt, Salmonella enterica enterica serovar Typhi Ty2
aguccugcgucgcuucgcca

SEQ ID NO: 3684004 - RNA, 14 nt, Salmonella enterica enterica serovar Typhi Ty2
aguccugcucaugc

SEQ ID NO: 3684005 - RNA, 18 nt, Salmonella enterica enterica serovar Typhi Ty2
aguccuucaacccacuuu

SEQ ID NO: 3684006 - RNA, 14 nt, Salmonella enterica enterica serovar Typhi Ty2
aguccuuccgccgg

SEQ ID NO: 3684007 - RNA, 18 nt, Salmonella enterica enterica serovar Typhi Ty2
agucgaaauuuucuucuu

SEQ ID NO: 3684008 - RNA, 16 nt, Salmonella enterica enterica serovar Typhi Ty2
agucgacucaucuuuu

SEQ ID NO: 3684009 - RNA, 19 nt, Salmonella enterica enterica serovar Typhi Ty2
agucgagggugauuuccgc

SEQ ID NO: 3684010 - RNA, 19 nt, Salmonella enterica enterica serovar Typhi Ty2
agucgauguggccuuccuc

SEQ ID NO: 3684011 - RNA, 16 nt, Salmonella enterica enterica serovar Typhi Ty2
agucgcaucauggcga

SEQ ID NO: 3684012 - RNA, 14 nt, Salmonella enterica enterica serovar Typhi Ty2
agucgccagaaggc

SEQ ID NO: 3684013 - RNA, 21 nt, Salmonella enterica enterica serovar Typhi Ty2
agucgcgccgugcccagcauc

SEQ ID NO: 3684014 - RNA, 16 nt, Salmonella enterica enterica serovar Typhi Ty2
agucgcucuaucgccu

SEQ ID NO: 3684015 - RNA, 20 nt, Salmonella enterica enterica serovar Typhi Ty2
agucgcuuaucugcugcugg

SEQ ID NO: 3684016 - RNA, 18 nt, Salmonella enterica enterica serovar Typhi Ty2
agucggaucaugaaaaau

SEQ ID NO: 3684017 - RNA, 18 nt, Salmonella enterica enterica serovar Typhi Ty2
agucggcgaacuucgcgg

SEQ ID NO: 3684018 - RNA, 17 nt, Salmonella enterica enterica serovar Typhi Ty2
agucgggaaagggcggc

SEQ ID NO: 3684019 - RNA, 16 nt, Salmonella enterica enterica serovar Typhi Ty2
agucgggaucgccaga

SEQ ID NO: 3684020 - RNA, 23 nt, Salmonella enterica enterica serovar Typhi Ty2
agucgggcgugccguccugugcu

SEQ ID NO: 3684021 - RNA, 22 nt, Salmonella enterica enterica serovar Typhi Ty2
agucggggcguaaaaauuuucc

SEQ ID NO: 3684022 - RNA, 21 nt, Salmonella enterica enterica serovar Typhi Ty2
agucgguuaugcauugcugau

SEQ ID NO: 3684023 - RNA, 22 nt, Salmonella enterica enterica serovar Typhi Ty2
aguguaaaaauuuuugaucugc

SEQ ID NO: 3684024 - RNA, 21 nt, Salmonella enterica enterica serovar Typhi Ty2
aguguccacucgcucauuugc

SEQ ID NO: 3684025 - RNA, 13 nt, Salmonella enterica enterica serovar Typhi Ty2
agugucgccauaa

SEQ ID NO: 3684026 - RNA, 17 nt, Salmonella enterica enterica serovar Typhi Ty2
agugucgccauaaauca

SEQ ID NO: 3684027 - RNA, 19 nt, Salmonella enterica enterica serovar Typhi Ty2
agugucgcccgcucaggga

SEQ ID NO: 3684028 - RNA, 19 nt, Salmonella enterica enterica serovar Typhi Ty2
agugugauaagccccuuua

SEQ ID NO: 3684029 - RNA, 22 nt, Salmonella enterica enterica serovar Typhi Ty2
agugugcaaacgauaaaagcuc

SEQ ID NO: 3684030 - RNA, 20 nt, Salmonella enterica enterica serovar Typhi Ty2
aguguggaugucauaauugc

SEQ ID NO: 3684031 - RNA, 17 nt, Salmonella enterica enterica serovar Typhi Ty2
aguguguaccagcagcg

SEQ ID NO: 3684032 - RNA, 20 nt, Salmonella enterica enterica serovar Typhi Ty2
aguguguaccagcagcgcca

SEQ ID NO: 3684033 - RNA, 13 nt, Salmonella enterica enterica serovar Typhi Ty2
aguguuaucgccg

SEQ ID NO: 3684034 - RNA, 21 nt, Salmonella enterica enterica serovar Typhi Ty2
aguguuggaugaaccauauca

SEQ ID NO: 3684035 - RNA, 18 nt, Salmonella enterica enterica serovar Typhi Ty2
aguguuucccaacaaugc

SEQ ID NO: 3684036 - RNA, 12 nt, Salmonella enterica enterica serovar Typhi Ty2
aguguuuccggc

SEQ ID NO: 3684037 - RNA, 14 nt, Salmonella enterica enterica serovar Typhi Ty2
aguuaaauaaacaa

SEQ ID NO: 3684038 - RNA, 15 nt, Salmonella enterica enterica serovar Typhi Ty2
aguuaaauaaacaaa

SEQ ID NO: 3684039 - RNA, 16 nt, Salmonella enterica enterica serovar Typhi Ty2
aguuaaauaaacaaaa

SEQ ID NO: 3684040 - RNA, 22 nt, Salmonella enterica enterica serovar Typhi Ty2
aguuaaauaaacaaaaaccugc

SEQ ID NO: 3684041 - RNA, 23 nt, Salmonella enterica enterica serovar Typhi Ty2
aguuaacagaaugcugaacagcc

SEQ ID NO: 3684042 - RNA, 21 nt, Salmonella enterica enterica serovar Typhi Ty2
aguuaaucagcgccgucgcca

SEQ ID NO: 3684043 - RNA, 21 nt, Salmonella enterica enterica serovar Typhi Ty2
aguuaccauccauuaaaaucu

SEQ ID NO: 3684044 - RNA, 15 nt, Salmonella enterica enterica serovar Typhi Ty2
aguuacgcacgccag

SEQ ID NO: 3684045 - RNA, 19 nt, Salmonella enterica enterica serovar Typhi Ty2
aguuacgcacgccagauaa

SEQ ID NO: 3684046 - RNA, 16 nt, Salmonella enterica enterica serovar Typhi Ty2
aguuacuuuccauaua

SEQ ID NO: 3684047 - RNA, 12 nt, Salmonella enterica enterica serovar Typhi Ty2
aguuaucacguu

SEQ ID NO: 3684048 - RNA, 21 nt, Salmonella enterica enterica serovar Typhi Ty2
aguuaucauuauauagucuua

SEQ ID NO: 3684049 - RNA, 15 nt, Salmonella enterica enterica serovar Typhi Ty2
aguuauccagcgccc

SEQ ID NO: 3684050 - RNA, 18 nt, Salmonella enterica enterica serovar Typhi Ty2
aguuaucgguaauugcgc

SEQ ID NO: 3684051 - RNA, 19 nt, Salmonella enterica enterica serovar Typhi Ty2
aguuauguuauccccacuu

SEQ ID NO: 3684052 - RNA, 16 nt, Salmonella enterica enterica serovar Typhi Ty2
aguucaccaguuuuuc

SEQ ID NO: 3684053 - RNA, 13 nt, Salmonella enterica enterica serovar Typhi Ty2
aguucagcagcac

SEQ ID NO: 3684054 - RNA, 15 nt, Salmonella enterica enterica serovar Typhi Ty2
aguucagcagcacca

SEQ ID NO: 3684055 - RNA, 17 nt, Salmonella enterica enterica serovar Typhi Ty2
aguucaggcacgugcau

SEQ ID NO: 3684056 - RNA, 17 nt, Salmonella enterica enterica serovar Typhi Ty2
aguucauagccguggcu

SEQ ID NO: 3684057 - RNA, 15 nt, Salmonella enterica enterica serovar Typhi Ty2
aguuccaaucucuuu

SEQ ID NO: 3684058 - RNA, 17 nt, Salmonella enterica enterica serovar Typhi Ty2
aguuccaggacggacau

SEQ ID NO: 3684059 - RNA, 11 nt, Salmonella enterica enterica serovar Typhi Ty2
aguucccagcg

SEQ ID NO: 3684060 - RNA, 23 nt, Salmonella enterica enterica serovar Typhi Ty2
aguucccuucuccucaacagaca

SEQ ID NO: 3684061 - RNA, 18 nt, Salmonella enterica enterica serovar Typhi Ty2
aguuccgcaauccuggcu

SEQ ID NO: 3684062 - RNA, 13 nt, Salmonella enterica enterica serovar Typhi Ty2
aguuccgccagac

SEQ ID NO: 3684063 - RNA, 19 nt, Salmonella enterica enterica serovar Typhi Ty2
aguuccgccagacucagcc

SEQ ID NO: 3684064 - RNA, 21 nt, Salmonella enterica enterica serovar Typhi Ty2
aguuccgccagacucagccag

SEQ ID NO: 3684065 - RNA, 15 nt, Salmonella enterica enterica serovar Typhi Ty2
aguucgccgccagga

SEQ ID NO: 3684066 - RNA, 13 nt, Salmonella enterica enterica serovar Typhi Ty2
aguucgccgccgg

SEQ ID NO: 3684067 - RNA, 22 nt, Salmonella enterica enterica serovar Typhi Ty2
aguucggcgauuuccagcgccg

SEQ ID NO: 3684068 - RNA, 15 nt, Salmonella enterica enterica serovar Typhi Ty2
aguucuaacaggaag

SEQ ID NO: 3684069 - RNA, 16 nt, Salmonella enterica enterica serovar Typhi Ty2
aguucuacgcugccau

SEQ ID NO: 3684070 - RNA, 17 nt, Salmonella enterica enterica serovar Typhi Ty2
aguucucgcgccaccug

SEQ ID NO: 3684071 - RNA, 18 nt, Salmonella enterica enterica serovar Typhi Ty2
aguucucgucugcugaaa

SEQ ID NO: 3684072 - RNA, 19 nt, Salmonella enterica enterica serovar Typhi Ty2
aguucuggcuuugcgccgg

SEQ ID NO: 3684073 - RNA, 21 nt, Salmonella enterica enterica serovar Typhi Ty2
aguucuggcuuugcgccggca

SEQ ID NO: 3684074 - RNA, 18 nt, Salmonella enterica enterica serovar Typhi Ty2
aguugaaaggaaaggucg

SEQ ID NO: 3684075 - RNA, 16 nt, Salmonella enterica enterica serovar Typhi Ty2
aguugaacgguaaaca

SEQ ID NO: 3684076 - RNA, 16 nt, Salmonella enterica enterica serovar Typhi Ty2
aguugaccacaucaaa

SEQ ID NO: 3684077 - RNA, 18 nt, Salmonella enterica enterica serovar Typhi Ty2
aguugauucgcuaauaau

SEQ ID NO: 3684078 - RNA, 23 nt, Salmonella enterica enterica serovar Typhi Ty2
aguugcaagucaccaucaguagc

SEQ ID NO: 3684079 - RNA, 19 nt, Salmonella enterica enterica serovar Typhi Ty2
aguugcacccgaacaacaa

SEQ ID NO: 3684080 - RNA, 21 nt, Salmonella enterica enterica serovar Typhi Ty2
aguugcauauaaggcccauac

SEQ ID NO: 3684081 - RNA, 18 nt, Salmonella enterica enterica serovar Typhi Ty2
aguugcccgacgccugca

SEQ ID NO: 3684082 - RNA, 20 nt, Salmonella enterica enterica serovar Typhi Ty2
aguugcccuuaucuggauga

SEQ ID NO: 3684083 - RNA, 13 nt, Salmonella enterica enterica serovar Typhi Ty2
aguugccuucgau

SEQ ID NO: 3684084 - RNA, 16 nt, Salmonella enterica enterica serovar Typhi Ty2
aguugcgcaggguauc

SEQ ID NO: 3684085 - RNA, 14 nt, Salmonella enterica enterica serovar Typhi Ty2
aguugcgccacugc

SEQ ID NO: 3684086 - RNA, 17 nt, Salmonella enterica enterica serovar Typhi Ty2
aguugcggcaacgugaa

SEQ ID NO: 3684087 - RNA, 12 nt, Salmonella enterica enterica serovar Typhi Ty2
aguugcugcauc

SEQ ID NO: 3684088 - RNA, 14 nt, Salmonella enterica enterica serovar Typhi Ty2
aguugcuggagcag

SEQ ID NO: 3684089 - RNA, 15 nt, Salmonella enterica enterica serovar Typhi Ty2
aguugcuuaccuugu

SEQ ID NO: 3684090 - RNA, 22 nt, Salmonella enterica enterica serovar Typhi Ty2
aguugcuuaccuuguucuucca

SEQ ID NO: 3684091 - RNA, 21 nt, Salmonella enterica enterica serovar Typhi Ty2
aguuggaaccaaacaccagau

SEQ ID NO: 3684092 - RNA, 15 nt, Salmonella enterica enterica serovar Typhi Ty2
aguuggcagggcuga

SEQ ID NO: 3684093 - RNA, 13 nt, Salmonella enterica enterica serovar Typhi Ty2
aguuggcuucagc

SEQ ID NO: 3684094 - RNA, 15 nt, Salmonella enterica enterica serovar Typhi Ty2
aguuggugggugaug

SEQ ID NO: 3684095 - RNA, 17 nt, Salmonella enterica enterica serovar Typhi Ty2
aguuguacaaacuguga

SEQ ID NO: 3684096 - RNA, 17 nt, Salmonella enterica enterica serovar Typhi Ty2
aguuguucacgggaacg

SEQ ID NO: 3684097 - RNA, 19 nt, Salmonella enterica enterica serovar Typhi Ty2
aguuguuccgcgcugaugg

SEQ ID NO: 3684098 - RNA, 18 nt, Salmonella enterica enterica serovar Typhi Ty2
aguuguucuuucaccauu

SEQ ID NO: 3684099 - RNA, 21 nt, Salmonella enterica enterica serovar Typhi Ty2
aguuguugucgagguuauaaa

SEQ ID NO: 3684100 - RNA, 22 nt, Salmonella enterica enterica serovar Typhi Ty2
aguuguuuauuccauucaucga

SEQ ID NO: 3684101 - RNA, 18 nt, Salmonella enterica enterica serovar Typhi Ty2
aguuuaaccguuccaacg

SEQ ID NO: 3684102 - RNA, 14 nt, Salmonella enterica enterica serovar Typhi Ty2
aguuuaauucuuug

SEQ ID NO: 3684103 - RNA, 15 nt, Salmonella enterica enterica serovar Typhi Ty2
aguuuagaaaauaua

SEQ ID NO: 3684104 - RNA, 22 nt, Salmonella enterica enterica serovar Typhi Ty2
aguuuagaaaauauauuggccu

SEQ ID NO: 3684105 - RNA, 20 nt, Salmonella enterica enterica serovar Typhi Ty2
auaaagggugcgcaaauugg

SEQ ID NO: 3684106 - RNA, 15 nt, Salmonella enterica enterica serovar Typhi Ty2
auaaaggucggcugc

SEQ ID NO: 3684107 - RNA, 16 nt, Salmonella enterica enterica serovar Typhi Ty2
auaaaguagccaaugc

SEQ ID NO: 3684108 - RNA, 20 nt, Salmonella enterica enterica serovar Typhi Ty2
auaaagucagacaaguagcc

SEQ ID NO: 3684109 - RNA, 23 nt, Salmonella enterica enterica serovar Typhi Ty2
auaaaguuuauuugaauagucaa

SEQ ID NO: 3684110 - RNA, 23 nt, Salmonella enterica enterica serovar Typhi Ty2
auaaauaaccgguaacugucaga

SEQ ID NO: 3684111 - RNA, 20 nt, Salmonella enterica enterica serovar Typhi Ty2
auaaauaccgcaauaaacac

SEQ ID NO: 3684112 - RNA, 17 nt, Salmonella enterica enterica serovar Typhi Ty2
auaaauaccguaaugcc

SEQ ID NO: 3684113 - RNA, 14 nt, Salmonella enterica enterica serovar Typhi Ty2
auaaauagcgcugg

SEQ ID NO: 3684114 - RNA, 15 nt, Salmonella enterica enterica serovar Typhi Ty2
auaaauauaagaucu

SEQ ID NO: 3684115 - RNA, 14 nt, Salmonella enterica enterica serovar Typhi Ty2
auaaauauccuccg

SEQ ID NO: 3684116 - RNA, 14 nt, Salmonella enterica enterica serovar Typhi Ty2
auaaaucagcccga

SEQ ID NO: 3684117 - RNA, 16 nt, Salmonella enterica enterica serovar Typhi Ty2
auaaaucaggaaaaag

SEQ ID NO: 3684118 - RNA, 17 nt, Salmonella enterica enterica serovar Typhi Ty2
auaaaucgcagauagca

SEQ ID NO: 3684119 - RNA, 16 nt, Salmonella enterica enterica serovar Typhi Ty2
auaaaugaauuauuuu

SEQ ID NO: 3684120 - RNA, 20 nt, Salmonella enterica enterica serovar Typhi Ty2
auaaaugaggcuguuuuuua

SEQ ID NO: 3684121 - RNA, 18 nt, Salmonella enterica enterica serovar Typhi Ty2
auaaauguacugcaauaa

SEQ ID NO: 3684122 - RNA, 19 nt, Salmonella enterica enterica serovar Typhi Ty2
auaaauucugucucaauaa

SEQ ID NO: 3684123 - RNA, 14 nt, Salmonella enterica enterica serovar Typhi Ty2
auaaauuucagugg

SEQ ID NO: 3684124 - RNA, 20 nt, Salmonella enterica enterica serovar Typhi Ty2
auaaauuugucagacaugau

SEQ ID NO: 3684125 - RNA, 14 nt, Salmonella enterica enterica serovar Typhi Ty2
auaaauuuuuuaac

SEQ ID NO: 3684126 - RNA, 18 nt, Salmonella enterica enterica serovar Typhi Ty2
auaaauuuuuuaacagaa

SEQ ID NO: 3684127 - RNA, 14 nt, Salmonella enterica enterica serovar Typhi Ty2
auaacaaacgccgc

SEQ ID NO: 3684128 - RNA, 18 nt, Salmonella enterica enterica serovar Typhi Ty2
auaacaauauuaaauaaa

SEQ ID NO: 3684129 - RNA, 12 nt, Salmonella enterica enterica serovar Typhi Ty2
auaacaucaucc

SEQ ID NO: 3684130 - RNA, 14 nt, Salmonella enterica enterica serovar Typhi Ty2
auaacaucuuccau

SEQ ID NO: 3684131 - RNA, 21 nt, Salmonella enterica enterica serovar Typhi Ty2
auaaccaaacgcgcauuuuau

SEQ ID NO: 3684132 - RNA, 14 nt, Salmonella enterica enterica serovar Typhi Ty2
auaaccaauaauug

SEQ ID NO: 3684133 - RNA, 16 nt, Salmonella enterica enterica serovar Typhi Ty2
auaaccacgaaaauua

SEQ ID NO: 3684134 - RNA, 17 nt, Salmonella enterica enterica serovar Typhi Ty2
auaaccacgaaaauuau

SEQ ID NO: 3684135 - RNA, 16 nt, Salmonella enterica enterica serovar Typhi Ty2
auaaccagaaaaccga

SEQ ID NO: 3684136 - RNA, 22 nt, Salmonella enterica enterica serovar Typhi Ty2
auaaccagaaaaccgacagcaa

SEQ ID NO: 3684137 - RNA, 15 nt, Salmonella enterica enterica serovar Typhi Ty2
auaaccaugcucagc

SEQ ID NO: 3684138 - RNA, 22 nt, Salmonella enterica enterica serovar Typhi Ty2
auaaccggugccgaaaucauca

SEQ ID NO: 3684139 - RNA, 16 nt, Salmonella enterica enterica serovar Typhi Ty2
auaaccuauuuugcaa

SEQ ID NO: 3684140 - RNA, 23 nt, Salmonella enterica enterica serovar Typhi Ty2
auaaccucaacgucgcucagaau

SEQ ID NO: 3684141 - RNA, 19 nt, Salmonella enterica enterica serovar Typhi Ty2
auaaccucaaugauuuccg

SEQ ID NO: 3684142 - RNA, 15 nt, Salmonella enterica enterica serovar Typhi Ty2
auaacgaaaaggguc

SEQ ID NO: 3684143 - RNA, 20 nt, Salmonella enterica enterica serovar Typhi Ty2
auaacgaccaaacaagaucg

SEQ ID NO: 3684144 - RNA, 16 nt, Salmonella enterica enterica serovar Typhi Ty2
auaacgauaugagcua

SEQ ID NO: 3684145 - RNA, 15 nt, Salmonella enterica enterica serovar Typhi Ty2
auaacgaugauuauu

SEQ ID NO: 3684146 - RNA, 18 nt, Salmonella enterica enterica serovar Typhi Ty2
auaacgcaacgucagcga

SEQ ID NO: 3684147 - RNA, 22 nt, Salmonella enterica enterica serovar Typhi Ty2
auaacgcaggcgauagccccag

SEQ ID NO: 3684148 - RNA, 22 nt, Salmonella enterica enterica serovar Typhi Ty2
auaacgccgaugccgccgacaa

SEQ ID NO: 3684149 - RNA, 19 nt, Salmonella enterica enterica serovar Typhi Ty2
auaacgccgcccccaugcc

SEQ ID NO: 3684150 - RNA, 17 nt, Salmonella enterica enterica serovar Typhi Ty2
auaacgccgguuccaac

SEQ ID NO: 3684151 - RNA, 23 nt, Salmonella enterica enterica serovar Typhi Ty2
auaacgcgagaagaagaauuauu

SEQ ID NO: 3684152 - RNA, 18 nt, Salmonella enterica enterica serovar Typhi Ty2
auaacgcguucuggcgau

SEQ ID NO: 3684153 - RNA, 20 nt, Salmonella enterica enterica serovar Typhi Ty2
auaacgugccgaccagcggu

SEQ ID NO: 3684154 - RNA, 15 nt, Salmonella enterica enterica serovar Typhi Ty2
auaacguguuaugcg

SEQ ID NO: 3684155 - RNA, 19 nt, Salmonella enterica enterica serovar Typhi Ty2
auaacguuacauuuuccau

SEQ ID NO: 3684156 - RNA, 15 nt, Salmonella enterica enterica serovar Typhi Ty2
auaacguuguggaau

SEQ ID NO: 3684157 - RNA, 13 nt, Salmonella enterica enterica serovar Typhi Ty2
auaacguuuucag

SEQ ID NO: 3684158 - RNA, 18 nt, Salmonella enterica enterica serovar Typhi Ty2
auaacucaauagcggugc

SEQ ID NO: 3684159 - RNA, 19 nt, Salmonella enterica enterica serovar Typhi Ty2
auaacucgaauuguuaaaa

SEQ ID NO: 3684160 - RNA, 17 nt, Salmonella enterica enterica serovar Typhi Ty2
auaacucuuaauuauaa

SEQ ID NO: 3684161 - RNA, 12 nt, Salmonella enterica enterica serovar Typhi Ty2
auaacucuucau

SEQ ID NO: 3684162 - RNA, 14 nt, Salmonella enterica enterica serovar Typhi Ty2
auaacuuuccugcc

SEQ ID NO: 3684163 - RNA, 20 nt, Salmonella enterica enterica serovar Typhi Ty2
auaacuuuccugccuucuga

SEQ ID NO: 3684164 - RNA, 19 nt, Salmonella enterica enterica serovar Typhi Ty2
auaagaaaaaacuggugca

SEQ ID NO: 3684165 - RNA, 16 nt, Salmonella enterica enterica serovar Typhi Ty2
auaagaaagauaaaau

SEQ ID NO: 3684166 - RNA, 24 nt, Salmonella enterica enterica serovar Typhi Ty2
auaagaaauaguucaucgugaaau

SEQ ID NO: 3684167 - RNA, 16 nt, Salmonella enterica enterica serovar Typhi Ty2
auaagaaguaaacaga

SEQ ID NO: 3684168 - RNA, 17 nt, Salmonella enterica enterica serovar Typhi Ty2
auaagaaguaaacagaa

SEQ ID NO: 3684169 - RNA, 15 nt, Salmonella enterica enterica serovar Typhi Ty2
auaagaucuuccggc

SEQ ID NO: 3684170 - RNA, 17 nt, Salmonella enterica enterica serovar Typhi Ty2
auaagcacaccauuuca

SEQ ID NO: 3684171 - RNA, 21 nt, Salmonella enterica enterica serovar Typhi Ty2
auaagcacaccauuucacaaa

SEQ ID NO: 3684172 - RNA, 17 nt, Salmonella enterica enterica serovar Typhi Ty2
auaagccacuucaacca

SEQ ID NO: 3684173 - RNA, 12 nt, Salmonella enterica enterica serovar Typhi Ty2
auaagccagccc

SEQ ID NO: 3684174 - RNA, 16 nt, Salmonella enterica enterica serovar Typhi Ty2
auaagccagguuuuca

SEQ ID NO: 3684175 - RNA, 20 nt, Salmonella enterica enterica serovar Typhi Ty2
auaagccgaucuuuaccuca

SEQ ID NO: 3684176 - RNA, 18 nt, Salmonella enterica enterica serovar Typhi Ty2
auaagccgcguucugucg

SEQ ID NO: 3684177 - RNA, 18 nt, Salmonella enterica enterica serovar Typhi Ty2
auaagcgcagcgccauca

SEQ ID NO: 3684178 - RNA, 17 nt, Salmonella enterica enterica serovar Typhi Ty2
auaagcgccgucauccg

SEQ ID NO: 3684179 - RNA, 15 nt, Salmonella enterica enterica serovar Typhi Ty2
auaagcgcucaggca

SEQ ID NO: 3684180 - RNA, 22 nt, Salmonella enterica enterica serovar Typhi Ty2
auaagcguagcgccaucaggcu

SEQ ID NO: 3684181 - RNA, 13 nt, Salmonella enterica enterica serovar Typhi Ty2
auaagcgucagcg

SEQ ID NO: 3684182 - RNA, 15 nt, Salmonella enterica enterica serovar Typhi Ty2
auaagcgucugcaau

SEQ ID NO: 3684183 - RNA, 17 nt, Salmonella enterica enterica serovar Typhi Ty2
auaagcgugcgccaucc

SEQ ID NO: 3684184 - RNA, 17 nt, Salmonella enterica enterica serovar Typhi Ty2
auaagcuauugcgcuuu

SEQ ID NO: 3684185 - RNA, 19 nt, Salmonella enterica enterica serovar Typhi Ty2
auaagcugcgacaacaagu

SEQ ID NO: 3684186 - RNA, 18 nt, Salmonella enterica enterica serovar Typhi Ty2
auaagcuuaggauaagaa

SEQ ID NO: 3684187 - RNA, 14 nt, Salmonella enterica enterica serovar Typhi Ty2
auacaaaacccaua

SEQ ID NO: 3684188 - RNA, 21 nt, Salmonella enterica enterica serovar Typhi Ty2
auacaccaaacgaauuuaaau

SEQ ID NO: 3684189 - RNA, 13 nt, Salmonella enterica enterica serovar Typhi Ty2
auacaccgcaucc

SEQ ID NO: 3684190 - RNA, 18 nt, Salmonella enterica enterica serovar Typhi Ty2
auacaccgccauauauuu

SEQ ID NO: 3684191 - RNA, 20 nt, Salmonella enterica enterica serovar Typhi Ty2
auacaccucggguaaagguu

SEQ ID NO: 3684192 - RNA, 14 nt, Salmonella enterica enterica serovar Typhi Ty2
auacacgaacacag

SEQ ID NO: 3684193 - RNA, 19 nt, Salmonella enterica enterica serovar Typhi Ty2
auacacgccuuccuccagc

SEQ ID NO: 3684194 - RNA, 19 nt, Salmonella enterica enterica serovar Typhi Ty2
auacacuuuccauucgaca

SEQ ID NO: 3684195 - RNA, 12 nt, Salmonella enterica enterica serovar Typhi Ty2
auacagcagcac

SEQ ID NO: 3684196 - RNA, 23 nt, Salmonella enterica enterica serovar Typhi Ty2
auacaggcauggccuucaaucag

SEQ ID NO: 3684197 - RNA, 17 nt, Salmonella enterica enterica serovar Typhi Ty2
auacaggguuugucagc

SEQ ID NO: 3684198 - RNA, 16 nt, Salmonella enterica enterica serovar Typhi Ty2
auacagguuuuaaucg

SEQ ID NO: 3684199 - RNA, 19 nt, Salmonella enterica enterica serovar Typhi Ty2
auacaguucgacaaugucc

SEQ ID NO: 3684200 - RNA, 15 nt, Salmonella enterica enterica serovar Typhi Ty2
auacauaccacgcag

SEQ ID NO: 3684201 - RNA, 22 nt, Salmonella enterica enterica serovar Typhi Ty2
auacaucacuuuaugaccauac

SEQ ID NO: 3684202 - RNA, 18 nt, Salmonella enterica enterica serovar Typhi Ty2
auacaucaguccuguuga

SEQ ID NO: 3684203 - RNA, 18 nt, Salmonella enterica enterica serovar Typhi Ty2
auacaugccugcgccaug

SEQ ID NO: 3684204 - RNA, 21 nt, Salmonella enterica enterica serovar Typhi Ty2
auacaugccugcgccauguuc

SEQ ID NO: 3684205 - RNA, 13 nt, Salmonella enterica enterica serovar Typhi Ty2
auacaugcuacag

SEQ ID NO: 3684206 - RNA, 20 nt, Salmonella enterica enterica serovar Typhi Ty2
auacauugaguaaauaaauc

SEQ ID NO: 3684207 - RNA, 18 nt, Salmonella enterica enterica serovar Typhi Ty2
auacauuugaauaauucu

SEQ ID NO: 3684208 - RNA, 19 nt, Salmonella enterica enterica serovar Typhi Ty2
auacauuuuuguaauaaaa

SEQ ID NO: 3684209 - RNA, 13 nt, Salmonella enterica enterica serovar Typhi Ty2
auaccaaaaauaa

SEQ ID NO: 3684210 - RNA, 20 nt, Salmonella enterica enterica serovar Typhi Ty2
auaccaacaccugcugguca

SEQ ID NO: 3684211 - RNA, 17 nt, Salmonella enterica enterica serovar Typhi Ty2
auaccaaguuuggcaau

SEQ ID NO: 3684212 - RNA, 14 nt, Salmonella enterica enterica serovar Typhi Ty2
auaccacaaauuuu

SEQ ID NO: 3684213 - RNA, 15 nt, Salmonella enterica enterica serovar Typhi Ty2
auaccacaacagaau

SEQ ID NO: 3684214 - RNA, 20 nt, Salmonella enterica enterica serovar Typhi Ty2
auaccacccgcuaugaagac

SEQ ID NO: 3684215 - RNA, 16 nt, Salmonella enterica enterica serovar Typhi Ty2
auaccaccugccaaag

SEQ ID NO: 3684216 - RNA, 17 nt, Salmonella enterica enterica serovar Typhi Ty2
auaccacgcagcggcau

SEQ ID NO: 3684217 - RNA, 23 nt, Salmonella enterica enterica serovar Typhi Ty2
auaccacgcccgccgccagcauu

SEQ ID NO: 3684218 - RNA, 21 nt, Salmonella enterica enterica serovar Typhi Ty2
auaccagcggcaaacagcgac

SEQ ID NO: 3684219 - RNA, 17 nt, Salmonella enterica enterica serovar Typhi Ty2
auaccagcguaauccuc

SEQ ID NO: 3684220 - RNA, 21 nt, Salmonella enterica enterica serovar Typhi Ty2
auaccaggcacuugagaaauu

SEQ ID NO: 3684221 - RNA, 21 nt, Salmonella enterica enterica serovar Typhi Ty2
auaccaggguucgcuggccag

SEQ ID NO: 3684222 - RNA, 19 nt, Salmonella enterica enterica serovar Typhi Ty2
auaccaggugccgagguaa

SEQ ID NO: 3684223 - RNA, 20 nt, Salmonella enterica enterica serovar Typhi Ty2
auaccaugcugccauuuuau

SEQ ID NO: 3684224 - RNA, 19 nt, Salmonella enterica enterica serovar Typhi Ty2
auaccccgcacaaacgcuu

SEQ ID NO: 3684225 - RNA, 16 nt, Salmonella enterica enterica serovar Typhi Ty2
auaccccuguucaaaa

SEQ ID NO: 3684226 - RNA, 15 nt, Salmonella enterica enterica serovar Typhi Ty2
auacccggcucccau

SEQ ID NO: 3684227 - RNA, 22 nt, Salmonella enterica enterica serovar Typhi Ty2
auacccugcggcgaaacagagu

SEQ ID NO: 3684228 - RNA, 22 nt, Salmonella enterica enterica serovar Typhi Ty2
auaccgaaauccgcuuugagcu

SEQ ID NO: 3684229 - RNA, 12 nt, Salmonella enterica enterica serovar Typhi Ty2
auaccgccaucc

SEQ ID NO: 3684230 - RNA, 17 nt, Salmonella enterica enterica serovar Typhi Ty2
auaccgcguuugcgcaa

SEQ ID NO: 3684231 - RNA, 20 nt, Salmonella enterica enterica serovar Typhi Ty2
auaccgcuuuguaaaacauu

SEQ ID NO: 3684232 - RNA, 19 nt, Salmonella enterica enterica serovar Typhi Ty2
auaccggccacgagcuguc

SEQ ID NO: 3684233 - RNA, 20 nt, Salmonella enterica enterica serovar Typhi Ty2
auaccgggaaucaaugggau

SEQ ID NO: 3684234 - RNA, 13 nt, Salmonella enterica enterica serovar Typhi Ty2
auaccguaaauuu

SEQ ID NO: 3684235 - RNA, 19 nt, Salmonella enterica enterica serovar Typhi Ty2
auaccgugagcuacagcgu

SEQ ID NO: 3684236 - RNA, 19 nt, Salmonella enterica enterica serovar Typhi Ty2
auaccguuuggaucugucg

SEQ ID NO: 3684237 - RNA, 16 nt, Salmonella enterica enterica serovar Typhi Ty2
auaccuaacucuuccg

SEQ ID NO: 3684238 - RNA, 20 nt, Salmonella enterica enterica serovar Typhi Ty2
auaccuaacucuuccgcaau

SEQ ID NO: 3684239 - RNA, 19 nt, Salmonella enterica enterica serovar Typhi Ty2
auaccuacuuuauuuuucg

SEQ ID NO: 3684240 - RNA, 16 nt, Salmonella enterica enterica serovar Typhi Ty2
auaccuauaaaaauga

SEQ ID NO: 3684241 - RNA, 15 nt, Salmonella enterica enterica serovar Typhi Ty2
auaccugucggcaaa

SEQ ID NO: 3684242 - RNA, 17 nt, Salmonella enterica enterica serovar Typhi Ty2
auaccuucccgcgauaa

SEQ ID NO: 3684243 - RNA, 22 nt, Salmonella enterica enterica serovar Typhi Ty2
auaccuucgugaugugguugug

SEQ ID NO: 3684244 - RNA, 22 nt, Salmonella enterica enterica serovar Typhi Ty2
auaccuucuucacuaaaaacag

SEQ ID NO: 3684245 - RNA, 13 nt, Salmonella enterica enterica serovar Typhi Ty2
auacgaaugggua

SEQ ID NO: 3684246 - RNA, 15 nt, Salmonella enterica enterica serovar Typhi Ty2
auacgacgcguguug

SEQ ID NO: 3684247 - RNA, 15 nt, Salmonella enterica enterica serovar Typhi Ty2
auacgaucgcgcaca

SEQ ID NO: 3684248 - RNA, 12 nt, Salmonella enterica enterica serovar Typhi Ty2
auacgcaccagc

SEQ ID NO: 3684249 - RNA, 17 nt, Salmonella enterica enterica serovar Typhi Ty2
auacgcaccagcucuac

SEQ ID NO: 3684250 - RNA, 22 nt, Salmonella enterica enterica serovar Typhi Ty2
auacgcagaucuuuuugcuccu

SEQ ID NO: 3684251 - RNA, 19 nt, Salmonella enterica enterica serovar Typhi Ty2
auacgcagcauuucgucga

SEQ ID NO: 3684252 - RNA, 14 nt, Salmonella enterica enterica serovar Typhi Ty2
auacgccaucuuuc

SEQ ID NO: 3684253 - RNA, 18 nt, Salmonella enterica enterica serovar Typhi Ty2
auacgccgccagcaauac

SEQ ID NO: 3684254 - RNA, 13 nt, Salmonella enterica enterica serovar Typhi Ty2
auacgccgucacg

SEQ ID NO: 3684255 - RNA, 16 nt, Salmonella enterica enterica serovar Typhi Ty2
auacgcgucaaauaga

SEQ ID NO: 3684256 - RNA, 20 nt, Salmonella enterica enterica serovar Typhi Ty2
auacgcgucaaauagagaaa

SEQ ID NO: 3684257 - RNA, 14 nt, Salmonella enterica enterica serovar Typhi Ty2
auacgcucaauaua

SEQ ID NO: 3684258 - RNA, 15 nt, Salmonella enterica enterica serovar Typhi Ty2
auacgcucgcgguuu

SEQ ID NO: 3684259 - RNA, 15 nt, Salmonella enterica enterica serovar Typhi Ty2
auacgcugaagcuug

SEQ ID NO: 3684260 - RNA, 17 nt, Salmonella enterica enterica serovar Typhi Ty2
auacgcugcaccauuuu

SEQ ID NO: 3684261 - RNA, 15 nt, Salmonella enterica enterica serovar Typhi Ty2
auacgcugcgucagg

SEQ ID NO: 3684262 - RNA, 17 nt, Salmonella enterica enterica serovar Typhi Ty2
auacggauucuugacgu

SEQ ID NO: 3684263 - RNA, 21 nt, Salmonella enterica enterica serovar Typhi Ty2
auacggcggcaaugccgccgu

SEQ ID NO: 3684264 - RNA, 23 nt, Salmonella enterica enterica serovar Typhi Ty2
auacggcgugauguagcuugaaa

SEQ ID NO: 3684265 - RNA, 13 nt, Salmonella enterica enterica serovar Typhi Ty2
auacggggacaga

SEQ ID NO: 3684266 - RNA, 15 nt, Salmonella enterica enterica serovar Typhi Ty2
auacggggucuaagg

SEQ ID NO: 3684267 - RNA, 15 nt, Salmonella enterica enterica serovar Typhi Ty2
auacgguaauaacuc

SEQ ID NO: 3684268 - RNA, 20 nt, Salmonella enterica enterica serovar Typhi Ty2
auacgucauaucauccagcc

SEQ ID NO: 3684269 - RNA, 17 nt, Salmonella enterica enterica serovar Typhi Ty2
auagcgccaucaggcau

SEQ ID NO: 3684270 - RNA, 16 nt, Salmonella enterica enterica serovar Typhi Ty2
auagcgccauccugcc

SEQ ID NO: 3684271 - RNA, 21 nt, Salmonella enterica enterica serovar Typhi Ty2
auagcgccccggugcuuucuc

SEQ ID NO: 3684272 - RNA, 14 nt, Salmonella enterica enterica serovar Typhi Ty2
auagcgccgcaucg

SEQ ID NO: 3684273 - RNA, 16 nt, Salmonella enterica enterica serovar Typhi Ty2
auagcgccgcaucgau

SEQ ID NO: 3684274 - RNA, 17 nt, Salmonella enterica enterica serovar Typhi Ty2
auagcgcgaaugauuuu

SEQ ID NO: 3684275 - RNA, 14 nt, Salmonella enterica enterica serovar Typhi Ty2
auagcgcgcuaaac

SEQ ID NO: 3684276 - RNA, 18 nt, Salmonella enterica enterica serovar Typhi Ty2
auagcgcgucguugccuu

SEQ ID NO: 3684277 - RNA, 23 nt, Salmonella enterica enterica serovar Typhi Ty2
auagcgcuaugcgcuccaggaug

SEQ ID NO: 3684278 - RNA, 16 nt, Salmonella enterica enterica serovar Typhi Ty2
auagcgcugaugcguu

SEQ ID NO: 3684279 - RNA, 23 nt, Salmonella enterica enterica serovar Typhi Ty2
auagcgcugcgccagaucaggcg

SEQ ID NO: 3684280 - RNA, 17 nt, Salmonella enterica enterica serovar Typhi Ty2
auagcggccagauggca

SEQ ID NO: 3684281 - RNA, 20 nt, Salmonella enterica enterica serovar Typhi Ty2
auagcggcguuuauauaaaa

SEQ ID NO: 3684282 - RNA, 21 nt, Salmonella enterica enterica serovar Typhi Ty2
auagcggcguuuauauaaaaa

SEQ ID NO: 3684283 - RNA, 14 nt, Salmonella enterica enterica serovar Typhi Ty2
auagcggcuaccgc

SEQ ID NO: 3684284 - RNA, 21 nt, Salmonella enterica enterica serovar Typhi Ty2
auagcgggcuuccuucuaccg

SEQ ID NO: 3684285 - RNA, 14 nt, Salmonella enterica enterica serovar Typhi Ty2
auagcggguaaaca

SEQ ID NO: 3684286 - RNA, 22 nt, Salmonella enterica enterica serovar Typhi Ty2
auagcgguacccggucccuggc

SEQ ID NO: 3684287 - RNA, 17 nt, Salmonella enterica enterica serovar Typhi Ty2
auagcguagcgccaucc

SEQ ID NO: 3684288 - RNA, 16 nt, Salmonella enterica enterica serovar Typhi Ty2
auagcguugauaugcu

SEQ ID NO: 3684289 - RNA, 23 nt, Salmonella enterica enterica serovar Typhi Ty2
auagcguuuuauccguuuccgca

SEQ ID NO: 3684290 - RNA, 14 nt, Salmonella enterica enterica serovar Typhi Ty2
auagcuaaauaaaa

SEQ ID NO: 3684291 - RNA, 16 nt, Salmonella enterica enterica serovar Typhi Ty2
auagcuaaauaaaaau

SEQ ID NO: 3684292 - RNA, 16 nt, Salmonella enterica enterica serovar Typhi Ty2
auagcuauccacgcag

SEQ ID NO: 3684293 - RNA, 15 nt, Salmonella enterica enterica serovar Typhi Ty2
auagcuauggucacu

SEQ ID NO: 3684294 - RNA, 14 nt, Salmonella enterica enterica serovar Typhi Ty2
auagcugaacauac

SEQ ID NO: 3684295 - RNA, 19 nt, Salmonella enterica enterica serovar Typhi Ty2
auagcuggcugucuuccgu

SEQ ID NO: 3684296 - RNA, 20 nt, Salmonella enterica enterica serovar Typhi Ty2
auagcuggcuuuauauaaaa

SEQ ID NO: 3684297 - RNA, 18 nt, Salmonella enterica enterica serovar Typhi Ty2
auagcuguuccgcaacac

SEQ ID NO: 3684298 - RNA, 19 nt, Salmonella enterica enterica serovar Typhi Ty2
auagcuuuucaagaauuac

SEQ ID NO: 3684299 - RNA, 20 nt, Salmonella enterica enterica serovar Typhi Ty2
auagcuuuucaugacgcucu

SEQ ID NO: 3684300 - RNA, 22 nt, Salmonella enterica enterica serovar Typhi Ty2
auaggccagcuacaccugggcu

SEQ ID NO: 3684301 - RNA, 14 nt, Salmonella enterica enterica serovar Typhi Ty2
auaggcgaggaaaa

SEQ ID NO: 3684302 - RNA, 20 nt, Salmonella enterica enterica serovar Typhi Ty2
auagguuaagccaaacucac

SEQ ID NO: 3684303 - RNA, 13 nt, Salmonella enterica enterica serovar Typhi Ty2
auagguuuuaugc

SEQ ID NO: 3684304 - RNA, 13 nt, Salmonella enterica enterica serovar Typhi Ty2
auaguaaauagaa

SEQ ID NO: 3684305 - RNA, 15 nt, Salmonella enterica enterica serovar Typhi Ty2
auaguaaauagaaaa

SEQ ID NO: 3684306 - RNA, 18 nt, Salmonella enterica enterica serovar Typhi Ty2
auaguaaauagaaaauaa

SEQ ID NO: 3684307 - RNA, 23 nt, Salmonella enterica enterica serovar Typhi Ty2
auaguaaauagaaaauaauucuu

SEQ ID NO: 3684308 - RNA, 21 nt, Salmonella enterica enterica serovar Typhi Ty2
auaguacccucugcaccagaa

SEQ ID NO: 3684309 - RNA, 23 nt, Salmonella enterica enterica serovar Typhi Ty2
auaguacccucugcaccagaacu

SEQ ID NO: 3684310 - RNA, 23 nt, Salmonella enterica enterica serovar Typhi Ty2
auaguaucgcugcuaaacgagcc

SEQ ID NO: 3684311 - RNA, 20 nt, Salmonella enterica enterica serovar Typhi Ty2
auagucauaauacucaauau

SEQ ID NO: 3684312 - RNA, 17 nt, Salmonella enterica enterica serovar Typhi Ty2
auagucauaauuaaaaa

SEQ ID NO: 3684313 - RNA, 12 nt, Salmonella enterica enterica serovar Typhi Ty2
auaguccagcag

SEQ ID NO: 3684314 - RNA, 16 nt, Salmonella enterica enterica serovar Typhi Ty2
auaguccagcagccau

SEQ ID NO: 3684315 - RNA, 22 nt, Salmonella enterica enterica serovar Typhi Ty2
auagucuuguuacucaauaaaa

SEQ ID NO: 3684316 - RNA, 18 nt, Salmonella enterica enterica serovar Typhi Ty2
auagugacgccgccaucc

SEQ ID NO: 3684317 - RNA, 18 nt, Salmonella enterica enterica serovar Typhi Ty2
auagugagcgacuucaaa

SEQ ID NO: 3684318 - RNA, 14 nt, Salmonella enterica enterica serovar Typhi Ty2
auagugauaccagu

SEQ ID NO: 3684319 - RNA, 21 nt, Salmonella enterica enterica serovar Typhi Ty2
auagugcucauucguuuugcu

SEQ ID NO: 3684320 - RNA, 20 nt, Salmonella enterica enterica serovar Typhi Ty2
auagugucgccauaaaucag

SEQ ID NO: 3684321 - RNA, 21 nt, Salmonella enterica enterica serovar Typhi Ty2
auaguuauacauuuuuuucuu

SEQ ID NO: 3684322 - RNA, 19 nt, Salmonella enterica enterica serovar Typhi Ty2
auaguucaucgugaaauua

SEQ ID NO: 3684323 - RNA, 16 nt, Salmonella enterica enterica serovar Typhi Ty2
auaguugagcagcgcg

SEQ ID NO: 3684324 - RNA, 19 nt, Salmonella enterica enterica serovar Typhi Ty2
auaguuucgucgugaauua

SEQ ID NO: 3684325 - RNA, 15 nt, Salmonella enterica enterica serovar Typhi Ty2
auaguuugccagaga

SEQ ID NO: 3684326 - RNA, 18 nt, Salmonella enterica enterica serovar Typhi Ty2
auaguuuuuaauuccacc

SEQ ID NO: 3684327 - RNA, 15 nt, Salmonella enterica enterica serovar Typhi Ty2
auaguuuuuccccau

SEQ ID NO: 3684328 - RNA, 19 nt, Salmonella enterica enterica serovar Typhi Ty2
auauaaaaaacauauaauu

SEQ ID NO: 3684329 - RNA, 19 nt, Salmonella enterica enterica serovar Typhi Ty2
auauaaaaauagcuggcug

SEQ ID NO: 3684330 - RNA, 23 nt, Salmonella enterica enterica serovar Typhi Ty2
auauaaacgggcccggcuuucug

SEQ ID NO: 3684331 - RNA, 15 nt, Salmonella enterica enterica serovar Typhi Ty2
auauaaauuuggcga

SEQ ID NO: 3684332 - RNA, 15 nt, Salmonella enterica enterica serovar Typhi Ty2
auauaacagaauaag

SEQ ID NO: 3684333 - RNA, 17 nt, Salmonella enterica enterica serovar Typhi Ty2
auauaacgugccgacca

SEQ ID NO: 3684334 - RNA, 19 nt, Salmonella enterica enterica serovar Typhi Ty2
auauaagcgccgucauccg

SEQ ID NO: 3684335 - RNA, 19 nt, Salmonella enterica enterica serovar Typhi Ty2
auauaagcgguauucaggu

SEQ ID NO: 3684336 - RNA, 18 nt, Salmonella enterica enterica serovar Typhi Ty2
auauaaggaucggaagac

SEQ ID NO: 3684337 - RNA, 15 nt, Salmonella enterica enterica serovar Typhi Ty2
auauaaggugucuau

SEQ ID NO: 3684338 - RNA, 23 nt, Salmonella enterica enterica serovar Typhi Ty2
auauaauuuuauuauauuuaaaa

SEQ ID NO: 3684339 - RNA, 15 nt, Salmonella enterica enterica serovar Typhi Ty2
auauacccccugcaa

SEQ ID NO: 3684340 - RNA, 24 nt, Salmonella enterica enterica serovar Typhi Ty2
auauacgccacggccagcagccau

SEQ ID NO: 3684341 - RNA, 12 nt, Salmonella enterica enterica serovar Typhi Ty2
auauacugucuu

SEQ ID NO: 3684342 - RNA, 15 nt, Salmonella enterica enterica serovar Typhi Ty2
auauacuucaccaua

SEQ ID NO: 3684343 - RNA, 13 nt, Salmonella enterica enterica serovar Typhi Ty2
auauacuucauca

SEQ ID NO: 3684344 - RNA, 12 nt, Salmonella enterica enterica serovar Typhi Ty2
auauagacuccg

SEQ ID NO: 3684345 - RNA, 17 nt, Salmonella enterica enterica serovar Typhi Ty2
auauagccguggcuggc

SEQ ID NO: 3684346 - RNA, 23 nt, Salmonella enterica enterica serovar Typhi Ty2
auauagcuaaugcaauaaacuaa

SEQ ID NO: 3684347 - RNA, 21 nt, Salmonella enterica enterica serovar Typhi Ty2
auauauauuuucucaauuuua

SEQ ID NO: 3684348 - RNA, 20 nt, Salmonella enterica enterica serovar Typhi Ty2
auauauccgcuauuaccagu

SEQ ID NO: 3684349 - RNA, 16 nt, Salmonella enterica enterica serovar Typhi Ty2
auauauccuaacuuau

SEQ ID NO: 3684350 - RNA, 18 nt, Salmonella enterica enterica serovar Typhi Ty2
auauaucgcgucaucaaa

SEQ ID NO: 3684351 - RNA, 21 nt, Salmonella enterica enterica serovar Typhi Ty2
auaugcgucagauguucgcga

SEQ ID NO: 3684352 - RNA, 19 nt, Salmonella enterica enterica serovar Typhi Ty2
auaugcgucagcgcggcuu

SEQ ID NO: 3684353 - RNA, 17 nt, Salmonella enterica enterica serovar Typhi Ty2
auaugcguguagcagau

SEQ ID NO: 3684354 - RNA, 19 nt, Salmonella enterica enterica serovar Typhi Ty2
auaugcguugacccgucca

SEQ ID NO: 3684355 - RNA, 18 nt, Salmonella enterica enterica serovar Typhi Ty2
auaugcugaucuggcugc

SEQ ID NO: 3684356 - RNA, 17 nt, Salmonella enterica enterica serovar Typhi Ty2
auauggaugagucuugc

SEQ ID NO: 3684357 - RNA, 19 nt, Salmonella enterica enterica serovar Typhi Ty2
auauggccguuuucaugca

SEQ ID NO: 3684358 - RNA, 23 nt, Salmonella enterica enterica serovar Typhi Ty2
auauggcgcaaguguauggcugg

SEQ ID NO: 3684359 - RNA, 20 nt, Salmonella enterica enterica serovar Typhi Ty2
auaugguauucgugcaucag

SEQ ID NO: 3684360 - RNA, 15 nt, Salmonella enterica enterica serovar Typhi Ty2
auaugguuauccagc

SEQ ID NO: 3684361 - RNA, 17 nt, Salmonella enterica enterica serovar Typhi Ty2
auauguguaucuugcuu

SEQ ID NO: 3684362 - RNA, 12 nt, Salmonella enterica enterica serovar Typhi Ty2
auauguugcgcu

SEQ ID NO: 3684363 - RNA, 14 nt, Salmonella enterica enterica serovar Typhi Ty2
auauguuugcgcgu

SEQ ID NO: 3684364 - RNA, 14 nt, Salmonella enterica enterica serovar Typhi Ty2
auauuaauuaagga

SEQ ID NO: 3684365 - RNA, 14 nt, Salmonella enterica enterica serovar Typhi Ty2
auauuacaacaugu

SEQ ID NO: 3684366 - RNA, 15 nt, Salmonella enterica enterica serovar Typhi Ty2
auauuacuaauaaaa

SEQ ID NO: 3684367 - RNA, 19 nt, Salmonella enterica enterica serovar Typhi Ty2
auauuagcgguacucuuuu

SEQ ID NO: 3684368 - RNA, 22 nt, Salmonella enterica enterica serovar Typhi Ty2
auauuagcgguacucuuuuucc

SEQ ID NO: 3684369 - RNA, 16 nt, Salmonella enterica enterica serovar Typhi Ty2
auauuaguguuauaua

SEQ ID NO: 3684370 - RNA, 12 nt, Salmonella enterica enterica serovar Typhi Ty2
auauuauaaaau

SEQ ID NO: 3684371 - RNA, 12 nt, Salmonella enterica enterica serovar Typhi Ty2
auauuauauuuu

SEQ ID NO: 3684372 - RNA, 19 nt, Salmonella enterica enterica serovar Typhi Ty2
auauuaucgcgcugaauaa

SEQ ID NO: 3684373 - RNA, 19 nt, Salmonella enterica enterica serovar Typhi Ty2
auauuauucugcugaaaaa

SEQ ID NO: 3684374 - RNA, 14 nt, Salmonella enterica enterica serovar Typhi Ty2
auauucaccuguaa

SEQ ID NO: 3684375 - RNA, 22 nt, Salmonella enterica enterica serovar Typhi Ty2
auauucacuauaugccugccaa

SEQ ID NO: 3684376 - RNA, 13 nt, Salmonella enterica enterica serovar Typhi Ty2
auauucagaauuu

SEQ ID NO: 3684377 - RNA, 13 nt, Salmonella enterica enterica serovar Typhi Ty2
auauucaggagca

SEQ ID NO: 3684378 - RNA, 23 nt, Salmonella enterica enterica serovar Typhi Ty2
auauucaguacugacgcaaucug

SEQ ID NO: 3684379 - RNA, 19 nt, Salmonella enterica enterica serovar Typhi Ty2
auauucauucugucagaaa

SEQ ID NO: 3684380 - RNA, 18 nt, Salmonella enterica enterica serovar Typhi Ty2
auauuccguuugcgccgg

SEQ ID NO: 3684381 - RNA, 21 nt, Salmonella enterica enterica serovar Typhi Ty2
auauucugggcuuacuuucca

SEQ ID NO: 3684382 - RNA, 19 nt, Salmonella enterica enterica serovar Typhi Ty2
auauugaccgcuuuuucca

SEQ ID NO: 3684383 - RNA, 17 nt, Salmonella enterica enterica serovar Typhi Ty2
auauugauggccacauc

SEQ ID NO: 3684384 - RNA, 18 nt, Salmonella enterica enterica serovar Typhi Ty2
auauugauggccacaucg

SEQ ID NO: 3684385 - RNA, 12 nt, Salmonella enterica enterica serovar Typhi Ty2
auauugcauuuu

SEQ ID NO: 3684386 - RNA, 14 nt, Salmonella enterica enterica serovar Typhi Ty2
auauugcauuuuau

SEQ ID NO: 3684387 - RNA, 20 nt, Salmonella enterica enterica serovar Typhi Ty2
auauugcauuuuaucuuuug

SEQ ID NO: 3684388 - RNA, 14 nt, Salmonella enterica enterica serovar Typhi Ty2
auauugccauaaau

SEQ ID NO: 3684389 - RNA, 21 nt, Salmonella enterica enterica serovar Typhi Ty2
auauugcccaucgcgccauga

SEQ ID NO: 3684390 - RNA, 17 nt, Salmonella enterica enterica serovar Typhi Ty2
auauugcccguuuuaau

SEQ ID NO: 3684391 - RNA, 15 nt, Salmonella enterica enterica serovar Typhi Ty2
auauugccgccauua

SEQ ID NO: 3684392 - RNA, 18 nt, Salmonella enterica enterica serovar Typhi Ty2
auauugccgccauuauuc

SEQ ID NO: 3684393 - RNA, 19 nt, Salmonella enterica enterica serovar Typhi Ty2
auauugcgacaacuagaau

SEQ ID NO: 3684394 - RNA, 22 nt, Salmonella enterica enterica serovar Typhi Ty2
auauugcgacaacuagaauuuu

SEQ ID NO: 3684395 - RNA, 19 nt, Salmonella enterica enterica serovar Typhi Ty2
auauugcgcuuaccaggua

SEQ ID NO: 3684396 - RNA, 16 nt, Salmonella enterica enterica serovar Typhi Ty2
auauugcguaaaaacc

SEQ ID NO: 3684397 - RNA, 20 nt, Salmonella enterica enterica serovar Typhi Ty2
auauugcugugcuaugauaa

SEQ ID NO: 3684398 - RNA, 20 nt, Salmonella enterica enterica serovar Typhi Ty2
auauuggcgaggaacaucag

SEQ ID NO: 3684399 - RNA, 16 nt, Salmonella enterica enterica serovar Typhi Ty2
auauugucgcccugca

SEQ ID NO: 3684400 - RNA, 23 nt, Salmonella enterica enterica serovar Typhi Ty2
auauugugccucuuuuuucgcca

SEQ ID NO: 3684401 - RNA, 23 nt, Salmonella enterica enterica serovar Typhi Ty2
auauuguguuuuuuaauauauuc

SEQ ID NO: 3684402 - RNA, 11 nt, Salmonella enterica enterica serovar Typhi Ty2
auauuguugaa

SEQ ID NO: 3684403 - RNA, 21 nt, Salmonella enterica enterica serovar Typhi Ty2
auauuguuuucuauuuucucc

SEQ ID NO: 3684404 - RNA, 15 nt, Salmonella enterica enterica serovar Typhi Ty2
auauuuaaaauucca

SEQ ID NO: 3684405 - RNA, 16 nt, Salmonella enterica enterica serovar Typhi Ty2
auauuuaccgccgcuu

SEQ ID NO: 3684406 - RNA, 15 nt, Salmonella enterica enterica serovar Typhi Ty2
auauuuacugaauaa

SEQ ID NO: 3684407 - RNA, 17 nt, Salmonella enterica enterica serovar Typhi Ty2
auauuuauuuaauguuu

SEQ ID NO: 3684408 - RNA, 18 nt, Salmonella enterica enterica serovar Typhi Ty2
auauuuauuuaauguuuc

SEQ ID NO: 3684409 - RNA, 22 nt, Salmonella enterica enterica serovar Typhi Ty2
auauuuauuugcauuguacuuu

SEQ ID NO: 3684410 - RNA, 13 nt, Salmonella enterica enterica serovar Typhi Ty2
auauuuccgcgau

SEQ ID NO: 3684411 - RNA, 19 nt, Salmonella enterica enterica serovar Typhi Ty2
auauuugcgugucaucaaa

SEQ ID NO: 3684412 - RNA, 13 nt, Salmonella enterica enterica serovar Typhi Ty2
auauuuguaucug

SEQ ID NO: 3684413 - RNA, 20 nt, Salmonella enterica enterica serovar Typhi Ty2
auauuugugaccaacaucau

SEQ ID NO: 3684414 - RNA, 13 nt, Salmonella enterica enterica serovar Typhi Ty2
auauuuuguaguu

SEQ ID NO: 3684415 - RNA, 21 nt, Salmonella enterica enterica serovar Typhi Ty2
auauuuuguuuuaaauucaac

SEQ ID NO: 3684416 - RNA, 10 nt, Salmonella enterica enterica serovar Typhi Ty2
auauuuuuaa

SEQ ID NO: 3684417 - RNA, 20 nt, Salmonella enterica enterica serovar Typhi Ty2
auauuuuuacgucccgguaa

SEQ ID NO: 3684418 - RNA, 16 nt, Salmonella enterica enterica serovar Typhi Ty2
auauuuuucacacaua

SEQ ID NO: 3684419 - RNA, 17 nt, Salmonella enterica enterica serovar Typhi Ty2
auauuuuucagcuucug

SEQ ID NO: 3684420 - RNA, 12 nt, Salmonella enterica enterica serovar Typhi Ty2
auauuuuucccu

SEQ ID NO: 3684421 - RNA, 14 nt, Salmonella enterica enterica serovar Typhi Ty2
aucaaaacauuaga

SEQ ID NO: 3684422 - RNA, 23 nt, Salmonella enterica enterica serovar Typhi Ty2
aucaaaacuacgccaaugaacuc

SEQ ID NO: 3684423 - RNA, 16 nt, Salmonella enterica enterica serovar Typhi Ty2
aucaaaaucaucgcca

SEQ ID NO: 3684424 - RNA, 19 nt, Salmonella enterica enterica serovar Typhi Ty2
aucaaacaaaccaaacuga

SEQ ID NO: 3684425 - RNA, 20 nt, Salmonella enterica enterica serovar Typhi Ty2
aucaaacaggacuucucccu

SEQ ID NO: 3684426 - RNA, 18 nt, Salmonella enterica enterica serovar Typhi Ty2
aucaaaccaucccagguu

SEQ ID NO: 3684427 - RNA, 20 nt, Salmonella enterica enterica serovar Typhi Ty2
aucaaacccuuccgcaucga

SEQ ID NO: 3684428 - RNA, 24 nt, Salmonella enterica enterica serovar Typhi Ty2
aucaaaccgauagcuaucacacau

SEQ ID NO: 3684429 - RNA, 14 nt, Salmonella enterica enterica serovar Typhi Ty2
aucaaacuucguua

SEQ ID NO: 3684430 - RNA, 23 nt, Salmonella enterica enterica serovar Typhi Ty2
aucaaacuugcccagcgccuucu

SEQ ID NO: 3684431 - RNA, 19 nt, Salmonella enterica enterica serovar Typhi Ty2
aucaaacuuuuaaauugaa

SEQ ID NO: 3684432 - RNA, 21 nt, Salmonella enterica enterica serovar Typhi Ty2
aucaaacuuuuaaauugaaga

SEQ ID NO: 3684433 - RNA, 17 nt, Salmonella enterica enterica serovar Typhi Ty2
aucacgcauaucccacu

SEQ ID NO: 3684434 - RNA, 13 nt, Salmonella enterica enterica serovar Typhi Ty2
aucacgcaucacu

SEQ ID NO: 3684435 - RNA, 22 nt, Salmonella enterica enterica serovar Typhi Ty2
aucacgccacaguauuccggca

SEQ ID NO: 3684436 - RNA, 13 nt, Salmonella enterica enterica serovar Typhi Ty2
aucacgcccagcg

SEQ ID NO: 3684437 - RNA, 15 nt, Salmonella enterica enterica serovar Typhi Ty2
aucacgcccagcgcg

SEQ ID NO: 3684438 - RNA, 13 nt, Salmonella enterica enterica serovar Typhi Ty2
aucacgguaaacc

SEQ ID NO: 3684439 - RNA, 15 nt, Salmonella enterica enterica serovar Typhi Ty2
aucacguagccagag

SEQ ID NO: 3684440 - RNA, 15 nt, Salmonella enterica enterica serovar Typhi Ty2
aucacguccugauag

SEQ ID NO: 3684441 - RNA, 22 nt, Salmonella enterica enterica serovar Typhi Ty2
aucacguguuacgccgcaauca

SEQ ID NO: 3684442 - RNA, 20 nt, Salmonella enterica enterica serovar Typhi Ty2
aucacguuggggaauaaaua

SEQ ID NO: 3684443 - RNA, 21 nt, Salmonella enterica enterica serovar Typhi Ty2
aucacguuggggaauaaauau

SEQ ID NO: 3684444 - RNA, 22 nt, Salmonella enterica enterica serovar Typhi Ty2
aucacuaacugaccauauauga

SEQ ID NO: 3684445 - RNA, 15 nt, Salmonella enterica enterica serovar Typhi Ty2
aucacuaagaccagc

SEQ ID NO: 3684446 - RNA, 13 nt, Salmonella enterica enterica serovar Typhi Ty2
aucacuaauuugc

SEQ ID NO: 3684447 - RNA, 16 nt, Salmonella enterica enterica serovar Typhi Ty2
aucacuaccgccauca

SEQ ID NO: 3684448 - RNA, 18 nt, Salmonella enterica enterica serovar Typhi Ty2
aucacuaccgccgcggau

SEQ ID NO: 3684449 - RNA, 13 nt, Salmonella enterica enterica serovar Typhi Ty2
aucacucucuugu

SEQ ID NO: 3684450 - RNA, 13 nt, Salmonella enterica enterica serovar Typhi Ty2
aucacugauauaa

SEQ ID NO: 3684451 - RNA, 23 nt, Salmonella enterica enterica serovar Typhi Ty2
aucacugcaccucagaccguuag

SEQ ID NO: 3684452 - RNA, 21 nt, Salmonella enterica enterica serovar Typhi Ty2
aucacuuaucaaaccagcuuu

SEQ ID NO: 3684453 - RNA, 14 nt, Salmonella enterica enterica serovar Typhi Ty2
aucacuuccgccac

SEQ ID NO: 3684454 - RNA, 16 nt, Salmonella enterica enterica serovar Typhi Ty2
aucacuuccgccacca

SEQ ID NO: 3684455 - RNA, 12 nt, Salmonella enterica enterica serovar Typhi Ty2
aucacuuccugu

SEQ ID NO: 3684456 - RNA, 20 nt, Salmonella enterica enterica serovar Typhi Ty2
aucacuuuacccacaucaau

SEQ ID NO: 3684457 - RNA, 16 nt, Salmonella enterica enterica serovar Typhi Ty2
aucacuuuugauaaug

SEQ ID NO: 3684458 - RNA, 16 nt, Salmonella enterica enterica serovar Typhi Ty2
aucacuuuugccguca

SEQ ID NO: 3684459 - RNA, 14 nt, Salmonella enterica enterica serovar Typhi Ty2
aucagaaaaaauua

SEQ ID NO: 3684460 - RNA, 13 nt, Salmonella enterica enterica serovar Typhi Ty2
aucagaaaaaccu

SEQ ID NO: 3684461 - RNA, 21 nt, Salmonella enterica enterica serovar Typhi Ty2
aucagaaaaaccuccggcuau

SEQ ID NO: 3684462 - RNA, 15 nt, Salmonella enterica enterica serovar Typhi Ty2
aucagaaaacagcau

SEQ ID NO: 3684463 - RNA, 15 nt, Salmonella enterica enterica serovar Typhi Ty2
aucagaagaaauauu

SEQ ID NO: 3684464 - RNA, 15 nt, Salmonella enterica enterica serovar Typhi Ty2
aucagaagaagacaa

SEQ ID NO: 3684465 - RNA, 12 nt, Salmonella enterica enterica serovar Typhi Ty2
aucagaagcuuc

SEQ ID NO: 3684466 - RNA, 15 nt, Salmonella enterica enterica serovar Typhi Ty2
aucagaauaguuuug

SEQ ID NO: 3684467 - RNA, 17 nt, Salmonella enterica enterica serovar Typhi Ty2
aucagaauuucgcccug

SEQ ID NO: 3684468 - RNA, 23 nt, Salmonella enterica enterica serovar Typhi Ty2
aucagaauuucgcccuguauaca

SEQ ID NO: 3684469 - RNA, 18 nt, Salmonella enterica enterica serovar Typhi Ty2
aucagaccuguaaaaaaa

SEQ ID NO: 3684470 - RNA, 16 nt, Salmonella enterica enterica serovar Typhi Ty2
aucagacgcacaaucg

SEQ ID NO: 3684471 - RNA, 13 nt, Salmonella enterica enterica serovar Typhi Ty2
aucagacgcauca

SEQ ID NO: 3684472 - RNA, 22 nt, Salmonella enterica enterica serovar Typhi Ty2
aucagacgccgggccugcgccu

SEQ ID NO: 3684473 - RNA, 23 nt, Salmonella enterica enterica serovar Typhi Ty2
aucagacguuuauaccccaccau

SEQ ID NO: 3684474 - RNA, 15 nt, Salmonella enterica enterica serovar Typhi Ty2
aucagacuaucuucg

SEQ ID NO: 3684475 - RNA, 16 nt, Salmonella enterica enterica serovar Typhi Ty2
aucagacuguuacgcu

SEQ ID NO: 3684476 - RNA, 14 nt, Salmonella enterica enterica serovar Typhi Ty2
aucagagacaaaua

SEQ ID NO: 3684477 - RNA, 23 nt, Salmonella enterica enterica serovar Typhi Ty2
aucagagguaauuagaucggcaa

SEQ ID NO: 3684478 - RNA, 22 nt, Salmonella enterica enterica serovar Typhi Ty2
aucagaguaauuuguugcgcuu

SEQ ID NO: 3684479 - RNA, 19 nt, Salmonella enterica enterica serovar Typhi Ty2
aucagauacggcuccagca

SEQ ID NO: 3684480 - RNA, 20 nt, Salmonella enterica enterica serovar Typhi Ty2
aucagauacggcuccagcac

SEQ ID NO: 3684481 - RNA, 18 nt, Salmonella enterica enterica serovar Typhi Ty2
aucagauaggcggcaaau

SEQ ID NO: 3684482 - RNA, 18 nt, Salmonella enterica enterica serovar Typhi Ty2
aucagauauuccagcgac

SEQ ID NO: 3684483 - RNA, 15 nt, Salmonella enterica enterica serovar Typhi Ty2
aucagauuguugccg

SEQ ID NO: 3684484 - RNA, 20 nt, Salmonella enterica enterica serovar Typhi Ty2
aucagcaaaauaccggcagc

SEQ ID NO: 3684485 - RNA, 22 nt, Salmonella enterica enterica serovar Typhi Ty2
aucagcaaaauaccggcagcgg

SEQ ID NO: 3684486 - RNA, 14 nt, Salmonella enterica enterica serovar Typhi Ty2
aucagcaaaugaac

SEQ ID NO: 3684487 - RNA, 13 nt, Salmonella enterica enterica serovar Typhi Ty2
aucagcaacgcgc

SEQ ID NO: 3684488 - RNA, 17 nt, Salmonella enterica enterica serovar Typhi Ty2
aucagcacacuacacag

SEQ ID NO: 3684489 - RNA, 13 nt, Salmonella enterica enterica serovar Typhi Ty2
aucagcagaucca

SEQ ID NO: 3684490 - RNA, 13 nt, Salmonella enterica enterica serovar Typhi Ty2
aucagcaucccac

SEQ ID NO: 3684491 - RNA, 15 nt, Salmonella enterica enterica serovar Typhi Ty2
aucagcaucccaccg

SEQ ID NO: 3684492 - RNA, 22 nt, Salmonella enterica enterica serovar Typhi Ty2
aucagcaucuuaugcgcaaaaa

SEQ ID NO: 3684493 - RNA, 16 nt, Salmonella enterica enterica serovar Typhi Ty2
aucagccagccgccaa

SEQ ID NO: 3684494 - RNA, 21 nt, Salmonella enterica enterica serovar Typhi Ty2
aucagccagccgccaaaaaua

SEQ ID NO: 3684495 - RNA, 13 nt, Salmonella enterica enterica serovar Typhi Ty2
aucagccaggagu

SEQ ID NO: 3684496 - RNA, 17 nt, Salmonella enterica enterica serovar Typhi Ty2
aucagccauuaaccaga

SEQ ID NO: 3684497 - RNA, 22 nt, Salmonella enterica enterica serovar Typhi Ty2
aucagcccgauacccgcccaga

SEQ ID NO: 3684498 - RNA, 13 nt, Salmonella enterica enterica serovar Typhi Ty2
aucagcccgcaaa

SEQ ID NO: 3684499 - RNA, 18 nt, Salmonella enterica enterica serovar Typhi Ty2
aucagcccgcaaaggacc

SEQ ID NO: 3684500 - RNA, 23 nt, Salmonella enterica enterica serovar Typhi Ty2
aucagcccgcaaaggaccaacac

SEQ ID NO: 3684501 - RNA, 22 nt, Salmonella enterica enterica serovar Typhi Ty2
aucagcccuaucgcugcgcugc

SEQ ID NO: 3684502 - RNA, 14 nt, Salmonella enterica enterica serovar Typhi Ty2
aucagcgacucauu

SEQ ID NO: 3684503 - RNA, 17 nt, Salmonella enterica enterica serovar Typhi Ty2
aucagcgauugcgccag

SEQ ID NO: 3684504 - RNA, 22 nt, Salmonella enterica enterica serovar Typhi Ty2
aucagcgauugcgccagaccca

SEQ ID NO: 3684505 - RNA, 13 nt, Salmonella enterica enterica serovar Typhi Ty2
aucagcgccacca

SEQ ID NO: 3684506 - RNA, 15 nt, Salmonella enterica enterica serovar Typhi Ty2
aucagcgccaccaca

SEQ ID NO: 3684507 - RNA, 18 nt, Salmonella enterica enterica serovar Typhi Ty2
aucagcgccaccacaaac

SEQ ID NO: 3684508 - RNA, 13 nt, Salmonella enterica enterica serovar Typhi Ty2
aucagcgccuccg

SEQ ID NO: 3684509 - RNA, 17 nt, Salmonella enterica enterica serovar Typhi Ty2
aucagcgcgcuccagac

SEQ ID NO: 3684510 - RNA, 20 nt, Salmonella enterica enterica serovar Typhi Ty2
aucagcgcggcgaaggucgc

SEQ ID NO: 3684511 - RNA, 14 nt, Salmonella enterica enterica serovar Typhi Ty2
aucagcgcgggaua

SEQ ID NO: 3684512 - RNA, 18 nt, Salmonella enterica enterica serovar Typhi Ty2
aucagcgcguuuuccauc

SEQ ID NO: 3684513 - RNA, 14 nt, Salmonella enterica enterica serovar Typhi Ty2
aucagcgucagcag

SEQ ID NO: 3684514 - RNA, 23 nt, Salmonella enterica enterica serovar Typhi Ty2
aucagcguuucgccguaaaacaa

SEQ ID NO: 3684515 - RNA, 19 nt, Salmonella enterica enterica serovar Typhi Ty2
aucaugggcucaucaaaca

SEQ ID NO: 3684516 - RNA, 15 nt, Salmonella enterica enterica serovar Typhi Ty2
aucaugguugaaaaa

SEQ ID NO: 3684517 - RNA, 16 nt, Salmonella enterica enterica serovar Typhi Ty2
aucaugucaaauucaa

SEQ ID NO: 3684518 - RNA, 17 nt, Salmonella enterica enterica serovar Typhi Ty2
aucaugucacccacgcc

SEQ ID NO: 3684519 - RNA, 15 nt, Salmonella enterica enterica serovar Typhi Ty2
aucaugugaucuaua

SEQ ID NO: 3684520 - RNA, 18 nt, Salmonella enterica enterica serovar Typhi Ty2
aucauuaauaaccccagc

SEQ ID NO: 3684521 - RNA, 13 nt, Salmonella enterica enterica serovar Typhi Ty2
aucauuaauuuac

SEQ ID NO: 3684522 - RNA, 19 nt, Salmonella enterica enterica serovar Typhi Ty2
aucauuaauuuacugauaa

SEQ ID NO: 3684523 - RNA, 13 nt, Salmonella enterica enterica serovar Typhi Ty2
aucauuacaggcg

SEQ ID NO: 3684524 - RNA, 22 nt, Salmonella enterica enterica serovar Typhi Ty2
aucauuaccuacgcgauaaaaa

SEQ ID NO: 3684525 - RNA, 23 nt, Salmonella enterica enterica serovar Typhi Ty2
aucauuauauagucuuaauuugc

SEQ ID NO: 3684526 - RNA, 13 nt, Salmonella enterica enterica serovar Typhi Ty2
aucauuauucccc

SEQ ID NO: 3684527 - RNA, 15 nt, Salmonella enterica enterica serovar Typhi Ty2
aucauuauuccccuc

SEQ ID NO: 3684528 - RNA, 16 nt, Salmonella enterica enterica serovar Typhi Ty2
aucauucccgcccagu

SEQ ID NO: 3684529 - RNA, 22 nt, Salmonella enterica enterica serovar Typhi Ty2
aucauucccguaucuucauguu

SEQ ID NO: 3684530 - RNA, 14 nt, Salmonella enterica enterica serovar Typhi Ty2
aucauucgcgucau

SEQ ID NO: 3684531 - RNA, 22 nt, Salmonella enterica enterica serovar Typhi Ty2
aucauucgggaugcauaaaaaa

SEQ ID NO: 3684532 - RNA, 23 nt, Salmonella enterica enterica serovar Typhi Ty2
aucauucgggaugcauaaaaaaa

SEQ ID NO: 3684533 - RNA, 16 nt, Salmonella enterica enterica serovar Typhi Ty2
aucauucucuacgccc

SEQ ID NO: 3684534 - RNA, 14 nt, Salmonella enterica enterica serovar Typhi Ty2
aucauugacuucaa

SEQ ID NO: 3684535 - RNA, 15 nt, Salmonella enterica enterica serovar Typhi Ty2
aucauugauacugua

SEQ ID NO: 3684536 - RNA, 19 nt, Salmonella enterica enterica serovar Typhi Ty2
aucauugcguucaggcggc

SEQ ID NO: 3684537 - RNA, 18 nt, Salmonella enterica enterica serovar Typhi Ty2
aucauuggggaaccuggc

SEQ ID NO: 3684538 - RNA, 22 nt, Salmonella enterica enterica serovar Typhi Ty2
aucauugguuaacucaagcgaa

SEQ ID NO: 3684539 - RNA, 20 nt, Salmonella enterica enterica serovar Typhi Ty2
aucauugucauuaacgucgc

SEQ ID NO: 3684540 - RNA, 21 nt, Salmonella enterica enterica serovar Typhi Ty2
aucauuuggaggccggauaag

SEQ ID NO: 3684541 - RNA, 18 nt, Salmonella enterica enterica serovar Typhi Ty2
aucauuuguacaaaaaau

SEQ ID NO: 3684542 - RNA, 12 nt, Salmonella enterica enterica serovar Typhi Ty2
aucauuuucuuu

SEQ ID NO: 3684543 - RNA, 19 nt, Salmonella enterica enterica serovar Typhi Ty2
aucauuuuuuuggcuucug

SEQ ID NO: 3684544 - RNA, 21 nt, Salmonella enterica enterica serovar Typhi Ty2
auccaacacggcgcucaggau

SEQ ID NO: 3684545 - RNA, 12 nt, Salmonella enterica enterica serovar Typhi Ty2
auccacaaccgg

SEQ ID NO: 3684546 - RNA, 19 nt, Salmonella enterica enterica serovar Typhi Ty2
auccacaaccggcuggcua

SEQ ID NO: 3684547 - RNA, 14 nt, Salmonella enterica enterica serovar Typhi Ty2
auccacaaucgucg

SEQ ID NO: 3684548 - RNA, 16 nt, Salmonella enterica enterica serovar Typhi Ty2
auccacagcgccagaa

SEQ ID NO: 3684549 - RNA, 20 nt, Salmonella enterica enterica serovar Typhi Ty2
auccacauuccagaccugaa

SEQ ID NO: 3684550 - RNA, 17 nt, Salmonella enterica enterica serovar Typhi Ty2
auccacauugguuuugc

SEQ ID NO: 3684551 - RNA, 13 nt, Salmonella enterica enterica serovar Typhi Ty2
auccaccaccuga

SEQ ID NO: 3684552 - RNA, 20 nt, Salmonella enterica enterica serovar Typhi Ty2
auccaccaccugauucugca

SEQ ID NO: 3684553 - RNA, 15 nt, Salmonella enterica enterica serovar Typhi Ty2
auccaccagaauaaa

SEQ ID NO: 3684554 - RNA, 14 nt, Salmonella enterica enterica serovar Typhi Ty2
auccaccagcccca

SEQ ID NO: 3684555 - RNA, 13 nt, Salmonella enterica enterica serovar Typhi Ty2
auccaccagcgcc

SEQ ID NO: 3684556 - RNA, 15 nt, Salmonella enterica enterica serovar Typhi Ty2
auccaccgcccgcgu

SEQ ID NO: 3684557 - RNA, 18 nt, Salmonella enterica enterica serovar Typhi Ty2
auccaccgguacgcucca

SEQ ID NO: 3684558 - RNA, 23 nt, Salmonella enterica enterica serovar Typhi Ty2
auccacgccgcuaucgaccagca

SEQ ID NO: 3684559 - RNA, 19 nt, Salmonella enterica enterica serovar Typhi Ty2
auccacggguuacaacugc

SEQ ID NO: 3684560 - RNA, 22 nt, Salmonella enterica enterica serovar Typhi Ty2
auccacgguucucaccguggca

SEQ ID NO: 3684561 - RNA, 20 nt, Salmonella enterica enterica serovar Typhi Ty2
auccacucccugcuuuuuca

SEQ ID NO: 3684562 - RNA, 19 nt, Salmonella enterica enterica serovar Typhi Ty2
auccacuccguguugcugc

SEQ ID NO: 3684563 - RNA, 18 nt, Salmonella enterica enterica serovar Typhi Ty2
auccacugagcgcgccau

SEQ ID NO: 3684564 - RNA, 20 nt, Salmonella enterica enterica serovar Typhi Ty2
auccacuggucgucugaaag

SEQ ID NO: 3684565 - RNA, 23 nt, Salmonella enterica enterica serovar Typhi Ty2
auccagaaccguugcgcccauca

SEQ ID NO: 3684566 - RNA, 18 nt, Salmonella enterica enterica serovar Typhi Ty2
auccagaauaccagaauc

SEQ ID NO: 3684567 - RNA, 22 nt, Salmonella enterica enterica serovar Typhi Ty2
auccagacaaauaccuccuggc

SEQ ID NO: 3684568 - RNA, 13 nt, Salmonella enterica enterica serovar Typhi Ty2
auccagacccaga

SEQ ID NO: 3684569 - RNA, 17 nt, Salmonella enterica enterica serovar Typhi Ty2
auccagauauggcaaac

SEQ ID NO: 3684570 - RNA, 18 nt, Salmonella enterica enterica serovar Typhi Ty2
auccagaucggcaugaug

SEQ ID NO: 3684571 - RNA, 23 nt, Salmonella enterica enterica serovar Typhi Ty2
auccagaucggcaugauggcgaa

SEQ ID NO: 3684572 - RNA, 19 nt, Salmonella enterica enterica serovar Typhi Ty2
auccagcaaccagguaauc

SEQ ID NO: 3684573 - RNA, 20 nt, Salmonella enterica enterica serovar Typhi Ty2
auccagcaaucguccucaca

SEQ ID NO: 3684574 - RNA, 17 nt, Salmonella enterica enterica serovar Typhi Ty2
auccagcgaaccuucca

SEQ ID NO: 3684575 - RNA, 19 nt, Salmonella enterica enterica serovar Typhi Ty2
auccagcgaaccuuccauc

SEQ ID NO: 3684576 - RNA, 17 nt, Salmonella enterica enterica serovar Typhi Ty2
auccagcgauugacggu

SEQ ID NO: 3684577 - RNA, 21 nt, Salmonella enterica enterica serovar Typhi Ty2
auccagcgcguaaauaccuuc

SEQ ID NO: 3684578 - RNA, 19 nt, Salmonella enterica enterica serovar Typhi Ty2
auccagcgcucaaucagcg

SEQ ID NO: 3684579 - RNA, 20 nt, Salmonella enterica enterica serovar Typhi Ty2
auccagcgggccgacgauaa

SEQ ID NO: 3684580 - RNA, 23 nt, Salmonella enterica enterica serovar Typhi Ty2
auccagcguaggguagaucacgc

SEQ ID NO: 3684581 - RNA, 17 nt, Salmonella enterica enterica serovar Typhi Ty2
auccagcucaguuucca

SEQ ID NO: 3684582 - RNA, 19 nt, Salmonella enterica enterica serovar Typhi Ty2
auccagcucaguuuccagc

SEQ ID NO: 3684583 - RNA, 15 nt, Salmonella enterica enterica serovar Typhi Ty2
auccagcucuucuuc

SEQ ID NO: 3684584 - RNA, 18 nt, Salmonella enterica enterica serovar Typhi Ty2
auccagcuugccgucaca

SEQ ID NO: 3684585 - RNA, 16 nt, Salmonella enterica enterica serovar Typhi Ty2
auccaggaauuuuccc

SEQ ID NO: 3684586 - RNA, 15 nt, Salmonella enterica enterica serovar Typhi Ty2
auccaggacgucuug

SEQ ID NO: 3684587 - RNA, 22 nt, Salmonella enterica enterica serovar Typhi Ty2
auccaggagcauuggaaauuca

SEQ ID NO: 3684588 - RNA, 20 nt, Salmonella enterica enterica serovar Typhi Ty2
auccaggccgucggcgccag

SEQ ID NO: 3684589 - RNA, 21 nt, Salmonella enterica enterica serovar Typhi Ty2
auccagguggaucggaaauca

SEQ ID NO: 3684590 - RNA, 21 nt, Salmonella enterica enterica serovar Typhi Ty2
auccaguaacgcguccaacug

SEQ ID NO: 3684591 - RNA, 16 nt, Salmonella enterica enterica serovar Typhi Ty2
auccaguacgucaaca

SEQ ID NO: 3684592 - RNA, 18 nt, Salmonella enterica enterica serovar Typhi Ty2
auccaguauuuuuaucgu

SEQ ID NO: 3684593 - RNA, 15 nt, Salmonella enterica enterica serovar Typhi Ty2
auccagucagaggaa

SEQ ID NO: 3684594 - RNA, 23 nt, Salmonella enterica enterica serovar Typhi Ty2
auccaguggugaaaaagcggcug

SEQ ID NO: 3684595 - RNA, 14 nt, Salmonella enterica enterica serovar Typhi Ty2
auccaguuuauauu

SEQ ID NO: 3684596 - RNA, 20 nt, Salmonella enterica enterica serovar Typhi Ty2
auccgcgccgccgccgaagg

SEQ ID NO: 3684597 - RNA, 18 nt, Salmonella enterica enterica serovar Typhi Ty2
auccgcgccggguuuggc

SEQ ID NO: 3684598 - RNA, 19 nt, Salmonella enterica enterica serovar Typhi Ty2
auccgcgccggguuuggcg

SEQ ID NO: 3684599 - RNA, 14 nt, Salmonella enterica enterica serovar Typhi Ty2
auccgcguuaccca

SEQ ID NO: 3684600 - RNA, 20 nt, Salmonella enterica enterica serovar Typhi Ty2
auccgcucccgcuucaaaac

SEQ ID NO: 3684601 - RNA, 20 nt, Salmonella enterica enterica serovar Typhi Ty2
auccgcuucucuauacggcg

SEQ ID NO: 3684602 - RNA, 15 nt, Salmonella enterica enterica serovar Typhi Ty2
auccggaauaagaau

SEQ ID NO: 3684603 - RNA, 23 nt, Salmonella enterica enterica serovar Typhi Ty2
auccggacgauaaccaugcucag

SEQ ID NO: 3684604 - RNA, 15 nt, Salmonella enterica enterica serovar Typhi Ty2
auccggauauucugc

SEQ ID NO: 3684605 - RNA, 19 nt, Salmonella enterica enterica serovar Typhi Ty2
auccggcaaaagaggcuaa

SEQ ID NO: 3684606 - RNA, 23 nt, Salmonella enterica enterica serovar Typhi Ty2
auccggcaacacguuugcccgau

SEQ ID NO: 3684607 - RNA, 14 nt, Salmonella enterica enterica serovar Typhi Ty2
auccggcaagcgcu

SEQ ID NO: 3684608 - RNA, 16 nt, Salmonella enterica enterica serovar Typhi Ty2
auccggcaagcgcugg

SEQ ID NO: 3684609 - RNA, 22 nt, Salmonella enterica enterica serovar Typhi Ty2
auccggcacgccaucgccugau

SEQ ID NO: 3684610 - RNA, 14 nt, Salmonella enterica enterica serovar Typhi Ty2
auccggcacgguca

SEQ ID NO: 3684611 - RNA, 12 nt, Salmonella enterica enterica serovar Typhi Ty2
auccggcacugu

SEQ ID NO: 3684612 - RNA, 20 nt, Salmonella enterica enterica serovar Typhi Ty2
auccggcauaagauuuacaa

SEQ ID NO: 3684613 - RNA, 11 nt, Salmonella enterica enterica serovar Typhi Ty2
auccggcauuu

SEQ ID NO: 3684614 - RNA, 13 nt, Salmonella enterica enterica serovar Typhi Ty2
auccggcauuuuu

SEQ ID NO: 3684615 - RNA, 18 nt, Salmonella enterica enterica serovar Typhi Ty2
auccggcauuuuucucag

SEQ ID NO: 3684616 - RNA, 13 nt, Salmonella enterica enterica serovar Typhi Ty2
auccggccugcac

SEQ ID NO: 3684617 - RNA, 17 nt, Salmonella enterica enterica serovar Typhi Ty2
auccggccugcggugua

SEQ ID NO: 3684618 - RNA, 21 nt, Salmonella enterica enterica serovar Typhi Ty2
auccggcgcgguauuucgccg

SEQ ID NO: 3684619 - RNA, 13 nt, Salmonella enterica enterica serovar Typhi Ty2
auccggcggcguc

SEQ ID NO: 3684620 - RNA, 22 nt, Salmonella enterica enterica serovar Typhi Ty2
auccggcuuacggcuauuccuc

SEQ ID NO: 3684621 - RNA, 21 nt, Salmonella enterica enterica serovar Typhi Ty2
auccgggauauaaaauuauug

SEQ ID NO: 3684622 - RNA, 23 nt, Salmonella enterica enterica serovar Typhi Ty2
auccggguaauuuugccaucgcg

SEQ ID NO: 3684623 - RNA, 15 nt, Salmonella enterica enterica serovar Typhi Ty2
auccgguuacucgca

SEQ ID NO: 3684624 - RNA, 21 nt, Salmonella enterica enterica serovar Typhi Ty2
auccgguugacgauaaaaugc

SEQ ID NO: 3684625 - RNA, 18 nt, Salmonella enterica enterica serovar Typhi Ty2
auccgucaggaugggcuu

SEQ ID NO: 3684626 - RNA, 14 nt, Salmonella enterica enterica serovar Typhi Ty2
auccguccucuuuc

SEQ ID NO: 3684627 - RNA, 14 nt, Salmonella enterica enterica serovar Typhi Ty2
auccgucuggcgau

SEQ ID NO: 3684628 - RNA, 14 nt, Salmonella enterica enterica serovar Typhi Ty2
auccgugaccugcu

SEQ ID NO: 3684629 - RNA, 12 nt, Salmonella enterica enterica serovar Typhi Ty2
auccguuauuua

SEQ ID NO: 3684630 - RNA, 16 nt, Salmonella enterica enterica serovar Typhi Ty2
auccguuucagaaaga

SEQ ID NO: 3684631 - RNA, 18 nt, Salmonella enterica enterica serovar Typhi Ty2
auccguuuccgcaauaag

SEQ ID NO: 3684632 - RNA, 16 nt, Salmonella enterica enterica serovar Typhi Ty2
auccuaaaucugccau

SEQ ID NO: 3684633 - RNA, 17 nt, Salmonella enterica enterica serovar Typhi Ty2
auccucacuugccgagu

SEQ ID NO: 3684634 - RNA, 16 nt, Salmonella enterica enterica serovar Typhi Ty2
auccucauacagcccg

SEQ ID NO: 3684635 - RNA, 19 nt, Salmonella enterica enterica serovar Typhi Ty2
auccucauuaguucaaguu

SEQ ID NO: 3684636 - RNA, 23 nt, Salmonella enterica enterica serovar Typhi Ty2
auccucauuuuguugcuccagca

SEQ ID NO: 3684637 - RNA, 19 nt, Salmonella enterica enterica serovar Typhi Ty2
auccuccauaaauaacauu

SEQ ID NO: 3684638 - RNA, 21 nt, Salmonella enterica enterica serovar Typhi Ty2
auccuccggcgcggcgcgcau

SEQ ID NO: 3684639 - RNA, 12 nt, Salmonella enterica enterica serovar Typhi Ty2
auccucgaugaa

SEQ ID NO: 3684640 - RNA, 13 nt, Salmonella enterica enterica serovar Typhi Ty2
auccucuauuuuu

SEQ ID NO: 3684641 - RNA, 22 nt, Salmonella enterica enterica serovar Typhi Ty2
auccugaaccagcggcaccagc

SEQ ID NO: 3684642 - RNA, 19 nt, Salmonella enterica enterica serovar Typhi Ty2
auccugaagacaugcuguu

SEQ ID NO: 3684643 - RNA, 22 nt, Salmonella enterica enterica serovar Typhi Ty2
auccugaagacaugcuguugaa

SEQ ID NO: 3684644 - RNA, 13 nt, Salmonella enterica enterica serovar Typhi Ty2
auccugaagaugg

SEQ ID NO: 3684645 - RNA, 17 nt, Salmonella enterica enterica serovar Typhi Ty2
auccugacuauugcuga

SEQ ID NO: 3684646 - RNA, 17 nt, Salmonella enterica enterica serovar Typhi Ty2
auccugaguauaaaacu

SEQ ID NO: 3684647 - RNA, 20 nt, Salmonella enterica enterica serovar Typhi Ty2
auccugaguauaaaacucgc

SEQ ID NO: 3684648 - RNA, 13 nt, Salmonella enterica enterica serovar Typhi Ty2
auccugauuauua

SEQ ID NO: 3684649 - RNA, 21 nt, Salmonella enterica enterica serovar Typhi Ty2
auccugauuuuacugacuauc

SEQ ID NO: 3684650 - RNA, 16 nt, Salmonella enterica enterica serovar Typhi Ty2
auccugcaaauagcgc

SEQ ID NO: 3684651 - RNA, 21 nt, Salmonella enterica enterica serovar Typhi Ty2
auccugcacccgccuuaccca

SEQ ID NO: 3684652 - RNA, 14 nt, Salmonella enterica enterica serovar Typhi Ty2
auccugcaccgccu

SEQ ID NO: 3684653 - RNA, 21 nt, Salmonella enterica enterica serovar Typhi Ty2
auccugcaccgccugcggcau

SEQ ID NO: 3684654 - RNA, 19 nt, Salmonella enterica enterica serovar Typhi Ty2
auccugcauaauccaacga

SEQ ID NO: 3684655 - RNA, 15 nt, Salmonella enterica enterica serovar Typhi Ty2
auccugccacuguuc

SEQ ID NO: 3684656 - RNA, 19 nt, Salmonella enterica enterica serovar Typhi Ty2
auccugcucaucgacagaa

SEQ ID NO: 3684657 - RNA, 17 nt, Salmonella enterica enterica serovar Typhi Ty2
auccugcuugccugugc

SEQ ID NO: 3684658 - RNA, 20 nt, Salmonella enterica enterica serovar Typhi Ty2
auccuggauacguuccagca

SEQ ID NO: 3684659 - RNA, 24 nt, Salmonella enterica enterica serovar Typhi Ty2
auccuguaacaacuguuuuucacu

SEQ ID NO: 3684660 - RNA, 15 nt, Salmonella enterica enterica serovar Typhi Ty2
auccuguaccaccac

SEQ ID NO: 3684661 - RNA, 21 nt, Salmonella enterica enterica serovar Typhi Ty2
auccugucgggcguaccauuu

SEQ ID NO: 3684662 - RNA, 23 nt, Salmonella enterica enterica serovar Typhi Ty2
auccugugaaguaaaaaaaccgu

SEQ ID NO: 3684663 - RNA, 18 nt, Salmonella enterica enterica serovar Typhi Ty2
auccuguuaaucaucgcu

SEQ ID NO: 3684664 - RNA, 13 nt, Salmonella enterica enterica serovar Typhi Ty2
auccuguucaaac

SEQ ID NO: 3684665 - RNA, 18 nt, Salmonella enterica enterica serovar Typhi Ty2
auccuguucaaacaucag

SEQ ID NO: 3684666 - RNA, 22 nt, Salmonella enterica enterica serovar Typhi Ty2
auccuucauucagaucaaaaau

SEQ ID NO: 3684667 - RNA, 13 nt, Salmonella enterica enterica serovar Typhi Ty2
auccuuccagccc

SEQ ID NO: 3684668 - RNA, 14 nt, Salmonella enterica enterica serovar Typhi Ty2
auccuucuaccuuc

SEQ ID NO: 3684669 - RNA, 21 nt, Salmonella enterica enterica serovar Typhi Ty2
auccuucuaccuucaccccca

SEQ ID NO: 3684670 - RNA, 12 nt, Salmonella enterica enterica serovar Typhi Ty2
auccuucuucca

SEQ ID NO: 3684671 - RNA, 15 nt, Salmonella enterica enterica serovar Typhi Ty2
auccuucuuccauuc

SEQ ID NO: 3684672 - RNA, 16 nt, Salmonella enterica enterica serovar Typhi Ty2
auccuucuuccauucc

SEQ ID NO: 3684673 - RNA, 16 nt, Salmonella enterica enterica serovar Typhi Ty2
auccuuucucugguuu

SEQ ID NO: 3684674 - RNA, 15 nt, Salmonella enterica enterica serovar Typhi Ty2
auccuuuuucaugca

SEQ ID NO: 3684675 - RNA, 18 nt, Salmonella enterica enterica serovar Typhi Ty2
auccuuuuucugcgccag

SEQ ID NO: 3684676 - RNA, 19 nt, Salmonella enterica enterica serovar Typhi Ty2
aucgaacauucuuaugcaa

SEQ ID NO: 3684677 - RNA, 20 nt, Salmonella enterica enterica serovar Typhi Ty2
aucgaacgccgccugcgcca

SEQ ID NO: 3684678 - RNA, 23 nt, Salmonella enterica enterica serovar Typhi Ty2
aucgcgcccgccaucaugcccac

SEQ ID NO: 3684679 - RNA, 14 nt, Salmonella enterica enterica serovar Typhi Ty2
aucgcgcuggcagu

SEQ ID NO: 3684680 - RNA, 20 nt, Salmonella enterica enterica serovar Typhi Ty2
aucgcgcuggcaguuugcgc

SEQ ID NO: 3684681 - RNA, 15 nt, Salmonella enterica enterica serovar Typhi Ty2
aucgcggccagcaug

SEQ ID NO: 3684682 - RNA, 19 nt, Salmonella enterica enterica serovar Typhi Ty2
aucgcggucagcggcgcgc

SEQ ID NO: 3684683 - RNA, 18 nt, Salmonella enterica enterica serovar Typhi Ty2
aucgcgguuuuccggguc

SEQ ID NO: 3684684 - RNA, 17 nt, Salmonella enterica enterica serovar Typhi Ty2
aucgcguacagcgccau

SEQ ID NO: 3684685 - RNA, 16 nt, Salmonella enterica enterica serovar Typhi Ty2
aucgcguacaggaugu

SEQ ID NO: 3684686 - RNA, 18 nt, Salmonella enterica enterica serovar Typhi Ty2
aucgcguuuuccagcauc

SEQ ID NO: 3684687 - RNA, 21 nt, Salmonella enterica enterica serovar Typhi Ty2
aucgcuaaccaaaccagaugc

SEQ ID NO: 3684688 - RNA, 18 nt, Salmonella enterica enterica serovar Typhi Ty2
aucgcuccauucugucga

SEQ ID NO: 3684689 - RNA, 12 nt, Salmonella enterica enterica serovar Typhi Ty2
aucgcuccuccc

SEQ ID NO: 3684690 - RNA, 17 nt, Salmonella enterica enterica serovar Typhi Ty2
aucgcucuauauccugc

SEQ ID NO: 3684691 - RNA, 18 nt, Salmonella enterica enterica serovar Typhi Ty2
aucgcucuauauccugcc

SEQ ID NO: 3684692 - RNA, 16 nt, Salmonella enterica enterica serovar Typhi Ty2
aucgcugacgaucaug

SEQ ID NO: 3684693 - RNA, 13 nt, Salmonella enterica enterica serovar Typhi Ty2
aucgcugcgcccg

SEQ ID NO: 3684694 - RNA, 17 nt, Salmonella enterica enterica serovar Typhi Ty2
aucgcuggcgcguucau

SEQ ID NO: 3684695 - RNA, 16 nt, Salmonella enterica enterica serovar Typhi Ty2
aucgcugucggucaga

SEQ ID NO: 3684696 - RNA, 14 nt, Salmonella enterica enterica serovar Typhi Ty2
aucgcuguggcauu

SEQ ID NO: 3684697 - RNA, 22 nt, Salmonella enterica enterica serovar Typhi Ty2
aucgcugugguuuauccgcaga

SEQ ID NO: 3684698 - RNA, 14 nt, Salmonella enterica enterica serovar Typhi Ty2
aucgcuuccagcgc

SEQ ID NO: 3684699 - RNA, 16 nt, Salmonella enterica enterica serovar Typhi Ty2
aucgcuugguauggcg

SEQ ID NO: 3684700 - RNA, 23 nt, Salmonella enterica enterica serovar Typhi Ty2
aucgcuuuaacgcugcaaaguua

SEQ ID NO: 3684701 - RNA, 17 nt, Salmonella enterica enterica serovar Typhi Ty2
aucgcuuugcagaaaau

SEQ ID NO: 3684702 - RNA, 16 nt, Salmonella enterica enterica serovar Typhi Ty2
aucggaaaggugugaa

SEQ ID NO: 3684703 - RNA, 20 nt, Salmonella enterica enterica serovar Typhi Ty2
aucggaagacuggcgcagca

SEQ ID NO: 3684704 - RNA, 14 nt, Salmonella enterica enterica serovar Typhi Ty2
aucggaccuccgcg

SEQ ID NO: 3684705 - RNA, 21 nt, Salmonella enterica enterica serovar Typhi Ty2
aucggagauuucauccucuug

SEQ ID NO: 3684706 - RNA, 15 nt, Salmonella enterica enterica serovar Typhi Ty2
aucggauagaugaag

SEQ ID NO: 3684707 - RNA, 17 nt, Salmonella enterica enterica serovar Typhi Ty2
aucggauuuacagggga

SEQ ID NO: 3684708 - RNA, 20 nt, Salmonella enterica enterica serovar Typhi Ty2
aucggcaaacauagccucaa

SEQ ID NO: 3684709 - RNA, 15 nt, Salmonella enterica enterica serovar Typhi Ty2
aucggcaagcaucug

SEQ ID NO: 3684710 - RNA, 22 nt, Salmonella enterica enterica serovar Typhi Ty2
aucggcaucuuuaaccgccugc

SEQ ID NO: 3684711 - RNA, 13 nt, Salmonella enterica enterica serovar Typhi Ty2
aucggccagcagg

SEQ ID NO: 3684712 - RNA, 14 nt, Salmonella enterica enterica serovar Typhi Ty2
aucggccagcgcca

SEQ ID NO: 3684713 - RNA, 18 nt, Salmonella enterica enterica serovar Typhi Ty2
aucggccaggauggcccg

SEQ ID NO: 3684714 - RNA, 14 nt, Salmonella enterica enterica serovar Typhi Ty2
aucggccauaucca

SEQ ID NO: 3684715 - RNA, 19 nt, Salmonella enterica enterica serovar Typhi Ty2
aucggccauauccagccag

SEQ ID NO: 3684716 - RNA, 20 nt, Salmonella enterica enterica serovar Typhi Ty2
aucggccauauccagccagu

SEQ ID NO: 3684717 - RNA, 14 nt, Salmonella enterica enterica serovar Typhi Ty2
aucggccugaaugc

SEQ ID NO: 3684718 - RNA, 17 nt, Salmonella enterica enterica serovar Typhi Ty2
aucggccugaccaugga

SEQ ID NO: 3684719 - RNA, 22 nt, Salmonella enterica enterica serovar Typhi Ty2
aucggccugcucuugcggcagu

SEQ ID NO: 3684720 - RNA, 15 nt, Salmonella enterica enterica serovar Typhi Ty2
aucggcgagcggcua

SEQ ID NO: 3684721 - RNA, 22 nt, Salmonella enterica enterica serovar Typhi Ty2
aucggcgccggggugcuguucu

SEQ ID NO: 3684722 - RNA, 17 nt, Salmonella enterica enterica serovar Typhi Ty2
aucggcggcaaagccga

SEQ ID NO: 3684723 - RNA, 17 nt, Salmonella enterica enterica serovar Typhi Ty2
aucggcgucuugccgca

SEQ ID NO: 3684724 - RNA, 16 nt, Salmonella enterica enterica serovar Typhi Ty2
aucggcguguuucauc

SEQ ID NO: 3684725 - RNA, 20 nt, Salmonella enterica enterica serovar Typhi Ty2
aucggcguugccuggccucc

SEQ ID NO: 3684726 - RNA, 16 nt, Salmonella enterica enterica serovar Typhi Ty2
aucggcucagcaauca

SEQ ID NO: 3684727 - RNA, 14 nt, Salmonella enterica enterica serovar Typhi Ty2
aucggcuggcgcaa

SEQ ID NO: 3684728 - RNA, 17 nt, Salmonella enterica enterica serovar Typhi Ty2
aucggcuuauaaaacgc

SEQ ID NO: 3684729 - RNA, 21 nt, Salmonella enterica enterica serovar Typhi Ty2
aucgggaucagaaauucgcag

SEQ ID NO: 3684730 - RNA, 20 nt, Salmonella enterica enterica serovar Typhi Ty2
aucgggcgggcauuauacgc

SEQ ID NO: 3684731 - RNA, 20 nt, Salmonella enterica enterica serovar Typhi Ty2
aucggguggccuaacgccag

SEQ ID NO: 3684732 - RNA, 18 nt, Salmonella enterica enterica serovar Typhi Ty2
aucgguaagccgaaacca

SEQ ID NO: 3684733 - RNA, 21 nt, Salmonella enterica enterica serovar Typhi Ty2
aucgguaauugcgccguucac

SEQ ID NO: 3684734 - RNA, 17 nt, Salmonella enterica enterica serovar Typhi Ty2
aucgguaggccggauaa

SEQ ID NO: 3684735 - RNA, 18 nt, Salmonella enterica enterica serovar Typhi Ty2
aucgguaguguuaucgcc

SEQ ID NO: 3684736 - RNA, 20 nt, Salmonella enterica enterica serovar Typhi Ty2
aucggucugcuucagccacu

SEQ ID NO: 3684737 - RNA, 18 nt, Salmonella enterica enterica serovar Typhi Ty2
aucgguguacaucgcgcu

SEQ ID NO: 3684738 - RNA, 14 nt, Salmonella enterica enterica serovar Typhi Ty2
aucgguuaauugcc

SEQ ID NO: 3684739 - RNA, 13 nt, Salmonella enterica enterica serovar Typhi Ty2
aucguaaaucaaa

SEQ ID NO: 3684740 - RNA, 22 nt, Salmonella enterica enterica serovar Typhi Ty2
aucguaaugauuacggaacaaa

SEQ ID NO: 3684741 - RNA, 16 nt, Salmonella enterica enterica serovar Typhi Ty2
aucguaccaauaccca

SEQ ID NO: 3684742 - RNA, 16 nt, Salmonella enterica enterica serovar Typhi Ty2
aucguauccagcggca

SEQ ID NO: 3684743 - RNA, 23 nt, Salmonella enterica enterica serovar Typhi Ty2
aucguauccagcggcaaaggcau

SEQ ID NO: 3684744 - RNA, 21 nt, Salmonella enterica enterica serovar Typhi Ty2
aucguauccggucaauacauc

SEQ ID NO: 3684745 - RNA, 13 nt, Salmonella enterica enterica serovar Typhi Ty2
aucguaugcgccu

SEQ ID NO: 3684746 - RNA, 21 nt, Salmonella enterica enterica serovar Typhi Ty2
aucguaugcgccugucuuaaa

SEQ ID NO: 3684747 - RNA, 16 nt, Salmonella enterica enterica serovar Typhi Ty2
aucgucaccaggaugc

SEQ ID NO: 3684748 - RNA, 23 nt, Salmonella enterica enterica serovar Typhi Ty2
aucgucacccuauuuugcgccug

SEQ ID NO: 3684749 - RNA, 22 nt, Salmonella enterica enterica serovar Typhi Ty2
aucgucaucggucaguuugccc

SEQ ID NO: 3684750 - RNA, 16 nt, Salmonella enterica enterica serovar Typhi Ty2
aucgucgccagaccca

SEQ ID NO: 3684751 - RNA, 23 nt, Salmonella enterica enterica serovar Typhi Ty2
aucgucgcgaucgcgccagccuu

SEQ ID NO: 3684752 - RNA, 12 nt, Salmonella enterica enterica serovar Typhi Ty2
aucgucgcgcca

SEQ ID NO: 3684753 - RNA, 22 nt, Salmonella enterica enterica serovar Typhi Ty2
aucgucggacaacguaccggca

SEQ ID NO: 3684754 - RNA, 21 nt, Salmonella enterica enterica serovar Typhi Ty2
aucgucggcgauugucaucau

SEQ ID NO: 3684755 - RNA, 15 nt, Salmonella enterica enterica serovar Typhi Ty2
aucgucgggauaagc

SEQ ID NO: 3684756 - RNA, 14 nt, Salmonella enterica enterica serovar Typhi Ty2
aucgucucccgaca

SEQ ID NO: 3684757 - RNA, 16 nt, Salmonella enterica enterica serovar Typhi Ty2
aucgugaccaccgcca

SEQ ID NO: 3684758 - RNA, 18 nt, Salmonella enterica enterica serovar Typhi Ty2
aucgugagcgcgucauca

SEQ ID NO: 3684759 - RNA, 19 nt, Salmonella enterica enterica serovar Typhi Ty2
aucgugauaggccagacga

SEQ ID NO: 3684760 - RNA, 17 nt, Salmonella enterica enterica serovar Typhi Ty2
aucugcggucuccugaa

SEQ ID NO: 3684761 - RNA, 18 nt, Salmonella enterica enterica serovar Typhi Ty2
aucugcgucaguaccuga

SEQ ID NO: 3684762 - RNA, 19 nt, Salmonella enterica enterica serovar Typhi Ty2
aucugcgucaguaccugau

SEQ ID NO: 3684763 - RNA, 18 nt, Salmonella enterica enterica serovar Typhi Ty2
aucugcgugaugcaucag

SEQ ID NO: 3684764 - RNA, 20 nt, Salmonella enterica enterica serovar Typhi Ty2
aucugcgugaugcaucagaa

SEQ ID NO: 3684765 - RNA, 16 nt, Salmonella enterica enterica serovar Typhi Ty2
aucugcuccgccagca

SEQ ID NO: 3684766 - RNA, 17 nt, Salmonella enterica enterica serovar Typhi Ty2
aucuggccaauuuuuca

SEQ ID NO: 3684767 - RNA, 23 nt, Salmonella enterica enterica serovar Typhi Ty2
aucuggcgagagcauugccugau

SEQ ID NO: 3684768 - RNA, 17 nt, Salmonella enterica enterica serovar Typhi Ty2
aucuggcgcaaccggcg

SEQ ID NO: 3684769 - RNA, 18 nt, Salmonella enterica enterica serovar Typhi Ty2
aucuggcggcgaaagaga

SEQ ID NO: 3684770 - RNA, 19 nt, Salmonella enterica enterica serovar Typhi Ty2
aucuggcgguuugacggcu

SEQ ID NO: 3684771 - RNA, 18 nt, Salmonella enterica enterica serovar Typhi Ty2
aucuggcugcguaaaauc

SEQ ID NO: 3684772 - RNA, 17 nt, Salmonella enterica enterica serovar Typhi Ty2
aucuggucaaguauuuc

SEQ ID NO: 3684773 - RNA, 16 nt, Salmonella enterica enterica serovar Typhi Ty2
aucuggucauggcuua

SEQ ID NO: 3684774 - RNA, 17 nt, Salmonella enterica enterica serovar Typhi Ty2
aucuggugauaaagcag

SEQ ID NO: 3684775 - RNA, 18 nt, Salmonella enterica enterica serovar Typhi Ty2
aucuggugauaaagcaga

SEQ ID NO: 3684776 - RNA, 19 nt, Salmonella enterica enterica serovar Typhi Ty2
aucugguggaaaagaaaac

SEQ ID NO: 3684777 - RNA, 18 nt, Salmonella enterica enterica serovar Typhi Ty2
aucugguuauccaccagc

SEQ ID NO: 3684778 - RNA, 14 nt, Salmonella enterica enterica serovar Typhi Ty2
aucugguucacaga

SEQ ID NO: 3684779 - RNA, 17 nt, Salmonella enterica enterica serovar Typhi Ty2
aucuguaauuauaaaua

SEQ ID NO: 3684780 - RNA, 20 nt, Salmonella enterica enterica serovar Typhi Ty2
aucugucccagccuuccugg

SEQ ID NO: 3684781 - RNA, 21 nt, Salmonella enterica enterica serovar Typhi Ty2
aucugucccagccuuccuggu

SEQ ID NO: 3684782 - RNA, 15 nt, Salmonella enterica enterica serovar Typhi Ty2
aucuguuaucuggau

SEQ ID NO: 3684783 - RNA, 15 nt, Salmonella enterica enterica serovar Typhi Ty2
aucuguucaaaaaca

SEQ ID NO: 3684784 - RNA, 14 nt, Salmonella enterica enterica serovar Typhi Ty2
aucuguugcgccag

SEQ ID NO: 3684785 - RNA, 14 nt, Salmonella enterica enterica serovar Typhi Ty2
aucuguuucaugga

SEQ ID NO: 3684786 - RNA, 14 nt, Salmonella enterica enterica serovar Typhi Ty2
aucuguuugagaaa

SEQ ID NO: 3684787 - RNA, 15 nt, Salmonella enterica enterica serovar Typhi Ty2
aucuguuugagaaaa

SEQ ID NO: 3684788 - RNA, 15 nt, Salmonella enterica enterica serovar Typhi Ty2
aucuguuuuagcaug

SEQ ID NO: 3684789 - RNA, 21 nt, Salmonella enterica enterica serovar Typhi Ty2
aucuucaaagccacacugcau

SEQ ID NO: 3684790 - RNA, 21 nt, Salmonella enterica enterica serovar Typhi Ty2
aucuucaagguuaugcgcaca

SEQ ID NO: 3684791 - RNA, 19 nt, Salmonella enterica enterica serovar Typhi Ty2
aucuucaccgaugcccagc

SEQ ID NO: 3684792 - RNA, 22 nt, Salmonella enterica enterica serovar Typhi Ty2
aucuucaccgaugcccagcuug

SEQ ID NO: 3684793 - RNA, 21 nt, Salmonella enterica enterica serovar Typhi Ty2
aucuucacuguuaucgccauu

SEQ ID NO: 3684794 - RNA, 18 nt, Salmonella enterica enterica serovar Typhi Ty2
aucuucaucaaccaugau

SEQ ID NO: 3684795 - RNA, 14 nt, Salmonella enterica enterica serovar Typhi Ty2
aucuucaucccauc

SEQ ID NO: 3684796 - RNA, 17 nt, Salmonella enterica enterica serovar Typhi Ty2
aucuucauuucauugcg

SEQ ID NO: 3684797 - RNA, 20 nt, Salmonella enterica enterica serovar Typhi Ty2
aucuuccaacuguacgccac

SEQ ID NO: 3684798 - RNA, 18 nt, Salmonella enterica enterica serovar Typhi Ty2
aucuuccacgccgucgau

SEQ ID NO: 3684799 - RNA, 13 nt, Salmonella enterica enterica serovar Typhi Ty2
aucuuccagcauc

SEQ ID NO: 3684800 - RNA, 14 nt, Salmonella enterica enterica serovar Typhi Ty2
aucuuccaguugcu

SEQ ID NO: 3684801 - RNA, 18 nt, Salmonella enterica enterica serovar Typhi Ty2
aucuucgauaaacucaau

SEQ ID NO: 3684802 - RNA, 13 nt, Salmonella enterica enterica serovar Typhi Ty2
aucuucgauaaga

SEQ ID NO: 3684803 - RNA, 22 nt, Salmonella enterica enterica serovar Typhi Ty2
aucuucgcaguagauucuaucu

SEQ ID NO: 3684804 - RNA, 21 nt, Salmonella enterica enterica serovar Typhi Ty2
aucuucgccguauucuuaccc

SEQ ID NO: 3684805 - RNA, 21 nt, Salmonella enterica enterica serovar Typhi Ty2
aucuucgccguguucuuaccc

SEQ ID NO: 3684806 - RNA, 19 nt, Salmonella enterica enterica serovar Typhi Ty2
aucuucggcgggaucucca

SEQ ID NO: 3684807 - RNA, 15 nt, Salmonella enterica enterica serovar Typhi Ty2
aucuucuacaaugcg

SEQ ID NO: 3684808 - RNA, 18 nt, Salmonella enterica enterica serovar Typhi Ty2
aucuucuacaaugcggua

SEQ ID NO: 3684809 - RNA, 19 nt, Salmonella enterica enterica serovar Typhi Ty2
aucuucuacaugcccuucu

SEQ ID NO: 3684810 - RNA, 19 nt, Salmonella enterica enterica serovar Typhi Ty2
aucuucuccauugaucacu

SEQ ID NO: 3684811 - RNA, 20 nt, Salmonella enterica enterica serovar Typhi Ty2
aucuucuuugacccacgcca

SEQ ID NO: 3684812 - RNA, 17 nt, Salmonella enterica enterica serovar Typhi Ty2
aucuugaaugauuuugu

SEQ ID NO: 3684813 - RNA, 17 nt, Salmonella enterica enterica serovar Typhi Ty2
aucuugauaucaucauc

SEQ ID NO: 3684814 - RNA, 16 nt, Salmonella enterica enterica serovar Typhi Ty2
aucuuguccucaucau

SEQ ID NO: 3684815 - RNA, 14 nt, Salmonella enterica enterica serovar Typhi Ty2
aucuugugaguaau

SEQ ID NO: 3684816 - RNA, 17 nt, Salmonella enterica enterica serovar Typhi Ty2
aucuuuaccaaugugca

SEQ ID NO: 3684817 - RNA, 20 nt, Salmonella enterica enterica serovar Typhi Ty2
aucuuuaugucaguaauaua

SEQ ID NO: 3684818 - RNA, 19 nt, Salmonella enterica enterica serovar Typhi Ty2
aucuuuauugaaaagcagc

SEQ ID NO: 3684819 - RNA, 23 nt, Salmonella enterica enterica serovar Typhi Ty2
aucuuucuccugguuuuuccauu

SEQ ID NO: 3684820 - RNA, 16 nt, Salmonella enterica enterica serovar Typhi Ty2
aucuuugagcagauaa

SEQ ID NO: 3684821 - RNA, 14 nt, Salmonella enterica enterica serovar Typhi Ty2
aucuuugccgcaaa

SEQ ID NO: 3684822 - RNA, 19 nt, Salmonella enterica enterica serovar Typhi Ty2
aucuuuuaaaaucagauug

SEQ ID NO: 3684823 - RNA, 14 nt, Salmonella enterica enterica serovar Typhi Ty2
aucuuuuccugaag

SEQ ID NO: 3684824 - RNA, 18 nt, Salmonella enterica enterica serovar Typhi Ty2
aucuuuugcgccuuccag

SEQ ID NO: 3684825 - RNA, 15 nt, Salmonella enterica enterica serovar Typhi Ty2
aucuuuuugcuccug

SEQ ID NO: 3684826 - RNA, 17 nt, Salmonella enterica enterica serovar Typhi Ty2
augaaaaaaguuauuuu

SEQ ID NO: 3684827 - RNA, 18 nt, Salmonella enterica enterica serovar Typhi Ty2
augaaaaauauaaaaagc

SEQ ID NO: 3684828 - RNA, 15 nt, Salmonella enterica enterica serovar Typhi Ty2
augaaaaaucggcaa

SEQ ID NO: 3684829 - RNA, 12 nt, Salmonella enterica enterica serovar Typhi Ty2
augaaagagaaa

SEQ ID NO: 3684830 - RNA, 13 nt, Salmonella enterica enterica serovar Typhi Ty2
augaaagcggcac

SEQ ID NO: 3684831 - RNA, 22 nt, Salmonella enterica enterica serovar Typhi Ty2
augaaaucgucgccaacaccga

SEQ ID NO: 3684832 - RNA, 24 nt, Salmonella enterica enterica serovar Typhi Ty2
augaacaugcccggauggcgucug

SEQ ID NO: 3684833 - RNA, 21 nt, Salmonella enterica enterica serovar Typhi Ty2
augaaccauaucaaacaggac

SEQ ID NO: 3684834 - RNA, 22 nt, Salmonella enterica enterica serovar Typhi Ty2
augaacccucgaaugugaauuc

SEQ ID NO: 3684835 - RNA, 11 nt, Salmonella enterica enterica serovar Typhi Ty2
augaaccggga

SEQ ID NO: 3684836 - RNA, 22 nt, Salmonella enterica enterica serovar Typhi Ty2
augaacguuuugugucaaaaag

SEQ ID NO: 3684837 - RNA, 21 nt, Salmonella enterica enterica serovar Typhi Ty2
augaacucuaugcaaaagaaa

SEQ ID NO: 3684838 - RNA, 16 nt, Salmonella enterica enterica serovar Typhi Ty2
augaacugcaucagaa

SEQ ID NO: 3684839 - RNA, 14 nt, Salmonella enterica enterica serovar Typhi Ty2
augaagaaaauacu

SEQ ID NO: 3684840 - RNA, 15 nt, Salmonella enterica enterica serovar Typhi Ty2
augaagauauucacu

SEQ ID NO: 3684841 - RNA, 15 nt, Salmonella enterica enterica serovar Typhi Ty2
augaagcauaaaaag

SEQ ID NO: 3684842 - RNA, 15 nt, Salmonella enterica enterica serovar Typhi Ty2
augaugagcgccaua

SEQ ID NO: 3684843 - RNA, 19 nt, Salmonella enterica enterica serovar Typhi Ty2
augaugcauuugauuuguu

SEQ ID NO: 3684844 - RNA, 18 nt, Salmonella enterica enterica serovar Typhi Ty2
augaugccacgagaaauc

SEQ ID NO: 3684845 - RNA, 23 nt, Salmonella enterica enterica serovar Typhi Ty2
augaugccuugcgaauggagaag

SEQ ID NO: 3684846 - RNA, 17 nt, Salmonella enterica enterica serovar Typhi Ty2
augaugcgcuguaaaug

SEQ ID NO: 3684847 - RNA, 19 nt, Salmonella enterica enterica serovar Typhi Ty2
augauggcgaacagcccca

SEQ ID NO: 3684848 - RNA, 13 nt, Salmonella enterica enterica serovar Typhi Ty2
augauggcuccug

SEQ ID NO: 3684849 - RNA, 23 nt, Salmonella enterica enterica serovar Typhi Ty2
augaugggcgcacagcgccauga

SEQ ID NO: 3684850 - RNA, 17 nt, Salmonella enterica enterica serovar Typhi Ty2
augauggggucacaggu

SEQ ID NO: 3684851 - RNA, 14 nt, Salmonella enterica enterica serovar Typhi Ty2
augauggugagagc

SEQ ID NO: 3684852 - RNA, 20 nt, Salmonella enterica enterica serovar Typhi Ty2
augauguucauccauauauc

SEQ ID NO: 3684853 - RNA, 14 nt, Salmonella enterica enterica serovar Typhi Ty2
augauuaaaauaaa

SEQ ID NO: 3684854 - RNA, 15 nt, Salmonella enterica enterica serovar Typhi Ty2
augauuaaaauaaau

SEQ ID NO: 3684855 - RNA, 14 nt, Salmonella enterica enterica serovar Typhi Ty2
augauuaaagccac

SEQ ID NO: 3684856 - RNA, 15 nt, Salmonella enterica enterica serovar Typhi Ty2
augauuacggaacaa

SEQ ID NO: 3684857 - RNA, 19 nt, Salmonella enterica enterica serovar Typhi Ty2
augauuagauagauauuuu

SEQ ID NO: 3684858 - RNA, 15 nt, Salmonella enterica enterica serovar Typhi Ty2
augauuaucaucuau

SEQ ID NO: 3684859 - RNA, 15 nt, Salmonella enterica enterica serovar Typhi Ty2
augauugagcguuuc

SEQ ID NO: 3684860 - RNA, 24 nt, Salmonella enterica enterica serovar Typhi Ty2
augauugcuggcagaugaacauaa

SEQ ID NO: 3684861 - RNA, 21 nt, Salmonella enterica enterica serovar Typhi Ty2
augauuugcaaccgcucuuuu

SEQ ID NO: 3684862 - RNA, 16 nt, Salmonella enterica enterica serovar Typhi Ty2
augauuuuaacaucac

SEQ ID NO: 3684863 - RNA, 14 nt, Salmonella enterica enterica serovar Typhi Ty2
augauuuucuuauu

SEQ ID NO: 3684864 - RNA, 23 nt, Salmonella enterica enterica serovar Typhi Ty2
augauuuucuuauuacaagaaag

SEQ ID NO: 3684865 - RNA, 13 nt, Salmonella enterica enterica serovar Typhi Ty2
augcaaaagaaaa

SEQ ID NO: 3684866 - RNA, 12 nt, Salmonella enterica enterica serovar Typhi Ty2
augcaaauguca

SEQ ID NO: 3684867 - RNA, 14 nt, Salmonella enterica enterica serovar Typhi Ty2
augcaaccccugac

SEQ ID NO: 3684868 - RNA, 14 nt, Salmonella enterica enterica serovar Typhi Ty2
augcaacuggcaag

SEQ ID NO: 3684869 - RNA, 17 nt, Salmonella enterica enterica serovar Typhi Ty2
augcaagcagcauaaug

SEQ ID NO: 3684870 - RNA, 14 nt, Salmonella enterica enterica serovar Typhi Ty2
augcaauuccgcuu

SEQ ID NO: 3684871 - RNA, 18 nt, Salmonella enterica enterica serovar Typhi Ty2
augcaauuccgcuuucuu

SEQ ID NO: 3684872 - RNA, 19 nt, Salmonella enterica enterica serovar Typhi Ty2
augcaauuccgcuuucuuc

SEQ ID NO: 3684873 - RNA, 19 nt, Salmonella enterica enterica serovar Typhi Ty2
augcacaauacgccgagca

SEQ ID NO: 3684874 - RNA, 13 nt, Salmonella enterica enterica serovar Typhi Ty2
augcacacgcagc

SEQ ID NO: 3684875 - RNA, 16 nt, Salmonella enterica enterica serovar Typhi Ty2
augcacaggcggcggu

SEQ ID NO: 3684876 - RNA, 16 nt, Salmonella enterica enterica serovar Typhi Ty2
augcaccagucccagc

SEQ ID NO: 3684877 - RNA, 16 nt, Salmonella enterica enterica serovar Typhi Ty2
augcaccucuuuaugc

SEQ ID NO: 3684878 - RNA, 13 nt, Salmonella enterica enterica serovar Typhi Ty2
augcacgccacau

SEQ ID NO: 3684879 - RNA, 20 nt, Salmonella enterica enterica serovar Typhi Ty2
augcacgcuuuuuugcuggc

SEQ ID NO: 3684880 - RNA, 17 nt, Salmonella enterica enterica serovar Typhi Ty2
augcacuacgaaaagag

SEQ ID NO: 3684881 - RNA, 13 nt, Salmonella enterica enterica serovar Typhi Ty2
augcacugcugau

SEQ ID NO: 3684882 - RNA, 23 nt, Salmonella enterica enterica serovar Typhi Ty2
augcagcaccagauauuuuuccg

SEQ ID NO: 3684883 - RNA, 22 nt, Salmonella enterica enterica serovar Typhi Ty2
augcagcgcgauggcgucacga

SEQ ID NO: 3684884 - RNA, 20 nt, Salmonella enterica enterica serovar Typhi Ty2
augcagcgucugcccuccug

SEQ ID NO: 3684885 - RNA, 14 nt, Salmonella enterica enterica serovar Typhi Ty2
augcaggccaagca

SEQ ID NO: 3684886 - RNA, 23 nt, Salmonella enterica enterica serovar Typhi Ty2
augcagggauccuguaacaacug

SEQ ID NO: 3684887 - RNA, 17 nt, Salmonella enterica enterica serovar Typhi Ty2
augcaguucaucauccu

SEQ ID NO: 3684888 - RNA, 23 nt, Salmonella enterica enterica serovar Typhi Ty2
augcaguucuucgccguuaucgg

SEQ ID NO: 3684889 - RNA, 15 nt, Salmonella enterica enterica serovar Typhi Ty2
augcauaaaaaaacg

SEQ ID NO: 3684890 - RNA, 20 nt, Salmonella enterica enterica serovar Typhi Ty2
augcauacggaugaaauacu

SEQ ID NO: 3684891 - RNA, 15 nt, Salmonella enterica enterica serovar Typhi Ty2
augcauaugaaugau

SEQ ID NO: 3684892 - RNA, 18 nt, Salmonella enterica enterica serovar Typhi Ty2
augcauauuauucaugau

SEQ ID NO: 3684893 - RNA, 13 nt, Salmonella enterica enterica serovar Typhi Ty2
augcaucaugcua

SEQ ID NO: 3684894 - RNA, 12 nt, Salmonella enterica enterica serovar Typhi Ty2
augcauugcuga

SEQ ID NO: 3684895 - RNA, 12 nt, Salmonella enterica enterica serovar Typhi Ty2
augcauuugauu

SEQ ID NO: 3684896 - RNA, 22 nt, Salmonella enterica enterica serovar Typhi Ty2
augcauuugauuuguuuuuuau

SEQ ID NO: 3684897 - RNA, 19 nt, Salmonella enterica enterica serovar Typhi Ty2
augccaaauagcacgugca

SEQ ID NO: 3684898 - RNA, 21 nt, Salmonella enterica enterica serovar Typhi Ty2
augccaaguaauaaagagaac

SEQ ID NO: 3684899 - RNA, 20 nt, Salmonella enterica enterica serovar Typhi Ty2
augccacaacagaagcggcc

SEQ ID NO: 3684900 - RNA, 21 nt, Salmonella enterica enterica serovar Typhi Ty2
augccacacccugagcgccgc

SEQ ID NO: 3684901 - RNA, 17 nt, Salmonella enterica enterica serovar Typhi Ty2
augccacgagaaaucca

SEQ ID NO: 3684902 - RNA, 23 nt, Salmonella enterica enterica serovar Typhi Ty2
augccacugcccucaaguuaugu

SEQ ID NO: 3684903 - RNA, 13 nt, Salmonella enterica enterica serovar Typhi Ty2
augccacuguuca

SEQ ID NO: 3684904 - RNA, 17 nt, Salmonella enterica enterica serovar Typhi Ty2
augccagaauugcacgc

SEQ ID NO: 3684905 - RNA, 15 nt, Salmonella enterica enterica serovar Typhi Ty2
augccagcgauuauu

SEQ ID NO: 3684906 - RNA, 20 nt, Salmonella enterica enterica serovar Typhi Ty2
augccauaaucgauauaauu

SEQ ID NO: 3684907 - RNA, 21 nt, Salmonella enterica enterica serovar Typhi Ty2
augccaugcuggcucuugguu

SEQ ID NO: 3684908 - RNA, 12 nt, Salmonella enterica enterica serovar Typhi Ty2
augcccaaaaua

SEQ ID NO: 3684909 - RNA, 22 nt, Salmonella enterica enterica serovar Typhi Ty2
augcccaccgcgcgcgcggcau

SEQ ID NO: 3684910 - RNA, 23 nt, Salmonella enterica enterica serovar Typhi Ty2
augcccaccggaccuaauagcca

SEQ ID NO: 3684911 - RNA, 21 nt, Salmonella enterica enterica serovar Typhi Ty2
augcccaccugaaaaagggua

SEQ ID NO: 3684912 - RNA, 23 nt, Salmonella enterica enterica serovar Typhi Ty2
augcccagcgccgucauaccgcc

SEQ ID NO: 3684913 - RNA, 14 nt, Salmonella enterica enterica serovar Typhi Ty2
augcccauaaagaa

SEQ ID NO: 3684914 - RNA, 15 nt, Salmonella enterica enterica serovar Typhi Ty2
augcccauaaagaaa

SEQ ID NO: 3684915 - RNA, 17 nt, Salmonella enterica enterica serovar Typhi Ty2
augcccccgcgcaggcg

SEQ ID NO: 3684916 - RNA, 17 nt, Salmonella enterica enterica serovar Typhi Ty2
augccccgacaucagau

SEQ ID NO: 3684917 - RNA, 19 nt, Salmonella enterica enterica serovar Typhi Ty2
augcccggcauacgccggg

SEQ ID NO: 3684918 - RNA, 17 nt, Salmonella enterica enterica serovar Typhi Ty2
augcccggggugaacaa

SEQ ID NO: 3684919 - RNA, 19 nt, Salmonella enterica enterica serovar Typhi Ty2
augcccgguaagaaugcgc

SEQ ID NO: 3684920 - RNA, 21 nt, Salmonella enterica enterica serovar Typhi Ty2
augcccugcuggcgcaugauc

SEQ ID NO: 3684921 - RNA, 16 nt, Salmonella enterica enterica serovar Typhi Ty2
augccgaguuccggau

SEQ ID NO: 3684922 - RNA, 16 nt, Salmonella enterica enterica serovar Typhi Ty2
augccgcacaaaauuu

SEQ ID NO: 3684923 - RNA, 19 nt, Salmonella enterica enterica serovar Typhi Ty2
augccgcacuccccagaau

SEQ ID NO: 3684924 - RNA, 20 nt, Salmonella enterica enterica serovar Typhi Ty2
augcucugcugugccaguac

SEQ ID NO: 3684925 - RNA, 14 nt, Salmonella enterica enterica serovar Typhi Ty2
augcugaacagccg

SEQ ID NO: 3684926 - RNA, 13 nt, Salmonella enterica enterica serovar Typhi Ty2
augcugaauagcc

SEQ ID NO: 3684927 - RNA, 15 nt, Salmonella enterica enterica serovar Typhi Ty2
augcugaauagccag

SEQ ID NO: 3684928 - RNA, 18 nt, Salmonella enterica enterica serovar Typhi Ty2
augcugacggauucuucc

SEQ ID NO: 3684929 - RNA, 21 nt, Salmonella enterica enterica serovar Typhi Ty2
augcugauuaaugauuugcuu

SEQ ID NO: 3684930 - RNA, 21 nt, Salmonella enterica enterica serovar Typhi Ty2
augcugcaccgcaucaaacuu

SEQ ID NO: 3684931 - RNA, 16 nt, Salmonella enterica enterica serovar Typhi Ty2
augcugcaucuuacug

SEQ ID NO: 3684932 - RNA, 23 nt, Salmonella enterica enterica serovar Typhi Ty2
augcugccagcgaaccgcggcau

SEQ ID NO: 3684933 - RNA, 21 nt, Salmonella enterica enterica serovar Typhi Ty2
augcugcucuccacgccgcaa

SEQ ID NO: 3684934 - RNA, 15 nt, Salmonella enterica enterica serovar Typhi Ty2
augcuggcugaaaug

SEQ ID NO: 3684935 - RNA, 20 nt, Salmonella enterica enterica serovar Typhi Ty2
augcuggcugaaauggccgu

SEQ ID NO: 3684936 - RNA, 20 nt, Salmonella enterica enterica serovar Typhi Ty2
augcugggcgugucccugga

SEQ ID NO: 3684937 - RNA, 11 nt, Salmonella enterica enterica serovar Typhi Ty2
augcuggugca

SEQ ID NO: 3684938 - RNA, 12 nt, Salmonella enterica enterica serovar Typhi Ty2
augcuggugcau

SEQ ID NO: 3684939 - RNA, 21 nt, Salmonella enterica enterica serovar Typhi Ty2
augcugucgccggaaaaaaug

SEQ ID NO: 3684940 - RNA, 22 nt, Salmonella enterica enterica serovar Typhi Ty2
augcuuccaaagagcugaaugu

SEQ ID NO: 3684941 - RNA, 19 nt, Salmonella enterica enterica serovar Typhi Ty2
augcuuucaauaaaucaau

SEQ ID NO: 3684942 - RNA, 17 nt, Salmonella enterica enterica serovar Typhi Ty2
augcuuucaauacucca

SEQ ID NO: 3684943 - RNA, 15 nt, Salmonella enterica enterica serovar Typhi Ty2
augcuuucagcaugu

SEQ ID NO: 3684944 - RNA, 18 nt, Salmonella enterica enterica serovar Typhi Ty2
augcuuucgcgauaauca

SEQ ID NO: 3684945 - RNA, 23 nt, Salmonella enterica enterica serovar Typhi Ty2
augcuuuuuauaaagugauuaua

SEQ ID NO: 3684946 - RNA, 17 nt, Salmonella enterica enterica serovar Typhi Ty2
augcuuuuugugccgaa

SEQ ID NO: 3684947 - RNA, 14 nt, Salmonella enterica enterica serovar Typhi Ty2
auggaaaugcacgu

SEQ ID NO: 3684948 - RNA, 20 nt, Salmonella enterica enterica serovar Typhi Ty2
auggaacugccuggcucauu

SEQ ID NO: 3684949 - RNA, 12 nt, Salmonella enterica enterica serovar Typhi Ty2
auggaaguacug

SEQ ID NO: 3684950 - RNA, 19 nt, Salmonella enterica enterica serovar Typhi Ty2
auggaaucggcuaguaaua

SEQ ID NO: 3684951 - RNA, 15 nt, Salmonella enterica enterica serovar Typhi Ty2
auggacaaaaaagga

SEQ ID NO: 3684952 - RNA, 23 nt, Salmonella enterica enterica serovar Typhi Ty2
auggacagguaaaccggucaggu

SEQ ID NO: 3684953 - RNA, 15 nt, Salmonella enterica enterica serovar Typhi Ty2
auggacgggauacgg

SEQ ID NO: 3684954 - RNA, 17 nt, Salmonella enterica enterica serovar Typhi Ty2
auggacgggauacggcg

SEQ ID NO: 3684955 - RNA, 14 nt, Salmonella enterica enterica serovar Typhi Ty2
auggagaugaaaau

SEQ ID NO: 3684956 - RNA, 12 nt, Salmonella enterica enterica serovar Typhi Ty2
auggaggcagug

SEQ ID NO: 3684957 - RNA, 16 nt, Salmonella enterica enterica serovar Typhi Ty2
auggauaacgaaaagg

SEQ ID NO: 3684958 - RNA, 12 nt, Salmonella enterica enterica serovar Typhi Ty2
auggaucaucgg

SEQ ID NO: 3684959 - RNA, 16 nt, Salmonella enterica enterica serovar Typhi Ty2
auggaucgacaucuuc

SEQ ID NO: 3684960 - RNA, 22 nt, Salmonella enterica enterica serovar Typhi Ty2
auggaugcccaccugaaaaagg

SEQ ID NO: 3684961 - RNA, 23 nt, Salmonella enterica enterica serovar Typhi Ty2
auggaugcccaccugaaaaaggg

SEQ ID NO: 3684962 - RNA, 22 nt, Salmonella enterica enterica serovar Typhi Ty2
auggauucaugguacucaacau

SEQ ID NO: 3684963 - RNA, 21 nt, Salmonella enterica enterica serovar Typhi Ty2
auggcaaaagacauccccgcc

SEQ ID NO: 3684964 - RNA, 20 nt, Salmonella enterica enterica serovar Typhi Ty2
auggcaaaauucguauuggu

SEQ ID NO: 3684965 - RNA, 12 nt, Salmonella enterica enterica serovar Typhi Ty2
auggcaaagucg

SEQ ID NO: 3684966 - RNA, 18 nt, Salmonella enterica enterica serovar Typhi Ty2
auggcaacaaagccugcu

SEQ ID NO: 3684967 - RNA, 15 nt, Salmonella enterica enterica serovar Typhi Ty2
auggcacaucaggca

SEQ ID NO: 3684968 - RNA, 17 nt, Salmonella enterica enterica serovar Typhi Ty2
auggcacaucaggcaaa

SEQ ID NO: 3684969 - RNA, 16 nt, Salmonella enterica enterica serovar Typhi Ty2
auggcagaauaaaaca

SEQ ID NO: 3684970 - RNA, 15 nt, Salmonella enterica enterica serovar Typhi Ty2
auggcagauaaacca

SEQ ID NO: 3684971 - RNA, 12 nt, Salmonella enterica enterica serovar Typhi Ty2
auggcagcaggg

SEQ ID NO: 3684972 - RNA, 22 nt, Salmonella enterica enterica serovar Typhi Ty2
auggcauaugacgguauugcuu

SEQ ID NO: 3684973 - RNA, 22 nt, Salmonella enterica enterica serovar Typhi Ty2
auggccaauguacguaaaacca

SEQ ID NO: 3684974 - RNA, 18 nt, Salmonella enterica enterica serovar Typhi Ty2
auggccagaaugacaugg

SEQ ID NO: 3684975 - RNA, 12 nt, Salmonella enterica enterica serovar Typhi Ty2
auggccagcccc

SEQ ID NO: 3684976 - RNA, 14 nt, Salmonella enterica enterica serovar Typhi Ty2
auggccauagacuu

SEQ ID NO: 3684977 - RNA, 12 nt, Salmonella enterica enterica serovar Typhi Ty2
auggccgcagcc

SEQ ID NO: 3684978 - RNA, 20 nt, Salmonella enterica enterica serovar Typhi Ty2
auggccguuuucaugcacga

SEQ ID NO: 3684979 - RNA, 14 nt, Salmonella enterica enterica serovar Typhi Ty2
auggccugaugacg

SEQ ID NO: 3684980 - RNA, 22 nt, Salmonella enterica enterica serovar Typhi Ty2
auggccugcucaauacuuuccg

SEQ ID NO: 3684981 - RNA, 13 nt, Salmonella enterica enterica serovar Typhi Ty2
auggccuggagcg

SEQ ID NO: 3684982 - RNA, 21 nt, Salmonella enterica enterica serovar Typhi Ty2
auggcgaaaaucggcaggccg

SEQ ID NO: 3684983 - RNA, 18 nt, Salmonella enterica enterica serovar Typhi Ty2
auggcgacgacgcuguuu

SEQ ID NO: 3684984 - RNA, 15 nt, Salmonella enterica enterica serovar Typhi Ty2
auggcgacgaucagc

SEQ ID NO: 3684985 - RNA, 18 nt, Salmonella enterica enterica serovar Typhi Ty2
auggcgacguaacugucu

SEQ ID NO: 3684986 - RNA, 22 nt, Salmonella enterica enterica serovar Typhi Ty2
auggcgauaaaaauauccgcca

SEQ ID NO: 3684987 - RNA, 16 nt, Salmonella enterica enterica serovar Typhi Ty2
auggcgaucagcgcca

SEQ ID NO: 3684988 - RNA, 14 nt, Salmonella enterica enterica serovar Typhi Ty2
auggcgauuaacgc

SEQ ID NO: 3684989 - RNA, 18 nt, Salmonella enterica enterica serovar Typhi Ty2
auggcgcgaaaacagcug

SEQ ID NO: 3684990 - RNA, 21 nt, Salmonella enterica enterica serovar Typhi Ty2
auggcgcgaagugccagguuu

SEQ ID NO: 3684991 - RNA, 20 nt, Salmonella enterica enterica serovar Typhi Ty2
auggcgcgccacuucuuuga

SEQ ID NO: 3684992 - RNA, 20 nt, Salmonella enterica enterica serovar Typhi Ty2
auggcgcuacgcuuauccgg

SEQ ID NO: 3684993 - RNA, 16 nt, Salmonella enterica enterica serovar Typhi Ty2
auggcgcucuuuucca

SEQ ID NO: 3684994 - RNA, 15 nt, Salmonella enterica enterica serovar Typhi Ty2
auggcgcugcgcgca

SEQ ID NO: 3684995 - RNA, 20 nt, Salmonella enterica enterica serovar Typhi Ty2
auggcgcugcgcuuaucaga

SEQ ID NO: 3684996 - RNA, 19 nt, Salmonella enterica enterica serovar Typhi Ty2
auggcggauuccaguagcg

SEQ ID NO: 3684997 - RNA, 22 nt, Salmonella enterica enterica serovar Typhi Ty2
auggcggauuccaguagcgcgc

SEQ ID NO: 3684998 - RNA, 20 nt, Salmonella enterica enterica serovar Typhi Ty2
auggcggcgaaaugccuuau

SEQ ID NO: 3684999 - RNA, 23 nt, Salmonella enterica enterica serovar Typhi Ty2
auggcggcgaaaugccuuauccg

SEQ ID NO: 3685000 - RNA, 18 nt, Salmonella enterica enterica serovar Typhi Ty2
auggcggcguaccgccuu

SEQ ID NO: 3685001 - RNA, 17 nt, Salmonella enterica enterica serovar Typhi Ty2
auggcggcguuuuccgg

SEQ ID NO: 3685002 - RNA, 16 nt, Salmonella enterica enterica serovar Typhi Ty2
auggcggcugcgccuu

SEQ ID NO: 3685003 - RNA, 21 nt, Salmonella enterica enterica serovar Typhi Ty2
auggcggcuuggcuguagaua

SEQ ID NO: 3685004 - RNA, 16 nt, Salmonella enterica enterica serovar Typhi Ty2
auggcgguauaacugc

SEQ ID NO: 3685005 - RNA, 19 nt, Salmonella enterica enterica serovar Typhi Ty2
auggcggucaacgcggcua

SEQ ID NO: 3685006 - RNA, 17 nt, Salmonella enterica enterica serovar Typhi Ty2
augucccgauauugguc

SEQ ID NO: 3685007 - RNA, 15 nt, Salmonella enterica enterica serovar Typhi Ty2
auguccgacgccgcu

SEQ ID NO: 3685008 - RNA, 17 nt, Salmonella enterica enterica serovar Typhi Ty2
auguccgauagcauuau

SEQ ID NO: 3685009 - RNA, 19 nt, Salmonella enterica enterica serovar Typhi Ty2
auguccuuuacugcgccag

SEQ ID NO: 3685010 - RNA, 20 nt, Salmonella enterica enterica serovar Typhi Ty2
augucgacauaauuuccggc

SEQ ID NO: 3685011 - RNA, 17 nt, Salmonella enterica enterica serovar Typhi Ty2
augucgcgucagguuua

SEQ ID NO: 3685012 - RNA, 23 nt, Salmonella enterica enterica serovar Typhi Ty2
augucuuuucgguauuuaucaaa

SEQ ID NO: 3685013 - RNA, 16 nt, Salmonella enterica enterica serovar Typhi Ty2
augugaauccaggcca

SEQ ID NO: 3685014 - RNA, 22 nt, Salmonella enterica enterica serovar Typhi Ty2
augugagcaucggcgauuaagu

SEQ ID NO: 3685015 - RNA, 20 nt, Salmonella enterica enterica serovar Typhi Ty2
augugagcgcauccggccag

SEQ ID NO: 3685016 - RNA, 23 nt, Salmonella enterica enterica serovar Typhi Ty2
augugauuuuugacccgcagcaa

SEQ ID NO: 3685017 - RNA, 14 nt, Salmonella enterica enterica serovar Typhi Ty2
augugcaucggcac

SEQ ID NO: 3685018 - RNA, 17 nt, Salmonella enterica enterica serovar Typhi Ty2
augugccacuccgccag

SEQ ID NO: 3685019 - RNA, 23 nt, Salmonella enterica enterica serovar Typhi Ty2
augugcggagaagacgccgccgc

SEQ ID NO: 3685020 - RNA, 16 nt, Salmonella enterica enterica serovar Typhi Ty2
augugcuuucaucgcc

SEQ ID NO: 3685021 - RNA, 14 nt, Salmonella enterica enterica serovar Typhi Ty2
auguguuucagcag

SEQ ID NO: 3685022 - RNA, 21 nt, Salmonella enterica enterica serovar Typhi Ty2
auguuaaaguuuuucauaucc

SEQ ID NO: 3685023 - RNA, 22 nt, Salmonella enterica enterica serovar Typhi Ty2
auguuaaauacgccgccagcaa

SEQ ID NO: 3685024 - RNA, 22 nt, Salmonella enterica enterica serovar Typhi Ty2
auguuaauaccagcgccaauca

SEQ ID NO: 3685025 - RNA, 17 nt, Salmonella enterica enterica serovar Typhi Ty2
auguuaauuucaucgcc

SEQ ID NO: 3685026 - RNA, 15 nt, Salmonella enterica enterica serovar Typhi Ty2
auguuagcaaaaaug

SEQ ID NO: 3685027 - RNA, 18 nt, Salmonella enterica enterica serovar Typhi Ty2
auguuagcauuauuuuua

SEQ ID NO: 3685028 - RNA, 13 nt, Salmonella enterica enterica serovar Typhi Ty2
auguuauaaacuu

SEQ ID NO: 3685029 - RNA, 22 nt, Salmonella enterica enterica serovar Typhi Ty2
auguucaacgucagcuggaaug

SEQ ID NO: 3685030 - RNA, 17 nt, Salmonella enterica enterica serovar Typhi Ty2
auguucauaccggauau

SEQ ID NO: 3685031 - RNA, 14 nt, Salmonella enterica enterica serovar Typhi Ty2
auguuccgcagggg

SEQ ID NO: 3685032 - RNA, 18 nt, Salmonella enterica enterica serovar Typhi Ty2
auguuccgcaggggauuc

SEQ ID NO: 3685033 - RNA, 14 nt, Salmonella enterica enterica serovar Typhi Ty2
auguucgaacaugc

SEQ ID NO: 3685034 - RNA, 19 nt, Salmonella enterica enterica serovar Typhi Ty2
auguucgcuucugccgcca

SEQ ID NO: 3685035 - RNA, 15 nt, Salmonella enterica enterica serovar Typhi Ty2
auguucuaucuuuca

SEQ ID NO: 3685036 - RNA, 13 nt, Salmonella enterica enterica serovar Typhi Ty2
auguucuuucgcc

SEQ ID NO: 3685037 - RNA, 18 nt, Salmonella enterica enterica serovar Typhi Ty2
auguugauacagaaaacc

SEQ ID NO: 3685038 - RNA, 21 nt, Salmonella enterica enterica serovar Typhi Ty2
auguugaucguaaaaugaaaa

SEQ ID NO: 3685039 - RNA, 15 nt, Salmonella enterica enterica serovar Typhi Ty2
auguugccacaggcu

SEQ ID NO: 3685040 - RNA, 21 nt, Salmonella enterica enterica serovar Typhi Ty2
auguugccaugauccaucucg

SEQ ID NO: 3685041 - RNA, 17 nt, Salmonella enterica enterica serovar Typhi Ty2
auguugcguaaauaaau

SEQ ID NO: 3685042 - RNA, 14 nt, Salmonella enterica enterica serovar Typhi Ty2
auguugcugcaucu

SEQ ID NO: 3685043 - RNA, 17 nt, Salmonella enterica enterica serovar Typhi Ty2
auguuggauuauacauu

SEQ ID NO: 3685044 - RNA, 22 nt, Salmonella enterica enterica serovar Typhi Ty2
auguuggauuauacauucgcuc

SEQ ID NO: 3685045 - RNA, 13 nt, Salmonella enterica enterica serovar Typhi Ty2
auguuggcgcccu

SEQ ID NO: 3685046 - RNA, 15 nt, Salmonella enterica enterica serovar Typhi Ty2
auguuguuccagagu

SEQ ID NO: 3685047 - RNA, 17 nt, Salmonella enterica enterica serovar Typhi Ty2
auguuguuccagagugc

SEQ ID NO: 3685048 - RNA, 14 nt, Salmonella enterica enterica serovar Typhi Ty2
auguuguuugaaaa

SEQ ID NO: 3685049 - RNA, 15 nt, Salmonella enterica enterica serovar Typhi Ty2
auguuugccacgcca

SEQ ID NO: 3685050 - RNA, 14 nt, Salmonella enterica enterica serovar Typhi Ty2
auguuuuaccagua

SEQ ID NO: 3685051 - RNA, 14 nt, Salmonella enterica enterica serovar Typhi Ty2
auguuuuuguuguu

SEQ ID NO: 3685052 - RNA, 19 nt, Salmonella enterica enterica serovar Typhi Ty2
auuaaaaaaggcagaagaa

SEQ ID NO: 3685053 - RNA, 15 nt, Salmonella enterica enterica serovar Typhi Ty2
auuaaaaauacccca

SEQ ID NO: 3685054 - RNA, 22 nt, Salmonella enterica enterica serovar Typhi Ty2
auuaaaaauaccccaggggcau

SEQ ID NO: 3685055 - RNA, 17 nt, Salmonella enterica enterica serovar Typhi Ty2
auuaaaagaccccauuu

SEQ ID NO: 3685056 - RNA, 23 nt, Salmonella enterica enterica serovar Typhi Ty2
auuaaaagucaacugcucuacca

SEQ ID NO: 3685057 - RNA, 16 nt, Salmonella enterica enterica serovar Typhi Ty2
auuaaacuuucaugaa

SEQ ID NO: 3685058 - RNA, 21 nt, Salmonella enterica enterica serovar Typhi Ty2
auuaaagcacaagaacuuaaa

SEQ ID NO: 3685059 - RNA, 12 nt, Salmonella enterica enterica serovar Typhi Ty2
auuaaagccacg

SEQ ID NO: 3685060 - RNA, 13 nt, Salmonella enterica enterica serovar Typhi Ty2
auuaaagccccuu

SEQ ID NO: 3685061 - RNA, 18 nt, Salmonella enterica enterica serovar Typhi Ty2
auuaaauaacaaaugaag

SEQ ID NO: 3685062 - RNA, 15 nt, Salmonella enterica enterica serovar Typhi Ty2
auuaaaucaucauaa

SEQ ID NO: 3685063 - RNA, 17 nt, Salmonella enterica enterica serovar Typhi Ty2
auuaaaucaucauaauc

SEQ ID NO: 3685064 - RNA, 16 nt, Salmonella enterica enterica serovar Typhi Ty2
auuaaaugacggacca

SEQ ID NO: 3685065 - RNA, 18 nt, Salmonella enterica enterica serovar Typhi Ty2
auuaaaugcgccagcggc

SEQ ID NO: 3685066 - RNA, 20 nt, Salmonella enterica enterica serovar Typhi Ty2
auuaaauggaucgacaucuu

SEQ ID NO: 3685067 - RNA, 23 nt, Salmonella enterica enterica serovar Typhi Ty2
auuaacacacaaucgguuaugcg

SEQ ID NO: 3685068 - RNA, 23 nt, Salmonella enterica enterica serovar Typhi Ty2
auuaacaggcgccggggcagcaa

SEQ ID NO: 3685069 - RNA, 19 nt, Salmonella enterica enterica serovar Typhi Ty2
auuaacagucuaucgcugc

SEQ ID NO: 3685070 - RNA, 11 nt, Salmonella enterica enterica serovar Typhi Ty2
auuaacaucag

SEQ ID NO: 3685071 - RNA, 15 nt, Salmonella enterica enterica serovar Typhi Ty2
auuaacauuuaagaa

SEQ ID NO: 3685072 - RNA, 18 nt, Salmonella enterica enterica serovar Typhi Ty2
auuaacccacaugccggu

SEQ ID NO: 3685073 - RNA, 16 nt, Salmonella enterica enterica serovar Typhi Ty2
auuaacgacaaaaaua

SEQ ID NO: 3685074 - RNA, 23 nt, Salmonella enterica enterica serovar Typhi Ty2
auuaacgcagaauauuuuucuca

SEQ ID NO: 3685075 - RNA, 18 nt, Salmonella enterica enterica serovar Typhi Ty2
auuaacgggaaacuguuu

SEQ ID NO: 3685076 - RNA, 19 nt, Salmonella enterica enterica serovar Typhi Ty2
auuaacgucacgauggcga

SEQ ID NO: 3685077 - RNA, 14 nt, Salmonella enterica enterica serovar Typhi Ty2
auuaacuccggacg

SEQ ID NO: 3685078 - RNA, 13 nt, Salmonella enterica enterica serovar Typhi Ty2
auuaacucuuccg

SEQ ID NO: 3685079 - RNA, 15 nt, Salmonella enterica enterica serovar Typhi Ty2
auuaagcaauccauu

SEQ ID NO: 3685080 - RNA, 20 nt, Salmonella enterica enterica serovar Typhi Ty2
auuaagcaauccauuuuaaa

SEQ ID NO: 3685081 - RNA, 13 nt, Salmonella enterica enterica serovar Typhi Ty2
auuaagcaggccg

SEQ ID NO: 3685082 - RNA, 17 nt, Salmonella enterica enterica serovar Typhi Ty2
auuaagccauauggcau

SEQ ID NO: 3685083 - RNA, 21 nt, Salmonella enterica enterica serovar Typhi Ty2
auuaagcugauauuuuacuuu

SEQ ID NO: 3685084 - RNA, 20 nt, Salmonella enterica enterica serovar Typhi Ty2
auuaaggaugaacucuaugc

SEQ ID NO: 3685085 - RNA, 23 nt, Salmonella enterica enterica serovar Typhi Ty2
auuaaggcguuaucuugacauga

SEQ ID NO: 3685086 - RNA, 17 nt, Salmonella enterica enterica serovar Typhi Ty2
auuaagggacgguaaau

SEQ ID NO: 3685087 - RNA, 12 nt, Salmonella enterica enterica serovar Typhi Ty2
auuaaguuuuuu

SEQ ID NO: 3685088 - RNA, 18 nt, Salmonella enterica enterica serovar Typhi Ty2
auuaucgauuugguaaau

SEQ ID NO: 3685089 - RNA, 16 nt, Salmonella enterica enterica serovar Typhi Ty2
auuaucguccggcauc

SEQ ID NO: 3685090 - RNA, 16 nt, Salmonella enterica enterica serovar Typhi Ty2
auuaucuuuauugaaa

SEQ ID NO: 3685091 - RNA, 18 nt, Salmonella enterica enterica serovar Typhi Ty2
auuaucuuuauugaaaag

SEQ ID NO: 3685092 - RNA, 17 nt, Salmonella enterica enterica serovar Typhi Ty2
auuaugaucgguuuuuu

SEQ ID NO: 3685093 - RNA, 18 nt, Salmonella enterica enterica serovar Typhi Ty2
auuaugccugucaucauc

SEQ ID NO: 3685094 - RNA, 13 nt, Salmonella enterica enterica serovar Typhi Ty2
auuauucugcuga

SEQ ID NO: 3685095 - RNA, 14 nt, Salmonella enterica enterica serovar Typhi Ty2
auuauugacauuca

SEQ ID NO: 3685096 - RNA, 15 nt, Salmonella enterica enterica serovar Typhi Ty2
auuauuggucaguag

SEQ ID NO: 3685097 - RNA, 15 nt, Salmonella enterica enterica serovar Typhi Ty2
auuauuggugaaaaa

SEQ ID NO: 3685098 - RNA, 20 nt, Salmonella enterica enterica serovar Typhi Ty2
auuauuggugaaaaaucauu

SEQ ID NO: 3685099 - RNA, 14 nt, Salmonella enterica enterica serovar Typhi Ty2
auuauuguuaaaaa

SEQ ID NO: 3685100 - RNA, 17 nt, Salmonella enterica enterica serovar Typhi Ty2
auuauuuuagugaaaaa

SEQ ID NO: 3685101 - RNA, 19 nt, Salmonella enterica enterica serovar Typhi Ty2
auuauuuuagugaaaaaau

SEQ ID NO: 3685102 - RNA, 17 nt, Salmonella enterica enterica serovar Typhi Ty2
auuauuuuuaaauaacu

SEQ ID NO: 3685103 - RNA, 18 nt, Salmonella enterica enterica serovar Typhi Ty2
auuauuuuuaaauaacuu

SEQ ID NO: 3685104 - RNA, 21 nt, Salmonella enterica enterica serovar Typhi Ty2
auucaaaccuucaagaaucaa

SEQ ID NO: 3685105 - RNA, 19 nt, Salmonella enterica enterica serovar Typhi Ty2
auucaacacauuccauuuu

SEQ ID NO: 3685106 - RNA, 22 nt, Salmonella enterica enterica serovar Typhi Ty2
auucaacacauuccauuuuucg

SEQ ID NO: 3685107 - RNA, 19 nt, Salmonella enterica enterica serovar Typhi Ty2
auucaacagggguuccggc

SEQ ID NO: 3685108 - RNA, 22 nt, Salmonella enterica enterica serovar Typhi Ty2
auucaaccagccgaucagcgcc

SEQ ID NO: 3685109 - RNA, 19 nt, Salmonella enterica enterica serovar Typhi Ty2
auucaacgccaucuuccuc

SEQ ID NO: 3685110 - RNA, 23 nt, Salmonella enterica enterica serovar Typhi Ty2
auucaagcaacuguagaaugcua

SEQ ID NO: 3685111 - RNA, 11 nt, Salmonella enterica enterica serovar Typhi Ty2
auucaauauug

SEQ ID NO: 3685112 - RNA, 17 nt, Salmonella enterica enterica serovar Typhi Ty2
auucaaucuggugacga

SEQ ID NO: 3685113 - RNA, 19 nt, Salmonella enterica enterica serovar Typhi Ty2
auucaauucuggaaucaau

SEQ ID NO: 3685114 - RNA, 18 nt, Salmonella enterica enterica serovar Typhi Ty2
auucacaccuuuauauuu

SEQ ID NO: 3685115 - RNA, 22 nt, Salmonella enterica enterica serovar Typhi Ty2
auucacaccuuuauauuuuucc

SEQ ID NO: 3685116 - RNA, 22 nt, Salmonella enterica enterica serovar Typhi Ty2
auucacacgcucacccaguuuu

SEQ ID NO: 3685117 - RNA, 16 nt, Salmonella enterica enterica serovar Typhi Ty2
auucaccaaaaggcag

SEQ ID NO: 3685118 - RNA, 14 nt, Salmonella enterica enterica serovar Typhi Ty2
auucaccaaauccu

SEQ ID NO: 3685119 - RNA, 17 nt, Salmonella enterica enterica serovar Typhi Ty2
auucaccaaauccucac

SEQ ID NO: 3685120 - RNA, 14 nt, Salmonella enterica enterica serovar Typhi Ty2
auucaccaacugcu

SEQ ID NO: 3685121 - RNA, 22 nt, Salmonella enterica enterica serovar Typhi Ty2
auucaccaccacccgaucgccc

SEQ ID NO: 3685122 - RNA, 19 nt, Salmonella enterica enterica serovar Typhi Ty2
auucacccaauaaauaaua

SEQ ID NO: 3685123 - RNA, 21 nt, Salmonella enterica enterica serovar Typhi Ty2
auucacccaauaaauaauauc

SEQ ID NO: 3685124 - RNA, 19 nt, Salmonella enterica enterica serovar Typhi Ty2
auucaccuggauuccucca

SEQ ID NO: 3685125 - RNA, 22 nt, Salmonella enterica enterica serovar Typhi Ty2
auucacgcgauuguuauccccc

SEQ ID NO: 3685126 - RNA, 16 nt, Salmonella enterica enterica serovar Typhi Ty2
auucacguagcggcgc

SEQ ID NO: 3685127 - RNA, 16 nt, Salmonella enterica enterica serovar Typhi Ty2
auucagaaccugcgau

SEQ ID NO: 3685128 - RNA, 16 nt, Salmonella enterica enterica serovar Typhi Ty2
auucagaauaugccag

SEQ ID NO: 3685129 - RNA, 23 nt, Salmonella enterica enterica serovar Typhi Ty2
auucagaccccugugauuuaugu

SEQ ID NO: 3685130 - RNA, 17 nt, Salmonella enterica enterica serovar Typhi Ty2
auucagcacccagcgaa

SEQ ID NO: 3685131 - RNA, 16 nt, Salmonella enterica enterica serovar Typhi Ty2
auucagcaggaggcuu

SEQ ID NO: 3685132 - RNA, 13 nt, Salmonella enterica enterica serovar Typhi Ty2
auucagcggcugc

SEQ ID NO: 3685133 - RNA, 20 nt, Salmonella enterica enterica serovar Typhi Ty2
auucagcugcggcugaacca

SEQ ID NO: 3685134 - RNA, 16 nt, Salmonella enterica enterica serovar Typhi Ty2
auucaggccgccagca

SEQ ID NO: 3685135 - RNA, 21 nt, Salmonella enterica enterica serovar Typhi Ty2
auucagggaacguugcgccau

SEQ ID NO: 3685136 - RNA, 21 nt, Salmonella enterica enterica serovar Typhi Ty2
auucagggcuuuauuuuacaa

SEQ ID NO: 3685137 - RNA, 16 nt, Salmonella enterica enterica serovar Typhi Ty2
auucaggguugucuca

SEQ ID NO: 3685138 - RNA, 18 nt, Salmonella enterica enterica serovar Typhi Ty2
auucaggguugucucaga

SEQ ID NO: 3685139 - RNA, 11 nt, Salmonella enterica enterica serovar Typhi Ty2
auucagguaau

SEQ ID NO: 3685140 - RNA, 12 nt, Salmonella enterica enterica serovar Typhi Ty2
auucagguaaua

SEQ ID NO: 3685141 - RNA, 17 nt, Salmonella enterica enterica serovar Typhi Ty2
auucagguuaauaacug

SEQ ID NO: 3685142 - RNA, 21 nt, Salmonella enterica enterica serovar Typhi Ty2
auucagguuauuugccucugg

SEQ ID NO: 3685143 - RNA, 20 nt, Salmonella enterica enterica serovar Typhi Ty2
auucagguuuugcugaucaa

SEQ ID NO: 3685144 - RNA, 20 nt, Salmonella enterica enterica serovar Typhi Ty2
auucauaaugguugugccag

SEQ ID NO: 3685145 - RNA, 16 nt, Salmonella enterica enterica serovar Typhi Ty2
auucauaccuuuaagc

SEQ ID NO: 3685146 - RNA, 15 nt, Salmonella enterica enterica serovar Typhi Ty2
auucauagccacagc

SEQ ID NO: 3685147 - RNA, 15 nt, Salmonella enterica enterica serovar Typhi Ty2
auucaucaucuuguc

SEQ ID NO: 3685148 - RNA, 20 nt, Salmonella enterica enterica serovar Typhi Ty2
auucaucgauacgcggaugu

SEQ ID NO: 3685149 - RNA, 15 nt, Salmonella enterica enterica serovar Typhi Ty2
auucaucuccucuuc

SEQ ID NO: 3685150 - RNA, 15 nt, Salmonella enterica enterica serovar Typhi Ty2
auucaugaucuuucc

SEQ ID NO: 3685151 - RNA, 19 nt, Salmonella enterica enterica serovar Typhi Ty2
auucaugcaacuucaccuc

SEQ ID NO: 3685152 - RNA, 19 nt, Salmonella enterica enterica serovar Typhi Ty2
auucaugccagaagcaaau

SEQ ID NO: 3685153 - RNA, 23 nt, Salmonella enterica enterica serovar Typhi Ty2
auucaugccagaagcaaauucag

SEQ ID NO: 3685154 - RNA, 20 nt, Salmonella enterica enterica serovar Typhi Ty2
auucaugguacucaacauca

SEQ ID NO: 3685155 - RNA, 14 nt, Salmonella enterica enterica serovar Typhi Ty2
auucauuauuuuua

SEQ ID NO: 3685156 - RNA, 16 nt, Salmonella enterica enterica serovar Typhi Ty2
auucauuauuuuuaaa

SEQ ID NO: 3685157 - RNA, 22 nt, Salmonella enterica enterica serovar Typhi Ty2
auucauuauuuuuaaauaacuu

SEQ ID NO: 3685158 - RNA, 21 nt, Salmonella enterica enterica serovar Typhi Ty2
auucauucacccaauaaauaa

SEQ ID NO: 3685159 - RNA, 15 nt, Salmonella enterica enterica serovar Typhi Ty2
auucauucccauacu

SEQ ID NO: 3685160 - RNA, 22 nt, Salmonella enterica enterica serovar Typhi Ty2
auucauuguccguaauuugcuu

SEQ ID NO: 3685161 - RNA, 18 nt, Salmonella enterica enterica serovar Typhi Ty2
auucauugucuuuuucuc

SEQ ID NO: 3685162 - RNA, 15 nt, Salmonella enterica enterica serovar Typhi Ty2
auucauuucaaugua

SEQ ID NO: 3685163 - RNA, 14 nt, Salmonella enterica enterica serovar Typhi Ty2
auucauuuccagca

SEQ ID NO: 3685164 - RNA, 21 nt, Salmonella enterica enterica serovar Typhi Ty2
auuccagaagcgcuuugccaa

SEQ ID NO: 3685165 - RNA, 18 nt, Salmonella enterica enterica serovar Typhi Ty2
auuccagcgugccgagca

SEQ ID NO: 3685166 - RNA, 22 nt, Salmonella enterica enterica serovar Typhi Ty2
auuccagcgugccgagcaacag

SEQ ID NO: 3685167 - RNA, 18 nt, Salmonella enterica enterica serovar Typhi Ty2
auuccagggcauuuuuuc

SEQ ID NO: 3685168 - RNA, 14 nt, Salmonella enterica enterica serovar Typhi Ty2
auuccaguccuuuc

SEQ ID NO: 3685169 - RNA, 21 nt, Salmonella enterica enterica serovar Typhi Ty2
auuccaguccuuucgacgcau

SEQ ID NO: 3685170 - RNA, 14 nt, Salmonella enterica enterica serovar Typhi Ty2
auugaacauuuuuu

SEQ ID NO: 3685171 - RNA, 17 nt, Salmonella enterica enterica serovar Typhi Ty2
auugaacggcucaaaau

SEQ ID NO: 3685172 - RNA, 12 nt, Salmonella enterica enterica serovar Typhi Ty2
auugaacgugau

SEQ ID NO: 3685173 - RNA, 23 nt, Salmonella enterica enterica serovar Typhi Ty2
auugaagcgauauucgguaagcu

SEQ ID NO: 3685174 - RNA, 12 nt, Salmonella enterica enterica serovar Typhi Ty2
auugaagugcga

SEQ ID NO: 3685175 - RNA, 21 nt, Salmonella enterica enterica serovar Typhi Ty2
auugaauccggguuccugcau

SEQ ID NO: 3685176 - RNA, 19 nt, Salmonella enterica enterica serovar Typhi Ty2
auugaauucaccgcaugac

SEQ ID NO: 3685177 - RNA, 20 nt, Salmonella enterica enterica serovar Typhi Ty2
auugaccaucucuuccgcgg

SEQ ID NO: 3685178 - RNA, 17 nt, Salmonella enterica enterica serovar Typhi Ty2
auugaccgcuuuuucca

SEQ ID NO: 3685179 - RNA, 20 nt, Salmonella enterica enterica serovar Typhi Ty2
auugaccguccccagccaga

SEQ ID NO: 3685180 - RNA, 18 nt, Salmonella enterica enterica serovar Typhi Ty2
auugacgggaaaucuccc

SEQ ID NO: 3685181 - RNA, 22 nt, Salmonella enterica enterica serovar Typhi Ty2
auugacuuaucgcgcuggcagu

SEQ ID NO: 3685182 - RNA, 14 nt, Salmonella enterica enterica serovar Typhi Ty2
auugacuucaacgc

SEQ ID NO: 3685183 - RNA, 14 nt, Salmonella enterica enterica serovar Typhi Ty2
auugagacaugccg

SEQ ID NO: 3685184 - RNA, 20 nt, Salmonella enterica enterica serovar Typhi Ty2
auugagcgcaaaacgcugcu

SEQ ID NO: 3685185 - RNA, 19 nt, Salmonella enterica enterica serovar Typhi Ty2
auugaggcggguaauuugc

SEQ ID NO: 3685186 - RNA, 20 nt, Salmonella enterica enterica serovar Typhi Ty2
auugaggcggguaauuugcg

SEQ ID NO: 3685187 - RNA, 15 nt, Salmonella enterica enterica serovar Typhi Ty2
auugaggcuacccag

SEQ ID NO: 3685188 - RNA, 22 nt, Salmonella enterica enterica serovar Typhi Ty2
auugaguaaauaaaucagcgcg

SEQ ID NO: 3685189 - RNA, 22 nt, Salmonella enterica enterica serovar Typhi Ty2
auugauaccuaaacgcgucaga

SEQ ID NO: 3685190 - RNA, 14 nt, Salmonella enterica enterica serovar Typhi Ty2
auugauauuccgcg

SEQ ID NO: 3685191 - RNA, 21 nt, Salmonella enterica enterica serovar Typhi Ty2
auugaucacaaaaucauugcg

SEQ ID NO: 3685192 - RNA, 22 nt, Salmonella enterica enterica serovar Typhi Ty2
auugaucacaaaaucauugcgu

SEQ ID NO: 3685193 - RNA, 20 nt, Salmonella enterica enterica serovar Typhi Ty2
auugaugccugcccaucuaa

SEQ ID NO: 3685194 - RNA, 20 nt, Salmonella enterica enterica serovar Typhi Ty2
auugauuaaucgucaucccg

SEQ ID NO: 3685195 - RNA, 17 nt, Salmonella enterica enterica serovar Typhi Ty2
auugauuggcaaacugu

SEQ ID NO: 3685196 - RNA, 13 nt, Salmonella enterica enterica serovar Typhi Ty2
auugauuuuucug

SEQ ID NO: 3685197 - RNA, 22 nt, Salmonella enterica enterica serovar Typhi Ty2
auugcaacgaucccuaauaaaa

SEQ ID NO: 3685198 - RNA, 13 nt, Salmonella enterica enterica serovar Typhi Ty2
auugcaagaauau

SEQ ID NO: 3685199 - RNA, 16 nt, Salmonella enterica enterica serovar Typhi Ty2
auugcagaauauguuc

SEQ ID NO: 3685200 - RNA, 22 nt, Salmonella enterica enterica serovar Typhi Ty2
auugcagggugcagcaaauaau

SEQ ID NO: 3685201 - RNA, 13 nt, Salmonella enterica enterica serovar Typhi Ty2
auugcauaucgcu

SEQ ID NO: 3685202 - RNA, 13 nt, Salmonella enterica enterica serovar Typhi Ty2
auugcaucaucgg

SEQ ID NO: 3685203 - RNA, 14 nt, Salmonella enterica enterica serovar Typhi Ty2
auugcauggcaauu

SEQ ID NO: 3685204 - RNA, 13 nt, Salmonella enterica enterica serovar Typhi Ty2
auugccacuuaau

SEQ ID NO: 3685205 - RNA, 21 nt, Salmonella enterica enterica serovar Typhi Ty2
auugccacuuaauaucaauau

SEQ ID NO: 3685206 - RNA, 20 nt, Salmonella enterica enterica serovar Typhi Ty2
auugccaugcgacuaaccug

SEQ ID NO: 3685207 - RNA, 13 nt, Salmonella enterica enterica serovar Typhi Ty2
auugcccaccggc

SEQ ID NO: 3685208 - RNA, 15 nt, Salmonella enterica enterica serovar Typhi Ty2
auugcccuuuuguuu

SEQ ID NO: 3685209 - RNA, 17 nt, Salmonella enterica enterica serovar Typhi Ty2
auugcccuuuuguuuuu

SEQ ID NO: 3685210 - RNA, 13 nt, Salmonella enterica enterica serovar Typhi Ty2
auugccgaccauu

SEQ ID NO: 3685211 - RNA, 19 nt, Salmonella enterica enterica serovar Typhi Ty2
auugccgaccauuacccac

SEQ ID NO: 3685212 - RNA, 19 nt, Salmonella enterica enterica serovar Typhi Ty2
auugccgaccgccagcaga

SEQ ID NO: 3685213 - RNA, 18 nt, Salmonella enterica enterica serovar Typhi Ty2
auugccgccagcuccugc

SEQ ID NO: 3685214 - RNA, 21 nt, Salmonella enterica enterica serovar Typhi Ty2
auugccgccaucuuuacccug

SEQ ID NO: 3685215 - RNA, 18 nt, Salmonella enterica enterica serovar Typhi Ty2
auugccgcgcccugcgga

SEQ ID NO: 3685216 - RNA, 20 nt, Salmonella enterica enterica serovar Typhi Ty2
auugccgcuuaaauuaccgc

SEQ ID NO: 3685217 - RNA, 16 nt, Salmonella enterica enterica serovar Typhi Ty2
auugccguuaacugcu

SEQ ID NO: 3685218 - RNA, 21 nt, Salmonella enterica enterica serovar Typhi Ty2
auugccguuguugucaauauc

SEQ ID NO: 3685219 - RNA, 16 nt, Salmonella enterica enterica serovar Typhi Ty2
auugcgaauaaaacug

SEQ ID NO: 3685220 - RNA, 17 nt, Salmonella enterica enterica serovar Typhi Ty2
auugcgaauaaaacugc

SEQ ID NO: 3685221 - RNA, 22 nt, Salmonella enterica enterica serovar Typhi Ty2
auugcgacaacuagaauuuuca

SEQ ID NO: 3685222 - RNA, 20 nt, Salmonella enterica enterica serovar Typhi Ty2
auugcgacaagcucauuucc

SEQ ID NO: 3685223 - RNA, 13 nt, Salmonella enterica enterica serovar Typhi Ty2
auugcgagaaaaa

SEQ ID NO: 3685224 - RNA, 14 nt, Salmonella enterica enterica serovar Typhi Ty2
auugcgagaaaaaa

SEQ ID NO: 3685225 - RNA, 16 nt, Salmonella enterica enterica serovar Typhi Ty2
auugcgauaugcuguu

SEQ ID NO: 3685226 - RNA, 21 nt, Salmonella enterica enterica serovar Typhi Ty2
auugcgaucuccuuuaaugaa

SEQ ID NO: 3685227 - RNA, 13 nt, Salmonella enterica enterica serovar Typhi Ty2
auugcgccaccuu

SEQ ID NO: 3685228 - RNA, 13 nt, Salmonella enterica enterica serovar Typhi Ty2
auugcguugcuuu

SEQ ID NO: 3685229 - RNA, 14 nt, Salmonella enterica enterica serovar Typhi Ty2
auugcugaagauaa

SEQ ID NO: 3685230 - RNA, 22 nt, Salmonella enterica enterica serovar Typhi Ty2
auugcugacaaaauaaagugaa

SEQ ID NO: 3685231 - RNA, 16 nt, Salmonella enterica enterica serovar Typhi Ty2
auugcugacgcgcuuu

SEQ ID NO: 3685232 - RNA, 14 nt, Salmonella enterica enterica serovar Typhi Ty2
auugcugagcugac

SEQ ID NO: 3685233 - RNA, 20 nt, Salmonella enterica enterica serovar Typhi Ty2
auugcugcuauauaacauau

SEQ ID NO: 3685234 - RNA, 19 nt, Salmonella enterica enterica serovar Typhi Ty2
auugcuggcagaugaacau

SEQ ID NO: 3685235 - RNA, 23 nt, Salmonella enterica enterica serovar Typhi Ty2
auugcuguaggcacuuuccagac

SEQ ID NO: 3685236 - RNA, 15 nt, Salmonella enterica enterica serovar Typhi Ty2
auugcuguauuuuau

SEQ ID NO: 3685237 - RNA, 15 nt, Salmonella enterica enterica serovar Typhi Ty2
auugcuguuaauuuc

SEQ ID NO: 3685238 - RNA, 18 nt, Salmonella enterica enterica serovar Typhi Ty2
auugcuuucaauuuccgc

SEQ ID NO: 3685239 - RNA, 14 nt, Salmonella enterica enterica serovar Typhi Ty2
auugcuuuuuucca

SEQ ID NO: 3685240 - RNA, 17 nt, Salmonella enterica enterica serovar Typhi Ty2
auuggaaaaccccaucc

SEQ ID NO: 3685241 - RNA, 13 nt, Salmonella enterica enterica serovar Typhi Ty2
auuggcaccacca

SEQ ID NO: 3685242 - RNA, 11 nt, Salmonella enterica enterica serovar Typhi Ty2
auuggcaucug

SEQ ID NO: 3685243 - RNA, 14 nt, Salmonella enterica enterica serovar Typhi Ty2
auuggccaucaggu

SEQ ID NO: 3685244 - RNA, 13 nt, Salmonella enterica enterica serovar Typhi Ty2
auuggccccuggc

SEQ ID NO: 3685245 - RNA, 16 nt, Salmonella enterica enterica serovar Typhi Ty2
auuggcgcagccuguu

SEQ ID NO: 3685246 - RNA, 21 nt, Salmonella enterica enterica serovar Typhi Ty2
auuggcggacgaaucuggaua

SEQ ID NO: 3685247 - RNA, 23 nt, Salmonella enterica enterica serovar Typhi Ty2
auuggcgucgacgugucuaugcu

SEQ ID NO: 3685248 - RNA, 16 nt, Salmonella enterica enterica serovar Typhi Ty2
auuggcguuaccggca

SEQ ID NO: 3685249 - RNA, 20 nt, Salmonella enterica enterica serovar Typhi Ty2
auuggcucggcgucaucccg

SEQ ID NO: 3685250 - RNA, 23 nt, Salmonella enterica enterica serovar Typhi Ty2
auugggccagcagcgcaucaucc

SEQ ID NO: 3685251 - RNA, 20 nt, Salmonella enterica enterica serovar Typhi Ty2
auugggcguaagaaaaguuu

SEQ ID NO: 3685252 - RNA, 16 nt, Salmonella enterica enterica serovar Typhi Ty2
auuucaggaauacauu

SEQ ID NO: 3685253 - RNA, 20 nt, Salmonella enterica enterica serovar Typhi Ty2
auuucaggcaaaaaaaaacc

SEQ ID NO: 3685254 - RNA, 17 nt, Salmonella enterica enterica serovar Typhi Ty2
auuucaggcaaaggaau

SEQ ID NO: 3685255 - RNA, 17 nt, Salmonella enterica enterica serovar Typhi Ty2
auuucagggaaaagaag

SEQ ID NO: 3685256 - RNA, 20 nt, Salmonella enterica enterica serovar Typhi Ty2
auuucaguacagccaaaaau

SEQ ID NO: 3685257 - RNA, 21 nt, Salmonella enterica enterica serovar Typhi Ty2
auuucaguacagccaaaaaua

SEQ ID NO: 3685258 - RNA, 21 nt, Salmonella enterica enterica serovar Typhi Ty2
auuucagugaaucgacggcaa

SEQ ID NO: 3685259 - RNA, 14 nt, Salmonella enterica enterica serovar Typhi Ty2
auuucauaauaagc

SEQ ID NO: 3685260 - RNA, 17 nt, Salmonella enterica enterica serovar Typhi Ty2
auuuccagugccaguua

SEQ ID NO: 3685261 - RNA, 15 nt, Salmonella enterica enterica serovar Typhi Ty2
auuucccccacuucu

SEQ ID NO: 3685262 - RNA, 12 nt, Salmonella enterica enterica serovar Typhi Ty2
auuuccgcagcc

SEQ ID NO: 3685263 - RNA, 18 nt, Salmonella enterica enterica serovar Typhi Ty2
auuuccgcagccagaauc

SEQ ID NO: 3685264 - RNA, 16 nt, Salmonella enterica enterica serovar Typhi Ty2
auuuccgcgcaaucgc

SEQ ID NO: 3685265 - RNA, 17 nt, Salmonella enterica enterica serovar Typhi Ty2
auuuccgcgcaaucgcc

SEQ ID NO: 3685266 - RNA, 16 nt, Salmonella enterica enterica serovar Typhi Ty2
auuuccgcuucgcggg

SEQ ID NO: 3685267 - RNA, 21 nt, Salmonella enterica enterica serovar Typhi Ty2
auuuccggaccguuaucaaaa

SEQ ID NO: 3685268 - RNA, 21 nt, Salmonella enterica enterica serovar Typhi Ty2
auuucgacgauaaaaaaagua

SEQ ID NO: 3685269 - RNA, 22 nt, Salmonella enterica enterica serovar Typhi Ty2
auuucgacgucaacgguaaaau

SEQ ID NO: 3685270 - RNA, 12 nt, Salmonella enterica enterica serovar Typhi Ty2
auuucgaucugu

SEQ ID NO: 3685271 - RNA, 12 nt, Salmonella enterica enterica serovar Typhi Ty2
auuucgauggua

SEQ ID NO: 3685272 - RNA, 19 nt, Salmonella enterica enterica serovar Typhi Ty2
auuucgcgaauaaucuguu

SEQ ID NO: 3685273 - RNA, 20 nt, Salmonella enterica enterica serovar Typhi Ty2
auuucgcuggcggccccucu

SEQ ID NO: 3685274 - RNA, 16 nt, Salmonella enterica enterica serovar Typhi Ty2
auuucggaaugagaga

SEQ ID NO: 3685275 - RNA, 17 nt, Salmonella enterica enterica serovar Typhi Ty2
auuucuccgcccaucca

SEQ ID NO: 3685276 - RNA, 13 nt, Salmonella enterica enterica serovar Typhi Ty2
auuucuccugcau

SEQ ID NO: 3685277 - RNA, 15 nt, Salmonella enterica enterica serovar Typhi Ty2
auuucuccugcgcca

SEQ ID NO: 3685278 - RNA, 18 nt, Salmonella enterica enterica serovar Typhi Ty2
auuucuccugcgccagcc

SEQ ID NO: 3685279 - RNA, 22 nt, Salmonella enterica enterica serovar Typhi Ty2
auuucuccugcgccagccggau

SEQ ID NO: 3685280 - RNA, 13 nt, Salmonella enterica enterica serovar Typhi Ty2
auuucucgcccgc

SEQ ID NO: 3685281 - RNA, 18 nt, Salmonella enterica enterica serovar Typhi Ty2
auuucugaccacauuuuc

SEQ ID NO: 3685282 - RNA, 22 nt, Salmonella enterica enterica serovar Typhi Ty2
auuucugccugcuucagacaac

SEQ ID NO: 3685283 - RNA, 13 nt, Salmonella enterica enterica serovar Typhi Ty2
auuucugcugcca

SEQ ID NO: 3685284 - RNA, 15 nt, Salmonella enterica enterica serovar Typhi Ty2
auuucugcuggacgu

SEQ ID NO: 3685285 - RNA, 14 nt, Salmonella enterica enterica serovar Typhi Ty2
auuucuggccccug

SEQ ID NO: 3685286 - RNA, 17 nt, Salmonella enterica enterica serovar Typhi Ty2
auuucuuaauuccucag

SEQ ID NO: 3685287 - RNA, 23 nt, Salmonella enterica enterica serovar Typhi Ty2
auuucuuagcacccaccaucacu

SEQ ID NO: 3685288 - RNA, 14 nt, Salmonella enterica enterica serovar Typhi Ty2
auuucuuagcgcca

SEQ ID NO: 3685289 - RNA, 14 nt, Salmonella enterica enterica serovar Typhi Ty2
auuucuuccagcac

SEQ ID NO: 3685290 - RNA, 13 nt, Salmonella enterica enterica serovar Typhi Ty2
auuucuuccauua

SEQ ID NO: 3685291 - RNA, 16 nt, Salmonella enterica enterica serovar Typhi Ty2
auuucuugaucaaucu

SEQ ID NO: 3685292 - RNA, 16 nt, Salmonella enterica enterica serovar Typhi Ty2
auuucuugcaauagcg

SEQ ID NO: 3685293 - RNA, 23 nt, Salmonella enterica enterica serovar Typhi Ty2
auuugaaggacugauacagccaa

SEQ ID NO: 3685294 - RNA, 23 nt, Salmonella enterica enterica serovar Typhi Ty2
auuugacgagucggaucaugaaa

SEQ ID NO: 3685295 - RNA, 15 nt, Salmonella enterica enterica serovar Typhi Ty2
auuugcaucaaacuu

SEQ ID NO: 3685296 - RNA, 18 nt, Salmonella enterica enterica serovar Typhi Ty2
auuugcccuuccagcagc

SEQ ID NO: 3685297 - RNA, 13 nt, Salmonella enterica enterica serovar Typhi Ty2
auuugcgcaguuu

SEQ ID NO: 3685298 - RNA, 16 nt, Salmonella enterica enterica serovar Typhi Ty2
auuugcgcuuuuaauu

SEQ ID NO: 3685299 - RNA, 17 nt, Salmonella enterica enterica serovar Typhi Ty2
auuugcggcgucgccug

SEQ ID NO: 3685300 - RNA, 17 nt, Salmonella enterica enterica serovar Typhi Ty2
auuugcgucguuaacug

SEQ ID NO: 3685301 - RNA, 16 nt, Salmonella enterica enterica serovar Typhi Ty2
auuugcgugucaucaa

SEQ ID NO: 3685302 - RNA, 11 nt, Salmonella enterica enterica serovar Typhi Ty2
auuugcucagu

SEQ ID NO: 3685303 - RNA, 15 nt, Salmonella enterica enterica serovar Typhi Ty2
auuugcucaguucag

SEQ ID NO: 3685304 - RNA, 13 nt, Salmonella enterica enterica serovar Typhi Ty2
auuugcugcaacg

SEQ ID NO: 3685305 - RNA, 15 nt, Salmonella enterica enterica serovar Typhi Ty2
auuugcugcauuucu

SEQ ID NO: 3685306 - RNA, 22 nt, Salmonella enterica enterica serovar Typhi Ty2
auuugcugcauuucuuguugac

SEQ ID NO: 3685307 - RNA, 16 nt, Salmonella enterica enterica serovar Typhi Ty2
auuugcugcugcucgc

SEQ ID NO: 3685308 - RNA, 21 nt, Salmonella enterica enterica serovar Typhi Ty2
auuugcuguuuuuuguugauu

SEQ ID NO: 3685309 - RNA, 16 nt, Salmonella enterica enterica serovar Typhi Ty2
auuuggcuuaaauaau

SEQ ID NO: 3685310 - RNA, 16 nt, Salmonella enterica enterica serovar Typhi Ty2
auuugguaaauaacuu

SEQ ID NO: 3685311 - RNA, 19 nt, Salmonella enterica enterica serovar Typhi Ty2
auuuguacaaaaaauguga

SEQ ID NO: 3685312 - RNA, 16 nt, Salmonella enterica enterica serovar Typhi Ty2
auuugugagauaaaaa

SEQ ID NO: 3685313 - RNA, 13 nt, Salmonella enterica enterica serovar Typhi Ty2
auuugugauaaag

SEQ ID NO: 3685314 - RNA, 18 nt, Salmonella enterica enterica serovar Typhi Ty2
auuugugcugguggugcc

SEQ ID NO: 3685315 - RNA, 20 nt, Salmonella enterica enterica serovar Typhi Ty2
auuuguggcguuaacggcgc

SEQ ID NO: 3685316 - RNA, 14 nt, Salmonella enterica enterica serovar Typhi Ty2
auuuguuaguccgc

SEQ ID NO: 3685317 - RNA, 15 nt, Salmonella enterica enterica serovar Typhi Ty2
auuuguugacugucu

SEQ ID NO: 3685318 - RNA, 15 nt, Salmonella enterica enterica serovar Typhi Ty2
auuuguugguuuaaa

SEQ ID NO: 3685319 - RNA, 14 nt, Salmonella enterica enterica serovar Typhi Ty2
auuuuaaauacacc

SEQ ID NO: 3685320 - RNA, 13 nt, Salmonella enterica enterica serovar Typhi Ty2
auuuuaacaucac

SEQ ID NO: 3685321 - RNA, 23 nt, Salmonella enterica enterica serovar Typhi Ty2
auuuuaccuucgcguuuaucacc

SEQ ID NO: 3685322 - RNA, 14 nt, Salmonella enterica enterica serovar Typhi Ty2
auuuuacgagaacc

SEQ ID NO: 3685323 - RNA, 17 nt, Salmonella enterica enterica serovar Typhi Ty2
auuuuagaaauagaaau

SEQ ID NO: 3685324 - RNA, 14 nt, Salmonella enterica enterica serovar Typhi Ty2
auuuuagaucccca

SEQ ID NO: 3685325 - RNA, 13 nt, Salmonella enterica enterica serovar Typhi Ty2
auuuuagcgcauc

SEQ ID NO: 3685326 - RNA, 15 nt, Salmonella enterica enterica serovar Typhi Ty2
auuuuagcgcaucgc

SEQ ID NO: 3685327 - RNA, 16 nt, Salmonella enterica enterica serovar Typhi Ty2
auuuuauagcagucag

SEQ ID NO: 3685328 - RNA, 22 nt, Salmonella enterica enterica serovar Typhi Ty2
auuuuaucgacgcuauuuuuca

SEQ ID NO: 3685329 - RNA, 16 nt, Salmonella enterica enterica serovar Typhi Ty2
auuuuaugaugcauuu

SEQ ID NO: 3685330 - RNA, 21 nt, Salmonella enterica enterica serovar Typhi Ty2
auuuuauggaggauauaaaaa

SEQ ID NO: 3685331 - RNA, 14 nt, Salmonella enterica enterica serovar Typhi Ty2
auuuuauuuaaaaa

SEQ ID NO: 3685332 - RNA, 13 nt, Salmonella enterica enterica serovar Typhi Ty2
auuuuauuuuuca

SEQ ID NO: 3685333 - RNA, 13 nt, Salmonella enterica enterica serovar Typhi Ty2
auuuucaaaaaca

SEQ ID NO: 3685334 - RNA, 14 nt, Salmonella enterica enterica serovar Typhi Ty2
auuuucaaaaacaa

SEQ ID NO: 3685335 - RNA, 20 nt, Salmonella enterica enterica serovar Typhi Ty2
caaaaaucgucaucagauag

SEQ ID NO: 3685336 - RNA, 14 nt, Salmonella enterica enterica serovar Typhi Ty2
caaaaaugaucacu

SEQ ID NO: 3685337 - RNA, 23 nt, Salmonella enterica enterica serovar Typhi Ty2
caaaaauggcuucggcaauuucc

SEQ ID NO: 3685338 - RNA, 21 nt, Salmonella enterica enterica serovar Typhi Ty2
caaaaauuucgaccucuucgu

SEQ ID NO: 3685339 - RNA, 15 nt, Salmonella enterica enterica serovar Typhi Ty2
caaaaauuugcgcga

SEQ ID NO: 3685340 - RNA, 15 nt, Salmonella enterica enterica serovar Typhi Ty2
caaaacaacaaagua

SEQ ID NO: 3685341 - RNA, 15 nt, Salmonella enterica enterica serovar Typhi Ty2
caaaaccacagugac

SEQ ID NO: 3685342 - RNA, 15 nt, Salmonella enterica enterica serovar Typhi Ty2
caaaacccaccagca

SEQ ID NO: 3685343 - RNA, 19 nt, Salmonella enterica enterica serovar Typhi Ty2
caaaaccuucauaaauacg

SEQ ID NO: 3685344 - RNA, 17 nt, Salmonella enterica enterica serovar Typhi Ty2
caaaacgcugcuauuuu

SEQ ID NO: 3685345 - RNA, 15 nt, Salmonella enterica enterica serovar Typhi Ty2
caaaacggucgguaa

SEQ ID NO: 3685346 - RNA, 17 nt, Salmonella enterica enterica serovar Typhi Ty2
caaaacgucgugagugg

SEQ ID NO: 3685347 - RNA, 21 nt, Salmonella enterica enterica serovar Typhi Ty2
caaaacugaguuguaggcuca

SEQ ID NO: 3685348 - RNA, 14 nt, Salmonella enterica enterica serovar Typhi Ty2
caaaagaaaaaacu

SEQ ID NO: 3685349 - RNA, 18 nt, Salmonella enterica enterica serovar Typhi Ty2
caaaagaaagcaauagcu

SEQ ID NO: 3685350 - RNA, 22 nt, Salmonella enterica enterica serovar Typhi Ty2
caaaagaggaaguugcucccgc

SEQ ID NO: 3685351 - RNA, 23 nt, Salmonella enterica enterica serovar Typhi Ty2
caaaagaggaaguugcucccgca

SEQ ID NO: 3685352 - RNA, 15 nt, Salmonella enterica enterica serovar Typhi Ty2
caaaagccagauaaa

SEQ ID NO: 3685353 - RNA, 21 nt, Salmonella enterica enterica serovar Typhi Ty2
caaaagccggucguaaugagc

SEQ ID NO: 3685354 - RNA, 22 nt, Salmonella enterica enterica serovar Typhi Ty2
caaaagccggucguaaugagca

SEQ ID NO: 3685355 - RNA, 17 nt, Salmonella enterica enterica serovar Typhi Ty2
caaaaggauacagcgcc

SEQ ID NO: 3685356 - RNA, 20 nt, Salmonella enterica enterica serovar Typhi Ty2
caaaaggcgccgcuuccccc

SEQ ID NO: 3685357 - RNA, 17 nt, Salmonella enterica enterica serovar Typhi Ty2
caaaaggcuggaacaga

SEQ ID NO: 3685358 - RNA, 23 nt, Salmonella enterica enterica serovar Typhi Ty2
caaaaggucgauuaaacgccugg

SEQ ID NO: 3685359 - RNA, 16 nt, Salmonella enterica enterica serovar Typhi Ty2
caaaagugaucauggu

SEQ ID NO: 3685360 - RNA, 18 nt, Salmonella enterica enterica serovar Typhi Ty2
caaaauaaauauccuccg

SEQ ID NO: 3685361 - RNA, 18 nt, Salmonella enterica enterica serovar Typhi Ty2
caaaauaacgcuucaccu

SEQ ID NO: 3685362 - RNA, 18 nt, Salmonella enterica enterica serovar Typhi Ty2
caaaauaacguuuaaacu

SEQ ID NO: 3685363 - RNA, 17 nt, Salmonella enterica enterica serovar Typhi Ty2
caaaauaagucauauca

SEQ ID NO: 3685364 - RNA, 16 nt, Salmonella enterica enterica serovar Typhi Ty2
caaaauaauacguuua

SEQ ID NO: 3685365 - RNA, 14 nt, Salmonella enterica enterica serovar Typhi Ty2
caaaauacuggccg

SEQ ID NO: 3685366 - RNA, 18 nt, Salmonella enterica enterica serovar Typhi Ty2
caaaauauauaauuuaua

SEQ ID NO: 3685367 - RNA, 16 nt, Salmonella enterica enterica serovar Typhi Ty2
caaaaucaaacagaau

SEQ ID NO: 3685368 - RNA, 20 nt, Salmonella enterica enterica serovar Typhi Ty2
caaaaucacgcacacgucug

SEQ ID NO: 3685369 - RNA, 21 nt, Salmonella enterica enterica serovar Typhi Ty2
caaaaucacgcacacgucuga

SEQ ID NO: 3685370 - RNA, 14 nt, Salmonella enterica enterica serovar Typhi Ty2
caaaaucaucauca

SEQ ID NO: 3685371 - RNA, 16 nt, Salmonella enterica enterica serovar Typhi Ty2
caaaaucccggcuggg

SEQ ID NO: 3685372 - RNA, 23 nt, Salmonella enterica enterica serovar Typhi Ty2
caaaauccgccaccgcgcgcaga

SEQ ID NO: 3685373 - RNA, 16 nt, Salmonella enterica enterica serovar Typhi Ty2
caaaauccuuguugau

SEQ ID NO: 3685374 - RNA, 19 nt, Salmonella enterica enterica serovar Typhi Ty2
caaaaucgcccaggccuga

SEQ ID NO: 3685375 - RNA, 21 nt, Salmonella enterica enterica serovar Typhi Ty2
caaaaucgcccaggccugaug

SEQ ID NO: 3685376 - RNA, 23 nt, Salmonella enterica enterica serovar Typhi Ty2
caaaaucgcgcuuuauguuuaug

SEQ ID NO: 3685377 - RNA, 18 nt, Salmonella enterica enterica serovar Typhi Ty2
caaaaucggcuucuccca

SEQ ID NO: 3685378 - RNA, 23 nt, Salmonella enterica enterica serovar Typhi Ty2
caaaaucguuaaccagcggcgac

SEQ ID NO: 3685379 - RNA, 12 nt, Salmonella enterica enterica serovar Typhi Ty2
caaaaugaggac

SEQ ID NO: 3685380 - RNA, 15 nt, Salmonella enterica enterica serovar Typhi Ty2
caaaaugaggacaca

SEQ ID NO: 3685381 - RNA, 18 nt, Salmonella enterica enterica serovar Typhi Ty2
caaaaugcaccggcguua

SEQ ID NO: 3685382 - RNA, 18 nt, Salmonella enterica enterica serovar Typhi Ty2
caaaaugcccuucgaccg

SEQ ID NO: 3685383 - RNA, 16 nt, Salmonella enterica enterica serovar Typhi Ty2
caaaauggaaaauaau

SEQ ID NO: 3685384 - RNA, 19 nt, Salmonella enterica enterica serovar Typhi Ty2
caaaauggcaaguaaaaua

SEQ ID NO: 3685385 - RNA, 16 nt, Salmonella enterica enterica serovar Typhi Ty2
caaaaugucaguaucg

SEQ ID NO: 3685386 - RNA, 22 nt, Salmonella enterica enterica serovar Typhi Ty2
caaaaugugcaaucacacuaca

SEQ ID NO: 3685387 - RNA, 13 nt, Salmonella enterica enterica serovar Typhi Ty2
caaaauuaaucgc

SEQ ID NO: 3685388 - RNA, 14 nt, Salmonella enterica enterica serovar Typhi Ty2
caaaauucacacca

SEQ ID NO: 3685389 - RNA, 20 nt, Salmonella enterica enterica serovar Typhi Ty2
caaaauuugugguggucauc

SEQ ID NO: 3685390 - RNA, 21 nt, Salmonella enterica enterica serovar Typhi Ty2
caaaauuugugguggucaucc

SEQ ID NO: 3685391 - RNA, 22 nt, Salmonella enterica enterica serovar Typhi Ty2
caaaauuugugguggucauccg

SEQ ID NO: 3685392 - RNA, 18 nt, Salmonella enterica enterica serovar Typhi Ty2
caaaauuuuuuaucaggu

SEQ ID NO: 3685393 - RNA, 13 nt, Salmonella enterica enterica serovar Typhi Ty2
caaacaaauaaau

SEQ ID NO: 3685394 - RNA, 18 nt, Salmonella enterica enterica serovar Typhi Ty2
caaacaauuuacgcagcc

SEQ ID NO: 3685395 - RNA, 17 nt, Salmonella enterica enterica serovar Typhi Ty2
caaacacaaucacaacg

SEQ ID NO: 3685396 - RNA, 19 nt, Salmonella enterica enterica serovar Typhi Ty2
caaacacaaucacgcccag

SEQ ID NO: 3685397 - RNA, 21 nt, Salmonella enterica enterica serovar Typhi Ty2
caaacacagccaucuucugcg

SEQ ID NO: 3685398 - RNA, 12 nt, Salmonella enterica enterica serovar Typhi Ty2
caaacaccacca

SEQ ID NO: 3685399 - RNA, 14 nt, Salmonella enterica enterica serovar Typhi Ty2
caaacaccaccagu

SEQ ID NO: 3685400 - RNA, 18 nt, Salmonella enterica enterica serovar Typhi Ty2
caaacaccucagccaccc

SEQ ID NO: 3685401 - RNA, 19 nt, Salmonella enterica enterica serovar Typhi Ty2
caaacaccucagccaccca

SEQ ID NO: 3685402 - RNA, 22 nt, Salmonella enterica enterica serovar Typhi Ty2
caaacacuaccgggcagcaucu

SEQ ID NO: 3685403 - RNA, 12 nt, Salmonella enterica enterica serovar Typhi Ty2
caaacagcagaa

SEQ ID NO: 3685404 - RNA, 19 nt, Salmonella enterica enterica serovar Typhi Ty2
caaacagcagaacaaccag

SEQ ID NO: 3685405 - RNA, 18 nt, Salmonella enterica enterica serovar Typhi Ty2
caaacagcgacucgcugg

SEQ ID NO: 3685406 - RNA, 21 nt, Salmonella enterica enterica serovar Typhi Ty2
caaacaggcggcuguugguuu

SEQ ID NO: 3685407 - RNA, 14 nt, Salmonella enterica enterica serovar Typhi Ty2
caaacaguacgccc

SEQ ID NO: 3685408 - RNA, 15 nt, Salmonella enterica enterica serovar Typhi Ty2
caaacaguacgcccg

SEQ ID NO: 3685409 - RNA, 15 nt, Salmonella enterica enterica serovar Typhi Ty2
caaacagugaaaaaa

SEQ ID NO: 3685410 - RNA, 16 nt, Salmonella enterica enterica serovar Typhi Ty2
caaacagugaaaaaac

SEQ ID NO: 3685411 - RNA, 16 nt, Salmonella enterica enterica serovar Typhi Ty2
caaacagugggaagca

SEQ ID NO: 3685412 - RNA, 23 nt, Salmonella enterica enterica serovar Typhi Ty2
caaacagugggaagcacauccau

SEQ ID NO: 3685413 - RNA, 21 nt, Salmonella enterica enterica serovar Typhi Ty2
caaacaguucagacaccacgc

SEQ ID NO: 3685414 - RNA, 22 nt, Salmonella enterica enterica serovar Typhi Ty2
caaacaguucauuucaggcaaa

SEQ ID NO: 3685415 - RNA, 13 nt, Salmonella enterica enterica serovar Typhi Ty2
caaacaguuccug

SEQ ID NO: 3685416 - RNA, 22 nt, Salmonella enterica enterica serovar Typhi Ty2
caaacauccccgcuugcagcgu

SEQ ID NO: 3685417 - RNA, 15 nt, Salmonella enterica enterica serovar Typhi Ty2
caaauacugcuuuuc

SEQ ID NO: 3685418 - RNA, 16 nt, Salmonella enterica enterica serovar Typhi Ty2
caaauacuggaaaaaa

SEQ ID NO: 3685419 - RNA, 14 nt, Salmonella enterica enterica serovar Typhi Ty2
caaauagagaaaau

SEQ ID NO: 3685420 - RNA, 17 nt, Salmonella enterica enterica serovar Typhi Ty2
caaauagagaaaauaac

SEQ ID NO: 3685421 - RNA, 19 nt, Salmonella enterica enterica serovar Typhi Ty2
caaauagagaaaauaacaa

SEQ ID NO: 3685422 - RNA, 16 nt, Salmonella enterica enterica serovar Typhi Ty2
caaauaguccagcagc

SEQ ID NO: 3685423 - RNA, 18 nt, Salmonella enterica enterica serovar Typhi Ty2
caaauauauugaaaaggg

SEQ ID NO: 3685424 - RNA, 20 nt, Salmonella enterica enterica serovar Typhi Ty2
caaauauccuaccacgccgc

SEQ ID NO: 3685425 - RNA, 22 nt, Salmonella enterica enterica serovar Typhi Ty2
caaauauccuaccacgccgcua

SEQ ID NO: 3685426 - RNA, 17 nt, Salmonella enterica enterica serovar Typhi Ty2
caaauaugauaugugua

SEQ ID NO: 3685427 - RNA, 14 nt, Salmonella enterica enterica serovar Typhi Ty2
caaaucaacauuau

SEQ ID NO: 3685428 - RNA, 16 nt, Salmonella enterica enterica serovar Typhi Ty2
caaaucaccacauggc

SEQ ID NO: 3685429 - RNA, 21 nt, Salmonella enterica enterica serovar Typhi Ty2
caaauccacuggucgucugaa

SEQ ID NO: 3685430 - RNA, 17 nt, Salmonella enterica enterica serovar Typhi Ty2
caaaucccgguaaaggu

SEQ ID NO: 3685431 - RNA, 20 nt, Salmonella enterica enterica serovar Typhi Ty2
caaaucccugaucggccaga

SEQ ID NO: 3685432 - RNA, 13 nt, Salmonella enterica enterica serovar Typhi Ty2
caaauccuccaua

SEQ ID NO: 3685433 - RNA, 15 nt, Salmonella enterica enterica serovar Typhi Ty2
caaaucgccaucagc

SEQ ID NO: 3685434 - RNA, 18 nt, Salmonella enterica enterica serovar Typhi Ty2
caaaucgcccaucacaug

SEQ ID NO: 3685435 - RNA, 20 nt, Salmonella enterica enterica serovar Typhi Ty2
caaaucgcccaucacaugua

SEQ ID NO: 3685436 - RNA, 16 nt, Salmonella enterica enterica serovar Typhi Ty2
caaaucgcgguaaaaa

SEQ ID NO: 3685437 - RNA, 18 nt, Salmonella enterica enterica serovar Typhi Ty2
caaaucgcgguaaaaagc

SEQ ID NO: 3685438 - RNA, 20 nt, Salmonella enterica enterica serovar Typhi Ty2
caaaucggcgccggcgcguu

SEQ ID NO: 3685439 - RNA, 18 nt, Salmonella enterica enterica serovar Typhi Ty2
caaaucgggaaaaugaug

SEQ ID NO: 3685440 - RNA, 16 nt, Salmonella enterica enterica serovar Typhi Ty2
caaaucuguuaucugg

SEQ ID NO: 3685441 - RNA, 19 nt, Salmonella enterica enterica serovar Typhi Ty2
caaaucuucauuucauugc

SEQ ID NO: 3685442 - RNA, 14 nt, Salmonella enterica enterica serovar Typhi Ty2
caaaugaagucugg

SEQ ID NO: 3685443 - RNA, 14 nt, Salmonella enterica enterica serovar Typhi Ty2
caaaugaccagauc

SEQ ID NO: 3685444 - RNA, 15 nt, Salmonella enterica enterica serovar Typhi Ty2
caaaugaccucaaga

SEQ ID NO: 3685445 - RNA, 15 nt, Salmonella enterica enterica serovar Typhi Ty2
caaaugagaauagac

SEQ ID NO: 3685446 - RNA, 16 nt, Salmonella enterica enterica serovar Typhi Ty2
caaaugagaauagacu

SEQ ID NO: 3685447 - RNA, 17 nt, Salmonella enterica enterica serovar Typhi Ty2
caaaugaucguuuuuug

SEQ ID NO: 3685448 - RNA, 17 nt, Salmonella enterica enterica serovar Typhi Ty2
caaaugcagcggaauuc

SEQ ID NO: 3685449 - RNA, 21 nt, Salmonella enterica enterica serovar Typhi Ty2
caaaugcagcggaauucccac

SEQ ID NO: 3685450 - RNA, 14 nt, Salmonella enterica enterica serovar Typhi Ty2
caaaugccauccca

SEQ ID NO: 3685451 - RNA, 14 nt, Salmonella enterica enterica serovar Typhi Ty2
caaaugcccagcuc

SEQ ID NO: 3685452 - RNA, 13 nt, Salmonella enterica enterica serovar Typhi Ty2
caaaugucagauc

SEQ ID NO: 3685453 - RNA, 17 nt, Salmonella enterica enterica serovar Typhi Ty2
caaauuaucuguugaua

SEQ ID NO: 3685454 - RNA, 24 nt, Salmonella enterica enterica serovar Typhi Ty2
caaauuaucuguugauaaaacacu

SEQ ID NO: 3685455 - RNA, 17 nt, Salmonella enterica enterica serovar Typhi Ty2
caaauucagaccccugu

SEQ ID NO: 3685456 - RNA, 21 nt, Salmonella enterica enterica serovar Typhi Ty2
caaauucagcgucgagcaccu

SEQ ID NO: 3685457 - RNA, 22 nt, Salmonella enterica enterica serovar Typhi Ty2
caaauuccggcacaaccuggcu

SEQ ID NO: 3685458 - RNA, 18 nt, Salmonella enterica enterica serovar Typhi Ty2
caaauucuuuucacgcau

SEQ ID NO: 3685459 - RNA, 12 nt, Salmonella enterica enterica serovar Typhi Ty2
caacaaacauaa

SEQ ID NO: 3685460 - RNA, 14 nt, Salmonella enterica enterica serovar Typhi Ty2
caacaaacauaagc

SEQ ID NO: 3685461 - RNA, 14 nt, Salmonella enterica enterica serovar Typhi Ty2
caacaaagguuugu

SEQ ID NO: 3685462 - RNA, 15 nt, Salmonella enterica enterica serovar Typhi Ty2
caacaaauuccggca

SEQ ID NO: 3685463 - RNA, 23 nt, Salmonella enterica enterica serovar Typhi Ty2
caacaacuucaaaauagguguug

SEQ ID NO: 3685464 - RNA, 21 nt, Salmonella enterica enterica serovar Typhi Ty2
caacaaguccuucuucccccu

SEQ ID NO: 3685465 - RNA, 19 nt, Salmonella enterica enterica serovar Typhi Ty2
caacaaucagaagaaauau

SEQ ID NO: 3685466 - RNA, 15 nt, Salmonella enterica enterica serovar Typhi Ty2
caacaaugccacgcc

SEQ ID NO: 3685467 - RNA, 18 nt, Salmonella enterica enterica serovar Typhi Ty2
caacaaugccacgccccu

SEQ ID NO: 3685468 - RNA, 16 nt, Salmonella enterica enterica serovar Typhi Ty2
caacacacguaacaac

SEQ ID NO: 3685469 - RNA, 16 nt, Salmonella enterica enterica serovar Typhi Ty2
caacacauaagccacu

SEQ ID NO: 3685470 - RNA, 15 nt, Salmonella enterica enterica serovar Typhi Ty2
caacacccacaccau

SEQ ID NO: 3685471 - RNA, 16 nt, Salmonella enterica enterica serovar Typhi Ty2
caacaccguaaaagga

SEQ ID NO: 3685472 - RNA, 15 nt, Salmonella enterica enterica serovar Typhi Ty2
caacacgauccccau

SEQ ID NO: 3685473 - RNA, 18 nt, Salmonella enterica enterica serovar Typhi Ty2
caacacgcgcaccaguuc

SEQ ID NO: 3685474 - RNA, 17 nt, Salmonella enterica enterica serovar Typhi Ty2
caacacggcgcucagga

SEQ ID NO: 3685475 - RNA, 16 nt, Salmonella enterica enterica serovar Typhi Ty2
caacagaaucgcgaua

SEQ ID NO: 3685476 - RNA, 21 nt, Salmonella enterica enterica serovar Typhi Ty2
caacagaccgacgaugaccgg

SEQ ID NO: 3685477 - RNA, 14 nt, Salmonella enterica enterica serovar Typhi Ty2
caacagcaauguuu

SEQ ID NO: 3685478 - RNA, 12 nt, Salmonella enterica enterica serovar Typhi Ty2
caacagcaccag

SEQ ID NO: 3685479 - RNA, 21 nt, Salmonella enterica enterica serovar Typhi Ty2
caacagcgaccacgccaccgc

SEQ ID NO: 3685480 - RNA, 15 nt, Salmonella enterica enterica serovar Typhi Ty2
caacagcgagcuaug

SEQ ID NO: 3685481 - RNA, 20 nt, Salmonella enterica enterica serovar Typhi Ty2
caacagcggcggcaguugcc

SEQ ID NO: 3685482 - RNA, 14 nt, Salmonella enterica enterica serovar Typhi Ty2
caacagcucgccau

SEQ ID NO: 3685483 - RNA, 18 nt, Salmonella enterica enterica serovar Typhi Ty2
caacagggcggccuccug

SEQ ID NO: 3685484 - RNA, 17 nt, Salmonella enterica enterica serovar Typhi Ty2
caacagguuaaucagca

SEQ ID NO: 3685485 - RNA, 20 nt, Salmonella enterica enterica serovar Typhi Ty2
caacaguaccugauaaaauu

SEQ ID NO: 3685486 - RNA, 15 nt, Salmonella enterica enterica serovar Typhi Ty2
caacaguaccuucaa

SEQ ID NO: 3685487 - RNA, 21 nt, Salmonella enterica enterica serovar Typhi Ty2
caacagugggcuaugaagaga

SEQ ID NO: 3685488 - RNA, 17 nt, Salmonella enterica enterica serovar Typhi Ty2
caacauacgccgccagc

SEQ ID NO: 3685489 - RNA, 20 nt, Salmonella enterica enterica serovar Typhi Ty2
caacauagcuaaauaaaaau

SEQ ID NO: 3685490 - RNA, 20 nt, Salmonella enterica enterica serovar Typhi Ty2
caacauauuuuucacacaua

SEQ ID NO: 3685491 - RNA, 21 nt, Salmonella enterica enterica serovar Typhi Ty2
caacaucagcgcuaccagcgc

SEQ ID NO: 3685492 - RNA, 12 nt, Salmonella enterica enterica serovar Typhi Ty2
caacaucauccc

SEQ ID NO: 3685493 - RNA, 19 nt, Salmonella enterica enterica serovar Typhi Ty2
caacaucauuauuccccuc

SEQ ID NO: 3685494 - RNA, 17 nt, Salmonella enterica enterica serovar Typhi Ty2
caacaucgcaaaauucc

SEQ ID NO: 3685495 - RNA, 21 nt, Salmonella enterica enterica serovar Typhi Ty2
caacaucuuaccggugcgauu

SEQ ID NO: 3685496 - RNA, 15 nt, Salmonella enterica enterica serovar Typhi Ty2
caacaugaccagcgc

SEQ ID NO: 3685497 - RNA, 23 nt, Salmonella enterica enterica serovar Typhi Ty2
caacaugcugaccgaaccgcugu

SEQ ID NO: 3685498 - RNA, 18 nt, Salmonella enterica enterica serovar Typhi Ty2
caacauuaucaaaaguga

SEQ ID NO: 3685499 - RNA, 17 nt, Salmonella enterica enterica serovar Typhi Ty2
caacgggacggcggcca

SEQ ID NO: 3685500 - RNA, 16 nt, Salmonella enterica enterica serovar Typhi Ty2
caacgggcaaugccac

SEQ ID NO: 3685501 - RNA, 21 nt, Salmonella enterica enterica serovar Typhi Ty2
caacgggcuuuuagccgcgcc

SEQ ID NO: 3685502 - RNA, 16 nt, Salmonella enterica enterica serovar Typhi Ty2
caacguaaauagagaa

SEQ ID NO: 3685503 - RNA, 20 nt, Salmonella enterica enterica serovar Typhi Ty2
caacguaaauuacuuaugau

SEQ ID NO: 3685504 - RNA, 19 nt, Salmonella enterica enterica serovar Typhi Ty2
caacguaaucaucaugcug

SEQ ID NO: 3685505 - RNA, 22 nt, Salmonella enterica enterica serovar Typhi Ty2
caacguaaucaucaugcugcac

SEQ ID NO: 3685506 - RNA, 19 nt, Salmonella enterica enterica serovar Typhi Ty2
caacguauaaaauggcaaa

SEQ ID NO: 3685507 - RNA, 15 nt, Salmonella enterica enterica serovar Typhi Ty2
caacgucaagacgcu

SEQ ID NO: 3685508 - RNA, 17 nt, Salmonella enterica enterica serovar Typhi Ty2
caacgucaucaugaaaa

SEQ ID NO: 3685509 - RNA, 18 nt, Salmonella enterica enterica serovar Typhi Ty2
caacguccaguucguucu

SEQ ID NO: 3685510 - RNA, 22 nt, Salmonella enterica enterica serovar Typhi Ty2
caacguccccguuugcaguccg

SEQ ID NO: 3685511 - RNA, 17 nt, Salmonella enterica enterica serovar Typhi Ty2
caacguccugcggcuuu

SEQ ID NO: 3685512 - RNA, 21 nt, Salmonella enterica enterica serovar Typhi Ty2
caacgucgacagacgcaucuu

SEQ ID NO: 3685513 - RNA, 14 nt, Salmonella enterica enterica serovar Typhi Ty2
caacgucgccaucc

SEQ ID NO: 3685514 - RNA, 15 nt, Salmonella enterica enterica serovar Typhi Ty2
caacgugcagauggu

SEQ ID NO: 3685515 - RNA, 16 nt, Salmonella enterica enterica serovar Typhi Ty2
caacgugccagaaaca

SEQ ID NO: 3685516 - RNA, 17 nt, Salmonella enterica enterica serovar Typhi Ty2
caacgugugccaggaag

SEQ ID NO: 3685517 - RNA, 14 nt, Salmonella enterica enterica serovar Typhi Ty2
caacguucaugucg

SEQ ID NO: 3685518 - RNA, 19 nt, Salmonella enterica enterica serovar Typhi Ty2
caacguuucuuucaucaga

SEQ ID NO: 3685519 - RNA, 17 nt, Salmonella enterica enterica serovar Typhi Ty2
caacguuuguaacagca

SEQ ID NO: 3685520 - RNA, 21 nt, Salmonella enterica enterica serovar Typhi Ty2
caacguuuguaacagcaggac

SEQ ID NO: 3685521 - RNA, 19 nt, Salmonella enterica enterica serovar Typhi Ty2
caacguuuucagcagugca

SEQ ID NO: 3685522 - RNA, 18 nt, Salmonella enterica enterica serovar Typhi Ty2
caacuauuaauucuuuua

SEQ ID NO: 3685523 - RNA, 13 nt, Salmonella enterica enterica serovar Typhi Ty2
caacucagcaaua

SEQ ID NO: 3685524 - RNA, 15 nt, Salmonella enterica enterica serovar Typhi Ty2
caacucauccaccuu

SEQ ID NO: 3685525 - RNA, 23 nt, Salmonella enterica enterica serovar Typhi Ty2
caacuccgccggcgcggaaggga

SEQ ID NO: 3685526 - RNA, 21 nt, Salmonella enterica enterica serovar Typhi Ty2
caacucgaauuauuuaggguu

SEQ ID NO: 3685527 - RNA, 22 nt, Salmonella enterica enterica serovar Typhi Ty2
caacucgcacaguacaccugca

SEQ ID NO: 3685528 - RNA, 19 nt, Salmonella enterica enterica serovar Typhi Ty2
caacucuuuacccagcggg

SEQ ID NO: 3685529 - RNA, 21 nt, Salmonella enterica enterica serovar Typhi Ty2
caacucuuuacccagcgggug

SEQ ID NO: 3685530 - RNA, 18 nt, Salmonella enterica enterica serovar Typhi Ty2
caacugauuaaucugccg

SEQ ID NO: 3685531 - RNA, 16 nt, Salmonella enterica enterica serovar Typhi Ty2
caacugcgccugaaga

SEQ ID NO: 3685532 - RNA, 11 nt, Salmonella enterica enterica serovar Typhi Ty2
caacugcugac

SEQ ID NO: 3685533 - RNA, 17 nt, Salmonella enterica enterica serovar Typhi Ty2
caacuguacgccacggc

SEQ ID NO: 3685534 - RNA, 15 nt, Salmonella enterica enterica serovar Typhi Ty2
caacuguauuuugaa

SEQ ID NO: 3685535 - RNA, 22 nt, Salmonella enterica enterica serovar Typhi Ty2
caacuguucuucgguuucgaca

SEQ ID NO: 3685536 - RNA, 22 nt, Salmonella enterica enterica serovar Typhi Ty2
caacuguuuuaccaaaucaaua

SEQ ID NO: 3685537 - RNA, 10 nt, Salmonella enterica enterica serovar Typhi Ty2
caacuucaug

SEQ ID NO: 3685538 - RNA, 12 nt, Salmonella enterica enterica serovar Typhi Ty2
caacuuccacca

SEQ ID NO: 3685539 - RNA, 15 nt, Salmonella enterica enterica serovar Typhi Ty2
caacuuccaccaccu

SEQ ID NO: 3685540 - RNA, 21 nt, Salmonella enterica enterica serovar Typhi Ty2
caacuuccaccaccuccugcu

SEQ ID NO: 3685541 - RNA, 16 nt, Salmonella enterica enterica serovar Typhi Ty2
caacuucguucaguuc

SEQ ID NO: 3685542 - RNA, 12 nt, Salmonella enterica enterica serovar Typhi Ty2
caacuucugcug

SEQ ID NO: 3685543 - RNA, 19 nt, Salmonella enterica enterica serovar Typhi Ty2
caacuuguuuccuguucgg

SEQ ID NO: 3685544 - RNA, 16 nt, Salmonella enterica enterica serovar Typhi Ty2
caacuuuuucuuaagc

SEQ ID NO: 3685545 - RNA, 23 nt, Salmonella enterica enterica serovar Typhi Ty2
caagaaaugcaggcguuuuauug

SEQ ID NO: 3685546 - RNA, 18 nt, Salmonella enterica enterica serovar Typhi Ty2
caagaacagagcaauuac

SEQ ID NO: 3685547 - RNA, 17 nt, Salmonella enterica enterica serovar Typhi Ty2
caagaaccgcuuuuccu

SEQ ID NO: 3685548 - RNA, 19 nt, Salmonella enterica enterica serovar Typhi Ty2
caagaagauuucuuaauuc

SEQ ID NO: 3685549 - RNA, 13 nt, Salmonella enterica enterica serovar Typhi Ty2
caagaaguuccgc

SEQ ID NO: 3685550 - RNA, 16 nt, Salmonella enterica enterica serovar Typhi Ty2
caagaauaugagauug

SEQ ID NO: 3685551 - RNA, 20 nt, Salmonella enterica enterica serovar Typhi Ty2
caagaaugaccagccgaagu

SEQ ID NO: 3685552 - RNA, 21 nt, Salmonella enterica enterica serovar Typhi Ty2
caagaaugaccagccgaaguu

SEQ ID NO: 3685553 - RNA, 16 nt, Salmonella enterica enterica serovar Typhi Ty2
caagaauuaaauaacg

SEQ ID NO: 3685554 - RNA, 18 nt, Salmonella enterica enterica serovar Typhi Ty2
caagaauuauuucaggaa

SEQ ID NO: 3685555 - RNA, 16 nt, Salmonella enterica enterica serovar Typhi Ty2
caagaauuuaucgcaa

SEQ ID NO: 3685556 - RNA, 20 nt, Salmonella enterica enterica serovar Typhi Ty2
caagacacagcgucgcgcga

SEQ ID NO: 3685557 - RNA, 22 nt, Salmonella enterica enterica serovar Typhi Ty2
caagaccgauagagacugccgc

SEQ ID NO: 3685558 - RNA, 23 nt, Salmonella enterica enterica serovar Typhi Ty2
caagaccgggcugcacgccaucg

SEQ ID NO: 3685559 - RNA, 17 nt, Salmonella enterica enterica serovar Typhi Ty2
caagacgaaaaaugaau

SEQ ID NO: 3685560 - RNA, 21 nt, Salmonella enterica enterica serovar Typhi Ty2
caagacgguuauuuuucagau

SEQ ID NO: 3685561 - RNA, 20 nt, Salmonella enterica enterica serovar Typhi Ty2
caagagaaaaaucagucauu

SEQ ID NO: 3685562 - RNA, 21 nt, Salmonella enterica enterica serovar Typhi Ty2
caagagagcaacauaccgcag

SEQ ID NO: 3685563 - RNA, 17 nt, Salmonella enterica enterica serovar Typhi Ty2
caagagaugcagacaau

SEQ ID NO: 3685564 - RNA, 22 nt, Salmonella enterica enterica serovar Typhi Ty2
caagagaugcagacaauuuccg

SEQ ID NO: 3685565 - RNA, 15 nt, Salmonella enterica enterica serovar Typhi Ty2
caagagauucaggcc

SEQ ID NO: 3685566 - RNA, 19 nt, Salmonella enterica enterica serovar Typhi Ty2
caagagcagcaacccugcc

SEQ ID NO: 3685567 - RNA, 15 nt, Salmonella enterica enterica serovar Typhi Ty2
caagagccgccgcca

SEQ ID NO: 3685568 - RNA, 13 nt, Salmonella enterica enterica serovar Typhi Ty2
caagauaaaaaga

SEQ ID NO: 3685569 - RNA, 19 nt, Salmonella enterica enterica serovar Typhi Ty2
caagauaagaaguaaacag

SEQ ID NO: 3685570 - RNA, 14 nt, Salmonella enterica enterica serovar Typhi Ty2
caagaucauccggg

SEQ ID NO: 3685571 - RNA, 23 nt, Salmonella enterica enterica serovar Typhi Ty2
caagaucauccggguuaaaccag

SEQ ID NO: 3685572 - RNA, 17 nt, Salmonella enterica enterica serovar Typhi Ty2
caagauccaacacggcg

SEQ ID NO: 3685573 - RNA, 14 nt, Salmonella enterica enterica serovar Typhi Ty2
caagaucccucacc

SEQ ID NO: 3685574 - RNA, 14 nt, Salmonella enterica enterica serovar Typhi Ty2
caagauccguccau

SEQ ID NO: 3685575 - RNA, 13 nt, Salmonella enterica enterica serovar Typhi Ty2
caagaugcugaau

SEQ ID NO: 3685576 - RNA, 16 nt, Salmonella enterica enterica serovar Typhi Ty2
caagauuucaaaaccc

SEQ ID NO: 3685577 - RNA, 17 nt, Salmonella enterica enterica serovar Typhi Ty2
caagcaaugccagaaau

SEQ ID NO: 3685578 - RNA, 13 nt, Salmonella enterica enterica serovar Typhi Ty2
caagcacaaaaag

SEQ ID NO: 3685579 - RNA, 18 nt, Salmonella enterica enterica serovar Typhi Ty2
caagcaccuuauccggcc

SEQ ID NO: 3685580 - RNA, 20 nt, Salmonella enterica enterica serovar Typhi Ty2
caagcaguaucguguuauuu

SEQ ID NO: 3685581 - RNA, 19 nt, Salmonella enterica enterica serovar Typhi Ty2
caauagguugaaagaggaa

SEQ ID NO: 3685582 - RNA, 22 nt, Salmonella enterica enterica serovar Typhi Ty2
caauaguauccauaauuuuccc

SEQ ID NO: 3685583 - RNA, 23 nt, Salmonella enterica enterica serovar Typhi Ty2
caauaguuaauguugaaccguca

SEQ ID NO: 3685584 - RNA, 14 nt, Salmonella enterica enterica serovar Typhi Ty2
caauauaccgucag

SEQ ID NO: 3685585 - RNA, 16 nt, Salmonella enterica enterica serovar Typhi Ty2
caauauagccguggcu

SEQ ID NO: 3685586 - RNA, 21 nt, Salmonella enterica enterica serovar Typhi Ty2
caauauaguugagccauucca

SEQ ID NO: 3685587 - RNA, 20 nt, Salmonella enterica enterica serovar Typhi Ty2
caauaucagccauuaaccag

SEQ ID NO: 3685588 - RNA, 21 nt, Salmonella enterica enterica serovar Typhi Ty2
caauaucagccauuaaccaga

SEQ ID NO: 3685589 - RNA, 15 nt, Salmonella enterica enterica serovar Typhi Ty2
caauauccccagccc

SEQ ID NO: 3685590 - RNA, 20 nt, Salmonella enterica enterica serovar Typhi Ty2
caauauccgccccgcuggcu

SEQ ID NO: 3685591 - RNA, 21 nt, Salmonella enterica enterica serovar Typhi Ty2
caauaucgauagcauuuuuac

SEQ ID NO: 3685592 - RNA, 19 nt, Salmonella enterica enterica serovar Typhi Ty2
caauaucgcggcaaagaaa

SEQ ID NO: 3685593 - RNA, 16 nt, Salmonella enterica enterica serovar Typhi Ty2
caauaucguugccgcc

SEQ ID NO: 3685594 - RNA, 19 nt, Salmonella enterica enterica serovar Typhi Ty2
caauaugcagaucgacggu

SEQ ID NO: 3685595 - RNA, 15 nt, Salmonella enterica enterica serovar Typhi Ty2
caauauggcaccgaa

SEQ ID NO: 3685596 - RNA, 22 nt, Salmonella enterica enterica serovar Typhi Ty2
caauaugguuauccagcaggua

SEQ ID NO: 3685597 - RNA, 17 nt, Salmonella enterica enterica serovar Typhi Ty2
caauaugucuuaaacag

SEQ ID NO: 3685598 - RNA, 17 nt, Salmonella enterica enterica serovar Typhi Ty2
caauaugugcaucggca

SEQ ID NO: 3685599 - RNA, 14 nt, Salmonella enterica enterica serovar Typhi Ty2
caauauuaaauaaa

SEQ ID NO: 3685600 - RNA, 13 nt, Salmonella enterica enterica serovar Typhi Ty2
caauauuaaauga

SEQ ID NO: 3685601 - RNA, 20 nt, Salmonella enterica enterica serovar Typhi Ty2
caauauucacgcgaauuccu

SEQ ID NO: 3685602 - RNA, 23 nt, Salmonella enterica enterica serovar Typhi Ty2
caauauugaacauuuuuucagcc

SEQ ID NO: 3685603 - RNA, 15 nt, Salmonella enterica enterica serovar Typhi Ty2
caauauuuauuuaau

SEQ ID NO: 3685604 - RNA, 12 nt, Salmonella enterica enterica serovar Typhi Ty2
caauauuuuucc

SEQ ID NO: 3685605 - RNA, 13 nt, Salmonella enterica enterica serovar Typhi Ty2
caauauuuuuccg

SEQ ID NO: 3685606 - RNA, 15 nt, Salmonella enterica enterica serovar Typhi Ty2
caaucaaaacauuag

SEQ ID NO: 3685607 - RNA, 16 nt, Salmonella enterica enterica serovar Typhi Ty2
caaucaacuccauaau

SEQ ID NO: 3685608 - RNA, 14 nt, Salmonella enterica enterica serovar Typhi Ty2
caaucacaaaaugg

SEQ ID NO: 3685609 - RNA, 15 nt, Salmonella enterica enterica serovar Typhi Ty2
caaucaccaucccau

SEQ ID NO: 3685610 - RNA, 12 nt, Salmonella enterica enterica serovar Typhi Ty2
caaucaccguug

SEQ ID NO: 3685611 - RNA, 21 nt, Salmonella enterica enterica serovar Typhi Ty2
caaucaccugaugcccauacg

SEQ ID NO: 3685612 - RNA, 16 nt, Salmonella enterica enterica serovar Typhi Ty2
caaucacgcccagcgc

SEQ ID NO: 3685613 - RNA, 19 nt, Salmonella enterica enterica serovar Typhi Ty2
caaucacguuauagccgcc

SEQ ID NO: 3685614 - RNA, 22 nt, Salmonella enterica enterica serovar Typhi Ty2
caaucacugaugccacacccug

SEQ ID NO: 3685615 - RNA, 19 nt, Salmonella enterica enterica serovar Typhi Ty2
caaucacuuuugcgaccca

SEQ ID NO: 3685616 - RNA, 22 nt, Salmonella enterica enterica serovar Typhi Ty2
caaucacuuuugcgacccacaa

SEQ ID NO: 3685617 - RNA, 14 nt, Salmonella enterica enterica serovar Typhi Ty2
caaucagaagaaau

SEQ ID NO: 3685618 - RNA, 22 nt, Salmonella enterica enterica serovar Typhi Ty2
caaucaggaaagagccgcgcag

SEQ ID NO: 3685619 - RNA, 19 nt, Salmonella enterica enterica serovar Typhi Ty2
caaucagguauuuccugcu

SEQ ID NO: 3685620 - RNA, 15 nt, Salmonella enterica enterica serovar Typhi Ty2
caaucaguacgcgcg

SEQ ID NO: 3685621 - RNA, 20 nt, Salmonella enterica enterica serovar Typhi Ty2
caaucaguaugaugaccugg

SEQ ID NO: 3685622 - RNA, 17 nt, Salmonella enterica enterica serovar Typhi Ty2
caaucaguucucgcgcc

SEQ ID NO: 3685623 - RNA, 18 nt, Salmonella enterica enterica serovar Typhi Ty2
caaucauaaacgccugac

SEQ ID NO: 3685624 - RNA, 21 nt, Salmonella enterica enterica serovar Typhi Ty2
caaucaucagaccgauaaaua

SEQ ID NO: 3685625 - RNA, 20 nt, Salmonella enterica enterica serovar Typhi Ty2
caaucauugugguuucccug

SEQ ID NO: 3685626 - RNA, 17 nt, Salmonella enterica enterica serovar Typhi Ty2
caauccaacgaaacuca

SEQ ID NO: 3685627 - RNA, 21 nt, Salmonella enterica enterica serovar Typhi Ty2
caauccaacgaaacucagcgg

SEQ ID NO: 3685628 - RNA, 23 nt, Salmonella enterica enterica serovar Typhi Ty2
caauccagaauaccagaaucacc

SEQ ID NO: 3685629 - RNA, 23 nt, Salmonella enterica enterica serovar Typhi Ty2
caauccagguggaucggaaauca

SEQ ID NO: 3685630 - RNA, 17 nt, Salmonella enterica enterica serovar Typhi Ty2
caauccauuuuaaauac

SEQ ID NO: 3685631 - RNA, 18 nt, Salmonella enterica enterica serovar Typhi Ty2
caauccauuuuaaauaca

SEQ ID NO: 3685632 - RNA, 23 nt, Salmonella enterica enterica serovar Typhi Ty2
caaucccggagagagcaacuggc

SEQ ID NO: 3685633 - RNA, 15 nt, Salmonella enterica enterica serovar Typhi Ty2
caaucccuuaaagcc

SEQ ID NO: 3685634 - RNA, 18 nt, Salmonella enterica enterica serovar Typhi Ty2
caauccgcgccgcaucuu

SEQ ID NO: 3685635 - RNA, 15 nt, Salmonella enterica enterica serovar Typhi Ty2
caauccgcggcaaac

SEQ ID NO: 3685636 - RNA, 18 nt, Salmonella enterica enterica serovar Typhi Ty2
caauccguuauuucacag

SEQ ID NO: 3685637 - RNA, 22 nt, Salmonella enterica enterica serovar Typhi Ty2
caauccugucgucaccagcagg

SEQ ID NO: 3685638 - RNA, 14 nt, Salmonella enterica enterica serovar Typhi Ty2
caaucgagaagcca

SEQ ID NO: 3685639 - RNA, 16 nt, Salmonella enterica enterica serovar Typhi Ty2
caaucgagaucagacu

SEQ ID NO: 3685640 - RNA, 17 nt, Salmonella enterica enterica serovar Typhi Ty2
caaucgcaaauugcugu

SEQ ID NO: 3685641 - RNA, 14 nt, Salmonella enterica enterica serovar Typhi Ty2
caaucgccagcccc

SEQ ID NO: 3685642 - RNA, 19 nt, Salmonella enterica enterica serovar Typhi Ty2
caaucgccgaucgcauaaa

SEQ ID NO: 3685643 - RNA, 13 nt, Salmonella enterica enterica serovar Typhi Ty2
caaucgccugcaa

SEQ ID NO: 3685644 - RNA, 16 nt, Salmonella enterica enterica serovar Typhi Ty2
caaucgcgguaugcga

SEQ ID NO: 3685645 - RNA, 16 nt, Salmonella enterica enterica serovar Typhi Ty2
caaucgcguuuuccag

SEQ ID NO: 3685646 - RNA, 18 nt, Salmonella enterica enterica serovar Typhi Ty2
caaucgcuaucugacagc

SEQ ID NO: 3685647 - RNA, 23 nt, Salmonella enterica enterica serovar Typhi Ty2
caaucggcgauaaaccaacagcc

SEQ ID NO: 3685648 - RNA, 14 nt, Salmonella enterica enterica serovar Typhi Ty2
caaucguaugcgcc

SEQ ID NO: 3685649 - RNA, 21 nt, Salmonella enterica enterica serovar Typhi Ty2
caaucgucacuucaauuugcc

SEQ ID NO: 3685650 - RNA, 12 nt, Salmonella enterica enterica serovar Typhi Ty2
caaucgucuuca

SEQ ID NO: 3685651 - RNA, 13 nt, Salmonella enterica enterica serovar Typhi Ty2
caaucguucuugc

SEQ ID NO: 3685652 - RNA, 18 nt, Salmonella enterica enterica serovar Typhi Ty2
caaucuccagaccgcugc

SEQ ID NO: 3685653 - RNA, 22 nt, Salmonella enterica enterica serovar Typhi Ty2
caaucuccuccggcuucagcaa

SEQ ID NO: 3685654 - RNA, 13 nt, Salmonella enterica enterica serovar Typhi Ty2
caaucucgccaau

SEQ ID NO: 3685655 - RNA, 16 nt, Salmonella enterica enterica serovar Typhi Ty2
caaucucgccaaugcc

SEQ ID NO: 3685656 - RNA, 12 nt, Salmonella enterica enterica serovar Typhi Ty2
caaucucuuuau

SEQ ID NO: 3685657 - RNA, 14 nt, Salmonella enterica enterica serovar Typhi Ty2
caaucuggugacga

SEQ ID NO: 3685658 - RNA, 21 nt, Salmonella enterica enterica serovar Typhi Ty2
caaucuggugacgaugauaac

SEQ ID NO: 3685659 - RNA, 17 nt, Salmonella enterica enterica serovar Typhi Ty2
caaucuguuuguuagaa

SEQ ID NO: 3685660 - RNA, 13 nt, Salmonella enterica enterica serovar Typhi Ty2
caaugaacaguuu

SEQ ID NO: 3685661 - RNA, 17 nt, Salmonella enterica enterica serovar Typhi Ty2
caaugaccacaaauucu

SEQ ID NO: 3685662 - RNA, 21 nt, Salmonella enterica enterica serovar Typhi Ty2
caaugacgcuucguuccgcga

SEQ ID NO: 3685663 - RNA, 21 nt, Salmonella enterica enterica serovar Typhi Ty2
cacaaauuugaauaaaacggg

SEQ ID NO: 3685664 - RNA, 17 nt, Salmonella enterica enterica serovar Typhi Ty2
cacaaauuuugauaaaa

SEQ ID NO: 3685665 - RNA, 16 nt, Salmonella enterica enterica serovar Typhi Ty2
cacaacacggcggcua

SEQ ID NO: 3685666 - RNA, 21 nt, Salmonella enterica enterica serovar Typhi Ty2
cacaacauuccgcuuccagaa

SEQ ID NO: 3685667 - RNA, 13 nt, Salmonella enterica enterica serovar Typhi Ty2
cacaacccaaagg

SEQ ID NO: 3685668 - RNA, 16 nt, Salmonella enterica enterica serovar Typhi Ty2
cacaacccaaaggcca

SEQ ID NO: 3685669 - RNA, 17 nt, Salmonella enterica enterica serovar Typhi Ty2
cacaaccggcuggcuau

SEQ ID NO: 3685670 - RNA, 17 nt, Salmonella enterica enterica serovar Typhi Ty2
cacaaccuccacgccca

SEQ ID NO: 3685671 - RNA, 15 nt, Salmonella enterica enterica serovar Typhi Ty2
cacaaccugaaagaa

SEQ ID NO: 3685672 - RNA, 16 nt, Salmonella enterica enterica serovar Typhi Ty2
cacaacgaguccccuc

SEQ ID NO: 3685673 - RNA, 22 nt, Salmonella enterica enterica serovar Typhi Ty2
cacaacgcgaguauucgcgccc

SEQ ID NO: 3685674 - RNA, 12 nt, Salmonella enterica enterica serovar Typhi Ty2
cacaacguaaua

SEQ ID NO: 3685675 - RNA, 21 nt, Salmonella enterica enterica serovar Typhi Ty2
cacaacgucaguggaaaacag

SEQ ID NO: 3685676 - RNA, 21 nt, Salmonella enterica enterica serovar Typhi Ty2
cacaacgugaugaucguguug

SEQ ID NO: 3685677 - RNA, 16 nt, Salmonella enterica enterica serovar Typhi Ty2
cacaagagcagcaacc

SEQ ID NO: 3685678 - RNA, 19 nt, Salmonella enterica enterica serovar Typhi Ty2
cacaagagcagcaacccug

SEQ ID NO: 3685679 - RNA, 15 nt, Salmonella enterica enterica serovar Typhi Ty2
cacaagcuguuucuc

SEQ ID NO: 3685680 - RNA, 13 nt, Salmonella enterica enterica serovar Typhi Ty2
cacaaguuuaucc

SEQ ID NO: 3685681 - RNA, 13 nt, Salmonella enterica enterica serovar Typhi Ty2
cacaauagcgcua

SEQ ID NO: 3685682 - RNA, 20 nt, Salmonella enterica enterica serovar Typhi Ty2
cacaauaugguuauccagca

SEQ ID NO: 3685683 - RNA, 13 nt, Salmonella enterica enterica serovar Typhi Ty2
cacaaucaaggca

SEQ ID NO: 3685684 - RNA, 12 nt, Salmonella enterica enterica serovar Typhi Ty2
cacaaucagcca

SEQ ID NO: 3685685 - RNA, 15 nt, Salmonella enterica enterica serovar Typhi Ty2
cacaaucagccacgg

SEQ ID NO: 3685686 - RNA, 18 nt, Salmonella enterica enterica serovar Typhi Ty2
cacaaucagccacggcaa

SEQ ID NO: 3685687 - RNA, 22 nt, Salmonella enterica enterica serovar Typhi Ty2
cacaaucccgccagacccgcaa

SEQ ID NO: 3685688 - RNA, 20 nt, Salmonella enterica enterica serovar Typhi Ty2
cacaaucccggcaacugcgc

SEQ ID NO: 3685689 - RNA, 20 nt, Salmonella enterica enterica serovar Typhi Ty2
cacaaucgcgccugccagga

SEQ ID NO: 3685690 - RNA, 22 nt, Salmonella enterica enterica serovar Typhi Ty2
cacaaugacagaaaugcaggga

SEQ ID NO: 3685691 - RNA, 21 nt, Salmonella enterica enterica serovar Typhi Ty2
cacaaugguugccuggugucc

SEQ ID NO: 3685692 - RNA, 22 nt, Salmonella enterica enterica serovar Typhi Ty2
cacaauguuuuuguaccaggcc

SEQ ID NO: 3685693 - RNA, 20 nt, Salmonella enterica enterica serovar Typhi Ty2
cacaauugccagcagguauc

SEQ ID NO: 3685694 - RNA, 23 nt, Salmonella enterica enterica serovar Typhi Ty2
cacaauuuucuuaauaugcugcc

SEQ ID NO: 3685695 - RNA, 23 nt, Salmonella enterica enterica serovar Typhi Ty2
cacacacuguuuaaugcuuucaa

SEQ ID NO: 3685696 - RNA, 19 nt, Salmonella enterica enterica serovar Typhi Ty2
cacaccaaugucauauuug

SEQ ID NO: 3685697 - RNA, 18 nt, Salmonella enterica enterica serovar Typhi Ty2
cacaccacgugcggacgu

SEQ ID NO: 3685698 - RNA, 13 nt, Salmonella enterica enterica serovar Typhi Ty2
cacaccauaccgc

SEQ ID NO: 3685699 - RNA, 16 nt, Salmonella enterica enterica serovar Typhi Ty2
cacaccauuucacaaa

SEQ ID NO: 3685700 - RNA, 20 nt, Salmonella enterica enterica serovar Typhi Ty2
cacaccauuucacaaauuaa

SEQ ID NO: 3685701 - RNA, 13 nt, Salmonella enterica enterica serovar Typhi Ty2
cacacccauagca

SEQ ID NO: 3685702 - RNA, 16 nt, Salmonella enterica enterica serovar Typhi Ty2
cacaccggauaccggu

SEQ ID NO: 3685703 - RNA, 19 nt, Salmonella enterica enterica serovar Typhi Ty2
cacaccgucaacaucaucc

SEQ ID NO: 3685704 - RNA, 22 nt, Salmonella enterica enterica serovar Typhi Ty2
cacaccugaugguuauuuucag

SEQ ID NO: 3685705 - RNA, 20 nt, Salmonella enterica enterica serovar Typhi Ty2
cacacgccuggccaggcuuu

SEQ ID NO: 3685706 - RNA, 14 nt, Salmonella enterica enterica serovar Typhi Ty2
cacacggcauucac

SEQ ID NO: 3685707 - RNA, 15 nt, Salmonella enterica enterica serovar Typhi Ty2
cacacggccaccaua

SEQ ID NO: 3685708 - RNA, 16 nt, Salmonella enterica enterica serovar Typhi Ty2
cacacgucugagcagg

SEQ ID NO: 3685709 - RNA, 14 nt, Salmonella enterica enterica serovar Typhi Ty2
cacacucucuccag

SEQ ID NO: 3685710 - RNA, 15 nt, Salmonella enterica enterica serovar Typhi Ty2
cacacugcgccgcca

SEQ ID NO: 3685711 - RNA, 13 nt, Salmonella enterica enterica serovar Typhi Ty2
cacacuuaccgac

SEQ ID NO: 3685712 - RNA, 14 nt, Salmonella enterica enterica serovar Typhi Ty2
cacacuuucaucag

SEQ ID NO: 3685713 - RNA, 15 nt, Salmonella enterica enterica serovar Typhi Ty2
cacacuuucaucagc

SEQ ID NO: 3685714 - RNA, 24 nt, Salmonella enterica enterica serovar Typhi Ty2
cacacuuucgcccggcgccagcuc

SEQ ID NO: 3685715 - RNA, 20 nt, Salmonella enterica enterica serovar Typhi Ty2
cacagaaaaaccaaaaaaua

SEQ ID NO: 3685716 - RNA, 21 nt, Salmonella enterica enterica serovar Typhi Ty2
cacagaaaaaccaaaaaauau

SEQ ID NO: 3685717 - RNA, 20 nt, Salmonella enterica enterica serovar Typhi Ty2
cacagaaggcuaacagcugg

SEQ ID NO: 3685718 - RNA, 15 nt, Salmonella enterica enterica serovar Typhi Ty2
cacagaaucgcugug

SEQ ID NO: 3685719 - RNA, 23 nt, Salmonella enterica enterica serovar Typhi Ty2
cacagaauuacauaugcgcggcg

SEQ ID NO: 3685720 - RNA, 16 nt, Salmonella enterica enterica serovar Typhi Ty2
cacagacccaguacaa

SEQ ID NO: 3685721 - RNA, 19 nt, Salmonella enterica enterica serovar Typhi Ty2
cacagacccaguacaaaca

SEQ ID NO: 3685722 - RNA, 20 nt, Salmonella enterica enterica serovar Typhi Ty2
cacagagaucgugcauccgg

SEQ ID NO: 3685723 - RNA, 15 nt, Salmonella enterica enterica serovar Typhi Ty2
cacagcaaacauccc

SEQ ID NO: 3685724 - RNA, 17 nt, Salmonella enterica enterica serovar Typhi Ty2
cacagcaaacauccccg

SEQ ID NO: 3685725 - RNA, 17 nt, Salmonella enterica enterica serovar Typhi Ty2
cacagcaaaugaaagga

SEQ ID NO: 3685726 - RNA, 15 nt, Salmonella enterica enterica serovar Typhi Ty2
cacagcacauagaag

SEQ ID NO: 3685727 - RNA, 22 nt, Salmonella enterica enterica serovar Typhi Ty2
cacagcacauagaagcucaugu

SEQ ID NO: 3685728 - RNA, 19 nt, Salmonella enterica enterica serovar Typhi Ty2
cacagcaccauguugacca

SEQ ID NO: 3685729 - RNA, 21 nt, Salmonella enterica enterica serovar Typhi Ty2
cacagcaccauguugaccagg

SEQ ID NO: 3685730 - RNA, 19 nt, Salmonella enterica enterica serovar Typhi Ty2
cacagcacgauaugcauaa

SEQ ID NO: 3685731 - RNA, 20 nt, Salmonella enterica enterica serovar Typhi Ty2
cacagcacuaacgaggccac

SEQ ID NO: 3685732 - RNA, 21 nt, Salmonella enterica enterica serovar Typhi Ty2
cacagcagaaagcaacagcaa

SEQ ID NO: 3685733 - RNA, 15 nt, Salmonella enterica enterica serovar Typhi Ty2
cacagccacacugcu

SEQ ID NO: 3685734 - RNA, 15 nt, Salmonella enterica enterica serovar Typhi Ty2
cacagccagcacgag

SEQ ID NO: 3685735 - RNA, 19 nt, Salmonella enterica enterica serovar Typhi Ty2
cacagccaguaagaacgag

SEQ ID NO: 3685736 - RNA, 20 nt, Salmonella enterica enterica serovar Typhi Ty2
cacagccaucuucugcguca

SEQ ID NO: 3685737 - RNA, 16 nt, Salmonella enterica enterica serovar Typhi Ty2
cacagcccaguaauau

SEQ ID NO: 3685738 - RNA, 14 nt, Salmonella enterica enterica serovar Typhi Ty2
cacagccguguccg

SEQ ID NO: 3685739 - RNA, 16 nt, Salmonella enterica enterica serovar Typhi Ty2
cacagcgccagacacu

SEQ ID NO: 3685740 - RNA, 15 nt, Salmonella enterica enterica serovar Typhi Ty2
cacagcgcuaucagg

SEQ ID NO: 3685741 - RNA, 14 nt, Salmonella enterica enterica serovar Typhi Ty2
cacagcggaauaga

SEQ ID NO: 3685742 - RNA, 22 nt, Salmonella enterica enterica serovar Typhi Ty2
cacagcguacaauggcaggcau

SEQ ID NO: 3685743 - RNA, 22 nt, Salmonella enterica enterica serovar Typhi Ty2
cacagcuugccguagcgcgcuu

SEQ ID NO: 3685744 - RNA, 17 nt, Salmonella enterica enterica serovar Typhi Ty2
cacaggagccaguuuuc

SEQ ID NO: 3685745 - RNA, 23 nt, Salmonella enterica enterica serovar Typhi Ty2
caccacugaaaaauaauuacuau

SEQ ID NO: 3685746 - RNA, 20 nt, Salmonella enterica enterica serovar Typhi Ty2
caccacuuuguuuuuguccg

SEQ ID NO: 3685747 - RNA, 15 nt, Salmonella enterica enterica serovar Typhi Ty2
caccagaaucgccag

SEQ ID NO: 3685748 - RNA, 17 nt, Salmonella enterica enterica serovar Typhi Ty2
caccagaaucgccagca

SEQ ID NO: 3685749 - RNA, 14 nt, Salmonella enterica enterica serovar Typhi Ty2
caccagaccgacaa

SEQ ID NO: 3685750 - RNA, 14 nt, Salmonella enterica enterica serovar Typhi Ty2
caccagaucggcau

SEQ ID NO: 3685751 - RNA, 17 nt, Salmonella enterica enterica serovar Typhi Ty2
caccagcacgaugcaua

SEQ ID NO: 3685752 - RNA, 19 nt, Salmonella enterica enterica serovar Typhi Ty2
caccagcagggcaugauua

SEQ ID NO: 3685753 - RNA, 14 nt, Salmonella enterica enterica serovar Typhi Ty2
caccagcaguugcc

SEQ ID NO: 3685754 - RNA, 13 nt, Salmonella enterica enterica serovar Typhi Ty2
caccagcccaacg

SEQ ID NO: 3685755 - RNA, 24 nt, Salmonella enterica enterica serovar Typhi Ty2
caccagccccaaaauucacgcuuc

SEQ ID NO: 3685756 - RNA, 19 nt, Salmonella enterica enterica serovar Typhi Ty2
caccagcccuggcuguccu

SEQ ID NO: 3685757 - RNA, 13 nt, Salmonella enterica enterica serovar Typhi Ty2
caccagccgcauc

SEQ ID NO: 3685758 - RNA, 18 nt, Salmonella enterica enterica serovar Typhi Ty2
caccagcgauaucaacgu

SEQ ID NO: 3685759 - RNA, 16 nt, Salmonella enterica enterica serovar Typhi Ty2
caccagcgaugcgcgc

SEQ ID NO: 3685760 - RNA, 19 nt, Salmonella enterica enterica serovar Typhi Ty2
caccagcgauuacgccaga

SEQ ID NO: 3685761 - RNA, 21 nt, Salmonella enterica enterica serovar Typhi Ty2
caccagcgauuuuuacgccau

SEQ ID NO: 3685762 - RNA, 14 nt, Salmonella enterica enterica serovar Typhi Ty2
caccagcgccaggc

SEQ ID NO: 3685763 - RNA, 16 nt, Salmonella enterica enterica serovar Typhi Ty2
caccagcgccugcgcu

SEQ ID NO: 3685764 - RNA, 13 nt, Salmonella enterica enterica serovar Typhi Ty2
caccagcgcgccg

SEQ ID NO: 3685765 - RNA, 18 nt, Salmonella enterica enterica serovar Typhi Ty2
caccagcggaauccccgc

SEQ ID NO: 3685766 - RNA, 19 nt, Salmonella enterica enterica serovar Typhi Ty2
caccagcguggcuauccau

SEQ ID NO: 3685767 - RNA, 13 nt, Salmonella enterica enterica serovar Typhi Ty2
caccaggaacgcc

SEQ ID NO: 3685768 - RNA, 21 nt, Salmonella enterica enterica serovar Typhi Ty2
caccaggaaugcggccauccu

SEQ ID NO: 3685769 - RNA, 18 nt, Salmonella enterica enterica serovar Typhi Ty2
caccaggaguuaaaccug

SEQ ID NO: 3685770 - RNA, 20 nt, Salmonella enterica enterica serovar Typhi Ty2
caccaggcguaagaucccag

SEQ ID NO: 3685771 - RNA, 17 nt, Salmonella enterica enterica serovar Typhi Ty2
caccagggauuuugcuu

SEQ ID NO: 3685772 - RNA, 17 nt, Salmonella enterica enterica serovar Typhi Ty2
caccagguucagcaacg

SEQ ID NO: 3685773 - RNA, 15 nt, Salmonella enterica enterica serovar Typhi Ty2
caccaguucacuccu

SEQ ID NO: 3685774 - RNA, 22 nt, Salmonella enterica enterica serovar Typhi Ty2
caccauaauuaccggcacaccg

SEQ ID NO: 3685775 - RNA, 22 nt, Salmonella enterica enterica serovar Typhi Ty2
caccauauagacauacaggaau

SEQ ID NO: 3685776 - RNA, 13 nt, Salmonella enterica enterica serovar Typhi Ty2
caccaucacuucc

SEQ ID NO: 3685777 - RNA, 19 nt, Salmonella enterica enterica serovar Typhi Ty2
caccaucaugcaagagucc

SEQ ID NO: 3685778 - RNA, 14 nt, Salmonella enterica enterica serovar Typhi Ty2
caccaucccggcgu

SEQ ID NO: 3685779 - RNA, 14 nt, Salmonella enterica enterica serovar Typhi Ty2
caccauccgcgcau

SEQ ID NO: 3685780 - RNA, 14 nt, Salmonella enterica enterica serovar Typhi Ty2
caccauccggcgcu

SEQ ID NO: 3685781 - RNA, 15 nt, Salmonella enterica enterica serovar Typhi Ty2
caccaucgccggaga

SEQ ID NO: 3685782 - RNA, 20 nt, Salmonella enterica enterica serovar Typhi Ty2
caccaucgucgccagaccca

SEQ ID NO: 3685783 - RNA, 16 nt, Salmonella enterica enterica serovar Typhi Ty2
caccaucguugccagc

SEQ ID NO: 3685784 - RNA, 19 nt, Salmonella enterica enterica serovar Typhi Ty2
caccaucguugccagcggc

SEQ ID NO: 3685785 - RNA, 20 nt, Salmonella enterica enterica serovar Typhi Ty2
caccaucguugccagcggcc

SEQ ID NO: 3685786 - RNA, 21 nt, Salmonella enterica enterica serovar Typhi Ty2
caccaucguugccagcggcca

SEQ ID NO: 3685787 - RNA, 15 nt, Salmonella enterica enterica serovar Typhi Ty2
caccaucuuuuugcu

SEQ ID NO: 3685788 - RNA, 14 nt, Salmonella enterica enterica serovar Typhi Ty2
caccaugcaaaaug

SEQ ID NO: 3685789 - RNA, 16 nt, Salmonella enterica enterica serovar Typhi Ty2
caccaugcaaaaugcu

SEQ ID NO: 3685790 - RNA, 21 nt, Salmonella enterica enterica serovar Typhi Ty2
caccauuaugaccaauaauaa

SEQ ID NO: 3685791 - RNA, 16 nt, Salmonella enterica enterica serovar Typhi Ty2
caccauucccagcgcc

SEQ ID NO: 3685792 - RNA, 12 nt, Salmonella enterica enterica serovar Typhi Ty2
caccauucuuca

SEQ ID NO: 3685793 - RNA, 15 nt, Salmonella enterica enterica serovar Typhi Ty2
cacccaauaaauaau

SEQ ID NO: 3685794 - RNA, 20 nt, Salmonella enterica enterica serovar Typhi Ty2
cacccaauauagaguccuga

SEQ ID NO: 3685795 - RNA, 13 nt, Salmonella enterica enterica serovar Typhi Ty2
cacccacgccgga

SEQ ID NO: 3685796 - RNA, 21 nt, Salmonella enterica enterica serovar Typhi Ty2
cacccagaauacggccuucuu

SEQ ID NO: 3685797 - RNA, 20 nt, Salmonella enterica enterica serovar Typhi Ty2
cacccaguuuuuuucugcca

SEQ ID NO: 3685798 - RNA, 18 nt, Salmonella enterica enterica serovar Typhi Ty2
cacccauagauaccuucu

SEQ ID NO: 3685799 - RNA, 14 nt, Salmonella enterica enterica serovar Typhi Ty2
cacccaugccgcga

SEQ ID NO: 3685800 - RNA, 20 nt, Salmonella enterica enterica serovar Typhi Ty2
cacccauuuuauccucuuca

SEQ ID NO: 3685801 - RNA, 21 nt, Salmonella enterica enterica serovar Typhi Ty2
caccccaaaucucccccggca

SEQ ID NO: 3685802 - RNA, 21 nt, Salmonella enterica enterica serovar Typhi Ty2
caccccaacaaauagcacaca

SEQ ID NO: 3685803 - RNA, 11 nt, Salmonella enterica enterica serovar Typhi Ty2
caccccagccu

SEQ ID NO: 3685804 - RNA, 18 nt, Salmonella enterica enterica serovar Typhi Ty2
cacccgaaagucaaaaua

SEQ ID NO: 3685805 - RNA, 18 nt, Salmonella enterica enterica serovar Typhi Ty2
cacccgauaaaaucaucg

SEQ ID NO: 3685806 - RNA, 20 nt, Salmonella enterica enterica serovar Typhi Ty2
cacccgauacacgccgacgc

SEQ ID NO: 3685807 - RNA, 22 nt, Salmonella enterica enterica serovar Typhi Ty2
cacccgcagccgcaaucagcgu

SEQ ID NO: 3685808 - RNA, 13 nt, Salmonella enterica enterica serovar Typhi Ty2
cacccgccuuacc

SEQ ID NO: 3685809 - RNA, 12 nt, Salmonella enterica enterica serovar Typhi Ty2
cacccgcgcagg

SEQ ID NO: 3685810 - RNA, 15 nt, Salmonella enterica enterica serovar Typhi Ty2
cacccgcgccagcag

SEQ ID NO: 3685811 - RNA, 17 nt, Salmonella enterica enterica serovar Typhi Ty2
cacccgcucgcugcauu

SEQ ID NO: 3685812 - RNA, 14 nt, Salmonella enterica enterica serovar Typhi Ty2
cacccggagagaaa

SEQ ID NO: 3685813 - RNA, 15 nt, Salmonella enterica enterica serovar Typhi Ty2
cacccggagagaaac

SEQ ID NO: 3685814 - RNA, 18 nt, Salmonella enterica enterica serovar Typhi Ty2
cacccggcugacugccgu

SEQ ID NO: 3685815 - RNA, 20 nt, Salmonella enterica enterica serovar Typhi Ty2
cacccgggaaaaaugacgcc

SEQ ID NO: 3685816 - RNA, 24 nt, Salmonella enterica enterica serovar Typhi Ty2
cacccgggccggaagagcgcagag

SEQ ID NO: 3685817 - RNA, 14 nt, Salmonella enterica enterica serovar Typhi Ty2
cacccguagcccag

SEQ ID NO: 3685818 - RNA, 15 nt, Salmonella enterica enterica serovar Typhi Ty2
cacccuauccgccag

SEQ ID NO: 3685819 - RNA, 19 nt, Salmonella enterica enterica serovar Typhi Ty2
cacccuauuuugcgccugg

SEQ ID NO: 3685820 - RNA, 20 nt, Salmonella enterica enterica serovar Typhi Ty2
cacccuauuuugcgccuggg

SEQ ID NO: 3685821 - RNA, 19 nt, Salmonella enterica enterica serovar Typhi Ty2
cacccucgucuuugccucg

SEQ ID NO: 3685822 - RNA, 10 nt, Salmonella enterica enterica serovar Typhi Ty2
cacccugccc

SEQ ID NO: 3685823 - RNA, 17 nt, Salmonella enterica enterica serovar Typhi Ty2
cacccuugcggcuugca

SEQ ID NO: 3685824 - RNA, 13 nt, Salmonella enterica enterica serovar Typhi Ty2
caccgacacaaau

SEQ ID NO: 3685825 - RNA, 14 nt, Salmonella enterica enterica serovar Typhi Ty2
caccgaggguuugu

SEQ ID NO: 3685826 - RNA, 22 nt, Salmonella enterica enterica serovar Typhi Ty2
caccgauacaggacugacugcu

SEQ ID NO: 3685827 - RNA, 22 nt, Salmonella enterica enterica serovar Typhi Ty2
caccuguaaccccagcaucugc

SEQ ID NO: 3685828 - RNA, 23 nt, Salmonella enterica enterica serovar Typhi Ty2
caccuguaaccccagcaucugca

SEQ ID NO: 3685829 - RNA, 22 nt, Salmonella enterica enterica serovar Typhi Ty2
caccuguccgguguccaucagg

SEQ ID NO: 3685830 - RNA, 17 nt, Salmonella enterica enterica serovar Typhi Ty2
caccuuaaacuugccgu

SEQ ID NO: 3685831 - RNA, 15 nt, Salmonella enterica enterica serovar Typhi Ty2
caccuuacccggcgu

SEQ ID NO: 3685832 - RNA, 22 nt, Salmonella enterica enterica serovar Typhi Ty2
caccuuacgaauuuuaucuucc

SEQ ID NO: 3685833 - RNA, 18 nt, Salmonella enterica enterica serovar Typhi Ty2
caccuuacgcacaugauc

SEQ ID NO: 3685834 - RNA, 13 nt, Salmonella enterica enterica serovar Typhi Ty2
caccuuucugcca

SEQ ID NO: 3685835 - RNA, 21 nt, Salmonella enterica enterica serovar Typhi Ty2
caccuuugaaaaucacaucgc

SEQ ID NO: 3685836 - RNA, 18 nt, Salmonella enterica enterica serovar Typhi Ty2
caccuuuuuauuuacugc

SEQ ID NO: 3685837 - RNA, 21 nt, Salmonella enterica enterica serovar Typhi Ty2
caccuuuuuauuuacugccgu

SEQ ID NO: 3685838 - RNA, 13 nt, Salmonella enterica enterica serovar Typhi Ty2
cacgaaaaauaaa

SEQ ID NO: 3685839 - RNA, 14 nt, Salmonella enterica enterica serovar Typhi Ty2
cacgaaaaauaaaa

SEQ ID NO: 3685840 - RNA, 21 nt, Salmonella enterica enterica serovar Typhi Ty2
cacgaaaaguguguaccagca

SEQ ID NO: 3685841 - RNA, 17 nt, Salmonella enterica enterica serovar Typhi Ty2
cacgaacgauauaaaaa

SEQ ID NO: 3685842 - RNA, 14 nt, Salmonella enterica enterica serovar Typhi Ty2
cacgaagcggguuu

SEQ ID NO: 3685843 - RNA, 15 nt, Salmonella enterica enterica serovar Typhi Ty2
cacgaagcuccagua

SEQ ID NO: 3685844 - RNA, 13 nt, Salmonella enterica enterica serovar Typhi Ty2
cacgaaucaggau

SEQ ID NO: 3685845 - RNA, 22 nt, Salmonella enterica enterica serovar Typhi Ty2
cacgaaucuggucguaagaauu

SEQ ID NO: 3685846 - RNA, 13 nt, Salmonella enterica enterica serovar Typhi Ty2
cacgaaugucgcg

SEQ ID NO: 3685847 - RNA, 13 nt, Salmonella enterica enterica serovar Typhi Ty2
cacgacgccgccg

SEQ ID NO: 3685848 - RNA, 18 nt, Salmonella enterica enterica serovar Typhi Ty2
cacgacuaucgucacccu

SEQ ID NO: 3685849 - RNA, 22 nt, Salmonella enterica enterica serovar Typhi Ty2
cacgacuaucgucacccuauuu

SEQ ID NO: 3685850 - RNA, 21 nt, Salmonella enterica enterica serovar Typhi Ty2
cacgauaaccagaucggcuau

SEQ ID NO: 3685851 - RNA, 17 nt, Salmonella enterica enterica serovar Typhi Ty2
cacgauacgccccugcu

SEQ ID NO: 3685852 - RNA, 16 nt, Salmonella enterica enterica serovar Typhi Ty2
cacgauagacagcacc

SEQ ID NO: 3685853 - RNA, 11 nt, Salmonella enterica enterica serovar Typhi Ty2
cacgaucaucg

SEQ ID NO: 3685854 - RNA, 16 nt, Salmonella enterica enterica serovar Typhi Ty2
cacgaucgagccgucg

SEQ ID NO: 3685855 - RNA, 20 nt, Salmonella enterica enterica serovar Typhi Ty2
cacgaucgagucaggcgcca

SEQ ID NO: 3685856 - RNA, 14 nt, Salmonella enterica enterica serovar Typhi Ty2
cacgaucgccuaau

SEQ ID NO: 3685857 - RNA, 12 nt, Salmonella enterica enterica serovar Typhi Ty2
cacgauggcaaa

SEQ ID NO: 3685858 - RNA, 23 nt, Salmonella enterica enterica serovar Typhi Ty2
cacgauugaucucaucgaucacc

SEQ ID NO: 3685859 - RNA, 13 nt, Salmonella enterica enterica serovar Typhi Ty2
cacgcaaaccgcu

SEQ ID NO: 3685860 - RNA, 22 nt, Salmonella enterica enterica serovar Typhi Ty2
cacgcaaucucuuccgcccaga

SEQ ID NO: 3685861 - RNA, 15 nt, Salmonella enterica enterica serovar Typhi Ty2
cacgcaaugccugac

SEQ ID NO: 3685862 - RNA, 16 nt, Salmonella enterica enterica serovar Typhi Ty2
cacgcaaugcguccgu

SEQ ID NO: 3685863 - RNA, 23 nt, Salmonella enterica enterica serovar Typhi Ty2
cacgcacacgucugagcaggcgg

SEQ ID NO: 3685864 - RNA, 22 nt, Salmonella enterica enterica serovar Typhi Ty2
cacgcacaucccgaauacgcug

SEQ ID NO: 3685865 - RNA, 19 nt, Salmonella enterica enterica serovar Typhi Ty2
cacgcagauaucuuccagc

SEQ ID NO: 3685866 - RNA, 20 nt, Salmonella enterica enterica serovar Typhi Ty2
cacgcagauaucuuccagcg

SEQ ID NO: 3685867 - RNA, 13 nt, Salmonella enterica enterica serovar Typhi Ty2
cacgcagccaugu

SEQ ID NO: 3685868 - RNA, 21 nt, Salmonella enterica enterica serovar Typhi Ty2
cacgcagcgccuuaucgagug

SEQ ID NO: 3685869 - RNA, 16 nt, Salmonella enterica enterica serovar Typhi Ty2
cacgcaggucauuggg

SEQ ID NO: 3685870 - RNA, 16 nt, Salmonella enterica enterica serovar Typhi Ty2
cacgcaguccaacaag

SEQ ID NO: 3685871 - RNA, 22 nt, Salmonella enterica enterica serovar Typhi Ty2
cacgcauggcguugcugcaaau

SEQ ID NO: 3685872 - RNA, 18 nt, Salmonella enterica enterica serovar Typhi Ty2
cacgcauucuuuuuucuc

SEQ ID NO: 3685873 - RNA, 13 nt, Salmonella enterica enterica serovar Typhi Ty2
cacgccaccaucc

SEQ ID NO: 3685874 - RNA, 15 nt, Salmonella enterica enterica serovar Typhi Ty2
cacgccagauaaauc

SEQ ID NO: 3685875 - RNA, 18 nt, Salmonella enterica enterica serovar Typhi Ty2
cacgccagauaaaucagc

SEQ ID NO: 3685876 - RNA, 13 nt, Salmonella enterica enterica serovar Typhi Ty2
cacgccagcagcu

SEQ ID NO: 3685877 - RNA, 12 nt, Salmonella enterica enterica serovar Typhi Ty2
cacgccagcggu

SEQ ID NO: 3685878 - RNA, 20 nt, Salmonella enterica enterica serovar Typhi Ty2
cacgccagggagggccaacc

SEQ ID NO: 3685879 - RNA, 16 nt, Salmonella enterica enterica serovar Typhi Ty2
cacgccaucauuggcu

SEQ ID NO: 3685880 - RNA, 13 nt, Salmonella enterica enterica serovar Typhi Ty2
cacgccaucgcgg

SEQ ID NO: 3685881 - RNA, 14 nt, Salmonella enterica enterica serovar Typhi Ty2
cacgccaucggcua

SEQ ID NO: 3685882 - RNA, 22 nt, Salmonella enterica enterica serovar Typhi Ty2
cacgccccccgguagccacacc

SEQ ID NO: 3685883 - RNA, 13 nt, Salmonella enterica enterica serovar Typhi Ty2
cacgcccgcagca

SEQ ID NO: 3685884 - RNA, 17 nt, Salmonella enterica enterica serovar Typhi Ty2
cacgccgaacaacacgg

SEQ ID NO: 3685885 - RNA, 17 nt, Salmonella enterica enterica serovar Typhi Ty2
cacgccgacgaccggca

SEQ ID NO: 3685886 - RNA, 22 nt, Salmonella enterica enterica serovar Typhi Ty2
cacgccgacucacgcagcgcuc

SEQ ID NO: 3685887 - RNA, 16 nt, Salmonella enterica enterica serovar Typhi Ty2
cacgccgccauccggc

SEQ ID NO: 3685888 - RNA, 19 nt, Salmonella enterica enterica serovar Typhi Ty2
cacgccgccauccggcaac

SEQ ID NO: 3685889 - RNA, 12 nt, Salmonella enterica enterica serovar Typhi Ty2
cacgccgcgcug

SEQ ID NO: 3685890 - RNA, 21 nt, Salmonella enterica enterica serovar Typhi Ty2
cacgccgcuaucgaccagcac

SEQ ID NO: 3685891 - RNA, 23 nt, Salmonella enterica enterica serovar Typhi Ty2
cacgccgcuaucgaccagcaccu

SEQ ID NO: 3685892 - RNA, 24 nt, Salmonella enterica enterica serovar Typhi Ty2
cacgccgcuaucgaccagcaccug

SEQ ID NO: 3685893 - RNA, 14 nt, Salmonella enterica enterica serovar Typhi Ty2
cacgccgcuccaca

SEQ ID NO: 3685894 - RNA, 15 nt, Salmonella enterica enterica serovar Typhi Ty2
cacgccguccagcac

SEQ ID NO: 3685895 - RNA, 15 nt, Salmonella enterica enterica serovar Typhi Ty2
cacgccgucgaugau

SEQ ID NO: 3685896 - RNA, 21 nt, Salmonella enterica enterica serovar Typhi Ty2
cacgccgugcacuucugcggu

SEQ ID NO: 3685897 - RNA, 15 nt, Salmonella enterica enterica serovar Typhi Ty2
cacgccguuugccau

SEQ ID NO: 3685898 - RNA, 17 nt, Salmonella enterica enterica serovar Typhi Ty2
cacgccugcauaaagga

SEQ ID NO: 3685899 - RNA, 13 nt, Salmonella enterica enterica serovar Typhi Ty2
cacgccuuccucc

SEQ ID NO: 3685900 - RNA, 17 nt, Salmonella enterica enterica serovar Typhi Ty2
cacgcgaauagccagac

SEQ ID NO: 3685901 - RNA, 22 nt, Salmonella enterica enterica serovar Typhi Ty2
cacgcgaauagccagacagccc

SEQ ID NO: 3685902 - RNA, 13 nt, Salmonella enterica enterica serovar Typhi Ty2
cacgcgacgccag

SEQ ID NO: 3685903 - RNA, 14 nt, Salmonella enterica enterica serovar Typhi Ty2
cacgcgacgccagc

SEQ ID NO: 3685904 - RNA, 14 nt, Salmonella enterica enterica serovar Typhi Ty2
cacgcgacgcgcca

SEQ ID NO: 3685905 - RNA, 19 nt, Salmonella enterica enterica serovar Typhi Ty2
cacgcgaugcaaccccuga

SEQ ID NO: 3685906 - RNA, 14 nt, Salmonella enterica enterica serovar Typhi Ty2
cacgcgcagcaucu

SEQ ID NO: 3685907 - RNA, 21 nt, Salmonella enterica enterica serovar Typhi Ty2
cacgcgcgccugccgccagca

SEQ ID NO: 3685908 - RNA, 15 nt, Salmonella enterica enterica serovar Typhi Ty2
cacgcgcgcgcguca

SEQ ID NO: 3685909 - RNA, 14 nt, Salmonella enterica enterica serovar Typhi Ty2
cacuaccaucggcg

SEQ ID NO: 3685910 - RNA, 15 nt, Salmonella enterica enterica serovar Typhi Ty2
cacuaccgggcagca

SEQ ID NO: 3685911 - RNA, 21 nt, Salmonella enterica enterica serovar Typhi Ty2
cacuaccgggcagcaucucga

SEQ ID NO: 3685912 - RNA, 19 nt, Salmonella enterica enterica serovar Typhi Ty2
cacuacgcagcuccagcuc

SEQ ID NO: 3685913 - RNA, 19 nt, Salmonella enterica enterica serovar Typhi Ty2
cacuacggcaaacgcuggu

SEQ ID NO: 3685914 - RNA, 22 nt, Salmonella enterica enterica serovar Typhi Ty2
cacuacggcaaacgcuggugcu

SEQ ID NO: 3685915 - RNA, 16 nt, Salmonella enterica enterica serovar Typhi Ty2
cacuacggguuuuugu

SEQ ID NO: 3685916 - RNA, 18 nt, Salmonella enterica enterica serovar Typhi Ty2
cacuacggguuuuugugu

SEQ ID NO: 3685917 - RNA, 15 nt, Salmonella enterica enterica serovar Typhi Ty2
cacuauccagucagc

SEQ ID NO: 3685918 - RNA, 19 nt, Salmonella enterica enterica serovar Typhi Ty2
cacucaaucauugucauua

SEQ ID NO: 3685919 - RNA, 16 nt, Salmonella enterica enterica serovar Typhi Ty2
cacucacaaaacuauu

SEQ ID NO: 3685920 - RNA, 14 nt, Salmonella enterica enterica serovar Typhi Ty2
cacucagaaaauua

SEQ ID NO: 3685921 - RNA, 21 nt, Salmonella enterica enterica serovar Typhi Ty2
cacucagaaaauuauuuuaaa

SEQ ID NO: 3685922 - RNA, 16 nt, Salmonella enterica enterica serovar Typhi Ty2
cacucaggcagauggu

SEQ ID NO: 3685923 - RNA, 15 nt, Salmonella enterica enterica serovar Typhi Ty2
cacucauccagacca

SEQ ID NO: 3685924 - RNA, 12 nt, Salmonella enterica enterica serovar Typhi Ty2
cacuccagaccu

SEQ ID NO: 3685925 - RNA, 14 nt, Salmonella enterica enterica serovar Typhi Ty2
cacuccaucgccug

SEQ ID NO: 3685926 - RNA, 15 nt, Salmonella enterica enterica serovar Typhi Ty2
cacuccccagaauga

SEQ ID NO: 3685927 - RNA, 23 nt, Salmonella enterica enterica serovar Typhi Ty2
cacucccgauucaacguuucgcu

SEQ ID NO: 3685928 - RNA, 15 nt, Salmonella enterica enterica serovar Typhi Ty2
cacuccuaagagaaa

SEQ ID NO: 3685929 - RNA, 14 nt, Salmonella enterica enterica serovar Typhi Ty2
cacucgcggauaau

SEQ ID NO: 3685930 - RNA, 14 nt, Salmonella enterica enterica serovar Typhi Ty2
cacucgcucauuug

SEQ ID NO: 3685931 - RNA, 16 nt, Salmonella enterica enterica serovar Typhi Ty2
cacucuucaaccggca

SEQ ID NO: 3685932 - RNA, 23 nt, Salmonella enterica enterica serovar Typhi Ty2
cacucuuuggacggcaucaggaa

SEQ ID NO: 3685933 - RNA, 14 nt, Salmonella enterica enterica serovar Typhi Ty2
cacucuuuuuggcu

SEQ ID NO: 3685934 - RNA, 14 nt, Salmonella enterica enterica serovar Typhi Ty2
cacugaaccugccu

SEQ ID NO: 3685935 - RNA, 19 nt, Salmonella enterica enterica serovar Typhi Ty2
cacugaagccuggugccca

SEQ ID NO: 3685936 - RNA, 19 nt, Salmonella enterica enterica serovar Typhi Ty2
cacugaauuacugcguaaa

SEQ ID NO: 3685937 - RNA, 20 nt, Salmonella enterica enterica serovar Typhi Ty2
cacugaauuacugcguaaac

SEQ ID NO: 3685938 - RNA, 18 nt, Salmonella enterica enterica serovar Typhi Ty2
cacugacuauccacagcg

SEQ ID NO: 3685939 - RNA, 17 nt, Salmonella enterica enterica serovar Typhi Ty2
cacugagcgcgccauga

SEQ ID NO: 3685940 - RNA, 18 nt, Salmonella enterica enterica serovar Typhi Ty2
cacugagcugugauaaaa

SEQ ID NO: 3685941 - RNA, 17 nt, Salmonella enterica enterica serovar Typhi Ty2
cacugagcuucaccgcc

SEQ ID NO: 3685942 - RNA, 20 nt, Salmonella enterica enterica serovar Typhi Ty2
cacugauaaaauucccgcgc

SEQ ID NO: 3685943 - RNA, 19 nt, Salmonella enterica enterica serovar Typhi Ty2
cacugauaccccagcgauc

SEQ ID NO: 3685944 - RNA, 15 nt, Salmonella enterica enterica serovar Typhi Ty2
cacugauagccgcca

SEQ ID NO: 3685945 - RNA, 21 nt, Salmonella enterica enterica serovar Typhi Ty2
cacugauggaguuucaucagc

SEQ ID NO: 3685946 - RNA, 18 nt, Salmonella enterica enterica serovar Typhi Ty2
cacugcaauuucugcugg

SEQ ID NO: 3685947 - RNA, 14 nt, Salmonella enterica enterica serovar Typhi Ty2
cacugcacaucccg

SEQ ID NO: 3685948 - RNA, 19 nt, Salmonella enterica enterica serovar Typhi Ty2
cacugcaccaguccagugc

SEQ ID NO: 3685949 - RNA, 15 nt, Salmonella enterica enterica serovar Typhi Ty2
cacugcccgccgcca

SEQ ID NO: 3685950 - RNA, 18 nt, Salmonella enterica enterica serovar Typhi Ty2
cacugcccucaaguuaug

SEQ ID NO: 3685951 - RNA, 21 nt, Salmonella enterica enterica serovar Typhi Ty2
cacugcccucaaguuauguua

SEQ ID NO: 3685952 - RNA, 12 nt, Salmonella enterica enterica serovar Typhi Ty2
cacugccgccac

SEQ ID NO: 3685953 - RNA, 23 nt, Salmonella enterica enterica serovar Typhi Ty2
cacugcgaacgcaucaaagccac

SEQ ID NO: 3685954 - RNA, 12 nt, Salmonella enterica enterica serovar Typhi Ty2
cacugcgccgcc

SEQ ID NO: 3685955 - RNA, 19 nt, Salmonella enterica enterica serovar Typhi Ty2
cacugcgcuuauccggccu

SEQ ID NO: 3685956 - RNA, 16 nt, Salmonella enterica enterica serovar Typhi Ty2
cacugcuguguccagg

SEQ ID NO: 3685957 - RNA, 19 nt, Salmonella enterica enterica serovar Typhi Ty2
cacuggccucccaguuccc

SEQ ID NO: 3685958 - RNA, 20 nt, Salmonella enterica enterica serovar Typhi Ty2
cacuggccucccaguucccc

SEQ ID NO: 3685959 - RNA, 18 nt, Salmonella enterica enterica serovar Typhi Ty2
cacuggcgcucagcgccg

SEQ ID NO: 3685960 - RNA, 20 nt, Salmonella enterica enterica serovar Typhi Ty2
cacuggcguagucucccucc

SEQ ID NO: 3685961 - RNA, 22 nt, Salmonella enterica enterica serovar Typhi Ty2
cacuggcguagucucccuccug

SEQ ID NO: 3685962 - RNA, 20 nt, Salmonella enterica enterica serovar Typhi Ty2
cacugucaugguuauuuugu

SEQ ID NO: 3685963 - RNA, 17 nt, Salmonella enterica enterica serovar Typhi Ty2
cacuguggugugccugc

SEQ ID NO: 3685964 - RNA, 19 nt, Salmonella enterica enterica serovar Typhi Ty2
cacuguucaaucaucacga

SEQ ID NO: 3685965 - RNA, 21 nt, Salmonella enterica enterica serovar Typhi Ty2
cacuguuuuuagccuguuauu

SEQ ID NO: 3685966 - RNA, 23 nt, Salmonella enterica enterica serovar Typhi Ty2
cacuuaauacucgccccguuccu

SEQ ID NO: 3685967 - RNA, 23 nt, Salmonella enterica enterica serovar Typhi Ty2
cacuuacggacaaaauauugccc

SEQ ID NO: 3685968 - RNA, 17 nt, Salmonella enterica enterica serovar Typhi Ty2
cacuuagcacaaagaau

SEQ ID NO: 3685969 - RNA, 18 nt, Salmonella enterica enterica serovar Typhi Ty2
cacuuaggcagccaggca

SEQ ID NO: 3685970 - RNA, 17 nt, Salmonella enterica enterica serovar Typhi Ty2
cacuucacccaucgcca

SEQ ID NO: 3685971 - RNA, 13 nt, Salmonella enterica enterica serovar Typhi Ty2
cacuucauccggc

SEQ ID NO: 3685972 - RNA, 21 nt, Salmonella enterica enterica serovar Typhi Ty2
cacuucauccggcguugcgcc

SEQ ID NO: 3685973 - RNA, 13 nt, Salmonella enterica enterica serovar Typhi Ty2
cacuuccccugcc

SEQ ID NO: 3685974 - RNA, 17 nt, Salmonella enterica enterica serovar Typhi Ty2
cacuuccgccaccacgc

SEQ ID NO: 3685975 - RNA, 15 nt, Salmonella enterica enterica serovar Typhi Ty2
cacuuccgccucgcc

SEQ ID NO: 3685976 - RNA, 13 nt, Salmonella enterica enterica serovar Typhi Ty2
cacuucugacaga

SEQ ID NO: 3685977 - RNA, 22 nt, Salmonella enterica enterica serovar Typhi Ty2
cacuucugaguucggcaugggg

SEQ ID NO: 3685978 - RNA, 15 nt, Salmonella enterica enterica serovar Typhi Ty2
cacuucuuccagcgu

SEQ ID NO: 3685979 - RNA, 22 nt, Salmonella enterica enterica serovar Typhi Ty2
cacuucuuucacugucaugguu

SEQ ID NO: 3685980 - RNA, 21 nt, Salmonella enterica enterica serovar Typhi Ty2
cacuugccgaguggaaucagc

SEQ ID NO: 3685981 - RNA, 22 nt, Salmonella enterica enterica serovar Typhi Ty2
cacuugccgaguggaaucagcc

SEQ ID NO: 3685982 - RNA, 13 nt, Salmonella enterica enterica serovar Typhi Ty2
cacuugccgcguu

SEQ ID NO: 3685983 - RNA, 11 nt, Salmonella enterica enterica serovar Typhi Ty2
cacuuguucuu

SEQ ID NO: 3685984 - RNA, 22 nt, Salmonella enterica enterica serovar Typhi Ty2
cacuuuaccaggcauaauggaa

SEQ ID NO: 3685985 - RNA, 22 nt, Salmonella enterica enterica serovar Typhi Ty2
cacuuuacugaauaacagcacc

SEQ ID NO: 3685986 - RNA, 17 nt, Salmonella enterica enterica serovar Typhi Ty2
cacuuucagaccacuau

SEQ ID NO: 3685987 - RNA, 13 nt, Salmonella enterica enterica serovar Typhi Ty2
cacuuucaucagc

SEQ ID NO: 3685988 - RNA, 15 nt, Salmonella enterica enterica serovar Typhi Ty2
cacuuugcgcugcgc

SEQ ID NO: 3685989 - RNA, 13 nt, Salmonella enterica enterica serovar Typhi Ty2
cacuuuuaccggc

SEQ ID NO: 3685990 - RNA, 17 nt, Salmonella enterica enterica serovar Typhi Ty2
cacuuuuaccggcgucc

SEQ ID NO: 3685991 - RNA, 17 nt, Salmonella enterica enterica serovar Typhi Ty2
cagacagauaacaccag

SEQ ID NO: 3685992 - RNA, 19 nt, Salmonella enterica enterica serovar Typhi Ty2
cagacagauaacaccagcg

SEQ ID NO: 3685993 - RNA, 22 nt, Salmonella enterica enterica serovar Typhi Ty2
cagacagauaacaccagcgauc

SEQ ID NO: 3685994 - RNA, 23 nt, Salmonella enterica enterica serovar Typhi Ty2
cagacagccauauuuaugcagcg

SEQ ID NO: 3685995 - RNA, 14 nt, Salmonella enterica enterica serovar Typhi Ty2
cagacaggacgcca

SEQ ID NO: 3685996 - RNA, 23 nt, Salmonella enterica enterica serovar Typhi Ty2
cagacaggccugguuaacaauau

SEQ ID NO: 3685997 - RNA, 15 nt, Salmonella enterica enterica serovar Typhi Ty2
cagacaggugaacau

SEQ ID NO: 3685998 - RNA, 20 nt, Salmonella enterica enterica serovar Typhi Ty2
cagacagucuggauauaaac

SEQ ID NO: 3685999 - RNA, 22 nt, Salmonella enterica enterica serovar Typhi Ty2
cagacaguggccaucuuccagc

SEQ ID NO: 3686000 - RNA, 14 nt, Salmonella enterica enterica serovar Typhi Ty2
cagacaucaucgaa

SEQ ID NO: 3686001 - RNA, 18 nt, Salmonella enterica enterica serovar Typhi Ty2
cagacaugaccgcacagc

SEQ ID NO: 3686002 - RNA, 20 nt, Salmonella enterica enterica serovar Typhi Ty2
cagacaugaccgcacagcag

SEQ ID NO: 3686003 - RNA, 14 nt, Salmonella enterica enterica serovar Typhi Ty2
cagacaugcacaug

SEQ ID NO: 3686004 - RNA, 20 nt, Salmonella enterica enterica serovar Typhi Ty2
cagacaugcagcacuuuuga

SEQ ID NO: 3686005 - RNA, 16 nt, Salmonella enterica enterica serovar Typhi Ty2
cagacauggcaauggc

SEQ ID NO: 3686006 - RNA, 15 nt, Salmonella enterica enterica serovar Typhi Ty2
cagacauucgcgcac

SEQ ID NO: 3686007 - RNA, 17 nt, Salmonella enterica enterica serovar Typhi Ty2
cagaccaaagucaaacu

SEQ ID NO: 3686008 - RNA, 18 nt, Salmonella enterica enterica serovar Typhi Ty2
cagaccaaagucaaacug

SEQ ID NO: 3686009 - RNA, 13 nt, Salmonella enterica enterica serovar Typhi Ty2
cagaccaauagag

SEQ ID NO: 3686010 - RNA, 18 nt, Salmonella enterica enterica serovar Typhi Ty2
cagaccacgaaucaggau

SEQ ID NO: 3686011 - RNA, 16 nt, Salmonella enterica enterica serovar Typhi Ty2
cagaccagucggacag

SEQ ID NO: 3686012 - RNA, 18 nt, Salmonella enterica enterica serovar Typhi Ty2
cagacccgauagcgccgc

SEQ ID NO: 3686013 - RNA, 15 nt, Salmonella enterica enterica serovar Typhi Ty2
cagacccgcaaacca

SEQ ID NO: 3686014 - RNA, 19 nt, Salmonella enterica enterica serovar Typhi Ty2
cagacccgcauacaggaag

SEQ ID NO: 3686015 - RNA, 21 nt, Salmonella enterica enterica serovar Typhi Ty2
cagacccgcauacaggaagcc

SEQ ID NO: 3686016 - RNA, 15 nt, Salmonella enterica enterica serovar Typhi Ty2
cagaccgacaaaacu

SEQ ID NO: 3686017 - RNA, 17 nt, Salmonella enterica enterica serovar Typhi Ty2
cagaccgacaagccccc

SEQ ID NO: 3686018 - RNA, 18 nt, Salmonella enterica enterica serovar Typhi Ty2
cagaccgacgccaaccgc

SEQ ID NO: 3686019 - RNA, 17 nt, Salmonella enterica enterica serovar Typhi Ty2
cagaccgaucucaugca

SEQ ID NO: 3686020 - RNA, 23 nt, Salmonella enterica enterica serovar Typhi Ty2
cagaccgccaagcgcggacagca

SEQ ID NO: 3686021 - RNA, 13 nt, Salmonella enterica enterica serovar Typhi Ty2
cagaccgccaugc

SEQ ID NO: 3686022 - RNA, 17 nt, Salmonella enterica enterica serovar Typhi Ty2
cagaccgcugcggaaca

SEQ ID NO: 3686023 - RNA, 20 nt, Salmonella enterica enterica serovar Typhi Ty2
cagaccgcuuaacuccggcg

SEQ ID NO: 3686024 - RNA, 18 nt, Salmonella enterica enterica serovar Typhi Ty2
cagaccggagcgugcuuc

SEQ ID NO: 3686025 - RNA, 14 nt, Salmonella enterica enterica serovar Typhi Ty2
cagaccggauugcc

SEQ ID NO: 3686026 - RNA, 20 nt, Salmonella enterica enterica serovar Typhi Ty2
cagaccggcaucucaucuug

SEQ ID NO: 3686027 - RNA, 21 nt, Salmonella enterica enterica serovar Typhi Ty2
cagaccggcaucucaucuugc

SEQ ID NO: 3686028 - RNA, 17 nt, Salmonella enterica enterica serovar Typhi Ty2
cagaccgucaugacguc

SEQ ID NO: 3686029 - RNA, 15 nt, Salmonella enterica enterica serovar Typhi Ty2
cagaccgugcggcgu

SEQ ID NO: 3686030 - RNA, 19 nt, Salmonella enterica enterica serovar Typhi Ty2
cagaccuacgcuauccggc

SEQ ID NO: 3686031 - RNA, 14 nt, Salmonella enterica enterica serovar Typhi Ty2
cagaccucugcaaa

SEQ ID NO: 3686032 - RNA, 18 nt, Salmonella enterica enterica serovar Typhi Ty2
cagaccucugcaaacacc

SEQ ID NO: 3686033 - RNA, 23 nt, Salmonella enterica enterica serovar Typhi Ty2
cagaccugaauauucggcuccag

SEQ ID NO: 3686034 - RNA, 15 nt, Salmonella enterica enterica serovar Typhi Ty2
cagaccuguaaaaaa

SEQ ID NO: 3686035 - RNA, 21 nt, Salmonella enterica enterica serovar Typhi Ty2
cagaccuucaacccagcagca

SEQ ID NO: 3686036 - RNA, 18 nt, Salmonella enterica enterica serovar Typhi Ty2
cagaccuuuauaagguua

SEQ ID NO: 3686037 - RNA, 20 nt, Salmonella enterica enterica serovar Typhi Ty2
cagacgaaaaaaaagacgcu

SEQ ID NO: 3686038 - RNA, 20 nt, Salmonella enterica enterica serovar Typhi Ty2
cagacgaagcgcaaacggau

SEQ ID NO: 3686039 - RNA, 17 nt, Salmonella enterica enterica serovar Typhi Ty2
cagacgaccauccacca

SEQ ID NO: 3686040 - RNA, 19 nt, Salmonella enterica enterica serovar Typhi Ty2
cagacgaccguaauagcaa

SEQ ID NO: 3686041 - RNA, 14 nt, Salmonella enterica enterica serovar Typhi Ty2
cagacgaugaauuc

SEQ ID NO: 3686042 - RNA, 20 nt, Salmonella enterica enterica serovar Typhi Ty2
cagacgcaucaggaaccaca

SEQ ID NO: 3686043 - RNA, 17 nt, Salmonella enterica enterica serovar Typhi Ty2
cagacgcaucuuuuucc

SEQ ID NO: 3686044 - RNA, 20 nt, Salmonella enterica enterica serovar Typhi Ty2
cagacgccgcgcugcggcgu

SEQ ID NO: 3686045 - RNA, 13 nt, Salmonella enterica enterica serovar Typhi Ty2
cagacgccuuuca

SEQ ID NO: 3686046 - RNA, 21 nt, Salmonella enterica enterica serovar Typhi Ty2
cagacgcguauggcgguuggg

SEQ ID NO: 3686047 - RNA, 13 nt, Salmonella enterica enterica serovar Typhi Ty2
cagacgcuccgca

SEQ ID NO: 3686048 - RNA, 16 nt, Salmonella enterica enterica serovar Typhi Ty2
cagacgcugcuucacg

SEQ ID NO: 3686049 - RNA, 14 nt, Salmonella enterica enterica serovar Typhi Ty2
cagacgcugguugu

SEQ ID NO: 3686050 - RNA, 21 nt, Salmonella enterica enterica serovar Typhi Ty2
cagacggcgcuaauguacgcc

SEQ ID NO: 3686051 - RNA, 23 nt, Salmonella enterica enterica serovar Typhi Ty2
cagacggcgcuaauguacgccua

SEQ ID NO: 3686052 - RNA, 18 nt, Salmonella enterica enterica serovar Typhi Ty2
cagacggcuccagcgcca

SEQ ID NO: 3686053 - RNA, 15 nt, Salmonella enterica enterica serovar Typhi Ty2
cagacguaaauugcg

SEQ ID NO: 3686054 - RNA, 18 nt, Salmonella enterica enterica serovar Typhi Ty2
cagacgugcaauaucgcg

SEQ ID NO: 3686055 - RNA, 15 nt, Salmonella enterica enterica serovar Typhi Ty2
cagacguuuaagcau

SEQ ID NO: 3686056 - RNA, 18 nt, Salmonella enterica enterica serovar Typhi Ty2
cagacuacggaaacugua

SEQ ID NO: 3686057 - RNA, 12 nt, Salmonella enterica enterica serovar Typhi Ty2
cagacuaucuuc

SEQ ID NO: 3686058 - RNA, 14 nt, Salmonella enterica enterica serovar Typhi Ty2
cagacucagccagg

SEQ ID NO: 3686059 - RNA, 17 nt, Salmonella enterica enterica serovar Typhi Ty2
cagacucgcucccuucc

SEQ ID NO: 3686060 - RNA, 20 nt, Salmonella enterica enterica serovar Typhi Ty2
cagacucgcucccuuccccc

SEQ ID NO: 3686061 - RNA, 15 nt, Salmonella enterica enterica serovar Typhi Ty2
cagacucgcuucacg

SEQ ID NO: 3686062 - RNA, 14 nt, Salmonella enterica enterica serovar Typhi Ty2
cagacucugcgcgu

SEQ ID NO: 3686063 - RNA, 15 nt, Salmonella enterica enterica serovar Typhi Ty2
cagacugcacuuccu

SEQ ID NO: 3686064 - RNA, 19 nt, Salmonella enterica enterica serovar Typhi Ty2
cagacugcacuuccugcgu

SEQ ID NO: 3686065 - RNA, 16 nt, Salmonella enterica enterica serovar Typhi Ty2
cagacuguaugugcuc

SEQ ID NO: 3686066 - RNA, 17 nt, Salmonella enterica enterica serovar Typhi Ty2
cagacuuagggcggaga

SEQ ID NO: 3686067 - RNA, 18 nt, Salmonella enterica enterica serovar Typhi Ty2
cagacuucaacgccgcac

SEQ ID NO: 3686068 - RNA, 16 nt, Salmonella enterica enterica serovar Typhi Ty2
cagacuucauuuucca

SEQ ID NO: 3686069 - RNA, 17 nt, Salmonella enterica enterica serovar Typhi Ty2
cagacuucauuuuccac

SEQ ID NO: 3686070 - RNA, 21 nt, Salmonella enterica enterica serovar Typhi Ty2
cagagagcguuucuacgccau

SEQ ID NO: 3686071 - RNA, 22 nt, Salmonella enterica enterica serovar Typhi Ty2
cagagagcguuucuacgccaug

SEQ ID NO: 3686072 - RNA, 15 nt, Salmonella enterica enterica serovar Typhi Ty2
cagagagggaaaaaa

SEQ ID NO: 3686073 - RNA, 14 nt, Salmonella enterica enterica serovar Typhi Ty2
cagauggaaaccgg

SEQ ID NO: 3686074 - RNA, 22 nt, Salmonella enterica enterica serovar Typhi Ty2
cagauggcgauucauaugcgcc

SEQ ID NO: 3686075 - RNA, 21 nt, Salmonella enterica enterica serovar Typhi Ty2
cagauggcgucacauggcgaa

SEQ ID NO: 3686076 - RNA, 22 nt, Salmonella enterica enterica serovar Typhi Ty2
cagauggcuaugaagcuggagc

SEQ ID NO: 3686077 - RNA, 22 nt, Salmonella enterica enterica serovar Typhi Ty2
cagauggcuuuacgcuuauucg

SEQ ID NO: 3686078 - RNA, 18 nt, Salmonella enterica enterica serovar Typhi Ty2
cagaugggccauuuacgc

SEQ ID NO: 3686079 - RNA, 19 nt, Salmonella enterica enterica serovar Typhi Ty2
cagauggugauagcgcgcc

SEQ ID NO: 3686080 - RNA, 18 nt, Salmonella enterica enterica serovar Typhi Ty2
cagaugguuggcgccgau

SEQ ID NO: 3686081 - RNA, 20 nt, Salmonella enterica enterica serovar Typhi Ty2
cagauguaccagcggcagcu

SEQ ID NO: 3686082 - RNA, 18 nt, Salmonella enterica enterica serovar Typhi Ty2
cagauguaucgcgcuuac

SEQ ID NO: 3686083 - RNA, 18 nt, Salmonella enterica enterica serovar Typhi Ty2
cagauguccaccgauuuc

SEQ ID NO: 3686084 - RNA, 19 nt, Salmonella enterica enterica serovar Typhi Ty2
cagauguccaccgauuuca

SEQ ID NO: 3686085 - RNA, 23 nt, Salmonella enterica enterica serovar Typhi Ty2
cagauguccaccgauuucaucgc

SEQ ID NO: 3686086 - RNA, 19 nt, Salmonella enterica enterica serovar Typhi Ty2
cagaugucgcggauaugca

SEQ ID NO: 3686087 - RNA, 18 nt, Salmonella enterica enterica serovar Typhi Ty2
cagaugucggcggcaggu

SEQ ID NO: 3686088 - RNA, 15 nt, Salmonella enterica enterica serovar Typhi Ty2
cagauguuauaaacu

SEQ ID NO: 3686089 - RNA, 17 nt, Salmonella enterica enterica serovar Typhi Ty2
cagauguuauaaacuuc

SEQ ID NO: 3686090 - RNA, 16 nt, Salmonella enterica enterica serovar Typhi Ty2
cagauuacgcaugguc

SEQ ID NO: 3686091 - RNA, 16 nt, Salmonella enterica enterica serovar Typhi Ty2
cagauuaucagcgaga

SEQ ID NO: 3686092 - RNA, 12 nt, Salmonella enterica enterica serovar Typhi Ty2
cagauucagaug

SEQ ID NO: 3686093 - RNA, 13 nt, Salmonella enterica enterica serovar Typhi Ty2
cagauucuucugc

SEQ ID NO: 3686094 - RNA, 22 nt, Salmonella enterica enterica serovar Typhi Ty2
cagauugauacggguaaucaga

SEQ ID NO: 3686095 - RNA, 22 nt, Salmonella enterica enterica serovar Typhi Ty2
cagauuggugaugcgcaacguu

SEQ ID NO: 3686096 - RNA, 17 nt, Salmonella enterica enterica serovar Typhi Ty2
cagauuguugccgucuu

SEQ ID NO: 3686097 - RNA, 15 nt, Salmonella enterica enterica serovar Typhi Ty2
cagauuuagguucug

SEQ ID NO: 3686098 - RNA, 22 nt, Salmonella enterica enterica serovar Typhi Ty2
cagauuuucauuuagcgccugu

SEQ ID NO: 3686099 - RNA, 15 nt, Salmonella enterica enterica serovar Typhi Ty2
cagauuuuuaauguc

SEQ ID NO: 3686100 - RNA, 22 nt, Salmonella enterica enterica serovar Typhi Ty2
cagauuuuuaauguccagcagu

SEQ ID NO: 3686101 - RNA, 23 nt, Salmonella enterica enterica serovar Typhi Ty2
cagauuuuuaauguccagcagug

SEQ ID NO: 3686102 - RNA, 19 nt, Salmonella enterica enterica serovar Typhi Ty2
cagcaaaacgcgcuaucaa

SEQ ID NO: 3686103 - RNA, 19 nt, Salmonella enterica enterica serovar Typhi Ty2
cagcaaaauaccggcagcg

SEQ ID NO: 3686104 - RNA, 15 nt, Salmonella enterica enterica serovar Typhi Ty2
cagcaaaauggcaau

SEQ ID NO: 3686105 - RNA, 21 nt, Salmonella enterica enterica serovar Typhi Ty2
cagcaaaauggcaauugcgcc

SEQ ID NO: 3686106 - RNA, 15 nt, Salmonella enterica enterica serovar Typhi Ty2
cagcaaacauccccg

SEQ ID NO: 3686107 - RNA, 13 nt, Salmonella enterica enterica serovar Typhi Ty2
cagcaaaccgaua

SEQ ID NO: 3686108 - RNA, 20 nt, Salmonella enterica enterica serovar Typhi Ty2
cagcaaacgccauagcaucg

SEQ ID NO: 3686109 - RNA, 21 nt, Salmonella enterica enterica serovar Typhi Ty2
cagcaaacgccauagcaucga

SEQ ID NO: 3686110 - RNA, 21 nt, Salmonella enterica enterica serovar Typhi Ty2
cagcaaacggcuggauaaccg

SEQ ID NO: 3686111 - RNA, 14 nt, Salmonella enterica enterica serovar Typhi Ty2
cagcaaaucagcua

SEQ ID NO: 3686112 - RNA, 20 nt, Salmonella enterica enterica serovar Typhi Ty2
cagcaaaucgggaaaaugau

SEQ ID NO: 3686113 - RNA, 19 nt, Salmonella enterica enterica serovar Typhi Ty2
cagcaacacuuugcgcugc

SEQ ID NO: 3686114 - RNA, 21 nt, Salmonella enterica enterica serovar Typhi Ty2
cagcaacagugggcuaugaag

SEQ ID NO: 3686115 - RNA, 23 nt, Salmonella enterica enterica serovar Typhi Ty2
cagcaacagugggcuaugaagag

SEQ ID NO: 3686116 - RNA, 17 nt, Salmonella enterica enterica serovar Typhi Ty2
cagcaacaguugcugga

SEQ ID NO: 3686117 - RNA, 17 nt, Salmonella enterica enterica serovar Typhi Ty2
cagcaaccccugagugc

SEQ ID NO: 3686118 - RNA, 17 nt, Salmonella enterica enterica serovar Typhi Ty2
cagcaacgagcuuuuuu

SEQ ID NO: 3686119 - RNA, 13 nt, Salmonella enterica enterica serovar Typhi Ty2
cagcaacgcccag

SEQ ID NO: 3686120 - RNA, 22 nt, Salmonella enterica enterica serovar Typhi Ty2
cagcaacgcgcuaaaugcauag

SEQ ID NO: 3686121 - RNA, 19 nt, Salmonella enterica enterica serovar Typhi Ty2
cagcaacggaagcugacca

SEQ ID NO: 3686122 - RNA, 14 nt, Salmonella enterica enterica serovar Typhi Ty2
cagcaacggcugau

SEQ ID NO: 3686123 - RNA, 22 nt, Salmonella enterica enterica serovar Typhi Ty2
cagcaacgugaacugcgccugc

SEQ ID NO: 3686124 - RNA, 18 nt, Salmonella enterica enterica serovar Typhi Ty2
cagcaacugcgcgcgggu

SEQ ID NO: 3686125 - RNA, 17 nt, Salmonella enterica enterica serovar Typhi Ty2
cagcaaggcugccgcca

SEQ ID NO: 3686126 - RNA, 23 nt, Salmonella enterica enterica serovar Typhi Ty2
cagcaagucgcgggcgcuaaacc

SEQ ID NO: 3686127 - RNA, 14 nt, Salmonella enterica enterica serovar Typhi Ty2
cagcaauaaaagga

SEQ ID NO: 3686128 - RNA, 15 nt, Salmonella enterica enterica serovar Typhi Ty2
cagcaauaaaaggaa

SEQ ID NO: 3686129 - RNA, 22 nt, Salmonella enterica enterica serovar Typhi Ty2
cagcaauaacaccggcggcgcc

SEQ ID NO: 3686130 - RNA, 13 nt, Salmonella enterica enterica serovar Typhi Ty2
cagcaauacgccc

SEQ ID NO: 3686131 - RNA, 20 nt, Salmonella enterica enterica serovar Typhi Ty2
cagcaauaguggacacacaa

SEQ ID NO: 3686132 - RNA, 18 nt, Salmonella enterica enterica serovar Typhi Ty2
cagcaaugagacaacggc

SEQ ID NO: 3686133 - RNA, 15 nt, Salmonella enterica enterica serovar Typhi Ty2
cagcaaugagcaggc

SEQ ID NO: 3686134 - RNA, 13 nt, Salmonella enterica enterica serovar Typhi Ty2
cagcaaugauaac

SEQ ID NO: 3686135 - RNA, 18 nt, Salmonella enterica enterica serovar Typhi Ty2
cagcaaugauuuuuagcc

SEQ ID NO: 3686136 - RNA, 20 nt, Salmonella enterica enterica serovar Typhi Ty2
cagcaauguuaaauucagca

SEQ ID NO: 3686137 - RNA, 21 nt, Salmonella enterica enterica serovar Typhi Ty2
cagcaauuggccaucuucguu

SEQ ID NO: 3686138 - RNA, 22 nt, Salmonella enterica enterica serovar Typhi Ty2
cagcaauuucucgcccgccaga

SEQ ID NO: 3686139 - RNA, 14 nt, Salmonella enterica enterica serovar Typhi Ty2
cagcacaaaauccc

SEQ ID NO: 3686140 - RNA, 14 nt, Salmonella enterica enterica serovar Typhi Ty2
cagcacaaucagcg

SEQ ID NO: 3686141 - RNA, 21 nt, Salmonella enterica enterica serovar Typhi Ty2
cagcacaauuccggcccaggc

SEQ ID NO: 3686142 - RNA, 16 nt, Salmonella enterica enterica serovar Typhi Ty2
cagcacauagaagcuc

SEQ ID NO: 3686143 - RNA, 17 nt, Salmonella enterica enterica serovar Typhi Ty2
cagcacauagccuaaug

SEQ ID NO: 3686144 - RNA, 17 nt, Salmonella enterica enterica serovar Typhi Ty2
cagcacaugauguuuua

SEQ ID NO: 3686145 - RNA, 14 nt, Salmonella enterica enterica serovar Typhi Ty2
cagcacaugcaauu

SEQ ID NO: 3686146 - RNA, 22 nt, Salmonella enterica enterica serovar Typhi Ty2
cagcacauuacaggcaucuucc

SEQ ID NO: 3686147 - RNA, 16 nt, Salmonella enterica enterica serovar Typhi Ty2
cagcacauucagcagc

SEQ ID NO: 3686148 - RNA, 16 nt, Salmonella enterica enterica serovar Typhi Ty2
cagcaccaacgccgcu

SEQ ID NO: 3686149 - RNA, 13 nt, Salmonella enterica enterica serovar Typhi Ty2
cagcaccacgccc

SEQ ID NO: 3686150 - RNA, 12 nt, Salmonella enterica enterica serovar Typhi Ty2
cagcaccagcau

SEQ ID NO: 3686151 - RNA, 17 nt, Salmonella enterica enterica serovar Typhi Ty2
cagcaccaucuuuuccg

SEQ ID NO: 3686152 - RNA, 20 nt, Salmonella enterica enterica serovar Typhi Ty2
cagcacccagcgaauuauga

SEQ ID NO: 3686153 - RNA, 15 nt, Salmonella enterica enterica serovar Typhi Ty2
cagcaccgccgcgau

SEQ ID NO: 3686154 - RNA, 14 nt, Salmonella enterica enterica serovar Typhi Ty2
cagcaccgccggga

SEQ ID NO: 3686155 - RNA, 13 nt, Salmonella enterica enterica serovar Typhi Ty2
cagcauuucuuca

SEQ ID NO: 3686156 - RNA, 17 nt, Salmonella enterica enterica serovar Typhi Ty2
cagcauuugcuguuuua

SEQ ID NO: 3686157 - RNA, 21 nt, Salmonella enterica enterica serovar Typhi Ty2
cagcauuuuucacaguucuac

SEQ ID NO: 3686158 - RNA, 15 nt, Salmonella enterica enterica serovar Typhi Ty2
cagccaaaacgucgu

SEQ ID NO: 3686159 - RNA, 17 nt, Salmonella enterica enterica serovar Typhi Ty2
cagccaaaauaugcugg

SEQ ID NO: 3686160 - RNA, 19 nt, Salmonella enterica enterica serovar Typhi Ty2
cagccaaacuccucacugc

SEQ ID NO: 3686161 - RNA, 13 nt, Salmonella enterica enterica serovar Typhi Ty2
cagccaaacugcu

SEQ ID NO: 3686162 - RNA, 15 nt, Salmonella enterica enterica serovar Typhi Ty2
cagccaaacugcugu

SEQ ID NO: 3686163 - RNA, 18 nt, Salmonella enterica enterica serovar Typhi Ty2
cagccaaacugcuguagc

SEQ ID NO: 3686164 - RNA, 23 nt, Salmonella enterica enterica serovar Typhi Ty2
cagccaaagcgagguaaaaagcg

SEQ ID NO: 3686165 - RNA, 15 nt, Salmonella enterica enterica serovar Typhi Ty2
cagccaaauagcgcc

SEQ ID NO: 3686166 - RNA, 18 nt, Salmonella enterica enterica serovar Typhi Ty2
cagccaaauagcgccaga

SEQ ID NO: 3686167 - RNA, 21 nt, Salmonella enterica enterica serovar Typhi Ty2
cagccaaauaggcgaggaaaa

SEQ ID NO: 3686168 - RNA, 16 nt, Salmonella enterica enterica serovar Typhi Ty2
cagccaacaaagaggc

SEQ ID NO: 3686169 - RNA, 17 nt, Salmonella enterica enterica serovar Typhi Ty2
cagccaacaacaggccg

SEQ ID NO: 3686170 - RNA, 14 nt, Salmonella enterica enterica serovar Typhi Ty2
cagccaaucauaaa

SEQ ID NO: 3686171 - RNA, 21 nt, Salmonella enterica enterica serovar Typhi Ty2
cagccaaucauaaacgccuga

SEQ ID NO: 3686172 - RNA, 22 nt, Salmonella enterica enterica serovar Typhi Ty2
cagccaaucauaaacgccugac

SEQ ID NO: 3686173 - RNA, 20 nt, Salmonella enterica enterica serovar Typhi Ty2
cagccacacacuguuuaaug

SEQ ID NO: 3686174 - RNA, 15 nt, Salmonella enterica enterica serovar Typhi Ty2
cagccacacugcugu

SEQ ID NO: 3686175 - RNA, 19 nt, Salmonella enterica enterica serovar Typhi Ty2
cagccacauuguaugcaag

SEQ ID NO: 3686176 - RNA, 16 nt, Salmonella enterica enterica serovar Typhi Ty2
cagccacggcaacgcc

SEQ ID NO: 3686177 - RNA, 16 nt, Salmonella enterica enterica serovar Typhi Ty2
cagccacguugcgcgc

SEQ ID NO: 3686178 - RNA, 14 nt, Salmonella enterica enterica serovar Typhi Ty2
cagccacucccgau

SEQ ID NO: 3686179 - RNA, 23 nt, Salmonella enterica enterica serovar Typhi Ty2
cagccacugacuuuccugguaau

SEQ ID NO: 3686180 - RNA, 16 nt, Salmonella enterica enterica serovar Typhi Ty2
cagccacugcgccauu

SEQ ID NO: 3686181 - RNA, 15 nt, Salmonella enterica enterica serovar Typhi Ty2
cagccacuucuucca

SEQ ID NO: 3686182 - RNA, 13 nt, Salmonella enterica enterica serovar Typhi Ty2
cagccagaaaaag

SEQ ID NO: 3686183 - RNA, 16 nt, Salmonella enterica enterica serovar Typhi Ty2
cagccagaacucaucu

SEQ ID NO: 3686184 - RNA, 19 nt, Salmonella enterica enterica serovar Typhi Ty2
cagccagacgccagccacu

SEQ ID NO: 3686185 - RNA, 16 nt, Salmonella enterica enterica serovar Typhi Ty2
cagccagacggcgccc

SEQ ID NO: 3686186 - RNA, 17 nt, Salmonella enterica enterica serovar Typhi Ty2
cagccagacggcgccca

SEQ ID NO: 3686187 - RNA, 12 nt, Salmonella enterica enterica serovar Typhi Ty2
cagccagcagcu

SEQ ID NO: 3686188 - RNA, 17 nt, Salmonella enterica enterica serovar Typhi Ty2
cagccagcagcucaacg

SEQ ID NO: 3686189 - RNA, 16 nt, Salmonella enterica enterica serovar Typhi Ty2
cagccagcgccccugc

SEQ ID NO: 3686190 - RNA, 11 nt, Salmonella enterica enterica serovar Typhi Ty2
cagccagcggg

SEQ ID NO: 3686191 - RNA, 20 nt, Salmonella enterica enterica serovar Typhi Ty2
cagccagcguuucuggaagu

SEQ ID NO: 3686192 - RNA, 17 nt, Salmonella enterica enterica serovar Typhi Ty2
cagccagcucaccagcc

SEQ ID NO: 3686193 - RNA, 12 nt, Salmonella enterica enterica serovar Typhi Ty2
cagccaggaaug

SEQ ID NO: 3686194 - RNA, 17 nt, Salmonella enterica enterica serovar Typhi Ty2
cagccaggcaaaacagu

SEQ ID NO: 3686195 - RNA, 18 nt, Salmonella enterica enterica serovar Typhi Ty2
cagccaggcaaagcccca

SEQ ID NO: 3686196 - RNA, 11 nt, Salmonella enterica enterica serovar Typhi Ty2
cagccaggcca

SEQ ID NO: 3686197 - RNA, 16 nt, Salmonella enterica enterica serovar Typhi Ty2
cagccaggccagcgcu

SEQ ID NO: 3686198 - RNA, 18 nt, Salmonella enterica enterica serovar Typhi Ty2
cagccaggccgccagcgu

SEQ ID NO: 3686199 - RNA, 23 nt, Salmonella enterica enterica serovar Typhi Ty2
cagccagggaucaagcaaugcca

SEQ ID NO: 3686200 - RNA, 21 nt, Salmonella enterica enterica serovar Typhi Ty2
cagccagguauuuagccacgc

SEQ ID NO: 3686201 - RNA, 17 nt, Salmonella enterica enterica serovar Typhi Ty2
cagccagguugccagaa

SEQ ID NO: 3686202 - RNA, 12 nt, Salmonella enterica enterica serovar Typhi Ty2
cagccaguccuc

SEQ ID NO: 3686203 - RNA, 21 nt, Salmonella enterica enterica serovar Typhi Ty2
cagccaguuagcgaucgcgcc

SEQ ID NO: 3686204 - RNA, 23 nt, Salmonella enterica enterica serovar Typhi Ty2
cagccaguuggcuucagcaaacg

SEQ ID NO: 3686205 - RNA, 15 nt, Salmonella enterica enterica serovar Typhi Ty2
cagccauaaauauug

SEQ ID NO: 3686206 - RNA, 18 nt, Salmonella enterica enterica serovar Typhi Ty2
cagccauaaucaguacug

SEQ ID NO: 3686207 - RNA, 23 nt, Salmonella enterica enterica serovar Typhi Ty2
cagccauaaucaguacugcgccc

SEQ ID NO: 3686208 - RNA, 14 nt, Salmonella enterica enterica serovar Typhi Ty2
cagccauagcagca

SEQ ID NO: 3686209 - RNA, 15 nt, Salmonella enterica enterica serovar Typhi Ty2
cagccauagcccacu

SEQ ID NO: 3686210 - RNA, 22 nt, Salmonella enterica enterica serovar Typhi Ty2
cagccauagcgcgccgcuccag

SEQ ID NO: 3686211 - RNA, 16 nt, Salmonella enterica enterica serovar Typhi Ty2
cagccauauuuaugca

SEQ ID NO: 3686212 - RNA, 15 nt, Salmonella enterica enterica serovar Typhi Ty2
cagccauccccauau

SEQ ID NO: 3686213 - RNA, 13 nt, Salmonella enterica enterica serovar Typhi Ty2
cagccauccgacg

SEQ ID NO: 3686214 - RNA, 13 nt, Salmonella enterica enterica serovar Typhi Ty2
cagccaugccagc

SEQ ID NO: 3686215 - RNA, 22 nt, Salmonella enterica enterica serovar Typhi Ty2
cagccaugccauauggccgucg

SEQ ID NO: 3686216 - RNA, 22 nt, Salmonella enterica enterica serovar Typhi Ty2
cagccauggcccaaaagguagc

SEQ ID NO: 3686217 - RNA, 13 nt, Salmonella enterica enterica serovar Typhi Ty2
cagccauggcccu

SEQ ID NO: 3686218 - RNA, 20 nt, Salmonella enterica enterica serovar Typhi Ty2
cagccauguagaauagcgcc

SEQ ID NO: 3686219 - RNA, 14 nt, Salmonella enterica enterica serovar Typhi Ty2
cagccauucaccac

SEQ ID NO: 3686220 - RNA, 17 nt, Salmonella enterica enterica serovar Typhi Ty2
cagccauucaccacugg

SEQ ID NO: 3686221 - RNA, 22 nt, Salmonella enterica enterica serovar Typhi Ty2
cagcccagguagaaucccacca

SEQ ID NO: 3686222 - RNA, 16 nt, Salmonella enterica enterica serovar Typhi Ty2
cagcccagguuaccaa

SEQ ID NO: 3686223 - RNA, 20 nt, Salmonella enterica enterica serovar Typhi Ty2
cagcccaucggucgcgcgca

SEQ ID NO: 3686224 - RNA, 12 nt, Salmonella enterica enterica serovar Typhi Ty2
cagcccaugaag

SEQ ID NO: 3686225 - RNA, 22 nt, Salmonella enterica enterica serovar Typhi Ty2
cagcccaugaaggagcaaugag

SEQ ID NO: 3686226 - RNA, 16 nt, Salmonella enterica enterica serovar Typhi Ty2
cagccccacauuggaa

SEQ ID NO: 3686227 - RNA, 22 nt, Salmonella enterica enterica serovar Typhi Ty2
cagccccagcaccaacgccgcu

SEQ ID NO: 3686228 - RNA, 13 nt, Salmonella enterica enterica serovar Typhi Ty2
cagccccagcgcc

SEQ ID NO: 3686229 - RNA, 17 nt, Salmonella enterica enterica serovar Typhi Ty2
cagccccagcgccagcc

SEQ ID NO: 3686230 - RNA, 22 nt, Salmonella enterica enterica serovar Typhi Ty2
cagcccccaguuuuugaacaua

SEQ ID NO: 3686231 - RNA, 16 nt, Salmonella enterica enterica serovar Typhi Ty2
cagccccuucgcuguc

SEQ ID NO: 3686232 - RNA, 17 nt, Salmonella enterica enterica serovar Typhi Ty2
cagcccgauacccgccc

SEQ ID NO: 3686233 - RNA, 16 nt, Salmonella enterica enterica serovar Typhi Ty2
cagcccgaucggcugg

SEQ ID NO: 3686234 - RNA, 22 nt, Salmonella enterica enterica serovar Typhi Ty2
cagcccgaucggcuggcauuuu

SEQ ID NO: 3686235 - RNA, 13 nt, Salmonella enterica enterica serovar Typhi Ty2
cagcccgccagca

SEQ ID NO: 3686236 - RNA, 14 nt, Salmonella enterica enterica serovar Typhi Ty2
cagcccgccagcac

SEQ ID NO: 3686237 - RNA, 16 nt, Salmonella enterica enterica serovar Typhi Ty2
cagcgauuacgccaga

SEQ ID NO: 3686238 - RNA, 17 nt, Salmonella enterica enterica serovar Typhi Ty2
cagcgauuuuuacgcca

SEQ ID NO: 3686239 - RNA, 21 nt, Salmonella enterica enterica serovar Typhi Ty2
cagcgauuuuuacgccauuca

SEQ ID NO: 3686240 - RNA, 12 nt, Salmonella enterica enterica serovar Typhi Ty2
cagcgcaacgcc

SEQ ID NO: 3686241 - RNA, 14 nt, Salmonella enterica enterica serovar Typhi Ty2
cagcgcaacgcgca

SEQ ID NO: 3686242 - RNA, 17 nt, Salmonella enterica enterica serovar Typhi Ty2
cagcgcagaauuuauuu

SEQ ID NO: 3686243 - RNA, 20 nt, Salmonella enterica enterica serovar Typhi Ty2
cagcgcauacuuauacagcg

SEQ ID NO: 3686244 - RNA, 19 nt, Salmonella enterica enterica serovar Typhi Ty2
cagcgcauagcugcccugu

SEQ ID NO: 3686245 - RNA, 14 nt, Salmonella enterica enterica serovar Typhi Ty2
cagcgcauggaaga

SEQ ID NO: 3686246 - RNA, 14 nt, Salmonella enterica enterica serovar Typhi Ty2
cagcgcauugccuu

SEQ ID NO: 3686247 - RNA, 21 nt, Salmonella enterica enterica serovar Typhi Ty2
cagcgccaacgccacugccau

SEQ ID NO: 3686248 - RNA, 16 nt, Salmonella enterica enterica serovar Typhi Ty2
cagcgccaccacaaac

SEQ ID NO: 3686249 - RNA, 21 nt, Salmonella enterica enterica serovar Typhi Ty2
cagcgccaccacaaacgccgu

SEQ ID NO: 3686250 - RNA, 12 nt, Salmonella enterica enterica serovar Typhi Ty2
cagcgccaccgg

SEQ ID NO: 3686251 - RNA, 23 nt, Salmonella enterica enterica serovar Typhi Ty2
cagcgccagaauagacgccaugu

SEQ ID NO: 3686252 - RNA, 14 nt, Salmonella enterica enterica serovar Typhi Ty2
cagcgccagauagu

SEQ ID NO: 3686253 - RNA, 13 nt, Salmonella enterica enterica serovar Typhi Ty2
cagcgccagcccu

SEQ ID NO: 3686254 - RNA, 14 nt, Salmonella enterica enterica serovar Typhi Ty2
cagcgccagcccug

SEQ ID NO: 3686255 - RNA, 15 nt, Salmonella enterica enterica serovar Typhi Ty2
cagcgccagcccugc

SEQ ID NO: 3686256 - RNA, 16 nt, Salmonella enterica enterica serovar Typhi Ty2
cagcgccagcccugcg

SEQ ID NO: 3686257 - RNA, 14 nt, Salmonella enterica enterica serovar Typhi Ty2
cagcgccagcgcca

SEQ ID NO: 3686258 - RNA, 16 nt, Salmonella enterica enterica serovar Typhi Ty2
cagcgccagcggcugc

SEQ ID NO: 3686259 - RNA, 19 nt, Salmonella enterica enterica serovar Typhi Ty2
cagcgccagcggcugcucc

SEQ ID NO: 3686260 - RNA, 21 nt, Salmonella enterica enterica serovar Typhi Ty2
cagcgccagcugcgucauguc

SEQ ID NO: 3686261 - RNA, 18 nt, Salmonella enterica enterica serovar Typhi Ty2
cagcgccaguuuuucccg

SEQ ID NO: 3686262 - RNA, 22 nt, Salmonella enterica enterica serovar Typhi Ty2
cagcgccauaaucgcuuuuucc

SEQ ID NO: 3686263 - RNA, 15 nt, Salmonella enterica enterica serovar Typhi Ty2
cagcgccaucaggaa

SEQ ID NO: 3686264 - RNA, 15 nt, Salmonella enterica enterica serovar Typhi Ty2
cagcgccaucaggca

SEQ ID NO: 3686265 - RNA, 18 nt, Salmonella enterica enterica serovar Typhi Ty2
cagcgccaucaggcaaug

SEQ ID NO: 3686266 - RNA, 17 nt, Salmonella enterica enterica serovar Typhi Ty2
cagcgccaucaggcccc

SEQ ID NO: 3686267 - RNA, 23 nt, Salmonella enterica enterica serovar Typhi Ty2
cagcgccauccacggccccgggc

SEQ ID NO: 3686268 - RNA, 14 nt, Salmonella enterica enterica serovar Typhi Ty2
cagcgccauccggc

SEQ ID NO: 3686269 - RNA, 17 nt, Salmonella enterica enterica serovar Typhi Ty2
cagcgccauccggcaaa

SEQ ID NO: 3686270 - RNA, 21 nt, Salmonella enterica enterica serovar Typhi Ty2
cagcgccauuaacgccaugac

SEQ ID NO: 3686271 - RNA, 14 nt, Salmonella enterica enterica serovar Typhi Ty2
cagcgccgccagaa

SEQ ID NO: 3686272 - RNA, 11 nt, Salmonella enterica enterica serovar Typhi Ty2
cagcgccgccu

SEQ ID NO: 3686273 - RNA, 13 nt, Salmonella enterica enterica serovar Typhi Ty2
cagcgccgccugu

SEQ ID NO: 3686274 - RNA, 16 nt, Salmonella enterica enterica serovar Typhi Ty2
cagcgccgcgggcugg

SEQ ID NO: 3686275 - RNA, 13 nt, Salmonella enterica enterica serovar Typhi Ty2
cagcgccggaaaa

SEQ ID NO: 3686276 - RNA, 20 nt, Salmonella enterica enterica serovar Typhi Ty2
cagcgccggauaauccagac

SEQ ID NO: 3686277 - RNA, 13 nt, Salmonella enterica enterica serovar Typhi Ty2
cagcgccggcagc

SEQ ID NO: 3686278 - RNA, 14 nt, Salmonella enterica enterica serovar Typhi Ty2
cagcgccggcagca

SEQ ID NO: 3686279 - RNA, 15 nt, Salmonella enterica enterica serovar Typhi Ty2
cagcgccggcagcag

SEQ ID NO: 3686280 - RNA, 18 nt, Salmonella enterica enterica serovar Typhi Ty2
cagcgccgucgccaucac

SEQ ID NO: 3686281 - RNA, 14 nt, Salmonella enterica enterica serovar Typhi Ty2
cagcgcgaacaggc

SEQ ID NO: 3686282 - RNA, 17 nt, Salmonella enterica enterica serovar Typhi Ty2
cagcgcgaccagcguga

SEQ ID NO: 3686283 - RNA, 16 nt, Salmonella enterica enterica serovar Typhi Ty2
cagcgcgaccaggaaa

SEQ ID NO: 3686284 - RNA, 14 nt, Salmonella enterica enterica serovar Typhi Ty2
cagcgcgaccugca

SEQ ID NO: 3686285 - RNA, 22 nt, Salmonella enterica enterica serovar Typhi Ty2
cagcgcgaccugcaucccuuuc

SEQ ID NO: 3686286 - RNA, 20 nt, Salmonella enterica enterica serovar Typhi Ty2
cagcgcgauacgcagcaccg

SEQ ID NO: 3686287 - RNA, 19 nt, Salmonella enterica enterica serovar Typhi Ty2
cagcgcgccaaaguuaauc

SEQ ID NO: 3686288 - RNA, 19 nt, Salmonella enterica enterica serovar Typhi Ty2
cagcgcgcccgccaccagc

SEQ ID NO: 3686289 - RNA, 12 nt, Salmonella enterica enterica serovar Typhi Ty2
cagcgcgccgca

SEQ ID NO: 3686290 - RNA, 18 nt, Salmonella enterica enterica serovar Typhi Ty2
cagcgcgccgccaacgcc

SEQ ID NO: 3686291 - RNA, 13 nt, Salmonella enterica enterica serovar Typhi Ty2
cagcgcgccgccc

SEQ ID NO: 3686292 - RNA, 12 nt, Salmonella enterica enterica serovar Typhi Ty2
cagcgcgccgcg

SEQ ID NO: 3686293 - RNA, 17 nt, Salmonella enterica enterica serovar Typhi Ty2
cagcgcgcgcgacggca

SEQ ID NO: 3686294 - RNA, 12 nt, Salmonella enterica enterica serovar Typhi Ty2
cagcgcgcggcu

SEQ ID NO: 3686295 - RNA, 13 nt, Salmonella enterica enterica serovar Typhi Ty2
cagcgcgcguaac

SEQ ID NO: 3686296 - RNA, 14 nt, Salmonella enterica enterica serovar Typhi Ty2
cagcgcggcaagga

SEQ ID NO: 3686297 - RNA, 15 nt, Salmonella enterica enterica serovar Typhi Ty2
cagcgcggcacacag

SEQ ID NO: 3686298 - RNA, 19 nt, Salmonella enterica enterica serovar Typhi Ty2
cagcgcggcguacacuuca

SEQ ID NO: 3686299 - RNA, 17 nt, Salmonella enterica enterica serovar Typhi Ty2
cagcgcgguuucuacac

SEQ ID NO: 3686300 - RNA, 18 nt, Salmonella enterica enterica serovar Typhi Ty2
cagcgcguccaauagccc

SEQ ID NO: 3686301 - RNA, 12 nt, Salmonella enterica enterica serovar Typhi Ty2
cagcgcguccuu

SEQ ID NO: 3686302 - RNA, 16 nt, Salmonella enterica enterica serovar Typhi Ty2
cagcgcgucgaccaua

SEQ ID NO: 3686303 - RNA, 20 nt, Salmonella enterica enterica serovar Typhi Ty2
cagcgcuaccagcgcggcgc

SEQ ID NO: 3686304 - RNA, 22 nt, Salmonella enterica enterica serovar Typhi Ty2
cagcgcuaccagcgcggcgcca

SEQ ID NO: 3686305 - RNA, 17 nt, Salmonella enterica enterica serovar Typhi Ty2
cagcgcuaucaggaaga

SEQ ID NO: 3686306 - RNA, 14 nt, Salmonella enterica enterica serovar Typhi Ty2
cagcgcuaucaggc

SEQ ID NO: 3686307 - RNA, 18 nt, Salmonella enterica enterica serovar Typhi Ty2
cagcgcuaucaggcacug

SEQ ID NO: 3686308 - RNA, 20 nt, Salmonella enterica enterica serovar Typhi Ty2
cagcgcuaucaggcacugaa

SEQ ID NO: 3686309 - RNA, 23 nt, Salmonella enterica enterica serovar Typhi Ty2
cagcgcuccaccaaccaggcaaa

SEQ ID NO: 3686310 - RNA, 15 nt, Salmonella enterica enterica serovar Typhi Ty2
cagcgcuccgacaaa

SEQ ID NO: 3686311 - RNA, 23 nt, Salmonella enterica enterica serovar Typhi Ty2
cagcgcuccgggguucuuuuuaa

SEQ ID NO: 3686312 - RNA, 16 nt, Salmonella enterica enterica serovar Typhi Ty2
cagcgcucugcaaugu

SEQ ID NO: 3686313 - RNA, 17 nt, Salmonella enterica enterica serovar Typhi Ty2
cagcgcugaaucgcaau

SEQ ID NO: 3686314 - RNA, 22 nt, Salmonella enterica enterica serovar Typhi Ty2
cagcgcugagucauccuucccc

SEQ ID NO: 3686315 - RNA, 21 nt, Salmonella enterica enterica serovar Typhi Ty2
cagcgcugcauuugcugccgu

SEQ ID NO: 3686316 - RNA, 23 nt, Salmonella enterica enterica serovar Typhi Ty2
cagcgcugcuguaacagacgcag

SEQ ID NO: 3686317 - RNA, 18 nt, Salmonella enterica enterica serovar Typhi Ty2
cagcgcugucagugaaaa

SEQ ID NO: 3686318 - RNA, 23 nt, Salmonella enterica enterica serovar Typhi Ty2
cagcgcuucucuuuccaguuggc

SEQ ID NO: 3686319 - RNA, 17 nt, Salmonella enterica enterica serovar Typhi Ty2
cagcuggaaugcccacu

SEQ ID NO: 3686320 - RNA, 15 nt, Salmonella enterica enterica serovar Typhi Ty2
cagcugggccugcuc

SEQ ID NO: 3686321 - RNA, 17 nt, Salmonella enterica enterica serovar Typhi Ty2
cagcugggccugcuccg

SEQ ID NO: 3686322 - RNA, 16 nt, Salmonella enterica enterica serovar Typhi Ty2
cagcugggucgcgcuu

SEQ ID NO: 3686323 - RNA, 16 nt, Salmonella enterica enterica serovar Typhi Ty2
cagcugguauaggcca

SEQ ID NO: 3686324 - RNA, 11 nt, Salmonella enterica enterica serovar Typhi Ty2
cagcuggugcg

SEQ ID NO: 3686325 - RNA, 17 nt, Salmonella enterica enterica serovar Typhi Ty2
cagcugguuaaccaccu

SEQ ID NO: 3686326 - RNA, 22 nt, Salmonella enterica enterica serovar Typhi Ty2
cagcugguuaaccaccucauua

SEQ ID NO: 3686327 - RNA, 16 nt, Salmonella enterica enterica serovar Typhi Ty2
cagcuguuuaagcgcc

SEQ ID NO: 3686328 - RNA, 19 nt, Salmonella enterica enterica serovar Typhi Ty2
cagcuguuuaagcgccucc

SEQ ID NO: 3686329 - RNA, 20 nt, Salmonella enterica enterica serovar Typhi Ty2
cagcuguuuaagcgccucca

SEQ ID NO: 3686330 - RNA, 18 nt, Salmonella enterica enterica serovar Typhi Ty2
cagcuuaaaucgcggcgc

SEQ ID NO: 3686331 - RNA, 15 nt, Salmonella enterica enterica serovar Typhi Ty2
cagcuuacgcgcaga

SEQ ID NO: 3686332 - RNA, 13 nt, Salmonella enterica enterica serovar Typhi Ty2
cagcuuaucugac

SEQ ID NO: 3686333 - RNA, 17 nt, Salmonella enterica enterica serovar Typhi Ty2
cagcuuaucugaccaug

SEQ ID NO: 3686334 - RNA, 20 nt, Salmonella enterica enterica serovar Typhi Ty2
cagcuuaucuuuacgcuugu

SEQ ID NO: 3686335 - RNA, 18 nt, Salmonella enterica enterica serovar Typhi Ty2
cagcuucagcaucaucuc

SEQ ID NO: 3686336 - RNA, 20 nt, Salmonella enterica enterica serovar Typhi Ty2
cagcuucagcaucaucuccc

SEQ ID NO: 3686337 - RNA, 22 nt, Salmonella enterica enterica serovar Typhi Ty2
cagcuucaggcucaucagcgcc

SEQ ID NO: 3686338 - RNA, 17 nt, Salmonella enterica enterica serovar Typhi Ty2
cagcuucaucaccgcau

SEQ ID NO: 3686339 - RNA, 15 nt, Salmonella enterica enterica serovar Typhi Ty2
cagcuucgccccggc

SEQ ID NO: 3686340 - RNA, 17 nt, Salmonella enterica enterica serovar Typhi Ty2
cagcuugcuggccgcgu

SEQ ID NO: 3686341 - RNA, 14 nt, Salmonella enterica enterica serovar Typhi Ty2
cagcuuggcggcuu

SEQ ID NO: 3686342 - RNA, 18 nt, Salmonella enterica enterica serovar Typhi Ty2
cagcuuguuuacgcccuc

SEQ ID NO: 3686343 - RNA, 19 nt, Salmonella enterica enterica serovar Typhi Ty2
cagcuuuaaugcuuuccag

SEQ ID NO: 3686344 - RNA, 13 nt, Salmonella enterica enterica serovar Typhi Ty2
cagcuuugcggcc

SEQ ID NO: 3686345 - RNA, 17 nt, Salmonella enterica enterica serovar Typhi Ty2
caggaaaaacugucccu

SEQ ID NO: 3686346 - RNA, 14 nt, Salmonella enterica enterica serovar Typhi Ty2
caggaaaagaccau

SEQ ID NO: 3686347 - RNA, 17 nt, Salmonella enterica enterica serovar Typhi Ty2
caggaaagagccgcgca

SEQ ID NO: 3686348 - RNA, 22 nt, Salmonella enterica enterica serovar Typhi Ty2
caggaaagagccgcgcagcgca

SEQ ID NO: 3686349 - RNA, 21 nt, Salmonella enterica enterica serovar Typhi Ty2
caggaaauccagcagaauaac

SEQ ID NO: 3686350 - RNA, 17 nt, Salmonella enterica enterica serovar Typhi Ty2
caggaaaucuuccaguu

SEQ ID NO: 3686351 - RNA, 14 nt, Salmonella enterica enterica serovar Typhi Ty2
caggaacagauacu

SEQ ID NO: 3686352 - RNA, 20 nt, Salmonella enterica enterica serovar Typhi Ty2
caggaacagauacuggaagu

SEQ ID NO: 3686353 - RNA, 12 nt, Salmonella enterica enterica serovar Typhi Ty2
caggaacgccau

SEQ ID NO: 3686354 - RNA, 17 nt, Salmonella enterica enterica serovar Typhi Ty2
caggaacgcggcgccga

SEQ ID NO: 3686355 - RNA, 14 nt, Salmonella enterica enterica serovar Typhi Ty2
caggaacugacuga

SEQ ID NO: 3686356 - RNA, 14 nt, Salmonella enterica enterica serovar Typhi Ty2
caggaaggcgugca

SEQ ID NO: 3686357 - RNA, 15 nt, Salmonella enterica enterica serovar Typhi Ty2
caggaaggcgugcag

SEQ ID NO: 3686358 - RNA, 20 nt, Salmonella enterica enterica serovar Typhi Ty2
caggaaggcgugcagcgugc

SEQ ID NO: 3686359 - RNA, 15 nt, Salmonella enterica enterica serovar Typhi Ty2
caggaauaaagguca

SEQ ID NO: 3686360 - RNA, 21 nt, Salmonella enterica enterica serovar Typhi Ty2
caggaauaacaucguaaauca

SEQ ID NO: 3686361 - RNA, 23 nt, Salmonella enterica enterica serovar Typhi Ty2
caggaauaaccacugauggcugg

SEQ ID NO: 3686362 - RNA, 15 nt, Salmonella enterica enterica serovar Typhi Ty2
caggaaugccacgau

SEQ ID NO: 3686363 - RNA, 19 nt, Salmonella enterica enterica serovar Typhi Ty2
caggaauuccaguccuuuc

SEQ ID NO: 3686364 - RNA, 19 nt, Salmonella enterica enterica serovar Typhi Ty2
caggacagaugucccgccu

SEQ ID NO: 3686365 - RNA, 15 nt, Salmonella enterica enterica serovar Typhi Ty2
caggacgcacccugu

SEQ ID NO: 3686366 - RNA, 19 nt, Salmonella enterica enterica serovar Typhi Ty2
caggacgcacccuguucau

SEQ ID NO: 3686367 - RNA, 20 nt, Salmonella enterica enterica serovar Typhi Ty2
caggacgcacccuguucauc

SEQ ID NO: 3686368 - RNA, 18 nt, Salmonella enterica enterica serovar Typhi Ty2
caggacgccagcgcggca

SEQ ID NO: 3686369 - RNA, 15 nt, Salmonella enterica enterica serovar Typhi Ty2
caggacgccagugaa

SEQ ID NO: 3686370 - RNA, 17 nt, Salmonella enterica enterica serovar Typhi Ty2
caggacuaacgccgguc

SEQ ID NO: 3686371 - RNA, 13 nt, Salmonella enterica enterica serovar Typhi Ty2
caggacugacugc

SEQ ID NO: 3686372 - RNA, 18 nt, Salmonella enterica enterica serovar Typhi Ty2
caggagaucggcgcaggu

SEQ ID NO: 3686373 - RNA, 18 nt, Salmonella enterica enterica serovar Typhi Ty2
caggagcaaaccgaccca

SEQ ID NO: 3686374 - RNA, 14 nt, Salmonella enterica enterica serovar Typhi Ty2
caggagcauagaua

SEQ ID NO: 3686375 - RNA, 19 nt, Salmonella enterica enterica serovar Typhi Ty2
caggagcauuggaaauuca

SEQ ID NO: 3686376 - RNA, 21 nt, Salmonella enterica enterica serovar Typhi Ty2
caggagccaguuuucgacaua

SEQ ID NO: 3686377 - RNA, 18 nt, Salmonella enterica enterica serovar Typhi Ty2
caggagcggguagagcuu

SEQ ID NO: 3686378 - RNA, 16 nt, Salmonella enterica enterica serovar Typhi Ty2
caggauaaaauccugc

SEQ ID NO: 3686379 - RNA, 17 nt, Salmonella enterica enterica serovar Typhi Ty2
caggauaaaauccugca

SEQ ID NO: 3686380 - RNA, 12 nt, Salmonella enterica enterica serovar Typhi Ty2
caggauaaagac

SEQ ID NO: 3686381 - RNA, 19 nt, Salmonella enterica enterica serovar Typhi Ty2
caggauaaagaccggcaca

SEQ ID NO: 3686382 - RNA, 22 nt, Salmonella enterica enterica serovar Typhi Ty2
caggauaauaaugaucgcuuua

SEQ ID NO: 3686383 - RNA, 15 nt, Salmonella enterica enterica serovar Typhi Ty2
caggauacagccgac

SEQ ID NO: 3686384 - RNA, 18 nt, Salmonella enterica enterica serovar Typhi Ty2
caggauauacuucaucag

SEQ ID NO: 3686385 - RNA, 22 nt, Salmonella enterica enterica serovar Typhi Ty2
caggauauuuugcucauauugu

SEQ ID NO: 3686386 - RNA, 21 nt, Salmonella enterica enterica serovar Typhi Ty2
caggaucaaaaucgcgcccca

SEQ ID NO: 3686387 - RNA, 15 nt, Salmonella enterica enterica serovar Typhi Ty2
caggaucggaagcga

SEQ ID NO: 3686388 - RNA, 20 nt, Salmonella enterica enterica serovar Typhi Ty2
caggaucgggaucagcgcgc

SEQ ID NO: 3686389 - RNA, 13 nt, Salmonella enterica enterica serovar Typhi Ty2
caggaucgguaaa

SEQ ID NO: 3686390 - RNA, 13 nt, Salmonella enterica enterica serovar Typhi Ty2
caggaucuucauc

SEQ ID NO: 3686391 - RNA, 14 nt, Salmonella enterica enterica serovar Typhi Ty2
caggaucuucaucc

SEQ ID NO: 3686392 - RNA, 17 nt, Salmonella enterica enterica serovar Typhi Ty2
caggaucuucaucccau

SEQ ID NO: 3686393 - RNA, 13 nt, Salmonella enterica enterica serovar Typhi Ty2
caggaucuuuuuc

SEQ ID NO: 3686394 - RNA, 15 nt, Salmonella enterica enterica serovar Typhi Ty2
caggaugccaaccac

SEQ ID NO: 3686395 - RNA, 21 nt, Salmonella enterica enterica serovar Typhi Ty2
caggaugccaaccaccgcgga

SEQ ID NO: 3686396 - RNA, 19 nt, Salmonella enterica enterica serovar Typhi Ty2
caggaugcuuuuuauaaag

SEQ ID NO: 3686397 - RNA, 23 nt, Salmonella enterica enterica serovar Typhi Ty2
caggauguccugcggacgcagcu

SEQ ID NO: 3686398 - RNA, 17 nt, Salmonella enterica enterica serovar Typhi Ty2
caggauucgaaccugcg

SEQ ID NO: 3686399 - RNA, 22 nt, Salmonella enterica enterica serovar Typhi Ty2
caggauugcugugaaguaauuc

SEQ ID NO: 3686400 - RNA, 18 nt, Salmonella enterica enterica serovar Typhi Ty2
caggauuuacugagcgcc

SEQ ID NO: 3686401 - RNA, 19 nt, Salmonella enterica enterica serovar Typhi Ty2
caggcggguagucccagga

SEQ ID NO: 3686402 - RNA, 22 nt, Salmonella enterica enterica serovar Typhi Ty2
caggcggguagucccaggauag

SEQ ID NO: 3686403 - RNA, 14 nt, Salmonella enterica enterica serovar Typhi Ty2
caggcgggugcgca

SEQ ID NO: 3686404 - RNA, 19 nt, Salmonella enterica enterica serovar Typhi Ty2
caggcgggugcgcagcccc

SEQ ID NO: 3686405 - RNA, 22 nt, Salmonella enterica enterica serovar Typhi Ty2
caggcgggugcgcagccccagc

SEQ ID NO: 3686406 - RNA, 16 nt, Salmonella enterica enterica serovar Typhi Ty2
caggcggguggugagc

SEQ ID NO: 3686407 - RNA, 18 nt, Salmonella enterica enterica serovar Typhi Ty2
caggcgguauuucauaau

SEQ ID NO: 3686408 - RNA, 15 nt, Salmonella enterica enterica serovar Typhi Ty2
caggcggucagggug

SEQ ID NO: 3686409 - RNA, 13 nt, Salmonella enterica enterica serovar Typhi Ty2
caggcggucaucg

SEQ ID NO: 3686410 - RNA, 18 nt, Salmonella enterica enterica serovar Typhi Ty2
caggcguaagaucccagg

SEQ ID NO: 3686411 - RNA, 17 nt, Salmonella enterica enterica serovar Typhi Ty2
caggcgucaaaacaggu

SEQ ID NO: 3686412 - RNA, 21 nt, Salmonella enterica enterica serovar Typhi Ty2
caggcgucaaaacaggucugu

SEQ ID NO: 3686413 - RNA, 19 nt, Salmonella enterica enterica serovar Typhi Ty2
caggcgucauagccgcgcg

SEQ ID NO: 3686414 - RNA, 22 nt, Salmonella enterica enterica serovar Typhi Ty2
caggcgucauagccgcgcguca

SEQ ID NO: 3686415 - RNA, 17 nt, Salmonella enterica enterica serovar Typhi Ty2
caggcguguggccaggg

SEQ ID NO: 3686416 - RNA, 16 nt, Salmonella enterica enterica serovar Typhi Ty2
caggcguuacgcgcca

SEQ ID NO: 3686417 - RNA, 22 nt, Salmonella enterica enterica serovar Typhi Ty2
caggcguugaccgcuucgccuu

SEQ ID NO: 3686418 - RNA, 18 nt, Salmonella enterica enterica serovar Typhi Ty2
caggcuaaauggcauagc

SEQ ID NO: 3686419 - RNA, 15 nt, Salmonella enterica enterica serovar Typhi Ty2
caggcucaccagccc

SEQ ID NO: 3686420 - RNA, 14 nt, Salmonella enterica enterica serovar Typhi Ty2
caggcucagcgcca

SEQ ID NO: 3686421 - RNA, 17 nt, Salmonella enterica enterica serovar Typhi Ty2
caggcucaucagcgcca

SEQ ID NO: 3686422 - RNA, 18 nt, Salmonella enterica enterica serovar Typhi Ty2
caggcucaucagcgccau

SEQ ID NO: 3686423 - RNA, 18 nt, Salmonella enterica enterica serovar Typhi Ty2
caggcugaacccugccug

SEQ ID NO: 3686424 - RNA, 22 nt, Salmonella enterica enterica serovar Typhi Ty2
caggcugccgacaacgccuccu

SEQ ID NO: 3686425 - RNA, 21 nt, Salmonella enterica enterica serovar Typhi Ty2
caggcuggguuucgguauaaa

SEQ ID NO: 3686426 - RNA, 19 nt, Salmonella enterica enterica serovar Typhi Ty2
caggcugguggagagcagu

SEQ ID NO: 3686427 - RNA, 14 nt, Salmonella enterica enterica serovar Typhi Ty2
caggcugucgcggc

SEQ ID NO: 3686428 - RNA, 16 nt, Salmonella enterica enterica serovar Typhi Ty2
caggcugucgcggcgg

SEQ ID NO: 3686429 - RNA, 22 nt, Salmonella enterica enterica serovar Typhi Ty2
caggcuucaucggauagaugaa

SEQ ID NO: 3686430 - RNA, 15 nt, Salmonella enterica enterica serovar Typhi Ty2
caggcuuccagauac

SEQ ID NO: 3686431 - RNA, 14 nt, Salmonella enterica enterica serovar Typhi Ty2
caggcuugcccauu

SEQ ID NO: 3686432 - RNA, 13 nt, Salmonella enterica enterica serovar Typhi Ty2
caggcuugccgcg

SEQ ID NO: 3686433 - RNA, 15 nt, Salmonella enterica enterica serovar Typhi Ty2
caggcuugccgcgcc

SEQ ID NO: 3686434 - RNA, 21 nt, Salmonella enterica enterica serovar Typhi Ty2
caggcuugccgcgccagacgc

SEQ ID NO: 3686435 - RNA, 19 nt, Salmonella enterica enterica serovar Typhi Ty2
caggcuuuaaauucagcac

SEQ ID NO: 3686436 - RNA, 21 nt, Salmonella enterica enterica serovar Typhi Ty2
caggcuuuaaauucagcaccc

SEQ ID NO: 3686437 - RNA, 21 nt, Salmonella enterica enterica serovar Typhi Ty2
caggcuuuccacguucccggu

SEQ ID NO: 3686438 - RNA, 15 nt, Salmonella enterica enterica serovar Typhi Ty2
caggcuuuucaggcu

SEQ ID NO: 3686439 - RNA, 21 nt, Salmonella enterica enterica serovar Typhi Ty2
caggcuuuucaggcuguggcu

SEQ ID NO: 3686440 - RNA, 16 nt, Salmonella enterica enterica serovar Typhi Ty2
cagggaaaccauguug

SEQ ID NO: 3686441 - RNA, 18 nt, Salmonella enterica enterica serovar Typhi Ty2
cagggaaauggcgaacag

SEQ ID NO: 3686442 - RNA, 22 nt, Salmonella enterica enterica serovar Typhi Ty2
cagggaaauggcgaacagcccg

SEQ ID NO: 3686443 - RNA, 19 nt, Salmonella enterica enterica serovar Typhi Ty2
cagggaacguugcgccaug

SEQ ID NO: 3686444 - RNA, 19 nt, Salmonella enterica enterica serovar Typhi Ty2
cagggaauacccgcccggu

SEQ ID NO: 3686445 - RNA, 19 nt, Salmonella enterica enterica serovar Typhi Ty2
cagggaauaugauuuaaaa

SEQ ID NO: 3686446 - RNA, 19 nt, Salmonella enterica enterica serovar Typhi Ty2
cagggacgcauccugcacu

SEQ ID NO: 3686447 - RNA, 13 nt, Salmonella enterica enterica serovar Typhi Ty2
cagggagggccaa

SEQ ID NO: 3686448 - RNA, 17 nt, Salmonella enterica enterica serovar Typhi Ty2
cagggauaugcugaucu

SEQ ID NO: 3686449 - RNA, 22 nt, Salmonella enterica enterica serovar Typhi Ty2
cagggauauuccauacaguggc

SEQ ID NO: 3686450 - RNA, 13 nt, Salmonella enterica enterica serovar Typhi Ty2
cagggauccugua

SEQ ID NO: 3686451 - RNA, 19 nt, Salmonella enterica enterica serovar Typhi Ty2
cagggauccuguaacaacu

SEQ ID NO: 3686452 - RNA, 16 nt, Salmonella enterica enterica serovar Typhi Ty2
cagggauugauggcca

SEQ ID NO: 3686453 - RNA, 19 nt, Salmonella enterica enterica serovar Typhi Ty2
cagggauuuugcuuuuucg

SEQ ID NO: 3686454 - RNA, 21 nt, Salmonella enterica enterica serovar Typhi Ty2
cagggcaaauuaucccuuccu

SEQ ID NO: 3686455 - RNA, 16 nt, Salmonella enterica enterica serovar Typhi Ty2
cagggcaacggccagc

SEQ ID NO: 3686456 - RNA, 19 nt, Salmonella enterica enterica serovar Typhi Ty2
cagggcaacggccagcgca

SEQ ID NO: 3686457 - RNA, 15 nt, Salmonella enterica enterica serovar Typhi Ty2
cagggcaggcaguga

SEQ ID NO: 3686458 - RNA, 21 nt, Salmonella enterica enterica serovar Typhi Ty2
cagggcaugauuacagauauc

SEQ ID NO: 3686459 - RNA, 15 nt, Salmonella enterica enterica serovar Typhi Ty2
cagggcgaugccuca

SEQ ID NO: 3686460 - RNA, 23 nt, Salmonella enterica enterica serovar Typhi Ty2
cagggcgcggcgcaacuuuuucg

SEQ ID NO: 3686461 - RNA, 15 nt, Salmonella enterica enterica serovar Typhi Ty2
cagggcggaagcaga

SEQ ID NO: 3686462 - RNA, 16 nt, Salmonella enterica enterica serovar Typhi Ty2
cagggcggaagcagau

SEQ ID NO: 3686463 - RNA, 22 nt, Salmonella enterica enterica serovar Typhi Ty2
cagggcggcaaaaucuuuuucg

SEQ ID NO: 3686464 - RNA, 17 nt, Salmonella enterica enterica serovar Typhi Ty2
cagggcggccuccuggc

SEQ ID NO: 3686465 - RNA, 14 nt, Salmonella enterica enterica serovar Typhi Ty2
cagggcguaagcgc

SEQ ID NO: 3686466 - RNA, 13 nt, Salmonella enterica enterica serovar Typhi Ty2
cagggcugcuggc

SEQ ID NO: 3686467 - RNA, 17 nt, Salmonella enterica enterica serovar Typhi Ty2
cagggcuuauucaagca

SEQ ID NO: 3686468 - RNA, 14 nt, Salmonella enterica enterica serovar Typhi Ty2
cagggcuuuauuuu

SEQ ID NO: 3686469 - RNA, 20 nt, Salmonella enterica enterica serovar Typhi Ty2
cagggcuuuuuucucgcgcu

SEQ ID NO: 3686470 - RNA, 13 nt, Salmonella enterica enterica serovar Typhi Ty2
caggggauucugc

SEQ ID NO: 3686471 - RNA, 19 nt, Salmonella enterica enterica serovar Typhi Ty2
caggggcuccugcgccgga

SEQ ID NO: 3686472 - RNA, 20 nt, Salmonella enterica enterica serovar Typhi Ty2
cagggggccacuuacggaca

SEQ ID NO: 3686473 - RNA, 23 nt, Salmonella enterica enterica serovar Typhi Ty2
caggggggaaaugagaaaaggaa

SEQ ID NO: 3686474 - RNA, 15 nt, Salmonella enterica enterica serovar Typhi Ty2
caggggucagcguau

SEQ ID NO: 3686475 - RNA, 18 nt, Salmonella enterica enterica serovar Typhi Ty2
caggggucaucggcacgu

SEQ ID NO: 3686476 - RNA, 14 nt, Salmonella enterica enterica serovar Typhi Ty2
cagggguguccaga

SEQ ID NO: 3686477 - RNA, 16 nt, Salmonella enterica enterica serovar Typhi Ty2
cagggguuccggcaau

SEQ ID NO: 3686478 - RNA, 21 nt, Salmonella enterica enterica serovar Typhi Ty2
caggguaucauuaugggcagc

SEQ ID NO: 3686479 - RNA, 22 nt, Salmonella enterica enterica serovar Typhi Ty2
caggguaucauuaugggcagca

SEQ ID NO: 3686480 - RNA, 17 nt, Salmonella enterica enterica serovar Typhi Ty2
caggguaucuaacccgc

SEQ ID NO: 3686481 - RNA, 17 nt, Salmonella enterica enterica serovar Typhi Ty2
caggguccccauauccc

SEQ ID NO: 3686482 - RNA, 17 nt, Salmonella enterica enterica serovar Typhi Ty2
cagggucuuauuucucc

SEQ ID NO: 3686483 - RNA, 23 nt, Salmonella enterica enterica serovar Typhi Ty2
caguaauaucgccucccugccua

SEQ ID NO: 3686484 - RNA, 17 nt, Salmonella enterica enterica serovar Typhi Ty2
caguaauaugaauugau

SEQ ID NO: 3686485 - RNA, 13 nt, Salmonella enterica enterica serovar Typhi Ty2
caguaauuuuucc

SEQ ID NO: 3686486 - RNA, 18 nt, Salmonella enterica enterica serovar Typhi Ty2
caguaauuuuuccgccuc

SEQ ID NO: 3686487 - RNA, 14 nt, Salmonella enterica enterica serovar Typhi Ty2
caguaauuuuucuc

SEQ ID NO: 3686488 - RNA, 18 nt, Salmonella enterica enterica serovar Typhi Ty2
caguacaaacgcaccgcc

SEQ ID NO: 3686489 - RNA, 17 nt, Salmonella enterica enterica serovar Typhi Ty2
caguacagacuggaugg

SEQ ID NO: 3686490 - RNA, 16 nt, Salmonella enterica enterica serovar Typhi Ty2
caguacagccaaaaau

SEQ ID NO: 3686491 - RNA, 12 nt, Salmonella enterica enterica serovar Typhi Ty2
caguacaggcau

SEQ ID NO: 3686492 - RNA, 13 nt, Salmonella enterica enterica serovar Typhi Ty2
caguaccagcgag

SEQ ID NO: 3686493 - RNA, 14 nt, Salmonella enterica enterica serovar Typhi Ty2
caguaccagcgaga

SEQ ID NO: 3686494 - RNA, 15 nt, Salmonella enterica enterica serovar Typhi Ty2
caguaccuucaacgc

SEQ ID NO: 3686495 - RNA, 11 nt, Salmonella enterica enterica serovar Typhi Ty2
caguaccuuua

SEQ ID NO: 3686496 - RNA, 17 nt, Salmonella enterica enterica serovar Typhi Ty2
caguacgaucaugaguc

SEQ ID NO: 3686497 - RNA, 19 nt, Salmonella enterica enterica serovar Typhi Ty2
caguacgaucaugagucgc

SEQ ID NO: 3686498 - RNA, 15 nt, Salmonella enterica enterica serovar Typhi Ty2
caguacgcccgccuc

SEQ ID NO: 3686499 - RNA, 21 nt, Salmonella enterica enterica serovar Typhi Ty2
caguacgcccgugacgccagg

SEQ ID NO: 3686500 - RNA, 17 nt, Salmonella enterica enterica serovar Typhi Ty2
caguacgcgaccgccgc

SEQ ID NO: 3686501 - RNA, 17 nt, Salmonella enterica enterica serovar Typhi Ty2
caguacgcgcgcggcgu

SEQ ID NO: 3686502 - RNA, 12 nt, Salmonella enterica enterica serovar Typhi Ty2
caguacggauga

SEQ ID NO: 3686503 - RNA, 19 nt, Salmonella enterica enterica serovar Typhi Ty2
caguacggaugauguacag

SEQ ID NO: 3686504 - RNA, 22 nt, Salmonella enterica enterica serovar Typhi Ty2
caguacggucaggcucaggaaa

SEQ ID NO: 3686505 - RNA, 22 nt, Salmonella enterica enterica serovar Typhi Ty2
caguacgucaacaaugcuuuca

SEQ ID NO: 3686506 - RNA, 12 nt, Salmonella enterica enterica serovar Typhi Ty2
caguagauggcg

SEQ ID NO: 3686507 - RNA, 18 nt, Salmonella enterica enterica serovar Typhi Ty2
caguagauggcgcuaaaa

SEQ ID NO: 3686508 - RNA, 15 nt, Salmonella enterica enterica serovar Typhi Ty2
caguagcagacagcc

SEQ ID NO: 3686509 - RNA, 12 nt, Salmonella enterica enterica serovar Typhi Ty2
caguagccaugc

SEQ ID NO: 3686510 - RNA, 20 nt, Salmonella enterica enterica serovar Typhi Ty2
caguagccgccgcaggacag

SEQ ID NO: 3686511 - RNA, 13 nt, Salmonella enterica enterica serovar Typhi Ty2
caguagcgcgccc

SEQ ID NO: 3686512 - RNA, 21 nt, Salmonella enterica enterica serovar Typhi Ty2
caguaggcgaacuucauccac

SEQ ID NO: 3686513 - RNA, 13 nt, Salmonella enterica enterica serovar Typhi Ty2
caguaguaaaccg

SEQ ID NO: 3686514 - RNA, 12 nt, Salmonella enterica enterica serovar Typhi Ty2
caguagugagcc

SEQ ID NO: 3686515 - RNA, 22 nt, Salmonella enterica enterica serovar Typhi Ty2
caguaguuaccguaaucaucgc

SEQ ID NO: 3686516 - RNA, 22 nt, Salmonella enterica enterica serovar Typhi Ty2
caguaguugaccugaucggcca

SEQ ID NO: 3686517 - RNA, 15 nt, Salmonella enterica enterica serovar Typhi Ty2
caguauaaauaccuu

SEQ ID NO: 3686518 - RNA, 17 nt, Salmonella enterica enterica serovar Typhi Ty2
caguaucguguuauuuu

SEQ ID NO: 3686519 - RNA, 22 nt, Salmonella enterica enterica serovar Typhi Ty2
caguaugaucaugcccggcaaa

SEQ ID NO: 3686520 - RNA, 23 nt, Salmonella enterica enterica serovar Typhi Ty2
cagucaaaacgacauaaccggca

SEQ ID NO: 3686521 - RNA, 18 nt, Salmonella enterica enterica serovar Typhi Ty2
cagucacccugcccugca

SEQ ID NO: 3686522 - RNA, 14 nt, Salmonella enterica enterica serovar Typhi Ty2
cagucagccuugac

SEQ ID NO: 3686523 - RNA, 19 nt, Salmonella enterica enterica serovar Typhi Ty2
cagucagccuugaccgccu

SEQ ID NO: 3686524 - RNA, 12 nt, Salmonella enterica enterica serovar Typhi Ty2
cagucaguuuau

SEQ ID NO: 3686525 - RNA, 14 nt, Salmonella enterica enterica serovar Typhi Ty2
cagucaucgccgcu

SEQ ID NO: 3686526 - RNA, 14 nt, Salmonella enterica enterica serovar Typhi Ty2
cagucaugaaaucg

SEQ ID NO: 3686527 - RNA, 17 nt, Salmonella enterica enterica serovar Typhi Ty2
cagucaugaaaucgauu

SEQ ID NO: 3686528 - RNA, 23 nt, Salmonella enterica enterica serovar Typhi Ty2
cagucaugaaaucgauuuguuua

SEQ ID NO: 3686529 - RNA, 17 nt, Salmonella enterica enterica serovar Typhi Ty2
cagucauucucuuucug

SEQ ID NO: 3686530 - RNA, 19 nt, Salmonella enterica enterica serovar Typhi Ty2
caguccaccuguaaccgcu

SEQ ID NO: 3686531 - RNA, 22 nt, Salmonella enterica enterica serovar Typhi Ty2
caguccagccgccgcgcggcag

SEQ ID NO: 3686532 - RNA, 23 nt, Salmonella enterica enterica serovar Typhi Ty2
caguccccagcguaccacgccgc

SEQ ID NO: 3686533 - RNA, 16 nt, Salmonella enterica enterica serovar Typhi Ty2
caguccgcacgccugc

SEQ ID NO: 3686534 - RNA, 22 nt, Salmonella enterica enterica serovar Typhi Ty2
caguccggaugucucagcgcau

SEQ ID NO: 3686535 - RNA, 23 nt, Salmonella enterica enterica serovar Typhi Ty2
caguccgggccgugacacauuug

SEQ ID NO: 3686536 - RNA, 23 nt, Salmonella enterica enterica serovar Typhi Ty2
caguccgguacgacgacccuuuu

SEQ ID NO: 3686537 - RNA, 20 nt, Salmonella enterica enterica serovar Typhi Ty2
caguccgguauaaaacguca

SEQ ID NO: 3686538 - RNA, 21 nt, Salmonella enterica enterica serovar Typhi Ty2
caguccgguggcgaaaacgcu

SEQ ID NO: 3686539 - RNA, 18 nt, Salmonella enterica enterica serovar Typhi Ty2
caguccuccggcugaagc

SEQ ID NO: 3686540 - RNA, 22 nt, Salmonella enterica enterica serovar Typhi Ty2
caguccuccggcugaagcccca

SEQ ID NO: 3686541 - RNA, 17 nt, Salmonella enterica enterica serovar Typhi Ty2
caguccucgcccacuuc

SEQ ID NO: 3686542 - RNA, 18 nt, Salmonella enterica enterica serovar Typhi Ty2
caguccugucccugccag

SEQ ID NO: 3686543 - RNA, 14 nt, Salmonella enterica enterica serovar Typhi Ty2
caguccuuccgccg

SEQ ID NO: 3686544 - RNA, 19 nt, Salmonella enterica enterica serovar Typhi Ty2
cagucgacaguauagaaau

SEQ ID NO: 3686545 - RNA, 16 nt, Salmonella enterica enterica serovar Typhi Ty2
cagucgauguggccuu

SEQ ID NO: 3686546 - RNA, 20 nt, Salmonella enterica enterica serovar Typhi Ty2
cagucgauguggccuuccuc

SEQ ID NO: 3686547 - RNA, 19 nt, Salmonella enterica enterica serovar Typhi Ty2
cagucgccagaaggcaggc

SEQ ID NO: 3686548 - RNA, 12 nt, Salmonella enterica enterica serovar Typhi Ty2
cagucgcgccgu

SEQ ID NO: 3686549 - RNA, 20 nt, Salmonella enterica enterica serovar Typhi Ty2
cagucgcuauggugcggggu

SEQ ID NO: 3686550 - RNA, 14 nt, Salmonella enterica enterica serovar Typhi Ty2
cagucgcuccacca

SEQ ID NO: 3686551 - RNA, 21 nt, Salmonella enterica enterica serovar Typhi Ty2
cagucggcaaagaccaauaaa

SEQ ID NO: 3686552 - RNA, 15 nt, Salmonella enterica enterica serovar Typhi Ty2
cagucgucuggcgcu

SEQ ID NO: 3686553 - RNA, 16 nt, Salmonella enterica enterica serovar Typhi Ty2
cagucguuuacgcgcu

SEQ ID NO: 3686554 - RNA, 18 nt, Salmonella enterica enterica serovar Typhi Ty2
cagucucaaaggccugca

SEQ ID NO: 3686555 - RNA, 19 nt, Salmonella enterica enterica serovar Typhi Ty2
cagucugcagaccuguucu

SEQ ID NO: 3686556 - RNA, 16 nt, Salmonella enterica enterica serovar Typhi Ty2
cagucuggcggcagcc

SEQ ID NO: 3686557 - RNA, 17 nt, Salmonella enterica enterica serovar Typhi Ty2
cagugaaaaaccgaucu

SEQ ID NO: 3686558 - RNA, 21 nt, Salmonella enterica enterica serovar Typhi Ty2
cagugaaauuugucgauaaaa

SEQ ID NO: 3686559 - RNA, 16 nt, Salmonella enterica enterica serovar Typhi Ty2
cagugaacacccugcc

SEQ ID NO: 3686560 - RNA, 17 nt, Salmonella enterica enterica serovar Typhi Ty2
cagugaagaauggcgcc

SEQ ID NO: 3686561 - RNA, 18 nt, Salmonella enterica enterica serovar Typhi Ty2
cagugaauuaugaccaau

SEQ ID NO: 3686562 - RNA, 17 nt, Salmonella enterica enterica serovar Typhi Ty2
cagugacagaggaauga

SEQ ID NO: 3686563 - RNA, 15 nt, Salmonella enterica enterica serovar Typhi Ty2
cagugaccagcauca

SEQ ID NO: 3686564 - RNA, 14 nt, Salmonella enterica enterica serovar Typhi Ty2
cagugacccgccgc

SEQ ID NO: 3686565 - RNA, 23 nt, Salmonella enterica enterica serovar Typhi Ty2
caguuuuuuacuuucaaaauacu

SEQ ID NO: 3686566 - RNA, 22 nt, Salmonella enterica enterica serovar Typhi Ty2
caguuuuuucaguagccgccgc

SEQ ID NO: 3686567 - RNA, 13 nt, Salmonella enterica enterica serovar Typhi Ty2
caguuuuuuccag

SEQ ID NO: 3686568 - RNA, 15 nt, Salmonella enterica enterica serovar Typhi Ty2
cauaaaaaagaggaa

SEQ ID NO: 3686569 - RNA, 24 nt, Salmonella enterica enterica serovar Typhi Ty2
cauaaaaagacgaucuucgcagua

SEQ ID NO: 3686570 - RNA, 19 nt, Salmonella enterica enterica serovar Typhi Ty2
cauaaaaagcguacaaaaa

SEQ ID NO: 3686571 - RNA, 22 nt, Salmonella enterica enterica serovar Typhi Ty2
cauaaaacccguuaaauaccag

SEQ ID NO: 3686572 - RNA, 15 nt, Salmonella enterica enterica serovar Typhi Ty2
cauaaacaaaacaac

SEQ ID NO: 3686573 - RNA, 12 nt, Salmonella enterica enterica serovar Typhi Ty2
cauaaacauuau

SEQ ID NO: 3686574 - RNA, 19 nt, Salmonella enterica enterica serovar Typhi Ty2
cauaaaccccgauaaacca

SEQ ID NO: 3686575 - RNA, 19 nt, Salmonella enterica enterica serovar Typhi Ty2
cauaaaccgccgcuuugau

SEQ ID NO: 3686576 - RNA, 22 nt, Salmonella enterica enterica serovar Typhi Ty2
cauaaagauauugucgcccugc

SEQ ID NO: 3686577 - RNA, 21 nt, Salmonella enterica enterica serovar Typhi Ty2
cauaaaggcuuuaaagcaggc

SEQ ID NO: 3686578 - RNA, 17 nt, Salmonella enterica enterica serovar Typhi Ty2
cauaaauaucugcauug

SEQ ID NO: 3686579 - RNA, 19 nt, Salmonella enterica enterica serovar Typhi Ty2
cauaaaucauuacuuauau

SEQ ID NO: 3686580 - RNA, 14 nt, Salmonella enterica enterica serovar Typhi Ty2
cauaaauuggcuca

SEQ ID NO: 3686581 - RNA, 15 nt, Salmonella enterica enterica serovar Typhi Ty2
cauaaccaaacgcgc

SEQ ID NO: 3686582 - RNA, 18 nt, Salmonella enterica enterica serovar Typhi Ty2
cauaaccacaacgugaua

SEQ ID NO: 3686583 - RNA, 18 nt, Salmonella enterica enterica serovar Typhi Ty2
cauaaccgcagcgcggcc

SEQ ID NO: 3686584 - RNA, 22 nt, Salmonella enterica enterica serovar Typhi Ty2
cauaaccggcaaccaaagucca

SEQ ID NO: 3686585 - RNA, 14 nt, Salmonella enterica enterica serovar Typhi Ty2
cauaaccucuccuu

SEQ ID NO: 3686586 - RNA, 21 nt, Salmonella enterica enterica serovar Typhi Ty2
cauaacgaaauccgcgccgcc

SEQ ID NO: 3686587 - RNA, 16 nt, Salmonella enterica enterica serovar Typhi Ty2
cauaacgaaugccauu

SEQ ID NO: 3686588 - RNA, 18 nt, Salmonella enterica enterica serovar Typhi Ty2
cauaacgcacaacgucag

SEQ ID NO: 3686589 - RNA, 18 nt, Salmonella enterica enterica serovar Typhi Ty2
cauaacggcuacgcagcg

SEQ ID NO: 3686590 - RNA, 15 nt, Salmonella enterica enterica serovar Typhi Ty2
cauaacggcugucca

SEQ ID NO: 3686591 - RNA, 14 nt, Salmonella enterica enterica serovar Typhi Ty2
cauaacgggaagcc

SEQ ID NO: 3686592 - RNA, 18 nt, Salmonella enterica enterica serovar Typhi Ty2
cauaacgugccaucuuug

SEQ ID NO: 3686593 - RNA, 19 nt, Salmonella enterica enterica serovar Typhi Ty2
cauaacguuguggaaugcc

SEQ ID NO: 3686594 - RNA, 20 nt, Salmonella enterica enterica serovar Typhi Ty2
cauaacugagacucagcagc

SEQ ID NO: 3686595 - RNA, 21 nt, Salmonella enterica enterica serovar Typhi Ty2
cauaagagauggaaugagcau

SEQ ID NO: 3686596 - RNA, 15 nt, Salmonella enterica enterica serovar Typhi Ty2
cauaagcaaacagug

SEQ ID NO: 3686597 - RNA, 15 nt, Salmonella enterica enterica serovar Typhi Ty2
cauaagcaaauccuc

SEQ ID NO: 3686598 - RNA, 14 nt, Salmonella enterica enterica serovar Typhi Ty2
cauaagcaauaggu

SEQ ID NO: 3686599 - RNA, 21 nt, Salmonella enterica enterica serovar Typhi Ty2
cauaagcacaccauuucacaa

SEQ ID NO: 3686600 - RNA, 14 nt, Salmonella enterica enterica serovar Typhi Ty2
cauaagccaguccu

SEQ ID NO: 3686601 - RNA, 18 nt, Salmonella enterica enterica serovar Typhi Ty2
cauaagccaguccugcca

SEQ ID NO: 3686602 - RNA, 22 nt, Salmonella enterica enterica serovar Typhi Ty2
cauaagccgcguucugucgaua

SEQ ID NO: 3686603 - RNA, 15 nt, Salmonella enterica enterica serovar Typhi Ty2
cauaagcgcggcgga

SEQ ID NO: 3686604 - RNA, 15 nt, Salmonella enterica enterica serovar Typhi Ty2
cauaaguaaauaaca

SEQ ID NO: 3686605 - RNA, 12 nt, Salmonella enterica enterica serovar Typhi Ty2
cauaagucaucc

SEQ ID NO: 3686606 - RNA, 17 nt, Salmonella enterica enterica serovar Typhi Ty2
cauaauaaugacuaauu

SEQ ID NO: 3686607 - RNA, 13 nt, Salmonella enterica enterica serovar Typhi Ty2
cauaauaauugcg

SEQ ID NO: 3686608 - RNA, 23 nt, Salmonella enterica enterica serovar Typhi Ty2
cauaauaucucccguuuguauaa

SEQ ID NO: 3686609 - RNA, 21 nt, Salmonella enterica enterica serovar Typhi Ty2
cauaauauucauaacgccgau

SEQ ID NO: 3686610 - RNA, 17 nt, Salmonella enterica enterica serovar Typhi Ty2
cauaaucaguacugcgc

SEQ ID NO: 3686611 - RNA, 15 nt, Salmonella enterica enterica serovar Typhi Ty2
cauaaucgacagugg

SEQ ID NO: 3686612 - RNA, 15 nt, Salmonella enterica enterica serovar Typhi Ty2
cauaaucgauauaau

SEQ ID NO: 3686613 - RNA, 19 nt, Salmonella enterica enterica serovar Typhi Ty2
cauaaucgauauaauuuua

SEQ ID NO: 3686614 - RNA, 21 nt, Salmonella enterica enterica serovar Typhi Ty2
cauaaucggccaggauggccc

SEQ ID NO: 3686615 - RNA, 19 nt, Salmonella enterica enterica serovar Typhi Ty2
cauaaugaauuuaucccgu

SEQ ID NO: 3686616 - RNA, 22 nt, Salmonella enterica enterica serovar Typhi Ty2
cauaaugaauuuaucccguggu

SEQ ID NO: 3686617 - RNA, 14 nt, Salmonella enterica enterica serovar Typhi Ty2
cauaauggaacugc

SEQ ID NO: 3686618 - RNA, 22 nt, Salmonella enterica enterica serovar Typhi Ty2
cauaauggaacugccuggcuca

SEQ ID NO: 3686619 - RNA, 21 nt, Salmonella enterica enterica serovar Typhi Ty2
cauaauggcccaguguacugc

SEQ ID NO: 3686620 - RNA, 17 nt, Salmonella enterica enterica serovar Typhi Ty2
cauaaugguggaaugcc

SEQ ID NO: 3686621 - RNA, 21 nt, Salmonella enterica enterica serovar Typhi Ty2
cauaauugcugcccgccgccg

SEQ ID NO: 3686622 - RNA, 15 nt, Salmonella enterica enterica serovar Typhi Ty2
cauaauuuuccccag

SEQ ID NO: 3686623 - RNA, 14 nt, Salmonella enterica enterica serovar Typhi Ty2
cauacacgcggcga

SEQ ID NO: 3686624 - RNA, 14 nt, Salmonella enterica enterica serovar Typhi Ty2
cauacacucaacca

SEQ ID NO: 3686625 - RNA, 14 nt, Salmonella enterica enterica serovar Typhi Ty2
cauacacugcauaa

SEQ ID NO: 3686626 - RNA, 15 nt, Salmonella enterica enterica serovar Typhi Ty2
cauacagcacuuccc

SEQ ID NO: 3686627 - RNA, 13 nt, Salmonella enterica enterica serovar Typhi Ty2
cauacagcccgcg

SEQ ID NO: 3686628 - RNA, 19 nt, Salmonella enterica enterica serovar Typhi Ty2
cauacagcgauaaccgccg

SEQ ID NO: 3686629 - RNA, 14 nt, Salmonella enterica enterica serovar Typhi Ty2
cauacauaaauccg

SEQ ID NO: 3686630 - RNA, 16 nt, Salmonella enterica enterica serovar Typhi Ty2
cauaccacaacagaau

SEQ ID NO: 3686631 - RNA, 22 nt, Salmonella enterica enterica serovar Typhi Ty2
cauaccacaacagaaucgcgau

SEQ ID NO: 3686632 - RNA, 18 nt, Salmonella enterica enterica serovar Typhi Ty2
cauaccacgcagcggcau

SEQ ID NO: 3686633 - RNA, 17 nt, Salmonella enterica enterica serovar Typhi Ty2
cauaccagccauaaaua

SEQ ID NO: 3686634 - RNA, 19 nt, Salmonella enterica enterica serovar Typhi Ty2
cauaccagcgaaaugcgaa

SEQ ID NO: 3686635 - RNA, 19 nt, Salmonella enterica enterica serovar Typhi Ty2
cauacccgcgcucuccggc

SEQ ID NO: 3686636 - RNA, 12 nt, Salmonella enterica enterica serovar Typhi Ty2
cauacccgcuua

SEQ ID NO: 3686637 - RNA, 21 nt, Salmonella enterica enterica serovar Typhi Ty2
cauaccgcuuaacagcguaca

SEQ ID NO: 3686638 - RNA, 18 nt, Salmonella enterica enterica serovar Typhi Ty2
cauaccggacuccaggca

SEQ ID NO: 3686639 - RNA, 22 nt, Salmonella enterica enterica serovar Typhi Ty2
cauaccggacuccaggcaacgu

SEQ ID NO: 3686640 - RNA, 20 nt, Salmonella enterica enterica serovar Typhi Ty2
cauaccggugcgccccagca

SEQ ID NO: 3686641 - RNA, 16 nt, Salmonella enterica enterica serovar Typhi Ty2
cauaccgguugcgcgc

SEQ ID NO: 3686642 - RNA, 19 nt, Salmonella enterica enterica serovar Typhi Ty2
cauaccgucgugaaucauc

SEQ ID NO: 3686643 - RNA, 19 nt, Salmonella enterica enterica serovar Typhi Ty2
cauaccugcggccaugauc

SEQ ID NO: 3686644 - RNA, 21 nt, Salmonella enterica enterica serovar Typhi Ty2
cauaccugguuacucacgcga

SEQ ID NO: 3686645 - RNA, 18 nt, Salmonella enterica enterica serovar Typhi Ty2
cauaccuguaucaaacca

SEQ ID NO: 3686646 - RNA, 19 nt, Salmonella enterica enterica serovar Typhi Ty2
cauaccuguaucaaaccaa

SEQ ID NO: 3686647 - RNA, 16 nt, Salmonella enterica enterica serovar Typhi Ty2
cauauuaaauuccggc

SEQ ID NO: 3686648 - RNA, 17 nt, Salmonella enterica enterica serovar Typhi Ty2
cauauuaaauuccggcu

SEQ ID NO: 3686649 - RNA, 15 nt, Salmonella enterica enterica serovar Typhi Ty2
cauauuacauagaaa

SEQ ID NO: 3686650 - RNA, 18 nt, Salmonella enterica enterica serovar Typhi Ty2
cauauuaucgcgcugaau

SEQ ID NO: 3686651 - RNA, 21 nt, Salmonella enterica enterica serovar Typhi Ty2
cauauucaccagagcaucaau

SEQ ID NO: 3686652 - RNA, 20 nt, Salmonella enterica enterica serovar Typhi Ty2
cauauuccagaagcgcuuug

SEQ ID NO: 3686653 - RNA, 22 nt, Salmonella enterica enterica serovar Typhi Ty2
cauauuccagccacacgacggu

SEQ ID NO: 3686654 - RNA, 11 nt, Salmonella enterica enterica serovar Typhi Ty2
cauauuccugc

SEQ ID NO: 3686655 - RNA, 23 nt, Salmonella enterica enterica serovar Typhi Ty2
cauauucgguagcuguaccagau

SEQ ID NO: 3686656 - RNA, 20 nt, Salmonella enterica enterica serovar Typhi Ty2
cauauucuuugcgccuuauu

SEQ ID NO: 3686657 - RNA, 22 nt, Salmonella enterica enterica serovar Typhi Ty2
cauauucuuugcgccuuauuca

SEQ ID NO: 3686658 - RNA, 14 nt, Salmonella enterica enterica serovar Typhi Ty2
cauauugagcggua

SEQ ID NO: 3686659 - RNA, 14 nt, Salmonella enterica enterica serovar Typhi Ty2
cauauugccgcaca

SEQ ID NO: 3686660 - RNA, 20 nt, Salmonella enterica enterica serovar Typhi Ty2
cauauugcgacaacuagaau

SEQ ID NO: 3686661 - RNA, 14 nt, Salmonella enterica enterica serovar Typhi Ty2
cauauugcgccgca

SEQ ID NO: 3686662 - RNA, 20 nt, Salmonella enterica enterica serovar Typhi Ty2
cauauugcgcuucacuaacu

SEQ ID NO: 3686663 - RNA, 19 nt, Salmonella enterica enterica serovar Typhi Ty2
cauauuugcgugucaucaa

SEQ ID NO: 3686664 - RNA, 20 nt, Salmonella enterica enterica serovar Typhi Ty2
cauauuugcgugucaucaaa

SEQ ID NO: 3686665 - RNA, 13 nt, Salmonella enterica enterica serovar Typhi Ty2
cauauuuuuaugc

SEQ ID NO: 3686666 - RNA, 15 nt, Salmonella enterica enterica serovar Typhi Ty2
cauauuuuucacaca

SEQ ID NO: 3686667 - RNA, 18 nt, Salmonella enterica enterica serovar Typhi Ty2
cauauuuuucacacauaa

SEQ ID NO: 3686668 - RNA, 18 nt, Salmonella enterica enterica serovar Typhi Ty2
cauauuuuuccagcgccu

SEQ ID NO: 3686669 - RNA, 13 nt, Salmonella enterica enterica serovar Typhi Ty2
caucaaaaucauc

SEQ ID NO: 3686670 - RNA, 18 nt, Salmonella enterica enterica serovar Typhi Ty2
caucaaaaucaucgccac

SEQ ID NO: 3686671 - RNA, 22 nt, Salmonella enterica enterica serovar Typhi Ty2
caucaaacgcagcaaacgccau

SEQ ID NO: 3686672 - RNA, 14 nt, Salmonella enterica enterica serovar Typhi Ty2
caucaaacuuuuaa

SEQ ID NO: 3686673 - RNA, 15 nt, Salmonella enterica enterica serovar Typhi Ty2
caucaaagaaaacca

SEQ ID NO: 3686674 - RNA, 15 nt, Salmonella enterica enterica serovar Typhi Ty2
caucaaauaauacgc

SEQ ID NO: 3686675 - RNA, 18 nt, Salmonella enterica enterica serovar Typhi Ty2
caucaacagcggagagac

SEQ ID NO: 3686676 - RNA, 20 nt, Salmonella enterica enterica serovar Typhi Ty2
caucaaccaccaaaaagcca

SEQ ID NO: 3686677 - RNA, 22 nt, Salmonella enterica enterica serovar Typhi Ty2
caucaagcugcuggcgagcagg

SEQ ID NO: 3686678 - RNA, 22 nt, Salmonella enterica enterica serovar Typhi Ty2
caucaaguacagcuuaaucacc

SEQ ID NO: 3686679 - RNA, 19 nt, Salmonella enterica enterica serovar Typhi Ty2
caucaaguaccgugaagaa

SEQ ID NO: 3686680 - RNA, 22 nt, Salmonella enterica enterica serovar Typhi Ty2
caucaauaauuugucgauaagc

SEQ ID NO: 3686681 - RNA, 18 nt, Salmonella enterica enterica serovar Typhi Ty2
caucaauacccggccccu

SEQ ID NO: 3686682 - RNA, 13 nt, Salmonella enterica enterica serovar Typhi Ty2
caucaaucaccuu

SEQ ID NO: 3686683 - RNA, 21 nt, Salmonella enterica enterica serovar Typhi Ty2
caucaaucacuacggguuuuu

SEQ ID NO: 3686684 - RNA, 23 nt, Salmonella enterica enterica serovar Typhi Ty2
caucaaucacuacggguuuuugu

SEQ ID NO: 3686685 - RNA, 16 nt, Salmonella enterica enterica serovar Typhi Ty2
caucaauccaacgaaa

SEQ ID NO: 3686686 - RNA, 13 nt, Salmonella enterica enterica serovar Typhi Ty2
caucaaugcccag

SEQ ID NO: 3686687 - RNA, 16 nt, Salmonella enterica enterica serovar Typhi Ty2
caucaauuugaaaagg

SEQ ID NO: 3686688 - RNA, 18 nt, Salmonella enterica enterica serovar Typhi Ty2
caucaauuuugcgccuac

SEQ ID NO: 3686689 - RNA, 22 nt, Salmonella enterica enterica serovar Typhi Ty2
caucacaaucuccagaccgcug

SEQ ID NO: 3686690 - RNA, 18 nt, Salmonella enterica enterica serovar Typhi Ty2
caucacaaugaccucuuu

SEQ ID NO: 3686691 - RNA, 15 nt, Salmonella enterica enterica serovar Typhi Ty2
caucacagccacacu

SEQ ID NO: 3686692 - RNA, 18 nt, Salmonella enterica enterica serovar Typhi Ty2
caucacagccacacugcu

SEQ ID NO: 3686693 - RNA, 20 nt, Salmonella enterica enterica serovar Typhi Ty2
caucacagccacacugcugu

SEQ ID NO: 3686694 - RNA, 16 nt, Salmonella enterica enterica serovar Typhi Ty2
caucacaucgcgcagc

SEQ ID NO: 3686695 - RNA, 21 nt, Salmonella enterica enterica serovar Typhi Ty2
caucacaucguaaaucagcgu

SEQ ID NO: 3686696 - RNA, 22 nt, Salmonella enterica enterica serovar Typhi Ty2
caucaccaguugcgaagccacu

SEQ ID NO: 3686697 - RNA, 18 nt, Salmonella enterica enterica serovar Typhi Ty2
caucaccaucgccggaga

SEQ ID NO: 3686698 - RNA, 17 nt, Salmonella enterica enterica serovar Typhi Ty2
caucaccgacggggcgu

SEQ ID NO: 3686699 - RNA, 12 nt, Salmonella enterica enterica serovar Typhi Ty2
caucaccguuac

SEQ ID NO: 3686700 - RNA, 16 nt, Salmonella enterica enterica serovar Typhi Ty2
caucaccguuuuccag

SEQ ID NO: 3686701 - RNA, 14 nt, Salmonella enterica enterica serovar Typhi Ty2
caucaccuccagca

SEQ ID NO: 3686702 - RNA, 16 nt, Salmonella enterica enterica serovar Typhi Ty2
caucaccuccagcacg

SEQ ID NO: 3686703 - RNA, 21 nt, Salmonella enterica enterica serovar Typhi Ty2
caucacgaucuggcaaaccau

SEQ ID NO: 3686704 - RNA, 22 nt, Salmonella enterica enterica serovar Typhi Ty2
caucacgcaaaugcagcggaau

SEQ ID NO: 3686705 - RNA, 17 nt, Salmonella enterica enterica serovar Typhi Ty2
caucacgcaacggugag

SEQ ID NO: 3686706 - RNA, 20 nt, Salmonella enterica enterica serovar Typhi Ty2
caucacggagcgguaguuca

SEQ ID NO: 3686707 - RNA, 18 nt, Salmonella enterica enterica serovar Typhi Ty2
caucacgggaucgcagaa

SEQ ID NO: 3686708 - RNA, 14 nt, Salmonella enterica enterica serovar Typhi Ty2
caucacguccuccc

SEQ ID NO: 3686709 - RNA, 19 nt, Salmonella enterica enterica serovar Typhi Ty2
caucacuaccauuuccggc

SEQ ID NO: 3686710 - RNA, 18 nt, Salmonella enterica enterica serovar Typhi Ty2
caucacugaacccaaaca

SEQ ID NO: 3686711 - RNA, 16 nt, Salmonella enterica enterica serovar Typhi Ty2
caucacuggcguauug

SEQ ID NO: 3686712 - RNA, 21 nt, Salmonella enterica enterica serovar Typhi Ty2
caucacuuccuguaucacuga

SEQ ID NO: 3686713 - RNA, 17 nt, Salmonella enterica enterica serovar Typhi Ty2
caucacuucgcgcauug

SEQ ID NO: 3686714 - RNA, 15 nt, Salmonella enterica enterica serovar Typhi Ty2
caucacuuuuggcga

SEQ ID NO: 3686715 - RNA, 21 nt, Salmonella enterica enterica serovar Typhi Ty2
caucacuuuuggcgacaggaa

SEQ ID NO: 3686716 - RNA, 15 nt, Salmonella enterica enterica serovar Typhi Ty2
caucagaaaaaccuc

SEQ ID NO: 3686717 - RNA, 15 nt, Salmonella enterica enterica serovar Typhi Ty2
caucagaagugccag

SEQ ID NO: 3686718 - RNA, 22 nt, Salmonella enterica enterica serovar Typhi Ty2
caucagaauaaugcuggcggac

SEQ ID NO: 3686719 - RNA, 22 nt, Salmonella enterica enterica serovar Typhi Ty2
caucagacaguacggaugaugu

SEQ ID NO: 3686720 - RNA, 21 nt, Salmonella enterica enterica serovar Typhi Ty2
caucagaccgagacccagcgc

SEQ ID NO: 3686721 - RNA, 17 nt, Salmonella enterica enterica serovar Typhi Ty2
caucagaccgauaaaua

SEQ ID NO: 3686722 - RNA, 18 nt, Salmonella enterica enterica serovar Typhi Ty2
caucagaccgauaaauac

SEQ ID NO: 3686723 - RNA, 17 nt, Salmonella enterica enterica serovar Typhi Ty2
caucagaccgccaagcg

SEQ ID NO: 3686724 - RNA, 20 nt, Salmonella enterica enterica serovar Typhi Ty2
caucagacuacuuuuacccu

SEQ ID NO: 3686725 - RNA, 21 nt, Salmonella enterica enterica serovar Typhi Ty2
caucagacucucaaugcccau

SEQ ID NO: 3686726 - RNA, 15 nt, Salmonella enterica enterica serovar Typhi Ty2
caucagacuguaugu

SEQ ID NO: 3686727 - RNA, 19 nt, Salmonella enterica enterica serovar Typhi Ty2
caucagauaaacagguaaa

SEQ ID NO: 3686728 - RNA, 16 nt, Salmonella enterica enterica serovar Typhi Ty2
caucagauucaacagg

SEQ ID NO: 3686729 - RNA, 14 nt, Salmonella enterica enterica serovar Typhi Ty2
cauccagcgaaccu

SEQ ID NO: 3686730 - RNA, 17 nt, Salmonella enterica enterica serovar Typhi Ty2
cauccagcgaaccuucc

SEQ ID NO: 3686731 - RNA, 12 nt, Salmonella enterica enterica serovar Typhi Ty2
cauccagcgcaa

SEQ ID NO: 3686732 - RNA, 14 nt, Salmonella enterica enterica serovar Typhi Ty2
cauccagcgccugc

SEQ ID NO: 3686733 - RNA, 18 nt, Salmonella enterica enterica serovar Typhi Ty2
cauccagcgucacaggcu

SEQ ID NO: 3686734 - RNA, 20 nt, Salmonella enterica enterica serovar Typhi Ty2
cauccagcuugccgucacag

SEQ ID NO: 3686735 - RNA, 21 nt, Salmonella enterica enterica serovar Typhi Ty2
cauccaggaaguaaauuauuc

SEQ ID NO: 3686736 - RNA, 16 nt, Salmonella enterica enterica serovar Typhi Ty2
cauccagucagcaauu

SEQ ID NO: 3686737 - RNA, 19 nt, Salmonella enterica enterica serovar Typhi Ty2
cauccaguuguuuauucca

SEQ ID NO: 3686738 - RNA, 23 nt, Salmonella enterica enterica serovar Typhi Ty2
cauccaguuuauauucuucgccc

SEQ ID NO: 3686739 - RNA, 15 nt, Salmonella enterica enterica serovar Typhi Ty2
cauccauuaaaaucu

SEQ ID NO: 3686740 - RNA, 18 nt, Salmonella enterica enterica serovar Typhi Ty2
cauccauugcgccacgga

SEQ ID NO: 3686741 - RNA, 20 nt, Salmonella enterica enterica serovar Typhi Ty2
cauccauugcgccacggaug

SEQ ID NO: 3686742 - RNA, 13 nt, Salmonella enterica enterica serovar Typhi Ty2
caucccauccggg

SEQ ID NO: 3686743 - RNA, 23 nt, Salmonella enterica enterica serovar Typhi Ty2
caucccauccgggccacucucca

SEQ ID NO: 3686744 - RNA, 16 nt, Salmonella enterica enterica serovar Typhi Ty2
cauccccaccgcugau

SEQ ID NO: 3686745 - RNA, 15 nt, Salmonella enterica enterica serovar Typhi Ty2
cauccccgccgagaa

SEQ ID NO: 3686746 - RNA, 21 nt, Salmonella enterica enterica serovar Typhi Ty2
caucccgauaauggcgccgau

SEQ ID NO: 3686747 - RNA, 15 nt, Salmonella enterica enterica serovar Typhi Ty2
caucccgcccagcaa

SEQ ID NO: 3686748 - RNA, 12 nt, Salmonella enterica enterica serovar Typhi Ty2
caucccggcaac

SEQ ID NO: 3686749 - RNA, 14 nt, Salmonella enterica enterica serovar Typhi Ty2
caucccggcaacgu

SEQ ID NO: 3686750 - RNA, 15 nt, Salmonella enterica enterica serovar Typhi Ty2
caucccgucccacca

SEQ ID NO: 3686751 - RNA, 16 nt, Salmonella enterica enterica serovar Typhi Ty2
caucccgucccaccac

SEQ ID NO: 3686752 - RNA, 21 nt, Salmonella enterica enterica serovar Typhi Ty2
cauccgauuucauggucaucg

SEQ ID NO: 3686753 - RNA, 23 nt, Salmonella enterica enterica serovar Typhi Ty2
cauccgauuucauggucaucgca

SEQ ID NO: 3686754 - RNA, 16 nt, Salmonella enterica enterica serovar Typhi Ty2
cauccgccagccgcca

SEQ ID NO: 3686755 - RNA, 17 nt, Salmonella enterica enterica serovar Typhi Ty2
cauccgccagcgccucu

SEQ ID NO: 3686756 - RNA, 23 nt, Salmonella enterica enterica serovar Typhi Ty2
cauccgcgcaauaugcggcgcca

SEQ ID NO: 3686757 - RNA, 15 nt, Salmonella enterica enterica serovar Typhi Ty2
cauccgcgcuuucug

SEQ ID NO: 3686758 - RNA, 21 nt, Salmonella enterica enterica serovar Typhi Ty2
cauccgcuucggacuccugac

SEQ ID NO: 3686759 - RNA, 13 nt, Salmonella enterica enterica serovar Typhi Ty2
cauccggacgcca

SEQ ID NO: 3686760 - RNA, 19 nt, Salmonella enterica enterica serovar Typhi Ty2
cauccggaugguuaagcag

SEQ ID NO: 3686761 - RNA, 15 nt, Salmonella enterica enterica serovar Typhi Ty2
cauccggcaaacuca

SEQ ID NO: 3686762 - RNA, 19 nt, Salmonella enterica enterica serovar Typhi Ty2
cauccggcaaacucagcgg

SEQ ID NO: 3686763 - RNA, 23 nt, Salmonella enterica enterica serovar Typhi Ty2
cauccggcaagcgcugggcgaua

SEQ ID NO: 3686764 - RNA, 15 nt, Salmonella enterica enterica serovar Typhi Ty2
cauccggcaauaaug

SEQ ID NO: 3686765 - RNA, 14 nt, Salmonella enterica enterica serovar Typhi Ty2
cauccggcaaugau

SEQ ID NO: 3686766 - RNA, 13 nt, Salmonella enterica enterica serovar Typhi Ty2
cauccggcacagu

SEQ ID NO: 3686767 - RNA, 21 nt, Salmonella enterica enterica serovar Typhi Ty2
cauccggcacgccaucgccug

SEQ ID NO: 3686768 - RNA, 18 nt, Salmonella enterica enterica serovar Typhi Ty2
cauccggcauuuaugcug

SEQ ID NO: 3686769 - RNA, 16 nt, Salmonella enterica enterica serovar Typhi Ty2
cauccggcgcugauga

SEQ ID NO: 3686770 - RNA, 19 nt, Salmonella enterica enterica serovar Typhi Ty2
cauccggcgcugcgcggcg

SEQ ID NO: 3686771 - RNA, 23 nt, Salmonella enterica enterica serovar Typhi Ty2
cauccggcgcugcgcggcgugca

SEQ ID NO: 3686772 - RNA, 19 nt, Salmonella enterica enterica serovar Typhi Ty2
cauccggcguugcgccgcc

SEQ ID NO: 3686773 - RNA, 18 nt, Salmonella enterica enterica serovar Typhi Ty2
cauccggguuaaaccagc

SEQ ID NO: 3686774 - RNA, 14 nt, Salmonella enterica enterica serovar Typhi Ty2
cauccgucaggccc

SEQ ID NO: 3686775 - RNA, 13 nt, Salmonella enterica enterica serovar Typhi Ty2
cauccucauuuug

SEQ ID NO: 3686776 - RNA, 22 nt, Salmonella enterica enterica serovar Typhi Ty2
cauccucauuuuguugcuccag

SEQ ID NO: 3686777 - RNA, 22 nt, Salmonella enterica enterica serovar Typhi Ty2
cauccuccauccagguaacaua

SEQ ID NO: 3686778 - RNA, 20 nt, Salmonella enterica enterica serovar Typhi Ty2
cauccuccggcgacugaaug

SEQ ID NO: 3686779 - RNA, 19 nt, Salmonella enterica enterica serovar Typhi Ty2
cauccucuuggguuauuuc

SEQ ID NO: 3686780 - RNA, 14 nt, Salmonella enterica enterica serovar Typhi Ty2
cauccugacaggcc

SEQ ID NO: 3686781 - RNA, 18 nt, Salmonella enterica enterica serovar Typhi Ty2
cauccugaguauaaaacu

SEQ ID NO: 3686782 - RNA, 17 nt, Salmonella enterica enterica serovar Typhi Ty2
cauccugcaacucaaaa

SEQ ID NO: 3686783 - RNA, 15 nt, Salmonella enterica enterica serovar Typhi Ty2
cauccugccgcacca

SEQ ID NO: 3686784 - RNA, 15 nt, Salmonella enterica enterica serovar Typhi Ty2
cauccugcgcacagc

SEQ ID NO: 3686785 - RNA, 17 nt, Salmonella enterica enterica serovar Typhi Ty2
cauccugcgggaugcgu

SEQ ID NO: 3686786 - RNA, 13 nt, Salmonella enterica enterica serovar Typhi Ty2
cauccugcggguu

SEQ ID NO: 3686787 - RNA, 20 nt, Salmonella enterica enterica serovar Typhi Ty2
cauccugcggguucaucgcc

SEQ ID NO: 3686788 - RNA, 20 nt, Salmonella enterica enterica serovar Typhi Ty2
cauccuguaccaccacgccc

SEQ ID NO: 3686789 - RNA, 15 nt, Salmonella enterica enterica serovar Typhi Ty2
cauccuguucaagca

SEQ ID NO: 3686790 - RNA, 23 nt, Salmonella enterica enterica serovar Typhi Ty2
cauccuuaugggucacauccaga

SEQ ID NO: 3686791 - RNA, 23 nt, Salmonella enterica enterica serovar Typhi Ty2
caucgacaagcuaauccccagcg

SEQ ID NO: 3686792 - RNA, 15 nt, Salmonella enterica enterica serovar Typhi Ty2
caucgacagacuuca

SEQ ID NO: 3686793 - RNA, 21 nt, Salmonella enterica enterica serovar Typhi Ty2
caucgacccccaccucaauca

SEQ ID NO: 3686794 - RNA, 19 nt, Salmonella enterica enterica serovar Typhi Ty2
caucgacgaaauggugugc

SEQ ID NO: 3686795 - RNA, 23 nt, Salmonella enterica enterica serovar Typhi Ty2
caucgagccaacguauaaaaugg

SEQ ID NO: 3686796 - RNA, 18 nt, Salmonella enterica enterica serovar Typhi Ty2
caucgauacccugcugau

SEQ ID NO: 3686797 - RNA, 21 nt, Salmonella enterica enterica serovar Typhi Ty2
caucgauuuuagcgcaucgcu

SEQ ID NO: 3686798 - RNA, 14 nt, Salmonella enterica enterica serovar Typhi Ty2
caucgauuuuucau

SEQ ID NO: 3686799 - RNA, 14 nt, Salmonella enterica enterica serovar Typhi Ty2
caucgcaaaauucc

SEQ ID NO: 3686800 - RNA, 20 nt, Salmonella enterica enterica serovar Typhi Ty2
caucgcauauugcguaucgu

SEQ ID NO: 3686801 - RNA, 18 nt, Salmonella enterica enterica serovar Typhi Ty2
caucgcauuaacguccau

SEQ ID NO: 3686802 - RNA, 19 nt, Salmonella enterica enterica serovar Typhi Ty2
caucgccacaugcggcagg

SEQ ID NO: 3686803 - RNA, 18 nt, Salmonella enterica enterica serovar Typhi Ty2
caucgccaccgcauggaa

SEQ ID NO: 3686804 - RNA, 20 nt, Salmonella enterica enterica serovar Typhi Ty2
caucgccauccugcagccau

SEQ ID NO: 3686805 - RNA, 21 nt, Salmonella enterica enterica serovar Typhi Ty2
caucgcccugauggcgcgcca

SEQ ID NO: 3686806 - RNA, 18 nt, Salmonella enterica enterica serovar Typhi Ty2
caucgccgcaagcggcaa

SEQ ID NO: 3686807 - RNA, 19 nt, Salmonella enterica enterica serovar Typhi Ty2
caucgccgcaaugaccaca

SEQ ID NO: 3686808 - RNA, 16 nt, Salmonella enterica enterica serovar Typhi Ty2
caucgccgcccagugg

SEQ ID NO: 3686809 - RNA, 19 nt, Salmonella enterica enterica serovar Typhi Ty2
caucgccugaucgcgcaga

SEQ ID NO: 3686810 - RNA, 13 nt, Salmonella enterica enterica serovar Typhi Ty2
caucgccugauga

SEQ ID NO: 3686811 - RNA, 12 nt, Salmonella enterica enterica serovar Typhi Ty2
caucuuauauuu

SEQ ID NO: 3686812 - RNA, 16 nt, Salmonella enterica enterica serovar Typhi Ty2
caucuuauauuuuggu

SEQ ID NO: 3686813 - RNA, 14 nt, Salmonella enterica enterica serovar Typhi Ty2
caucuuaucaggcc

SEQ ID NO: 3686814 - RNA, 17 nt, Salmonella enterica enterica serovar Typhi Ty2
caucuucaccuuuccag

SEQ ID NO: 3686815 - RNA, 13 nt, Salmonella enterica enterica serovar Typhi Ty2
caucuucacuuca

SEQ ID NO: 3686816 - RNA, 12 nt, Salmonella enterica enterica serovar Typhi Ty2
caucuucagcaa

SEQ ID NO: 3686817 - RNA, 12 nt, Salmonella enterica enterica serovar Typhi Ty2
caucuuccagua

SEQ ID NO: 3686818 - RNA, 23 nt, Salmonella enterica enterica serovar Typhi Ty2
caucuuccucacagccuugccag

SEQ ID NO: 3686819 - RNA, 14 nt, Salmonella enterica enterica serovar Typhi Ty2
caucuucgcccggc

SEQ ID NO: 3686820 - RNA, 20 nt, Salmonella enterica enterica serovar Typhi Ty2
caucuucggcgggaucucca

SEQ ID NO: 3686821 - RNA, 13 nt, Salmonella enterica enterica serovar Typhi Ty2
caucuucugcguc

SEQ ID NO: 3686822 - RNA, 17 nt, Salmonella enterica enterica serovar Typhi Ty2
caucuuuaaccgccugc

SEQ ID NO: 3686823 - RNA, 21 nt, Salmonella enterica enterica serovar Typhi Ty2
caucuuuaccaaugugcaaag

SEQ ID NO: 3686824 - RNA, 22 nt, Salmonella enterica enterica serovar Typhi Ty2
caucuuucacccauugaacccg

SEQ ID NO: 3686825 - RNA, 14 nt, Salmonella enterica enterica serovar Typhi Ty2
caucuuucuuuucg

SEQ ID NO: 3686826 - RNA, 21 nt, Salmonella enterica enterica serovar Typhi Ty2
caucuuugccaaacugcugga

SEQ ID NO: 3686827 - RNA, 15 nt, Salmonella enterica enterica serovar Typhi Ty2
caucuuuuacaggcc

SEQ ID NO: 3686828 - RNA, 14 nt, Salmonella enterica enterica serovar Typhi Ty2
caucuuuuccggca

SEQ ID NO: 3686829 - RNA, 17 nt, Salmonella enterica enterica serovar Typhi Ty2
caucuuuuugcucaagc

SEQ ID NO: 3686830 - RNA, 16 nt, Salmonella enterica enterica serovar Typhi Ty2
caugaaaaauauaaaa

SEQ ID NO: 3686831 - RNA, 16 nt, Salmonella enterica enterica serovar Typhi Ty2
caugaacguuaucggc

SEQ ID NO: 3686832 - RNA, 23 nt, Salmonella enterica enterica serovar Typhi Ty2
caugaacguuggcgauaaggucg

SEQ ID NO: 3686833 - RNA, 14 nt, Salmonella enterica enterica serovar Typhi Ty2
caugaagaaaauac

SEQ ID NO: 3686834 - RNA, 24 nt, Salmonella enterica enterica serovar Typhi Ty2
caugaagauggucuguaccaccag

SEQ ID NO: 3686835 - RNA, 23 nt, Salmonella enterica enterica serovar Typhi Ty2
caugaauaucaaaccacgcugag

SEQ ID NO: 3686836 - RNA, 19 nt, Salmonella enterica enterica serovar Typhi Ty2
caugaaucaucacaauuag

SEQ ID NO: 3686837 - RNA, 12 nt, Salmonella enterica enterica serovar Typhi Ty2
caugaauugccg

SEQ ID NO: 3686838 - RNA, 14 nt, Salmonella enterica enterica serovar Typhi Ty2
caugacauccauga

SEQ ID NO: 3686839 - RNA, 14 nt, Salmonella enterica enterica serovar Typhi Ty2
caugaccaccagcg

SEQ ID NO: 3686840 - RNA, 14 nt, Salmonella enterica enterica serovar Typhi Ty2
caugaccagcgccg

SEQ ID NO: 3686841 - RNA, 16 nt, Salmonella enterica enterica serovar Typhi Ty2
caugaccagcgccgcg

SEQ ID NO: 3686842 - RNA, 16 nt, Salmonella enterica enterica serovar Typhi Ty2
caugaccggaugugcc

SEQ ID NO: 3686843 - RNA, 17 nt, Salmonella enterica enterica serovar Typhi Ty2
caugaccugggcgccag

SEQ ID NO: 3686844 - RNA, 19 nt, Salmonella enterica enterica serovar Typhi Ty2
caugacgucguuguccggc

SEQ ID NO: 3686845 - RNA, 18 nt, Salmonella enterica enterica serovar Typhi Ty2
caugacuuuuuucaaccu

SEQ ID NO: 3686846 - RNA, 13 nt, Salmonella enterica enterica serovar Typhi Ty2
caugagaagaaaa

SEQ ID NO: 3686847 - RNA, 16 nt, Salmonella enterica enterica serovar Typhi Ty2
caugagccagcccuca

SEQ ID NO: 3686848 - RNA, 18 nt, Salmonella enterica enterica serovar Typhi Ty2
caugagucgcgcgcgcca

SEQ ID NO: 3686849 - RNA, 18 nt, Salmonella enterica enterica serovar Typhi Ty2
caugauacccagcguccc

SEQ ID NO: 3686850 - RNA, 21 nt, Salmonella enterica enterica serovar Typhi Ty2
caugauacccagcgucccggc

SEQ ID NO: 3686851 - RNA, 19 nt, Salmonella enterica enterica serovar Typhi Ty2
caugauaguaucgcugcua

SEQ ID NO: 3686852 - RNA, 23 nt, Salmonella enterica enterica serovar Typhi Ty2
caugauaguaucgcugcuaaacg

SEQ ID NO: 3686853 - RNA, 16 nt, Salmonella enterica enterica serovar Typhi Ty2
caugaucauacugccg

SEQ ID NO: 3686854 - RNA, 21 nt, Salmonella enterica enterica serovar Typhi Ty2
caugaucauacugccgccgug

SEQ ID NO: 3686855 - RNA, 17 nt, Salmonella enterica enterica serovar Typhi Ty2
caugauccugguccggc

SEQ ID NO: 3686856 - RNA, 21 nt, Salmonella enterica enterica serovar Typhi Ty2
caugaucggcuggguuuccgg

SEQ ID NO: 3686857 - RNA, 12 nt, Salmonella enterica enterica serovar Typhi Ty2
caugaucgucag

SEQ ID NO: 3686858 - RNA, 19 nt, Salmonella enterica enterica serovar Typhi Ty2
caugaucucuugcauaaua

SEQ ID NO: 3686859 - RNA, 13 nt, Salmonella enterica enterica serovar Typhi Ty2
caugaucuuuccu

SEQ ID NO: 3686860 - RNA, 13 nt, Salmonella enterica enterica serovar Typhi Ty2
caugaugaagaua

SEQ ID NO: 3686861 - RNA, 17 nt, Salmonella enterica enterica serovar Typhi Ty2
caugaugagcgccauau

SEQ ID NO: 3686862 - RNA, 14 nt, Salmonella enterica enterica serovar Typhi Ty2
caugaugaucuuca

SEQ ID NO: 3686863 - RNA, 15 nt, Salmonella enterica enterica serovar Typhi Ty2
caugaugaucuucag

SEQ ID NO: 3686864 - RNA, 16 nt, Salmonella enterica enterica serovar Typhi Ty2
caugaugaucuucagc

SEQ ID NO: 3686865 - RNA, 20 nt, Salmonella enterica enterica serovar Typhi Ty2
caugauggcgaacagcccca

SEQ ID NO: 3686866 - RNA, 16 nt, Salmonella enterica enterica serovar Typhi Ty2
caugauggcguaaucc

SEQ ID NO: 3686867 - RNA, 15 nt, Salmonella enterica enterica serovar Typhi Ty2
caugauggugaacag

SEQ ID NO: 3686868 - RNA, 17 nt, Salmonella enterica enterica serovar Typhi Ty2
caugauggugaacagaa

SEQ ID NO: 3686869 - RNA, 22 nt, Salmonella enterica enterica serovar Typhi Ty2
caugauguuuuaacacacaguu

SEQ ID NO: 3686870 - RNA, 16 nt, Salmonella enterica enterica serovar Typhi Ty2
caugauuaaagccacg

SEQ ID NO: 3686871 - RNA, 22 nt, Salmonella enterica enterica serovar Typhi Ty2
caugauuaaagccacgucugau

SEQ ID NO: 3686872 - RNA, 22 nt, Salmonella enterica enterica serovar Typhi Ty2
caugauucuugcggauuaucgu

SEQ ID NO: 3686873 - RNA, 20 nt, Salmonella enterica enterica serovar Typhi Ty2
caugauuucuugagcggcau

SEQ ID NO: 3686874 - RNA, 12 nt, Salmonella enterica enterica serovar Typhi Ty2
caugcaaaaaag

SEQ ID NO: 3686875 - RNA, 17 nt, Salmonella enterica enterica serovar Typhi Ty2
caugcaaaaaagagggu

SEQ ID NO: 3686876 - RNA, 17 nt, Salmonella enterica enterica serovar Typhi Ty2
caugcaaaaaagcccau

SEQ ID NO: 3686877 - RNA, 23 nt, Salmonella enterica enterica serovar Typhi Ty2
caugcaaaaugcuucuucaaccu

SEQ ID NO: 3686878 - RNA, 16 nt, Salmonella enterica enterica serovar Typhi Ty2
caugcaacuucaccuc

SEQ ID NO: 3686879 - RNA, 18 nt, Salmonella enterica enterica serovar Typhi Ty2
caugcaagagucccagaa

SEQ ID NO: 3686880 - RNA, 21 nt, Salmonella enterica enterica serovar Typhi Ty2
caugcacgcuuuuuugcuggc

SEQ ID NO: 3686881 - RNA, 22 nt, Salmonella enterica enterica serovar Typhi Ty2
caugcagagcaacgagaaccca

SEQ ID NO: 3686882 - RNA, 15 nt, Salmonella enterica enterica serovar Typhi Ty2
caugcagcucaagcg

SEQ ID NO: 3686883 - RNA, 16 nt, Salmonella enterica enterica serovar Typhi Ty2
caugcagcucaagcgc

SEQ ID NO: 3686884 - RNA, 18 nt, Salmonella enterica enterica serovar Typhi Ty2
caugcauaaugcagccau

SEQ ID NO: 3686885 - RNA, 18 nt, Salmonella enterica enterica serovar Typhi Ty2
caugcaucucuucaaaca

SEQ ID NO: 3686886 - RNA, 17 nt, Salmonella enterica enterica serovar Typhi Ty2
caugcauuaaugggcga

SEQ ID NO: 3686887 - RNA, 13 nt, Salmonella enterica enterica serovar Typhi Ty2
caugccagaagca

SEQ ID NO: 3686888 - RNA, 16 nt, Salmonella enterica enterica serovar Typhi Ty2
caugccagaagcaaau

SEQ ID NO: 3686889 - RNA, 17 nt, Salmonella enterica enterica serovar Typhi Ty2
caugccagaagcaaauu

SEQ ID NO: 3686890 - RNA, 15 nt, Salmonella enterica enterica serovar Typhi Ty2
caugccagaauugca

SEQ ID NO: 3686891 - RNA, 17 nt, Salmonella enterica enterica serovar Typhi Ty2
caugccagauuuuccag

SEQ ID NO: 3686892 - RNA, 22 nt, Salmonella enterica enterica serovar Typhi Ty2
caugccagcaguuuuucaaucu

SEQ ID NO: 3686893 - RNA, 23 nt, Salmonella enterica enterica serovar Typhi Ty2
cauguccggcgacuccagaauau

SEQ ID NO: 3686894 - RNA, 13 nt, Salmonella enterica enterica serovar Typhi Ty2
caugucguuagaa

SEQ ID NO: 3686895 - RNA, 22 nt, Salmonella enterica enterica serovar Typhi Ty2
caugucugucuaugcacaggcg

SEQ ID NO: 3686896 - RNA, 20 nt, Salmonella enterica enterica serovar Typhi Ty2
caugugacggcauguccggc

SEQ ID NO: 3686897 - RNA, 22 nt, Salmonella enterica enterica serovar Typhi Ty2
cauguggccagcggccagccau

SEQ ID NO: 3686898 - RNA, 16 nt, Salmonella enterica enterica serovar Typhi Ty2
caugugguaggcuuca

SEQ ID NO: 3686899 - RNA, 22 nt, Salmonella enterica enterica serovar Typhi Ty2
cauguguaauguuuucugccag

SEQ ID NO: 3686900 - RNA, 19 nt, Salmonella enterica enterica serovar Typhi Ty2
cauguguggguaggguugc

SEQ ID NO: 3686901 - RNA, 19 nt, Salmonella enterica enterica serovar Typhi Ty2
cauguuagcaaaaaugccg

SEQ ID NO: 3686902 - RNA, 21 nt, Salmonella enterica enterica serovar Typhi Ty2
cauguucaugaaccacgccaa

SEQ ID NO: 3686903 - RNA, 17 nt, Salmonella enterica enterica serovar Typhi Ty2
cauguucccaugucagc

SEQ ID NO: 3686904 - RNA, 17 nt, Salmonella enterica enterica serovar Typhi Ty2
cauguuccgccccgccu

SEQ ID NO: 3686905 - RNA, 23 nt, Salmonella enterica enterica serovar Typhi Ty2
cauguugaucguaaaaugaaaaa

SEQ ID NO: 3686906 - RNA, 17 nt, Salmonella enterica enterica serovar Typhi Ty2
cauguugccaugaucca

SEQ ID NO: 3686907 - RNA, 21 nt, Salmonella enterica enterica serovar Typhi Ty2
cauguugcggguuucugaaua

SEQ ID NO: 3686908 - RNA, 19 nt, Salmonella enterica enterica serovar Typhi Ty2
cauguugcguaaauaaaua

SEQ ID NO: 3686909 - RNA, 15 nt, Salmonella enterica enterica serovar Typhi Ty2
cauguuuccccuucu

SEQ ID NO: 3686910 - RNA, 10 nt, Salmonella enterica enterica serovar Typhi Ty2
cauuaaaaaa

SEQ ID NO: 3686911 - RNA, 14 nt, Salmonella enterica enterica serovar Typhi Ty2
cauuaaaaaaacau

SEQ ID NO: 3686912 - RNA, 16 nt, Salmonella enterica enterica serovar Typhi Ty2
cauuaaagaaggcgcg

SEQ ID NO: 3686913 - RNA, 14 nt, Salmonella enterica enterica serovar Typhi Ty2
cauuaacccggccc

SEQ ID NO: 3686914 - RNA, 23 nt, Salmonella enterica enterica serovar Typhi Ty2
cauuaacgaggcgcuugcuaccc

SEQ ID NO: 3686915 - RNA, 12 nt, Salmonella enterica enterica serovar Typhi Ty2
cauuaacgccau

SEQ ID NO: 3686916 - RNA, 16 nt, Salmonella enterica enterica serovar Typhi Ty2
cauuaauacacugcgu

SEQ ID NO: 3686917 - RNA, 17 nt, Salmonella enterica enterica serovar Typhi Ty2
cauuaauacaggccagc

SEQ ID NO: 3686918 - RNA, 17 nt, Salmonella enterica enterica serovar Typhi Ty2
cauuaauaucagcccca

SEQ ID NO: 3686919 - RNA, 17 nt, Salmonella enterica enterica serovar Typhi Ty2
cauuaaucgccauugca

SEQ ID NO: 3686920 - RNA, 13 nt, Salmonella enterica enterica serovar Typhi Ty2
cauuacauccuca

SEQ ID NO: 3686921 - RNA, 13 nt, Salmonella enterica enterica serovar Typhi Ty2
cauuacccccgcc

SEQ ID NO: 3686922 - RNA, 13 nt, Salmonella enterica enterica serovar Typhi Ty2
cauuaccuuuucc

SEQ ID NO: 3686923 - RNA, 17 nt, Salmonella enterica enterica serovar Typhi Ty2
cauuaccuuuuccggcg

SEQ ID NO: 3686924 - RNA, 20 nt, Salmonella enterica enterica serovar Typhi Ty2
cauuacugaccgagaucagg

SEQ ID NO: 3686925 - RNA, 15 nt, Salmonella enterica enterica serovar Typhi Ty2
cauuacuguaaaccg

SEQ ID NO: 3686926 - RNA, 23 nt, Salmonella enterica enterica serovar Typhi Ty2
cauuagacaguuuuuucguucca

SEQ ID NO: 3686927 - RNA, 20 nt, Salmonella enterica enterica serovar Typhi Ty2
cauuagcgcgauaaaaccac

SEQ ID NO: 3686928 - RNA, 20 nt, Salmonella enterica enterica serovar Typhi Ty2
cauuagcggcauugaagagu

SEQ ID NO: 3686929 - RNA, 20 nt, Salmonella enterica enterica serovar Typhi Ty2
cauuaggcguaauuauuaca

SEQ ID NO: 3686930 - RNA, 22 nt, Salmonella enterica enterica serovar Typhi Ty2
cauuaggcuuuucauucagcgc

SEQ ID NO: 3686931 - RNA, 15 nt, Salmonella enterica enterica serovar Typhi Ty2
cauuauaaauaucau

SEQ ID NO: 3686932 - RNA, 15 nt, Salmonella enterica enterica serovar Typhi Ty2
cauuaucgaacugaa

SEQ ID NO: 3686933 - RNA, 19 nt, Salmonella enterica enterica serovar Typhi Ty2
cauuaucgaugcguauuuc

SEQ ID NO: 3686934 - RNA, 19 nt, Salmonella enterica enterica serovar Typhi Ty2
cauuaugaucgguuuuuuu

SEQ ID NO: 3686935 - RNA, 14 nt, Salmonella enterica enterica serovar Typhi Ty2
cauuaugcuggguu

SEQ ID NO: 3686936 - RNA, 16 nt, Salmonella enterica enterica serovar Typhi Ty2
cauuauuuggauuacg

SEQ ID NO: 3686937 - RNA, 16 nt, Salmonella enterica enterica serovar Typhi Ty2
cauuauuuuuaaauaa

SEQ ID NO: 3686938 - RNA, 14 nt, Salmonella enterica enterica serovar Typhi Ty2
cauucaacgcauca

SEQ ID NO: 3686939 - RNA, 15 nt, Salmonella enterica enterica serovar Typhi Ty2
cauucaacgcaucaa

SEQ ID NO: 3686940 - RNA, 19 nt, Salmonella enterica enterica serovar Typhi Ty2
cauucaacgcaucaaauac

SEQ ID NO: 3686941 - RNA, 15 nt, Salmonella enterica enterica serovar Typhi Ty2
cauucacacuccagg

SEQ ID NO: 3686942 - RNA, 20 nt, Salmonella enterica enterica serovar Typhi Ty2
cauucacccaauaaauaaua

SEQ ID NO: 3686943 - RNA, 13 nt, Salmonella enterica enterica serovar Typhi Ty2
cauucacgccacc

SEQ ID NO: 3686944 - RNA, 16 nt, Salmonella enterica enterica serovar Typhi Ty2
cauucacgccaccauc

SEQ ID NO: 3686945 - RNA, 13 nt, Salmonella enterica enterica serovar Typhi Ty2
cauucagagcguc

SEQ ID NO: 3686946 - RNA, 19 nt, Salmonella enterica enterica serovar Typhi Ty2
cauucagcagcgcccagcc

SEQ ID NO: 3686947 - RNA, 23 nt, Salmonella enterica enterica serovar Typhi Ty2
cauucaggcaggcgaaaccggcc

SEQ ID NO: 3686948 - RNA, 15 nt, Salmonella enterica enterica serovar Typhi Ty2
cauucaggccucugc

SEQ ID NO: 3686949 - RNA, 18 nt, Salmonella enterica enterica serovar Typhi Ty2
cauucaggccucugcuuu

SEQ ID NO: 3686950 - RNA, 14 nt, Salmonella enterica enterica serovar Typhi Ty2
cauucaggcuuucc

SEQ ID NO: 3686951 - RNA, 14 nt, Salmonella enterica enterica serovar Typhi Ty2
cauucauaaaagau

SEQ ID NO: 3686952 - RNA, 18 nt, Salmonella enterica enterica serovar Typhi Ty2
cauucauaagcaaacagu

SEQ ID NO: 3686953 - RNA, 16 nt, Salmonella enterica enterica serovar Typhi Ty2
cauucauugccgccag

SEQ ID NO: 3686954 - RNA, 19 nt, Salmonella enterica enterica serovar Typhi Ty2
cauucauugucuuuuucuc

SEQ ID NO: 3686955 - RNA, 19 nt, Salmonella enterica enterica serovar Typhi Ty2
cauucauuuuaucgauaau

SEQ ID NO: 3686956 - RNA, 12 nt, Salmonella enterica enterica serovar Typhi Ty2
cauuccagccgg

SEQ ID NO: 3686957 - RNA, 13 nt, Salmonella enterica enterica serovar Typhi Ty2
cauuccccacgcc

SEQ ID NO: 3686958 - RNA, 17 nt, Salmonella enterica enterica serovar Typhi Ty2
cauuccccacgcugacg

SEQ ID NO: 3686959 - RNA, 17 nt, Salmonella enterica enterica serovar Typhi Ty2
cauucccguaaaagaag

SEQ ID NO: 3686960 - RNA, 12 nt, Salmonella enterica enterica serovar Typhi Ty2
cauuccgccugc

SEQ ID NO: 3686961 - RNA, 22 nt, Salmonella enterica enterica serovar Typhi Ty2
cauuccgcgcaaauacugaaau

SEQ ID NO: 3686962 - RNA, 16 nt, Salmonella enterica enterica serovar Typhi Ty2
cauuccugccgccgca

SEQ ID NO: 3686963 - RNA, 17 nt, Salmonella enterica enterica serovar Typhi Ty2
cauuccuuuagcuucca

SEQ ID NO: 3686964 - RNA, 18 nt, Salmonella enterica enterica serovar Typhi Ty2
cauuccuuuagcuuccag

SEQ ID NO: 3686965 - RNA, 17 nt, Salmonella enterica enterica serovar Typhi Ty2
cauucgaauccuccugu

SEQ ID NO: 3686966 - RNA, 15 nt, Salmonella enterica enterica serovar Typhi Ty2
cauucgauaaccgcc

SEQ ID NO: 3686967 - RNA, 20 nt, Salmonella enterica enterica serovar Typhi Ty2
cauucgaucuguguacuuuu

SEQ ID NO: 3686968 - RNA, 23 nt, Salmonella enterica enterica serovar Typhi Ty2
cauucgcagcaaaaucuucuggc

SEQ ID NO: 3686969 - RNA, 17 nt, Salmonella enterica enterica serovar Typhi Ty2
cauucgcccagucauca

SEQ ID NO: 3686970 - RNA, 16 nt, Salmonella enterica enterica serovar Typhi Ty2
cauucgccccagcaua

SEQ ID NO: 3686971 - RNA, 16 nt, Salmonella enterica enterica serovar Typhi Ty2
cauucgcgcacggcgc

SEQ ID NO: 3686972 - RNA, 22 nt, Salmonella enterica enterica serovar Typhi Ty2
cauucgggacaaacccccagcc

SEQ ID NO: 3686973 - RNA, 15 nt, Salmonella enterica enterica serovar Typhi Ty2
cauucgguaguucca

SEQ ID NO: 3686974 - RNA, 20 nt, Salmonella enterica enterica serovar Typhi Ty2
cauucguuuugcugauauga

SEQ ID NO: 3686975 - RNA, 14 nt, Salmonella enterica enterica serovar Typhi Ty2
cauuucuccugcau

SEQ ID NO: 3686976 - RNA, 12 nt, Salmonella enterica enterica serovar Typhi Ty2
cauuucugccug

SEQ ID NO: 3686977 - RNA, 16 nt, Salmonella enterica enterica serovar Typhi Ty2
cauuucugccugcuuc

SEQ ID NO: 3686978 - RNA, 21 nt, Salmonella enterica enterica serovar Typhi Ty2
cauuucuucaagcguuuccag

SEQ ID NO: 3686979 - RNA, 14 nt, Salmonella enterica enterica serovar Typhi Ty2
cauuucuuccagca

SEQ ID NO: 3686980 - RNA, 14 nt, Salmonella enterica enterica serovar Typhi Ty2
cauuucuucuucaa

SEQ ID NO: 3686981 - RNA, 17 nt, Salmonella enterica enterica serovar Typhi Ty2
cauuucuuguugacgac

SEQ ID NO: 3686982 - RNA, 17 nt, Salmonella enterica enterica serovar Typhi Ty2
cauuugauuuguuuuuu

SEQ ID NO: 3686983 - RNA, 12 nt, Salmonella enterica enterica serovar Typhi Ty2
cauuugcagguu

SEQ ID NO: 3686984 - RNA, 14 nt, Salmonella enterica enterica serovar Typhi Ty2
cauuugcagguuac

SEQ ID NO: 3686985 - RNA, 22 nt, Salmonella enterica enterica serovar Typhi Ty2
cauuugcagguuacucacugcc

SEQ ID NO: 3686986 - RNA, 17 nt, Salmonella enterica enterica serovar Typhi Ty2
cauuuggcuuaaauaau

SEQ ID NO: 3686987 - RNA, 14 nt, Salmonella enterica enterica serovar Typhi Ty2
cauuuguacaaaaa

SEQ ID NO: 3686988 - RNA, 15 nt, Salmonella enterica enterica serovar Typhi Ty2
cauuuguacaaaaaa

SEQ ID NO: 3686989 - RNA, 22 nt, Salmonella enterica enterica serovar Typhi Ty2
cauuugucucuuacguugcauu

SEQ ID NO: 3686990 - RNA, 13 nt, Salmonella enterica enterica serovar Typhi Ty2
cauuuguuccucg

SEQ ID NO: 3686991 - RNA, 20 nt, Salmonella enterica enterica serovar Typhi Ty2
cauuuguuccucgaaacgcu

SEQ ID NO: 3686992 - RNA, 21 nt, Salmonella enterica enterica serovar Typhi Ty2
cauuuguuccucgaaacgcug

SEQ ID NO: 3686993 - RNA, 17 nt, Salmonella enterica enterica serovar Typhi Ty2
cauuuuaccuuuaaacu

SEQ ID NO: 3686994 - RNA, 14 nt, Salmonella enterica enterica serovar Typhi Ty2
cauuuuauccucuu

SEQ ID NO: 3686995 - RNA, 15 nt, Salmonella enterica enterica serovar Typhi Ty2
cauuuuauccucuuc

SEQ ID NO: 3686996 - RNA, 17 nt, Salmonella enterica enterica serovar Typhi Ty2
cauuuuauuuaaaaagg

SEQ ID NO: 3686997 - RNA, 15 nt, Salmonella enterica enterica serovar Typhi Ty2
cauuuuccgcugucu

SEQ ID NO: 3686998 - RNA, 20 nt, Salmonella enterica enterica serovar Typhi Ty2
cauuuuccgcugucuaucca

SEQ ID NO: 3686999 - RNA, 19 nt, Salmonella enterica enterica serovar Typhi Ty2
cauuuuccggcgacgcuuu

SEQ ID NO: 3687000 - RNA, 15 nt, Salmonella enterica enterica serovar Typhi Ty2
cauuuucuuauuuau

SEQ ID NO: 3687001 - RNA, 16 nt, Salmonella enterica enterica serovar Typhi Ty2
cauuuucuuucaucaa

SEQ ID NO: 3687002 - RNA, 19 nt, Salmonella enterica enterica serovar Typhi Ty2
cauuuugguuggcgacuuc

SEQ ID NO: 3687003 - RNA, 22 nt, Salmonella enterica enterica serovar Typhi Ty2
cauuuuguggcggauacgcuuc

SEQ ID NO: 3687004 - RNA, 13 nt, Salmonella enterica enterica serovar Typhi Ty2
cauuuuucccgau

SEQ ID NO: 3687005 - RNA, 18 nt, Salmonella enterica enterica serovar Typhi Ty2
cauuuuucgcccacaucu

SEQ ID NO: 3687006 - RNA, 13 nt, Salmonella enterica enterica serovar Typhi Ty2
cauuuuugccauu

SEQ ID NO: 3687007 - RNA, 14 nt, Salmonella enterica enterica serovar Typhi Ty2
cauuuuuucagccu

SEQ ID NO: 3687008 - RNA, 15 nt, Salmonella enterica enterica serovar Typhi Ty2
cauuuuuucagccug

SEQ ID NO: 3687009 - RNA, 15 nt, Salmonella enterica enterica serovar Typhi Ty2
cauuuuuuucagccu

SEQ ID NO: 3687010 - RNA, 16 nt, Salmonella enterica enterica serovar Typhi Ty2
cauuuuuuuggcuucu

SEQ ID NO: 3687011 - RNA, 22 nt, Salmonella enterica enterica serovar Typhi Ty2
cauuuuuuuguccgucauuuac

SEQ ID NO: 3687012 - RNA, 20 nt, Salmonella enterica enterica serovar Typhi Ty2
cauuuuuuuugcaugguagu

SEQ ID NO: 3687013 - RNA, 13 nt, Salmonella enterica enterica serovar Typhi Ty2
ccaaaaaccccga

SEQ ID NO: 3687014 - RNA, 17 nt, Salmonella enterica enterica serovar Typhi Ty2
ccaaaaauaacgcccug

SEQ ID NO: 3687015 - RNA, 16 nt, Salmonella enterica enterica serovar Typhi Ty2
ccaaaaccacagugac

SEQ ID NO: 3687016 - RNA, 14 nt, Salmonella enterica enterica serovar Typhi Ty2
ccaaaacgaacagg

SEQ ID NO: 3687017 - RNA, 16 nt, Salmonella enterica enterica serovar Typhi Ty2
ccaaaauaauaaaaau

SEQ ID NO: 3687018 - RNA, 17 nt, Salmonella enterica enterica serovar Typhi Ty2
ccaaaauagauaaucgc

SEQ ID NO: 3687019 - RNA, 19 nt, Salmonella enterica enterica serovar Typhi Ty2
ccaaaaugcgcaaagcaua

SEQ ID NO: 3687020 - RNA, 15 nt, Salmonella enterica enterica serovar Typhi Ty2
ccaaacacuuccccu

SEQ ID NO: 3687021 - RNA, 13 nt, Salmonella enterica enterica serovar Typhi Ty2
ccaaacagcggcu

SEQ ID NO: 3687022 - RNA, 18 nt, Salmonella enterica enterica serovar Typhi Ty2
ccaaacaucgcucgcgcc

SEQ ID NO: 3687023 - RNA, 19 nt, Salmonella enterica enterica serovar Typhi Ty2
ccaaacaucgcucgcgcca

SEQ ID NO: 3687024 - RNA, 22 nt, Salmonella enterica enterica serovar Typhi Ty2
ccaaaccacugauggaguuuca

SEQ ID NO: 3687025 - RNA, 19 nt, Salmonella enterica enterica serovar Typhi Ty2
ccaaacgaauuuaaauagc

SEQ ID NO: 3687026 - RNA, 20 nt, Salmonella enterica enterica serovar Typhi Ty2
ccaaacgacgcguuucacau

SEQ ID NO: 3687027 - RNA, 13 nt, Salmonella enterica enterica serovar Typhi Ty2
ccaaacggcagcu

SEQ ID NO: 3687028 - RNA, 19 nt, Salmonella enterica enterica serovar Typhi Ty2
ccaaacuccucacugcgua

SEQ ID NO: 3687029 - RNA, 18 nt, Salmonella enterica enterica serovar Typhi Ty2
ccaaacugcgcgccgccc

SEQ ID NO: 3687030 - RNA, 19 nt, Salmonella enterica enterica serovar Typhi Ty2
ccaaacuggcaaauaaaau

SEQ ID NO: 3687031 - RNA, 15 nt, Salmonella enterica enterica serovar Typhi Ty2
ccaaacuggcugugc

SEQ ID NO: 3687032 - RNA, 22 nt, Salmonella enterica enterica serovar Typhi Ty2
ccaaacuggcugugccaauaac

SEQ ID NO: 3687033 - RNA, 14 nt, Salmonella enterica enterica serovar Typhi Ty2
ccaaagauaagacc

SEQ ID NO: 3687034 - RNA, 14 nt, Salmonella enterica enterica serovar Typhi Ty2
ccaaagcagcugcu

SEQ ID NO: 3687035 - RNA, 18 nt, Salmonella enterica enterica serovar Typhi Ty2
ccaaagccaggccgccag

SEQ ID NO: 3687036 - RNA, 18 nt, Salmonella enterica enterica serovar Typhi Ty2
ccaaagcgcauccgguaa

SEQ ID NO: 3687037 - RNA, 16 nt, Salmonella enterica enterica serovar Typhi Ty2
ccaaagcgcuacaggg

SEQ ID NO: 3687038 - RNA, 15 nt, Salmonella enterica enterica serovar Typhi Ty2
ccaaagcgcugcugc

SEQ ID NO: 3687039 - RNA, 17 nt, Salmonella enterica enterica serovar Typhi Ty2
ccaaagcgcugcugcuc

SEQ ID NO: 3687040 - RNA, 18 nt, Salmonella enterica enterica serovar Typhi Ty2
ccaaagucaucaauugcu

SEQ ID NO: 3687041 - RNA, 13 nt, Salmonella enterica enterica serovar Typhi Ty2
ccaaagucauugc

SEQ ID NO: 3687042 - RNA, 17 nt, Salmonella enterica enterica serovar Typhi Ty2
ccaaagugguuccaggc

SEQ ID NO: 3687043 - RNA, 19 nt, Salmonella enterica enterica serovar Typhi Ty2
ccaaagugguuccaggcgc

SEQ ID NO: 3687044 - RNA, 15 nt, Salmonella enterica enterica serovar Typhi Ty2
ccaaaguuaaucagc

SEQ ID NO: 3687045 - RNA, 22 nt, Salmonella enterica enterica serovar Typhi Ty2
ccaaaguuaaucagcgccgucg

SEQ ID NO: 3687046 - RNA, 16 nt, Salmonella enterica enterica serovar Typhi Ty2
ccaaauaaaagccgcc

SEQ ID NO: 3687047 - RNA, 19 nt, Salmonella enterica enterica serovar Typhi Ty2
ccaaauaaaagccgccgug

SEQ ID NO: 3687048 - RNA, 15 nt, Salmonella enterica enterica serovar Typhi Ty2
ccaaauaacccaggg

SEQ ID NO: 3687049 - RNA, 23 nt, Salmonella enterica enterica serovar Typhi Ty2
ccaaauagcacgugcaugggaua

SEQ ID NO: 3687050 - RNA, 20 nt, Salmonella enterica enterica serovar Typhi Ty2
ccaaauaguccagcagccau

SEQ ID NO: 3687051 - RNA, 12 nt, Salmonella enterica enterica serovar Typhi Ty2
ccaaauauuucu

SEQ ID NO: 3687052 - RNA, 16 nt, Salmonella enterica enterica serovar Typhi Ty2
ccaaaucuguucuguc

SEQ ID NO: 3687053 - RNA, 21 nt, Salmonella enterica enterica serovar Typhi Ty2
ccaaaugccugccguuuuuaa

SEQ ID NO: 3687054 - RNA, 13 nt, Salmonella enterica enterica serovar Typhi Ty2
ccaacaacccauu

SEQ ID NO: 3687055 - RNA, 19 nt, Salmonella enterica enterica serovar Typhi Ty2
ccaacaaggauauccgcca

SEQ ID NO: 3687056 - RNA, 19 nt, Salmonella enterica enterica serovar Typhi Ty2
ccaacaaugccacgccccu

SEQ ID NO: 3687057 - RNA, 17 nt, Salmonella enterica enterica serovar Typhi Ty2
ccacagcgccagacacu

SEQ ID NO: 3687058 - RNA, 13 nt, Salmonella enterica enterica serovar Typhi Ty2
ccacagcgguaua

SEQ ID NO: 3687059 - RNA, 23 nt, Salmonella enterica enterica serovar Typhi Ty2
ccacaggaaccgguagccaggcg

SEQ ID NO: 3687060 - RNA, 23 nt, Salmonella enterica enterica serovar Typhi Ty2
ccacaggaccacguucccgauuc

SEQ ID NO: 3687061 - RNA, 16 nt, Salmonella enterica enterica serovar Typhi Ty2
ccacaggccaacauag

SEQ ID NO: 3687062 - RNA, 9 nt, Salmonella enterica enterica serovar Typhi Ty2
ccacaggcu

SEQ ID NO: 3687063 - RNA, 17 nt, Salmonella enterica enterica serovar Typhi Ty2
ccacagguuaucgccgc

SEQ ID NO: 3687064 - RNA, 21 nt, Salmonella enterica enterica serovar Typhi Ty2
ccacagucauggcuuuuaccc

SEQ ID NO: 3687065 - RNA, 17 nt, Salmonella enterica enterica serovar Typhi Ty2
ccacagucgucuggcgc

SEQ ID NO: 3687066 - RNA, 20 nt, Salmonella enterica enterica serovar Typhi Ty2
ccacagucgucuggcgcuau

SEQ ID NO: 3687067 - RNA, 20 nt, Salmonella enterica enterica serovar Typhi Ty2
ccacaguugcgacugauaac

SEQ ID NO: 3687068 - RNA, 22 nt, Salmonella enterica enterica serovar Typhi Ty2
ccacaguugguucugcucaaug

SEQ ID NO: 3687069 - RNA, 15 nt, Salmonella enterica enterica serovar Typhi Ty2
ccacauagcauccag

SEQ ID NO: 3687070 - RNA, 17 nt, Salmonella enterica enterica serovar Typhi Ty2
ccacauagcauccagac

SEQ ID NO: 3687071 - RNA, 19 nt, Salmonella enterica enterica serovar Typhi Ty2
ccacauauaaguaacuggu

SEQ ID NO: 3687072 - RNA, 22 nt, Salmonella enterica enterica serovar Typhi Ty2
ccacaucagaccgccaagcgcg

SEQ ID NO: 3687073 - RNA, 12 nt, Salmonella enterica enterica serovar Typhi Ty2
ccacaucagcgg

SEQ ID NO: 3687074 - RNA, 17 nt, Salmonella enterica enterica serovar Typhi Ty2
ccacauccaccccgguu

SEQ ID NO: 3687075 - RNA, 21 nt, Salmonella enterica enterica serovar Typhi Ty2
ccacaucggauuauuuucacg

SEQ ID NO: 3687076 - RNA, 17 nt, Salmonella enterica enterica serovar Typhi Ty2
ccacaugaccagcgccg

SEQ ID NO: 3687077 - RNA, 20 nt, Salmonella enterica enterica serovar Typhi Ty2
ccacaugaccagcgccgcga

SEQ ID NO: 3687078 - RNA, 23 nt, Salmonella enterica enterica serovar Typhi Ty2
ccacaugccggugcgagaaaaag

SEQ ID NO: 3687079 - RNA, 15 nt, Salmonella enterica enterica serovar Typhi Ty2
ccacauuacgcccau

SEQ ID NO: 3687080 - RNA, 20 nt, Salmonella enterica enterica serovar Typhi Ty2
ccaccaaagccaggccgcca

SEQ ID NO: 3687081 - RNA, 18 nt, Salmonella enterica enterica serovar Typhi Ty2
ccaccaauuucaccggau

SEQ ID NO: 3687082 - RNA, 11 nt, Salmonella enterica enterica serovar Typhi Ty2
ccaccacaaac

SEQ ID NO: 3687083 - RNA, 19 nt, Salmonella enterica enterica serovar Typhi Ty2
ccaccacccagugccacca

SEQ ID NO: 3687084 - RNA, 13 nt, Salmonella enterica enterica serovar Typhi Ty2
ccaccacgcccaa

SEQ ID NO: 3687085 - RNA, 18 nt, Salmonella enterica enterica serovar Typhi Ty2
ccaccacguaaugcgccc

SEQ ID NO: 3687086 - RNA, 20 nt, Salmonella enterica enterica serovar Typhi Ty2
ccaccacguuaccgcgcagu

SEQ ID NO: 3687087 - RNA, 20 nt, Salmonella enterica enterica serovar Typhi Ty2
ccaccagaaucgccagcauc

SEQ ID NO: 3687088 - RNA, 14 nt, Salmonella enterica enterica serovar Typhi Ty2
ccaccagaucuuca

SEQ ID NO: 3687089 - RNA, 18 nt, Salmonella enterica enterica serovar Typhi Ty2
ccaccagccggagccggu

SEQ ID NO: 3687090 - RNA, 12 nt, Salmonella enterica enterica serovar Typhi Ty2
ccaccagcgcca

SEQ ID NO: 3687091 - RNA, 16 nt, Salmonella enterica enterica serovar Typhi Ty2
ccaccagcgccagcgg

SEQ ID NO: 3687092 - RNA, 17 nt, Salmonella enterica enterica serovar Typhi Ty2
ccaccagcgccaggcca

SEQ ID NO: 3687093 - RNA, 13 nt, Salmonella enterica enterica serovar Typhi Ty2
ccaccagcgccau

SEQ ID NO: 3687094 - RNA, 22 nt, Salmonella enterica enterica serovar Typhi Ty2
ccaccagcgccauaauccagaa

SEQ ID NO: 3687095 - RNA, 23 nt, Salmonella enterica enterica serovar Typhi Ty2
ccaccagcgccauaauccagaau

SEQ ID NO: 3687096 - RNA, 16 nt, Salmonella enterica enterica serovar Typhi Ty2
ccaccagcuuaucuga

SEQ ID NO: 3687097 - RNA, 16 nt, Salmonella enterica enterica serovar Typhi Ty2
ccaccaggaacgccau

SEQ ID NO: 3687098 - RNA, 15 nt, Salmonella enterica enterica serovar Typhi Ty2
ccaccauaggccagc

SEQ ID NO: 3687099 - RNA, 19 nt, Salmonella enterica enterica serovar Typhi Ty2
ccaccauauucgccaccgc

SEQ ID NO: 3687100 - RNA, 21 nt, Salmonella enterica enterica serovar Typhi Ty2
ccaccauauucgccaccgcgc

SEQ ID NO: 3687101 - RNA, 17 nt, Salmonella enterica enterica serovar Typhi Ty2
ccaccaucagacccgau

SEQ ID NO: 3687102 - RNA, 18 nt, Salmonella enterica enterica serovar Typhi Ty2
ccaccauuacgcccccuc

SEQ ID NO: 3687103 - RNA, 18 nt, Salmonella enterica enterica serovar Typhi Ty2
ccacccagugccaccagc

SEQ ID NO: 3687104 - RNA, 16 nt, Salmonella enterica enterica serovar Typhi Ty2
ccacccauuuuccgcu

SEQ ID NO: 3687105 - RNA, 13 nt, Salmonella enterica enterica serovar Typhi Ty2
ccacccgcuauga

SEQ ID NO: 3687106 - RNA, 15 nt, Salmonella enterica enterica serovar Typhi Ty2
ccacccgcuaugaag

SEQ ID NO: 3687107 - RNA, 17 nt, Salmonella enterica enterica serovar Typhi Ty2
ccacccggcuuuuuuau

SEQ ID NO: 3687108 - RNA, 22 nt, Salmonella enterica enterica serovar Typhi Ty2
ccacccgggccggaagagcgca

SEQ ID NO: 3687109 - RNA, 11 nt, Salmonella enterica enterica serovar Typhi Ty2
ccaccgaauuc

SEQ ID NO: 3687110 - RNA, 18 nt, Salmonella enterica enterica serovar Typhi Ty2
ccaccgcauuuucagcuu

SEQ ID NO: 3687111 - RNA, 15 nt, Salmonella enterica enterica serovar Typhi Ty2
ccaccgccaaccgcc

SEQ ID NO: 3687112 - RNA, 16 nt, Salmonella enterica enterica serovar Typhi Ty2
ccaccgccagacgccc

SEQ ID NO: 3687113 - RNA, 17 nt, Salmonella enterica enterica serovar Typhi Ty2
ccaccgccgccaccaaa

SEQ ID NO: 3687114 - RNA, 15 nt, Salmonella enterica enterica serovar Typhi Ty2
ccaccgccucgccaa

SEQ ID NO: 3687115 - RNA, 12 nt, Salmonella enterica enterica serovar Typhi Ty2
ccaccgcugaug

SEQ ID NO: 3687116 - RNA, 22 nt, Salmonella enterica enterica serovar Typhi Ty2
ccaccgcugauggcguggcgca

SEQ ID NO: 3687117 - RNA, 23 nt, Salmonella enterica enterica serovar Typhi Ty2
ccaccggagcggcguccgccagc

SEQ ID NO: 3687118 - RNA, 24 nt, Salmonella enterica enterica serovar Typhi Ty2
ccaccgggcaacccggcuaaauga

SEQ ID NO: 3687119 - RNA, 14 nt, Salmonella enterica enterica serovar Typhi Ty2
ccaccgggccguca

SEQ ID NO: 3687120 - RNA, 22 nt, Salmonella enterica enterica serovar Typhi Ty2
ccaccggguccagucgcgccgc

SEQ ID NO: 3687121 - RNA, 20 nt, Salmonella enterica enterica serovar Typhi Ty2
ccaccggguuaaagcccuga

SEQ ID NO: 3687122 - RNA, 15 nt, Salmonella enterica enterica serovar Typhi Ty2
ccaccucaaacgaug

SEQ ID NO: 3687123 - RNA, 17 nt, Salmonella enterica enterica serovar Typhi Ty2
ccaccucaaucaccguu

SEQ ID NO: 3687124 - RNA, 21 nt, Salmonella enterica enterica serovar Typhi Ty2
ccaccugccaggcuucgcgca

SEQ ID NO: 3687125 - RNA, 15 nt, Salmonella enterica enterica serovar Typhi Ty2
ccaccugccaguccg

SEQ ID NO: 3687126 - RNA, 21 nt, Salmonella enterica enterica serovar Typhi Ty2
ccaccuggcccugcaucagcu

SEQ ID NO: 3687127 - RNA, 21 nt, Salmonella enterica enterica serovar Typhi Ty2
ccaccuuaaucgacuucaugc

SEQ ID NO: 3687128 - RNA, 13 nt, Salmonella enterica enterica serovar Typhi Ty2
ccaccuucgcgga

SEQ ID NO: 3687129 - RNA, 15 nt, Salmonella enterica enterica serovar Typhi Ty2
ccaccuuucugcucc

SEQ ID NO: 3687130 - RNA, 15 nt, Salmonella enterica enterica serovar Typhi Ty2
ccacgaaaauuauuu

SEQ ID NO: 3687131 - RNA, 18 nt, Salmonella enterica enterica serovar Typhi Ty2
ccacgaaaauuauuuucg

SEQ ID NO: 3687132 - RNA, 20 nt, Salmonella enterica enterica serovar Typhi Ty2
ccacgaacgauauaaaaacc

SEQ ID NO: 3687133 - RNA, 16 nt, Salmonella enterica enterica serovar Typhi Ty2
ccacgaaucaggauau

SEQ ID NO: 3687134 - RNA, 15 nt, Salmonella enterica enterica serovar Typhi Ty2
ccacgaaugccgaua

SEQ ID NO: 3687135 - RNA, 16 nt, Salmonella enterica enterica serovar Typhi Ty2
ccacgacaauauccuc

SEQ ID NO: 3687136 - RNA, 15 nt, Salmonella enterica enterica serovar Typhi Ty2
ccacgacauccggaa

SEQ ID NO: 3687137 - RNA, 17 nt, Salmonella enterica enterica serovar Typhi Ty2
ccacgacggccggaccu

SEQ ID NO: 3687138 - RNA, 16 nt, Salmonella enterica enterica serovar Typhi Ty2
ccacgagaaauccaca

SEQ ID NO: 3687139 - RNA, 17 nt, Salmonella enterica enterica serovar Typhi Ty2
ccacuuuugucggccug

SEQ ID NO: 3687140 - RNA, 20 nt, Salmonella enterica enterica serovar Typhi Ty2
ccagaaaaccgacagcaaua

SEQ ID NO: 3687141 - RNA, 17 nt, Salmonella enterica enterica serovar Typhi Ty2
ccagaaacgguccugau

SEQ ID NO: 3687142 - RNA, 15 nt, Salmonella enterica enterica serovar Typhi Ty2
ccagaaagaucagca

SEQ ID NO: 3687143 - RNA, 22 nt, Salmonella enterica enterica serovar Typhi Ty2
ccagaaaucgcucaugcgcguc

SEQ ID NO: 3687144 - RNA, 21 nt, Salmonella enterica enterica serovar Typhi Ty2
ccagaaccucaccguccgcca

SEQ ID NO: 3687145 - RNA, 18 nt, Salmonella enterica enterica serovar Typhi Ty2
ccagaacgagaggaggag

SEQ ID NO: 3687146 - RNA, 23 nt, Salmonella enterica enterica serovar Typhi Ty2
ccagaacguugacguuucaguca

SEQ ID NO: 3687147 - RNA, 14 nt, Salmonella enterica enterica serovar Typhi Ty2
ccagaacucaucuu

SEQ ID NO: 3687148 - RNA, 21 nt, Salmonella enterica enterica serovar Typhi Ty2
ccagaacugcgaaaucaccga

SEQ ID NO: 3687149 - RNA, 12 nt, Salmonella enterica enterica serovar Typhi Ty2
ccagaagaaaau

SEQ ID NO: 3687150 - RNA, 12 nt, Salmonella enterica enterica serovar Typhi Ty2
ccagaagcacuu

SEQ ID NO: 3687151 - RNA, 18 nt, Salmonella enterica enterica serovar Typhi Ty2
ccagaagcgcuuugccaa

SEQ ID NO: 3687152 - RNA, 13 nt, Salmonella enterica enterica serovar Typhi Ty2
ccagaaggcaaaa

SEQ ID NO: 3687153 - RNA, 22 nt, Salmonella enterica enterica serovar Typhi Ty2
ccagaaggcaaaaugccagccc

SEQ ID NO: 3687154 - RNA, 14 nt, Salmonella enterica enterica serovar Typhi Ty2
ccagaaggcaggcu

SEQ ID NO: 3687155 - RNA, 18 nt, Salmonella enterica enterica serovar Typhi Ty2
ccagaaggcgaacauaag

SEQ ID NO: 3687156 - RNA, 23 nt, Salmonella enterica enterica serovar Typhi Ty2
ccagaaguagcagagaaaagguu

SEQ ID NO: 3687157 - RNA, 15 nt, Salmonella enterica enterica serovar Typhi Ty2
ccagaauacaccgcc

SEQ ID NO: 3687158 - RNA, 18 nt, Salmonella enterica enterica serovar Typhi Ty2
ccagaauacacuucucaa

SEQ ID NO: 3687159 - RNA, 19 nt, Salmonella enterica enterica serovar Typhi Ty2
ccagaauacgccgccgccc

SEQ ID NO: 3687160 - RNA, 23 nt, Salmonella enterica enterica serovar Typhi Ty2
ccagaaucaguaacacaaucagg

SEQ ID NO: 3687161 - RNA, 14 nt, Salmonella enterica enterica serovar Typhi Ty2
ccagaaucagugac

SEQ ID NO: 3687162 - RNA, 22 nt, Salmonella enterica enterica serovar Typhi Ty2
ccagaaucccgccuugcggcgc

SEQ ID NO: 3687163 - RNA, 13 nt, Salmonella enterica enterica serovar Typhi Ty2
ccagaauccgcgc

SEQ ID NO: 3687164 - RNA, 13 nt, Salmonella enterica enterica serovar Typhi Ty2
ccagaaucuggcc

SEQ ID NO: 3687165 - RNA, 17 nt, Salmonella enterica enterica serovar Typhi Ty2
ccagaaugccagcgccg

SEQ ID NO: 3687166 - RNA, 18 nt, Salmonella enterica enterica serovar Typhi Ty2
ccagaaugcccagcaagg

SEQ ID NO: 3687167 - RNA, 21 nt, Salmonella enterica enterica serovar Typhi Ty2
ccagaaugcccugcuguucca

SEQ ID NO: 3687168 - RNA, 23 nt, Salmonella enterica enterica serovar Typhi Ty2
ccagacaaaaucuuuccagcucc

SEQ ID NO: 3687169 - RNA, 14 nt, Salmonella enterica enterica serovar Typhi Ty2
ccagacaagcacau

SEQ ID NO: 3687170 - RNA, 16 nt, Salmonella enterica enterica serovar Typhi Ty2
ccagacaagcacauaa

SEQ ID NO: 3687171 - RNA, 17 nt, Salmonella enterica enterica serovar Typhi Ty2
ccagacacggugugccg

SEQ ID NO: 3687172 - RNA, 20 nt, Salmonella enterica enterica serovar Typhi Ty2
ccagacacggugugccgcca

SEQ ID NO: 3687173 - RNA, 19 nt, Salmonella enterica enterica serovar Typhi Ty2
ccagacagauuuggucagu

SEQ ID NO: 3687174 - RNA, 14 nt, Salmonella enterica enterica serovar Typhi Ty2
ccagacagcccaac

SEQ ID NO: 3687175 - RNA, 13 nt, Salmonella enterica enterica serovar Typhi Ty2
ccagacaggacgc

SEQ ID NO: 3687176 - RNA, 15 nt, Salmonella enterica enterica serovar Typhi Ty2
ccagacaugcacaug

SEQ ID NO: 3687177 - RNA, 15 nt, Salmonella enterica enterica serovar Typhi Ty2
ccagacaugcgccgg

SEQ ID NO: 3687178 - RNA, 15 nt, Salmonella enterica enterica serovar Typhi Ty2
ccagaccaauagaga

SEQ ID NO: 3687179 - RNA, 22 nt, Salmonella enterica enterica serovar Typhi Ty2
ccagaccgauauuuugcugcac

SEQ ID NO: 3687180 - RNA, 14 nt, Salmonella enterica enterica serovar Typhi Ty2
ccagaccgcuuaac

SEQ ID NO: 3687181 - RNA, 21 nt, Salmonella enterica enterica serovar Typhi Ty2
ccagaccggauugcccgcggc

SEQ ID NO: 3687182 - RNA, 13 nt, Salmonella enterica enterica serovar Typhi Ty2
ccagaccggcgac

SEQ ID NO: 3687183 - RNA, 23 nt, Salmonella enterica enterica serovar Typhi Ty2
ccagaccugaauauucggcucca

SEQ ID NO: 3687184 - RNA, 21 nt, Salmonella enterica enterica serovar Typhi Ty2
ccagacgaacggccugaucaa

SEQ ID NO: 3687185 - RNA, 18 nt, Salmonella enterica enterica serovar Typhi Ty2
ccagacgaccguaauagc

SEQ ID NO: 3687186 - RNA, 13 nt, Salmonella enterica enterica serovar Typhi Ty2
ccagacgauaagg

SEQ ID NO: 3687187 - RNA, 19 nt, Salmonella enterica enterica serovar Typhi Ty2
ccagacgcguaaccccugc

SEQ ID NO: 3687188 - RNA, 15 nt, Salmonella enterica enterica serovar Typhi Ty2
ccagacggcgcuguu

SEQ ID NO: 3687189 - RNA, 17 nt, Salmonella enterica enterica serovar Typhi Ty2
ccagacgggccaggcga

SEQ ID NO: 3687190 - RNA, 16 nt, Salmonella enterica enterica serovar Typhi Ty2
ccagacucaccccuuc

SEQ ID NO: 3687191 - RNA, 16 nt, Salmonella enterica enterica serovar Typhi Ty2
ccagacucagccaggu

SEQ ID NO: 3687192 - RNA, 22 nt, Salmonella enterica enterica serovar Typhi Ty2
ccagacuccuuuuaccggcgaa

SEQ ID NO: 3687193 - RNA, 15 nt, Salmonella enterica enterica serovar Typhi Ty2
ccagacucgcucccu

SEQ ID NO: 3687194 - RNA, 16 nt, Salmonella enterica enterica serovar Typhi Ty2
ccagacuuuccagcac

SEQ ID NO: 3687195 - RNA, 18 nt, Salmonella enterica enterica serovar Typhi Ty2
ccagacuuuccagcacga

SEQ ID NO: 3687196 - RNA, 16 nt, Salmonella enterica enterica serovar Typhi Ty2
ccagagccccaaugcu

SEQ ID NO: 3687197 - RNA, 18 nt, Salmonella enterica enterica serovar Typhi Ty2
ccagagccccaaugcuuu

SEQ ID NO: 3687198 - RNA, 15 nt, Salmonella enterica enterica serovar Typhi Ty2
ccagagcgcgcuggc

SEQ ID NO: 3687199 - RNA, 18 nt, Salmonella enterica enterica serovar Typhi Ty2
ccagauaaauagcgcugg

SEQ ID NO: 3687200 - RNA, 14 nt, Salmonella enterica enterica serovar Typhi Ty2
ccagauaaaucagc

SEQ ID NO: 3687201 - RNA, 16 nt, Salmonella enterica enterica serovar Typhi Ty2
ccagauaaaucagccc

SEQ ID NO: 3687202 - RNA, 21 nt, Salmonella enterica enterica serovar Typhi Ty2
ccagauaagcucuccuggaug

SEQ ID NO: 3687203 - RNA, 14 nt, Salmonella enterica enterica serovar Typhi Ty2
ccagauaaggcuca

SEQ ID NO: 3687204 - RNA, 16 nt, Salmonella enterica enterica serovar Typhi Ty2
ccagauaauccagcgu

SEQ ID NO: 3687205 - RNA, 22 nt, Salmonella enterica enterica serovar Typhi Ty2
ccagauaaucgccgccagcuca

SEQ ID NO: 3687206 - RNA, 21 nt, Salmonella enterica enterica serovar Typhi Ty2
ccagauacaaaucucagggug

SEQ ID NO: 3687207 - RNA, 14 nt, Salmonella enterica enterica serovar Typhi Ty2
ccagauacauggcu

SEQ ID NO: 3687208 - RNA, 19 nt, Salmonella enterica enterica serovar Typhi Ty2
ccagauacccuuuaucgcg

SEQ ID NO: 3687209 - RNA, 14 nt, Salmonella enterica enterica serovar Typhi Ty2
ccagauacgcgccg

SEQ ID NO: 3687210 - RNA, 17 nt, Salmonella enterica enterica serovar Typhi Ty2
ccagauacgcgccggcc

SEQ ID NO: 3687211 - RNA, 19 nt, Salmonella enterica enterica serovar Typhi Ty2
ccagauagaaccacgcaaa

SEQ ID NO: 3687212 - RNA, 13 nt, Salmonella enterica enterica serovar Typhi Ty2
ccagauagcgcug

SEQ ID NO: 3687213 - RNA, 18 nt, Salmonella enterica enterica serovar Typhi Ty2
ccagauagcgcugcgcca

SEQ ID NO: 3687214 - RNA, 16 nt, Salmonella enterica enterica serovar Typhi Ty2
ccagauaguggcugag

SEQ ID NO: 3687215 - RNA, 22 nt, Salmonella enterica enterica serovar Typhi Ty2
ccagauaucgcguacaggaugu

SEQ ID NO: 3687216 - RNA, 17 nt, Salmonella enterica enterica serovar Typhi Ty2
ccagauauugccgacca

SEQ ID NO: 3687217 - RNA, 15 nt, Salmonella enterica enterica serovar Typhi Ty2
ccagauauuuuuccg

SEQ ID NO: 3687218 - RNA, 12 nt, Salmonella enterica enterica serovar Typhi Ty2
ccagaucauuac

SEQ ID NO: 3687219 - RNA, 17 nt, Salmonella enterica enterica serovar Typhi Ty2
ccagaucgauauccgug

SEQ ID NO: 3687220 - RNA, 21 nt, Salmonella enterica enterica serovar Typhi Ty2
ccagaucgcgguaacggccug

SEQ ID NO: 3687221 - RNA, 20 nt, Salmonella enterica enterica serovar Typhi Ty2
ccagcaucaugggcucauca

SEQ ID NO: 3687222 - RNA, 13 nt, Salmonella enterica enterica serovar Typhi Ty2
ccagcaucccgcu

SEQ ID NO: 3687223 - RNA, 13 nt, Salmonella enterica enterica serovar Typhi Ty2
ccagcaucgacca

SEQ ID NO: 3687224 - RNA, 17 nt, Salmonella enterica enterica serovar Typhi Ty2
ccagcaucgaccaggau

SEQ ID NO: 3687225 - RNA, 17 nt, Salmonella enterica enterica serovar Typhi Ty2
ccagcaucggcagcgcc

SEQ ID NO: 3687226 - RNA, 21 nt, Salmonella enterica enterica serovar Typhi Ty2
ccagcaucgguagaaugaaug

SEQ ID NO: 3687227 - RNA, 15 nt, Salmonella enterica enterica serovar Typhi Ty2
ccagcaugagccagc

SEQ ID NO: 3687228 - RNA, 11 nt, Salmonella enterica enterica serovar Typhi Ty2
ccagcauggcg

SEQ ID NO: 3687229 - RNA, 18 nt, Salmonella enterica enterica serovar Typhi Ty2
ccagcauggcgucggcga

SEQ ID NO: 3687230 - RNA, 17 nt, Salmonella enterica enterica serovar Typhi Ty2
ccagcauuuccagcugg

SEQ ID NO: 3687231 - RNA, 20 nt, Salmonella enterica enterica serovar Typhi Ty2
ccagcauuuccagcugguua

SEQ ID NO: 3687232 - RNA, 16 nt, Salmonella enterica enterica serovar Typhi Ty2
ccagcauuucuucaag

SEQ ID NO: 3687233 - RNA, 12 nt, Salmonella enterica enterica serovar Typhi Ty2
ccagccacaaga

SEQ ID NO: 3687234 - RNA, 13 nt, Salmonella enterica enterica serovar Typhi Ty2
ccagccacugacu

SEQ ID NO: 3687235 - RNA, 16 nt, Salmonella enterica enterica serovar Typhi Ty2
ccagccagacgccagc

SEQ ID NO: 3687236 - RNA, 17 nt, Salmonella enterica enterica serovar Typhi Ty2
ccagccagacgccagcc

SEQ ID NO: 3687237 - RNA, 18 nt, Salmonella enterica enterica serovar Typhi Ty2
ccagccaggaaccgccga

SEQ ID NO: 3687238 - RNA, 18 nt, Salmonella enterica enterica serovar Typhi Ty2
ccagccagggaucaagca

SEQ ID NO: 3687239 - RNA, 16 nt, Salmonella enterica enterica serovar Typhi Ty2
ccagccaguccuccgg

SEQ ID NO: 3687240 - RNA, 22 nt, Salmonella enterica enterica serovar Typhi Ty2
ccagccaguuagcgaucgcgcc

SEQ ID NO: 3687241 - RNA, 14 nt, Salmonella enterica enterica serovar Typhi Ty2
ccagccauaaauau

SEQ ID NO: 3687242 - RNA, 17 nt, Salmonella enterica enterica serovar Typhi Ty2
ccagccauaaaugcuga

SEQ ID NO: 3687243 - RNA, 17 nt, Salmonella enterica enterica serovar Typhi Ty2
ccagccauagcagcaaa

SEQ ID NO: 3687244 - RNA, 14 nt, Salmonella enterica enterica serovar Typhi Ty2
ccagccaugccaua

SEQ ID NO: 3687245 - RNA, 21 nt, Salmonella enterica enterica serovar Typhi Ty2
ccagccauggcccuuuugccc

SEQ ID NO: 3687246 - RNA, 16 nt, Salmonella enterica enterica serovar Typhi Ty2
ccagccauuaaagaag

SEQ ID NO: 3687247 - RNA, 18 nt, Salmonella enterica enterica serovar Typhi Ty2
ccagccauugcugacaaa

SEQ ID NO: 3687248 - RNA, 18 nt, Salmonella enterica enterica serovar Typhi Ty2
ccagcccaauacgccagc

SEQ ID NO: 3687249 - RNA, 19 nt, Salmonella enterica enterica serovar Typhi Ty2
ccagcccaauacgccagcc

SEQ ID NO: 3687250 - RNA, 18 nt, Salmonella enterica enterica serovar Typhi Ty2
ccagcccaugaaggagca

SEQ ID NO: 3687251 - RNA, 13 nt, Salmonella enterica enterica serovar Typhi Ty2
ccagccccagccc

SEQ ID NO: 3687252 - RNA, 14 nt, Salmonella enterica enterica serovar Typhi Ty2
ccagccccagcccu

SEQ ID NO: 3687253 - RNA, 17 nt, Salmonella enterica enterica serovar Typhi Ty2
ccagcccccagccgauc

SEQ ID NO: 3687254 - RNA, 15 nt, Salmonella enterica enterica serovar Typhi Ty2
ccagcccccugccag

SEQ ID NO: 3687255 - RNA, 14 nt, Salmonella enterica enterica serovar Typhi Ty2
ccagcccgccgccc

SEQ ID NO: 3687256 - RNA, 18 nt, Salmonella enterica enterica serovar Typhi Ty2
ccagcccgccgcccuccg

SEQ ID NO: 3687257 - RNA, 22 nt, Salmonella enterica enterica serovar Typhi Ty2
ccagcccggaaauaaacgccag

SEQ ID NO: 3687258 - RNA, 22 nt, Salmonella enterica enterica serovar Typhi Ty2
ccagcccuaaaaauagcaccag

SEQ ID NO: 3687259 - RNA, 19 nt, Salmonella enterica enterica serovar Typhi Ty2
ccagcccucaacauugccg

SEQ ID NO: 3687260 - RNA, 18 nt, Salmonella enterica enterica serovar Typhi Ty2
ccagcccugcgaucauca

SEQ ID NO: 3687261 - RNA, 21 nt, Salmonella enterica enterica serovar Typhi Ty2
ccagccgagcgguaagagcca

SEQ ID NO: 3687262 - RNA, 17 nt, Salmonella enterica enterica serovar Typhi Ty2
ccagccgaucagcgcca

SEQ ID NO: 3687263 - RNA, 18 nt, Salmonella enterica enterica serovar Typhi Ty2
ccagccgaucaucacgaa

SEQ ID NO: 3687264 - RNA, 15 nt, Salmonella enterica enterica serovar Typhi Ty2
ccagccgaucuauuu

SEQ ID NO: 3687265 - RNA, 21 nt, Salmonella enterica enterica serovar Typhi Ty2
ccagccgauuucauaccacug

SEQ ID NO: 3687266 - RNA, 19 nt, Salmonella enterica enterica serovar Typhi Ty2
ccagccgcaucuuauauuu

SEQ ID NO: 3687267 - RNA, 13 nt, Salmonella enterica enterica serovar Typhi Ty2
ccagccgccgccg

SEQ ID NO: 3687268 - RNA, 19 nt, Salmonella enterica enterica serovar Typhi Ty2
ccagccgcgccaucuccuc

SEQ ID NO: 3687269 - RNA, 20 nt, Salmonella enterica enterica serovar Typhi Ty2
ccagccggaaaagcgcuggc

SEQ ID NO: 3687270 - RNA, 17 nt, Salmonella enterica enterica serovar Typhi Ty2
ccagccgggcaggaaaa

SEQ ID NO: 3687271 - RNA, 19 nt, Salmonella enterica enterica serovar Typhi Ty2
ccagccgguguuaaccaga

SEQ ID NO: 3687272 - RNA, 18 nt, Salmonella enterica enterica serovar Typhi Ty2
ccagccguucaccagcca

SEQ ID NO: 3687273 - RNA, 16 nt, Salmonella enterica enterica serovar Typhi Ty2
ccagccuaccugccgc

SEQ ID NO: 3687274 - RNA, 19 nt, Salmonella enterica enterica serovar Typhi Ty2
ccagccuaccugccgccau

SEQ ID NO: 3687275 - RNA, 20 nt, Salmonella enterica enterica serovar Typhi Ty2
ccagccuaccugccgccaua

SEQ ID NO: 3687276 - RNA, 19 nt, Salmonella enterica enterica serovar Typhi Ty2
ccagccucgcgcauccggg

SEQ ID NO: 3687277 - RNA, 15 nt, Salmonella enterica enterica serovar Typhi Ty2
ccagccucucccagc

SEQ ID NO: 3687278 - RNA, 19 nt, Salmonella enterica enterica serovar Typhi Ty2
ccagccugaacaucuucca

SEQ ID NO: 3687279 - RNA, 15 nt, Salmonella enterica enterica serovar Typhi Ty2
ccagccugccugccu

SEQ ID NO: 3687280 - RNA, 22 nt, Salmonella enterica enterica serovar Typhi Ty2
ccagccugcuggucugaaucug

SEQ ID NO: 3687281 - RNA, 16 nt, Salmonella enterica enterica serovar Typhi Ty2
ccagccugucgggcca

SEQ ID NO: 3687282 - RNA, 20 nt, Salmonella enterica enterica serovar Typhi Ty2
ccagccuuaucccaucccgc

SEQ ID NO: 3687283 - RNA, 22 nt, Salmonella enterica enterica serovar Typhi Ty2
ccagcgaaaaccagcgccgcca

SEQ ID NO: 3687284 - RNA, 23 nt, Salmonella enterica enterica serovar Typhi Ty2
ccagcgaaaugacggccaccagc

SEQ ID NO: 3687285 - RNA, 15 nt, Salmonella enterica enterica serovar Typhi Ty2
ccagcgaaccgcggc

SEQ ID NO: 3687286 - RNA, 21 nt, Salmonella enterica enterica serovar Typhi Ty2
ccagcgaacugauaaaagaga

SEQ ID NO: 3687287 - RNA, 13 nt, Salmonella enterica enterica serovar Typhi Ty2
ccagcgaauaaug

SEQ ID NO: 3687288 - RNA, 13 nt, Salmonella enterica enterica serovar Typhi Ty2
ccagcgacaguag

SEQ ID NO: 3687289 - RNA, 23 nt, Salmonella enterica enterica serovar Typhi Ty2
ccagcgacaguaguaucauccau

SEQ ID NO: 3687290 - RNA, 16 nt, Salmonella enterica enterica serovar Typhi Ty2
ccagcgacaucgcaua

SEQ ID NO: 3687291 - RNA, 23 nt, Salmonella enterica enterica serovar Typhi Ty2
ccagcgacauggcggucgccaua

SEQ ID NO: 3687292 - RNA, 20 nt, Salmonella enterica enterica serovar Typhi Ty2
ccagcgaccaccgucccagu

SEQ ID NO: 3687293 - RNA, 15 nt, Salmonella enterica enterica serovar Typhi Ty2
ccagcgacgcccagu

SEQ ID NO: 3687294 - RNA, 21 nt, Salmonella enterica enterica serovar Typhi Ty2
ccagcgacggcguauucggca

SEQ ID NO: 3687295 - RNA, 19 nt, Salmonella enterica enterica serovar Typhi Ty2
ccagcgagaugaaaaguca

SEQ ID NO: 3687296 - RNA, 18 nt, Salmonella enterica enterica serovar Typhi Ty2
ccagcgaucccaguugau

SEQ ID NO: 3687297 - RNA, 17 nt, Salmonella enterica enterica serovar Typhi Ty2
ccagcgaugagcgccag

SEQ ID NO: 3687298 - RNA, 19 nt, Salmonella enterica enterica serovar Typhi Ty2
ccagcgaugagcgccagca

SEQ ID NO: 3687299 - RNA, 22 nt, Salmonella enterica enterica serovar Typhi Ty2
ccagcgaugagcgccagcaaca

SEQ ID NO: 3687300 - RNA, 21 nt, Salmonella enterica enterica serovar Typhi Ty2
ccagcgauggggcaagcucag

SEQ ID NO: 3687301 - RNA, 22 nt, Salmonella enterica enterica serovar Typhi Ty2
ccagcgcaaagggacacucaag

SEQ ID NO: 3687302 - RNA, 15 nt, Salmonella enterica enterica serovar Typhi Ty2
ccagcgcauugacga

SEQ ID NO: 3687303 - RNA, 15 nt, Salmonella enterica enterica serovar Typhi Ty2
ccagcucguuauuuc

SEQ ID NO: 3687304 - RNA, 23 nt, Salmonella enterica enterica serovar Typhi Ty2
ccagcucugccgguugaccggcc

SEQ ID NO: 3687305 - RNA, 14 nt, Salmonella enterica enterica serovar Typhi Ty2
ccagcucuucuucg

SEQ ID NO: 3687306 - RNA, 15 nt, Salmonella enterica enterica serovar Typhi Ty2
ccagcucuucuucgc

SEQ ID NO: 3687307 - RNA, 12 nt, Salmonella enterica enterica serovar Typhi Ty2
ccagcugacgac

SEQ ID NO: 3687308 - RNA, 19 nt, Salmonella enterica enterica serovar Typhi Ty2
ccagcugacgacgccagcc

SEQ ID NO: 3687309 - RNA, 14 nt, Salmonella enterica enterica serovar Typhi Ty2
ccagcugacgcagc

SEQ ID NO: 3687310 - RNA, 15 nt, Salmonella enterica enterica serovar Typhi Ty2
ccagcugacgcagca

SEQ ID NO: 3687311 - RNA, 18 nt, Salmonella enterica enterica serovar Typhi Ty2
ccagcuguuuaagcgccu

SEQ ID NO: 3687312 - RNA, 11 nt, Salmonella enterica enterica serovar Typhi Ty2
ccagcuuaaau

SEQ ID NO: 3687313 - RNA, 14 nt, Salmonella enterica enterica serovar Typhi Ty2
ccagcuucgccccg

SEQ ID NO: 3687314 - RNA, 16 nt, Salmonella enterica enterica serovar Typhi Ty2
ccagcuucgccccggc

SEQ ID NO: 3687315 - RNA, 11 nt, Salmonella enterica enterica serovar Typhi Ty2
ccagcuugaau

SEQ ID NO: 3687316 - RNA, 19 nt, Salmonella enterica enterica serovar Typhi Ty2
ccagcuuguuauccaucag

SEQ ID NO: 3687317 - RNA, 21 nt, Salmonella enterica enterica serovar Typhi Ty2
ccaggaagaguaucucucugg

SEQ ID NO: 3687318 - RNA, 23 nt, Salmonella enterica enterica serovar Typhi Ty2
ccaggaaguaaauuauuccuuga

SEQ ID NO: 3687319 - RNA, 17 nt, Salmonella enterica enterica serovar Typhi Ty2
ccaggacaacgccggua

SEQ ID NO: 3687320 - RNA, 15 nt, Salmonella enterica enterica serovar Typhi Ty2
ccaggagcauuggaa

SEQ ID NO: 3687321 - RNA, 19 nt, Salmonella enterica enterica serovar Typhi Ty2
ccaggaguuaaaccuggua

SEQ ID NO: 3687322 - RNA, 15 nt, Salmonella enterica enterica serovar Typhi Ty2
ccaggauaauaauga

SEQ ID NO: 3687323 - RNA, 22 nt, Salmonella enterica enterica serovar Typhi Ty2
ccaggauaguacugaccagaca

SEQ ID NO: 3687324 - RNA, 13 nt, Salmonella enterica enterica serovar Typhi Ty2
ccaggauaucgcg

SEQ ID NO: 3687325 - RNA, 22 nt, Salmonella enterica enterica serovar Typhi Ty2
ccaggauccguucaucggcaua

SEQ ID NO: 3687326 - RNA, 15 nt, Salmonella enterica enterica serovar Typhi Ty2
ccaggaugccaacca

SEQ ID NO: 3687327 - RNA, 17 nt, Salmonella enterica enterica serovar Typhi Ty2
ccaggaugccaaccacc

SEQ ID NO: 3687328 - RNA, 19 nt, Salmonella enterica enterica serovar Typhi Ty2
ccaggaugccaaccaccgc

SEQ ID NO: 3687329 - RNA, 15 nt, Salmonella enterica enterica serovar Typhi Ty2
ccaggauggccagca

SEQ ID NO: 3687330 - RNA, 20 nt, Salmonella enterica enterica serovar Typhi Ty2
ccaggauggccagcaccagc

SEQ ID NO: 3687331 - RNA, 14 nt, Salmonella enterica enterica serovar Typhi Ty2
ccaggcaaaccagc

SEQ ID NO: 3687332 - RNA, 22 nt, Salmonella enterica enterica serovar Typhi Ty2
ccaggcaaagauuaccgggccc

SEQ ID NO: 3687333 - RNA, 19 nt, Salmonella enterica enterica serovar Typhi Ty2
ccaggcaaagccccaguca

SEQ ID NO: 3687334 - RNA, 22 nt, Salmonella enterica enterica serovar Typhi Ty2
ccaggcaaaugauuaucuccau

SEQ ID NO: 3687335 - RNA, 13 nt, Salmonella enterica enterica serovar Typhi Ty2
ccaggcaaucagc

SEQ ID NO: 3687336 - RNA, 19 nt, Salmonella enterica enterica serovar Typhi Ty2
ccaggcaaugccccgccgc

SEQ ID NO: 3687337 - RNA, 16 nt, Salmonella enterica enterica serovar Typhi Ty2
ccaggcaccauccggu

SEQ ID NO: 3687338 - RNA, 17 nt, Salmonella enterica enterica serovar Typhi Ty2
ccaggcaccauccggua

SEQ ID NO: 3687339 - RNA, 12 nt, Salmonella enterica enterica serovar Typhi Ty2
ccaggcagcgcg

SEQ ID NO: 3687340 - RNA, 21 nt, Salmonella enterica enterica serovar Typhi Ty2
ccaggcagcgcgccagcgcua

SEQ ID NO: 3687341 - RNA, 19 nt, Salmonella enterica enterica serovar Typhi Ty2
ccaggcagcguggcgagcu

SEQ ID NO: 3687342 - RNA, 16 nt, Salmonella enterica enterica serovar Typhi Ty2
ccaggcauaaaaaaag

SEQ ID NO: 3687343 - RNA, 11 nt, Salmonella enterica enterica serovar Typhi Ty2
ccaggcauccg

SEQ ID NO: 3687344 - RNA, 18 nt, Salmonella enterica enterica serovar Typhi Ty2
ccaggcaucgacgccagc

SEQ ID NO: 3687345 - RNA, 20 nt, Salmonella enterica enterica serovar Typhi Ty2
ccaggcaucgacgccagcgg

SEQ ID NO: 3687346 - RNA, 14 nt, Salmonella enterica enterica serovar Typhi Ty2
ccaggcauugauaa

SEQ ID NO: 3687347 - RNA, 12 nt, Salmonella enterica enterica serovar Typhi Ty2
ccaggccaaaac

SEQ ID NO: 3687348 - RNA, 21 nt, Salmonella enterica enterica serovar Typhi Ty2
ccaggccaaaaccacagugac

SEQ ID NO: 3687349 - RNA, 15 nt, Salmonella enterica enterica serovar Typhi Ty2
ccaggccagauggcu

SEQ ID NO: 3687350 - RNA, 16 nt, Salmonella enterica enterica serovar Typhi Ty2
ccaggccagcuccgcg

SEQ ID NO: 3687351 - RNA, 13 nt, Salmonella enterica enterica serovar Typhi Ty2
ccaggccaucaga

SEQ ID NO: 3687352 - RNA, 23 nt, Salmonella enterica enterica serovar Typhi Ty2
ccaggccaugcgccgcgucagca

SEQ ID NO: 3687353 - RNA, 18 nt, Salmonella enterica enterica serovar Typhi Ty2
ccaggcccagccgcuccg

SEQ ID NO: 3687354 - RNA, 16 nt, Salmonella enterica enterica serovar Typhi Ty2
ccaggccgccaccgcc

SEQ ID NO: 3687355 - RNA, 12 nt, Salmonella enterica enterica serovar Typhi Ty2
ccaggccgccag

SEQ ID NO: 3687356 - RNA, 20 nt, Salmonella enterica enterica serovar Typhi Ty2
ccaggccgucggcgccagcc

SEQ ID NO: 3687357 - RNA, 15 nt, Salmonella enterica enterica serovar Typhi Ty2
ccaggccguggcgca

SEQ ID NO: 3687358 - RNA, 21 nt, Salmonella enterica enterica serovar Typhi Ty2
ccaggccguggcgcaucuccu

SEQ ID NO: 3687359 - RNA, 17 nt, Salmonella enterica enterica serovar Typhi Ty2
ccaggccuaucagcgau

SEQ ID NO: 3687360 - RNA, 13 nt, Salmonella enterica enterica serovar Typhi Ty2
ccaggccugagcc

SEQ ID NO: 3687361 - RNA, 21 nt, Salmonella enterica enterica serovar Typhi Ty2
ccaggccugaugagcgcagcg

SEQ ID NO: 3687362 - RNA, 19 nt, Salmonella enterica enterica serovar Typhi Ty2
ccaggcgaaccccaugccg

SEQ ID NO: 3687363 - RNA, 16 nt, Salmonella enterica enterica serovar Typhi Ty2
ccaggcgauaccgcgc

SEQ ID NO: 3687364 - RNA, 18 nt, Salmonella enterica enterica serovar Typhi Ty2
ccaggcgcgaaucgacaa

SEQ ID NO: 3687365 - RNA, 17 nt, Salmonella enterica enterica serovar Typhi Ty2
ccaggcgcgcagcugcc

SEQ ID NO: 3687366 - RNA, 16 nt, Salmonella enterica enterica serovar Typhi Ty2
ccaggcggugaagacg

SEQ ID NO: 3687367 - RNA, 22 nt, Salmonella enterica enterica serovar Typhi Ty2
ccaggcuauaguggauggccca

SEQ ID NO: 3687368 - RNA, 22 nt, Salmonella enterica enterica serovar Typhi Ty2
ccaggcuuccugcgcugucacc

SEQ ID NO: 3687369 - RNA, 15 nt, Salmonella enterica enterica serovar Typhi Ty2
ccaggcuucgcgcag

SEQ ID NO: 3687370 - RNA, 15 nt, Salmonella enterica enterica serovar Typhi Ty2
ccagggaaugccaua

SEQ ID NO: 3687371 - RNA, 14 nt, Salmonella enterica enterica serovar Typhi Ty2
ccagggagggccaa

SEQ ID NO: 3687372 - RNA, 23 nt, Salmonella enterica enterica serovar Typhi Ty2
ccagggauugauggccagccccu

SEQ ID NO: 3687373 - RNA, 21 nt, Salmonella enterica enterica serovar Typhi Ty2
ccagggauuuugcuuuuucgg

SEQ ID NO: 3687374 - RNA, 22 nt, Salmonella enterica enterica serovar Typhi Ty2
ccagggcaaauuaucccuuccu

SEQ ID NO: 3687375 - RNA, 17 nt, Salmonella enterica enterica serovar Typhi Ty2
ccagggcaggcagugaa

SEQ ID NO: 3687376 - RNA, 18 nt, Salmonella enterica enterica serovar Typhi Ty2
ccagggcaucaugauguu

SEQ ID NO: 3687377 - RNA, 16 nt, Salmonella enterica enterica serovar Typhi Ty2
ccagggcaugauuaaa

SEQ ID NO: 3687378 - RNA, 14 nt, Salmonella enterica enterica serovar Typhi Ty2
ccagggcgauuccc

SEQ ID NO: 3687379 - RNA, 19 nt, Salmonella enterica enterica serovar Typhi Ty2
ccagggcgggauccccugc

SEQ ID NO: 3687380 - RNA, 21 nt, Salmonella enterica enterica serovar Typhi Ty2
ccaggggaugauuuucaggca

SEQ ID NO: 3687381 - RNA, 19 nt, Salmonella enterica enterica serovar Typhi Ty2
ccagguaacauacaaaaag

SEQ ID NO: 3687382 - RNA, 22 nt, Salmonella enterica enterica serovar Typhi Ty2
ccagguaacauacaaaaaguac

SEQ ID NO: 3687383 - RNA, 16 nt, Salmonella enterica enterica serovar Typhi Ty2
ccagguauuuagccac

SEQ ID NO: 3687384 - RNA, 17 nt, Salmonella enterica enterica serovar Typhi Ty2
ccaggucaucaccucca

SEQ ID NO: 3687385 - RNA, 21 nt, Salmonella enterica enterica serovar Typhi Ty2
ccaguuucucaaacacuucua

SEQ ID NO: 3687386 - RNA, 20 nt, Salmonella enterica enterica serovar Typhi Ty2
ccaguuugcguucacagcac

SEQ ID NO: 3687387 - RNA, 19 nt, Salmonella enterica enterica serovar Typhi Ty2
ccaguuugguuaauuccgc

SEQ ID NO: 3687388 - RNA, 20 nt, Salmonella enterica enterica serovar Typhi Ty2
ccaguuuuaaauaucauuua

SEQ ID NO: 3687389 - RNA, 15 nt, Salmonella enterica enterica serovar Typhi Ty2
ccaguuuuaagcgca

SEQ ID NO: 3687390 - RNA, 21 nt, Salmonella enterica enterica serovar Typhi Ty2
ccaguuuuugcauuauauuuu

SEQ ID NO: 3687391 - RNA, 17 nt, Salmonella enterica enterica serovar Typhi Ty2
ccaguuuuuuccagcgc

SEQ ID NO: 3687392 - RNA, 20 nt, Salmonella enterica enterica serovar Typhi Ty2
ccauaaaauaaagucagcaa

SEQ ID NO: 3687393 - RNA, 16 nt, Salmonella enterica enterica serovar Typhi Ty2
ccauaaagaagcgugc

SEQ ID NO: 3687394 - RNA, 17 nt, Salmonella enterica enterica serovar Typhi Ty2
ccauaaagcgaauaauu

SEQ ID NO: 3687395 - RNA, 13 nt, Salmonella enterica enterica serovar Typhi Ty2
ccauaaaggccuc

SEQ ID NO: 3687396 - RNA, 23 nt, Salmonella enterica enterica serovar Typhi Ty2
ccauaaaucauuacuuauauuua

SEQ ID NO: 3687397 - RNA, 17 nt, Salmonella enterica enterica serovar Typhi Ty2
ccauaacaacuauuuuu

SEQ ID NO: 3687398 - RNA, 20 nt, Salmonella enterica enterica serovar Typhi Ty2
ccauaagcuuaggauaagaa

SEQ ID NO: 3687399 - RNA, 20 nt, Salmonella enterica enterica serovar Typhi Ty2
ccauaauacuuaauucauaa

SEQ ID NO: 3687400 - RNA, 18 nt, Salmonella enterica enterica serovar Typhi Ty2
ccauaaucgauauaauuu

SEQ ID NO: 3687401 - RNA, 12 nt, Salmonella enterica enterica serovar Typhi Ty2
ccauaaugacgc

SEQ ID NO: 3687402 - RNA, 14 nt, Salmonella enterica enterica serovar Typhi Ty2
ccauaaugcaauca

SEQ ID NO: 3687403 - RNA, 20 nt, Salmonella enterica enterica serovar Typhi Ty2
ccauacacugcauaaauauc

SEQ ID NO: 3687404 - RNA, 21 nt, Salmonella enterica enterica serovar Typhi Ty2
ccauacacugcauaaauaucu

SEQ ID NO: 3687405 - RNA, 13 nt, Salmonella enterica enterica serovar Typhi Ty2
ccauacagcccau

SEQ ID NO: 3687406 - RNA, 17 nt, Salmonella enterica enterica serovar Typhi Ty2
ccauacaguggccagac

SEQ ID NO: 3687407 - RNA, 15 nt, Salmonella enterica enterica serovar Typhi Ty2
ccauaccccaucauc

SEQ ID NO: 3687408 - RNA, 16 nt, Salmonella enterica enterica serovar Typhi Ty2
ccauacccggcuccca

SEQ ID NO: 3687409 - RNA, 22 nt, Salmonella enterica enterica serovar Typhi Ty2
ccauacgauucagguuuugcug

SEQ ID NO: 3687410 - RNA, 16 nt, Salmonella enterica enterica serovar Typhi Ty2
ccauacggaugccgau

SEQ ID NO: 3687411 - RNA, 20 nt, Salmonella enterica enterica serovar Typhi Ty2
ccauacuauccaacagaagg

SEQ ID NO: 3687412 - RNA, 20 nt, Salmonella enterica enterica serovar Typhi Ty2
ccauacuccugccugacaau

SEQ ID NO: 3687413 - RNA, 16 nt, Salmonella enterica enterica serovar Typhi Ty2
ccauacuuacugcugu

SEQ ID NO: 3687414 - RNA, 14 nt, Salmonella enterica enterica serovar Typhi Ty2
ccauagacaguacg

SEQ ID NO: 3687415 - RNA, 20 nt, Salmonella enterica enterica serovar Typhi Ty2
ccauagauaccuucuucacu

SEQ ID NO: 3687416 - RNA, 22 nt, Salmonella enterica enterica serovar Typhi Ty2
ccauagcagcuccgaaacaauc

SEQ ID NO: 3687417 - RNA, 23 nt, Salmonella enterica enterica serovar Typhi Ty2
ccauagcaucgacccuugcgacc

SEQ ID NO: 3687418 - RNA, 23 nt, Salmonella enterica enterica serovar Typhi Ty2
ccauagccaacacauaagccacu

SEQ ID NO: 3687419 - RNA, 22 nt, Salmonella enterica enterica serovar Typhi Ty2
ccauagcgggcagcauugacca

SEQ ID NO: 3687420 - RNA, 22 nt, Salmonella enterica enterica serovar Typhi Ty2
ccauagcguuuaaaaagcugca

SEQ ID NO: 3687421 - RNA, 14 nt, Salmonella enterica enterica serovar Typhi Ty2
ccauaguccaugcc

SEQ ID NO: 3687422 - RNA, 18 nt, Salmonella enterica enterica serovar Typhi Ty2
ccauauaacagaauaagc

SEQ ID NO: 3687423 - RNA, 14 nt, Salmonella enterica enterica serovar Typhi Ty2
ccauauauuuacug

SEQ ID NO: 3687424 - RNA, 20 nt, Salmonella enterica enterica serovar Typhi Ty2
ccauauauuuacugaauaaa

SEQ ID NO: 3687425 - RNA, 21 nt, Salmonella enterica enterica serovar Typhi Ty2
ccauauauuuacugaauaaau

SEQ ID NO: 3687426 - RNA, 21 nt, Salmonella enterica enterica serovar Typhi Ty2
ccauaucgccgcugccgcuau

SEQ ID NO: 3687427 - RNA, 14 nt, Salmonella enterica enterica serovar Typhi Ty2
ccauauuauucugc

SEQ ID NO: 3687428 - RNA, 17 nt, Salmonella enterica enterica serovar Typhi Ty2
ccauauuccagaaagga

SEQ ID NO: 3687429 - RNA, 16 nt, Salmonella enterica enterica serovar Typhi Ty2
ccauauucuucgcaua

SEQ ID NO: 3687430 - RNA, 20 nt, Salmonella enterica enterica serovar Typhi Ty2
ccauauucuuugcgccuuau

SEQ ID NO: 3687431 - RNA, 12 nt, Salmonella enterica enterica serovar Typhi Ty2
ccauauugcugu

SEQ ID NO: 3687432 - RNA, 15 nt, Salmonella enterica enterica serovar Typhi Ty2
ccauauuuaugcagc

SEQ ID NO: 3687433 - RNA, 18 nt, Salmonella enterica enterica serovar Typhi Ty2
ccauauuuaugcagcgcg

SEQ ID NO: 3687434 - RNA, 23 nt, Salmonella enterica enterica serovar Typhi Ty2
ccauauuuuuucugccaguuucu

SEQ ID NO: 3687435 - RNA, 16 nt, Salmonella enterica enterica serovar Typhi Ty2
ccaucaaacgcagcaa

SEQ ID NO: 3687436 - RNA, 14 nt, Salmonella enterica enterica serovar Typhi Ty2
ccaucaaauaauac

SEQ ID NO: 3687437 - RNA, 17 nt, Salmonella enterica enterica serovar Typhi Ty2
ccaucaauuuugcgccu

SEQ ID NO: 3687438 - RNA, 17 nt, Salmonella enterica enterica serovar Typhi Ty2
ccaucacauguagcgcg

SEQ ID NO: 3687439 - RNA, 15 nt, Salmonella enterica enterica serovar Typhi Ty2
ccaucaccgccaguc

SEQ ID NO: 3687440 - RNA, 14 nt, Salmonella enterica enterica serovar Typhi Ty2
ccaucaccucuucg

SEQ ID NO: 3687441 - RNA, 18 nt, Salmonella enterica enterica serovar Typhi Ty2
ccaucacgaucgcgguuc

SEQ ID NO: 3687442 - RNA, 22 nt, Salmonella enterica enterica serovar Typhi Ty2
ccaucacguuggggaauaaaua

SEQ ID NO: 3687443 - RNA, 23 nt, Salmonella enterica enterica serovar Typhi Ty2
ccaucacguuggggaauaaauau

SEQ ID NO: 3687444 - RNA, 13 nt, Salmonella enterica enterica serovar Typhi Ty2
ccaucacuuccug

SEQ ID NO: 3687445 - RNA, 15 nt, Salmonella enterica enterica serovar Typhi Ty2
ccaucagauucaaca

SEQ ID NO: 3687446 - RNA, 21 nt, Salmonella enterica enterica serovar Typhi Ty2
ccaucagcaaaauaccggcag

SEQ ID NO: 3687447 - RNA, 14 nt, Salmonella enterica enterica serovar Typhi Ty2
ccaucagcacauga

SEQ ID NO: 3687448 - RNA, 19 nt, Salmonella enterica enterica serovar Typhi Ty2
ccaucagcaucccaccgga

SEQ ID NO: 3687449 - RNA, 19 nt, Salmonella enterica enterica serovar Typhi Ty2
ccaucagcccgcaaaggac

SEQ ID NO: 3687450 - RNA, 20 nt, Salmonella enterica enterica serovar Typhi Ty2
ccaucagcgccagcccugcg

SEQ ID NO: 3687451 - RNA, 14 nt, Salmonella enterica enterica serovar Typhi Ty2
ccaucaggcaauau

SEQ ID NO: 3687452 - RNA, 16 nt, Salmonella enterica enterica serovar Typhi Ty2
ccaucaggcaaucuuu

SEQ ID NO: 3687453 - RNA, 22 nt, Salmonella enterica enterica serovar Typhi Ty2
ccaucaggcaaucuuuaacgcu

SEQ ID NO: 3687454 - RNA, 17 nt, Salmonella enterica enterica serovar Typhi Ty2
ccaucaggcaauucugg

SEQ ID NO: 3687455 - RNA, 22 nt, Salmonella enterica enterica serovar Typhi Ty2
ccaucaggcaucugaaaugcuc

SEQ ID NO: 3687456 - RNA, 13 nt, Salmonella enterica enterica serovar Typhi Ty2
ccaucagggaaaa

SEQ ID NO: 3687457 - RNA, 15 nt, Salmonella enterica enterica serovar Typhi Ty2
ccaucauaccgccaa

SEQ ID NO: 3687458 - RNA, 22 nt, Salmonella enterica enterica serovar Typhi Ty2
ccaucaugcaagagucccagaa

SEQ ID NO: 3687459 - RNA, 13 nt, Salmonella enterica enterica serovar Typhi Ty2
ccaucaugcgcca

SEQ ID NO: 3687460 - RNA, 13 nt, Salmonella enterica enterica serovar Typhi Ty2
ccaucauuaauau

SEQ ID NO: 3687461 - RNA, 15 nt, Salmonella enterica enterica serovar Typhi Ty2
ccaucauuaauauaa

SEQ ID NO: 3687462 - RNA, 20 nt, Salmonella enterica enterica serovar Typhi Ty2
ccaucauugacuucaacgca

SEQ ID NO: 3687463 - RNA, 16 nt, Salmonella enterica enterica serovar Typhi Ty2
ccaucauuuccggcgg

SEQ ID NO: 3687464 - RNA, 16 nt, Salmonella enterica enterica serovar Typhi Ty2
ccauccaccagaaccu

SEQ ID NO: 3687465 - RNA, 19 nt, Salmonella enterica enterica serovar Typhi Ty2
ccauccaccaggcaugcag

SEQ ID NO: 3687466 - RNA, 14 nt, Salmonella enterica enterica serovar Typhi Ty2
ccaucccccugccg

SEQ ID NO: 3687467 - RNA, 16 nt, Salmonella enterica enterica serovar Typhi Ty2
ccauuacuaacacguu

SEQ ID NO: 3687468 - RNA, 12 nt, Salmonella enterica enterica serovar Typhi Ty2
ccauuagcgccu

SEQ ID NO: 3687469 - RNA, 17 nt, Salmonella enterica enterica serovar Typhi Ty2
ccauuaugcucaccgcg

SEQ ID NO: 3687470 - RNA, 12 nt, Salmonella enterica enterica serovar Typhi Ty2
ccauuauucgga

SEQ ID NO: 3687471 - RNA, 14 nt, Salmonella enterica enterica serovar Typhi Ty2
ccauuccaggucau

SEQ ID NO: 3687472 - RNA, 14 nt, Salmonella enterica enterica serovar Typhi Ty2
ccauucccaccaua

SEQ ID NO: 3687473 - RNA, 21 nt, Salmonella enterica enterica serovar Typhi Ty2
ccauucccagcgcccccagca

SEQ ID NO: 3687474 - RNA, 19 nt, Salmonella enterica enterica serovar Typhi Ty2
ccauuccgauagcgaaacu

SEQ ID NO: 3687475 - RNA, 15 nt, Salmonella enterica enterica serovar Typhi Ty2
ccauuccgccaacgg

SEQ ID NO: 3687476 - RNA, 12 nt, Salmonella enterica enterica serovar Typhi Ty2
ccauuccucacg

SEQ ID NO: 3687477 - RNA, 22 nt, Salmonella enterica enterica serovar Typhi Ty2
ccauucgccagcccgaucaucu

SEQ ID NO: 3687478 - RNA, 16 nt, Salmonella enterica enterica serovar Typhi Ty2
ccauucggccugcggu

SEQ ID NO: 3687479 - RNA, 13 nt, Salmonella enterica enterica serovar Typhi Ty2
ccauucugcugau

SEQ ID NO: 3687480 - RNA, 19 nt, Salmonella enterica enterica serovar Typhi Ty2
ccauucuuucgcguaaaca

SEQ ID NO: 3687481 - RNA, 22 nt, Salmonella enterica enterica serovar Typhi Ty2
ccauucuuucgcguaaacacuc

SEQ ID NO: 3687482 - RNA, 16 nt, Salmonella enterica enterica serovar Typhi Ty2
ccauugauaccaauaa

SEQ ID NO: 3687483 - RNA, 16 nt, Salmonella enterica enterica serovar Typhi Ty2
ccauugaugccugccc

SEQ ID NO: 3687484 - RNA, 21 nt, Salmonella enterica enterica serovar Typhi Ty2
ccauugaugccugcccaucua

SEQ ID NO: 3687485 - RNA, 14 nt, Salmonella enterica enterica serovar Typhi Ty2
ccauugauuuccgc

SEQ ID NO: 3687486 - RNA, 15 nt, Salmonella enterica enterica serovar Typhi Ty2
ccauugccaguaccg

SEQ ID NO: 3687487 - RNA, 11 nt, Salmonella enterica enterica serovar Typhi Ty2
ccauugccgcg

SEQ ID NO: 3687488 - RNA, 16 nt, Salmonella enterica enterica serovar Typhi Ty2
ccauugcgagaaaaaa

SEQ ID NO: 3687489 - RNA, 22 nt, Salmonella enterica enterica serovar Typhi Ty2
ccauugcuaggaacagugacaa

SEQ ID NO: 3687490 - RNA, 16 nt, Salmonella enterica enterica serovar Typhi Ty2
ccauugcugacaaaau

SEQ ID NO: 3687491 - RNA, 23 nt, Salmonella enterica enterica serovar Typhi Ty2
ccauuguugucauuguaaaaccg

SEQ ID NO: 3687492 - RNA, 11 nt, Salmonella enterica enterica serovar Typhi Ty2
ccauuucacaa

SEQ ID NO: 3687493 - RNA, 15 nt, Salmonella enterica enterica serovar Typhi Ty2
ccauuucaugaccga

SEQ ID NO: 3687494 - RNA, 18 nt, Salmonella enterica enterica serovar Typhi Ty2
ccauuucuucuucaagcc

SEQ ID NO: 3687495 - RNA, 19 nt, Salmonella enterica enterica serovar Typhi Ty2
ccauuugaaucguagcgug

SEQ ID NO: 3687496 - RNA, 15 nt, Salmonella enterica enterica serovar Typhi Ty2
ccauuugcauccgua

SEQ ID NO: 3687497 - RNA, 14 nt, Salmonella enterica enterica serovar Typhi Ty2
ccauuugccagaua

SEQ ID NO: 3687498 - RNA, 17 nt, Salmonella enterica enterica serovar Typhi Ty2
ccauuugccagauagcg

SEQ ID NO: 3687499 - RNA, 14 nt, Salmonella enterica enterica serovar Typhi Ty2
ccauuuuaaauaca

SEQ ID NO: 3687500 - RNA, 15 nt, Salmonella enterica enterica serovar Typhi Ty2
ccauuuuauccucuu

SEQ ID NO: 3687501 - RNA, 23 nt, Salmonella enterica enterica serovar Typhi Ty2
ccauuuuggggaaaauaccggua

SEQ ID NO: 3687502 - RNA, 18 nt, Salmonella enterica enterica serovar Typhi Ty2
ccauuuugguuacuauuu

SEQ ID NO: 3687503 - RNA, 21 nt, Salmonella enterica enterica serovar Typhi Ty2
ccauuuuuuuagcuuaaaaaa

SEQ ID NO: 3687504 - RNA, 13 nt, Salmonella enterica enterica serovar Typhi Ty2
cccaaaauaauuc

SEQ ID NO: 3687505 - RNA, 21 nt, Salmonella enterica enterica serovar Typhi Ty2
cccaaacugcucguaaagcau

SEQ ID NO: 3687506 - RNA, 20 nt, Salmonella enterica enterica serovar Typhi Ty2
cccaaaugaaaaaucggcaa

SEQ ID NO: 3687507 - RNA, 19 nt, Salmonella enterica enterica serovar Typhi Ty2
cccaacagcgaccacgcca

SEQ ID NO: 3687508 - RNA, 14 nt, Salmonella enterica enterica serovar Typhi Ty2
cccaaccagcccag

SEQ ID NO: 3687509 - RNA, 21 nt, Salmonella enterica enterica serovar Typhi Ty2
cccaaccaguggcggggcaga

SEQ ID NO: 3687510 - RNA, 14 nt, Salmonella enterica enterica serovar Typhi Ty2
cccaacccgaccag

SEQ ID NO: 3687511 - RNA, 20 nt, Salmonella enterica enterica serovar Typhi Ty2
cccaacgacagcacuacgcu

SEQ ID NO: 3687512 - RNA, 22 nt, Salmonella enterica enterica serovar Typhi Ty2
cccaacggaugcgccaucccau

SEQ ID NO: 3687513 - RNA, 15 nt, Salmonella enterica enterica serovar Typhi Ty2
cccaacuacacucuu

SEQ ID NO: 3687514 - RNA, 15 nt, Salmonella enterica enterica serovar Typhi Ty2
cccaauaccacaacc

SEQ ID NO: 3687515 - RNA, 13 nt, Salmonella enterica enterica serovar Typhi Ty2
cccaauaccggcg

SEQ ID NO: 3687516 - RNA, 20 nt, Salmonella enterica enterica serovar Typhi Ty2
cccaauagcgaucgagauaa

SEQ ID NO: 3687517 - RNA, 22 nt, Salmonella enterica enterica serovar Typhi Ty2
cccaaucaggcuugagcgaugg

SEQ ID NO: 3687518 - RNA, 15 nt, Salmonella enterica enterica serovar Typhi Ty2
cccaauugcugcuau

SEQ ID NO: 3687519 - RNA, 22 nt, Salmonella enterica enterica serovar Typhi Ty2
cccacacaucacaaucuccaga

SEQ ID NO: 3687520 - RNA, 12 nt, Salmonella enterica enterica serovar Typhi Ty2
cccacaccauac

SEQ ID NO: 3687521 - RNA, 17 nt, Salmonella enterica enterica serovar Typhi Ty2
cccacacggccaccaua

SEQ ID NO: 3687522 - RNA, 19 nt, Salmonella enterica enterica serovar Typhi Ty2
cccacagcuugccguagcg

SEQ ID NO: 3687523 - RNA, 12 nt, Salmonella enterica enterica serovar Typhi Ty2
cccacagguagg

SEQ ID NO: 3687524 - RNA, 21 nt, Salmonella enterica enterica serovar Typhi Ty2
cccacaguaauggacagguaa

SEQ ID NO: 3687525 - RNA, 15 nt, Salmonella enterica enterica serovar Typhi Ty2
cccacauguuggcau

SEQ ID NO: 3687526 - RNA, 14 nt, Salmonella enterica enterica serovar Typhi Ty2
cccacauuggcccc

SEQ ID NO: 3687527 - RNA, 13 nt, Salmonella enterica enterica serovar Typhi Ty2
cccaccaccgcca

SEQ ID NO: 3687528 - RNA, 13 nt, Salmonella enterica enterica serovar Typhi Ty2
cccaccagcgcca

SEQ ID NO: 3687529 - RNA, 16 nt, Salmonella enterica enterica serovar Typhi Ty2
cccaccauaggccagc

SEQ ID NO: 3687530 - RNA, 15 nt, Salmonella enterica enterica serovar Typhi Ty2
cccaccaucacuucc

SEQ ID NO: 3687531 - RNA, 16 nt, Salmonella enterica enterica serovar Typhi Ty2
cccaccaucacuucca

SEQ ID NO: 3687532 - RNA, 20 nt, Salmonella enterica enterica serovar Typhi Ty2
cccaccgcuggauauguuuu

SEQ ID NO: 3687533 - RNA, 15 nt, Salmonella enterica enterica serovar Typhi Ty2
cccaccggcccacgc

SEQ ID NO: 3687534 - RNA, 18 nt, Salmonella enterica enterica serovar Typhi Ty2
cccaccuuuugcagcgcg

SEQ ID NO: 3687535 - RNA, 19 nt, Salmonella enterica enterica serovar Typhi Ty2
cccacgacgcgguacccac

SEQ ID NO: 3687536 - RNA, 21 nt, Salmonella enterica enterica serovar Typhi Ty2
cccacgcaaaauggccugcug

SEQ ID NO: 3687537 - RNA, 22 nt, Salmonella enterica enterica serovar Typhi Ty2
cccacgcaaaauggccugcugg

SEQ ID NO: 3687538 - RNA, 17 nt, Salmonella enterica enterica serovar Typhi Ty2
cccacgcauaguccugc

SEQ ID NO: 3687539 - RNA, 14 nt, Salmonella enterica enterica serovar Typhi Ty2
cccacgccagcagc

SEQ ID NO: 3687540 - RNA, 19 nt, Salmonella enterica enterica serovar Typhi Ty2
cccacgcccgccaucgccg

SEQ ID NO: 3687541 - RNA, 15 nt, Salmonella enterica enterica serovar Typhi Ty2
cccacgcgccacguc

SEQ ID NO: 3687542 - RNA, 21 nt, Salmonella enterica enterica serovar Typhi Ty2
cccacgcggaaucgucacaga

SEQ ID NO: 3687543 - RNA, 15 nt, Salmonella enterica enterica serovar Typhi Ty2
cccacgcuuuuuuau

SEQ ID NO: 3687544 - RNA, 21 nt, Salmonella enterica enterica serovar Typhi Ty2
cccacggagaaaagcgaaaau

SEQ ID NO: 3687545 - RNA, 18 nt, Salmonella enterica enterica serovar Typhi Ty2
cccacgguacgacgcggc

SEQ ID NO: 3687546 - RNA, 12 nt, Salmonella enterica enterica serovar Typhi Ty2
cccacuauuuuu

SEQ ID NO: 3687547 - RNA, 20 nt, Salmonella enterica enterica serovar Typhi Ty2
cccacucaaucauugucauu

SEQ ID NO: 3687548 - RNA, 19 nt, Salmonella enterica enterica serovar Typhi Ty2
cccacucauccagcaaaau

SEQ ID NO: 3687549 - RNA, 20 nt, Salmonella enterica enterica serovar Typhi Ty2
ccccugcccgcgaucgagcg

SEQ ID NO: 3687550 - RNA, 22 nt, Salmonella enterica enterica serovar Typhi Ty2
ccccugcgguuucuaccaccca

SEQ ID NO: 3687551 - RNA, 21 nt, Salmonella enterica enterica serovar Typhi Ty2
ccccugcuggcgaaccaccag

SEQ ID NO: 3687552 - RNA, 21 nt, Salmonella enterica enterica serovar Typhi Ty2
ccccuggacgcgagccacagg

SEQ ID NO: 3687553 - RNA, 21 nt, Salmonella enterica enterica serovar Typhi Ty2
ccccuuacuaagccaguucuc

SEQ ID NO: 3687554 - RNA, 13 nt, Salmonella enterica enterica serovar Typhi Ty2
ccccuucgcuguc

SEQ ID NO: 3687555 - RNA, 18 nt, Salmonella enterica enterica serovar Typhi Ty2
ccccuuucgcaaucaugc

SEQ ID NO: 3687556 - RNA, 20 nt, Salmonella enterica enterica serovar Typhi Ty2
ccccuuugggacgaaccggc

SEQ ID NO: 3687557 - RNA, 14 nt, Salmonella enterica enterica serovar Typhi Ty2
ccccuuuuuugcug

SEQ ID NO: 3687558 - RNA, 13 nt, Salmonella enterica enterica serovar Typhi Ty2
cccgaaguggugg

SEQ ID NO: 3687559 - RNA, 15 nt, Salmonella enterica enterica serovar Typhi Ty2
cccgacaccagccgu

SEQ ID NO: 3687560 - RNA, 13 nt, Salmonella enterica enterica serovar Typhi Ty2
cccgaccacgccc

SEQ ID NO: 3687561 - RNA, 19 nt, Salmonella enterica enterica serovar Typhi Ty2
cccgacuaccggcaccagc

SEQ ID NO: 3687562 - RNA, 14 nt, Salmonella enterica enterica serovar Typhi Ty2
cccgagcgacgccc

SEQ ID NO: 3687563 - RNA, 23 nt, Salmonella enterica enterica serovar Typhi Ty2
cccgagcgacgcccugcccauga

SEQ ID NO: 3687564 - RNA, 19 nt, Salmonella enterica enterica serovar Typhi Ty2
cccgauaagcaagcgccau

SEQ ID NO: 3687565 - RNA, 14 nt, Salmonella enterica enterica serovar Typhi Ty2
cccgauacccgccc

SEQ ID NO: 3687566 - RNA, 13 nt, Salmonella enterica enterica serovar Typhi Ty2
cccgauacccuga

SEQ ID NO: 3687567 - RNA, 13 nt, Salmonella enterica enterica serovar Typhi Ty2
cccgauagcgccg

SEQ ID NO: 3687568 - RNA, 20 nt, Salmonella enterica enterica serovar Typhi Ty2
cccgauguccgucuuuucug

SEQ ID NO: 3687569 - RNA, 21 nt, Salmonella enterica enterica serovar Typhi Ty2
cccgaugucgccacgccgccc

SEQ ID NO: 3687570 - RNA, 13 nt, Salmonella enterica enterica serovar Typhi Ty2
cccgauucugcca

SEQ ID NO: 3687571 - RNA, 14 nt, Salmonella enterica enterica serovar Typhi Ty2
cccgauucugccag

SEQ ID NO: 3687572 - RNA, 11 nt, Salmonella enterica enterica serovar Typhi Ty2
cccgcaaaagc

SEQ ID NO: 3687573 - RNA, 17 nt, Salmonella enterica enterica serovar Typhi Ty2
cccgcaaaccaggucug

SEQ ID NO: 3687574 - RNA, 20 nt, Salmonella enterica enterica serovar Typhi Ty2
cccgcaaacuaauggcgcag

SEQ ID NO: 3687575 - RNA, 21 nt, Salmonella enterica enterica serovar Typhi Ty2
cccgcaaacuaauggcgcagc

SEQ ID NO: 3687576 - RNA, 19 nt, Salmonella enterica enterica serovar Typhi Ty2
cccgcaaacuggccacagc

SEQ ID NO: 3687577 - RNA, 18 nt, Salmonella enterica enterica serovar Typhi Ty2
cccgcacaaacgcuuuuu

SEQ ID NO: 3687578 - RNA, 14 nt, Salmonella enterica enterica serovar Typhi Ty2
cccgcacagcacau

SEQ ID NO: 3687579 - RNA, 19 nt, Salmonella enterica enterica serovar Typhi Ty2
cccgcacgcgacgcgccag

SEQ ID NO: 3687580 - RNA, 13 nt, Salmonella enterica enterica serovar Typhi Ty2
cccgcagccacuc

SEQ ID NO: 3687581 - RNA, 15 nt, Salmonella enterica enterica serovar Typhi Ty2
cccgcagccacuccc

SEQ ID NO: 3687582 - RNA, 13 nt, Salmonella enterica enterica serovar Typhi Ty2
cccgcaggccugg

SEQ ID NO: 3687583 - RNA, 17 nt, Salmonella enterica enterica serovar Typhi Ty2
cccgcaggccuggcugg

SEQ ID NO: 3687584 - RNA, 18 nt, Salmonella enterica enterica serovar Typhi Ty2
cccgcauucgcggcaagc

SEQ ID NO: 3687585 - RNA, 17 nt, Salmonella enterica enterica serovar Typhi Ty2
cccgcauuuaacaggac

SEQ ID NO: 3687586 - RNA, 14 nt, Salmonella enterica enterica serovar Typhi Ty2
cccgccaccgccgc

SEQ ID NO: 3687587 - RNA, 13 nt, Salmonella enterica enterica serovar Typhi Ty2
cccgccagaugca

SEQ ID NO: 3687588 - RNA, 21 nt, Salmonella enterica enterica serovar Typhi Ty2
cccgccagaugcagcggcagu

SEQ ID NO: 3687589 - RNA, 12 nt, Salmonella enterica enterica serovar Typhi Ty2
cccgccagcaca

SEQ ID NO: 3687590 - RNA, 15 nt, Salmonella enterica enterica serovar Typhi Ty2
cccgccagcacagca

SEQ ID NO: 3687591 - RNA, 23 nt, Salmonella enterica enterica serovar Typhi Ty2
cccgcccacaggcugcggcacgc

SEQ ID NO: 3687592 - RNA, 13 nt, Salmonella enterica enterica serovar Typhi Ty2
cccgcccagauca

SEQ ID NO: 3687593 - RNA, 12 nt, Salmonella enterica enterica serovar Typhi Ty2
cccgcccugccc

SEQ ID NO: 3687594 - RNA, 18 nt, Salmonella enterica enterica serovar Typhi Ty2
cccgccgaaggcaacgcc

SEQ ID NO: 3687595 - RNA, 11 nt, Salmonella enterica enterica serovar Typhi Ty2
cccgccgccau

SEQ ID NO: 3687596 - RNA, 12 nt, Salmonella enterica enterica serovar Typhi Ty2
cccgccgccauc

SEQ ID NO: 3687597 - RNA, 12 nt, Salmonella enterica enterica serovar Typhi Ty2
cccgccgccauu

SEQ ID NO: 3687598 - RNA, 13 nt, Salmonella enterica enterica serovar Typhi Ty2
cccgccgccugau

SEQ ID NO: 3687599 - RNA, 22 nt, Salmonella enterica enterica serovar Typhi Ty2
cccgccgcggcgguuauccucc

SEQ ID NO: 3687600 - RNA, 23 nt, Salmonella enterica enterica serovar Typhi Ty2
cccgccgcggcgguuauccuccg

SEQ ID NO: 3687601 - RNA, 16 nt, Salmonella enterica enterica serovar Typhi Ty2
cccgccggcagcagcu

SEQ ID NO: 3687602 - RNA, 22 nt, Salmonella enterica enterica serovar Typhi Ty2
cccgccgggcgucacccgccgg

SEQ ID NO: 3687603 - RNA, 14 nt, Salmonella enterica enterica serovar Typhi Ty2
cccgccuccgucac

SEQ ID NO: 3687604 - RNA, 20 nt, Salmonella enterica enterica serovar Typhi Ty2
cccgccucggucaguauuuc

SEQ ID NO: 3687605 - RNA, 16 nt, Salmonella enterica enterica serovar Typhi Ty2
cccgccugagcgcgca

SEQ ID NO: 3687606 - RNA, 12 nt, Salmonella enterica enterica serovar Typhi Ty2
cccgccugcugc

SEQ ID NO: 3687607 - RNA, 14 nt, Salmonella enterica enterica serovar Typhi Ty2
cccgccugcugcaa

SEQ ID NO: 3687608 - RNA, 15 nt, Salmonella enterica enterica serovar Typhi Ty2
cccgccuugcggcgc

SEQ ID NO: 3687609 - RNA, 21 nt, Salmonella enterica enterica serovar Typhi Ty2
cccgcgauaaaaauccugcuc

SEQ ID NO: 3687610 - RNA, 17 nt, Salmonella enterica enterica serovar Typhi Ty2
cccgcgcagaaucacuu

SEQ ID NO: 3687611 - RNA, 22 nt, Salmonella enterica enterica serovar Typhi Ty2
cccgcgcagaaucacuucaucc

SEQ ID NO: 3687612 - RNA, 15 nt, Salmonella enterica enterica serovar Typhi Ty2
cccgcgcagcgccag

SEQ ID NO: 3687613 - RNA, 13 nt, Salmonella enterica enterica serovar Typhi Ty2
cccgcgcaggcgg

SEQ ID NO: 3687614 - RNA, 13 nt, Salmonella enterica enterica serovar Typhi Ty2
cccgcgcauccca

SEQ ID NO: 3687615 - RNA, 12 nt, Salmonella enterica enterica serovar Typhi Ty2
cccgcgccagca

SEQ ID NO: 3687616 - RNA, 14 nt, Salmonella enterica enterica serovar Typhi Ty2
cccgcgccagcagg

SEQ ID NO: 3687617 - RNA, 13 nt, Salmonella enterica enterica serovar Typhi Ty2
cccgcgcucuccg

SEQ ID NO: 3687618 - RNA, 14 nt, Salmonella enterica enterica serovar Typhi Ty2
cccgcgcucuccgg

SEQ ID NO: 3687619 - RNA, 16 nt, Salmonella enterica enterica serovar Typhi Ty2
cccgcgcuuuccagcc

SEQ ID NO: 3687620 - RNA, 15 nt, Salmonella enterica enterica serovar Typhi Ty2
cccgcggcauggucu

SEQ ID NO: 3687621 - RNA, 23 nt, Salmonella enterica enterica serovar Typhi Ty2
cccgcgugcggacguagggcugc

SEQ ID NO: 3687622 - RNA, 17 nt, Salmonella enterica enterica serovar Typhi Ty2
cccgcguuaagccccuc

SEQ ID NO: 3687623 - RNA, 14 nt, Salmonella enterica enterica serovar Typhi Ty2
cccgcguuggcggc

SEQ ID NO: 3687624 - RNA, 23 nt, Salmonella enterica enterica serovar Typhi Ty2
cccgcucuucaguaaccagggag

SEQ ID NO: 3687625 - RNA, 13 nt, Salmonella enterica enterica serovar Typhi Ty2
cccgcugacgaug

SEQ ID NO: 3687626 - RNA, 12 nt, Salmonella enterica enterica serovar Typhi Ty2
cccgcugagugg

SEQ ID NO: 3687627 - RNA, 15 nt, Salmonella enterica enterica serovar Typhi Ty2
cccgcugcgccguuc

SEQ ID NO: 3687628 - RNA, 12 nt, Salmonella enterica enterica serovar Typhi Ty2
cccgcuggcgcg

SEQ ID NO: 3687629 - RNA, 21 nt, Salmonella enterica enterica serovar Typhi Ty2
cccgcuggcgcggggaucggu

SEQ ID NO: 3687630 - RNA, 20 nt, Salmonella enterica enterica serovar Typhi Ty2
cccgcuggcuggcguugagc

SEQ ID NO: 3687631 - RNA, 20 nt, Salmonella enterica enterica serovar Typhi Ty2
cccgcugucgggagccucuu

SEQ ID NO: 3687632 - RNA, 13 nt, Salmonella enterica enterica serovar Typhi Ty2
cccuuuuugcauu

SEQ ID NO: 3687633 - RNA, 21 nt, Salmonella enterica enterica serovar Typhi Ty2
cccuuuuugcauucgcuccuc

SEQ ID NO: 3687634 - RNA, 21 nt, Salmonella enterica enterica serovar Typhi Ty2
cccuuuuuugguuauccagca

SEQ ID NO: 3687635 - RNA, 16 nt, Salmonella enterica enterica serovar Typhi Ty2
ccgaaagaaagacgcu

SEQ ID NO: 3687636 - RNA, 20 nt, Salmonella enterica enterica serovar Typhi Ty2
ccgaaagccgguaaucgauc

SEQ ID NO: 3687637 - RNA, 18 nt, Salmonella enterica enterica serovar Typhi Ty2
ccgaaaugaccaccgcau

SEQ ID NO: 3687638 - RNA, 12 nt, Salmonella enterica enterica serovar Typhi Ty2
ccgaacacgcau

SEQ ID NO: 3687639 - RNA, 14 nt, Salmonella enterica enterica serovar Typhi Ty2
ccgaacaugccgcc

SEQ ID NO: 3687640 - RNA, 19 nt, Salmonella enterica enterica serovar Typhi Ty2
ccgaacugcaucccugcuu

SEQ ID NO: 3687641 - RNA, 18 nt, Salmonella enterica enterica serovar Typhi Ty2
ccgaagaacagauucauu

SEQ ID NO: 3687642 - RNA, 18 nt, Salmonella enterica enterica serovar Typhi Ty2
ccgaagauaaagauauuc

SEQ ID NO: 3687643 - RNA, 12 nt, Salmonella enterica enterica serovar Typhi Ty2
ccgaaucaggcg

SEQ ID NO: 3687644 - RNA, 20 nt, Salmonella enterica enterica serovar Typhi Ty2
ccgaauuugaaaaaaacauc

SEQ ID NO: 3687645 - RNA, 18 nt, Salmonella enterica enterica serovar Typhi Ty2
ccgacaacgccuccugcc

SEQ ID NO: 3687646 - RNA, 23 nt, Salmonella enterica enterica serovar Typhi Ty2
ccgacaagaaucacguaaucggc

SEQ ID NO: 3687647 - RNA, 18 nt, Salmonella enterica enterica serovar Typhi Ty2
ccgacaagccccccgcac

SEQ ID NO: 3687648 - RNA, 20 nt, Salmonella enterica enterica serovar Typhi Ty2
ccgacaauauucgccgcgau

SEQ ID NO: 3687649 - RNA, 17 nt, Salmonella enterica enterica serovar Typhi Ty2
ccgacacaguaaaaaaa

SEQ ID NO: 3687650 - RNA, 16 nt, Salmonella enterica enterica serovar Typhi Ty2
ccgacacauucaggcu

SEQ ID NO: 3687651 - RNA, 15 nt, Salmonella enterica enterica serovar Typhi Ty2
ccgacacgcucaugu

SEQ ID NO: 3687652 - RNA, 21 nt, Salmonella enterica enterica serovar Typhi Ty2
ccgacacugaaacuccgcagc

SEQ ID NO: 3687653 - RNA, 16 nt, Salmonella enterica enterica serovar Typhi Ty2
ccgacaggguuugcca

SEQ ID NO: 3687654 - RNA, 22 nt, Salmonella enterica enterica serovar Typhi Ty2
ccgacaggguuugccagcacca

SEQ ID NO: 3687655 - RNA, 21 nt, Salmonella enterica enterica serovar Typhi Ty2
ccgacauaggccagccgacgc

SEQ ID NO: 3687656 - RNA, 16 nt, Salmonella enterica enterica serovar Typhi Ty2
ccgacaugacgucgca

SEQ ID NO: 3687657 - RNA, 22 nt, Salmonella enterica enterica serovar Typhi Ty2
ccgacaugguuaaccaccagcg

SEQ ID NO: 3687658 - RNA, 18 nt, Salmonella enterica enterica serovar Typhi Ty2
ccgacauucccugcgcau

SEQ ID NO: 3687659 - RNA, 15 nt, Salmonella enterica enterica serovar Typhi Ty2
ccgaccaccagcuug

SEQ ID NO: 3687660 - RNA, 15 nt, Salmonella enterica enterica serovar Typhi Ty2
ccgaccaccgcccug

SEQ ID NO: 3687661 - RNA, 13 nt, Salmonella enterica enterica serovar Typhi Ty2
ccgaccagggcau

SEQ ID NO: 3687662 - RNA, 16 nt, Salmonella enterica enterica serovar Typhi Ty2
ccgaccagggcauccc

SEQ ID NO: 3687663 - RNA, 22 nt, Salmonella enterica enterica serovar Typhi Ty2
ccgaccauccagacaugcacau

SEQ ID NO: 3687664 - RNA, 15 nt, Salmonella enterica enterica serovar Typhi Ty2
ccgaccauuacccac

SEQ ID NO: 3687665 - RNA, 21 nt, Salmonella enterica enterica serovar Typhi Ty2
ccgaccauuggcaccaccagg

SEQ ID NO: 3687666 - RNA, 13 nt, Salmonella enterica enterica serovar Typhi Ty2
ccgaccgccagca

SEQ ID NO: 3687667 - RNA, 19 nt, Salmonella enterica enterica serovar Typhi Ty2
ccgacgauaaacagauaug

SEQ ID NO: 3687668 - RNA, 23 nt, Salmonella enterica enterica serovar Typhi Ty2
ccgacgauaaacagauaugaaau

SEQ ID NO: 3687669 - RNA, 14 nt, Salmonella enterica enterica serovar Typhi Ty2
ccgacgccagccau

SEQ ID NO: 3687670 - RNA, 13 nt, Salmonella enterica enterica serovar Typhi Ty2
ccgacgccugcau

SEQ ID NO: 3687671 - RNA, 23 nt, Salmonella enterica enterica serovar Typhi Ty2
ccgacgcgaauugcgaguaaccu

SEQ ID NO: 3687672 - RNA, 15 nt, Salmonella enterica enterica serovar Typhi Ty2
ccgacgcgaugccag

SEQ ID NO: 3687673 - RNA, 15 nt, Salmonella enterica enterica serovar Typhi Ty2
ccgacgcgggccgca

SEQ ID NO: 3687674 - RNA, 15 nt, Salmonella enterica enterica serovar Typhi Ty2
ccgacgcucuuccuc

SEQ ID NO: 3687675 - RNA, 18 nt, Salmonella enterica enterica serovar Typhi Ty2
ccgacggcauaacggccu

SEQ ID NO: 3687676 - RNA, 23 nt, Salmonella enterica enterica serovar Typhi Ty2
ccgacggccucuucacgcagcgc

SEQ ID NO: 3687677 - RNA, 19 nt, Salmonella enterica enterica serovar Typhi Ty2
ccgacggggcguuaaucac

SEQ ID NO: 3687678 - RNA, 16 nt, Salmonella enterica enterica serovar Typhi Ty2
ccgacuaauuauuuuu

SEQ ID NO: 3687679 - RNA, 17 nt, Salmonella enterica enterica serovar Typhi Ty2
ccgacuaauuauuuuuc

SEQ ID NO: 3687680 - RNA, 21 nt, Salmonella enterica enterica serovar Typhi Ty2
ccgacuaauuauuuuucaaau

SEQ ID NO: 3687681 - RNA, 19 nt, Salmonella enterica enterica serovar Typhi Ty2
ccgacuaccggcaccagca

SEQ ID NO: 3687682 - RNA, 17 nt, Salmonella enterica enterica serovar Typhi Ty2
ccgacucacgcagcgcu

SEQ ID NO: 3687683 - RNA, 16 nt, Salmonella enterica enterica serovar Typhi Ty2
ccgacucugacgccgg

SEQ ID NO: 3687684 - RNA, 14 nt, Salmonella enterica enterica serovar Typhi Ty2
ccgacugcgauaac

SEQ ID NO: 3687685 - RNA, 20 nt, Salmonella enterica enterica serovar Typhi Ty2
ccgacugucgaaaccagcau

SEQ ID NO: 3687686 - RNA, 13 nt, Salmonella enterica enterica serovar Typhi Ty2
ccgacuuucaaau

SEQ ID NO: 3687687 - RNA, 18 nt, Salmonella enterica enterica serovar Typhi Ty2
ccgacuuuuuugccuuuc

SEQ ID NO: 3687688 - RNA, 15 nt, Salmonella enterica enterica serovar Typhi Ty2
ccgagaaacaccaga

SEQ ID NO: 3687689 - RNA, 14 nt, Salmonella enterica enterica serovar Typhi Ty2
ccgagaauccacuc

SEQ ID NO: 3687690 - RNA, 15 nt, Salmonella enterica enterica serovar Typhi Ty2
ccgagacccagcgcg

SEQ ID NO: 3687691 - RNA, 13 nt, Salmonella enterica enterica serovar Typhi Ty2
ccgagacugcccg

SEQ ID NO: 3687692 - RNA, 18 nt, Salmonella enterica enterica serovar Typhi Ty2
ccgagaguccagcgccag

SEQ ID NO: 3687693 - RNA, 12 nt, Salmonella enterica enterica serovar Typhi Ty2
ccgagcaacaga

SEQ ID NO: 3687694 - RNA, 18 nt, Salmonella enterica enterica serovar Typhi Ty2
ccgagcagcuuggcggcu

SEQ ID NO: 3687695 - RNA, 23 nt, Salmonella enterica enterica serovar Typhi Ty2
ccgagcaggacgcgcgcgaaaag

SEQ ID NO: 3687696 - RNA, 17 nt, Salmonella enterica enterica serovar Typhi Ty2
ccgagcgguaagagcca

SEQ ID NO: 3687697 - RNA, 19 nt, Salmonella enterica enterica serovar Typhi Ty2
ccgaggacgggacuugaac

SEQ ID NO: 3687698 - RNA, 16 nt, Salmonella enterica enterica serovar Typhi Ty2
ccgaggcuaagccaga

SEQ ID NO: 3687699 - RNA, 22 nt, Salmonella enterica enterica serovar Typhi Ty2
ccgaggguggacaugauaagcg

SEQ ID NO: 3687700 - RNA, 21 nt, Salmonella enterica enterica serovar Typhi Ty2
ccgagguucaccagcgcgccg

SEQ ID NO: 3687701 - RNA, 23 nt, Salmonella enterica enterica serovar Typhi Ty2
ccgagucgaucgucgggauaagc

SEQ ID NO: 3687702 - RNA, 19 nt, Salmonella enterica enterica serovar Typhi Ty2
ccgagucuacaucaagaga

SEQ ID NO: 3687703 - RNA, 16 nt, Salmonella enterica enterica serovar Typhi Ty2
ccgagugucgcccgcu

SEQ ID NO: 3687704 - RNA, 15 nt, Salmonella enterica enterica serovar Typhi Ty2
ccgauaaacggcuuu

SEQ ID NO: 3687705 - RNA, 21 nt, Salmonella enterica enterica serovar Typhi Ty2
ccgauaagcaagcgccaucgg

SEQ ID NO: 3687706 - RNA, 15 nt, Salmonella enterica enterica serovar Typhi Ty2
ccgauaagcgcugua

SEQ ID NO: 3687707 - RNA, 15 nt, Salmonella enterica enterica serovar Typhi Ty2
ccgauaaucaccagc

SEQ ID NO: 3687708 - RNA, 17 nt, Salmonella enterica enterica serovar Typhi Ty2
ccgauacaggacugacu

SEQ ID NO: 3687709 - RNA, 23 nt, Salmonella enterica enterica serovar Typhi Ty2
ccgauacaggacugacugcuguc

SEQ ID NO: 3687710 - RNA, 14 nt, Salmonella enterica enterica serovar Typhi Ty2
ccgauacgaucguc

SEQ ID NO: 3687711 - RNA, 16 nt, Salmonella enterica enterica serovar Typhi Ty2
ccgauagcgccgcgcu

SEQ ID NO: 3687712 - RNA, 15 nt, Salmonella enterica enterica serovar Typhi Ty2
ccgauagcggcgcag

SEQ ID NO: 3687713 - RNA, 16 nt, Salmonella enterica enterica serovar Typhi Ty2
ccgauagcguaaagaa

SEQ ID NO: 3687714 - RNA, 15 nt, Salmonella enterica enterica serovar Typhi Ty2
ccgccaauauccggc

SEQ ID NO: 3687715 - RNA, 13 nt, Salmonella enterica enterica serovar Typhi Ty2
ccgccaccacaaa

SEQ ID NO: 3687716 - RNA, 14 nt, Salmonella enterica enterica serovar Typhi Ty2
ccgccaccacaaag

SEQ ID NO: 3687717 - RNA, 14 nt, Salmonella enterica enterica serovar Typhi Ty2
ccgccaccacgccc

SEQ ID NO: 3687718 - RNA, 12 nt, Salmonella enterica enterica serovar Typhi Ty2
ccgccaccagca

SEQ ID NO: 3687719 - RNA, 15 nt, Salmonella enterica enterica serovar Typhi Ty2
ccgccaccauccggc

SEQ ID NO: 3687720 - RNA, 15 nt, Salmonella enterica enterica serovar Typhi Ty2
ccgccacccggcaaa

SEQ ID NO: 3687721 - RNA, 13 nt, Salmonella enterica enterica serovar Typhi Ty2
ccgccaccgccgc

SEQ ID NO: 3687722 - RNA, 15 nt, Salmonella enterica enterica serovar Typhi Ty2
ccgccaccgccucgc

SEQ ID NO: 3687723 - RNA, 14 nt, Salmonella enterica enterica serovar Typhi Ty2
ccgccaccgcgcgc

SEQ ID NO: 3687724 - RNA, 18 nt, Salmonella enterica enterica serovar Typhi Ty2
ccgccaccuuucugcucc

SEQ ID NO: 3687725 - RNA, 19 nt, Salmonella enterica enterica serovar Typhi Ty2
ccgccacgccgcuccacag

SEQ ID NO: 3687726 - RNA, 17 nt, Salmonella enterica enterica serovar Typhi Ty2
ccgccagacucagccag

SEQ ID NO: 3687727 - RNA, 22 nt, Salmonella enterica enterica serovar Typhi Ty2
ccgccagacucagccaggucug

SEQ ID NO: 3687728 - RNA, 20 nt, Salmonella enterica enterica serovar Typhi Ty2
ccgccagauuauccaguccc

SEQ ID NO: 3687729 - RNA, 15 nt, Salmonella enterica enterica serovar Typhi Ty2
ccgccagcaaugccg

SEQ ID NO: 3687730 - RNA, 13 nt, Salmonella enterica enterica serovar Typhi Ty2
ccgccagcacagc

SEQ ID NO: 3687731 - RNA, 14 nt, Salmonella enterica enterica serovar Typhi Ty2
ccgccagcacagca

SEQ ID NO: 3687732 - RNA, 14 nt, Salmonella enterica enterica serovar Typhi Ty2
ccgccagcaccagg

SEQ ID NO: 3687733 - RNA, 14 nt, Salmonella enterica enterica serovar Typhi Ty2
ccgccagccccacc

SEQ ID NO: 3687734 - RNA, 15 nt, Salmonella enterica enterica serovar Typhi Ty2
ccgccagcgagauga

SEQ ID NO: 3687735 - RNA, 19 nt, Salmonella enterica enterica serovar Typhi Ty2
ccgccagcgagaugaaaag

SEQ ID NO: 3687736 - RNA, 13 nt, Salmonella enterica enterica serovar Typhi Ty2
ccgccagcgccgc

SEQ ID NO: 3687737 - RNA, 12 nt, Salmonella enterica enterica serovar Typhi Ty2
ccgccagcgccu

SEQ ID NO: 3687738 - RNA, 12 nt, Salmonella enterica enterica serovar Typhi Ty2
ccgccagcgcgg

SEQ ID NO: 3687739 - RNA, 19 nt, Salmonella enterica enterica serovar Typhi Ty2
ccgccagcgugacccagac

SEQ ID NO: 3687740 - RNA, 21 nt, Salmonella enterica enterica serovar Typhi Ty2
ccgccagcgugacccagacaa

SEQ ID NO: 3687741 - RNA, 21 nt, Salmonella enterica enterica serovar Typhi Ty2
ccgccaggucuuuaucuauca

SEQ ID NO: 3687742 - RNA, 17 nt, Salmonella enterica enterica serovar Typhi Ty2
ccgccaguugcucaaca

SEQ ID NO: 3687743 - RNA, 21 nt, Salmonella enterica enterica serovar Typhi Ty2
ccgccaguuuguaaccaacaa

SEQ ID NO: 3687744 - RNA, 15 nt, Salmonella enterica enterica serovar Typhi Ty2
ccgccauaagaaugu

SEQ ID NO: 3687745 - RNA, 19 nt, Salmonella enterica enterica serovar Typhi Ty2
ccgccauacccggcuccca

SEQ ID NO: 3687746 - RNA, 20 nt, Salmonella enterica enterica serovar Typhi Ty2
ccgccauagccggcgauagc

SEQ ID NO: 3687747 - RNA, 16 nt, Salmonella enterica enterica serovar Typhi Ty2
ccgccauauauuuacu

SEQ ID NO: 3687748 - RNA, 24 nt, Salmonella enterica enterica serovar Typhi Ty2
ccgccauauauuuacugaauaaau

SEQ ID NO: 3687749 - RNA, 21 nt, Salmonella enterica enterica serovar Typhi Ty2
ccgccaucacaccaacgcugg

SEQ ID NO: 3687750 - RNA, 11 nt, Salmonella enterica enterica serovar Typhi Ty2
ccgccaucaug

SEQ ID NO: 3687751 - RNA, 19 nt, Salmonella enterica enterica serovar Typhi Ty2
ccgccauccggcacaguau

SEQ ID NO: 3687752 - RNA, 19 nt, Salmonella enterica enterica serovar Typhi Ty2
ccgccauccggcauuuuuu

SEQ ID NO: 3687753 - RNA, 14 nt, Salmonella enterica enterica serovar Typhi Ty2
ccgccaucgacagc

SEQ ID NO: 3687754 - RNA, 17 nt, Salmonella enterica enterica serovar Typhi Ty2
ccgccaucgcugacgau

SEQ ID NO: 3687755 - RNA, 13 nt, Salmonella enterica enterica serovar Typhi Ty2
ccgccaucucacg

SEQ ID NO: 3687756 - RNA, 18 nt, Salmonella enterica enterica serovar Typhi Ty2
ccgccauggcgaauccgu

SEQ ID NO: 3687757 - RNA, 15 nt, Salmonella enterica enterica serovar Typhi Ty2
ccgccauuauucuga

SEQ ID NO: 3687758 - RNA, 22 nt, Salmonella enterica enterica serovar Typhi Ty2
ccgccauugccaguaccgacgc

SEQ ID NO: 3687759 - RNA, 20 nt, Salmonella enterica enterica serovar Typhi Ty2
ccgccauuuuauccaggcca

SEQ ID NO: 3687760 - RNA, 13 nt, Salmonella enterica enterica serovar Typhi Ty2
ccgcccaaccagc

SEQ ID NO: 3687761 - RNA, 12 nt, Salmonella enterica enterica serovar Typhi Ty2
ccgcccagaacg

SEQ ID NO: 3687762 - RNA, 13 nt, Salmonella enterica enterica serovar Typhi Ty2
ccgcccagaacgg

SEQ ID NO: 3687763 - RNA, 13 nt, Salmonella enterica enterica serovar Typhi Ty2
ccgcccaggauau

SEQ ID NO: 3687764 - RNA, 13 nt, Salmonella enterica enterica serovar Typhi Ty2
ccgcccaggccug

SEQ ID NO: 3687765 - RNA, 18 nt, Salmonella enterica enterica serovar Typhi Ty2
ccgcccaguaccagcacu

SEQ ID NO: 3687766 - RNA, 13 nt, Salmonella enterica enterica serovar Typhi Ty2
ccgcccagucacg

SEQ ID NO: 3687767 - RNA, 13 nt, Salmonella enterica enterica serovar Typhi Ty2
ccgcccauccaga

SEQ ID NO: 3687768 - RNA, 14 nt, Salmonella enterica enterica serovar Typhi Ty2
ccgcccauccaggg

SEQ ID NO: 3687769 - RNA, 23 nt, Salmonella enterica enterica serovar Typhi Ty2
ccgcccaucgggccgcucagcau

SEQ ID NO: 3687770 - RNA, 22 nt, Salmonella enterica enterica serovar Typhi Ty2
ccgcccauuaauaucagcccca

SEQ ID NO: 3687771 - RNA, 16 nt, Salmonella enterica enterica serovar Typhi Ty2
ccgccccagcagcagc

SEQ ID NO: 3687772 - RNA, 13 nt, Salmonella enterica enterica serovar Typhi Ty2
ccgccccugugga

SEQ ID NO: 3687773 - RNA, 22 nt, Salmonella enterica enterica serovar Typhi Ty2
ccgccccuguggaaucagucgg

SEQ ID NO: 3687774 - RNA, 21 nt, Salmonella enterica enterica serovar Typhi Ty2
ccgcccgcggcgaucaccacg

SEQ ID NO: 3687775 - RNA, 13 nt, Salmonella enterica enterica serovar Typhi Ty2
ccgcccgcguagc

SEQ ID NO: 3687776 - RNA, 23 nt, Salmonella enterica enterica serovar Typhi Ty2
ccgcccguacagacaucaucgaa

SEQ ID NO: 3687777 - RNA, 13 nt, Salmonella enterica enterica serovar Typhi Ty2
ccgcccguccgcu

SEQ ID NO: 3687778 - RNA, 13 nt, Salmonella enterica enterica serovar Typhi Ty2
ccgcccugcccgc

SEQ ID NO: 3687779 - RNA, 11 nt, Salmonella enterica enterica serovar Typhi Ty2
ccgcccuuucg

SEQ ID NO: 3687780 - RNA, 14 nt, Salmonella enterica enterica serovar Typhi Ty2
ccgccgacaaccag

SEQ ID NO: 3687781 - RNA, 15 nt, Salmonella enterica enterica serovar Typhi Ty2
ccgccgacaaccagc

SEQ ID NO: 3687782 - RNA, 16 nt, Salmonella enterica enterica serovar Typhi Ty2
ccgccgacaccggccu

SEQ ID NO: 3687783 - RNA, 16 nt, Salmonella enterica enterica serovar Typhi Ty2
ccgccgacaugacggu

SEQ ID NO: 3687784 - RNA, 16 nt, Salmonella enterica enterica serovar Typhi Ty2
ccgccgacccccuccu

SEQ ID NO: 3687785 - RNA, 20 nt, Salmonella enterica enterica serovar Typhi Ty2
ccgccgaggcuaagccagaa

SEQ ID NO: 3687786 - RNA, 16 nt, Salmonella enterica enterica serovar Typhi Ty2
ccgccgauaagcgcug

SEQ ID NO: 3687787 - RNA, 13 nt, Salmonella enterica enterica serovar Typhi Ty2
ccgccgcaaaagc

SEQ ID NO: 3687788 - RNA, 14 nt, Salmonella enterica enterica serovar Typhi Ty2
ccgccgcaacgcgc

SEQ ID NO: 3687789 - RNA, 22 nt, Salmonella enterica enterica serovar Typhi Ty2
ccgccgcaacgcgcacggcguu

SEQ ID NO: 3687790 - RNA, 22 nt, Salmonella enterica enterica serovar Typhi Ty2
ccgccgcaauuccugacugcgc

SEQ ID NO: 3687791 - RNA, 18 nt, Salmonella enterica enterica serovar Typhi Ty2
ccgccgcaggccaucaua

SEQ ID NO: 3687792 - RNA, 17 nt, Salmonella enterica enterica serovar Typhi Ty2
ccgccgccaaacugcgc

SEQ ID NO: 3687793 - RNA, 19 nt, Salmonella enterica enterica serovar Typhi Ty2
ccgccgccagccaucccca

SEQ ID NO: 3687794 - RNA, 13 nt, Salmonella enterica enterica serovar Typhi Ty2
ccgccgcccagcg

SEQ ID NO: 3687795 - RNA, 13 nt, Salmonella enterica enterica serovar Typhi Ty2
ccgccgccgcgcc

SEQ ID NO: 3687796 - RNA, 14 nt, Salmonella enterica enterica serovar Typhi Ty2
ccgccgccggccug

SEQ ID NO: 3687797 - RNA, 17 nt, Salmonella enterica enterica serovar Typhi Ty2
ccgcguauugcccucgg

SEQ ID NO: 3687798 - RNA, 17 nt, Salmonella enterica enterica serovar Typhi Ty2
ccgcguuaacgccguug

SEQ ID NO: 3687799 - RNA, 19 nt, Salmonella enterica enterica serovar Typhi Ty2
ccgcguucugucgauaaac

SEQ ID NO: 3687800 - RNA, 19 nt, Salmonella enterica enterica serovar Typhi Ty2
ccgcguuuaacgcagcgcg

SEQ ID NO: 3687801 - RNA, 13 nt, Salmonella enterica enterica serovar Typhi Ty2
ccgcguuuaucgc

SEQ ID NO: 3687802 - RNA, 15 nt, Salmonella enterica enterica serovar Typhi Ty2
ccgcguuuaucgcau

SEQ ID NO: 3687803 - RNA, 13 nt, Salmonella enterica enterica serovar Typhi Ty2
ccgcguuucgcga

SEQ ID NO: 3687804 - RNA, 19 nt, Salmonella enterica enterica serovar Typhi Ty2
ccgcuagcugcagcgcucc

SEQ ID NO: 3687805 - RNA, 15 nt, Salmonella enterica enterica serovar Typhi Ty2
ccgcuaucauaccua

SEQ ID NO: 3687806 - RNA, 16 nt, Salmonella enterica enterica serovar Typhi Ty2
ccgcuaucgccaaacu

SEQ ID NO: 3687807 - RNA, 20 nt, Salmonella enterica enterica serovar Typhi Ty2
ccgcucaccaccgccgcgag

SEQ ID NO: 3687808 - RNA, 15 nt, Salmonella enterica enterica serovar Typhi Ty2
ccgcucgccauaucu

SEQ ID NO: 3687809 - RNA, 15 nt, Salmonella enterica enterica serovar Typhi Ty2
ccgcucgcccgccgc

SEQ ID NO: 3687810 - RNA, 19 nt, Salmonella enterica enterica serovar Typhi Ty2
ccgcucgcccgccgcaaaa

SEQ ID NO: 3687811 - RNA, 22 nt, Salmonella enterica enterica serovar Typhi Ty2
ccgcucgcuuacgcggcgcgcu

SEQ ID NO: 3687812 - RNA, 15 nt, Salmonella enterica enterica serovar Typhi Ty2
ccgcucucuucguga

SEQ ID NO: 3687813 - RNA, 19 nt, Salmonella enterica enterica serovar Typhi Ty2
ccgcugacgaccccaggca

SEQ ID NO: 3687814 - RNA, 19 nt, Salmonella enterica enterica serovar Typhi Ty2
ccgcugauguuuugcgccg

SEQ ID NO: 3687815 - RNA, 22 nt, Salmonella enterica enterica serovar Typhi Ty2
ccgcugauguuuugcgccgcgc

SEQ ID NO: 3687816 - RNA, 23 nt, Salmonella enterica enterica serovar Typhi Ty2
ccgcugauucguuuuuacacuga

SEQ ID NO: 3687817 - RNA, 11 nt, Salmonella enterica enterica serovar Typhi Ty2
ccgcugcggaa

SEQ ID NO: 3687818 - RNA, 19 nt, Salmonella enterica enterica serovar Typhi Ty2
ccgcugcggucaggaauga

SEQ ID NO: 3687819 - RNA, 11 nt, Salmonella enterica enterica serovar Typhi Ty2
ccgcugcugug

SEQ ID NO: 3687820 - RNA, 16 nt, Salmonella enterica enterica serovar Typhi Ty2
ccgcugcuucacggaa

SEQ ID NO: 3687821 - RNA, 12 nt, Salmonella enterica enterica serovar Typhi Ty2
ccgcuggaauaa

SEQ ID NO: 3687822 - RNA, 19 nt, Salmonella enterica enterica serovar Typhi Ty2
ccgcuggcgccaccgcugc

SEQ ID NO: 3687823 - RNA, 22 nt, Salmonella enterica enterica serovar Typhi Ty2
ccgcuggcgcggggaacaccca

SEQ ID NO: 3687824 - RNA, 22 nt, Salmonella enterica enterica serovar Typhi Ty2
ccgcuggcgcggggaucgguuu

SEQ ID NO: 3687825 - RNA, 20 nt, Salmonella enterica enterica serovar Typhi Ty2
ccgcuggcuggccagggcau

SEQ ID NO: 3687826 - RNA, 14 nt, Salmonella enterica enterica serovar Typhi Ty2
ccgcugucgccaga

SEQ ID NO: 3687827 - RNA, 21 nt, Salmonella enterica enterica serovar Typhi Ty2
ccgcuguuaugcacgcgcggc

SEQ ID NO: 3687828 - RNA, 18 nt, Salmonella enterica enterica serovar Typhi Ty2
ccgcuguuuuucaucauc

SEQ ID NO: 3687829 - RNA, 19 nt, Salmonella enterica enterica serovar Typhi Ty2
ccgcuuaaauuaccgccgc

SEQ ID NO: 3687830 - RNA, 14 nt, Salmonella enterica enterica serovar Typhi Ty2
ccgcuucacacugg

SEQ ID NO: 3687831 - RNA, 16 nt, Salmonella enterica enterica serovar Typhi Ty2
ccgcuucacgcgcggc

SEQ ID NO: 3687832 - RNA, 17 nt, Salmonella enterica enterica serovar Typhi Ty2
ccgcuucacgcgcggcu

SEQ ID NO: 3687833 - RNA, 13 nt, Salmonella enterica enterica serovar Typhi Ty2
ccgcuuccagaau

SEQ ID NO: 3687834 - RNA, 18 nt, Salmonella enterica enterica serovar Typhi Ty2
ccgcuuccagcgcgucgg

SEQ ID NO: 3687835 - RNA, 16 nt, Salmonella enterica enterica serovar Typhi Ty2
ccgcuucgcgcgccag

SEQ ID NO: 3687836 - RNA, 14 nt, Salmonella enterica enterica serovar Typhi Ty2
ccgcuucgcgggac

SEQ ID NO: 3687837 - RNA, 23 nt, Salmonella enterica enterica serovar Typhi Ty2
ccgcuucggacuccugacgcuga

SEQ ID NO: 3687838 - RNA, 15 nt, Salmonella enterica enterica serovar Typhi Ty2
ccgcuuuaccgccuu

SEQ ID NO: 3687839 - RNA, 18 nt, Salmonella enterica enterica serovar Typhi Ty2
ccgcuuuaccgccuuccu

SEQ ID NO: 3687840 - RNA, 21 nt, Salmonella enterica enterica serovar Typhi Ty2
ccgcuuuaucguaaccgaugu

SEQ ID NO: 3687841 - RNA, 22 nt, Salmonella enterica enterica serovar Typhi Ty2
ccgcuuuaugcgcuuccagcau

SEQ ID NO: 3687842 - RNA, 16 nt, Salmonella enterica enterica serovar Typhi Ty2
ccgcuuugccgcgcuc

SEQ ID NO: 3687843 - RNA, 19 nt, Salmonella enterica enterica serovar Typhi Ty2
ccgcuuuucuggcuucagc

SEQ ID NO: 3687844 - RNA, 17 nt, Salmonella enterica enterica serovar Typhi Ty2
ccgcuuuuuucagcggc

SEQ ID NO: 3687845 - RNA, 23 nt, Salmonella enterica enterica serovar Typhi Ty2
ccggaaagaauaaucgccgccgg

SEQ ID NO: 3687846 - RNA, 21 nt, Salmonella enterica enterica serovar Typhi Ty2
ccggaaagacggcagcgccau

SEQ ID NO: 3687847 - RNA, 21 nt, Salmonella enterica enterica serovar Typhi Ty2
ccggaaaggauauaagcgcca

SEQ ID NO: 3687848 - RNA, 20 nt, Salmonella enterica enterica serovar Typhi Ty2
ccggaaauaaacgccagugg

SEQ ID NO: 3687849 - RNA, 12 nt, Salmonella enterica enterica serovar Typhi Ty2
ccggaaaucaca

SEQ ID NO: 3687850 - RNA, 22 nt, Salmonella enterica enterica serovar Typhi Ty2
ccggaaaucacaaacaccacca

SEQ ID NO: 3687851 - RNA, 22 nt, Salmonella enterica enterica serovar Typhi Ty2
ccggaaauggucgcuccggaac

SEQ ID NO: 3687852 - RNA, 20 nt, Salmonella enterica enterica serovar Typhi Ty2
ccggaacaggcuuuucaggc

SEQ ID NO: 3687853 - RNA, 14 nt, Salmonella enterica enterica serovar Typhi Ty2
ccggaacagggccg

SEQ ID NO: 3687854 - RNA, 13 nt, Salmonella enterica enterica serovar Typhi Ty2
ccggaaccggcau

SEQ ID NO: 3687855 - RNA, 18 nt, Salmonella enterica enterica serovar Typhi Ty2
ccggaacgcgagaagccc

SEQ ID NO: 3687856 - RNA, 13 nt, Salmonella enterica enterica serovar Typhi Ty2
ccggaacgggcau

SEQ ID NO: 3687857 - RNA, 15 nt, Salmonella enterica enterica serovar Typhi Ty2
ccggaagagcgcaga

SEQ ID NO: 3687858 - RNA, 13 nt, Salmonella enterica enterica serovar Typhi Ty2
ccggaauacacaa

SEQ ID NO: 3687859 - RNA, 21 nt, Salmonella enterica enterica serovar Typhi Ty2
ccggaaucgccugcgucgccc

SEQ ID NO: 3687860 - RNA, 20 nt, Salmonella enterica enterica serovar Typhi Ty2
ccggaaugguauaaaucccg

SEQ ID NO: 3687861 - RNA, 20 nt, Salmonella enterica enterica serovar Typhi Ty2
ccggaauggucgcgccaggg

SEQ ID NO: 3687862 - RNA, 15 nt, Salmonella enterica enterica serovar Typhi Ty2
ccggaauuugcuucu

SEQ ID NO: 3687863 - RNA, 20 nt, Salmonella enterica enterica serovar Typhi Ty2
ccggacaacgcaaacuguau

SEQ ID NO: 3687864 - RNA, 18 nt, Salmonella enterica enterica serovar Typhi Ty2
ccggacaucauccccggc

SEQ ID NO: 3687865 - RNA, 14 nt, Salmonella enterica enterica serovar Typhi Ty2
ccggaccagacgac

SEQ ID NO: 3687866 - RNA, 11 nt, Salmonella enterica enterica serovar Typhi Ty2
ccggaccuaau

SEQ ID NO: 3687867 - RNA, 21 nt, Salmonella enterica enterica serovar Typhi Ty2
ccggaccuaauagccagcccc

SEQ ID NO: 3687868 - RNA, 18 nt, Salmonella enterica enterica serovar Typhi Ty2
ccggacgaucaauaaaau

SEQ ID NO: 3687869 - RNA, 14 nt, Salmonella enterica enterica serovar Typhi Ty2
ccggacgccaccac

SEQ ID NO: 3687870 - RNA, 20 nt, Salmonella enterica enterica serovar Typhi Ty2
ccggacguugaaaaaacggg

SEQ ID NO: 3687871 - RNA, 18 nt, Salmonella enterica enterica serovar Typhi Ty2
ccggagaccggcgaaauc

SEQ ID NO: 3687872 - RNA, 19 nt, Salmonella enterica enterica serovar Typhi Ty2
ccggagaggcguucaugcc

SEQ ID NO: 3687873 - RNA, 22 nt, Salmonella enterica enterica serovar Typhi Ty2
ccggaggauauuuauucccccu

SEQ ID NO: 3687874 - RNA, 17 nt, Salmonella enterica enterica serovar Typhi Ty2
ccggauaaccgcccgcg

SEQ ID NO: 3687875 - RNA, 16 nt, Salmonella enterica enterica serovar Typhi Ty2
ccggauaacgcgcugg

SEQ ID NO: 3687876 - RNA, 16 nt, Salmonella enterica enterica serovar Typhi Ty2
ccggauaacggcgcga

SEQ ID NO: 3687877 - RNA, 22 nt, Salmonella enterica enterica serovar Typhi Ty2
ccggauaacggcgcgaaagcgc

SEQ ID NO: 3687878 - RNA, 20 nt, Salmonella enterica enterica serovar Typhi Ty2
ccggauaagcaacgcgccau

SEQ ID NO: 3687879 - RNA, 13 nt, Salmonella enterica enterica serovar Typhi Ty2
ccggcgauggugc

SEQ ID NO: 3687880 - RNA, 16 nt, Salmonella enterica enterica serovar Typhi Ty2
ccggcgauguuggcgc

SEQ ID NO: 3687881 - RNA, 14 nt, Salmonella enterica enterica serovar Typhi Ty2
ccggcgcagacggc

SEQ ID NO: 3687882 - RNA, 14 nt, Salmonella enterica enterica serovar Typhi Ty2
ccggcgcauccagu

SEQ ID NO: 3687883 - RNA, 18 nt, Salmonella enterica enterica serovar Typhi Ty2
ccggcgccagaagcuggc

SEQ ID NO: 3687884 - RNA, 16 nt, Salmonella enterica enterica serovar Typhi Ty2
ccggcgcccauccgcc

SEQ ID NO: 3687885 - RNA, 19 nt, Salmonella enterica enterica serovar Typhi Ty2
ccggcgccgaucaucccgc

SEQ ID NO: 3687886 - RNA, 18 nt, Salmonella enterica enterica serovar Typhi Ty2
ccggcgcgaucaucgcau

SEQ ID NO: 3687887 - RNA, 11 nt, Salmonella enterica enterica serovar Typhi Ty2
ccggcgcgcca

SEQ ID NO: 3687888 - RNA, 13 nt, Salmonella enterica enterica serovar Typhi Ty2
ccggcgcgccagc

SEQ ID NO: 3687889 - RNA, 15 nt, Salmonella enterica enterica serovar Typhi Ty2
ccggcgcgcguggcu

SEQ ID NO: 3687890 - RNA, 12 nt, Salmonella enterica enterica serovar Typhi Ty2
ccggcgcggcgc

SEQ ID NO: 3687891 - RNA, 16 nt, Salmonella enterica enterica serovar Typhi Ty2
ccggcgcgggcgagau

SEQ ID NO: 3687892 - RNA, 20 nt, Salmonella enterica enterica serovar Typhi Ty2
ccggcgcguuuuggcagaca

SEQ ID NO: 3687893 - RNA, 19 nt, Salmonella enterica enterica serovar Typhi Ty2
ccggcgcucagccagaaac

SEQ ID NO: 3687894 - RNA, 22 nt, Salmonella enterica enterica serovar Typhi Ty2
ccggcgcuggacaaaccacagu

SEQ ID NO: 3687895 - RNA, 17 nt, Salmonella enterica enterica serovar Typhi Ty2
ccggcgcuggcgcacgc

SEQ ID NO: 3687896 - RNA, 18 nt, Salmonella enterica enterica serovar Typhi Ty2
ccggcgcuggcgcuggcu

SEQ ID NO: 3687897 - RNA, 15 nt, Salmonella enterica enterica serovar Typhi Ty2
ccggcggcaaggucu

SEQ ID NO: 3687898 - RNA, 16 nt, Salmonella enterica enterica serovar Typhi Ty2
ccggcggcaaggucug

SEQ ID NO: 3687899 - RNA, 19 nt, Salmonella enterica enterica serovar Typhi Ty2
ccggcggcaaggucugcgc

SEQ ID NO: 3687900 - RNA, 11 nt, Salmonella enterica enterica serovar Typhi Ty2
ccggcggccua

SEQ ID NO: 3687901 - RNA, 17 nt, Salmonella enterica enterica serovar Typhi Ty2
ccggcggcgacuggcua

SEQ ID NO: 3687902 - RNA, 20 nt, Salmonella enterica enterica serovar Typhi Ty2
ccggcggucgauuuugccuu

SEQ ID NO: 3687903 - RNA, 12 nt, Salmonella enterica enterica serovar Typhi Ty2
ccggcgguugag

SEQ ID NO: 3687904 - RNA, 18 nt, Salmonella enterica enterica serovar Typhi Ty2
ccggcguaauugcgccug

SEQ ID NO: 3687905 - RNA, 18 nt, Salmonella enterica enterica serovar Typhi Ty2
ccggcgucauacugccaa

SEQ ID NO: 3687906 - RNA, 18 nt, Salmonella enterica enterica serovar Typhi Ty2
ccggcgugaaagcgcuug

SEQ ID NO: 3687907 - RNA, 23 nt, Salmonella enterica enterica serovar Typhi Ty2
ccggcgugaaagcgcuugauaau

SEQ ID NO: 3687908 - RNA, 17 nt, Salmonella enterica enterica serovar Typhi Ty2
ccggcgugacucagcgg

SEQ ID NO: 3687909 - RNA, 12 nt, Salmonella enterica enterica serovar Typhi Ty2
ccggcgugcgcu

SEQ ID NO: 3687910 - RNA, 21 nt, Salmonella enterica enterica serovar Typhi Ty2
ccggcgugugucccggacaau

SEQ ID NO: 3687911 - RNA, 16 nt, Salmonella enterica enterica serovar Typhi Ty2
ccggcguuacuccgcg

SEQ ID NO: 3687912 - RNA, 22 nt, Salmonella enterica enterica serovar Typhi Ty2
ccggcguuccgcacauaaucac

SEQ ID NO: 3687913 - RNA, 18 nt, Salmonella enterica enterica serovar Typhi Ty2
ccggcguuccgcccaggc

SEQ ID NO: 3687914 - RNA, 14 nt, Salmonella enterica enterica serovar Typhi Ty2
ccggcguugcgccg

SEQ ID NO: 3687915 - RNA, 22 nt, Salmonella enterica enterica serovar Typhi Ty2
ccggcuccgaccaucgccgcga

SEQ ID NO: 3687916 - RNA, 23 nt, Salmonella enterica enterica serovar Typhi Ty2
ccggcuccgaccaucgccgcgaa

SEQ ID NO: 3687917 - RNA, 11 nt, Salmonella enterica enterica serovar Typhi Ty2
ccggcucgccc

SEQ ID NO: 3687918 - RNA, 11 nt, Salmonella enterica enterica serovar Typhi Ty2
ccggcucgccu

SEQ ID NO: 3687919 - RNA, 23 nt, Salmonella enterica enterica serovar Typhi Ty2
ccggcugaacguuguauaaacag

SEQ ID NO: 3687920 - RNA, 23 nt, Salmonella enterica enterica serovar Typhi Ty2
ccggcugaagccccaacagaccg

SEQ ID NO: 3687921 - RNA, 23 nt, Salmonella enterica enterica serovar Typhi Ty2
ccggcuguucgacgaauggcggc

SEQ ID NO: 3687922 - RNA, 19 nt, Salmonella enterica enterica serovar Typhi Ty2
ccggcuuaaugcccggccc

SEQ ID NO: 3687923 - RNA, 20 nt, Salmonella enterica enterica serovar Typhi Ty2
ccggcuuaaugcccggcccg

SEQ ID NO: 3687924 - RNA, 15 nt, Salmonella enterica enterica serovar Typhi Ty2
ccggcuucguuaagc

SEQ ID NO: 3687925 - RNA, 15 nt, Salmonella enterica enterica serovar Typhi Ty2
ccggcuuuauuacuu

SEQ ID NO: 3687926 - RNA, 17 nt, Salmonella enterica enterica serovar Typhi Ty2
ccggcuuuccgcaccgc

SEQ ID NO: 3687927 - RNA, 16 nt, Salmonella enterica enterica serovar Typhi Ty2
ccggcuuuuuucaccu

SEQ ID NO: 3687928 - RNA, 21 nt, Salmonella enterica enterica serovar Typhi Ty2
ccgggaaaacaucacccggcg

SEQ ID NO: 3687929 - RNA, 19 nt, Salmonella enterica enterica serovar Typhi Ty2
ccgggaaaugucuggcgcu

SEQ ID NO: 3687930 - RNA, 16 nt, Salmonella enterica enterica serovar Typhi Ty2
ccgggaagaaggcucc

SEQ ID NO: 3687931 - RNA, 19 nt, Salmonella enterica enterica serovar Typhi Ty2
ccgggagaaaacgcggccu

SEQ ID NO: 3687932 - RNA, 23 nt, Salmonella enterica enterica serovar Typhi Ty2
ccgggagaaaacgcggccuggaa

SEQ ID NO: 3687933 - RNA, 17 nt, Salmonella enterica enterica serovar Typhi Ty2
ccgggagaacgccgggc

SEQ ID NO: 3687934 - RNA, 22 nt, Salmonella enterica enterica serovar Typhi Ty2
ccgggagaacgccgggccugcc

SEQ ID NO: 3687935 - RNA, 12 nt, Salmonella enterica enterica serovar Typhi Ty2
ccgggagguacg

SEQ ID NO: 3687936 - RNA, 14 nt, Salmonella enterica enterica serovar Typhi Ty2
ccgggauaaucagg

SEQ ID NO: 3687937 - RNA, 13 nt, Salmonella enterica enterica serovar Typhi Ty2
ccgggauauaaaa

SEQ ID NO: 3687938 - RNA, 13 nt, Salmonella enterica enterica serovar Typhi Ty2
ccgggcauggcuc

SEQ ID NO: 3687939 - RNA, 13 nt, Salmonella enterica enterica serovar Typhi Ty2
ccgggccaaugcc

SEQ ID NO: 3687940 - RNA, 20 nt, Salmonella enterica enterica serovar Typhi Ty2
ccgggccgacaggcggccgc

SEQ ID NO: 3687941 - RNA, 13 nt, Salmonella enterica enterica serovar Typhi Ty2
ccgggccgucagg

SEQ ID NO: 3687942 - RNA, 17 nt, Salmonella enterica enterica serovar Typhi Ty2
ccgggccugagcgcgca

SEQ ID NO: 3687943 - RNA, 19 nt, Salmonella enterica enterica serovar Typhi Ty2
ccgggccugagcgcgcagc

SEQ ID NO: 3687944 - RNA, 13 nt, Salmonella enterica enterica serovar Typhi Ty2
ccgggccuggcau

SEQ ID NO: 3687945 - RNA, 12 nt, Salmonella enterica enterica serovar Typhi Ty2
ccgggcgaaagc

SEQ ID NO: 3687946 - RNA, 13 nt, Salmonella enterica enterica serovar Typhi Ty2
ccgggcgauaaac

SEQ ID NO: 3687947 - RNA, 12 nt, Salmonella enterica enterica serovar Typhi Ty2
ccgggcggcgca

SEQ ID NO: 3687948 - RNA, 14 nt, Salmonella enterica enterica serovar Typhi Ty2
ccgggcggcgcagc

SEQ ID NO: 3687949 - RNA, 18 nt, Salmonella enterica enterica serovar Typhi Ty2
ccgggcggcugucccaga

SEQ ID NO: 3687950 - RNA, 22 nt, Salmonella enterica enterica serovar Typhi Ty2
ccgggcgucacccgccggcagc

SEQ ID NO: 3687951 - RNA, 21 nt, Salmonella enterica enterica serovar Typhi Ty2
ccgggcugaacgccaggccgu

SEQ ID NO: 3687952 - RNA, 14 nt, Salmonella enterica enterica serovar Typhi Ty2
ccgggcugcacgcc

SEQ ID NO: 3687953 - RNA, 13 nt, Salmonella enterica enterica serovar Typhi Ty2
ccgggcuucagga

SEQ ID NO: 3687954 - RNA, 14 nt, Salmonella enterica enterica serovar Typhi Ty2
ccggggaagcgcgc

SEQ ID NO: 3687955 - RNA, 19 nt, Salmonella enterica enterica serovar Typhi Ty2
ccgggguaucuguuuauuc

SEQ ID NO: 3687956 - RNA, 19 nt, Salmonella enterica enterica serovar Typhi Ty2
ccggggugcagaacaucaa

SEQ ID NO: 3687957 - RNA, 14 nt, Salmonella enterica enterica serovar Typhi Ty2
ccggguacaaaaac

SEQ ID NO: 3687958 - RNA, 20 nt, Salmonella enterica enterica serovar Typhi Ty2
ccggguauaccaucggcugg

SEQ ID NO: 3687959 - RNA, 21 nt, Salmonella enterica enterica serovar Typhi Ty2
ccggguauuucugaaaaaccg

SEQ ID NO: 3687960 - RNA, 23 nt, Salmonella enterica enterica serovar Typhi Ty2
ccgggucggacgagcgcgucagc

SEQ ID NO: 3687961 - RNA, 15 nt, Salmonella enterica enterica serovar Typhi Ty2
ccguccacauccagc

SEQ ID NO: 3687962 - RNA, 17 nt, Salmonella enterica enterica serovar Typhi Ty2
ccguccacauccagcgc

SEQ ID NO: 3687963 - RNA, 14 nt, Salmonella enterica enterica serovar Typhi Ty2
ccguccaccuggcc

SEQ ID NO: 3687964 - RNA, 15 nt, Salmonella enterica enterica serovar Typhi Ty2
ccguccaccuggccc

SEQ ID NO: 3687965 - RNA, 18 nt, Salmonella enterica enterica serovar Typhi Ty2
ccguccagaccgucauga

SEQ ID NO: 3687966 - RNA, 13 nt, Salmonella enterica enterica serovar Typhi Ty2
ccgucccagcgga

SEQ ID NO: 3687967 - RNA, 13 nt, Salmonella enterica enterica serovar Typhi Ty2
ccguccccagcca

SEQ ID NO: 3687968 - RNA, 22 nt, Salmonella enterica enterica serovar Typhi Ty2
ccgucccuaagccggcaggcag

SEQ ID NO: 3687969 - RNA, 14 nt, Salmonella enterica enterica serovar Typhi Ty2
ccgucccuuccgcc

SEQ ID NO: 3687970 - RNA, 20 nt, Salmonella enterica enterica serovar Typhi Ty2
ccgucccuuccgccaccagg

SEQ ID NO: 3687971 - RNA, 15 nt, Salmonella enterica enterica serovar Typhi Ty2
ccguccgccaggccc

SEQ ID NO: 3687972 - RNA, 19 nt, Salmonella enterica enterica serovar Typhi Ty2
ccguccgcgcucauacgau

SEQ ID NO: 3687973 - RNA, 17 nt, Salmonella enterica enterica serovar Typhi Ty2
ccguccggcaaacccuu

SEQ ID NO: 3687974 - RNA, 13 nt, Salmonella enterica enterica serovar Typhi Ty2
ccguccggcauca

SEQ ID NO: 3687975 - RNA, 16 nt, Salmonella enterica enterica serovar Typhi Ty2
ccgucgccacaccgga

SEQ ID NO: 3687976 - RNA, 17 nt, Salmonella enterica enterica serovar Typhi Ty2
ccgucgccaucaccagg

SEQ ID NO: 3687977 - RNA, 12 nt, Salmonella enterica enterica serovar Typhi Ty2
ccgucgccggaa

SEQ ID NO: 3687978 - RNA, 13 nt, Salmonella enterica enterica serovar Typhi Ty2
ccgucgcggcauc

SEQ ID NO: 3687979 - RNA, 17 nt, Salmonella enterica enterica serovar Typhi Ty2
ccgucgcggcuuucagc

SEQ ID NO: 3687980 - RNA, 14 nt, Salmonella enterica enterica serovar Typhi Ty2
ccgucggcaauaaa

SEQ ID NO: 3687981 - RNA, 18 nt, Salmonella enterica enterica serovar Typhi Ty2
ccgucggcaauuaacauu

SEQ ID NO: 3687982 - RNA, 18 nt, Salmonella enterica enterica serovar Typhi Ty2
ccgucggcgccagccaca

SEQ ID NO: 3687983 - RNA, 18 nt, Salmonella enterica enterica serovar Typhi Ty2
ccgucggggauggcggau

SEQ ID NO: 3687984 - RNA, 22 nt, Salmonella enterica enterica serovar Typhi Ty2
ccgucguuaacaucaucaggcc

SEQ ID NO: 3687985 - RNA, 18 nt, Salmonella enterica enterica serovar Typhi Ty2
ccgucguugcugucgcgc

SEQ ID NO: 3687986 - RNA, 19 nt, Salmonella enterica enterica serovar Typhi Ty2
ccgucucaaccagcaauga

SEQ ID NO: 3687987 - RNA, 13 nt, Salmonella enterica enterica serovar Typhi Ty2
ccgucucaccagg

SEQ ID NO: 3687988 - RNA, 11 nt, Salmonella enterica enterica serovar Typhi Ty2
ccgucucgguu

SEQ ID NO: 3687989 - RNA, 22 nt, Salmonella enterica enterica serovar Typhi Ty2
ccgucucuuuaucuaacugcgg

SEQ ID NO: 3687990 - RNA, 19 nt, Salmonella enterica enterica serovar Typhi Ty2
ccgucuuuucugucguguc

SEQ ID NO: 3687991 - RNA, 14 nt, Salmonella enterica enterica serovar Typhi Ty2
ccgucuuuuuccug

SEQ ID NO: 3687992 - RNA, 21 nt, Salmonella enterica enterica serovar Typhi Ty2
ccgugaaagcauaccuucaca

SEQ ID NO: 3687993 - RNA, 13 nt, Salmonella enterica enterica serovar Typhi Ty2
ccgugaauagagc

SEQ ID NO: 3687994 - RNA, 18 nt, Salmonella enterica enterica serovar Typhi Ty2
ccgugaaugccaagcgca

SEQ ID NO: 3687995 - RNA, 18 nt, Salmonella enterica enterica serovar Typhi Ty2
ccgugaauuucugcugcc

SEQ ID NO: 3687996 - RNA, 16 nt, Salmonella enterica enterica serovar Typhi Ty2
ccgugacgucccacaa

SEQ ID NO: 3687997 - RNA, 14 nt, Salmonella enterica enterica serovar Typhi Ty2
ccgugaguuuuaac

SEQ ID NO: 3687998 - RNA, 16 nt, Salmonella enterica enterica serovar Typhi Ty2
ccgugauaaauacgcu

SEQ ID NO: 3687999 - RNA, 21 nt, Salmonella enterica enterica serovar Typhi Ty2
ccgugauaauaguggugcgca

SEQ ID NO: 3688000 - RNA, 16 nt, Salmonella enterica enterica serovar Typhi Ty2
ccgugauuuauuuucg

SEQ ID NO: 3688001 - RNA, 13 nt, Salmonella enterica enterica serovar Typhi Ty2
ccgugcccagcau

SEQ ID NO: 3688002 - RNA, 14 nt, Salmonella enterica enterica serovar Typhi Ty2
ccgugcccagcauc

SEQ ID NO: 3688003 - RNA, 14 nt, Salmonella enterica enterica serovar Typhi Ty2
ccgugccgccgcga

SEQ ID NO: 3688004 - RNA, 16 nt, Salmonella enterica enterica serovar Typhi Ty2
ccgugcucuucgugga

SEQ ID NO: 3688005 - RNA, 15 nt, Salmonella enterica enterica serovar Typhi Ty2
ccguggcauucgcuu

SEQ ID NO: 3688006 - RNA, 18 nt, Salmonella enterica enterica serovar Typhi Ty2
ccguggugaccgccagau

SEQ ID NO: 3688007 - RNA, 15 nt, Salmonella enterica enterica serovar Typhi Ty2
ccguguggucgcggc

SEQ ID NO: 3688008 - RNA, 23 nt, Salmonella enterica enterica serovar Typhi Ty2
ccguuaaaccaaagguauugccu

SEQ ID NO: 3688009 - RNA, 15 nt, Salmonella enterica enterica serovar Typhi Ty2
ccguuaacugcugcu

SEQ ID NO: 3688010 - RNA, 14 nt, Salmonella enterica enterica serovar Typhi Ty2
ccguuaagcccuga

SEQ ID NO: 3688011 - RNA, 13 nt, Salmonella enterica enterica serovar Typhi Ty2
ccguuaagcugga

SEQ ID NO: 3688012 - RNA, 18 nt, Salmonella enterica enterica serovar Typhi Ty2
ccguuaaucuggccuacg

SEQ ID NO: 3688013 - RNA, 13 nt, Salmonella enterica enterica serovar Typhi Ty2
ccguuacaaauag

SEQ ID NO: 3688014 - RNA, 18 nt, Salmonella enterica enterica serovar Typhi Ty2
ccguuacgcagucagcac

SEQ ID NO: 3688015 - RNA, 21 nt, Salmonella enterica enterica serovar Typhi Ty2
ccguuaugcaguucaaaaggu

SEQ ID NO: 3688016 - RNA, 16 nt, Salmonella enterica enterica serovar Typhi Ty2
ccguuauucauucacc

SEQ ID NO: 3688017 - RNA, 18 nt, Salmonella enterica enterica serovar Typhi Ty2
ccguucauaguuugcaua

SEQ ID NO: 3688018 - RNA, 22 nt, Salmonella enterica enterica serovar Typhi Ty2
ccguucccucgacaauuucacc

SEQ ID NO: 3688019 - RNA, 14 nt, Salmonella enterica enterica serovar Typhi Ty2
ccguuccgccagau

SEQ ID NO: 3688020 - RNA, 13 nt, Salmonella enterica enterica serovar Typhi Ty2
ccguucgcgguaa

SEQ ID NO: 3688021 - RNA, 14 nt, Salmonella enterica enterica serovar Typhi Ty2
ccguucuccagcgu

SEQ ID NO: 3688022 - RNA, 13 nt, Salmonella enterica enterica serovar Typhi Ty2
ccguucuuccugg

SEQ ID NO: 3688023 - RNA, 16 nt, Salmonella enterica enterica serovar Typhi Ty2
ccguucuuccugggga

SEQ ID NO: 3688024 - RNA, 17 nt, Salmonella enterica enterica serovar Typhi Ty2
ccguugaccagcugacg

SEQ ID NO: 3688025 - RNA, 20 nt, Salmonella enterica enterica serovar Typhi Ty2
ccguugcaauauaguugagc

SEQ ID NO: 3688026 - RNA, 23 nt, Salmonella enterica enterica serovar Typhi Ty2
ccguugccacccaaugauccgga

SEQ ID NO: 3688027 - RNA, 21 nt, Salmonella enterica enterica serovar Typhi Ty2
ccguugucuucaccuugcugc

SEQ ID NO: 3688028 - RNA, 17 nt, Salmonella enterica enterica serovar Typhi Ty2
ccguuuaaaagcggaua

SEQ ID NO: 3688029 - RNA, 18 nt, Salmonella enterica enterica serovar Typhi Ty2
ccguuuaccggugcagac

SEQ ID NO: 3688030 - RNA, 14 nt, Salmonella enterica enterica serovar Typhi Ty2
ccguuucagaaaga

SEQ ID NO: 3688031 - RNA, 21 nt, Salmonella enterica enterica serovar Typhi Ty2
ccguuucagaaagagauuaga

SEQ ID NO: 3688032 - RNA, 17 nt, Salmonella enterica enterica serovar Typhi Ty2
ccguuucagccccuugc

SEQ ID NO: 3688033 - RNA, 12 nt, Salmonella enterica enterica serovar Typhi Ty2
ccguuugccaua

SEQ ID NO: 3688034 - RNA, 12 nt, Salmonella enterica enterica serovar Typhi Ty2
ccguuuguaaca

SEQ ID NO: 3688035 - RNA, 18 nt, Salmonella enterica enterica serovar Typhi Ty2
ccguuuuaccuucugccg

SEQ ID NO: 3688036 - RNA, 21 nt, Salmonella enterica enterica serovar Typhi Ty2
ccguuuucgcccccagcacga

SEQ ID NO: 3688037 - RNA, 16 nt, Salmonella enterica enterica serovar Typhi Ty2
ccguuuuggcagcgcc

SEQ ID NO: 3688038 - RNA, 21 nt, Salmonella enterica enterica serovar Typhi Ty2
ccguuuuguugccgcccguuu

SEQ ID NO: 3688039 - RNA, 16 nt, Salmonella enterica enterica serovar Typhi Ty2
ccguuuuuaauuugcu

SEQ ID NO: 3688040 - RNA, 16 nt, Salmonella enterica enterica serovar Typhi Ty2
ccguuuuucccgcugg

SEQ ID NO: 3688041 - RNA, 22 nt, Salmonella enterica enterica serovar Typhi Ty2
ccuaaaucugccaucagcaccu

SEQ ID NO: 3688042 - RNA, 11 nt, Salmonella enterica enterica serovar Typhi Ty2
ccuaacaguuu

SEQ ID NO: 3688043 - RNA, 15 nt, Salmonella enterica enterica serovar Typhi Ty2
ccuaacaucauuccc

SEQ ID NO: 3688044 - RNA, 12 nt, Salmonella enterica enterica serovar Typhi Ty2
ccuccugcucca

SEQ ID NO: 3688045 - RNA, 22 nt, Salmonella enterica enterica serovar Typhi Ty2
ccuccuggcguuaucaucguaa

SEQ ID NO: 3688046 - RNA, 17 nt, Salmonella enterica enterica serovar Typhi Ty2
ccuccuucgcgccugug

SEQ ID NO: 3688047 - RNA, 22 nt, Salmonella enterica enterica serovar Typhi Ty2
ccucgacguuuuccaucaccau

SEQ ID NO: 3688048 - RNA, 17 nt, Salmonella enterica enterica serovar Typhi Ty2
ccucgcaaaacauggcu

SEQ ID NO: 3688049 - RNA, 16 nt, Salmonella enterica enterica serovar Typhi Ty2
ccucgcaguuaugcgc

SEQ ID NO: 3688050 - RNA, 17 nt, Salmonella enterica enterica serovar Typhi Ty2
ccucgcauaacuucgaa

SEQ ID NO: 3688051 - RNA, 13 nt, Salmonella enterica enterica serovar Typhi Ty2
ccucgcauccucc

SEQ ID NO: 3688052 - RNA, 18 nt, Salmonella enterica enterica serovar Typhi Ty2
ccucgccaaagcgcugcu

SEQ ID NO: 3688053 - RNA, 13 nt, Salmonella enterica enterica serovar Typhi Ty2
ccucgcccgcgau

SEQ ID NO: 3688054 - RNA, 16 nt, Salmonella enterica enterica serovar Typhi Ty2
ccucgcgauccgccag

SEQ ID NO: 3688055 - RNA, 13 nt, Salmonella enterica enterica serovar Typhi Ty2
ccucgcucaccgg

SEQ ID NO: 3688056 - RNA, 21 nt, Salmonella enterica enterica serovar Typhi Ty2
ccucgcucaccggucccggaa

SEQ ID NO: 3688057 - RNA, 20 nt, Salmonella enterica enterica serovar Typhi Ty2
ccucggcaacauaccgggua

SEQ ID NO: 3688058 - RNA, 20 nt, Salmonella enterica enterica serovar Typhi Ty2
ccucgguauguccugccgca

SEQ ID NO: 3688059 - RNA, 21 nt, Salmonella enterica enterica serovar Typhi Ty2
ccucgguggccuuguagcgcu

SEQ ID NO: 3688060 - RNA, 17 nt, Salmonella enterica enterica serovar Typhi Ty2
ccucgucauaucugaug

SEQ ID NO: 3688061 - RNA, 16 nt, Salmonella enterica enterica serovar Typhi Ty2
ccucguccagaugggc

SEQ ID NO: 3688062 - RNA, 14 nt, Salmonella enterica enterica serovar Typhi Ty2
ccucguucggcgca

SEQ ID NO: 3688063 - RNA, 13 nt, Salmonella enterica enterica serovar Typhi Ty2
ccucuacauuuuc

SEQ ID NO: 3688064 - RNA, 22 nt, Salmonella enterica enterica serovar Typhi Ty2
ccucuaccggaaaacagccgcc

SEQ ID NO: 3688065 - RNA, 13 nt, Salmonella enterica enterica serovar Typhi Ty2
ccucuaucuuuuc

SEQ ID NO: 3688066 - RNA, 23 nt, Salmonella enterica enterica serovar Typhi Ty2
ccucucaccguggugaccgccag

SEQ ID NO: 3688067 - RNA, 21 nt, Salmonella enterica enterica serovar Typhi Ty2
ccucuccugaauugcaaggcg

SEQ ID NO: 3688068 - RNA, 14 nt, Salmonella enterica enterica serovar Typhi Ty2
ccucucuucucgcu

SEQ ID NO: 3688069 - RNA, 12 nt, Salmonella enterica enterica serovar Typhi Ty2
ccucugauuuuu

SEQ ID NO: 3688070 - RNA, 23 nt, Salmonella enterica enterica serovar Typhi Ty2
ccucugccguagcguacuuucaa

SEQ ID NO: 3688071 - RNA, 17 nt, Salmonella enterica enterica serovar Typhi Ty2
ccucuggccaguuucaa

SEQ ID NO: 3688072 - RNA, 21 nt, Salmonella enterica enterica serovar Typhi Ty2
ccucuggccgcgcuuuuuuaa

SEQ ID NO: 3688073 - RNA, 22 nt, Salmonella enterica enterica serovar Typhi Ty2
ccucuggccgcgcuuuuuuaac

SEQ ID NO: 3688074 - RNA, 20 nt, Salmonella enterica enterica serovar Typhi Ty2
ccucuuauccggcugccguu

SEQ ID NO: 3688075 - RNA, 19 nt, Salmonella enterica enterica serovar Typhi Ty2
ccucuuccaucagccaggc

SEQ ID NO: 3688076 - RNA, 19 nt, Salmonella enterica enterica serovar Typhi Ty2
ccucuuccgguagcgccug

SEQ ID NO: 3688077 - RNA, 21 nt, Salmonella enterica enterica serovar Typhi Ty2
ccucuuccgguagcgccugug

SEQ ID NO: 3688078 - RNA, 16 nt, Salmonella enterica enterica serovar Typhi Ty2
ccucuugcagcaagaa

SEQ ID NO: 3688079 - RNA, 23 nt, Salmonella enterica enterica serovar Typhi Ty2
ccucuuuaucuuuuagcgcgccg

SEQ ID NO: 3688080 - RNA, 20 nt, Salmonella enterica enterica serovar Typhi Ty2
ccucuuucagaucgccgccg

SEQ ID NO: 3688081 - RNA, 13 nt, Salmonella enterica enterica serovar Typhi Ty2
ccucuuuggaggc

SEQ ID NO: 3688082 - RNA, 15 nt, Salmonella enterica enterica serovar Typhi Ty2
ccucuuuugucgucc

SEQ ID NO: 3688083 - RNA, 12 nt, Salmonella enterica enterica serovar Typhi Ty2
ccucuuuuucau

SEQ ID NO: 3688084 - RNA, 16 nt, Salmonella enterica enterica serovar Typhi Ty2
ccugaaaaaauucccg

SEQ ID NO: 3688085 - RNA, 13 nt, Salmonella enterica enterica serovar Typhi Ty2
ccugaaaaagggu

SEQ ID NO: 3688086 - RNA, 22 nt, Salmonella enterica enterica serovar Typhi Ty2
ccugaaaagagcgacguugucu

SEQ ID NO: 3688087 - RNA, 13 nt, Salmonella enterica enterica serovar Typhi Ty2
ccugaaacgcggc

SEQ ID NO: 3688088 - RNA, 15 nt, Salmonella enterica enterica serovar Typhi Ty2
ccugaaagaagcgcc

SEQ ID NO: 3688089 - RNA, 20 nt, Salmonella enterica enterica serovar Typhi Ty2
ccugaaaggucgcgauccgc

SEQ ID NO: 3688090 - RNA, 19 nt, Salmonella enterica enterica serovar Typhi Ty2
ccugaaauaacagacuccg

SEQ ID NO: 3688091 - RNA, 20 nt, Salmonella enterica enterica serovar Typhi Ty2
ccugaaauacccgacucuuu

SEQ ID NO: 3688092 - RNA, 11 nt, Salmonella enterica enterica serovar Typhi Ty2
ccugaacaggg

SEQ ID NO: 3688093 - RNA, 13 nt, Salmonella enterica enterica serovar Typhi Ty2
ccugaaccagcgg

SEQ ID NO: 3688094 - RNA, 21 nt, Salmonella enterica enterica serovar Typhi Ty2
ccugaacuuuuugcaggagcu

SEQ ID NO: 3688095 - RNA, 20 nt, Salmonella enterica enterica serovar Typhi Ty2
ccugaagaccuuaucccgcu

SEQ ID NO: 3688096 - RNA, 23 nt, Salmonella enterica enterica serovar Typhi Ty2
ccugaagauagucgauccccaac

SEQ ID NO: 3688097 - RNA, 19 nt, Salmonella enterica enterica serovar Typhi Ty2
ccugaagcccuuuagugaa

SEQ ID NO: 3688098 - RNA, 16 nt, Salmonella enterica enterica serovar Typhi Ty2
ccugaaggacaagcug

SEQ ID NO: 3688099 - RNA, 18 nt, Salmonella enterica enterica serovar Typhi Ty2
ccugaaggacaagcugcg

SEQ ID NO: 3688100 - RNA, 22 nt, Salmonella enterica enterica serovar Typhi Ty2
ccugaauaacccgcagcccugc

SEQ ID NO: 3688101 - RNA, 20 nt, Salmonella enterica enterica serovar Typhi Ty2
ccugaauauggccagucccc

SEQ ID NO: 3688102 - RNA, 14 nt, Salmonella enterica enterica serovar Typhi Ty2
ccugaaucauauuc

SEQ ID NO: 3688103 - RNA, 15 nt, Salmonella enterica enterica serovar Typhi Ty2
ccugaaucgccgcac

SEQ ID NO: 3688104 - RNA, 22 nt, Salmonella enterica enterica serovar Typhi Ty2
ccugacacuguagcaacugcca

SEQ ID NO: 3688105 - RNA, 14 nt, Salmonella enterica enterica serovar Typhi Ty2
ccugacagaaauag

SEQ ID NO: 3688106 - RNA, 12 nt, Salmonella enterica enterica serovar Typhi Ty2
ccugacagcgcg

SEQ ID NO: 3688107 - RNA, 20 nt, Salmonella enterica enterica serovar Typhi Ty2
ccugacagcgcgcgaauauc

SEQ ID NO: 3688108 - RNA, 15 nt, Salmonella enterica enterica serovar Typhi Ty2
ccugacauagcucac

SEQ ID NO: 3688109 - RNA, 15 nt, Salmonella enterica enterica serovar Typhi Ty2
ccugacccgcucgua

SEQ ID NO: 3688110 - RNA, 20 nt, Salmonella enterica enterica serovar Typhi Ty2
ccugacgccgcuguuuucac

SEQ ID NO: 3688111 - RNA, 14 nt, Salmonella enterica enterica serovar Typhi Ty2
ccugacgcugagag

SEQ ID NO: 3688112 - RNA, 21 nt, Salmonella enterica enterica serovar Typhi Ty2
ccugacuauugcugagcugac

SEQ ID NO: 3688113 - RNA, 20 nt, Salmonella enterica enterica serovar Typhi Ty2
ccugacugcgcgccugcgcu

SEQ ID NO: 3688114 - RNA, 14 nt, Salmonella enterica enterica serovar Typhi Ty2
ccugagcaaucagu

SEQ ID NO: 3688115 - RNA, 12 nt, Salmonella enterica enterica serovar Typhi Ty2
ccugagcgcgca

SEQ ID NO: 3688116 - RNA, 17 nt, Salmonella enterica enterica serovar Typhi Ty2
ccugagcgcgcagcugg

SEQ ID NO: 3688117 - RNA, 19 nt, Salmonella enterica enterica serovar Typhi Ty2
ccugagcgcgcagcugggc

SEQ ID NO: 3688118 - RNA, 12 nt, Salmonella enterica enterica serovar Typhi Ty2
ccugagcgugca

SEQ ID NO: 3688119 - RNA, 13 nt, Salmonella enterica enterica serovar Typhi Ty2
ccugaguaucaau

SEQ ID NO: 3688120 - RNA, 20 nt, Salmonella enterica enterica serovar Typhi Ty2
ccugauaaacguagcgucau

SEQ ID NO: 3688121 - RNA, 20 nt, Salmonella enterica enterica serovar Typhi Ty2
ccugauaaccuauuuugcaa

SEQ ID NO: 3688122 - RNA, 19 nt, Salmonella enterica enterica serovar Typhi Ty2
ccugauaagcacaggccau

SEQ ID NO: 3688123 - RNA, 20 nt, Salmonella enterica enterica serovar Typhi Ty2
ccugauaagcgaagcgccau

SEQ ID NO: 3688124 - RNA, 19 nt, Salmonella enterica enterica serovar Typhi Ty2
ccugauaagcgcagcgcca

SEQ ID NO: 3688125 - RNA, 19 nt, Salmonella enterica enterica serovar Typhi Ty2
ccugauaagcguagcgcca

SEQ ID NO: 3688126 - RNA, 16 nt, Salmonella enterica enterica serovar Typhi Ty2
ccugcgucgccccaau

SEQ ID NO: 3688127 - RNA, 18 nt, Salmonella enterica enterica serovar Typhi Ty2
ccugcgucgcuucgccaa

SEQ ID NO: 3688128 - RNA, 18 nt, Salmonella enterica enterica serovar Typhi Ty2
ccugcguuaaacgcugug

SEQ ID NO: 3688129 - RNA, 17 nt, Salmonella enterica enterica serovar Typhi Ty2
ccugcuaucuuauccgc

SEQ ID NO: 3688130 - RNA, 13 nt, Salmonella enterica enterica serovar Typhi Ty2
ccugcucaucagg

SEQ ID NO: 3688131 - RNA, 11 nt, Salmonella enterica enterica serovar Typhi Ty2
ccugcucaugc

SEQ ID NO: 3688132 - RNA, 15 nt, Salmonella enterica enterica serovar Typhi Ty2
ccugcucccacagcu

SEQ ID NO: 3688133 - RNA, 12 nt, Salmonella enterica enterica serovar Typhi Ty2
ccugcucccaga

SEQ ID NO: 3688134 - RNA, 15 nt, Salmonella enterica enterica serovar Typhi Ty2
ccugcucccagauua

SEQ ID NO: 3688135 - RNA, 16 nt, Salmonella enterica enterica serovar Typhi Ty2
ccugcucccagauuaa

SEQ ID NO: 3688136 - RNA, 13 nt, Salmonella enterica enterica serovar Typhi Ty2
ccugcuccgccag

SEQ ID NO: 3688137 - RNA, 18 nt, Salmonella enterica enterica serovar Typhi Ty2
ccugcugacaaaaacggc

SEQ ID NO: 3688138 - RNA, 20 nt, Salmonella enterica enterica serovar Typhi Ty2
ccugcugccagccgccgccg

SEQ ID NO: 3688139 - RNA, 21 nt, Salmonella enterica enterica serovar Typhi Ty2
ccugcugccagccgccgccgg

SEQ ID NO: 3688140 - RNA, 18 nt, Salmonella enterica enterica serovar Typhi Ty2
ccugcugcgccagcgcau

SEQ ID NO: 3688141 - RNA, 19 nt, Salmonella enterica enterica serovar Typhi Ty2
ccugcuggucgccgcccau

SEQ ID NO: 3688142 - RNA, 17 nt, Salmonella enterica enterica serovar Typhi Ty2
ccugcuguaaccccugc

SEQ ID NO: 3688143 - RNA, 15 nt, Salmonella enterica enterica serovar Typhi Ty2
ccugcuguacuuuug

SEQ ID NO: 3688144 - RNA, 13 nt, Salmonella enterica enterica serovar Typhi Ty2
ccugcugugacau

SEQ ID NO: 3688145 - RNA, 22 nt, Salmonella enterica enterica serovar Typhi Ty2
ccugcuguugcggaauacacga

SEQ ID NO: 3688146 - RNA, 22 nt, Salmonella enterica enterica serovar Typhi Ty2
ccugcuucagacaacgccgccu

SEQ ID NO: 3688147 - RNA, 18 nt, Salmonella enterica enterica serovar Typhi Ty2
ccugcuuuuucagcgagg

SEQ ID NO: 3688148 - RNA, 20 nt, Salmonella enterica enterica serovar Typhi Ty2
ccugcuuuuucaucauacug

SEQ ID NO: 3688149 - RNA, 23 nt, Salmonella enterica enterica serovar Typhi Ty2
ccuggaaguugaagaaaaacccc

SEQ ID NO: 3688150 - RNA, 22 nt, Salmonella enterica enterica serovar Typhi Ty2
ccuggaauagcgugggcagacc

SEQ ID NO: 3688151 - RNA, 15 nt, Salmonella enterica enterica serovar Typhi Ty2
ccuggaauuuuucca

SEQ ID NO: 3688152 - RNA, 22 nt, Salmonella enterica enterica serovar Typhi Ty2
ccuggaauuuuuccagcucaga

SEQ ID NO: 3688153 - RNA, 16 nt, Salmonella enterica enterica serovar Typhi Ty2
ccuggagagcagcgcc

SEQ ID NO: 3688154 - RNA, 22 nt, Salmonella enterica enterica serovar Typhi Ty2
ccuggagagcagcgccagcgac

SEQ ID NO: 3688155 - RNA, 18 nt, Salmonella enterica enterica serovar Typhi Ty2
ccuggagaucagcauggu

SEQ ID NO: 3688156 - RNA, 18 nt, Salmonella enterica enterica serovar Typhi Ty2
ccuggaggaacagcgccg

SEQ ID NO: 3688157 - RNA, 24 nt, Salmonella enterica enterica serovar Typhi Ty2
ccuggagugacuaaaagacgccau

SEQ ID NO: 3688158 - RNA, 18 nt, Salmonella enterica enterica serovar Typhi Ty2
ccuggauaauaagacgcc

SEQ ID NO: 3688159 - RNA, 23 nt, Salmonella enterica enterica serovar Typhi Ty2
ccuggauacguuccagcagcgca

SEQ ID NO: 3688160 - RNA, 17 nt, Salmonella enterica enterica serovar Typhi Ty2
ccuggauagcaauuuca

SEQ ID NO: 3688161 - RNA, 23 nt, Salmonella enterica enterica serovar Typhi Ty2
ccuggaucugcgcauuaacgcca

SEQ ID NO: 3688162 - RNA, 18 nt, Salmonella enterica enterica serovar Typhi Ty2
ccuggaugaagcagacau

SEQ ID NO: 3688163 - RNA, 14 nt, Salmonella enterica enterica serovar Typhi Ty2
ccuggaugcgcuga

SEQ ID NO: 3688164 - RNA, 23 nt, Salmonella enterica enterica serovar Typhi Ty2
ccuggaugcgcugaauagcgcug

SEQ ID NO: 3688165 - RNA, 14 nt, Salmonella enterica enterica serovar Typhi Ty2
ccuggaugcuuaaa

SEQ ID NO: 3688166 - RNA, 19 nt, Salmonella enterica enterica serovar Typhi Ty2
ccuggaugcuuaaaauccc

SEQ ID NO: 3688167 - RNA, 22 nt, Salmonella enterica enterica serovar Typhi Ty2
ccuggcacuucgcgccauugau

SEQ ID NO: 3688168 - RNA, 20 nt, Salmonella enterica enterica serovar Typhi Ty2
ccuggcagaaaggugaaaaa

SEQ ID NO: 3688169 - RNA, 16 nt, Salmonella enterica enterica serovar Typhi Ty2
ccuggcagguauuaau

SEQ ID NO: 3688170 - RNA, 17 nt, Salmonella enterica enterica serovar Typhi Ty2
ccuggcaguucagucgg

SEQ ID NO: 3688171 - RNA, 15 nt, Salmonella enterica enterica serovar Typhi Ty2
ccuggccaauggcuc

SEQ ID NO: 3688172 - RNA, 19 nt, Salmonella enterica enterica serovar Typhi Ty2
ccuggcccggcaguugcug

SEQ ID NO: 3688173 - RNA, 17 nt, Salmonella enterica enterica serovar Typhi Ty2
ccuggcccugcaucagc

SEQ ID NO: 3688174 - RNA, 14 nt, Salmonella enterica enterica serovar Typhi Ty2
ccuggcgaauaaaa

SEQ ID NO: 3688175 - RNA, 19 nt, Salmonella enterica enterica serovar Typhi Ty2
ccuggcgaauaaaauucag

SEQ ID NO: 3688176 - RNA, 19 nt, Salmonella enterica enterica serovar Typhi Ty2
ccuggcgcucaaucagaau

SEQ ID NO: 3688177 - RNA, 20 nt, Salmonella enterica enterica serovar Typhi Ty2
ccuggcgggaaacagguacu

SEQ ID NO: 3688178 - RNA, 14 nt, Salmonella enterica enterica serovar Typhi Ty2
ccuggcgggcagcc

SEQ ID NO: 3688179 - RNA, 19 nt, Salmonella enterica enterica serovar Typhi Ty2
ccuggcgguaagccaccag

SEQ ID NO: 3688180 - RNA, 21 nt, Salmonella enterica enterica serovar Typhi Ty2
ccuggcgugcgauuugcucaa

SEQ ID NO: 3688181 - RNA, 20 nt, Salmonella enterica enterica serovar Typhi Ty2
ccuggcgugucaucaaaauc

SEQ ID NO: 3688182 - RNA, 13 nt, Salmonella enterica enterica serovar Typhi Ty2
ccuggcguuauca

SEQ ID NO: 3688183 - RNA, 13 nt, Salmonella enterica enterica serovar Typhi Ty2
ccuggcucuuccg

SEQ ID NO: 3688184 - RNA, 20 nt, Salmonella enterica enterica serovar Typhi Ty2
ccuggcugucggcagaaccu

SEQ ID NO: 3688185 - RNA, 15 nt, Salmonella enterica enterica serovar Typhi Ty2
ccugggaaucgugca

SEQ ID NO: 3688186 - RNA, 13 nt, Salmonella enterica enterica serovar Typhi Ty2
ccugggccgggua

SEQ ID NO: 3688187 - RNA, 13 nt, Salmonella enterica enterica serovar Typhi Ty2
ccugggcgaaaac

SEQ ID NO: 3688188 - RNA, 19 nt, Salmonella enterica enterica serovar Typhi Ty2
ccugggcgaaaacgcccgc

SEQ ID NO: 3688189 - RNA, 22 nt, Salmonella enterica enterica serovar Typhi Ty2
ccuggguauuuuuuagcgccaa

SEQ ID NO: 3688190 - RNA, 18 nt, Salmonella enterica enterica serovar Typhi Ty2
ccugggucguugacguga

SEQ ID NO: 3688191 - RNA, 15 nt, Salmonella enterica enterica serovar Typhi Ty2
ccugguaagcgcaau

SEQ ID NO: 3688192 - RNA, 20 nt, Salmonella enterica enterica serovar Typhi Ty2
ccugguaaggcaaauaugcu

SEQ ID NO: 3688193 - RNA, 15 nt, Salmonella enterica enterica serovar Typhi Ty2
ccugguccggcaggu

SEQ ID NO: 3688194 - RNA, 17 nt, Salmonella enterica enterica serovar Typhi Ty2
ccugguccucugauaag

SEQ ID NO: 3688195 - RNA, 13 nt, Salmonella enterica enterica serovar Typhi Ty2
ccuggucgauaau

SEQ ID NO: 3688196 - RNA, 18 nt, Salmonella enterica enterica serovar Typhi Ty2
ccuggucuauucguucuc

SEQ ID NO: 3688197 - RNA, 20 nt, Salmonella enterica enterica serovar Typhi Ty2
ccuggucuauucguucucug

SEQ ID NO: 3688198 - RNA, 16 nt, Salmonella enterica enterica serovar Typhi Ty2
ccuggugagcuccagc

SEQ ID NO: 3688199 - RNA, 18 nt, Salmonella enterica enterica serovar Typhi Ty2
ccuggugagguuucagca

SEQ ID NO: 3688200 - RNA, 19 nt, Salmonella enterica enterica serovar Typhi Ty2
ccuggugcgacaccacgca

SEQ ID NO: 3688201 - RNA, 13 nt, Salmonella enterica enterica serovar Typhi Ty2
ccugguuaacaau

SEQ ID NO: 3688202 - RNA, 20 nt, Salmonella enterica enterica serovar Typhi Ty2
ccugguuauuagaugcgaau

SEQ ID NO: 3688203 - RNA, 15 nt, Salmonella enterica enterica serovar Typhi Ty2
ccugguugacccgca

SEQ ID NO: 3688204 - RNA, 19 nt, Salmonella enterica enterica serovar Typhi Ty2
ccugguuuguccagggcau

SEQ ID NO: 3688205 - RNA, 18 nt, Salmonella enterica enterica serovar Typhi Ty2
ccuguaaaaaauccagcg

SEQ ID NO: 3688206 - RNA, 14 nt, Salmonella enterica enterica serovar Typhi Ty2
ccuguaaaccgccu

SEQ ID NO: 3688207 - RNA, 19 nt, Salmonella enterica enterica serovar Typhi Ty2
ccuguaaacgcuucugcgc

SEQ ID NO: 3688208 - RNA, 14 nt, Salmonella enterica enterica serovar Typhi Ty2
ccuucgaacagcuc

SEQ ID NO: 3688209 - RNA, 17 nt, Salmonella enterica enterica serovar Typhi Ty2
ccuucgaccgucagcag

SEQ ID NO: 3688210 - RNA, 21 nt, Salmonella enterica enterica serovar Typhi Ty2
ccuucgacgagguuuccggcg

SEQ ID NO: 3688211 - RNA, 17 nt, Salmonella enterica enterica serovar Typhi Ty2
ccuucgaugagcgcgaa

SEQ ID NO: 3688212 - RNA, 20 nt, Salmonella enterica enterica serovar Typhi Ty2
ccuucgaugagcgcgaaauc

SEQ ID NO: 3688213 - RNA, 16 nt, Salmonella enterica enterica serovar Typhi Ty2
ccuucgcccggcgcgc

SEQ ID NO: 3688214 - RNA, 14 nt, Salmonella enterica enterica serovar Typhi Ty2
ccuucgcccucgcc

SEQ ID NO: 3688215 - RNA, 12 nt, Salmonella enterica enterica serovar Typhi Ty2
ccuucgccgccg

SEQ ID NO: 3688216 - RNA, 20 nt, Salmonella enterica enterica serovar Typhi Ty2
ccuucgcggugaucccaggc

SEQ ID NO: 3688217 - RNA, 20 nt, Salmonella enterica enterica serovar Typhi Ty2
ccuucggccuccgcuuccug

SEQ ID NO: 3688218 - RNA, 12 nt, Salmonella enterica enterica serovar Typhi Ty2
ccuucggcucca

SEQ ID NO: 3688219 - RNA, 12 nt, Salmonella enterica enterica serovar Typhi Ty2
ccuucgggcgau

SEQ ID NO: 3688220 - RNA, 14 nt, Salmonella enterica enterica serovar Typhi Ty2
ccuucggugccaua

SEQ ID NO: 3688221 - RNA, 15 nt, Salmonella enterica enterica serovar Typhi Ty2
ccuucgucaaaaugg

SEQ ID NO: 3688222 - RNA, 16 nt, Salmonella enterica enterica serovar Typhi Ty2
ccuucgucaaaauggg

SEQ ID NO: 3688223 - RNA, 18 nt, Salmonella enterica enterica serovar Typhi Ty2
ccuucgucaggaggccug

SEQ ID NO: 3688224 - RNA, 13 nt, Salmonella enterica enterica serovar Typhi Ty2
ccuucguccggau

SEQ ID NO: 3688225 - RNA, 14 nt, Salmonella enterica enterica serovar Typhi Ty2
ccuucuccacucau

SEQ ID NO: 3688226 - RNA, 14 nt, Salmonella enterica enterica serovar Typhi Ty2
ccuucuccccuuca

SEQ ID NO: 3688227 - RNA, 17 nt, Salmonella enterica enterica serovar Typhi Ty2
ccuucucugucgagcau

SEQ ID NO: 3688228 - RNA, 14 nt, Salmonella enterica enterica serovar Typhi Ty2
ccuucugcgcccgc

SEQ ID NO: 3688229 - RNA, 17 nt, Salmonella enterica enterica serovar Typhi Ty2
ccuucugcuaucaggau

SEQ ID NO: 3688230 - RNA, 18 nt, Salmonella enterica enterica serovar Typhi Ty2
ccuucugguagccagaca

SEQ ID NO: 3688231 - RNA, 19 nt, Salmonella enterica enterica serovar Typhi Ty2
ccuucuguaagcaauuaau

SEQ ID NO: 3688232 - RNA, 17 nt, Salmonella enterica enterica serovar Typhi Ty2
ccuucuuccauucccac

SEQ ID NO: 3688233 - RNA, 12 nt, Salmonella enterica enterica serovar Typhi Ty2
ccuucuuccccc

SEQ ID NO: 3688234 - RNA, 19 nt, Salmonella enterica enterica serovar Typhi Ty2
ccuucuuccgucaccguau

SEQ ID NO: 3688235 - RNA, 14 nt, Salmonella enterica enterica serovar Typhi Ty2
ccuucuucgccaac

SEQ ID NO: 3688236 - RNA, 15 nt, Salmonella enterica enterica serovar Typhi Ty2
ccuucuucgccguca

SEQ ID NO: 3688237 - RNA, 18 nt, Salmonella enterica enterica serovar Typhi Ty2
ccuucuugcucaaaaagc

SEQ ID NO: 3688238 - RNA, 20 nt, Salmonella enterica enterica serovar Typhi Ty2
ccuucuuuauucacuuuuuc

SEQ ID NO: 3688239 - RNA, 21 nt, Salmonella enterica enterica serovar Typhi Ty2
ccuucuuuauucacuuuuucu

SEQ ID NO: 3688240 - RNA, 13 nt, Salmonella enterica enterica serovar Typhi Ty2
ccuucuuuggcuu

SEQ ID NO: 3688241 - RNA, 12 nt, Salmonella enterica enterica serovar Typhi Ty2
ccuucuuuuacu

SEQ ID NO: 3688242 - RNA, 15 nt, Salmonella enterica enterica serovar Typhi Ty2
ccuugaccgccugau

SEQ ID NO: 3688243 - RNA, 20 nt, Salmonella enterica enterica serovar Typhi Ty2
ccuugccgcuuccaguccag

SEQ ID NO: 3688244 - RNA, 13 nt, Salmonella enterica enterica serovar Typhi Ty2
ccuugcgaagacc

SEQ ID NO: 3688245 - RNA, 14 nt, Salmonella enterica enterica serovar Typhi Ty2
ccuugcgcagccag

SEQ ID NO: 3688246 - RNA, 15 nt, Salmonella enterica enterica serovar Typhi Ty2
ccuugcggcggcguu

SEQ ID NO: 3688247 - RNA, 18 nt, Salmonella enterica enterica serovar Typhi Ty2
ccuugcgggauacaugcc

SEQ ID NO: 3688248 - RNA, 23 nt, Salmonella enterica enterica serovar Typhi Ty2
ccuugcgggcaugggaaauaacg

SEQ ID NO: 3688249 - RNA, 21 nt, Salmonella enterica enterica serovar Typhi Ty2
ccuugcggugagaaacgcgcc

SEQ ID NO: 3688250 - RNA, 15 nt, Salmonella enterica enterica serovar Typhi Ty2
ccuugcggugcagca

SEQ ID NO: 3688251 - RNA, 16 nt, Salmonella enterica enterica serovar Typhi Ty2
ccuugcgguugcagca

SEQ ID NO: 3688252 - RNA, 21 nt, Salmonella enterica enterica serovar Typhi Ty2
ccuugcuggccuguucaagug

SEQ ID NO: 3688253 - RNA, 13 nt, Salmonella enterica enterica serovar Typhi Ty2
ccuugugucacau

SEQ ID NO: 3688254 - RNA, 12 nt, Salmonella enterica enterica serovar Typhi Ty2
ccuuguuuuaac

SEQ ID NO: 3688255 - RNA, 22 nt, Salmonella enterica enterica serovar Typhi Ty2
ccuuuacugaaucucagauaau

SEQ ID NO: 3688256 - RNA, 18 nt, Salmonella enterica enterica serovar Typhi Ty2
ccuuuacugacaauaagu

SEQ ID NO: 3688257 - RNA, 17 nt, Salmonella enterica enterica serovar Typhi Ty2
ccuuuacuguugccuuu

SEQ ID NO: 3688258 - RNA, 19 nt, Salmonella enterica enterica serovar Typhi Ty2
ccuuuacuucuuugcgauu

SEQ ID NO: 3688259 - RNA, 12 nt, Salmonella enterica enterica serovar Typhi Ty2
ccuuucaacgga

SEQ ID NO: 3688260 - RNA, 19 nt, Salmonella enterica enterica serovar Typhi Ty2
ccuuucaacggauugugaa

SEQ ID NO: 3688261 - RNA, 11 nt, Salmonella enterica enterica serovar Typhi Ty2
ccuuucauuuu

SEQ ID NO: 3688262 - RNA, 13 nt, Salmonella enterica enterica serovar Typhi Ty2
ccuuuccugugcu

SEQ ID NO: 3688263 - RNA, 17 nt, Salmonella enterica enterica serovar Typhi Ty2
ccuuucggacuuccugu

SEQ ID NO: 3688264 - RNA, 21 nt, Salmonella enterica enterica serovar Typhi Ty2
ccuuucguaguuggcaacccg

SEQ ID NO: 3688265 - RNA, 19 nt, Salmonella enterica enterica serovar Typhi Ty2
ccuuucgugcacuucaugc

SEQ ID NO: 3688266 - RNA, 15 nt, Salmonella enterica enterica serovar Typhi Ty2
ccuuucuguucuuug

SEQ ID NO: 3688267 - RNA, 16 nt, Salmonella enterica enterica serovar Typhi Ty2
ccuuucuuauuuuuuu

SEQ ID NO: 3688268 - RNA, 14 nt, Salmonella enterica enterica serovar Typhi Ty2
ccuuugacaaccug

SEQ ID NO: 3688269 - RNA, 13 nt, Salmonella enterica enterica serovar Typhi Ty2
ccuuugaccauua

SEQ ID NO: 3688270 - RNA, 16 nt, Salmonella enterica enterica serovar Typhi Ty2
ccuuugccgguuuuug

SEQ ID NO: 3688271 - RNA, 23 nt, Salmonella enterica enterica serovar Typhi Ty2
ccuuugcgaauggccuccagcag

SEQ ID NO: 3688272 - RNA, 21 nt, Salmonella enterica enterica serovar Typhi Ty2
ccuuugcgcgcgauauccacc

SEQ ID NO: 3688273 - RNA, 23 nt, Salmonella enterica enterica serovar Typhi Ty2
ccuuuggaggagagcgucaugaa

SEQ ID NO: 3688274 - RNA, 13 nt, Salmonella enterica enterica serovar Typhi Ty2
ccuuugucaucca

SEQ ID NO: 3688275 - RNA, 14 nt, Salmonella enterica enterica serovar Typhi Ty2
ccuuuuaacgcggu

SEQ ID NO: 3688276 - RNA, 15 nt, Salmonella enterica enterica serovar Typhi Ty2
ccuuuuaagguuaca

SEQ ID NO: 3688277 - RNA, 16 nt, Salmonella enterica enterica serovar Typhi Ty2
ccuuuuagcacuuuaa

SEQ ID NO: 3688278 - RNA, 13 nt, Salmonella enterica enterica serovar Typhi Ty2
ccuuuugcagaau

SEQ ID NO: 3688279 - RNA, 19 nt, Salmonella enterica enterica serovar Typhi Ty2
ccuuuuuauggcccgccag

SEQ ID NO: 3688280 - RNA, 20 nt, Salmonella enterica enterica serovar Typhi Ty2
ccuuuuucaauuuccaguuu

SEQ ID NO: 3688281 - RNA, 19 nt, Salmonella enterica enterica serovar Typhi Ty2
ccuuuuucauccucaacca

SEQ ID NO: 3688282 - RNA, 22 nt, Salmonella enterica enterica serovar Typhi Ty2
ccuuuuugauccguuucagaaa

SEQ ID NO: 3688283 - RNA, 15 nt, Salmonella enterica enterica serovar Typhi Ty2
ccuuuuugcagcgcg

SEQ ID NO: 3688284 - RNA, 19 nt, Salmonella enterica enterica serovar Typhi Ty2
ccuuuuugcauucgcuccu

SEQ ID NO: 3688285 - RNA, 20 nt, Salmonella enterica enterica serovar Typhi Ty2
ccuuuuuugguuauccagca

SEQ ID NO: 3688286 - RNA, 13 nt, Salmonella enterica enterica serovar Typhi Ty2
cgaaaaaagaugg

SEQ ID NO: 3688287 - RNA, 18 nt, Salmonella enterica enterica serovar Typhi Ty2
cgaaaacagcuggcgaua

SEQ ID NO: 3688288 - RNA, 22 nt, Salmonella enterica enterica serovar Typhi Ty2
cgaaaaccgagcgcaugguaga

SEQ ID NO: 3688289 - RNA, 22 nt, Salmonella enterica enterica serovar Typhi Ty2
cgaaaacggcgcaggcaaauca

SEQ ID NO: 3688290 - RNA, 23 nt, Salmonella enterica enterica serovar Typhi Ty2
cgaaaacggcgcaggcaaaucaa

SEQ ID NO: 3688291 - RNA, 16 nt, Salmonella enterica enterica serovar Typhi Ty2
cgaauaauuauuuucg

SEQ ID NO: 3688292 - RNA, 22 nt, Salmonella enterica enterica serovar Typhi Ty2
cgaauacuacugguggaauaaa

SEQ ID NO: 3688293 - RNA, 20 nt, Salmonella enterica enterica serovar Typhi Ty2
cgaauacuccugcaacagaa

SEQ ID NO: 3688294 - RNA, 13 nt, Salmonella enterica enterica serovar Typhi Ty2
cgaauagcgccag

SEQ ID NO: 3688295 - RNA, 22 nt, Salmonella enterica enterica serovar Typhi Ty2
cgaauagcgcgcuaaacgugac

SEQ ID NO: 3688296 - RNA, 22 nt, Salmonella enterica enterica serovar Typhi Ty2
cgaauaguggcgcgccagcgau

SEQ ID NO: 3688297 - RNA, 18 nt, Salmonella enterica enterica serovar Typhi Ty2
cgaauauacgcaccugau

SEQ ID NO: 3688298 - RNA, 15 nt, Salmonella enterica enterica serovar Typhi Ty2
cgaauaucuuugucc

SEQ ID NO: 3688299 - RNA, 18 nt, Salmonella enterica enterica serovar Typhi Ty2
cgaauccccaucuccaga

SEQ ID NO: 3688300 - RNA, 19 nt, Salmonella enterica enterica serovar Typhi Ty2
cgaauccccaucuccagac

SEQ ID NO: 3688301 - RNA, 23 nt, Salmonella enterica enterica serovar Typhi Ty2
cgaauccgccauagccggcgaua

SEQ ID NO: 3688302 - RNA, 12 nt, Salmonella enterica enterica serovar Typhi Ty2
cgaauccggggg

SEQ ID NO: 3688303 - RNA, 19 nt, Salmonella enterica enterica serovar Typhi Ty2
cgaauccguugaucgucca

SEQ ID NO: 3688304 - RNA, 12 nt, Salmonella enterica enterica serovar Typhi Ty2
cgaauccuccug

SEQ ID NO: 3688305 - RNA, 21 nt, Salmonella enterica enterica serovar Typhi Ty2
cgaaucgacaauccgccacgc

SEQ ID NO: 3688306 - RNA, 22 nt, Salmonella enterica enterica serovar Typhi Ty2
cgaaucgacaauccgccacgcu

SEQ ID NO: 3688307 - RNA, 22 nt, Salmonella enterica enterica serovar Typhi Ty2
cgaaucgccuguaccgggcaga

SEQ ID NO: 3688308 - RNA, 16 nt, Salmonella enterica enterica serovar Typhi Ty2
cgaaugcgccagcgag

SEQ ID NO: 3688309 - RNA, 18 nt, Salmonella enterica enterica serovar Typhi Ty2
cgaaugcgccagcgagac

SEQ ID NO: 3688310 - RNA, 16 nt, Salmonella enterica enterica serovar Typhi Ty2
cgaaugcugcaucuua

SEQ ID NO: 3688311 - RNA, 16 nt, Salmonella enterica enterica serovar Typhi Ty2
cgaauguacaccguaa

SEQ ID NO: 3688312 - RNA, 15 nt, Salmonella enterica enterica serovar Typhi Ty2
cgaaugucauccgga

SEQ ID NO: 3688313 - RNA, 22 nt, Salmonella enterica enterica serovar Typhi Ty2
cgaaugugcaccuuaaccgucu

SEQ ID NO: 3688314 - RNA, 13 nt, Salmonella enterica enterica serovar Typhi Ty2
cgaauguuccgca

SEQ ID NO: 3688315 - RNA, 12 nt, Salmonella enterica enterica serovar Typhi Ty2
cgaauuccgccu

SEQ ID NO: 3688316 - RNA, 22 nt, Salmonella enterica enterica serovar Typhi Ty2
cgaauucguccacacgccuggc

SEQ ID NO: 3688317 - RNA, 14 nt, Salmonella enterica enterica serovar Typhi Ty2
cgaauugucgguuu

SEQ ID NO: 3688318 - RNA, 21 nt, Salmonella enterica enterica serovar Typhi Ty2
cgaauuuauaagccugagcgc

SEQ ID NO: 3688319 - RNA, 15 nt, Salmonella enterica enterica serovar Typhi Ty2
cgaauuucacgcagc

SEQ ID NO: 3688320 - RNA, 19 nt, Salmonella enterica enterica serovar Typhi Ty2
cgacaaaaagcgcgccgaa

SEQ ID NO: 3688321 - RNA, 19 nt, Salmonella enterica enterica serovar Typhi Ty2
cgacaaaagccagauaaag

SEQ ID NO: 3688322 - RNA, 15 nt, Salmonella enterica enterica serovar Typhi Ty2
cgacaaacagcgccc

SEQ ID NO: 3688323 - RNA, 15 nt, Salmonella enterica enterica serovar Typhi Ty2
cgacaaacagcuauc

SEQ ID NO: 3688324 - RNA, 18 nt, Salmonella enterica enterica serovar Typhi Ty2
cgacaaaccacugcugua

SEQ ID NO: 3688325 - RNA, 16 nt, Salmonella enterica enterica serovar Typhi Ty2
cgacaaacuccagcuc

SEQ ID NO: 3688326 - RNA, 14 nt, Salmonella enterica enterica serovar Typhi Ty2
cgacaaccagcgaa

SEQ ID NO: 3688327 - RNA, 21 nt, Salmonella enterica enterica serovar Typhi Ty2
cgacaaccuguaggccggaua

SEQ ID NO: 3688328 - RNA, 16 nt, Salmonella enterica enterica serovar Typhi Ty2
cgacaacgcccacauc

SEQ ID NO: 3688329 - RNA, 18 nt, Salmonella enterica enterica serovar Typhi Ty2
cgacaacgccuccugccg

SEQ ID NO: 3688330 - RNA, 20 nt, Salmonella enterica enterica serovar Typhi Ty2
cgacaacgccuccugccgau

SEQ ID NO: 3688331 - RNA, 21 nt, Salmonella enterica enterica serovar Typhi Ty2
cgacaacuucuaauuuuucca

SEQ ID NO: 3688332 - RNA, 23 nt, Salmonella enterica enterica serovar Typhi Ty2
cgacaacuucuaauuuuuccagc

SEQ ID NO: 3688333 - RNA, 20 nt, Salmonella enterica enterica serovar Typhi Ty2
cgacaagcggguggucugga

SEQ ID NO: 3688334 - RNA, 15 nt, Salmonella enterica enterica serovar Typhi Ty2
cgacaaucagcacca

SEQ ID NO: 3688335 - RNA, 12 nt, Salmonella enterica enterica serovar Typhi Ty2
cgacaaucgcaa

SEQ ID NO: 3688336 - RNA, 16 nt, Salmonella enterica enterica serovar Typhi Ty2
cgacaaucucaccggc

SEQ ID NO: 3688337 - RNA, 21 nt, Salmonella enterica enterica serovar Typhi Ty2
cgacaauggcgacgaucagcg

SEQ ID NO: 3688338 - RNA, 20 nt, Salmonella enterica enterica serovar Typhi Ty2
cgacaauggcuagggaaacg

SEQ ID NO: 3688339 - RNA, 15 nt, Salmonella enterica enterica serovar Typhi Ty2
cgacaauguccgcca

SEQ ID NO: 3688340 - RNA, 22 nt, Salmonella enterica enterica serovar Typhi Ty2
cgacacagcguuuaacugaaca

SEQ ID NO: 3688341 - RNA, 14 nt, Salmonella enterica enterica serovar Typhi Ty2
cgacacaucaucgc

SEQ ID NO: 3688342 - RNA, 15 nt, Salmonella enterica enterica serovar Typhi Ty2
cgacacauccugcgg

SEQ ID NO: 3688343 - RNA, 21 nt, Salmonella enterica enterica serovar Typhi Ty2
cgacacauccugcgggaugcg

SEQ ID NO: 3688344 - RNA, 18 nt, Salmonella enterica enterica serovar Typhi Ty2
cgacacauuucagcgcag

SEQ ID NO: 3688345 - RNA, 23 nt, Salmonella enterica enterica serovar Typhi Ty2
cgacacauuuucaaugcacgcca

SEQ ID NO: 3688346 - RNA, 16 nt, Salmonella enterica enterica serovar Typhi Ty2
cgacaccagcgucgca

SEQ ID NO: 3688347 - RNA, 19 nt, Salmonella enterica enterica serovar Typhi Ty2
cgacacccgauacacgccg

SEQ ID NO: 3688348 - RNA, 21 nt, Salmonella enterica enterica serovar Typhi Ty2
cgacacgcgcgcugcgccugg

SEQ ID NO: 3688349 - RNA, 13 nt, Salmonella enterica enterica serovar Typhi Ty2
cgacacuugcgca

SEQ ID NO: 3688350 - RNA, 23 nt, Salmonella enterica enterica serovar Typhi Ty2
cgacagaauaugcauauucauau

SEQ ID NO: 3688351 - RNA, 18 nt, Salmonella enterica enterica serovar Typhi Ty2
cgacagagaaugcgccgc

SEQ ID NO: 3688352 - RNA, 19 nt, Salmonella enterica enterica serovar Typhi Ty2
cgacagagaaugcgccgcc

SEQ ID NO: 3688353 - RNA, 23 nt, Salmonella enterica enterica serovar Typhi Ty2
cgacagagucguuagcagaaugg

SEQ ID NO: 3688354 - RNA, 19 nt, Salmonella enterica enterica serovar Typhi Ty2
cgacagauuggucagcagc

SEQ ID NO: 3688355 - RNA, 21 nt, Salmonella enterica enterica serovar Typhi Ty2
cgacagauuggucagcagccc

SEQ ID NO: 3688356 - RNA, 22 nt, Salmonella enterica enterica serovar Typhi Ty2
cgacagcaauguuaaauucagc

SEQ ID NO: 3688357 - RNA, 23 nt, Salmonella enterica enterica serovar Typhi Ty2
cgacagcaauguuaaauucagca

SEQ ID NO: 3688358 - RNA, 20 nt, Salmonella enterica enterica serovar Typhi Ty2
cgacagccagcauuuccagc

SEQ ID NO: 3688359 - RNA, 16 nt, Salmonella enterica enterica serovar Typhi Ty2
cgacagcccggcgugu

SEQ ID NO: 3688360 - RNA, 15 nt, Salmonella enterica enterica serovar Typhi Ty2
cgacagcgcccaacg

SEQ ID NO: 3688361 - RNA, 14 nt, Salmonella enterica enterica serovar Typhi Ty2
cgacagcgcgcgcg

SEQ ID NO: 3688362 - RNA, 20 nt, Salmonella enterica enterica serovar Typhi Ty2
cgacagcgcuauccggccca

SEQ ID NO: 3688363 - RNA, 14 nt, Salmonella enterica enterica serovar Typhi Ty2
cgacagcggcgauu

SEQ ID NO: 3688364 - RNA, 22 nt, Salmonella enterica enterica serovar Typhi Ty2
cgacaggggggaacagcaaugc

SEQ ID NO: 3688365 - RNA, 22 nt, Salmonella enterica enterica serovar Typhi Ty2
cgacaggguuugccagcaccag

SEQ ID NO: 3688366 - RNA, 17 nt, Salmonella enterica enterica serovar Typhi Ty2
cgacauaaaacccgccu

SEQ ID NO: 3688367 - RNA, 13 nt, Salmonella enterica enterica serovar Typhi Ty2
cgacauaaacauu

SEQ ID NO: 3688368 - RNA, 14 nt, Salmonella enterica enterica serovar Typhi Ty2
cgacauagcugaac

SEQ ID NO: 3688369 - RNA, 13 nt, Salmonella enterica enterica serovar Typhi Ty2
cgacaucacgcaa

SEQ ID NO: 3688370 - RNA, 12 nt, Salmonella enterica enterica serovar Typhi Ty2
cgacaucagcca

SEQ ID NO: 3688371 - RNA, 19 nt, Salmonella enterica enterica serovar Typhi Ty2
cgacaucagccagccgcca

SEQ ID NO: 3688372 - RNA, 16 nt, Salmonella enterica enterica serovar Typhi Ty2
cgacaucgccaaccgc

SEQ ID NO: 3688373 - RNA, 13 nt, Salmonella enterica enterica serovar Typhi Ty2
cgacgucuuucuu

SEQ ID NO: 3688374 - RNA, 20 nt, Salmonella enterica enterica serovar Typhi Ty2
cgacguuaucgccgacaaac

SEQ ID NO: 3688375 - RNA, 17 nt, Salmonella enterica enterica serovar Typhi Ty2
cgacguuaucucgccag

SEQ ID NO: 3688376 - RNA, 21 nt, Salmonella enterica enterica serovar Typhi Ty2
cgacguugaucgccaucgcga

SEQ ID NO: 3688377 - RNA, 17 nt, Salmonella enterica enterica serovar Typhi Ty2
cgacguugucuucaucu

SEQ ID NO: 3688378 - RNA, 18 nt, Salmonella enterica enterica serovar Typhi Ty2
cgacuaccgccgauaaac

SEQ ID NO: 3688379 - RNA, 14 nt, Salmonella enterica enterica serovar Typhi Ty2
cgacuaucuucuuc

SEQ ID NO: 3688380 - RNA, 19 nt, Salmonella enterica enterica serovar Typhi Ty2
cgacuauuccgcaaacgcc

SEQ ID NO: 3688381 - RNA, 15 nt, Salmonella enterica enterica serovar Typhi Ty2
cgacugaccagacag

SEQ ID NO: 3688382 - RNA, 15 nt, Salmonella enterica enterica serovar Typhi Ty2
cgacugauaacggcg

SEQ ID NO: 3688383 - RNA, 14 nt, Salmonella enterica enterica serovar Typhi Ty2
cgacugccgcagac

SEQ ID NO: 3688384 - RNA, 21 nt, Salmonella enterica enterica serovar Typhi Ty2
cgacugguaaugucauccagc

SEQ ID NO: 3688385 - RNA, 14 nt, Salmonella enterica enterica serovar Typhi Ty2
cgacuguuguucuu

SEQ ID NO: 3688386 - RNA, 20 nt, Salmonella enterica enterica serovar Typhi Ty2
cgacuguuguucuucauaca

SEQ ID NO: 3688387 - RNA, 13 nt, Salmonella enterica enterica serovar Typhi Ty2
cgacuuaucuucc

SEQ ID NO: 3688388 - RNA, 17 nt, Salmonella enterica enterica serovar Typhi Ty2
cgacuuaucuuccacgc

SEQ ID NO: 3688389 - RNA, 16 nt, Salmonella enterica enterica serovar Typhi Ty2
cgacuuauuugcucag

SEQ ID NO: 3688390 - RNA, 14 nt, Salmonella enterica enterica serovar Typhi Ty2
cgacuucaagguuc

SEQ ID NO: 3688391 - RNA, 15 nt, Salmonella enterica enterica serovar Typhi Ty2
cgacuucgaagguuc

SEQ ID NO: 3688392 - RNA, 21 nt, Salmonella enterica enterica serovar Typhi Ty2
cgacuuuaaacuuauccgcca

SEQ ID NO: 3688393 - RNA, 23 nt, Salmonella enterica enterica serovar Typhi Ty2
cgacuuuaaacuuauccgccauc

SEQ ID NO: 3688394 - RNA, 14 nt, Salmonella enterica enterica serovar Typhi Ty2
cgacuuuucgcccc

SEQ ID NO: 3688395 - RNA, 14 nt, Salmonella enterica enterica serovar Typhi Ty2
cgagaaaaaacuca

SEQ ID NO: 3688396 - RNA, 14 nt, Salmonella enterica enterica serovar Typhi Ty2
cgagaaagcguugc

SEQ ID NO: 3688397 - RNA, 22 nt, Salmonella enterica enterica serovar Typhi Ty2
cgagaaagcguugccguaggca

SEQ ID NO: 3688398 - RNA, 16 nt, Salmonella enterica enterica serovar Typhi Ty2
cgagaaccaacugcca

SEQ ID NO: 3688399 - RNA, 21 nt, Salmonella enterica enterica serovar Typhi Ty2
cgagaaccaacugccaaacca

SEQ ID NO: 3688400 - RNA, 16 nt, Salmonella enterica enterica serovar Typhi Ty2
cgagaagcccagcuca

SEQ ID NO: 3688401 - RNA, 15 nt, Salmonella enterica enterica serovar Typhi Ty2
cgagaagucggcuuu

SEQ ID NO: 3688402 - RNA, 18 nt, Salmonella enterica enterica serovar Typhi Ty2
cgagaaguucucacccau

SEQ ID NO: 3688403 - RNA, 19 nt, Salmonella enterica enterica serovar Typhi Ty2
cgagaauguguucucccug

SEQ ID NO: 3688404 - RNA, 17 nt, Salmonella enterica enterica serovar Typhi Ty2
cgagaccaucaacagcg

SEQ ID NO: 3688405 - RNA, 14 nt, Salmonella enterica enterica serovar Typhi Ty2
cgagacccagcgcg

SEQ ID NO: 3688406 - RNA, 23 nt, Salmonella enterica enterica serovar Typhi Ty2
cgagacuacccaucacgcccugu

SEQ ID NO: 3688407 - RNA, 17 nt, Salmonella enterica enterica serovar Typhi Ty2
cgagacucaaagaaaac

SEQ ID NO: 3688408 - RNA, 15 nt, Salmonella enterica enterica serovar Typhi Ty2
cgagacugcccggca

SEQ ID NO: 3688409 - RNA, 17 nt, Salmonella enterica enterica serovar Typhi Ty2
cgagacugcccggcaua

SEQ ID NO: 3688410 - RNA, 15 nt, Salmonella enterica enterica serovar Typhi Ty2
cgagagaaaaaaauc

SEQ ID NO: 3688411 - RNA, 23 nt, Salmonella enterica enterica serovar Typhi Ty2
cgagagaauuaacagcgcgacca

SEQ ID NO: 3688412 - RNA, 18 nt, Salmonella enterica enterica serovar Typhi Ty2
cgagagaguauccacaga

SEQ ID NO: 3688413 - RNA, 22 nt, Salmonella enterica enterica serovar Typhi Ty2
cgagagauuaagcgaaccuuaa

SEQ ID NO: 3688414 - RNA, 16 nt, Salmonella enterica enterica serovar Typhi Ty2
cgagagucaaggcauc

SEQ ID NO: 3688415 - RNA, 17 nt, Salmonella enterica enterica serovar Typhi Ty2
cgagagugacgacgcca

SEQ ID NO: 3688416 - RNA, 15 nt, Salmonella enterica enterica serovar Typhi Ty2
cgagaguuugugaug

SEQ ID NO: 3688417 - RNA, 13 nt, Salmonella enterica enterica serovar Typhi Ty2
cgagauaaaaacg

SEQ ID NO: 3688418 - RNA, 16 nt, Salmonella enterica enterica serovar Typhi Ty2
cgagauaaaaacgggu

SEQ ID NO: 3688419 - RNA, 13 nt, Salmonella enterica enterica serovar Typhi Ty2
cgagauaaccggg

SEQ ID NO: 3688420 - RNA, 12 nt, Salmonella enterica enterica serovar Typhi Ty2
cgagauacgcug

SEQ ID NO: 3688421 - RNA, 20 nt, Salmonella enterica enterica serovar Typhi Ty2
cgagauacugcaacgccaga

SEQ ID NO: 3688422 - RNA, 13 nt, Salmonella enterica enterica serovar Typhi Ty2
cgagaucaggccg

SEQ ID NO: 3688423 - RNA, 21 nt, Salmonella enterica enterica serovar Typhi Ty2
cgagauuacugcgugcuggcg

SEQ ID NO: 3688424 - RNA, 13 nt, Salmonella enterica enterica serovar Typhi Ty2
cgagauucaauaa

SEQ ID NO: 3688425 - RNA, 16 nt, Salmonella enterica enterica serovar Typhi Ty2
cgagauucaauaaugu

SEQ ID NO: 3688426 - RNA, 21 nt, Salmonella enterica enterica serovar Typhi Ty2
cgagauuuaccgggaaauguc

SEQ ID NO: 3688427 - RNA, 18 nt, Salmonella enterica enterica serovar Typhi Ty2
cgagauuuuucugcgcca

SEQ ID NO: 3688428 - RNA, 19 nt, Salmonella enterica enterica serovar Typhi Ty2
cgagcacuaauauucgauu

SEQ ID NO: 3688429 - RNA, 18 nt, Salmonella enterica enterica serovar Typhi Ty2
cgagcacuguagcggcug

SEQ ID NO: 3688430 - RNA, 19 nt, Salmonella enterica enterica serovar Typhi Ty2
cgagcacuuuuuccuccug

SEQ ID NO: 3688431 - RNA, 14 nt, Salmonella enterica enterica serovar Typhi Ty2
cgagcaguucagca

SEQ ID NO: 3688432 - RNA, 22 nt, Salmonella enterica enterica serovar Typhi Ty2
cgagcaguucagcagcaccacu

SEQ ID NO: 3688433 - RNA, 18 nt, Salmonella enterica enterica serovar Typhi Ty2
cgagcauccgcgcaauau

SEQ ID NO: 3688434 - RNA, 18 nt, Salmonella enterica enterica serovar Typhi Ty2
cgagcauuuccgcagcca

SEQ ID NO: 3688435 - RNA, 14 nt, Salmonella enterica enterica serovar Typhi Ty2
cgagccacgcggca

SEQ ID NO: 3688436 - RNA, 18 nt, Salmonella enterica enterica serovar Typhi Ty2
cgagccauuaaugcaggc

SEQ ID NO: 3688437 - RNA, 20 nt, Salmonella enterica enterica serovar Typhi Ty2
cgagccauuaaugcaggcag

SEQ ID NO: 3688438 - RNA, 20 nt, Salmonella enterica enterica serovar Typhi Ty2
cgagcccagacuuuccagca

SEQ ID NO: 3688439 - RNA, 18 nt, Salmonella enterica enterica serovar Typhi Ty2
cgagccgucgccggccug

SEQ ID NO: 3688440 - RNA, 21 nt, Salmonella enterica enterica serovar Typhi Ty2
cgagcgauagagaguuccucc

SEQ ID NO: 3688441 - RNA, 19 nt, Salmonella enterica enterica serovar Typhi Ty2
cgagcgaucauaagggagc

SEQ ID NO: 3688442 - RNA, 12 nt, Salmonella enterica enterica serovar Typhi Ty2
cgagcgccugau

SEQ ID NO: 3688443 - RNA, 13 nt, Salmonella enterica enterica serovar Typhi Ty2
cgagcgccugaug

SEQ ID NO: 3688444 - RNA, 17 nt, Salmonella enterica enterica serovar Typhi Ty2
cgagcgcgucagcgccu

SEQ ID NO: 3688445 - RNA, 18 nt, Salmonella enterica enterica serovar Typhi Ty2
cgagcgcgucagcgccuc

SEQ ID NO: 3688446 - RNA, 19 nt, Salmonella enterica enterica serovar Typhi Ty2
cgagcggccaaagggagca

SEQ ID NO: 3688447 - RNA, 14 nt, Salmonella enterica enterica serovar Typhi Ty2
cgagcguagccaac

SEQ ID NO: 3688448 - RNA, 19 nt, Salmonella enterica enterica serovar Typhi Ty2
cgagcuauguuuaagccag

SEQ ID NO: 3688449 - RNA, 21 nt, Salmonella enterica enterica serovar Typhi Ty2
cgagcucaguccagccgccgc

SEQ ID NO: 3688450 - RNA, 20 nt, Salmonella enterica enterica serovar Typhi Ty2
cgagcugucaccgacacgca

SEQ ID NO: 3688451 - RNA, 17 nt, Salmonella enterica enterica serovar Typhi Ty2
cgagcuuuucgccggaa

SEQ ID NO: 3688452 - RNA, 14 nt, Salmonella enterica enterica serovar Typhi Ty2
cgagcuuuuuucuu

SEQ ID NO: 3688453 - RNA, 21 nt, Salmonella enterica enterica serovar Typhi Ty2
cgaggaaaaaugagacgccga

SEQ ID NO: 3688454 - RNA, 21 nt, Salmonella enterica enterica serovar Typhi Ty2
cgaggaacaucagccagcagc

SEQ ID NO: 3688455 - RNA, 22 nt, Salmonella enterica enterica serovar Typhi Ty2
cgauauaagcgccgucauccgc

SEQ ID NO: 3688456 - RNA, 20 nt, Salmonella enterica enterica serovar Typhi Ty2
cgauauaccacccgcuauga

SEQ ID NO: 3688457 - RNA, 15 nt, Salmonella enterica enterica serovar Typhi Ty2
cgauauagcgcauag

SEQ ID NO: 3688458 - RNA, 14 nt, Salmonella enterica enterica serovar Typhi Ty2
cgauauagcgcuga

SEQ ID NO: 3688459 - RNA, 19 nt, Salmonella enterica enterica serovar Typhi Ty2
cgauauaucgcgucaucaa

SEQ ID NO: 3688460 - RNA, 20 nt, Salmonella enterica enterica serovar Typhi Ty2
cgauauaucgcgucaucaaa

SEQ ID NO: 3688461 - RNA, 14 nt, Salmonella enterica enterica serovar Typhi Ty2
cgauauauuuuccg

SEQ ID NO: 3688462 - RNA, 23 nt, Salmonella enterica enterica serovar Typhi Ty2
cgauaucagggcuuuuuucucgc

SEQ ID NO: 3688463 - RNA, 14 nt, Salmonella enterica enterica serovar Typhi Ty2
cgauaucgauaaag

SEQ ID NO: 3688464 - RNA, 22 nt, Salmonella enterica enterica serovar Typhi Ty2
cgauaucgccuggugugaacau

SEQ ID NO: 3688465 - RNA, 17 nt, Salmonella enterica enterica serovar Typhi Ty2
cgauauguggacgccau

SEQ ID NO: 3688466 - RNA, 14 nt, Salmonella enterica enterica serovar Typhi Ty2
cgaucaccagcgca

SEQ ID NO: 3688467 - RNA, 16 nt, Salmonella enterica enterica serovar Typhi Ty2
cgaucaccagcgcauc

SEQ ID NO: 3688468 - RNA, 21 nt, Salmonella enterica enterica serovar Typhi Ty2
cgaucacccacaucagcggca

SEQ ID NO: 3688469 - RNA, 20 nt, Salmonella enterica enterica serovar Typhi Ty2
cgaucacggcgaaucgccug

SEQ ID NO: 3688470 - RNA, 13 nt, Salmonella enterica enterica serovar Typhi Ty2
cgaucagcgccac

SEQ ID NO: 3688471 - RNA, 15 nt, Salmonella enterica enterica serovar Typhi Ty2
cgaucagcgccacca

SEQ ID NO: 3688472 - RNA, 16 nt, Salmonella enterica enterica serovar Typhi Ty2
cgaucaucagaacgcc

SEQ ID NO: 3688473 - RNA, 22 nt, Salmonella enterica enterica serovar Typhi Ty2
cgaucaucauuccgagggugga

SEQ ID NO: 3688474 - RNA, 14 nt, Salmonella enterica enterica serovar Typhi Ty2
cgaucaugccgccc

SEQ ID NO: 3688475 - RNA, 15 nt, Salmonella enterica enterica serovar Typhi Ty2
cgauccagccccagc

SEQ ID NO: 3688476 - RNA, 22 nt, Salmonella enterica enterica serovar Typhi Ty2
cgaucccaguugaucggccagc

SEQ ID NO: 3688477 - RNA, 23 nt, Salmonella enterica enterica serovar Typhi Ty2
cgauccccucuuccaucagccag

SEQ ID NO: 3688478 - RNA, 23 nt, Salmonella enterica enterica serovar Typhi Ty2
cgaucccggcaaaaaucagcccg

SEQ ID NO: 3688479 - RNA, 15 nt, Salmonella enterica enterica serovar Typhi Ty2
cgaucccgggcgaua

SEQ ID NO: 3688480 - RNA, 19 nt, Salmonella enterica enterica serovar Typhi Ty2
cgaucccgggcgauaaacc

SEQ ID NO: 3688481 - RNA, 14 nt, Salmonella enterica enterica serovar Typhi Ty2
cgaucccuaauaaa

SEQ ID NO: 3688482 - RNA, 16 nt, Salmonella enterica enterica serovar Typhi Ty2
cgauccgaagaacaga

SEQ ID NO: 3688483 - RNA, 21 nt, Salmonella enterica enterica serovar Typhi Ty2
cgauccggcauccaaccgaac

SEQ ID NO: 3688484 - RNA, 16 nt, Salmonella enterica enterica serovar Typhi Ty2
cgaucgagcgcaauac

SEQ ID NO: 3688485 - RNA, 23 nt, Salmonella enterica enterica serovar Typhi Ty2
cgaucgagucaggcgccagaguc

SEQ ID NO: 3688486 - RNA, 21 nt, Salmonella enterica enterica serovar Typhi Ty2
cgaucgccccgaccaggauga

SEQ ID NO: 3688487 - RNA, 16 nt, Salmonella enterica enterica serovar Typhi Ty2
cgaucgccuaauccgc

SEQ ID NO: 3688488 - RNA, 23 nt, Salmonella enterica enterica serovar Typhi Ty2
cgaucgcgauucgcccacggaug

SEQ ID NO: 3688489 - RNA, 22 nt, Salmonella enterica enterica serovar Typhi Ty2
cgaucgcgccaucgauagucau

SEQ ID NO: 3688490 - RNA, 16 nt, Salmonella enterica enterica serovar Typhi Ty2
cgaucgcuaaucagga

SEQ ID NO: 3688491 - RNA, 20 nt, Salmonella enterica enterica serovar Typhi Ty2
cgaucgcucaacuccugcau

SEQ ID NO: 3688492 - RNA, 20 nt, Salmonella enterica enterica serovar Typhi Ty2
cgaucgguaggccggauaag

SEQ ID NO: 3688493 - RNA, 14 nt, Salmonella enterica enterica serovar Typhi Ty2
cgaucgguuaucac

SEQ ID NO: 3688494 - RNA, 23 nt, Salmonella enterica enterica serovar Typhi Ty2
cgaucguaaucacccgcuuccag

SEQ ID NO: 3688495 - RNA, 17 nt, Salmonella enterica enterica serovar Typhi Ty2
cgaucuacgguaucugc

SEQ ID NO: 3688496 - RNA, 19 nt, Salmonella enterica enterica serovar Typhi Ty2
cgaucucauaaacgccugg

SEQ ID NO: 3688497 - RNA, 19 nt, Salmonella enterica enterica serovar Typhi Ty2
cgaucugguuauccaccag

SEQ ID NO: 3688498 - RNA, 20 nt, Salmonella enterica enterica serovar Typhi Ty2
cgaucuguacggcauauucc

SEQ ID NO: 3688499 - RNA, 18 nt, Salmonella enterica enterica serovar Typhi Ty2
cgaucuguuggugcgcgu

SEQ ID NO: 3688500 - RNA, 14 nt, Salmonella enterica enterica serovar Typhi Ty2
cgaugaaaaagagg

SEQ ID NO: 3688501 - RNA, 22 nt, Salmonella enterica enterica serovar Typhi Ty2
cgaugaaagagcgcgcgcgccu

SEQ ID NO: 3688502 - RNA, 17 nt, Salmonella enterica enterica serovar Typhi Ty2
cgaugaacaucgacaag

SEQ ID NO: 3688503 - RNA, 16 nt, Salmonella enterica enterica serovar Typhi Ty2
cgaugaacgacgcuga

SEQ ID NO: 3688504 - RNA, 16 nt, Salmonella enterica enterica serovar Typhi Ty2
cgaugaaugacgagca

SEQ ID NO: 3688505 - RNA, 23 nt, Salmonella enterica enterica serovar Typhi Ty2
cgaugacagcaggaacggcagga

SEQ ID NO: 3688506 - RNA, 14 nt, Salmonella enterica enterica serovar Typhi Ty2
cgaugacucccagu

SEQ ID NO: 3688507 - RNA, 17 nt, Salmonella enterica enterica serovar Typhi Ty2
cgaugagauaauaaaug

SEQ ID NO: 3688508 - RNA, 13 nt, Salmonella enterica enterica serovar Typhi Ty2
cgaugagcgccag

SEQ ID NO: 3688509 - RNA, 20 nt, Salmonella enterica enterica serovar Typhi Ty2
cgaugagcgcgaaaucaaag

SEQ ID NO: 3688510 - RNA, 22 nt, Salmonella enterica enterica serovar Typhi Ty2
cgaugagcucguuauaagcuuu

SEQ ID NO: 3688511 - RNA, 23 nt, Salmonella enterica enterica serovar Typhi Ty2
cgaugagcuugcacuaucgggca

SEQ ID NO: 3688512 - RNA, 18 nt, Salmonella enterica enterica serovar Typhi Ty2
cgaugauauccagcacgc

SEQ ID NO: 3688513 - RNA, 18 nt, Salmonella enterica enterica serovar Typhi Ty2
cgaugaucgaggcgugcg

SEQ ID NO: 3688514 - RNA, 13 nt, Salmonella enterica enterica serovar Typhi Ty2
cgaugaucgauga

SEQ ID NO: 3688515 - RNA, 19 nt, Salmonella enterica enterica serovar Typhi Ty2
cgaugaucgucgcgaucgc

SEQ ID NO: 3688516 - RNA, 17 nt, Salmonella enterica enterica serovar Typhi Ty2
cgaugaugaaaaagaau

SEQ ID NO: 3688517 - RNA, 21 nt, Salmonella enterica enterica serovar Typhi Ty2
cgaugauuauuguuaaaaaga

SEQ ID NO: 3688518 - RNA, 20 nt, Salmonella enterica enterica serovar Typhi Ty2
cgaugauuuucaagccaaaa

SEQ ID NO: 3688519 - RNA, 13 nt, Salmonella enterica enterica serovar Typhi Ty2
cgaugcagccugg

SEQ ID NO: 3688520 - RNA, 17 nt, Salmonella enterica enterica serovar Typhi Ty2
cgaugccgccgacaacc

SEQ ID NO: 3688521 - RNA, 17 nt, Salmonella enterica enterica serovar Typhi Ty2
cgaugccuuauccggcc

SEQ ID NO: 3688522 - RNA, 14 nt, Salmonella enterica enterica serovar Typhi Ty2
cgaugcggauccgg

SEQ ID NO: 3688523 - RNA, 23 nt, Salmonella enterica enterica serovar Typhi Ty2
cgaugcgguucaacgcgcugcag

SEQ ID NO: 3688524 - RNA, 15 nt, Salmonella enterica enterica serovar Typhi Ty2
cgaugcguucaaaaa

SEQ ID NO: 3688525 - RNA, 18 nt, Salmonella enterica enterica serovar Typhi Ty2
cgaugcuaugauggccga

SEQ ID NO: 3688526 - RNA, 23 nt, Salmonella enterica enterica serovar Typhi Ty2
cgaugcucaaccaguaccgggcc

SEQ ID NO: 3688527 - RNA, 22 nt, Salmonella enterica enterica serovar Typhi Ty2
cgaugcucagggcauccgccgc

SEQ ID NO: 3688528 - RNA, 21 nt, Salmonella enterica enterica serovar Typhi Ty2
cgaugcugaauagccagcccc

SEQ ID NO: 3688529 - RNA, 20 nt, Salmonella enterica enterica serovar Typhi Ty2
cgaugcuggugaagacgcug

SEQ ID NO: 3688530 - RNA, 18 nt, Salmonella enterica enterica serovar Typhi Ty2
cgauggccagaaugacau

SEQ ID NO: 3688531 - RNA, 15 nt, Salmonella enterica enterica serovar Typhi Ty2
cgauggccucaucau

SEQ ID NO: 3688532 - RNA, 20 nt, Salmonella enterica enterica serovar Typhi Ty2
cgauggccuguuuaagcuuu

SEQ ID NO: 3688533 - RNA, 20 nt, Salmonella enterica enterica serovar Typhi Ty2
cgauggcgauuuucaccggc

SEQ ID NO: 3688534 - RNA, 17 nt, Salmonella enterica enterica serovar Typhi Ty2
cgauggcgcugcgcgca

SEQ ID NO: 3688535 - RNA, 17 nt, Salmonella enterica enterica serovar Typhi Ty2
cgauggugccgacaacc

SEQ ID NO: 3688536 - RNA, 15 nt, Salmonella enterica enterica serovar Typhi Ty2
cgcacauaaucaccg

SEQ ID NO: 3688537 - RNA, 15 nt, Salmonella enterica enterica serovar Typhi Ty2
cgcacaugaucuucg

SEQ ID NO: 3688538 - RNA, 23 nt, Salmonella enterica enterica serovar Typhi Ty2
cgcacauguuaaauacgccgcca

SEQ ID NO: 3688539 - RNA, 20 nt, Salmonella enterica enterica serovar Typhi Ty2
cgcacauuuacgccagccag

SEQ ID NO: 3688540 - RNA, 18 nt, Salmonella enterica enterica serovar Typhi Ty2
cgcaccacgcaaaccgcu

SEQ ID NO: 3688541 - RNA, 15 nt, Salmonella enterica enterica serovar Typhi Ty2
cgcaccacgccgaag

SEQ ID NO: 3688542 - RNA, 14 nt, Salmonella enterica enterica serovar Typhi Ty2
cgcacccgcgcagg

SEQ ID NO: 3688543 - RNA, 17 nt, Salmonella enterica enterica serovar Typhi Ty2
cgcaccgcgaugcugcu

SEQ ID NO: 3688544 - RNA, 21 nt, Salmonella enterica enterica serovar Typhi Ty2
cgcaccguugccauacgccca

SEQ ID NO: 3688545 - RNA, 12 nt, Salmonella enterica enterica serovar Typhi Ty2
cgcacgccagau

SEQ ID NO: 3688546 - RNA, 14 nt, Salmonella enterica enterica serovar Typhi Ty2
cgcacgccagauaa

SEQ ID NO: 3688547 - RNA, 21 nt, Salmonella enterica enterica serovar Typhi Ty2
cgcacgccagauaaaucagcc

SEQ ID NO: 3688548 - RNA, 20 nt, Salmonella enterica enterica serovar Typhi Ty2
cgcacgccggccccgcuucc

SEQ ID NO: 3688549 - RNA, 21 nt, Salmonella enterica enterica serovar Typhi Ty2
cgcacgcgacgcgccagccag

SEQ ID NO: 3688550 - RNA, 12 nt, Salmonella enterica enterica serovar Typhi Ty2
cgcacgcgcgcc

SEQ ID NO: 3688551 - RNA, 13 nt, Salmonella enterica enterica serovar Typhi Ty2
cgcacgcgcgccc

SEQ ID NO: 3688552 - RNA, 22 nt, Salmonella enterica enterica serovar Typhi Ty2
cgcacggcgcguccucacacug

SEQ ID NO: 3688553 - RNA, 21 nt, Salmonella enterica enterica serovar Typhi Ty2
cgcacuaccagaaacaacacg

SEQ ID NO: 3688554 - RNA, 14 nt, Salmonella enterica enterica serovar Typhi Ty2
cgcacucagaaaau

SEQ ID NO: 3688555 - RNA, 14 nt, Salmonella enterica enterica serovar Typhi Ty2
cgcacuccagaugc

SEQ ID NO: 3688556 - RNA, 13 nt, Salmonella enterica enterica serovar Typhi Ty2
cgcacuccccaga

SEQ ID NO: 3688557 - RNA, 18 nt, Salmonella enterica enterica serovar Typhi Ty2
cgcacugauagccgccag

SEQ ID NO: 3688558 - RNA, 22 nt, Salmonella enterica enterica serovar Typhi Ty2
cgcacuggucgggcaggcuucc

SEQ ID NO: 3688559 - RNA, 21 nt, Salmonella enterica enterica serovar Typhi Ty2
cgcacuucacgcuccuugagc

SEQ ID NO: 3688560 - RNA, 14 nt, Salmonella enterica enterica serovar Typhi Ty2
cgcacuuuuccagc

SEQ ID NO: 3688561 - RNA, 16 nt, Salmonella enterica enterica serovar Typhi Ty2
cgcacuuuucccgcca

SEQ ID NO: 3688562 - RNA, 15 nt, Salmonella enterica enterica serovar Typhi Ty2
cgcagaauuuauuuc

SEQ ID NO: 3688563 - RNA, 14 nt, Salmonella enterica enterica serovar Typhi Ty2
cgcagacacugcca

SEQ ID NO: 3688564 - RNA, 15 nt, Salmonella enterica enterica serovar Typhi Ty2
cgcagagcccagcgc

SEQ ID NO: 3688565 - RNA, 16 nt, Salmonella enterica enterica serovar Typhi Ty2
cgcagagcccagcgcg

SEQ ID NO: 3688566 - RNA, 15 nt, Salmonella enterica enterica serovar Typhi Ty2
cgcagagucgcagcg

SEQ ID NO: 3688567 - RNA, 18 nt, Salmonella enterica enterica serovar Typhi Ty2
cgcagaguguaggccuga

SEQ ID NO: 3688568 - RNA, 15 nt, Salmonella enterica enterica serovar Typhi Ty2
cgcagauacgcguca

SEQ ID NO: 3688569 - RNA, 19 nt, Salmonella enterica enterica serovar Typhi Ty2
cgcagauaucuuccagcgc

SEQ ID NO: 3688570 - RNA, 21 nt, Salmonella enterica enterica serovar Typhi Ty2
cgcagauaucuuccagcgcgu

SEQ ID NO: 3688571 - RNA, 13 nt, Salmonella enterica enterica serovar Typhi Ty2
cgcagauccagca

SEQ ID NO: 3688572 - RNA, 18 nt, Salmonella enterica enterica serovar Typhi Ty2
cgcagaucguauccagcg

SEQ ID NO: 3688573 - RNA, 23 nt, Salmonella enterica enterica serovar Typhi Ty2
cgcagaucguauccagcggcaaa

SEQ ID NO: 3688574 - RNA, 12 nt, Salmonella enterica enterica serovar Typhi Ty2
cgcagaugcugc

SEQ ID NO: 3688575 - RNA, 15 nt, Salmonella enterica enterica serovar Typhi Ty2
cgcagcaaaucagcu

SEQ ID NO: 3688576 - RNA, 23 nt, Salmonella enterica enterica serovar Typhi Ty2
cgcagcaacgucucgacauuagc

SEQ ID NO: 3688577 - RNA, 17 nt, Salmonella enterica enterica serovar Typhi Ty2
cgcagcacaugcaauuu

SEQ ID NO: 3688578 - RNA, 20 nt, Salmonella enterica enterica serovar Typhi Ty2
cgcagcagauguggcggccc

SEQ ID NO: 3688579 - RNA, 17 nt, Salmonella enterica enterica serovar Typhi Ty2
cgcagccagaacagaag

SEQ ID NO: 3688580 - RNA, 14 nt, Salmonella enterica enterica serovar Typhi Ty2
cgcagccagcgccc

SEQ ID NO: 3688581 - RNA, 13 nt, Salmonella enterica enterica serovar Typhi Ty2
cgcagccccagcg

SEQ ID NO: 3688582 - RNA, 17 nt, Salmonella enterica enterica serovar Typhi Ty2
cgcagccgcaaucagcg

SEQ ID NO: 3688583 - RNA, 20 nt, Salmonella enterica enterica serovar Typhi Ty2
cgcagccgccauccggcaca

SEQ ID NO: 3688584 - RNA, 16 nt, Salmonella enterica enterica serovar Typhi Ty2
cgcagcgaaaauccag

SEQ ID NO: 3688585 - RNA, 21 nt, Salmonella enterica enterica serovar Typhi Ty2
cgcagcgaacucccgggcgcu

SEQ ID NO: 3688586 - RNA, 22 nt, Salmonella enterica enterica serovar Typhi Ty2
cgcagcgaccuccgcgcagcaa

SEQ ID NO: 3688587 - RNA, 15 nt, Salmonella enterica enterica serovar Typhi Ty2
cgcagcgauauuucu

SEQ ID NO: 3688588 - RNA, 15 nt, Salmonella enterica enterica serovar Typhi Ty2
cgcagcgcaacgccu

SEQ ID NO: 3688589 - RNA, 13 nt, Salmonella enterica enterica serovar Typhi Ty2
cgcagcgccauaa

SEQ ID NO: 3688590 - RNA, 18 nt, Salmonella enterica enterica serovar Typhi Ty2
cgcagcgccaucaggccc

SEQ ID NO: 3688591 - RNA, 20 nt, Salmonella enterica enterica serovar Typhi Ty2
cgcagcgccgacguuaucgc

SEQ ID NO: 3688592 - RNA, 17 nt, Salmonella enterica enterica serovar Typhi Ty2
cgcagcgccugcgccgc

SEQ ID NO: 3688593 - RNA, 14 nt, Salmonella enterica enterica serovar Typhi Ty2
cgcagcgccuucgc

SEQ ID NO: 3688594 - RNA, 12 nt, Salmonella enterica enterica serovar Typhi Ty2
cgcagcgcggcc

SEQ ID NO: 3688595 - RNA, 13 nt, Salmonella enterica enterica serovar Typhi Ty2
cgcagcgcggccu

SEQ ID NO: 3688596 - RNA, 13 nt, Salmonella enterica enterica serovar Typhi Ty2
cgcagcgcggcgc

SEQ ID NO: 3688597 - RNA, 12 nt, Salmonella enterica enterica serovar Typhi Ty2
cgcagcgcgucg

SEQ ID NO: 3688598 - RNA, 23 nt, Salmonella enterica enterica serovar Typhi Ty2
cgcagcgcuuugccgcugcugcc

SEQ ID NO: 3688599 - RNA, 19 nt, Salmonella enterica enterica serovar Typhi Ty2
cgcagcggcauuggcguua

SEQ ID NO: 3688600 - RNA, 12 nt, Salmonella enterica enterica serovar Typhi Ty2
cgcagcggcggu

SEQ ID NO: 3688601 - RNA, 13 nt, Salmonella enterica enterica serovar Typhi Ty2
cgcagcggcugcg

SEQ ID NO: 3688602 - RNA, 22 nt, Salmonella enterica enterica serovar Typhi Ty2
cgcagcugccacaccacaugcg

SEQ ID NO: 3688603 - RNA, 20 nt, Salmonella enterica enterica serovar Typhi Ty2
cgcagcuugguagcgcaacu

SEQ ID NO: 3688604 - RNA, 15 nt, Salmonella enterica enterica serovar Typhi Ty2
cgcaggacagcgaca

SEQ ID NO: 3688605 - RNA, 21 nt, Salmonella enterica enterica serovar Typhi Ty2
cgcaggacuuucgcuucacga

SEQ ID NO: 3688606 - RNA, 14 nt, Salmonella enterica enterica serovar Typhi Ty2
cgcaggagagccag

SEQ ID NO: 3688607 - RNA, 16 nt, Salmonella enterica enterica serovar Typhi Ty2
cgcaggaggcuuccgc

SEQ ID NO: 3688608 - RNA, 22 nt, Salmonella enterica enterica serovar Typhi Ty2
cgcaggauaaagaccggcacaa

SEQ ID NO: 3688609 - RNA, 19 nt, Salmonella enterica enterica serovar Typhi Ty2
cgcaggaugcgcugcgcgc

SEQ ID NO: 3688610 - RNA, 13 nt, Salmonella enterica enterica serovar Typhi Ty2
cgcaggccggaua

SEQ ID NO: 3688611 - RNA, 12 nt, Salmonella enterica enterica serovar Typhi Ty2
cgcaggcgagcg

SEQ ID NO: 3688612 - RNA, 16 nt, Salmonella enterica enterica serovar Typhi Ty2
cgcaggggggaaauga

SEQ ID NO: 3688613 - RNA, 20 nt, Salmonella enterica enterica serovar Typhi Ty2
cgcaggucuucgucagcgca

SEQ ID NO: 3688614 - RNA, 14 nt, Salmonella enterica enterica serovar Typhi Ty2
cgcagguuuuacuu

SEQ ID NO: 3688615 - RNA, 18 nt, Salmonella enterica enterica serovar Typhi Ty2
cgcaguaauacgccgccg

SEQ ID NO: 3688616 - RNA, 14 nt, Salmonella enterica enterica serovar Typhi Ty2
cgcaguacgcgcaa

SEQ ID NO: 3688617 - RNA, 17 nt, Salmonella enterica enterica serovar Typhi Ty2
cgcagucaaaacgacau

SEQ ID NO: 3688618 - RNA, 16 nt, Salmonella enterica enterica serovar Typhi Ty2
cgcagucaagcuugcc

SEQ ID NO: 3688619 - RNA, 14 nt, Salmonella enterica enterica serovar Typhi Ty2
cgccaaccucccaa

SEQ ID NO: 3688620 - RNA, 18 nt, Salmonella enterica enterica serovar Typhi Ty2
cgccaacgccacugccau

SEQ ID NO: 3688621 - RNA, 15 nt, Salmonella enterica enterica serovar Typhi Ty2
cgccaacguccgccg

SEQ ID NO: 3688622 - RNA, 16 nt, Salmonella enterica enterica serovar Typhi Ty2
cgccaacuuuuugcgc

SEQ ID NO: 3688623 - RNA, 17 nt, Salmonella enterica enterica serovar Typhi Ty2
cgccaacuuuuugcgca

SEQ ID NO: 3688624 - RNA, 21 nt, Salmonella enterica enterica serovar Typhi Ty2
cgccaagaaggguauccagcg

SEQ ID NO: 3688625 - RNA, 20 nt, Salmonella enterica enterica serovar Typhi Ty2
cgccaagaccgccuaacagc

SEQ ID NO: 3688626 - RNA, 12 nt, Salmonella enterica enterica serovar Typhi Ty2
cgccaagcgcgg

SEQ ID NO: 3688627 - RNA, 13 nt, Salmonella enterica enterica serovar Typhi Ty2
cgccaagcgcggc

SEQ ID NO: 3688628 - RNA, 17 nt, Salmonella enterica enterica serovar Typhi Ty2
cgccaagcggcaacucu

SEQ ID NO: 3688629 - RNA, 14 nt, Salmonella enterica enterica serovar Typhi Ty2
cgccaagcugugau

SEQ ID NO: 3688630 - RNA, 15 nt, Salmonella enterica enterica serovar Typhi Ty2
cgccaaguacgccuu

SEQ ID NO: 3688631 - RNA, 18 nt, Salmonella enterica enterica serovar Typhi Ty2
cgccaauaauauugaacg

SEQ ID NO: 3688632 - RNA, 17 nt, Salmonella enterica enterica serovar Typhi Ty2
cgccaauaaugccgccg

SEQ ID NO: 3688633 - RNA, 12 nt, Salmonella enterica enterica serovar Typhi Ty2
cgccaauaucca

SEQ ID NO: 3688634 - RNA, 18 nt, Salmonella enterica enterica serovar Typhi Ty2
cgccaaucaacgccgcca

SEQ ID NO: 3688635 - RNA, 15 nt, Salmonella enterica enterica serovar Typhi Ty2
cgccaauccaugccg

SEQ ID NO: 3688636 - RNA, 20 nt, Salmonella enterica enterica serovar Typhi Ty2
cgccaauccaugccggcuuu

SEQ ID NO: 3688637 - RNA, 18 nt, Salmonella enterica enterica serovar Typhi Ty2
cgccaaucgcgauaucaa

SEQ ID NO: 3688638 - RNA, 22 nt, Salmonella enterica enterica serovar Typhi Ty2
cgccaaucggcgucuugccgca

SEQ ID NO: 3688639 - RNA, 23 nt, Salmonella enterica enterica serovar Typhi Ty2
cgccaaucggcgucuugccgcaa

SEQ ID NO: 3688640 - RNA, 15 nt, Salmonella enterica enterica serovar Typhi Ty2
cgccaaucuguaauu

SEQ ID NO: 3688641 - RNA, 11 nt, Salmonella enterica enterica serovar Typhi Ty2
cgccaaugaac

SEQ ID NO: 3688642 - RNA, 15 nt, Salmonella enterica enterica serovar Typhi Ty2
cgccaaugccgcagc

SEQ ID NO: 3688643 - RNA, 19 nt, Salmonella enterica enterica serovar Typhi Ty2
cgccaaugguuaacgccgu

SEQ ID NO: 3688644 - RNA, 14 nt, Salmonella enterica enterica serovar Typhi Ty2
cgccacaauauccg

SEQ ID NO: 3688645 - RNA, 22 nt, Salmonella enterica enterica serovar Typhi Ty2
cgccacaauauccgccccgcug

SEQ ID NO: 3688646 - RNA, 17 nt, Salmonella enterica enterica serovar Typhi Ty2
cgccacaccgagacaga

SEQ ID NO: 3688647 - RNA, 15 nt, Salmonella enterica enterica serovar Typhi Ty2
cgccacagcauaccg

SEQ ID NO: 3688648 - RNA, 22 nt, Salmonella enterica enterica serovar Typhi Ty2
cgccacagcggaauagacggcc

SEQ ID NO: 3688649 - RNA, 19 nt, Salmonella enterica enterica serovar Typhi Ty2
cgccacaguauuccggcau

SEQ ID NO: 3688650 - RNA, 15 nt, Salmonella enterica enterica serovar Typhi Ty2
cgccacaugcggcag

SEQ ID NO: 3688651 - RNA, 18 nt, Salmonella enterica enterica serovar Typhi Ty2
cgccacauugaccccaua

SEQ ID NO: 3688652 - RNA, 15 nt, Salmonella enterica enterica serovar Typhi Ty2
cgccacauugcgcgc

SEQ ID NO: 3688653 - RNA, 12 nt, Salmonella enterica enterica serovar Typhi Ty2
cgccaccaaaaa

SEQ ID NO: 3688654 - RNA, 20 nt, Salmonella enterica enterica serovar Typhi Ty2
cgccaccaaagccaggccgc

SEQ ID NO: 3688655 - RNA, 18 nt, Salmonella enterica enterica serovar Typhi Ty2
cgccaccacaaacgccgu

SEQ ID NO: 3688656 - RNA, 22 nt, Salmonella enterica enterica serovar Typhi Ty2
cgccaccacagucaucgcgcca

SEQ ID NO: 3688657 - RNA, 19 nt, Salmonella enterica enterica serovar Typhi Ty2
cgccaccacauucaggcgg

SEQ ID NO: 3688658 - RNA, 13 nt, Salmonella enterica enterica serovar Typhi Ty2
cgccaccaccagc

SEQ ID NO: 3688659 - RNA, 16 nt, Salmonella enterica enterica serovar Typhi Ty2
cgccaccaccagcgua

SEQ ID NO: 3688660 - RNA, 20 nt, Salmonella enterica enterica serovar Typhi Ty2
cgccaccacgcccaacgacc

SEQ ID NO: 3688661 - RNA, 13 nt, Salmonella enterica enterica serovar Typhi Ty2
cgccaccacgccg

SEQ ID NO: 3688662 - RNA, 13 nt, Salmonella enterica enterica serovar Typhi Ty2
cgccaccagcgau

SEQ ID NO: 3688663 - RNA, 22 nt, Salmonella enterica enterica serovar Typhi Ty2
cgccaccaucgucgccagaccc

SEQ ID NO: 3688664 - RNA, 14 nt, Salmonella enterica enterica serovar Typhi Ty2
cgccacccaacauc

SEQ ID NO: 3688665 - RNA, 13 nt, Salmonella enterica enterica serovar Typhi Ty2
cgccaccgcaugg

SEQ ID NO: 3688666 - RNA, 16 nt, Salmonella enterica enterica serovar Typhi Ty2
cgccaccgccagccau

SEQ ID NO: 3688667 - RNA, 13 nt, Salmonella enterica enterica serovar Typhi Ty2
cgccaccgccgcu

SEQ ID NO: 3688668 - RNA, 17 nt, Salmonella enterica enterica serovar Typhi Ty2
cgccaccuuucugcucc

SEQ ID NO: 3688669 - RNA, 14 nt, Salmonella enterica enterica serovar Typhi Ty2
cgccacgacgcugg

SEQ ID NO: 3688670 - RNA, 21 nt, Salmonella enterica enterica serovar Typhi Ty2
cgccacgauagacagcaccau

SEQ ID NO: 3688671 - RNA, 23 nt, Salmonella enterica enterica serovar Typhi Ty2
cgccacgcaacuuaguguccacu

SEQ ID NO: 3688672 - RNA, 12 nt, Salmonella enterica enterica serovar Typhi Ty2
cgccacgcagcg

SEQ ID NO: 3688673 - RNA, 15 nt, Salmonella enterica enterica serovar Typhi Ty2
cgccacgccaccggg

SEQ ID NO: 3688674 - RNA, 16 nt, Salmonella enterica enterica serovar Typhi Ty2
cgccacgccuaaacug

SEQ ID NO: 3688675 - RNA, 20 nt, Salmonella enterica enterica serovar Typhi Ty2
cgccacgcgacgccagccga

SEQ ID NO: 3688676 - RNA, 17 nt, Salmonella enterica enterica serovar Typhi Ty2
cgccacgcgccaggucu

SEQ ID NO: 3688677 - RNA, 15 nt, Salmonella enterica enterica serovar Typhi Ty2
cgccacgcuccuucu

SEQ ID NO: 3688678 - RNA, 16 nt, Salmonella enterica enterica serovar Typhi Ty2
cgccacggccagcagc

SEQ ID NO: 3688679 - RNA, 14 nt, Salmonella enterica enterica serovar Typhi Ty2
cgccacggcuuuca

SEQ ID NO: 3688680 - RNA, 14 nt, Salmonella enterica enterica serovar Typhi Ty2
cgccacgucggaua

SEQ ID NO: 3688681 - RNA, 14 nt, Salmonella enterica enterica serovar Typhi Ty2
cgccacgucggcga

SEQ ID NO: 3688682 - RNA, 19 nt, Salmonella enterica enterica serovar Typhi Ty2
cgccacucuggcgacgcca

SEQ ID NO: 3688683 - RNA, 21 nt, Salmonella enterica enterica serovar Typhi Ty2
cgccacucuggcgacgccaau

SEQ ID NO: 3688684 - RNA, 17 nt, Salmonella enterica enterica serovar Typhi Ty2
cgccagaaaagaaccga

SEQ ID NO: 3688685 - RNA, 16 nt, Salmonella enterica enterica serovar Typhi Ty2
cgccagaauagcgcag

SEQ ID NO: 3688686 - RNA, 22 nt, Salmonella enterica enterica serovar Typhi Ty2
cgccagacacuggaaacagcca

SEQ ID NO: 3688687 - RNA, 23 nt, Salmonella enterica enterica serovar Typhi Ty2
cgccagacccacuaacugccgcu

SEQ ID NO: 3688688 - RNA, 14 nt, Salmonella enterica enterica serovar Typhi Ty2
cgccagacccagcg

SEQ ID NO: 3688689 - RNA, 18 nt, Salmonella enterica enterica serovar Typhi Ty2
cgccagacccgcaauaac

SEQ ID NO: 3688690 - RNA, 23 nt, Salmonella enterica enterica serovar Typhi Ty2
cgccagacccgcaauaacgccga

SEQ ID NO: 3688691 - RNA, 14 nt, Salmonella enterica enterica serovar Typhi Ty2
cgccagacgcgcau

SEQ ID NO: 3688692 - RNA, 17 nt, Salmonella enterica enterica serovar Typhi Ty2
cgccagauaaaucagcc

SEQ ID NO: 3688693 - RNA, 15 nt, Salmonella enterica enterica serovar Typhi Ty2
cgccagauacacgcc

SEQ ID NO: 3688694 - RNA, 16 nt, Salmonella enterica enterica serovar Typhi Ty2
cgccagauacacgccu

SEQ ID NO: 3688695 - RNA, 17 nt, Salmonella enterica enterica serovar Typhi Ty2
cgccagaucaggcguca

SEQ ID NO: 3688696 - RNA, 16 nt, Salmonella enterica enterica serovar Typhi Ty2
cgccagauccggcagc

SEQ ID NO: 3688697 - RNA, 22 nt, Salmonella enterica enterica serovar Typhi Ty2
cgccagaugcuuaaacugcgcg

SEQ ID NO: 3688698 - RNA, 18 nt, Salmonella enterica enterica serovar Typhi Ty2
cgccagcaacagguaccc

SEQ ID NO: 3688699 - RNA, 13 nt, Salmonella enterica enterica serovar Typhi Ty2
cgccagcaacgag

SEQ ID NO: 3688700 - RNA, 23 nt, Salmonella enterica enterica serovar Typhi Ty2
cgccagcaacgagcuuuuuucuu

SEQ ID NO: 3688701 - RNA, 18 nt, Salmonella enterica enterica serovar Typhi Ty2
cgccauaucuucgcgcgu

SEQ ID NO: 3688702 - RNA, 22 nt, Salmonella enterica enterica serovar Typhi Ty2
cgccaucaacuccuccggcgag

SEQ ID NO: 3688703 - RNA, 17 nt, Salmonella enterica enterica serovar Typhi Ty2
cgccaucaccaggucaa

SEQ ID NO: 3688704 - RNA, 17 nt, Salmonella enterica enterica serovar Typhi Ty2
cgccaucacguccugau

SEQ ID NO: 3688705 - RNA, 12 nt, Salmonella enterica enterica serovar Typhi Ty2
cgccaucagcaa

SEQ ID NO: 3688706 - RNA, 17 nt, Salmonella enterica enterica serovar Typhi Ty2
cgccaucaggcaaucuu

SEQ ID NO: 3688707 - RNA, 22 nt, Salmonella enterica enterica serovar Typhi Ty2
cgccaucaggcaauucggcccu

SEQ ID NO: 3688708 - RNA, 15 nt, Salmonella enterica enterica serovar Typhi Ty2
cgccaucaggcacgg

SEQ ID NO: 3688709 - RNA, 15 nt, Salmonella enterica enterica serovar Typhi Ty2
cgccaucaggcaugg

SEQ ID NO: 3688710 - RNA, 18 nt, Salmonella enterica enterica serovar Typhi Ty2
cgccaucaggcauggcag

SEQ ID NO: 3688711 - RNA, 21 nt, Salmonella enterica enterica serovar Typhi Ty2
cgccaucaggcauguugcgca

SEQ ID NO: 3688712 - RNA, 23 nt, Salmonella enterica enterica serovar Typhi Ty2
cgccaucaguucggcgcgccagc

SEQ ID NO: 3688713 - RNA, 16 nt, Salmonella enterica enterica serovar Typhi Ty2
cgccaucauccggcaa

SEQ ID NO: 3688714 - RNA, 21 nt, Salmonella enterica enterica serovar Typhi Ty2
cgccaucaugcccacaggcag

SEQ ID NO: 3688715 - RNA, 12 nt, Salmonella enterica enterica serovar Typhi Ty2
cgccauccacgg

SEQ ID NO: 3688716 - RNA, 16 nt, Salmonella enterica enterica serovar Typhi Ty2
cgccauccggcaauga

SEQ ID NO: 3688717 - RNA, 17 nt, Salmonella enterica enterica serovar Typhi Ty2
cgccauccggcaaugau

SEQ ID NO: 3688718 - RNA, 13 nt, Salmonella enterica enterica serovar Typhi Ty2
cgccauccggccu

SEQ ID NO: 3688719 - RNA, 13 nt, Salmonella enterica enterica serovar Typhi Ty2
cgccauccggcga

SEQ ID NO: 3688720 - RNA, 17 nt, Salmonella enterica enterica serovar Typhi Ty2
cgccauccggcggugca

SEQ ID NO: 3688721 - RNA, 22 nt, Salmonella enterica enterica serovar Typhi Ty2
cgccauccgguaaacgugcugg

SEQ ID NO: 3688722 - RNA, 15 nt, Salmonella enterica enterica serovar Typhi Ty2
cgccauccugccgca

SEQ ID NO: 3688723 - RNA, 21 nt, Salmonella enterica enterica serovar Typhi Ty2
cgccauccuguucaagcaaua

SEQ ID NO: 3688724 - RNA, 18 nt, Salmonella enterica enterica serovar Typhi Ty2
cgccaucgacaaaggcaa

SEQ ID NO: 3688725 - RNA, 17 nt, Salmonella enterica enterica serovar Typhi Ty2
cgccaucgacagcgcca

SEQ ID NO: 3688726 - RNA, 17 nt, Salmonella enterica enterica serovar Typhi Ty2
cgccaucgccgccucgc

SEQ ID NO: 3688727 - RNA, 19 nt, Salmonella enterica enterica serovar Typhi Ty2
cgccaucgccgccucgcgu

SEQ ID NO: 3688728 - RNA, 14 nt, Salmonella enterica enterica serovar Typhi Ty2
cgccaucgcggcgc

SEQ ID NO: 3688729 - RNA, 16 nt, Salmonella enterica enterica serovar Typhi Ty2
cgccaucgcggcgcaa

SEQ ID NO: 3688730 - RNA, 14 nt, Salmonella enterica enterica serovar Typhi Ty2
cgccaucggcgagc

SEQ ID NO: 3688731 - RNA, 13 nt, Salmonella enterica enterica serovar Typhi Ty2
cgccaucggcuuu

SEQ ID NO: 3688732 - RNA, 15 nt, Salmonella enterica enterica serovar Typhi Ty2
cgccaucgucacgca

SEQ ID NO: 3688733 - RNA, 18 nt, Salmonella enterica enterica serovar Typhi Ty2
cgccaucguuccgguucu

SEQ ID NO: 3688734 - RNA, 14 nt, Salmonella enterica enterica serovar Typhi Ty2
cgccaucucacgca

SEQ ID NO: 3688735 - RNA, 15 nt, Salmonella enterica enterica serovar Typhi Ty2
cgccaucuccuccuc

SEQ ID NO: 3688736 - RNA, 15 nt, Salmonella enterica enterica serovar Typhi Ty2
cgccaucuucacgca

SEQ ID NO: 3688737 - RNA, 17 nt, Salmonella enterica enterica serovar Typhi Ty2
cgccaucuuccucacag

SEQ ID NO: 3688738 - RNA, 21 nt, Salmonella enterica enterica serovar Typhi Ty2
cgccaugaccugggcgccaga

SEQ ID NO: 3688739 - RNA, 22 nt, Salmonella enterica enterica serovar Typhi Ty2
cgccaugaccugggcgccagag

SEQ ID NO: 3688740 - RNA, 18 nt, Salmonella enterica enterica serovar Typhi Ty2
cgccaugauucaucccgc

SEQ ID NO: 3688741 - RNA, 13 nt, Salmonella enterica enterica serovar Typhi Ty2
cgccauuacgccg

SEQ ID NO: 3688742 - RNA, 17 nt, Salmonella enterica enterica serovar Typhi Ty2
cgccauucccgcgacgu

SEQ ID NO: 3688743 - RNA, 20 nt, Salmonella enterica enterica serovar Typhi Ty2
cgccauuccugccgccgcac

SEQ ID NO: 3688744 - RNA, 21 nt, Salmonella enterica enterica serovar Typhi Ty2
cgccauuggcaaucaguacgc

SEQ ID NO: 3688745 - RNA, 22 nt, Salmonella enterica enterica serovar Typhi Ty2
cgccauuggcaaucaguacgcg

SEQ ID NO: 3688746 - RNA, 23 nt, Salmonella enterica enterica serovar Typhi Ty2
cgccauuggcuauuuuuugcugg

SEQ ID NO: 3688747 - RNA, 18 nt, Salmonella enterica enterica serovar Typhi Ty2
cgccauuugccagauagc

SEQ ID NO: 3688748 - RNA, 16 nt, Salmonella enterica enterica serovar Typhi Ty2
cgccauuugcgcggcu

SEQ ID NO: 3688749 - RNA, 20 nt, Salmonella enterica enterica serovar Typhi Ty2
cgccauuuuauccaggccag

SEQ ID NO: 3688750 - RNA, 18 nt, Salmonella enterica enterica serovar Typhi Ty2
cgcccaaauaguccagca

SEQ ID NO: 3688751 - RNA, 18 nt, Salmonella enterica enterica serovar Typhi Ty2
cgcccaaccagcccaggu

SEQ ID NO: 3688752 - RNA, 22 nt, Salmonella enterica enterica serovar Typhi Ty2
cgcccacaggcugcggcacgcu

SEQ ID NO: 3688753 - RNA, 22 nt, Salmonella enterica enterica serovar Typhi Ty2
cgcccacaucuguuugagaaaa

SEQ ID NO: 3688754 - RNA, 14 nt, Salmonella enterica enterica serovar Typhi Ty2
cgcccacgcggcgu

SEQ ID NO: 3688755 - RNA, 16 nt, Salmonella enterica enterica serovar Typhi Ty2
cgcccacgcggcgugc

SEQ ID NO: 3688756 - RNA, 18 nt, Salmonella enterica enterica serovar Typhi Ty2
cgcccagaaagaucagca

SEQ ID NO: 3688757 - RNA, 20 nt, Salmonella enterica enterica serovar Typhi Ty2
cgcccagaacggcagcgucc

SEQ ID NO: 3688758 - RNA, 18 nt, Salmonella enterica enterica serovar Typhi Ty2
cgcccagauauccgcgcu

SEQ ID NO: 3688759 - RNA, 20 nt, Salmonella enterica enterica serovar Typhi Ty2
cgcccagauuucacaauguu

SEQ ID NO: 3688760 - RNA, 21 nt, Salmonella enterica enterica serovar Typhi Ty2
cgcccagcguacguaacuucu

SEQ ID NO: 3688761 - RNA, 14 nt, Salmonella enterica enterica serovar Typhi Ty2
cgcccaggccaugc

SEQ ID NO: 3688762 - RNA, 12 nt, Salmonella enterica enterica serovar Typhi Ty2
cgcccaggccug

SEQ ID NO: 3688763 - RNA, 13 nt, Salmonella enterica enterica serovar Typhi Ty2
cgcccaggccuga

SEQ ID NO: 3688764 - RNA, 16 nt, Salmonella enterica enterica serovar Typhi Ty2
cgcccaggucgcccag

SEQ ID NO: 3688765 - RNA, 19 nt, Salmonella enterica enterica serovar Typhi Ty2
cgcccagucaucauaauuc

SEQ ID NO: 3688766 - RNA, 23 nt, Salmonella enterica enterica serovar Typhi Ty2
cgcccagucaucauaauucagcu

SEQ ID NO: 3688767 - RNA, 17 nt, Salmonella enterica enterica serovar Typhi Ty2
cgcccaguccuuccggc

SEQ ID NO: 3688768 - RNA, 18 nt, Salmonella enterica enterica serovar Typhi Ty2
cgcccaguccuuccggcg

SEQ ID NO: 3688769 - RNA, 16 nt, Salmonella enterica enterica serovar Typhi Ty2
cgcccaucaacaccag

SEQ ID NO: 3688770 - RNA, 15 nt, Salmonella enterica enterica serovar Typhi Ty2
cgcccaucacaugua

SEQ ID NO: 3688771 - RNA, 13 nt, Salmonella enterica enterica serovar Typhi Ty2
cgcccauccagag

SEQ ID NO: 3688772 - RNA, 15 nt, Salmonella enterica enterica serovar Typhi Ty2
cgcccaucccgaugg

SEQ ID NO: 3688773 - RNA, 14 nt, Salmonella enterica enterica serovar Typhi Ty2
cgcccaucgccaca

SEQ ID NO: 3688774 - RNA, 15 nt, Salmonella enterica enterica serovar Typhi Ty2
cgcccaucgccacag

SEQ ID NO: 3688775 - RNA, 14 nt, Salmonella enterica enterica serovar Typhi Ty2
cgcccaucgccuga

SEQ ID NO: 3688776 - RNA, 15 nt, Salmonella enterica enterica serovar Typhi Ty2
cgcccaugcggcuga

SEQ ID NO: 3688777 - RNA, 20 nt, Salmonella enterica enterica serovar Typhi Ty2
cgcccauggaugcgccgccc

SEQ ID NO: 3688778 - RNA, 20 nt, Salmonella enterica enterica serovar Typhi Ty2
cgcccauuaauaucagcccc

SEQ ID NO: 3688779 - RNA, 22 nt, Salmonella enterica enterica serovar Typhi Ty2
cgcccauuaauaucagccccac

SEQ ID NO: 3688780 - RNA, 20 nt, Salmonella enterica enterica serovar Typhi Ty2
cgcccauuagcauuccgccc

SEQ ID NO: 3688781 - RNA, 15 nt, Salmonella enterica enterica serovar Typhi Ty2
cgcccauuccgccug

SEQ ID NO: 3688782 - RNA, 16 nt, Salmonella enterica enterica serovar Typhi Ty2
cgcccauuccgccugc

SEQ ID NO: 3688783 - RNA, 18 nt, Salmonella enterica enterica serovar Typhi Ty2
cgccgcaggccaucauac

SEQ ID NO: 3688784 - RNA, 23 nt, Salmonella enterica enterica serovar Typhi Ty2
cgccgcaggccaucauaccgcca

SEQ ID NO: 3688785 - RNA, 15 nt, Salmonella enterica enterica serovar Typhi Ty2
cgccgcaggguauau

SEQ ID NO: 3688786 - RNA, 13 nt, Salmonella enterica enterica serovar Typhi Ty2
cgccgcaucgcgg

SEQ ID NO: 3688787 - RNA, 17 nt, Salmonella enterica enterica serovar Typhi Ty2
cgccgcaucuuccacgc

SEQ ID NO: 3688788 - RNA, 20 nt, Salmonella enterica enterica serovar Typhi Ty2
cgccgcaucuuuugccgcgg

SEQ ID NO: 3688789 - RNA, 22 nt, Salmonella enterica enterica serovar Typhi Ty2
cgccgccaaacugcgcgccgcc

SEQ ID NO: 3688790 - RNA, 22 nt, Salmonella enterica enterica serovar Typhi Ty2
cgccgccaaagcgcccgauaau

SEQ ID NO: 3688791 - RNA, 15 nt, Salmonella enterica enterica serovar Typhi Ty2
cgccgccaaugacca

SEQ ID NO: 3688792 - RNA, 13 nt, Salmonella enterica enterica serovar Typhi Ty2
cgccgccaccaaa

SEQ ID NO: 3688793 - RNA, 13 nt, Salmonella enterica enterica serovar Typhi Ty2
cgccgccaccaug

SEQ ID NO: 3688794 - RNA, 22 nt, Salmonella enterica enterica serovar Typhi Ty2
cgccgccagaaucaccucuuuc

SEQ ID NO: 3688795 - RNA, 20 nt, Salmonella enterica enterica serovar Typhi Ty2
cgccgccagauagccgcgcu

SEQ ID NO: 3688796 - RNA, 14 nt, Salmonella enterica enterica serovar Typhi Ty2
cgccgccagcaaua

SEQ ID NO: 3688797 - RNA, 14 nt, Salmonella enterica enterica serovar Typhi Ty2
cgccgccagcaccg

SEQ ID NO: 3688798 - RNA, 13 nt, Salmonella enterica enterica serovar Typhi Ty2
cgccgccagccau

SEQ ID NO: 3688799 - RNA, 14 nt, Salmonella enterica enterica serovar Typhi Ty2
cgccgccagccaua

SEQ ID NO: 3688800 - RNA, 20 nt, Salmonella enterica enterica serovar Typhi Ty2
cgccgccagcucaugcgcgg

SEQ ID NO: 3688801 - RNA, 20 nt, Salmonella enterica enterica serovar Typhi Ty2
cgccgccaggauaauaauga

SEQ ID NO: 3688802 - RNA, 14 nt, Salmonella enterica enterica serovar Typhi Ty2
cgccgccaucaacg

SEQ ID NO: 3688803 - RNA, 14 nt, Salmonella enterica enterica serovar Typhi Ty2
cgccgccaucacca

SEQ ID NO: 3688804 - RNA, 21 nt, Salmonella enterica enterica serovar Typhi Ty2
cgccgccauccgacaaccggc

SEQ ID NO: 3688805 - RNA, 20 nt, Salmonella enterica enterica serovar Typhi Ty2
cgccgccauccggcacgguc

SEQ ID NO: 3688806 - RNA, 14 nt, Salmonella enterica enterica serovar Typhi Ty2
cgccgccaucggcg

SEQ ID NO: 3688807 - RNA, 23 nt, Salmonella enterica enterica serovar Typhi Ty2
cgccgcccagauguugauacaga

SEQ ID NO: 3688808 - RNA, 19 nt, Salmonella enterica enterica serovar Typhi Ty2
cgccgcccccaugccgccu

SEQ ID NO: 3688809 - RNA, 14 nt, Salmonella enterica enterica serovar Typhi Ty2
cgccgccgccaacg

SEQ ID NO: 3688810 - RNA, 15 nt, Salmonella enterica enterica serovar Typhi Ty2
cgccgccgccaacgc

SEQ ID NO: 3688811 - RNA, 13 nt, Salmonella enterica enterica serovar Typhi Ty2
cgccgccgccaga

SEQ ID NO: 3688812 - RNA, 14 nt, Salmonella enterica enterica serovar Typhi Ty2
cgccgccgcguccu

SEQ ID NO: 3688813 - RNA, 24 nt, Salmonella enterica enterica serovar Typhi Ty2
cgccgccggccugacgaccguugc

SEQ ID NO: 3688814 - RNA, 13 nt, Salmonella enterica enterica serovar Typhi Ty2
cgccgccggcgag

SEQ ID NO: 3688815 - RNA, 18 nt, Salmonella enterica enterica serovar Typhi Ty2
cgccgccgggccgccgau

SEQ ID NO: 3688816 - RNA, 17 nt, Salmonella enterica enterica serovar Typhi Ty2
cgccgccuaucgccagc

SEQ ID NO: 3688817 - RNA, 23 nt, Salmonella enterica enterica serovar Typhi Ty2
cgccgccucccccucaaucggcg

SEQ ID NO: 3688818 - RNA, 13 nt, Salmonella enterica enterica serovar Typhi Ty2
cgccgccucuuca

SEQ ID NO: 3688819 - RNA, 12 nt, Salmonella enterica enterica serovar Typhi Ty2
cgccgccugaug

SEQ ID NO: 3688820 - RNA, 14 nt, Salmonella enterica enterica serovar Typhi Ty2
cgccgccugcgcca

SEQ ID NO: 3688821 - RNA, 16 nt, Salmonella enterica enterica serovar Typhi Ty2
cgccgccugcgccagc

SEQ ID NO: 3688822 - RNA, 15 nt, Salmonella enterica enterica serovar Typhi Ty2
cgccgccuugcggcg

SEQ ID NO: 3688823 - RNA, 18 nt, Salmonella enterica enterica serovar Typhi Ty2
cgccgcgaacaaagcccc

SEQ ID NO: 3688824 - RNA, 16 nt, Salmonella enterica enterica serovar Typhi Ty2
cgccgcgacaacgcca

SEQ ID NO: 3688825 - RNA, 15 nt, Salmonella enterica enterica serovar Typhi Ty2
cgccgcgacgcgcga

SEQ ID NO: 3688826 - RNA, 13 nt, Salmonella enterica enterica serovar Typhi Ty2
cgccgcgagcagc

SEQ ID NO: 3688827 - RNA, 21 nt, Salmonella enterica enterica serovar Typhi Ty2
cgccgcgcaguuuuuauccuc

SEQ ID NO: 3688828 - RNA, 18 nt, Salmonella enterica enterica serovar Typhi Ty2
cgccgcgccuaccagcgc

SEQ ID NO: 3688829 - RNA, 16 nt, Salmonella enterica enterica serovar Typhi Ty2
cgccgcgcggccccau

SEQ ID NO: 3688830 - RNA, 14 nt, Salmonella enterica enterica serovar Typhi Ty2
cgccgcgcguucca

SEQ ID NO: 3688831 - RNA, 22 nt, Salmonella enterica enterica serovar Typhi Ty2
cgccgcgcugaugcagcuugca

SEQ ID NO: 3688832 - RNA, 22 nt, Salmonella enterica enterica serovar Typhi Ty2
cgccgcggccuccggaucgaca

SEQ ID NO: 3688833 - RNA, 14 nt, Salmonella enterica enterica serovar Typhi Ty2
cgccgcggcgguua

SEQ ID NO: 3688834 - RNA, 16 nt, Salmonella enterica enterica serovar Typhi Ty2
cgccgcuacugccgcc

SEQ ID NO: 3688835 - RNA, 17 nt, Salmonella enterica enterica serovar Typhi Ty2
cgccgcuauuaccccgc

SEQ ID NO: 3688836 - RNA, 18 nt, Salmonella enterica enterica serovar Typhi Ty2
cgccgcucuucagcgucc

SEQ ID NO: 3688837 - RNA, 17 nt, Salmonella enterica enterica serovar Typhi Ty2
cgccgcuuuaccgccuu

SEQ ID NO: 3688838 - RNA, 15 nt, Salmonella enterica enterica serovar Typhi Ty2
cgccgcuuuuuccgc

SEQ ID NO: 3688839 - RNA, 17 nt, Salmonella enterica enterica serovar Typhi Ty2
cgccgcuuuuuccgccg

SEQ ID NO: 3688840 - RNA, 17 nt, Salmonella enterica enterica serovar Typhi Ty2
cgccgcuuuuuucagcg

SEQ ID NO: 3688841 - RNA, 20 nt, Salmonella enterica enterica serovar Typhi Ty2
cgccggaaaaccggucauau

SEQ ID NO: 3688842 - RNA, 19 nt, Salmonella enterica enterica serovar Typhi Ty2
cgccggaaagaaacgccgc

SEQ ID NO: 3688843 - RNA, 15 nt, Salmonella enterica enterica serovar Typhi Ty2
cgccggaaaucacaa

SEQ ID NO: 3688844 - RNA, 15 nt, Salmonella enterica enterica serovar Typhi Ty2
cgccggaaucgcgau

SEQ ID NO: 3688845 - RNA, 19 nt, Salmonella enterica enterica serovar Typhi Ty2
cgccggaaucgcgauccag

SEQ ID NO: 3688846 - RNA, 21 nt, Salmonella enterica enterica serovar Typhi Ty2
cgccggaauggcgacgacgcu

SEQ ID NO: 3688847 - RNA, 15 nt, Salmonella enterica enterica serovar Typhi Ty2
cgccggacuccagca

SEQ ID NO: 3688848 - RNA, 18 nt, Salmonella enterica enterica serovar Typhi Ty2
cgccggacuguugaugau

SEQ ID NO: 3688849 - RNA, 20 nt, Salmonella enterica enterica serovar Typhi Ty2
cgccggagagcauuuguagc

SEQ ID NO: 3688850 - RNA, 20 nt, Salmonella enterica enterica serovar Typhi Ty2
cgccggagaggggacucacc

SEQ ID NO: 3688851 - RNA, 15 nt, Salmonella enterica enterica serovar Typhi Ty2
cgccggagaucagca

SEQ ID NO: 3688852 - RNA, 16 nt, Salmonella enterica enterica serovar Typhi Ty2
cgccggagccgccugg

SEQ ID NO: 3688853 - RNA, 19 nt, Salmonella enterica enterica serovar Typhi Ty2
cgccggaucgggcuuccag

SEQ ID NO: 3688854 - RNA, 20 nt, Salmonella enterica enterica serovar Typhi Ty2
cgccggauuuaccagcgcuu

SEQ ID NO: 3688855 - RNA, 23 nt, Salmonella enterica enterica serovar Typhi Ty2
cgccggcagcaguucuucgccgg

SEQ ID NO: 3688856 - RNA, 22 nt, Salmonella enterica enterica serovar Typhi Ty2
cgccggcaguccuugcagccag

SEQ ID NO: 3688857 - RNA, 14 nt, Salmonella enterica enterica serovar Typhi Ty2
cgccggccccgcuu

SEQ ID NO: 3688858 - RNA, 13 nt, Salmonella enterica enterica serovar Typhi Ty2
cgccggccuguua

SEQ ID NO: 3688859 - RNA, 15 nt, Salmonella enterica enterica serovar Typhi Ty2
cgccgggaauuauua

SEQ ID NO: 3688860 - RNA, 20 nt, Salmonella enterica enterica serovar Typhi Ty2
cgccgggagcguuaaucacc

SEQ ID NO: 3688861 - RNA, 14 nt, Salmonella enterica enterica serovar Typhi Ty2
cgccgggcggcgca

SEQ ID NO: 3688862 - RNA, 20 nt, Salmonella enterica enterica serovar Typhi Ty2
cgccgggcuucauaccguga

SEQ ID NO: 3688863 - RNA, 14 nt, Salmonella enterica enterica serovar Typhi Ty2
cgccggggcagcaa

SEQ ID NO: 3688864 - RNA, 21 nt, Salmonella enterica enterica serovar Typhi Ty2
cgccggguaaacgcagcguca

SEQ ID NO: 3688865 - RNA, 18 nt, Salmonella enterica enterica serovar Typhi Ty2
cgccugcuguugggcagg

SEQ ID NO: 3688866 - RNA, 15 nt, Salmonella enterica enterica serovar Typhi Ty2
cgccugcuucacgua

SEQ ID NO: 3688867 - RNA, 19 nt, Salmonella enterica enterica serovar Typhi Ty2
cgccuggaugacgaacagg

SEQ ID NO: 3688868 - RNA, 23 nt, Salmonella enterica enterica serovar Typhi Ty2
cgccuggcauggugcagccgcca

SEQ ID NO: 3688869 - RNA, 16 nt, Salmonella enterica enterica serovar Typhi Ty2
cgccuggcgguaugaa

SEQ ID NO: 3688870 - RNA, 15 nt, Salmonella enterica enterica serovar Typhi Ty2
cgccugucuccagcg

SEQ ID NO: 3688871 - RNA, 16 nt, Salmonella enterica enterica serovar Typhi Ty2
cgccugucuccagcgc

SEQ ID NO: 3688872 - RNA, 17 nt, Salmonella enterica enterica serovar Typhi Ty2
cgccugucuccagcgcc

SEQ ID NO: 3688873 - RNA, 21 nt, Salmonella enterica enterica serovar Typhi Ty2
cgccugugguuuaaaacggug

SEQ ID NO: 3688874 - RNA, 19 nt, Salmonella enterica enterica serovar Typhi Ty2
cgccuguuagggcgcggcu

SEQ ID NO: 3688875 - RNA, 15 nt, Salmonella enterica enterica serovar Typhi Ty2
cgccuguuuacugac

SEQ ID NO: 3688876 - RNA, 18 nt, Salmonella enterica enterica serovar Typhi Ty2
cgccuguuuacugacgcc

SEQ ID NO: 3688877 - RNA, 21 nt, Salmonella enterica enterica serovar Typhi Ty2
cgccuguuugacgaaaucgca

SEQ ID NO: 3688878 - RNA, 15 nt, Salmonella enterica enterica serovar Typhi Ty2
cgccuuaaaccgucg

SEQ ID NO: 3688879 - RNA, 16 nt, Salmonella enterica enterica serovar Typhi Ty2
cgccuuacccaaccgu

SEQ ID NO: 3688880 - RNA, 19 nt, Salmonella enterica enterica serovar Typhi Ty2
cgccuuauccgaccuacag

SEQ ID NO: 3688881 - RNA, 20 nt, Salmonella enterica enterica serovar Typhi Ty2
cgccuuauccggccuacaac

SEQ ID NO: 3688882 - RNA, 19 nt, Salmonella enterica enterica serovar Typhi Ty2
cgccuuauccggccuacag

SEQ ID NO: 3688883 - RNA, 18 nt, Salmonella enterica enterica serovar Typhi Ty2
cgccuuauccggccuacg

SEQ ID NO: 3688884 - RNA, 14 nt, Salmonella enterica enterica serovar Typhi Ty2
cgccuuaucgacca

SEQ ID NO: 3688885 - RNA, 14 nt, Salmonella enterica enterica serovar Typhi Ty2
cgccuuauucaggc

SEQ ID NO: 3688886 - RNA, 16 nt, Salmonella enterica enterica serovar Typhi Ty2
cgccuucagcgcgccc

SEQ ID NO: 3688887 - RNA, 15 nt, Salmonella enterica enterica serovar Typhi Ty2
cgccuuccacuuuca

SEQ ID NO: 3688888 - RNA, 21 nt, Salmonella enterica enterica serovar Typhi Ty2
cgccuucggccugaaucagca

SEQ ID NO: 3688889 - RNA, 22 nt, Salmonella enterica enterica serovar Typhi Ty2
cgccuucggcgucgugcugggc

SEQ ID NO: 3688890 - RNA, 15 nt, Salmonella enterica enterica serovar Typhi Ty2
cgccuucuucaucuu

SEQ ID NO: 3688891 - RNA, 14 nt, Salmonella enterica enterica serovar Typhi Ty2
cgccuugcccgcgc

SEQ ID NO: 3688892 - RNA, 15 nt, Salmonella enterica enterica serovar Typhi Ty2
cgccuugccgggggc

SEQ ID NO: 3688893 - RNA, 14 nt, Salmonella enterica enterica serovar Typhi Ty2
cgccuugcggcggc

SEQ ID NO: 3688894 - RNA, 15 nt, Salmonella enterica enterica serovar Typhi Ty2
cgccuuguccggccu

SEQ ID NO: 3688895 - RNA, 17 nt, Salmonella enterica enterica serovar Typhi Ty2
cgccuuguugcggauga

SEQ ID NO: 3688896 - RNA, 23 nt, Salmonella enterica enterica serovar Typhi Ty2
cgccuuucagacuucaacgccgc

SEQ ID NO: 3688897 - RNA, 13 nt, Salmonella enterica enterica serovar Typhi Ty2
cgccuuuccggcc

SEQ ID NO: 3688898 - RNA, 19 nt, Salmonella enterica enterica serovar Typhi Ty2
cgccuuuuaacggacgauu

SEQ ID NO: 3688899 - RNA, 15 nt, Salmonella enterica enterica serovar Typhi Ty2
cgccuuuucccccag

SEQ ID NO: 3688900 - RNA, 19 nt, Salmonella enterica enterica serovar Typhi Ty2
cgccuuuucccccagcauu

SEQ ID NO: 3688901 - RNA, 23 nt, Salmonella enterica enterica serovar Typhi Ty2
cgccuuuuuuaaauuugaccucg

SEQ ID NO: 3688902 - RNA, 13 nt, Salmonella enterica enterica serovar Typhi Ty2
cgcgaaaaacgau

SEQ ID NO: 3688903 - RNA, 12 nt, Salmonella enterica enterica serovar Typhi Ty2
cgcgaaaacagc

SEQ ID NO: 3688904 - RNA, 18 nt, Salmonella enterica enterica serovar Typhi Ty2
cgcgaaaacagcuggcga

SEQ ID NO: 3688905 - RNA, 16 nt, Salmonella enterica enterica serovar Typhi Ty2
cgcgaaaaucgguaac

SEQ ID NO: 3688906 - RNA, 19 nt, Salmonella enterica enterica serovar Typhi Ty2
cgcgaaaaucgguaacauc

SEQ ID NO: 3688907 - RNA, 20 nt, Salmonella enterica enterica serovar Typhi Ty2
cgcgaaaucaaagaccuccg

SEQ ID NO: 3688908 - RNA, 18 nt, Salmonella enterica enterica serovar Typhi Ty2
cgcgaaaugucccgauau

SEQ ID NO: 3688909 - RNA, 22 nt, Salmonella enterica enterica serovar Typhi Ty2
cgcgaagaucguuauccagcag

SEQ ID NO: 3688910 - RNA, 20 nt, Salmonella enterica enterica serovar Typhi Ty2
cgcgaauaccuaacagccgc

SEQ ID NO: 3688911 - RNA, 17 nt, Salmonella enterica enterica serovar Typhi Ty2
cgcgaauaguggcgcgc

SEQ ID NO: 3688912 - RNA, 20 nt, Salmonella enterica enterica serovar Typhi Ty2
cgcgaaucgacaauccgcca

SEQ ID NO: 3688913 - RNA, 24 nt, Salmonella enterica enterica serovar Typhi Ty2
cgcgaaucgacaauccgccacgcu

SEQ ID NO: 3688914 - RNA, 21 nt, Salmonella enterica enterica serovar Typhi Ty2
cgcgaauuccuuuuuccgcca

SEQ ID NO: 3688915 - RNA, 22 nt, Salmonella enterica enterica serovar Typhi Ty2
cgcgaauuccuuuuuccgccac

SEQ ID NO: 3688916 - RNA, 17 nt, Salmonella enterica enterica serovar Typhi Ty2
cgcgaauuucaacgcga

SEQ ID NO: 3688917 - RNA, 15 nt, Salmonella enterica enterica serovar Typhi Ty2
cgcgaauuucaaucg

SEQ ID NO: 3688918 - RNA, 19 nt, Salmonella enterica enterica serovar Typhi Ty2
cgcgacaaaaagcgcgccg

SEQ ID NO: 3688919 - RNA, 13 nt, Salmonella enterica enterica serovar Typhi Ty2
cgcgacagcgcgc

SEQ ID NO: 3688920 - RNA, 15 nt, Salmonella enterica enterica serovar Typhi Ty2
cgcgacagcgcgcca

SEQ ID NO: 3688921 - RNA, 12 nt, Salmonella enterica enterica serovar Typhi Ty2
cgcgacagcgcu

SEQ ID NO: 3688922 - RNA, 16 nt, Salmonella enterica enterica serovar Typhi Ty2
cgcgacagucgcagag

SEQ ID NO: 3688923 - RNA, 15 nt, Salmonella enterica enterica serovar Typhi Ty2
cgcgacauccgcuuu

SEQ ID NO: 3688924 - RNA, 14 nt, Salmonella enterica enterica serovar Typhi Ty2
cgcgacauggcgaa

SEQ ID NO: 3688925 - RNA, 14 nt, Salmonella enterica enterica serovar Typhi Ty2
cgcgacauggcggu

SEQ ID NO: 3688926 - RNA, 15 nt, Salmonella enterica enterica serovar Typhi Ty2
cgcgacauggcggua

SEQ ID NO: 3688927 - RNA, 16 nt, Salmonella enterica enterica serovar Typhi Ty2
cgcgacauggcgguaa

SEQ ID NO: 3688928 - RNA, 13 nt, Salmonella enterica enterica serovar Typhi Ty2
cgcgaccacgcau

SEQ ID NO: 3688929 - RNA, 18 nt, Salmonella enterica enterica serovar Typhi Ty2
cgcgaccagagacauugc

SEQ ID NO: 3688930 - RNA, 17 nt, Salmonella enterica enterica serovar Typhi Ty2
cgcgaccagcagcauca

SEQ ID NO: 3688931 - RNA, 13 nt, Salmonella enterica enterica serovar Typhi Ty2
cgcgaccagcgcg

SEQ ID NO: 3688932 - RNA, 14 nt, Salmonella enterica enterica serovar Typhi Ty2
cgcgaccagcgcgc

SEQ ID NO: 3688933 - RNA, 14 nt, Salmonella enterica enterica serovar Typhi Ty2
cgcgaccaguucac

SEQ ID NO: 3688934 - RNA, 17 nt, Salmonella enterica enterica serovar Typhi Ty2
cgcgacccagcgcauga

SEQ ID NO: 3688935 - RNA, 13 nt, Salmonella enterica enterica serovar Typhi Ty2
cgcgaccgcauca

SEQ ID NO: 3688936 - RNA, 14 nt, Salmonella enterica enterica serovar Typhi Ty2
cgcgaccgccgcug

SEQ ID NO: 3688937 - RNA, 21 nt, Salmonella enterica enterica serovar Typhi Ty2
cgcgaccggaucaauaaacag

SEQ ID NO: 3688938 - RNA, 15 nt, Salmonella enterica enterica serovar Typhi Ty2
cgcgacgacgccagc

SEQ ID NO: 3688939 - RNA, 19 nt, Salmonella enterica enterica serovar Typhi Ty2
cgcgacgacgccagccagc

SEQ ID NO: 3688940 - RNA, 21 nt, Salmonella enterica enterica serovar Typhi Ty2
cgcgacgacgccagccagcca

SEQ ID NO: 3688941 - RNA, 13 nt, Salmonella enterica enterica serovar Typhi Ty2
cgcgacgcccaug

SEQ ID NO: 3688942 - RNA, 20 nt, Salmonella enterica enterica serovar Typhi Ty2
cgcgacgcccaugcaaccag

SEQ ID NO: 3688943 - RNA, 12 nt, Salmonella enterica enterica serovar Typhi Ty2
cgcgacgccgag

SEQ ID NO: 3688944 - RNA, 13 nt, Salmonella enterica enterica serovar Typhi Ty2
cgcgacgccgcau

SEQ ID NO: 3688945 - RNA, 14 nt, Salmonella enterica enterica serovar Typhi Ty2
cgcgacgccgcaua

SEQ ID NO: 3688946 - RNA, 22 nt, Salmonella enterica enterica serovar Typhi Ty2
cgcgacgcgccagccagcgcca

SEQ ID NO: 3688947 - RNA, 17 nt, Salmonella enterica enterica serovar Typhi Ty2
cgcgccaucuccuccuc

SEQ ID NO: 3688948 - RNA, 17 nt, Salmonella enterica enterica serovar Typhi Ty2
cgcgccauuugccagau

SEQ ID NO: 3688949 - RNA, 20 nt, Salmonella enterica enterica serovar Typhi Ty2
cgcgcccacgcgcggcauca

SEQ ID NO: 3688950 - RNA, 14 nt, Salmonella enterica enterica serovar Typhi Ty2
cgcgcccagcagca

SEQ ID NO: 3688951 - RNA, 14 nt, Salmonella enterica enterica serovar Typhi Ty2
cgcgcccagcgccg

SEQ ID NO: 3688952 - RNA, 14 nt, Salmonella enterica enterica serovar Typhi Ty2
cgcgccccagguga

SEQ ID NO: 3688953 - RNA, 18 nt, Salmonella enterica enterica serovar Typhi Ty2
cgcgcccgacauggcuga

SEQ ID NO: 3688954 - RNA, 20 nt, Salmonella enterica enterica serovar Typhi Ty2
cgcgcccgaucguccgccuc

SEQ ID NO: 3688955 - RNA, 20 nt, Salmonella enterica enterica serovar Typhi Ty2
cgcgcccgccaccagcacag

SEQ ID NO: 3688956 - RNA, 21 nt, Salmonella enterica enterica serovar Typhi Ty2
cgcgcccgccaucaugcccac

SEQ ID NO: 3688957 - RNA, 15 nt, Salmonella enterica enterica serovar Typhi Ty2
cgcgcccgccgccaa

SEQ ID NO: 3688958 - RNA, 22 nt, Salmonella enterica enterica serovar Typhi Ty2
cgcgccgacauagcugaacaau

SEQ ID NO: 3688959 - RNA, 15 nt, Salmonella enterica enterica serovar Typhi Ty2
cgcgccgccaacgau

SEQ ID NO: 3688960 - RNA, 13 nt, Salmonella enterica enterica serovar Typhi Ty2
cgcgccgcgcagc

SEQ ID NO: 3688961 - RNA, 18 nt, Salmonella enterica enterica serovar Typhi Ty2
cgcgccggacagcagcau

SEQ ID NO: 3688962 - RNA, 23 nt, Salmonella enterica enterica serovar Typhi Ty2
cgcgccggaugacggcagcgcgu

SEQ ID NO: 3688963 - RNA, 11 nt, Salmonella enterica enterica serovar Typhi Ty2
cgcgccggcaa

SEQ ID NO: 3688964 - RNA, 23 nt, Salmonella enterica enterica serovar Typhi Ty2
cgcgccggggcggggaaaccguc

SEQ ID NO: 3688965 - RNA, 17 nt, Salmonella enterica enterica serovar Typhi Ty2
cgcgccgguagcgagaa

SEQ ID NO: 3688966 - RNA, 16 nt, Salmonella enterica enterica serovar Typhi Ty2
cgcgccggucgccagc

SEQ ID NO: 3688967 - RNA, 21 nt, Salmonella enterica enterica serovar Typhi Ty2
cgcgccggugaucccaccagc

SEQ ID NO: 3688968 - RNA, 17 nt, Salmonella enterica enterica serovar Typhi Ty2
cgcgccuagcgcgcgca

SEQ ID NO: 3688969 - RNA, 22 nt, Salmonella enterica enterica serovar Typhi Ty2
cgcgccuccccugccggcggca

SEQ ID NO: 3688970 - RNA, 23 nt, Salmonella enterica enterica serovar Typhi Ty2
cgcgccugccauagcaucaccag

SEQ ID NO: 3688971 - RNA, 15 nt, Salmonella enterica enterica serovar Typhi Ty2
cgcgccugcucccgc

SEQ ID NO: 3688972 - RNA, 20 nt, Salmonella enterica enterica serovar Typhi Ty2
cgcgccuggaucugcgcauu

SEQ ID NO: 3688973 - RNA, 16 nt, Salmonella enterica enterica serovar Typhi Ty2
cgcgccuuccagcaau

SEQ ID NO: 3688974 - RNA, 18 nt, Salmonella enterica enterica serovar Typhi Ty2
cgcgcgaaacgcacccgc

SEQ ID NO: 3688975 - RNA, 21 nt, Salmonella enterica enterica serovar Typhi Ty2
cgcgcgaauaucgcugccggu

SEQ ID NO: 3688976 - RNA, 15 nt, Salmonella enterica enterica serovar Typhi Ty2
cgcgcgauauccacc

SEQ ID NO: 3688977 - RNA, 23 nt, Salmonella enterica enterica serovar Typhi Ty2
cgcgcgccaucgucccaucgucg

SEQ ID NO: 3688978 - RNA, 13 nt, Salmonella enterica enterica serovar Typhi Ty2
cgcgcgccgauaa

SEQ ID NO: 3688979 - RNA, 13 nt, Salmonella enterica enterica serovar Typhi Ty2
cgcgcgccgccug

SEQ ID NO: 3688980 - RNA, 14 nt, Salmonella enterica enterica serovar Typhi Ty2
cgcgcgccggugau

SEQ ID NO: 3688981 - RNA, 20 nt, Salmonella enterica enterica serovar Typhi Ty2
cgcgcgccugaugcgccgcc

SEQ ID NO: 3688982 - RNA, 13 nt, Salmonella enterica enterica serovar Typhi Ty2
cgcgcgcgcguca

SEQ ID NO: 3688983 - RNA, 20 nt, Salmonella enterica enterica serovar Typhi Ty2
cgcgcggauauggcggcggc

SEQ ID NO: 3688984 - RNA, 12 nt, Salmonella enterica enterica serovar Typhi Ty2
cgcgcggcguuc

SEQ ID NO: 3688985 - RNA, 16 nt, Salmonella enterica enterica serovar Typhi Ty2
cgcgcggcuaccggac

SEQ ID NO: 3688986 - RNA, 22 nt, Salmonella enterica enterica serovar Typhi Ty2
cgcgcgguugggcuuccgucgg

SEQ ID NO: 3688987 - RNA, 15 nt, Salmonella enterica enterica serovar Typhi Ty2
cgcgcgguuuauccc

SEQ ID NO: 3688988 - RNA, 14 nt, Salmonella enterica enterica serovar Typhi Ty2
cgcgcgucagcgug

SEQ ID NO: 3688989 - RNA, 14 nt, Salmonella enterica enterica serovar Typhi Ty2
cgcgcuaaacguga

SEQ ID NO: 3688990 - RNA, 15 nt, Salmonella enterica enterica serovar Typhi Ty2
cgcgcuaucaacgcc

SEQ ID NO: 3688991 - RNA, 22 nt, Salmonella enterica enterica serovar Typhi Ty2
cgcgcuaucaacgccuccaggc

SEQ ID NO: 3688992 - RNA, 16 nt, Salmonella enterica enterica serovar Typhi Ty2
cgcgcuaucgguauca

SEQ ID NO: 3688993 - RNA, 17 nt, Salmonella enterica enterica serovar Typhi Ty2
cgcgcucaagcgaaaaa

SEQ ID NO: 3688994 - RNA, 15 nt, Salmonella enterica enterica serovar Typhi Ty2
cgcgcucaagcuggg

SEQ ID NO: 3688995 - RNA, 21 nt, Salmonella enterica enterica serovar Typhi Ty2
cgcgcucauacgaucgcgcac

SEQ ID NO: 3688996 - RNA, 12 nt, Salmonella enterica enterica serovar Typhi Ty2
cgcgcucgccag

SEQ ID NO: 3688997 - RNA, 17 nt, Salmonella enterica enterica serovar Typhi Ty2
cgcgcucggucacuuca

SEQ ID NO: 3688998 - RNA, 17 nt, Salmonella enterica enterica serovar Typhi Ty2
cgcgcucuuccgccagc

SEQ ID NO: 3688999 - RNA, 13 nt, Salmonella enterica enterica serovar Typhi Ty2
cgcgcugccgccc

SEQ ID NO: 3689000 - RNA, 12 nt, Salmonella enterica enterica serovar Typhi Ty2
cgcgcuggcgga

SEQ ID NO: 3689001 - RNA, 14 nt, Salmonella enterica enterica serovar Typhi Ty2
cgcgcuuaaucgag

SEQ ID NO: 3689002 - RNA, 22 nt, Salmonella enterica enterica serovar Typhi Ty2
cgcgcuuacgcuccugcgguac

SEQ ID NO: 3689003 - RNA, 21 nt, Salmonella enterica enterica serovar Typhi Ty2
cgcgcuugcguguuugggcga

SEQ ID NO: 3689004 - RNA, 20 nt, Salmonella enterica enterica serovar Typhi Ty2
cgcgcuuuucgccagcgcau

SEQ ID NO: 3689005 - RNA, 19 nt, Salmonella enterica enterica serovar Typhi Ty2
cgcggaacuggugaaacag

SEQ ID NO: 3689006 - RNA, 19 nt, Salmonella enterica enterica serovar Typhi Ty2
cgcggaagccacguucuuc

SEQ ID NO: 3689007 - RNA, 13 nt, Salmonella enterica enterica serovar Typhi Ty2
cgcggaaggcgcc

SEQ ID NO: 3689008 - RNA, 20 nt, Salmonella enterica enterica serovar Typhi Ty2
cgcggaaggcgccucgcgcg

SEQ ID NO: 3689009 - RNA, 19 nt, Salmonella enterica enterica serovar Typhi Ty2
cgcggaccuuuugccgccc

SEQ ID NO: 3689010 - RNA, 15 nt, Salmonella enterica enterica serovar Typhi Ty2
cgcggagagaucgac

SEQ ID NO: 3689011 - RNA, 18 nt, Salmonella enterica enterica serovar Typhi Ty2
cgcggauaagcccggcgg

SEQ ID NO: 3689012 - RNA, 16 nt, Salmonella enterica enterica serovar Typhi Ty2
cgcggauagucauaau

SEQ ID NO: 3689013 - RNA, 17 nt, Salmonella enterica enterica serovar Typhi Ty2
cgcggauaugcagcagc

SEQ ID NO: 3689014 - RNA, 18 nt, Salmonella enterica enterica serovar Typhi Ty2
cgcggauaugcagcagcc

SEQ ID NO: 3689015 - RNA, 19 nt, Salmonella enterica enterica serovar Typhi Ty2
cgcggauaugcagcagcca

SEQ ID NO: 3689016 - RNA, 14 nt, Salmonella enterica enterica serovar Typhi Ty2
cgcggaucggcaca

SEQ ID NO: 3689017 - RNA, 20 nt, Salmonella enterica enterica serovar Typhi Ty2
cgcggaucggcacacagcca

SEQ ID NO: 3689018 - RNA, 21 nt, Salmonella enterica enterica serovar Typhi Ty2
cgcggaucgugauaacgcgau

SEQ ID NO: 3689019 - RNA, 17 nt, Salmonella enterica enterica serovar Typhi Ty2
cgcggauuaagcgaauc

SEQ ID NO: 3689020 - RNA, 19 nt, Salmonella enterica enterica serovar Typhi Ty2
cgcggcaaccagcccauga

SEQ ID NO: 3689021 - RNA, 17 nt, Salmonella enterica enterica serovar Typhi Ty2
cgcggcaauuuccgcug

SEQ ID NO: 3689022 - RNA, 22 nt, Salmonella enterica enterica serovar Typhi Ty2
cgcggcacacaacacggcggcu

SEQ ID NO: 3689023 - RNA, 13 nt, Salmonella enterica enterica serovar Typhi Ty2
cgcggcacacagc

SEQ ID NO: 3689024 - RNA, 14 nt, Salmonella enterica enterica serovar Typhi Ty2
cgcggcagccggaa

SEQ ID NO: 3689025 - RNA, 14 nt, Salmonella enterica enterica serovar Typhi Ty2
cgcggcaucaagca

SEQ ID NO: 3689026 - RNA, 17 nt, Salmonella enterica enterica serovar Typhi Ty2
cgcggcauuaaaugcgc

SEQ ID NO: 3689027 - RNA, 16 nt, Salmonella enterica enterica serovar Typhi Ty2
cgcggccaaaacccac

SEQ ID NO: 3689028 - RNA, 22 nt, Salmonella enterica enterica serovar Typhi Ty2
cgcggccaaaacccaccagcag

SEQ ID NO: 3689029 - RNA, 21 nt, Salmonella enterica enterica serovar Typhi Ty2
cgcguucgcaccauagcagcc

SEQ ID NO: 3689030 - RNA, 19 nt, Salmonella enterica enterica serovar Typhi Ty2
cgcguucgccgucacgccg

SEQ ID NO: 3689031 - RNA, 14 nt, Salmonella enterica enterica serovar Typhi Ty2
cgcguucgcgcagu

SEQ ID NO: 3689032 - RNA, 20 nt, Salmonella enterica enterica serovar Typhi Ty2
cgcguucgcuucgaggauaa

SEQ ID NO: 3689033 - RNA, 18 nt, Salmonella enterica enterica serovar Typhi Ty2
cgcguucugaauaaauug

SEQ ID NO: 3689034 - RNA, 14 nt, Salmonella enterica enterica serovar Typhi Ty2
cgcguucuggcgau

SEQ ID NO: 3689035 - RNA, 13 nt, Salmonella enterica enterica serovar Typhi Ty2
cgcguugccgccg

SEQ ID NO: 3689036 - RNA, 22 nt, Salmonella enterica enterica serovar Typhi Ty2
cgcguugcuuaucaggccuaca

SEQ ID NO: 3689037 - RNA, 14 nt, Salmonella enterica enterica serovar Typhi Ty2
cgcguuggacaggg

SEQ ID NO: 3689038 - RNA, 15 nt, Salmonella enterica enterica serovar Typhi Ty2
cgcguuggcggcuuu

SEQ ID NO: 3689039 - RNA, 17 nt, Salmonella enterica enterica serovar Typhi Ty2
cgcguuuagcgccagca

SEQ ID NO: 3689040 - RNA, 15 nt, Salmonella enterica enterica serovar Typhi Ty2
cgcguuuaucaccaa

SEQ ID NO: 3689041 - RNA, 15 nt, Salmonella enterica enterica serovar Typhi Ty2
cgcguuucgcgauaa

SEQ ID NO: 3689042 - RNA, 14 nt, Salmonella enterica enterica serovar Typhi Ty2
cgcguuuuccagca

SEQ ID NO: 3689043 - RNA, 23 nt, Salmonella enterica enterica serovar Typhi Ty2
cgcguuuuccagcauccugacau

SEQ ID NO: 3689044 - RNA, 13 nt, Salmonella enterica enterica serovar Typhi Ty2
cgcguuuuccauu

SEQ ID NO: 3689045 - RNA, 16 nt, Salmonella enterica enterica serovar Typhi Ty2
cgcguuuuuucaugaa

SEQ ID NO: 3689046 - RNA, 15 nt, Salmonella enterica enterica serovar Typhi Ty2
cgcuaaaauccacgu

SEQ ID NO: 3689047 - RNA, 20 nt, Salmonella enterica enterica serovar Typhi Ty2
cgcuaaacagcaaaucggga

SEQ ID NO: 3689048 - RNA, 20 nt, Salmonella enterica enterica serovar Typhi Ty2
cgcuaaacagcgccgcgaau

SEQ ID NO: 3689049 - RNA, 23 nt, Salmonella enterica enterica serovar Typhi Ty2
cgcuaaaccacaugaccagcgcc

SEQ ID NO: 3689050 - RNA, 23 nt, Salmonella enterica enterica serovar Typhi Ty2
cgcuaaaugacaaauagaagcca

SEQ ID NO: 3689051 - RNA, 14 nt, Salmonella enterica enterica serovar Typhi Ty2
cgcuaaaugcauag

SEQ ID NO: 3689052 - RNA, 14 nt, Salmonella enterica enterica serovar Typhi Ty2
cgcuaaccaucagc

SEQ ID NO: 3689053 - RNA, 16 nt, Salmonella enterica enterica serovar Typhi Ty2
cgcuaaccggcggcgu

SEQ ID NO: 3689054 - RNA, 14 nt, Salmonella enterica enterica serovar Typhi Ty2
cgcuaacggcacca

SEQ ID NO: 3689055 - RNA, 17 nt, Salmonella enterica enterica serovar Typhi Ty2
cgcuaagacgugacgua

SEQ ID NO: 3689056 - RNA, 14 nt, Salmonella enterica enterica serovar Typhi Ty2
cgcuaaguacggcg

SEQ ID NO: 3689057 - RNA, 12 nt, Salmonella enterica enterica serovar Typhi Ty2
cgcuaauaauuc

SEQ ID NO: 3689058 - RNA, 22 nt, Salmonella enterica enterica serovar Typhi Ty2
cgcuaaugcccggcgcggcauc

SEQ ID NO: 3689059 - RNA, 18 nt, Salmonella enterica enterica serovar Typhi Ty2
cgcuacaauccaggacgu

SEQ ID NO: 3689060 - RNA, 13 nt, Salmonella enterica enterica serovar Typhi Ty2
cgcuacagggcgu

SEQ ID NO: 3689061 - RNA, 21 nt, Salmonella enterica enterica serovar Typhi Ty2
cgcuacauccgccagccgcca

SEQ ID NO: 3689062 - RNA, 22 nt, Salmonella enterica enterica serovar Typhi Ty2
cgcuacauccgccagccgccau

SEQ ID NO: 3689063 - RNA, 17 nt, Salmonella enterica enterica serovar Typhi Ty2
cgcuaccagcgcggcgc

SEQ ID NO: 3689064 - RNA, 19 nt, Salmonella enterica enterica serovar Typhi Ty2
cgcuaccagcgcggcgcca

SEQ ID NO: 3689065 - RNA, 14 nt, Salmonella enterica enterica serovar Typhi Ty2
cgcuacccggcaca

SEQ ID NO: 3689066 - RNA, 17 nt, Salmonella enterica enterica serovar Typhi Ty2
cgcuaccuucuucccau

SEQ ID NO: 3689067 - RNA, 12 nt, Salmonella enterica enterica serovar Typhi Ty2
cgcuaccuuuuu

SEQ ID NO: 3689068 - RNA, 20 nt, Salmonella enterica enterica serovar Typhi Ty2
cgcuacgcuuaucaggccua

SEQ ID NO: 3689069 - RNA, 18 nt, Salmonella enterica enterica serovar Typhi Ty2
cgcuacgcuuaucgggcc

SEQ ID NO: 3689070 - RNA, 20 nt, Salmonella enterica enterica serovar Typhi Ty2
cgcuacguuuaucaggccua

SEQ ID NO: 3689071 - RNA, 14 nt, Salmonella enterica enterica serovar Typhi Ty2
cgcuacguuuaucu

SEQ ID NO: 3689072 - RNA, 18 nt, Salmonella enterica enterica serovar Typhi Ty2
cgcuacuccgcccuaauc

SEQ ID NO: 3689073 - RNA, 15 nt, Salmonella enterica enterica serovar Typhi Ty2
cgcuacugccgccau

SEQ ID NO: 3689074 - RNA, 16 nt, Salmonella enterica enterica serovar Typhi Ty2
cgcuacugccgccauc

SEQ ID NO: 3689075 - RNA, 14 nt, Salmonella enterica enterica serovar Typhi Ty2
cgcuacuucagggg

SEQ ID NO: 3689076 - RNA, 15 nt, Salmonella enterica enterica serovar Typhi Ty2
cgcuagcucaacgcc

SEQ ID NO: 3689077 - RNA, 19 nt, Salmonella enterica enterica serovar Typhi Ty2
cgcuagcuuaucgggccua

SEQ ID NO: 3689078 - RNA, 13 nt, Salmonella enterica enterica serovar Typhi Ty2
cgcuauaucacgc

SEQ ID NO: 3689079 - RNA, 13 nt, Salmonella enterica enterica serovar Typhi Ty2
cgcuaucaaaaug

SEQ ID NO: 3689080 - RNA, 16 nt, Salmonella enterica enterica serovar Typhi Ty2
cgcuaucaggcacuga

SEQ ID NO: 3689081 - RNA, 17 nt, Salmonella enterica enterica serovar Typhi Ty2
cgcuaucaggcacugaa

SEQ ID NO: 3689082 - RNA, 18 nt, Salmonella enterica enterica serovar Typhi Ty2
cgcuauccaggccgucgg

SEQ ID NO: 3689083 - RNA, 23 nt, Salmonella enterica enterica serovar Typhi Ty2
cgcuauccgcgcucgccagcaua

SEQ ID NO: 3689084 - RNA, 13 nt, Salmonella enterica enterica serovar Typhi Ty2
cgcuauccggcau

SEQ ID NO: 3689085 - RNA, 19 nt, Salmonella enterica enterica serovar Typhi Ty2
cgcuauccggcgcgcuggu

SEQ ID NO: 3689086 - RNA, 14 nt, Salmonella enterica enterica serovar Typhi Ty2
cgcuauccggcuuu

SEQ ID NO: 3689087 - RNA, 17 nt, Salmonella enterica enterica serovar Typhi Ty2
cgcuaucgaccagcacc

SEQ ID NO: 3689088 - RNA, 12 nt, Salmonella enterica enterica serovar Typhi Ty2
cgcuaucgccaa

SEQ ID NO: 3689089 - RNA, 13 nt, Salmonella enterica enterica serovar Typhi Ty2
cgcuaucgcccaa

SEQ ID NO: 3689090 - RNA, 20 nt, Salmonella enterica enterica serovar Typhi Ty2
cgcuaucucuuccagcgucu

SEQ ID NO: 3689091 - RNA, 18 nt, Salmonella enterica enterica serovar Typhi Ty2
cgcuaugcccaccgcgcg

SEQ ID NO: 3689092 - RNA, 16 nt, Salmonella enterica enterica serovar Typhi Ty2
cgcuaugcuuaccauc

SEQ ID NO: 3689093 - RNA, 18 nt, Salmonella enterica enterica serovar Typhi Ty2
cgcuaugcuuaccaucug

SEQ ID NO: 3689094 - RNA, 18 nt, Salmonella enterica enterica serovar Typhi Ty2
cgcuauggugcgggguuu

SEQ ID NO: 3689095 - RNA, 19 nt, Salmonella enterica enterica serovar Typhi Ty2
cgcuauuaccccgcggcau

SEQ ID NO: 3689096 - RNA, 19 nt, Salmonella enterica enterica serovar Typhi Ty2
cgcuauugagcgacgccgc

SEQ ID NO: 3689097 - RNA, 13 nt, Salmonella enterica enterica serovar Typhi Ty2
cgcuauuuaaccc

SEQ ID NO: 3689098 - RNA, 12 nt, Salmonella enterica enterica serovar Typhi Ty2
cgcucaaccggu

SEQ ID NO: 3689099 - RNA, 16 nt, Salmonella enterica enterica serovar Typhi Ty2
cgcucaaccgguuugu

SEQ ID NO: 3689100 - RNA, 21 nt, Salmonella enterica enterica serovar Typhi Ty2
cgcucaagcgaaaaaauaauc

SEQ ID NO: 3689101 - RNA, 18 nt, Salmonella enterica enterica serovar Typhi Ty2
cgcucaagcugggcguua

SEQ ID NO: 3689102 - RNA, 13 nt, Salmonella enterica enterica serovar Typhi Ty2
cgcucaaucagcg

SEQ ID NO: 3689103 - RNA, 16 nt, Salmonella enterica enterica serovar Typhi Ty2
cgcucaccaccgccgc

SEQ ID NO: 3689104 - RNA, 18 nt, Salmonella enterica enterica serovar Typhi Ty2
cgcucaccaccgccgcga

SEQ ID NO: 3689105 - RNA, 16 nt, Salmonella enterica enterica serovar Typhi Ty2
cgcucacccgauaaaa

SEQ ID NO: 3689106 - RNA, 15 nt, Salmonella enterica enterica serovar Typhi Ty2
cgcucaccgacuccu

SEQ ID NO: 3689107 - RNA, 13 nt, Salmonella enterica enterica serovar Typhi Ty2
cgcucacgauaac

SEQ ID NO: 3689108 - RNA, 14 nt, Salmonella enterica enterica serovar Typhi Ty2
cgcucacgcggcgc

SEQ ID NO: 3689109 - RNA, 20 nt, Salmonella enterica enterica serovar Typhi Ty2
cgcucacgguuucaacuucc

SEQ ID NO: 3689110 - RNA, 21 nt, Salmonella enterica enterica serovar Typhi Ty2
cgcucacgguuucaacuucca

SEQ ID NO: 3689111 - RNA, 15 nt, Salmonella enterica enterica serovar Typhi Ty2
cgcucagcaucgcau

SEQ ID NO: 3689112 - RNA, 23 nt, Salmonella enterica enterica serovar Typhi Ty2
cgcugcgcuuaccgggccgacag

SEQ ID NO: 3689113 - RNA, 20 nt, Salmonella enterica enterica serovar Typhi Ty2
cgcugcgcuuaccgggccua

SEQ ID NO: 3689114 - RNA, 16 nt, Salmonella enterica enterica serovar Typhi Ty2
cgcugcgcuuauccgg

SEQ ID NO: 3689115 - RNA, 20 nt, Salmonella enterica enterica serovar Typhi Ty2
cgcugcggccagaccgccgc

SEQ ID NO: 3689116 - RNA, 21 nt, Salmonella enterica enterica serovar Typhi Ty2
cgcugcggccagaccgccgcu

SEQ ID NO: 3689117 - RNA, 17 nt, Salmonella enterica enterica serovar Typhi Ty2
cgcugcggucaggaaug

SEQ ID NO: 3689118 - RNA, 16 nt, Salmonella enterica enterica serovar Typhi Ty2
cgcugcgucaggcgau

SEQ ID NO: 3689119 - RNA, 15 nt, Salmonella enterica enterica serovar Typhi Ty2
cgcugcguggcgggc

SEQ ID NO: 3689120 - RNA, 17 nt, Salmonella enterica enterica serovar Typhi Ty2
cgcugcguggcgggcgu

SEQ ID NO: 3689121 - RNA, 12 nt, Salmonella enterica enterica serovar Typhi Ty2
cgcugcuccggc

SEQ ID NO: 3689122 - RNA, 20 nt, Salmonella enterica enterica serovar Typhi Ty2
cgcugcugaccuuaauccag

SEQ ID NO: 3689123 - RNA, 15 nt, Salmonella enterica enterica serovar Typhi Ty2
cgcugcugcggcguu

SEQ ID NO: 3689124 - RNA, 13 nt, Salmonella enterica enterica serovar Typhi Ty2
cgcugcuggcgaa

SEQ ID NO: 3689125 - RNA, 13 nt, Salmonella enterica enterica serovar Typhi Ty2
cgcuggaagagaa

SEQ ID NO: 3689126 - RNA, 23 nt, Salmonella enterica enterica serovar Typhi Ty2
cgcuggaaguaugccucgcgcac

SEQ ID NO: 3689127 - RNA, 21 nt, Salmonella enterica enterica serovar Typhi Ty2
cgcuggacgucgucaccacgg

SEQ ID NO: 3689128 - RNA, 23 nt, Salmonella enterica enterica serovar Typhi Ty2
cgcuggagccuguuccagcugcg

SEQ ID NO: 3689129 - RNA, 14 nt, Salmonella enterica enterica serovar Typhi Ty2
cgcuggaggccaau

SEQ ID NO: 3689130 - RNA, 21 nt, Salmonella enterica enterica serovar Typhi Ty2
cgcuggcaauaaagcagggcg

SEQ ID NO: 3689131 - RNA, 16 nt, Salmonella enterica enterica serovar Typhi Ty2
cgcuggcacaggauau

SEQ ID NO: 3689132 - RNA, 21 nt, Salmonella enterica enterica serovar Typhi Ty2
cgcuggcauuccccaucgcga

SEQ ID NO: 3689133 - RNA, 17 nt, Salmonella enterica enterica serovar Typhi Ty2
cgcuggcgccaccgcug

SEQ ID NO: 3689134 - RNA, 16 nt, Salmonella enterica enterica serovar Typhi Ty2
cgcuggcgcgucugug

SEQ ID NO: 3689135 - RNA, 13 nt, Salmonella enterica enterica serovar Typhi Ty2
cgcuggcgcugca

SEQ ID NO: 3689136 - RNA, 14 nt, Salmonella enterica enterica serovar Typhi Ty2
cgcuggcggcccgc

SEQ ID NO: 3689137 - RNA, 23 nt, Salmonella enterica enterica serovar Typhi Ty2
cgcuggcggguagcgcauaacgc

SEQ ID NO: 3689138 - RNA, 23 nt, Salmonella enterica enterica serovar Typhi Ty2
cgcuggcguauucgcccggcagg

SEQ ID NO: 3689139 - RNA, 15 nt, Salmonella enterica enterica serovar Typhi Ty2
cgcuggcugccgcca

SEQ ID NO: 3689140 - RNA, 10 nt, Salmonella enterica enterica serovar Typhi Ty2
cgcuggcugg

SEQ ID NO: 3689141 - RNA, 22 nt, Salmonella enterica enterica serovar Typhi Ty2
cgcugggaaucgcgauuccgga

SEQ ID NO: 3689142 - RNA, 15 nt, Salmonella enterica enterica serovar Typhi Ty2
cgcugggcgauaaaa

SEQ ID NO: 3689143 - RNA, 18 nt, Salmonella enterica enterica serovar Typhi Ty2
cgcuggguuuuuccgcuu

SEQ ID NO: 3689144 - RNA, 14 nt, Salmonella enterica enterica serovar Typhi Ty2
cgcuggucagcgcg

SEQ ID NO: 3689145 - RNA, 14 nt, Salmonella enterica enterica serovar Typhi Ty2
cgcugguuccccgu

SEQ ID NO: 3689146 - RNA, 15 nt, Salmonella enterica enterica serovar Typhi Ty2
cgcugguuggcgcgc

SEQ ID NO: 3689147 - RNA, 13 nt, Salmonella enterica enterica serovar Typhi Ty2
cgcuguaccggca

SEQ ID NO: 3689148 - RNA, 13 nt, Salmonella enterica enterica serovar Typhi Ty2
cgcugucaaucga

SEQ ID NO: 3689149 - RNA, 19 nt, Salmonella enterica enterica serovar Typhi Ty2
cgcugucacuccggcugca

SEQ ID NO: 3689150 - RNA, 20 nt, Salmonella enterica enterica serovar Typhi Ty2
cgcugucagugaaaaaccga

SEQ ID NO: 3689151 - RNA, 14 nt, Salmonella enterica enterica serovar Typhi Ty2
cgcuguccgcccag

SEQ ID NO: 3689152 - RNA, 15 nt, Salmonella enterica enterica serovar Typhi Ty2
cgcugucgccgcgca

SEQ ID NO: 3689153 - RNA, 18 nt, Salmonella enterica enterica serovar Typhi Ty2
cgcugucguuccacacgu

SEQ ID NO: 3689154 - RNA, 15 nt, Salmonella enterica enterica serovar Typhi Ty2
cgcugucuauccacu

SEQ ID NO: 3689155 - RNA, 20 nt, Salmonella enterica enterica serovar Typhi Ty2
cgcuguggucgucuggagua

SEQ ID NO: 3689156 - RNA, 21 nt, Salmonella enterica enterica serovar Typhi Ty2
cgcuguguacgcguucugaau

SEQ ID NO: 3689157 - RNA, 15 nt, Salmonella enterica enterica serovar Typhi Ty2
cgcuguuaugcacgc

SEQ ID NO: 3689158 - RNA, 20 nt, Salmonella enterica enterica serovar Typhi Ty2
cgcuguuaugcacgcgcggc

SEQ ID NO: 3689159 - RNA, 15 nt, Salmonella enterica enterica serovar Typhi Ty2
cgcuguucgccggau

SEQ ID NO: 3689160 - RNA, 15 nt, Salmonella enterica enterica serovar Typhi Ty2
cgcuguuuauccaca

SEQ ID NO: 3689161 - RNA, 15 nt, Salmonella enterica enterica serovar Typhi Ty2
cgcuguuuuccgcuu

SEQ ID NO: 3689162 - RNA, 21 nt, Salmonella enterica enterica serovar Typhi Ty2
cgcuuaaagcguuccacgucg

SEQ ID NO: 3689163 - RNA, 17 nt, Salmonella enterica enterica serovar Typhi Ty2
cgcuuaacggcccaggc

SEQ ID NO: 3689164 - RNA, 23 nt, Salmonella enterica enterica serovar Typhi Ty2
cgcuuaauaauaagcggccuaua

SEQ ID NO: 3689165 - RNA, 16 nt, Salmonella enterica enterica serovar Typhi Ty2
cgcuuacaauuuaucu

SEQ ID NO: 3689166 - RNA, 17 nt, Salmonella enterica enterica serovar Typhi Ty2
cgcuuacaauuuaucug

SEQ ID NO: 3689167 - RNA, 19 nt, Salmonella enterica enterica serovar Typhi Ty2
cgcuuaccaggccuacacg

SEQ ID NO: 3689168 - RNA, 15 nt, Salmonella enterica enterica serovar Typhi Ty2
cgcuuaccgggcagg

SEQ ID NO: 3689169 - RNA, 18 nt, Salmonella enterica enterica serovar Typhi Ty2
cgcuuaccgggcaggaua

SEQ ID NO: 3689170 - RNA, 18 nt, Salmonella enterica enterica serovar Typhi Ty2
cgcuuacgcggcgcgcuc

SEQ ID NO: 3689171 - RNA, 16 nt, Salmonella enterica enterica serovar Typhi Ty2
cgcuuacgcuccugcg

SEQ ID NO: 3689172 - RNA, 20 nt, Salmonella enterica enterica serovar Typhi Ty2
cgcuuacgcuuacccggccu

SEQ ID NO: 3689173 - RNA, 18 nt, Salmonella enterica enterica serovar Typhi Ty2
cgcuuacucagccagaua

SEQ ID NO: 3689174 - RNA, 17 nt, Salmonella enterica enterica serovar Typhi Ty2
cgcuuacugugccgccg

SEQ ID NO: 3689175 - RNA, 13 nt, Salmonella enterica enterica serovar Typhi Ty2
cgcuuaucaggcc

SEQ ID NO: 3689176 - RNA, 17 nt, Salmonella enterica enterica serovar Typhi Ty2
cgcuuaucaggccuaca

SEQ ID NO: 3689177 - RNA, 20 nt, Salmonella enterica enterica serovar Typhi Ty2
cgcuuaucaggccuacaacg

SEQ ID NO: 3689178 - RNA, 19 nt, Salmonella enterica enterica serovar Typhi Ty2
cgcuuaucaggccuacaag

SEQ ID NO: 3689179 - RNA, 17 nt, Salmonella enterica enterica serovar Typhi Ty2
cgcuuaucaggccuacc

SEQ ID NO: 3689180 - RNA, 19 nt, Salmonella enterica enterica serovar Typhi Ty2
cgcuuaucccagccgcgau

SEQ ID NO: 3689181 - RNA, 12 nt, Salmonella enterica enterica serovar Typhi Ty2
cgcuuauccgcu

SEQ ID NO: 3689182 - RNA, 14 nt, Salmonella enterica enterica serovar Typhi Ty2
cgcuuauccggccu

SEQ ID NO: 3689183 - RNA, 19 nt, Salmonella enterica enterica serovar Typhi Ty2
cgcuuauccggccuacaga

SEQ ID NO: 3689184 - RNA, 18 nt, Salmonella enterica enterica serovar Typhi Ty2
cgcuuauccggccuaccg

SEQ ID NO: 3689185 - RNA, 19 nt, Salmonella enterica enterica serovar Typhi Ty2
cgcuuauccggccuacgcu

SEQ ID NO: 3689186 - RNA, 12 nt, Salmonella enterica enterica serovar Typhi Ty2
cgcuuaucgcca

SEQ ID NO: 3689187 - RNA, 14 nt, Salmonella enterica enterica serovar Typhi Ty2
cgcuucaccggcgu

SEQ ID NO: 3689188 - RNA, 20 nt, Salmonella enterica enterica serovar Typhi Ty2
cgcuucaccggcgugcgcuu

SEQ ID NO: 3689189 - RNA, 19 nt, Salmonella enterica enterica serovar Typhi Ty2
cgcuucacgcgcggcuacu

SEQ ID NO: 3689190 - RNA, 16 nt, Salmonella enterica enterica serovar Typhi Ty2
cgcuucacgucagcga

SEQ ID NO: 3689191 - RNA, 15 nt, Salmonella enterica enterica serovar Typhi Ty2
cgcuuccaccucuuc

SEQ ID NO: 3689192 - RNA, 18 nt, Salmonella enterica enterica serovar Typhi Ty2
cgcuuccaguccagcgcg

SEQ ID NO: 3689193 - RNA, 18 nt, Salmonella enterica enterica serovar Typhi Ty2
cgcuucccgaugccagca

SEQ ID NO: 3689194 - RNA, 11 nt, Salmonella enterica enterica serovar Typhi Ty2
cggaauaacuc

SEQ ID NO: 3689195 - RNA, 15 nt, Salmonella enterica enterica serovar Typhi Ty2
cggaauaccgucaaa

SEQ ID NO: 3689196 - RNA, 20 nt, Salmonella enterica enterica serovar Typhi Ty2
cggaauagacggccugcaaa

SEQ ID NO: 3689197 - RNA, 20 nt, Salmonella enterica enterica serovar Typhi Ty2
cggaauccccgccgccagua

SEQ ID NO: 3689198 - RNA, 19 nt, Salmonella enterica enterica serovar Typhi Ty2
cggaaucgcgauccagccc

SEQ ID NO: 3689199 - RNA, 16 nt, Salmonella enterica enterica serovar Typhi Ty2
cggaaugacaaacgcc

SEQ ID NO: 3689200 - RNA, 15 nt, Salmonella enterica enterica serovar Typhi Ty2
cggaaugaugugcua

SEQ ID NO: 3689201 - RNA, 19 nt, Salmonella enterica enterica serovar Typhi Ty2
cggaauggcacagcgcagc

SEQ ID NO: 3689202 - RNA, 15 nt, Salmonella enterica enterica serovar Typhi Ty2
cggaauggcgacgac

SEQ ID NO: 3689203 - RNA, 18 nt, Salmonella enterica enterica serovar Typhi Ty2
cggaauggcgggcgcagg

SEQ ID NO: 3689204 - RNA, 21 nt, Salmonella enterica enterica serovar Typhi Ty2
cggaaugugaaauacagccag

SEQ ID NO: 3689205 - RNA, 15 nt, Salmonella enterica enterica serovar Typhi Ty2
cggaauucccacauc

SEQ ID NO: 3689206 - RNA, 15 nt, Salmonella enterica enterica serovar Typhi Ty2
cggacaacgcuccag

SEQ ID NO: 3689207 - RNA, 15 nt, Salmonella enterica enterica serovar Typhi Ty2
cggacaaggcgcgcc

SEQ ID NO: 3689208 - RNA, 15 nt, Salmonella enterica enterica serovar Typhi Ty2
cggacacccgcagcc

SEQ ID NO: 3689209 - RNA, 17 nt, Salmonella enterica enterica serovar Typhi Ty2
cggacacccgcagccag

SEQ ID NO: 3689210 - RNA, 18 nt, Salmonella enterica enterica serovar Typhi Ty2
cggacacccgcagccaga

SEQ ID NO: 3689211 - RNA, 16 nt, Salmonella enterica enterica serovar Typhi Ty2
cggacacgcucauaaa

SEQ ID NO: 3689212 - RNA, 12 nt, Salmonella enterica enterica serovar Typhi Ty2
cggacagcagca

SEQ ID NO: 3689213 - RNA, 23 nt, Salmonella enterica enterica serovar Typhi Ty2
cggacauaaaggaaaugccgggc

SEQ ID NO: 3689214 - RNA, 19 nt, Salmonella enterica enterica serovar Typhi Ty2
cggacaucauccccggcag

SEQ ID NO: 3689215 - RNA, 12 nt, Salmonella enterica enterica serovar Typhi Ty2
cggacaucccaa

SEQ ID NO: 3689216 - RNA, 15 nt, Salmonella enterica enterica serovar Typhi Ty2
cggacaucggccucg

SEQ ID NO: 3689217 - RNA, 19 nt, Salmonella enterica enterica serovar Typhi Ty2
cggaccgauaacaggaacg

SEQ ID NO: 3689218 - RNA, 12 nt, Salmonella enterica enterica serovar Typhi Ty2
cggaccuccgcg

SEQ ID NO: 3689219 - RNA, 19 nt, Salmonella enterica enterica serovar Typhi Ty2
cggacgaacgcuaugcgcc

SEQ ID NO: 3689220 - RNA, 19 nt, Salmonella enterica enterica serovar Typhi Ty2
cggacgagcgcgucagcgc

SEQ ID NO: 3689221 - RNA, 17 nt, Salmonella enterica enterica serovar Typhi Ty2
cggacgcaccagccagg

SEQ ID NO: 3689222 - RNA, 14 nt, Salmonella enterica enterica serovar Typhi Ty2
cggacgcagcucau

SEQ ID NO: 3689223 - RNA, 16 nt, Salmonella enterica enterica serovar Typhi Ty2
cggacgccagugcgca

SEQ ID NO: 3689224 - RNA, 17 nt, Salmonella enterica enterica serovar Typhi Ty2
cggacgguaccugaagc

SEQ ID NO: 3689225 - RNA, 20 nt, Salmonella enterica enterica serovar Typhi Ty2
cggacguaccgcuuuaucau

SEQ ID NO: 3689226 - RNA, 16 nt, Salmonella enterica enterica serovar Typhi Ty2
cggacuagacagccuc

SEQ ID NO: 3689227 - RNA, 14 nt, Salmonella enterica enterica serovar Typhi Ty2
cggacucaggccuu

SEQ ID NO: 3689228 - RNA, 16 nt, Salmonella enterica enterica serovar Typhi Ty2
cggacucauacuugcc

SEQ ID NO: 3689229 - RNA, 17 nt, Salmonella enterica enterica serovar Typhi Ty2
cggacuccaggcaacgu

SEQ ID NO: 3689230 - RNA, 15 nt, Salmonella enterica enterica serovar Typhi Ty2
cggacucgcuggaca

SEQ ID NO: 3689231 - RNA, 16 nt, Salmonella enterica enterica serovar Typhi Ty2
cggacucgcuggacau

SEQ ID NO: 3689232 - RNA, 21 nt, Salmonella enterica enterica serovar Typhi Ty2
cggacugcggccugcaaagac

SEQ ID NO: 3689233 - RNA, 19 nt, Salmonella enterica enterica serovar Typhi Ty2
cggagaaaagcgaaaauaa

SEQ ID NO: 3689234 - RNA, 23 nt, Salmonella enterica enterica serovar Typhi Ty2
cggagaaauagacgagcgaaaaa

SEQ ID NO: 3689235 - RNA, 14 nt, Salmonella enterica enterica serovar Typhi Ty2
cggagaacggcaca

SEQ ID NO: 3689236 - RNA, 22 nt, Salmonella enterica enterica serovar Typhi Ty2
cggagaacggcacaauagcgcu

SEQ ID NO: 3689237 - RNA, 15 nt, Salmonella enterica enterica serovar Typhi Ty2
cggagauacuuucuu

SEQ ID NO: 3689238 - RNA, 17 nt, Salmonella enterica enterica serovar Typhi Ty2
cggagauuaacagcgcg

SEQ ID NO: 3689239 - RNA, 21 nt, Salmonella enterica enterica serovar Typhi Ty2
cggagauuaacagcgcgacca

SEQ ID NO: 3689240 - RNA, 23 nt, Salmonella enterica enterica serovar Typhi Ty2
cggagauuaacagcgcgaccagc

SEQ ID NO: 3689241 - RNA, 22 nt, Salmonella enterica enterica serovar Typhi Ty2
cggagcaaaaaaugagaacacc

SEQ ID NO: 3689242 - RNA, 23 nt, Salmonella enterica enterica serovar Typhi Ty2
cggagcgcuuuuuuuaugcguua

SEQ ID NO: 3689243 - RNA, 15 nt, Salmonella enterica enterica serovar Typhi Ty2
cggagcgucauuuuc

SEQ ID NO: 3689244 - RNA, 22 nt, Salmonella enterica enterica serovar Typhi Ty2
cggagcuaaaccgucauuuacc

SEQ ID NO: 3689245 - RNA, 15 nt, Salmonella enterica enterica serovar Typhi Ty2
cggagcuaauaugaa

SEQ ID NO: 3689246 - RNA, 15 nt, Salmonella enterica enterica serovar Typhi Ty2
cggaggagugcgcca

SEQ ID NO: 3689247 - RNA, 21 nt, Salmonella enterica enterica serovar Typhi Ty2
cggaggccagauucaccacca

SEQ ID NO: 3689248 - RNA, 18 nt, Salmonella enterica enterica serovar Typhi Ty2
cggaguagacccacauau

SEQ ID NO: 3689249 - RNA, 22 nt, Salmonella enterica enterica serovar Typhi Ty2
cggagucgacggcguaucaauc

SEQ ID NO: 3689250 - RNA, 23 nt, Salmonella enterica enterica serovar Typhi Ty2
cggagugcgcggcgaaaaagccg

SEQ ID NO: 3689251 - RNA, 22 nt, Salmonella enterica enterica serovar Typhi Ty2
cggaguggccgcaaaugauaau

SEQ ID NO: 3689252 - RNA, 20 nt, Salmonella enterica enterica serovar Typhi Ty2
cggauaaacgcugcgcaaca

SEQ ID NO: 3689253 - RNA, 13 nt, Salmonella enterica enterica serovar Typhi Ty2
cggauaaccgacg

SEQ ID NO: 3689254 - RNA, 15 nt, Salmonella enterica enterica serovar Typhi Ty2
cggauaaccgacgcc

SEQ ID NO: 3689255 - RNA, 13 nt, Salmonella enterica enterica serovar Typhi Ty2
cggauaacgcgcu

SEQ ID NO: 3689256 - RNA, 16 nt, Salmonella enterica enterica serovar Typhi Ty2
cggauaacgcgcuggc

SEQ ID NO: 3689257 - RNA, 19 nt, Salmonella enterica enterica serovar Typhi Ty2
cggauaacgcgcuggcgga

SEQ ID NO: 3689258 - RNA, 15 nt, Salmonella enterica enterica serovar Typhi Ty2
cggauaagcaacgcg

SEQ ID NO: 3689259 - RNA, 19 nt, Salmonella enterica enterica serovar Typhi Ty2
cggauaagcauuagcgcca

SEQ ID NO: 3689260 - RNA, 17 nt, Salmonella enterica enterica serovar Typhi Ty2
cggauaagcgcagcgcc

SEQ ID NO: 3689261 - RNA, 19 nt, Salmonella enterica enterica serovar Typhi Ty2
cggauaagcgcagcgccau

SEQ ID NO: 3689262 - RNA, 16 nt, Salmonella enterica enterica serovar Typhi Ty2
cggauaagcggcagcg

SEQ ID NO: 3689263 - RNA, 19 nt, Salmonella enterica enterica serovar Typhi Ty2
cggauaagcggcagcgcca

SEQ ID NO: 3689264 - RNA, 20 nt, Salmonella enterica enterica serovar Typhi Ty2
cggauaagcggcagcgccau

SEQ ID NO: 3689265 - RNA, 20 nt, Salmonella enterica enterica serovar Typhi Ty2
cggauaaggcgcagccgcca

SEQ ID NO: 3689266 - RNA, 22 nt, Salmonella enterica enterica serovar Typhi Ty2
cggauaaggcgcagccgccauc

SEQ ID NO: 3689267 - RNA, 19 nt, Salmonella enterica enterica serovar Typhi Ty2
cggauaaggcgcuugcgcc

SEQ ID NO: 3689268 - RNA, 20 nt, Salmonella enterica enterica serovar Typhi Ty2
cggauaaggcguuuacgccg

SEQ ID NO: 3689269 - RNA, 14 nt, Salmonella enterica enterica serovar Typhi Ty2
cggauaaguaaguu

SEQ ID NO: 3689270 - RNA, 21 nt, Salmonella enterica enterica serovar Typhi Ty2
cggauaauccgccacuuccug

SEQ ID NO: 3689271 - RNA, 22 nt, Salmonella enterica enterica serovar Typhi Ty2
cggauaccggcgcagcaucugc

SEQ ID NO: 3689272 - RNA, 18 nt, Salmonella enterica enterica serovar Typhi Ty2
cggauacugcuauuagcg

SEQ ID NO: 3689273 - RNA, 14 nt, Salmonella enterica enterica serovar Typhi Ty2
cggauagcucgcug

SEQ ID NO: 3689274 - RNA, 21 nt, Salmonella enterica enterica serovar Typhi Ty2
cggauagcucgcuguagcgcc

SEQ ID NO: 3689275 - RNA, 14 nt, Salmonella enterica enterica serovar Typhi Ty2
cggauaucgcuauc

SEQ ID NO: 3689276 - RNA, 21 nt, Salmonella enterica enterica serovar Typhi Ty2
cggcacauugucagcugaaca

SEQ ID NO: 3689277 - RNA, 15 nt, Salmonella enterica enterica serovar Typhi Ty2
cggcaccacauuaaa

SEQ ID NO: 3689278 - RNA, 11 nt, Salmonella enterica enterica serovar Typhi Ty2
cggcaccagca

SEQ ID NO: 3689279 - RNA, 15 nt, Salmonella enterica enterica serovar Typhi Ty2
cggcaccagcaauga

SEQ ID NO: 3689280 - RNA, 16 nt, Salmonella enterica enterica serovar Typhi Ty2
cggcaccagcgaugcg

SEQ ID NO: 3689281 - RNA, 21 nt, Salmonella enterica enterica serovar Typhi Ty2
cggcaccagcgaugcgcgcgc

SEQ ID NO: 3689282 - RNA, 20 nt, Salmonella enterica enterica serovar Typhi Ty2
cggcaccauguggcgcggcc

SEQ ID NO: 3689283 - RNA, 23 nt, Salmonella enterica enterica serovar Typhi Ty2
cggcaccggaaccggcaucggga

SEQ ID NO: 3689284 - RNA, 14 nt, Salmonella enterica enterica serovar Typhi Ty2
cggcaccggacauc

SEQ ID NO: 3689285 - RNA, 15 nt, Salmonella enterica enterica serovar Typhi Ty2
cggcacgccagcgcc

SEQ ID NO: 3689286 - RNA, 20 nt, Salmonella enterica enterica serovar Typhi Ty2
cggcacgccaucgccugaug

SEQ ID NO: 3689287 - RNA, 12 nt, Salmonella enterica enterica serovar Typhi Ty2
cggcacgccgaa

SEQ ID NO: 3689288 - RNA, 20 nt, Salmonella enterica enterica serovar Typhi Ty2
cggcacgucgucccaggcca

SEQ ID NO: 3689289 - RNA, 21 nt, Salmonella enterica enterica serovar Typhi Ty2
cggcacgucgucccaggccag

SEQ ID NO: 3689290 - RNA, 16 nt, Salmonella enterica enterica serovar Typhi Ty2
cggcacguuuuccagg

SEQ ID NO: 3689291 - RNA, 12 nt, Salmonella enterica enterica serovar Typhi Ty2
cggcacuacagc

SEQ ID NO: 3689292 - RNA, 21 nt, Salmonella enterica enterica serovar Typhi Ty2
cggcacucaccucuuccgcca

SEQ ID NO: 3689293 - RNA, 23 nt, Salmonella enterica enterica serovar Typhi Ty2
cggcacugacucuuccgggcgcg

SEQ ID NO: 3689294 - RNA, 18 nt, Salmonella enterica enterica serovar Typhi Ty2
cggcacugcuuccugccg

SEQ ID NO: 3689295 - RNA, 15 nt, Salmonella enterica enterica serovar Typhi Ty2
cggcagaaagcagca

SEQ ID NO: 3689296 - RNA, 11 nt, Salmonella enterica enterica serovar Typhi Ty2
cggcagaccgg

SEQ ID NO: 3689297 - RNA, 15 nt, Salmonella enterica enterica serovar Typhi Ty2
cggcagacggcuggg

SEQ ID NO: 3689298 - RNA, 13 nt, Salmonella enterica enterica serovar Typhi Ty2
cggcagccacgcc

SEQ ID NO: 3689299 - RNA, 14 nt, Salmonella enterica enterica serovar Typhi Ty2
cggcagccagcgua

SEQ ID NO: 3689300 - RNA, 15 nt, Salmonella enterica enterica serovar Typhi Ty2
cggcagccagcguau

SEQ ID NO: 3689301 - RNA, 16 nt, Salmonella enterica enterica serovar Typhi Ty2
cggcagccgccaccac

SEQ ID NO: 3689302 - RNA, 17 nt, Salmonella enterica enterica serovar Typhi Ty2
cggcagccgggccgcaa

SEQ ID NO: 3689303 - RNA, 21 nt, Salmonella enterica enterica serovar Typhi Ty2
cggcagccugccgcaucugac

SEQ ID NO: 3689304 - RNA, 13 nt, Salmonella enterica enterica serovar Typhi Ty2
cggcagcgcgcac

SEQ ID NO: 3689305 - RNA, 17 nt, Salmonella enterica enterica serovar Typhi Ty2
cggcagcgcgccgcccu

SEQ ID NO: 3689306 - RNA, 21 nt, Salmonella enterica enterica serovar Typhi Ty2
cggcagcguauacgccggaug

SEQ ID NO: 3689307 - RNA, 23 nt, Salmonella enterica enterica serovar Typhi Ty2
cggcagcucugccuguagcagcg

SEQ ID NO: 3689308 - RNA, 12 nt, Salmonella enterica enterica serovar Typhi Ty2
cggcagcuucca

SEQ ID NO: 3689309 - RNA, 23 nt, Salmonella enterica enterica serovar Typhi Ty2
cggcaggacaaucauaauaaacu

SEQ ID NO: 3689310 - RNA, 15 nt, Salmonella enterica enterica serovar Typhi Ty2
cggcaggcagcgcca

SEQ ID NO: 3689311 - RNA, 17 nt, Salmonella enterica enterica serovar Typhi Ty2
cggcaggcagcgccagc

SEQ ID NO: 3689312 - RNA, 12 nt, Salmonella enterica enterica serovar Typhi Ty2
cggcaggcauuu

SEQ ID NO: 3689313 - RNA, 20 nt, Salmonella enterica enterica serovar Typhi Ty2
cggcaggccggagcugauac

SEQ ID NO: 3689314 - RNA, 11 nt, Salmonella enterica enterica serovar Typhi Ty2
cggcaggcugg

SEQ ID NO: 3689315 - RNA, 17 nt, Salmonella enterica enterica serovar Typhi Ty2
cggcagggauucgcuca

SEQ ID NO: 3689316 - RNA, 23 nt, Salmonella enterica enterica serovar Typhi Ty2
cggcagguagucauauucacggc

SEQ ID NO: 3689317 - RNA, 21 nt, Salmonella enterica enterica serovar Typhi Ty2
cggcaguaaagaucuggccgu

SEQ ID NO: 3689318 - RNA, 12 nt, Salmonella enterica enterica serovar Typhi Ty2
cggcagucgcua

SEQ ID NO: 3689319 - RNA, 22 nt, Salmonella enterica enterica serovar Typhi Ty2
cggcaguggcauguucccaugu

SEQ ID NO: 3689320 - RNA, 20 nt, Salmonella enterica enterica serovar Typhi Ty2
cggcaguguuucccaacaau

SEQ ID NO: 3689321 - RNA, 23 nt, Salmonella enterica enterica serovar Typhi Ty2
cggcaguucaggcucgcaaauaa

SEQ ID NO: 3689322 - RNA, 17 nt, Salmonella enterica enterica serovar Typhi Ty2
cggcaguugcuggcgcu

SEQ ID NO: 3689323 - RNA, 16 nt, Salmonella enterica enterica serovar Typhi Ty2
cggcauaaacacagca

SEQ ID NO: 3689324 - RNA, 19 nt, Salmonella enterica enterica serovar Typhi Ty2
cggcauaagccaguccugc

SEQ ID NO: 3689325 - RNA, 21 nt, Salmonella enterica enterica serovar Typhi Ty2
cggcauacaccgccagcgucu

SEQ ID NO: 3689326 - RNA, 12 nt, Salmonella enterica enterica serovar Typhi Ty2
cggcauacagcg

SEQ ID NO: 3689327 - RNA, 23 nt, Salmonella enterica enterica serovar Typhi Ty2
cggcauacaggccgccgggucag

SEQ ID NO: 3689328 - RNA, 15 nt, Salmonella enterica enterica serovar Typhi Ty2
cggcauacgccgggc

SEQ ID NO: 3689329 - RNA, 19 nt, Salmonella enterica enterica serovar Typhi Ty2
cggcauacugucgcgcggc

SEQ ID NO: 3689330 - RNA, 16 nt, Salmonella enterica enterica serovar Typhi Ty2
cggcauaugcaggucg

SEQ ID NO: 3689331 - RNA, 17 nt, Salmonella enterica enterica serovar Typhi Ty2
cggcauaugcaggucgc

SEQ ID NO: 3689332 - RNA, 19 nt, Salmonella enterica enterica serovar Typhi Ty2
cggcauaugcaggucgcgc

SEQ ID NO: 3689333 - RNA, 20 nt, Salmonella enterica enterica serovar Typhi Ty2
cggcauauucaggagcaugg

SEQ ID NO: 3689334 - RNA, 18 nt, Salmonella enterica enterica serovar Typhi Ty2
cggcauauucccugacug

SEQ ID NO: 3689335 - RNA, 11 nt, Salmonella enterica enterica serovar Typhi Ty2
cggcaucaagc

SEQ ID NO: 3689336 - RNA, 19 nt, Salmonella enterica enterica serovar Typhi Ty2
cggcaucaagcccauguuc

SEQ ID NO: 3689337 - RNA, 11 nt, Salmonella enterica enterica serovar Typhi Ty2
cggcaucacgc

SEQ ID NO: 3689338 - RNA, 13 nt, Salmonella enterica enterica serovar Typhi Ty2
cggcaucacgccg

SEQ ID NO: 3689339 - RNA, 14 nt, Salmonella enterica enterica serovar Typhi Ty2
cggcaucagauggc

SEQ ID NO: 3689340 - RNA, 18 nt, Salmonella enterica enterica serovar Typhi Ty2
cggcaucauaaaucgaca

SEQ ID NO: 3689341 - RNA, 14 nt, Salmonella enterica enterica serovar Typhi Ty2
cggcaucgccgccc

SEQ ID NO: 3689342 - RNA, 20 nt, Salmonella enterica enterica serovar Typhi Ty2
cggcaucgggaacggcauac

SEQ ID NO: 3689343 - RNA, 17 nt, Salmonella enterica enterica serovar Typhi Ty2
cggcaucucaaggucug

SEQ ID NO: 3689344 - RNA, 14 nt, Salmonella enterica enterica serovar Typhi Ty2
cggcaucucaucuu

SEQ ID NO: 3689345 - RNA, 16 nt, Salmonella enterica enterica serovar Typhi Ty2
cggcaucucgccauaa

SEQ ID NO: 3689346 - RNA, 19 nt, Salmonella enterica enterica serovar Typhi Ty2
cggcaucuuuaaccgccug

SEQ ID NO: 3689347 - RNA, 19 nt, Salmonella enterica enterica serovar Typhi Ty2
cggcaugaauugccguggu

SEQ ID NO: 3689348 - RNA, 20 nt, Salmonella enterica enterica serovar Typhi Ty2
cggcaugauggcgaacagcc

SEQ ID NO: 3689349 - RNA, 18 nt, Salmonella enterica enterica serovar Typhi Ty2
cggcauguccggcgacuc

SEQ ID NO: 3689350 - RNA, 23 nt, Salmonella enterica enterica serovar Typhi Ty2
cggcauguccggcgacuccagaa

SEQ ID NO: 3689351 - RNA, 23 nt, Salmonella enterica enterica serovar Typhi Ty2
cggcauguucacaucgcucagaa

SEQ ID NO: 3689352 - RNA, 17 nt, Salmonella enterica enterica serovar Typhi Ty2
cggcauuaauacaggcc

SEQ ID NO: 3689353 - RNA, 15 nt, Salmonella enterica enterica serovar Typhi Ty2
cggcauuaauuucuu

SEQ ID NO: 3689354 - RNA, 15 nt, Salmonella enterica enterica serovar Typhi Ty2
cggcauuauaagcgc

SEQ ID NO: 3689355 - RNA, 19 nt, Salmonella enterica enterica serovar Typhi Ty2
cggcauuaugcaggcgucg

SEQ ID NO: 3689356 - RNA, 21 nt, Salmonella enterica enterica serovar Typhi Ty2
cggcauuucugucugacgacc

SEQ ID NO: 3689357 - RNA, 21 nt, Salmonella enterica enterica serovar Typhi Ty2
cggcauuuuucucaggacgcc

SEQ ID NO: 3689358 - RNA, 18 nt, Salmonella enterica enterica serovar Typhi Ty2
cggcugacgcccaucagc

SEQ ID NO: 3689359 - RNA, 19 nt, Salmonella enterica enterica serovar Typhi Ty2
cggcugacgcccaucagca

SEQ ID NO: 3689360 - RNA, 20 nt, Salmonella enterica enterica serovar Typhi Ty2
cggcugaggcuuugagcguc

SEQ ID NO: 3689361 - RNA, 21 nt, Salmonella enterica enterica serovar Typhi Ty2
cggcugaggcuuugagcguca

SEQ ID NO: 3689362 - RNA, 17 nt, Salmonella enterica enterica serovar Typhi Ty2
cggcugcaccagcguua

SEQ ID NO: 3689363 - RNA, 13 nt, Salmonella enterica enterica serovar Typhi Ty2
cggcugcauauac

SEQ ID NO: 3689364 - RNA, 18 nt, Salmonella enterica enterica serovar Typhi Ty2
cggcugccauuaucacca

SEQ ID NO: 3689365 - RNA, 19 nt, Salmonella enterica enterica serovar Typhi Ty2
cggcugccauuaucaccau

SEQ ID NO: 3689366 - RNA, 13 nt, Salmonella enterica enterica serovar Typhi Ty2
cggcugccugccg

SEQ ID NO: 3689367 - RNA, 15 nt, Salmonella enterica enterica serovar Typhi Ty2
cggcugcgcugccag

SEQ ID NO: 3689368 - RNA, 15 nt, Salmonella enterica enterica serovar Typhi Ty2
cggcugcucccccag

SEQ ID NO: 3689369 - RNA, 19 nt, Salmonella enterica enterica serovar Typhi Ty2
cggcuggacgucaugccgc

SEQ ID NO: 3689370 - RNA, 22 nt, Salmonella enterica enterica serovar Typhi Ty2
cggcuggacgucaugccgccac

SEQ ID NO: 3689371 - RNA, 13 nt, Salmonella enterica enterica serovar Typhi Ty2
cggcuggcuauag

SEQ ID NO: 3689372 - RNA, 20 nt, Salmonella enterica enterica serovar Typhi Ty2
cggcugggcgaggccacgca

SEQ ID NO: 3689373 - RNA, 17 nt, Salmonella enterica enterica serovar Typhi Ty2
cggcuggguuuccggau

SEQ ID NO: 3689374 - RNA, 14 nt, Salmonella enterica enterica serovar Typhi Ty2
cggcugguaagaga

SEQ ID NO: 3689375 - RNA, 20 nt, Salmonella enterica enterica serovar Typhi Ty2
cggcugguuauacugguggu

SEQ ID NO: 3689376 - RNA, 23 nt, Salmonella enterica enterica serovar Typhi Ty2
cggcuguaccuuaaccgggcgcu

SEQ ID NO: 3689377 - RNA, 13 nt, Salmonella enterica enterica serovar Typhi Ty2
cggcuguagccag

SEQ ID NO: 3689378 - RNA, 17 nt, Salmonella enterica enterica serovar Typhi Ty2
cggcuguagccagccug

SEQ ID NO: 3689379 - RNA, 13 nt, Salmonella enterica enterica serovar Typhi Ty2
cggcugucaucaa

SEQ ID NO: 3689380 - RNA, 13 nt, Salmonella enterica enterica serovar Typhi Ty2
cggcuguucacgu

SEQ ID NO: 3689381 - RNA, 15 nt, Salmonella enterica enterica serovar Typhi Ty2
cggcuguugguuuau

SEQ ID NO: 3689382 - RNA, 21 nt, Salmonella enterica enterica serovar Typhi Ty2
cggcuguugguuuaucgccga

SEQ ID NO: 3689383 - RNA, 18 nt, Salmonella enterica enterica serovar Typhi Ty2
cggcuuaaauggcgcugu

SEQ ID NO: 3689384 - RNA, 23 nt, Salmonella enterica enterica serovar Typhi Ty2
cggcuuaaccucgcuacuggcaa

SEQ ID NO: 3689385 - RNA, 19 nt, Salmonella enterica enterica serovar Typhi Ty2
cggcuuaaugcccggcccg

SEQ ID NO: 3689386 - RNA, 22 nt, Salmonella enterica enterica serovar Typhi Ty2
cggcuuacaacauuguuauguu

SEQ ID NO: 3689387 - RNA, 20 nt, Salmonella enterica enterica serovar Typhi Ty2
cggcuuacugcuucgcgccu

SEQ ID NO: 3689388 - RNA, 23 nt, Salmonella enterica enterica serovar Typhi Ty2
cggcuuacugcuucgcgccuucu

SEQ ID NO: 3689389 - RNA, 21 nt, Salmonella enterica enterica serovar Typhi Ty2
cggcuuauccggccugcacga

SEQ ID NO: 3689390 - RNA, 22 nt, Salmonella enterica enterica serovar Typhi Ty2
cggcuuaucguuaaggccugcg

SEQ ID NO: 3689391 - RNA, 18 nt, Salmonella enterica enterica serovar Typhi Ty2
cggcuucacgccauccag

SEQ ID NO: 3689392 - RNA, 15 nt, Salmonella enterica enterica serovar Typhi Ty2
cggcuuccucgcagu

SEQ ID NO: 3689393 - RNA, 15 nt, Salmonella enterica enterica serovar Typhi Ty2
cggcuucuccaccau

SEQ ID NO: 3689394 - RNA, 16 nt, Salmonella enterica enterica serovar Typhi Ty2
cggcuugugagcgucg

SEQ ID NO: 3689395 - RNA, 15 nt, Salmonella enterica enterica serovar Typhi Ty2
cggcuuguuaugcgg

SEQ ID NO: 3689396 - RNA, 17 nt, Salmonella enterica enterica serovar Typhi Ty2
cggcuuuaaugccgccg

SEQ ID NO: 3689397 - RNA, 16 nt, Salmonella enterica enterica serovar Typhi Ty2
cggcuuuccgcaccgc

SEQ ID NO: 3689398 - RNA, 21 nt, Salmonella enterica enterica serovar Typhi Ty2
cggcuuucuguuccgaaauaa

SEQ ID NO: 3689399 - RNA, 22 nt, Salmonella enterica enterica serovar Typhi Ty2
cggcuuucuuucuccagcguac

SEQ ID NO: 3689400 - RNA, 19 nt, Salmonella enterica enterica serovar Typhi Ty2
cggcuuugcgccggcaguc

SEQ ID NO: 3689401 - RNA, 16 nt, Salmonella enterica enterica serovar Typhi Ty2
cggcuuuuaucgacag

SEQ ID NO: 3689402 - RNA, 17 nt, Salmonella enterica enterica serovar Typhi Ty2
cggcuuuuugccgggcg

SEQ ID NO: 3689403 - RNA, 15 nt, Salmonella enterica enterica serovar Typhi Ty2
cggcuuuuuucucca

SEQ ID NO: 3689404 - RNA, 22 nt, Salmonella enterica enterica serovar Typhi Ty2
cgggaaaacggccagugaaaua

SEQ ID NO: 3689405 - RNA, 17 nt, Salmonella enterica enterica serovar Typhi Ty2
cgggaaaagcguccggg

SEQ ID NO: 3689406 - RNA, 19 nt, Salmonella enterica enterica serovar Typhi Ty2
cgggaaacuguuugaacga

SEQ ID NO: 3689407 - RNA, 18 nt, Salmonella enterica enterica serovar Typhi Ty2
cgggaaagggcggcagcg

SEQ ID NO: 3689408 - RNA, 15 nt, Salmonella enterica enterica serovar Typhi Ty2
cgggaaauagagcag

SEQ ID NO: 3689409 - RNA, 15 nt, Salmonella enterica enterica serovar Typhi Ty2
cgggaaaucacguuu

SEQ ID NO: 3689410 - RNA, 15 nt, Salmonella enterica enterica serovar Typhi Ty2
cgggaacagauaaau

SEQ ID NO: 3689411 - RNA, 17 nt, Salmonella enterica enterica serovar Typhi Ty2
cgggacguuucgauaac

SEQ ID NO: 3689412 - RNA, 22 nt, Salmonella enterica enterica serovar Typhi Ty2
cgggacuuuaaacgucaugcug

SEQ ID NO: 3689413 - RNA, 17 nt, Salmonella enterica enterica serovar Typhi Ty2
cgggagaaaacgcggcc

SEQ ID NO: 3689414 - RNA, 21 nt, Salmonella enterica enterica serovar Typhi Ty2
cgggagauuaggguucacggc

SEQ ID NO: 3689415 - RNA, 23 nt, Salmonella enterica enterica serovar Typhi Ty2
cgggagcucuaccagaccacgca

SEQ ID NO: 3689416 - RNA, 15 nt, Salmonella enterica enterica serovar Typhi Ty2
cgggauaaccaccgc

SEQ ID NO: 3689417 - RNA, 17 nt, Salmonella enterica enterica serovar Typhi Ty2
cgggauaauauugccau

SEQ ID NO: 3689418 - RNA, 14 nt, Salmonella enterica enterica serovar Typhi Ty2
cgggauauaaaauu

SEQ ID NO: 3689419 - RNA, 14 nt, Salmonella enterica enterica serovar Typhi Ty2
cgggauauccucuu

SEQ ID NO: 3689420 - RNA, 18 nt, Salmonella enterica enterica serovar Typhi Ty2
cgggauccccugcuccug

SEQ ID NO: 3689421 - RNA, 16 nt, Salmonella enterica enterica serovar Typhi Ty2
cgggauccugcaaaau

SEQ ID NO: 3689422 - RNA, 15 nt, Salmonella enterica enterica serovar Typhi Ty2
cgggaucgaaccgcc

SEQ ID NO: 3689423 - RNA, 16 nt, Salmonella enterica enterica serovar Typhi Ty2
cgggaucgaaccgccg

SEQ ID NO: 3689424 - RNA, 23 nt, Salmonella enterica enterica serovar Typhi Ty2
cgggaucgaaccgccgacccccu

SEQ ID NO: 3689425 - RNA, 17 nt, Salmonella enterica enterica serovar Typhi Ty2
cgggaucgcagaaauau

SEQ ID NO: 3689426 - RNA, 13 nt, Salmonella enterica enterica serovar Typhi Ty2
cgggaucgccaga

SEQ ID NO: 3689427 - RNA, 22 nt, Salmonella enterica enterica serovar Typhi Ty2
cgggaucgccagaucgaacagc

SEQ ID NO: 3689428 - RNA, 14 nt, Salmonella enterica enterica serovar Typhi Ty2
cgggaucuccagaa

SEQ ID NO: 3689429 - RNA, 22 nt, Salmonella enterica enterica serovar Typhi Ty2
cgggaucugcgccauugagguc

SEQ ID NO: 3689430 - RNA, 15 nt, Salmonella enterica enterica serovar Typhi Ty2
cgggaugguuaaauu

SEQ ID NO: 3689431 - RNA, 18 nt, Salmonella enterica enterica serovar Typhi Ty2
cgggauuuuaagcaucca

SEQ ID NO: 3689432 - RNA, 16 nt, Salmonella enterica enterica serovar Typhi Ty2
cgggcaaaagggccau

SEQ ID NO: 3689433 - RNA, 14 nt, Salmonella enterica enterica serovar Typhi Ty2
cgggcaacacacgc

SEQ ID NO: 3689434 - RNA, 17 nt, Salmonella enterica enterica serovar Typhi Ty2
cgggcaagcgaagcgcc

SEQ ID NO: 3689435 - RNA, 17 nt, Salmonella enterica enterica serovar Typhi Ty2
cgggcagacaucgccgu

SEQ ID NO: 3689436 - RNA, 23 nt, Salmonella enterica enterica serovar Typhi Ty2
cgggcagacauucgcgcacggcg

SEQ ID NO: 3689437 - RNA, 21 nt, Salmonella enterica enterica serovar Typhi Ty2
cgggcagauggucgcauggcu

SEQ ID NO: 3689438 - RNA, 13 nt, Salmonella enterica enterica serovar Typhi Ty2
cgggcagcagcag

SEQ ID NO: 3689439 - RNA, 15 nt, Salmonella enterica enterica serovar Typhi Ty2
cgggcagcagcaggc

SEQ ID NO: 3689440 - RNA, 22 nt, Salmonella enterica enterica serovar Typhi Ty2
cggguuucugaauagaaagucg

SEQ ID NO: 3689441 - RNA, 15 nt, Salmonella enterica enterica serovar Typhi Ty2
cggguuuuccugaau

SEQ ID NO: 3689442 - RNA, 16 nt, Salmonella enterica enterica serovar Typhi Ty2
cgguaaaccaggccag

SEQ ID NO: 3689443 - RNA, 16 nt, Salmonella enterica enterica serovar Typhi Ty2
cgguaaauacgcggca

SEQ ID NO: 3689444 - RNA, 22 nt, Salmonella enterica enterica serovar Typhi Ty2
cgguaaauuucuugaucaaucu

SEQ ID NO: 3689445 - RNA, 19 nt, Salmonella enterica enterica serovar Typhi Ty2
cgguaacaucaaguacagc

SEQ ID NO: 3689446 - RNA, 18 nt, Salmonella enterica enterica serovar Typhi Ty2
cgguaacgauacccacca

SEQ ID NO: 3689447 - RNA, 20 nt, Salmonella enterica enterica serovar Typhi Ty2
cgguaacgauacccaccagc

SEQ ID NO: 3689448 - RNA, 21 nt, Salmonella enterica enterica serovar Typhi Ty2
cgguaacguaacuugauuccu

SEQ ID NO: 3689449 - RNA, 23 nt, Salmonella enterica enterica serovar Typhi Ty2
cgguaagaaugcgcgucaggcca

SEQ ID NO: 3689450 - RNA, 15 nt, Salmonella enterica enterica serovar Typhi Ty2
cgguaagagccagac

SEQ ID NO: 3689451 - RNA, 16 nt, Salmonella enterica enterica serovar Typhi Ty2
cgguaagagccagacg

SEQ ID NO: 3689452 - RNA, 19 nt, Salmonella enterica enterica serovar Typhi Ty2
cgguaagagcguuacccag

SEQ ID NO: 3689453 - RNA, 14 nt, Salmonella enterica enterica serovar Typhi Ty2
cgguaagcacaacg

SEQ ID NO: 3689454 - RNA, 17 nt, Salmonella enterica enterica serovar Typhi Ty2
cgguaagcacaacgcau

SEQ ID NO: 3689455 - RNA, 15 nt, Salmonella enterica enterica serovar Typhi Ty2
cgguaagccaccaga

SEQ ID NO: 3689456 - RNA, 22 nt, Salmonella enterica enterica serovar Typhi Ty2
cgguaagcccauggcaggcagc

SEQ ID NO: 3689457 - RNA, 17 nt, Salmonella enterica enterica serovar Typhi Ty2
cgguaagcgcagcgcca

SEQ ID NO: 3689458 - RNA, 20 nt, Salmonella enterica enterica serovar Typhi Ty2
cgguaagcuguuccggcuuc

SEQ ID NO: 3689459 - RNA, 16 nt, Salmonella enterica enterica serovar Typhi Ty2
cgguaagucugauaac

SEQ ID NO: 3689460 - RNA, 23 nt, Salmonella enterica enterica serovar Typhi Ty2
cgguaauauauuucacuucauca

SEQ ID NO: 3689461 - RNA, 22 nt, Salmonella enterica enterica serovar Typhi Ty2
cgguaaucaccagaucggcauc

SEQ ID NO: 3689462 - RNA, 14 nt, Salmonella enterica enterica serovar Typhi Ty2
cgguaaucacugcc

SEQ ID NO: 3689463 - RNA, 18 nt, Salmonella enterica enterica serovar Typhi Ty2
cgguaaucacugccgcca

SEQ ID NO: 3689464 - RNA, 16 nt, Salmonella enterica enterica serovar Typhi Ty2
cgguaaucccuucacg

SEQ ID NO: 3689465 - RNA, 19 nt, Salmonella enterica enterica serovar Typhi Ty2
cgguacaaaccccacccac

SEQ ID NO: 3689466 - RNA, 16 nt, Salmonella enterica enterica serovar Typhi Ty2
cgguacacgcagucca

SEQ ID NO: 3689467 - RNA, 19 nt, Salmonella enterica enterica serovar Typhi Ty2
cgguaccaaagucaucaau

SEQ ID NO: 3689468 - RNA, 23 nt, Salmonella enterica enterica serovar Typhi Ty2
cgguacccgccgcuggcuguucc

SEQ ID NO: 3689469 - RNA, 20 nt, Salmonella enterica enterica serovar Typhi Ty2
cgguaccgcguuuugcugau

SEQ ID NO: 3689470 - RNA, 13 nt, Salmonella enterica enterica serovar Typhi Ty2
cgguaccggcauu

SEQ ID NO: 3689471 - RNA, 17 nt, Salmonella enterica enterica serovar Typhi Ty2
cgguacgcagcaggcag

SEQ ID NO: 3689472 - RNA, 17 nt, Salmonella enterica enterica serovar Typhi Ty2
cgguacgcaucaccagg

SEQ ID NO: 3689473 - RNA, 18 nt, Salmonella enterica enterica serovar Typhi Ty2
cgguacgcgucugaauga

SEQ ID NO: 3689474 - RNA, 12 nt, Salmonella enterica enterica serovar Typhi Ty2
cgguacgcuggu

SEQ ID NO: 3689475 - RNA, 15 nt, Salmonella enterica enterica serovar Typhi Ty2
cgguacggcauggcg

SEQ ID NO: 3689476 - RNA, 14 nt, Salmonella enterica enterica serovar Typhi Ty2
cgguacugcuggcc

SEQ ID NO: 3689477 - RNA, 16 nt, Salmonella enterica enterica serovar Typhi Ty2
cgguacuggagaccgg

SEQ ID NO: 3689478 - RNA, 17 nt, Salmonella enterica enterica serovar Typhi Ty2
cgguacuggugcccgca

SEQ ID NO: 3689479 - RNA, 11 nt, Salmonella enterica enterica serovar Typhi Ty2
cgguacuucug

SEQ ID NO: 3689480 - RNA, 16 nt, Salmonella enterica enterica serovar Typhi Ty2
cgguagaggcgccgac

SEQ ID NO: 3689481 - RNA, 14 nt, Salmonella enterica enterica serovar Typhi Ty2
cgguagccacaccc

SEQ ID NO: 3689482 - RNA, 16 nt, Salmonella enterica enterica serovar Typhi Ty2
cgguagcuccagacag

SEQ ID NO: 3689483 - RNA, 17 nt, Salmonella enterica enterica serovar Typhi Ty2
cgguagcuuuuuaaaua

SEQ ID NO: 3689484 - RNA, 22 nt, Salmonella enterica enterica serovar Typhi Ty2
cgguaguccgccagcaccugau

SEQ ID NO: 3689485 - RNA, 18 nt, Salmonella enterica enterica serovar Typhi Ty2
cgguaguguuaucgccga

SEQ ID NO: 3689486 - RNA, 14 nt, Salmonella enterica enterica serovar Typhi Ty2
cgguauaacugccu

SEQ ID NO: 3689487 - RNA, 18 nt, Salmonella enterica enterica serovar Typhi Ty2
cgguaucacgcgugcgcg

SEQ ID NO: 3689488 - RNA, 15 nt, Salmonella enterica enterica serovar Typhi Ty2
cgguaugccuuccag

SEQ ID NO: 3689489 - RNA, 15 nt, Salmonella enterica enterica serovar Typhi Ty2
cgguauuauccgccg

SEQ ID NO: 3689490 - RNA, 14 nt, Salmonella enterica enterica serovar Typhi Ty2
cgguauuccguucc

SEQ ID NO: 3689491 - RNA, 20 nt, Salmonella enterica enterica serovar Typhi Ty2
cgguauuuuucaccucacuc

SEQ ID NO: 3689492 - RNA, 21 nt, Salmonella enterica enterica serovar Typhi Ty2
cggucaaaagcugcauccggg

SEQ ID NO: 3689493 - RNA, 20 nt, Salmonella enterica enterica serovar Typhi Ty2
cggucaacguuaacugcugc

SEQ ID NO: 3689494 - RNA, 20 nt, Salmonella enterica enterica serovar Typhi Ty2
cggucaacugaauuucaucc

SEQ ID NO: 3689495 - RNA, 22 nt, Salmonella enterica enterica serovar Typhi Ty2
cggucaauacaucacgcaacgg

SEQ ID NO: 3689496 - RNA, 13 nt, Salmonella enterica enterica serovar Typhi Ty2
cggucacaggcau

SEQ ID NO: 3689497 - RNA, 16 nt, Salmonella enterica enterica serovar Typhi Ty2
cggucacaggcauaca

SEQ ID NO: 3689498 - RNA, 23 nt, Salmonella enterica enterica serovar Typhi Ty2
cggucagggcuuacucccuggug

SEQ ID NO: 3689499 - RNA, 19 nt, Salmonella enterica enterica serovar Typhi Ty2
cggucagggugaaucccgc

SEQ ID NO: 3689500 - RNA, 22 nt, Salmonella enterica enterica serovar Typhi Ty2
cggucagggugaaucccgccau

SEQ ID NO: 3689501 - RNA, 23 nt, Salmonella enterica enterica serovar Typhi Ty2
cggucagggugaaucccgccauc

SEQ ID NO: 3689502 - RNA, 15 nt, Salmonella enterica enterica serovar Typhi Ty2
cggucagguagcaga

SEQ ID NO: 3689503 - RNA, 14 nt, Salmonella enterica enterica serovar Typhi Ty2
cggucaguacgccc

SEQ ID NO: 3689504 - RNA, 22 nt, Salmonella enterica enterica serovar Typhi Ty2
cggucaguguuuccauacauuu

SEQ ID NO: 3689505 - RNA, 18 nt, Salmonella enterica enterica serovar Typhi Ty2
cggucauaaccggccgau

SEQ ID NO: 3689506 - RNA, 18 nt, Salmonella enterica enterica serovar Typhi Ty2
cggucauacugaacaagc

SEQ ID NO: 3689507 - RNA, 17 nt, Salmonella enterica enterica serovar Typhi Ty2
cggucauggauaacaug

SEQ ID NO: 3689508 - RNA, 17 nt, Salmonella enterica enterica serovar Typhi Ty2
cggucauuaauccccgg

SEQ ID NO: 3689509 - RNA, 18 nt, Salmonella enterica enterica serovar Typhi Ty2
cggucauuaauccccggc

SEQ ID NO: 3689510 - RNA, 22 nt, Salmonella enterica enterica serovar Typhi Ty2
cggucauucauugucuuuuucu

SEQ ID NO: 3689511 - RNA, 21 nt, Salmonella enterica enterica serovar Typhi Ty2
cgguccguuuucgcccccagc

SEQ ID NO: 3689512 - RNA, 17 nt, Salmonella enterica enterica serovar Typhi Ty2
cggucgagcguaauucc

SEQ ID NO: 3689513 - RNA, 22 nt, Salmonella enterica enterica serovar Typhi Ty2
cggucgagcuuuugcugcgcca

SEQ ID NO: 3689514 - RNA, 21 nt, Salmonella enterica enterica serovar Typhi Ty2
cggucgccuuuuaacgcggua

SEQ ID NO: 3689515 - RNA, 17 nt, Salmonella enterica enterica serovar Typhi Ty2
cggucgcggagaucauc

SEQ ID NO: 3689516 - RNA, 21 nt, Salmonella enterica enterica serovar Typhi Ty2
cggucgggauauaugcaaaac

SEQ ID NO: 3689517 - RNA, 16 nt, Salmonella enterica enterica serovar Typhi Ty2
cggucgucaucggcga

SEQ ID NO: 3689518 - RNA, 21 nt, Salmonella enterica enterica serovar Typhi Ty2
cggucucuuaaugccagcggc

SEQ ID NO: 3689519 - RNA, 13 nt, Salmonella enterica enterica serovar Typhi Ty2
cggucugacggcc

SEQ ID NO: 3689520 - RNA, 16 nt, Salmonella enterica enterica serovar Typhi Ty2
cggucugcgcgccgca

SEQ ID NO: 3689521 - RNA, 22 nt, Salmonella enterica enterica serovar Typhi Ty2
cggucugcuucagccacuggcu

SEQ ID NO: 3689522 - RNA, 15 nt, Salmonella enterica enterica serovar Typhi Ty2
cguaaaccauuucuc

SEQ ID NO: 3689523 - RNA, 20 nt, Salmonella enterica enterica serovar Typhi Ty2
cguaaacgccauuccuuuaa

SEQ ID NO: 3689524 - RNA, 16 nt, Salmonella enterica enterica serovar Typhi Ty2
cguaaacggcagccgc

SEQ ID NO: 3689525 - RNA, 18 nt, Salmonella enterica enterica serovar Typhi Ty2
cguaaagcaucagacuac

SEQ ID NO: 3689526 - RNA, 14 nt, Salmonella enterica enterica serovar Typhi Ty2
cguaaagcauggcu

SEQ ID NO: 3689527 - RNA, 15 nt, Salmonella enterica enterica serovar Typhi Ty2
cguaaaguucccagc

SEQ ID NO: 3689528 - RNA, 21 nt, Salmonella enterica enterica serovar Typhi Ty2
cguaaauaccaccugccaaag

SEQ ID NO: 3689529 - RNA, 14 nt, Salmonella enterica enterica serovar Typhi Ty2
cguaaauacccagg

SEQ ID NO: 3689530 - RNA, 13 nt, Salmonella enterica enterica serovar Typhi Ty2
cguaaaucaggcc

SEQ ID NO: 3689531 - RNA, 23 nt, Salmonella enterica enterica serovar Typhi Ty2
cguaaaucgcgagccuucaacaa

SEQ ID NO: 3689532 - RNA, 14 nt, Salmonella enterica enterica serovar Typhi Ty2
cguaaccgcaaaug

SEQ ID NO: 3689533 - RNA, 16 nt, Salmonella enterica enterica serovar Typhi Ty2
cguaaccgcagcgccu

SEQ ID NO: 3689534 - RNA, 19 nt, Salmonella enterica enterica serovar Typhi Ty2
cguaacgccgucgacaaag

SEQ ID NO: 3689535 - RNA, 16 nt, Salmonella enterica enterica serovar Typhi Ty2
cguaacgcgcaucuuc

SEQ ID NO: 3689536 - RNA, 20 nt, Salmonella enterica enterica serovar Typhi Ty2
cguaacggcugacgcccauc

SEQ ID NO: 3689537 - RNA, 14 nt, Salmonella enterica enterica serovar Typhi Ty2
cguaacguaaccug

SEQ ID NO: 3689538 - RNA, 16 nt, Salmonella enterica enterica serovar Typhi Ty2
cguaacgucguaaauu

SEQ ID NO: 3689539 - RNA, 15 nt, Salmonella enterica enterica serovar Typhi Ty2
cguaacucggcagcg

SEQ ID NO: 3689540 - RNA, 19 nt, Salmonella enterica enterica serovar Typhi Ty2
cguaacuugauuccuggcu

SEQ ID NO: 3689541 - RNA, 14 nt, Salmonella enterica enterica serovar Typhi Ty2
cguaagaucccagg

SEQ ID NO: 3689542 - RNA, 22 nt, Salmonella enterica enterica serovar Typhi Ty2
cguaagcgcccguccaugagua

SEQ ID NO: 3689543 - RNA, 21 nt, Salmonella enterica enterica serovar Typhi Ty2
cguaagcggcggaccagcgug

SEQ ID NO: 3689544 - RNA, 17 nt, Salmonella enterica enterica serovar Typhi Ty2
cguaaguuaaaacgcca

SEQ ID NO: 3689545 - RNA, 17 nt, Salmonella enterica enterica serovar Typhi Ty2
cguaauaaaauuuccca

SEQ ID NO: 3689546 - RNA, 23 nt, Salmonella enterica enterica serovar Typhi Ty2
cguaauaugaauauccgccgccc

SEQ ID NO: 3689547 - RNA, 15 nt, Salmonella enterica enterica serovar Typhi Ty2
cguaaucccgccagc

SEQ ID NO: 3689548 - RNA, 22 nt, Salmonella enterica enterica serovar Typhi Ty2
cguaaucgcuuucauuacgcuu

SEQ ID NO: 3689549 - RNA, 19 nt, Salmonella enterica enterica serovar Typhi Ty2
cguaaucuaaaauuauuuu

SEQ ID NO: 3689550 - RNA, 22 nt, Salmonella enterica enterica serovar Typhi Ty2
cguaaugacuggcuuugcgcca

SEQ ID NO: 3689551 - RNA, 16 nt, Salmonella enterica enterica serovar Typhi Ty2
cguaaugagcgucgcc

SEQ ID NO: 3689552 - RNA, 19 nt, Salmonella enterica enterica serovar Typhi Ty2
cguaaugccgaccagcguc

SEQ ID NO: 3689553 - RNA, 17 nt, Salmonella enterica enterica serovar Typhi Ty2
cguaauggguaaaaaua

SEQ ID NO: 3689554 - RNA, 22 nt, Salmonella enterica enterica serovar Typhi Ty2
cguaauuaaccgcgccgcuggc

SEQ ID NO: 3689555 - RNA, 14 nt, Salmonella enterica enterica serovar Typhi Ty2
cguaauuauuacag

SEQ ID NO: 3689556 - RNA, 17 nt, Salmonella enterica enterica serovar Typhi Ty2
cguaauuccgcauugag

SEQ ID NO: 3689557 - RNA, 15 nt, Salmonella enterica enterica serovar Typhi Ty2
cguaauugcgccugg

SEQ ID NO: 3689558 - RNA, 20 nt, Salmonella enterica enterica serovar Typhi Ty2
cguaauuguugccccgcuuu

SEQ ID NO: 3689559 - RNA, 18 nt, Salmonella enterica enterica serovar Typhi Ty2
cguaauuugcgacauggc

SEQ ID NO: 3689560 - RNA, 23 nt, Salmonella enterica enterica serovar Typhi Ty2
cguaauuuuuccaguugcgcuac

SEQ ID NO: 3689561 - RNA, 21 nt, Salmonella enterica enterica serovar Typhi Ty2
cguacaaaggggccacaggcg

SEQ ID NO: 3689562 - RNA, 12 nt, Salmonella enterica enterica serovar Typhi Ty2
cguacagcgcca

SEQ ID NO: 3689563 - RNA, 13 nt, Salmonella enterica enterica serovar Typhi Ty2
cguacagcgccau

SEQ ID NO: 3689564 - RNA, 19 nt, Salmonella enterica enterica serovar Typhi Ty2
cguacaggcggaaaucaac

SEQ ID NO: 3689565 - RNA, 23 nt, Salmonella enterica enterica serovar Typhi Ty2
cguaccaauacccagcgccaacg

SEQ ID NO: 3689566 - RNA, 22 nt, Salmonella enterica enterica serovar Typhi Ty2
cguaccacgccgcacacagcag

SEQ ID NO: 3689567 - RNA, 13 nt, Salmonella enterica enterica serovar Typhi Ty2
cguaccagcgccc

SEQ ID NO: 3689568 - RNA, 17 nt, Salmonella enterica enterica serovar Typhi Ty2
cguaccaggcagcgcgc

SEQ ID NO: 3689569 - RNA, 16 nt, Salmonella enterica enterica serovar Typhi Ty2
cguaccauauucaacu

SEQ ID NO: 3689570 - RNA, 19 nt, Salmonella enterica enterica serovar Typhi Ty2
cguaccaucgcgcaagacc

SEQ ID NO: 3689571 - RNA, 15 nt, Salmonella enterica enterica serovar Typhi Ty2
cguaccuccagcgac

SEQ ID NO: 3689572 - RNA, 16 nt, Salmonella enterica enterica serovar Typhi Ty2
cguaccugcgcgcagg

SEQ ID NO: 3689573 - RNA, 19 nt, Salmonella enterica enterica serovar Typhi Ty2
cguaccugucguacgccua

SEQ ID NO: 3689574 - RNA, 21 nt, Salmonella enterica enterica serovar Typhi Ty2
cguacgcagaucguauccagc

SEQ ID NO: 3689575 - RNA, 17 nt, Salmonella enterica enterica serovar Typhi Ty2
cguacgccuaaaugaac

SEQ ID NO: 3689576 - RNA, 15 nt, Salmonella enterica enterica serovar Typhi Ty2
cguacggcugccuuu

SEQ ID NO: 3689577 - RNA, 22 nt, Salmonella enterica enterica serovar Typhi Ty2
cguacuaaagagcgccugaccg

SEQ ID NO: 3689578 - RNA, 18 nt, Salmonella enterica enterica serovar Typhi Ty2
cguacuacguguacgcuc

SEQ ID NO: 3689579 - RNA, 15 nt, Salmonella enterica enterica serovar Typhi Ty2
cguacucagcagacc

SEQ ID NO: 3689580 - RNA, 16 nt, Salmonella enterica enterica serovar Typhi Ty2
cguacucuaggcgcug

SEQ ID NO: 3689581 - RNA, 21 nt, Salmonella enterica enterica serovar Typhi Ty2
cguacucuaggcgcugcuggc

SEQ ID NO: 3689582 - RNA, 21 nt, Salmonella enterica enterica serovar Typhi Ty2
cguacugaaauaacucuggau

SEQ ID NO: 3689583 - RNA, 15 nt, Salmonella enterica enterica serovar Typhi Ty2
cguagaacgggccga

SEQ ID NO: 3689584 - RNA, 19 nt, Salmonella enterica enterica serovar Typhi Ty2
cguagaucucuaucggcaa

SEQ ID NO: 3689585 - RNA, 18 nt, Salmonella enterica enterica serovar Typhi Ty2
cguagauuuucaucauau

SEQ ID NO: 3689586 - RNA, 12 nt, Salmonella enterica enterica serovar Typhi Ty2
cguagcagcgcg

SEQ ID NO: 3689587 - RNA, 24 nt, Salmonella enterica enterica serovar Typhi Ty2
cguagcaucucuucgacaucuuca

SEQ ID NO: 3689588 - RNA, 19 nt, Salmonella enterica enterica serovar Typhi Ty2
cguagcccagcgccgcauc

SEQ ID NO: 3689589 - RNA, 21 nt, Salmonella enterica enterica serovar Typhi Ty2
cguagccgcuuacucagccag

SEQ ID NO: 3689590 - RNA, 18 nt, Salmonella enterica enterica serovar Typhi Ty2
cguagcgagaaggcuuug

SEQ ID NO: 3689591 - RNA, 18 nt, Salmonella enterica enterica serovar Typhi Ty2
cguagcgagucaaaccuc

SEQ ID NO: 3689592 - RNA, 12 nt, Salmonella enterica enterica serovar Typhi Ty2
cguagcgccaac

SEQ ID NO: 3689593 - RNA, 13 nt, Salmonella enterica enterica serovar Typhi Ty2
cguagcgccaaca

SEQ ID NO: 3689594 - RNA, 15 nt, Salmonella enterica enterica serovar Typhi Ty2
cguagcgcguucagg

SEQ ID NO: 3689595 - RNA, 20 nt, Salmonella enterica enterica serovar Typhi Ty2
cguagcguaaugcagcgucu

SEQ ID NO: 3689596 - RNA, 17 nt, Salmonella enterica enterica serovar Typhi Ty2
cguagcguugccaaaag

SEQ ID NO: 3689597 - RNA, 21 nt, Salmonella enterica enterica serovar Typhi Ty2
cguagcuggucgccagcgccg

SEQ ID NO: 3689598 - RNA, 18 nt, Salmonella enterica enterica serovar Typhi Ty2
cguaggccggauaaggcg

SEQ ID NO: 3689599 - RNA, 19 nt, Salmonella enterica enterica serovar Typhi Ty2
cguaggccugauaagcgca

SEQ ID NO: 3689600 - RNA, 13 nt, Salmonella enterica enterica serovar Typhi Ty2
cguaggcggcgga

SEQ ID NO: 3689601 - RNA, 20 nt, Salmonella enterica enterica serovar Typhi Ty2
cguaguagguauccagcaga

SEQ ID NO: 3689602 - RNA, 15 nt, Salmonella enterica enterica serovar Typhi Ty2
cguaguggcauggca

SEQ ID NO: 3689603 - RNA, 15 nt, Salmonella enterica enterica serovar Typhi Ty2
cguauaauccagcuu

SEQ ID NO: 3689604 - RNA, 13 nt, Salmonella enterica enterica serovar Typhi Ty2
cgucauccugcag

SEQ ID NO: 3689605 - RNA, 14 nt, Salmonella enterica enterica serovar Typhi Ty2
cgucauccugcagg

SEQ ID NO: 3689606 - RNA, 21 nt, Salmonella enterica enterica serovar Typhi Ty2
cgucaucgcuccagacggcgc

SEQ ID NO: 3689607 - RNA, 15 nt, Salmonella enterica enterica serovar Typhi Ty2
cgucaucgcuucuau

SEQ ID NO: 3689608 - RNA, 18 nt, Salmonella enterica enterica serovar Typhi Ty2
cgucaucgggcuguuauu

SEQ ID NO: 3689609 - RNA, 13 nt, Salmonella enterica enterica serovar Typhi Ty2
cgucaugccgcca

SEQ ID NO: 3689610 - RNA, 17 nt, Salmonella enterica enterica serovar Typhi Ty2
cgucauggcgcauuauc

SEQ ID NO: 3689611 - RNA, 21 nt, Salmonella enterica enterica serovar Typhi Ty2
cgucauggcuaaucgccacga

SEQ ID NO: 3689612 - RNA, 21 nt, Salmonella enterica enterica serovar Typhi Ty2
cgucauuaccaguugaccaaa

SEQ ID NO: 3689613 - RNA, 22 nt, Salmonella enterica enterica serovar Typhi Ty2
cguccaacuggcuuucauccaa

SEQ ID NO: 3689614 - RNA, 15 nt, Salmonella enterica enterica serovar Typhi Ty2
cguccacauccccgc

SEQ ID NO: 3689615 - RNA, 22 nt, Salmonella enterica enterica serovar Typhi Ty2
cguccacggacaucggccucgc

SEQ ID NO: 3689616 - RNA, 22 nt, Salmonella enterica enterica serovar Typhi Ty2
cguccacggauauuuaccgccg

SEQ ID NO: 3689617 - RNA, 14 nt, Salmonella enterica enterica serovar Typhi Ty2
cguccacucuuccg

SEQ ID NO: 3689618 - RNA, 19 nt, Salmonella enterica enterica serovar Typhi Ty2
cguccacucuuccgggcga

SEQ ID NO: 3689619 - RNA, 15 nt, Salmonella enterica enterica serovar Typhi Ty2
cguccagacuccuuu

SEQ ID NO: 3689620 - RNA, 22 nt, Salmonella enterica enterica serovar Typhi Ty2
cguccagauacgcgccggccgg

SEQ ID NO: 3689621 - RNA, 22 nt, Salmonella enterica enterica serovar Typhi Ty2
cguccagccagcguuucuggaa

SEQ ID NO: 3689622 - RNA, 12 nt, Salmonella enterica enterica serovar Typhi Ty2
cguccaggcucg

SEQ ID NO: 3689623 - RNA, 23 nt, Salmonella enterica enterica serovar Typhi Ty2
cguccaguaaaaucggaccuccg

SEQ ID NO: 3689624 - RNA, 23 nt, Salmonella enterica enterica serovar Typhi Ty2
cguccaguccugucccugccagc

SEQ ID NO: 3689625 - RNA, 19 nt, Salmonella enterica enterica serovar Typhi Ty2
cguccaguguccgcuguua

SEQ ID NO: 3689626 - RNA, 16 nt, Salmonella enterica enterica serovar Typhi Ty2
cguccauuacucucau

SEQ ID NO: 3689627 - RNA, 20 nt, Salmonella enterica enterica serovar Typhi Ty2
cgucccaccacgcagccaug

SEQ ID NO: 3689628 - RNA, 15 nt, Salmonella enterica enterica serovar Typhi Ty2
cgucccacgcgccgc

SEQ ID NO: 3689629 - RNA, 23 nt, Salmonella enterica enterica serovar Typhi Ty2
cgucccacgcgccgccgaacaga

SEQ ID NO: 3689630 - RNA, 13 nt, Salmonella enterica enterica serovar Typhi Ty2
cgucccagcgcac

SEQ ID NO: 3689631 - RNA, 14 nt, Salmonella enterica enterica serovar Typhi Ty2
cguccccagccaga

SEQ ID NO: 3689632 - RNA, 16 nt, Salmonella enterica enterica serovar Typhi Ty2
cguccccguucugacc

SEQ ID NO: 3689633 - RNA, 13 nt, Salmonella enterica enterica serovar Typhi Ty2
cguccccugcggu

SEQ ID NO: 3689634 - RNA, 22 nt, Salmonella enterica enterica serovar Typhi Ty2
cguccccugcgguuucuaccac

SEQ ID NO: 3689635 - RNA, 17 nt, Salmonella enterica enterica serovar Typhi Ty2
cgucccgauauaaaggu

SEQ ID NO: 3689636 - RNA, 16 nt, Salmonella enterica enterica serovar Typhi Ty2
cgucccggcauuauaa

SEQ ID NO: 3689637 - RNA, 13 nt, Salmonella enterica enterica serovar Typhi Ty2
cgucccucgccgg

SEQ ID NO: 3689638 - RNA, 15 nt, Salmonella enterica enterica serovar Typhi Ty2
cgucccuuccgccac

SEQ ID NO: 3689639 - RNA, 19 nt, Salmonella enterica enterica serovar Typhi Ty2
cgucccuuucccuuccagc

SEQ ID NO: 3689640 - RNA, 16 nt, Salmonella enterica enterica serovar Typhi Ty2
cguccgccagaugcac

SEQ ID NO: 3689641 - RNA, 14 nt, Salmonella enterica enterica serovar Typhi Ty2
cguccgccaggccc

SEQ ID NO: 3689642 - RNA, 17 nt, Salmonella enterica enterica serovar Typhi Ty2
cguccgccaggcccaug

SEQ ID NO: 3689643 - RNA, 12 nt, Salmonella enterica enterica serovar Typhi Ty2
cguccgccuccg

SEQ ID NO: 3689644 - RNA, 22 nt, Salmonella enterica enterica serovar Typhi Ty2
cguccgcuaaucucgaccuggc

SEQ ID NO: 3689645 - RNA, 16 nt, Salmonella enterica enterica serovar Typhi Ty2
cguccggcacgcgcag

SEQ ID NO: 3689646 - RNA, 20 nt, Salmonella enterica enterica serovar Typhi Ty2
cguccggcgaaaaccgagca

SEQ ID NO: 3689647 - RNA, 12 nt, Salmonella enterica enterica serovar Typhi Ty2
cguccggcugcc

SEQ ID NO: 3689648 - RNA, 17 nt, Salmonella enterica enterica serovar Typhi Ty2
cguccgguagagaacga

SEQ ID NO: 3689649 - RNA, 19 nt, Salmonella enterica enterica serovar Typhi Ty2
cguccucaggccggauaag

SEQ ID NO: 3689650 - RNA, 21 nt, Salmonella enterica enterica serovar Typhi Ty2
cguccugaaucgcuugcgcgu

SEQ ID NO: 3689651 - RNA, 21 nt, Salmonella enterica enterica serovar Typhi Ty2
cgucgacaaagccgacgccac

SEQ ID NO: 3689652 - RNA, 14 nt, Salmonella enterica enterica serovar Typhi Ty2
cgucgacagccccc

SEQ ID NO: 3689653 - RNA, 15 nt, Salmonella enterica enterica serovar Typhi Ty2
cgucgacgccuucca

SEQ ID NO: 3689654 - RNA, 14 nt, Salmonella enterica enterica serovar Typhi Ty2
cgucgagacggugu

SEQ ID NO: 3689655 - RNA, 18 nt, Salmonella enterica enterica serovar Typhi Ty2
cgucgaggaagcugcgca

SEQ ID NO: 3689656 - RNA, 23 nt, Salmonella enterica enterica serovar Typhi Ty2
cgucgaggguagcgacugauaag

SEQ ID NO: 3689657 - RNA, 15 nt, Salmonella enterica enterica serovar Typhi Ty2
cgucgccaaucagca

SEQ ID NO: 3689658 - RNA, 19 nt, Salmonella enterica enterica serovar Typhi Ty2
cgucgccagacccagcgcu

SEQ ID NO: 3689659 - RNA, 14 nt, Salmonella enterica enterica serovar Typhi Ty2
cgucgccagcgucu

SEQ ID NO: 3689660 - RNA, 22 nt, Salmonella enterica enterica serovar Typhi Ty2
cgucgccauauccaagccccuc

SEQ ID NO: 3689661 - RNA, 23 nt, Salmonella enterica enterica serovar Typhi Ty2
cgucgccggugcuguagcugccc

SEQ ID NO: 3689662 - RNA, 18 nt, Salmonella enterica enterica serovar Typhi Ty2
cgucgccuguccggccug

SEQ ID NO: 3689663 - RNA, 21 nt, Salmonella enterica enterica serovar Typhi Ty2
cgucgccuguuucugcgccgc

SEQ ID NO: 3689664 - RNA, 22 nt, Salmonella enterica enterica serovar Typhi Ty2
cgucgccuguuucugcgccgcu

SEQ ID NO: 3689665 - RNA, 19 nt, Salmonella enterica enterica serovar Typhi Ty2
cgucgcgaauaauuauuuu

SEQ ID NO: 3689666 - RNA, 13 nt, Salmonella enterica enterica serovar Typhi Ty2
cgucgcgaaucgu

SEQ ID NO: 3689667 - RNA, 15 nt, Salmonella enterica enterica serovar Typhi Ty2
cgucgcgacguccgc

SEQ ID NO: 3689668 - RNA, 23 nt, Salmonella enterica enterica serovar Typhi Ty2
cgucgcgacguccgccaacagcc

SEQ ID NO: 3689669 - RNA, 13 nt, Salmonella enterica enterica serovar Typhi Ty2
cgucgcgaucaca

SEQ ID NO: 3689670 - RNA, 15 nt, Salmonella enterica enterica serovar Typhi Ty2
cgucgcgaucacaga

SEQ ID NO: 3689671 - RNA, 17 nt, Salmonella enterica enterica serovar Typhi Ty2
cgucgcgaucgcgccag

SEQ ID NO: 3689672 - RNA, 17 nt, Salmonella enterica enterica serovar Typhi Ty2
cgucgcgcauggcaggg

SEQ ID NO: 3689673 - RNA, 12 nt, Salmonella enterica enterica serovar Typhi Ty2
cgucgcgcgccg

SEQ ID NO: 3689674 - RNA, 14 nt, Salmonella enterica enterica serovar Typhi Ty2
cgucgcgcgccgcc

SEQ ID NO: 3689675 - RNA, 16 nt, Salmonella enterica enterica serovar Typhi Ty2
cgucgcgcgccgccuc

SEQ ID NO: 3689676 - RNA, 21 nt, Salmonella enterica enterica serovar Typhi Ty2
cgucgcgcgccgccugcgcca

SEQ ID NO: 3689677 - RNA, 14 nt, Salmonella enterica enterica serovar Typhi Ty2
cgucgcgcgcugug

SEQ ID NO: 3689678 - RNA, 16 nt, Salmonella enterica enterica serovar Typhi Ty2
cgucggcaauuaacau

SEQ ID NO: 3689679 - RNA, 16 nt, Salmonella enterica enterica serovar Typhi Ty2
cgucggcgacgacgau

SEQ ID NO: 3689680 - RNA, 15 nt, Salmonella enterica enterica serovar Typhi Ty2
cgucggcgccggcgu

SEQ ID NO: 3689681 - RNA, 17 nt, Salmonella enterica enterica serovar Typhi Ty2
cgucgggggcgacaaac

SEQ ID NO: 3689682 - RNA, 17 nt, Salmonella enterica enterica serovar Typhi Ty2
cgucgguuauagacgcc

SEQ ID NO: 3689683 - RNA, 14 nt, Salmonella enterica enterica serovar Typhi Ty2
cgucguaaaaccug

SEQ ID NO: 3689684 - RNA, 15 nt, Salmonella enterica enterica serovar Typhi Ty2
cgucguaaaaccugc

SEQ ID NO: 3689685 - RNA, 18 nt, Salmonella enterica enterica serovar Typhi Ty2
cgucguaaauuccugcau

SEQ ID NO: 3689686 - RNA, 21 nt, Salmonella enterica enterica serovar Typhi Ty2
cgugcaugggcagcuugccgc

SEQ ID NO: 3689687 - RNA, 18 nt, Salmonella enterica enterica serovar Typhi Ty2
cgugccaugaccauucac

SEQ ID NO: 3689688 - RNA, 19 nt, Salmonella enterica enterica serovar Typhi Ty2
cgugccaugaccauucaca

SEQ ID NO: 3689689 - RNA, 20 nt, Salmonella enterica enterica serovar Typhi Ty2
cgugccaugaccauucacac

SEQ ID NO: 3689690 - RNA, 15 nt, Salmonella enterica enterica serovar Typhi Ty2
cgugccauuaacgca

SEQ ID NO: 3689691 - RNA, 16 nt, Salmonella enterica enterica serovar Typhi Ty2
cgugccgaccagcggu

SEQ ID NO: 3689692 - RNA, 18 nt, Salmonella enterica enterica serovar Typhi Ty2
cgugccgccgcgaaaacg

SEQ ID NO: 3689693 - RNA, 22 nt, Salmonella enterica enterica serovar Typhi Ty2
cgugccguagaaaaugcgcugg

SEQ ID NO: 3689694 - RNA, 16 nt, Salmonella enterica enterica serovar Typhi Ty2
cgugccugcuccgcca

SEQ ID NO: 3689695 - RNA, 15 nt, Salmonella enterica enterica serovar Typhi Ty2
cgugccuucaaauau

SEQ ID NO: 3689696 - RNA, 23 nt, Salmonella enterica enterica serovar Typhi Ty2
cgugccuuccgcaauacagcccg

SEQ ID NO: 3689697 - RNA, 13 nt, Salmonella enterica enterica serovar Typhi Ty2
cgugcgcagcgcg

SEQ ID NO: 3689698 - RNA, 15 nt, Salmonella enterica enterica serovar Typhi Ty2
cgugcgccguccugc

SEQ ID NO: 3689699 - RNA, 21 nt, Salmonella enterica enterica serovar Typhi Ty2
cgugcgccgugaaauauccuc

SEQ ID NO: 3689700 - RNA, 19 nt, Salmonella enterica enterica serovar Typhi Ty2
cgugcgcucagggucagaa

SEQ ID NO: 3689701 - RNA, 15 nt, Salmonella enterica enterica serovar Typhi Ty2
cgugcgcugcggcca

SEQ ID NO: 3689702 - RNA, 17 nt, Salmonella enterica enterica serovar Typhi Ty2
cgugcggacguagcggc

SEQ ID NO: 3689703 - RNA, 17 nt, Salmonella enterica enterica serovar Typhi Ty2
cgugcggcggacgccgg

SEQ ID NO: 3689704 - RNA, 20 nt, Salmonella enterica enterica serovar Typhi Ty2
cgugcgguauaucacgccau

SEQ ID NO: 3689705 - RNA, 18 nt, Salmonella enterica enterica serovar Typhi Ty2
cgugcucucaccaucaua

SEQ ID NO: 3689706 - RNA, 12 nt, Salmonella enterica enterica serovar Typhi Ty2
cgugcuggaugg

SEQ ID NO: 3689707 - RNA, 16 nt, Salmonella enterica enterica serovar Typhi Ty2
cgugcugggcgcgccu

SEQ ID NO: 3689708 - RNA, 17 nt, Salmonella enterica enterica serovar Typhi Ty2
cguggaacugcagcgcg

SEQ ID NO: 3689709 - RNA, 20 nt, Salmonella enterica enterica serovar Typhi Ty2
cguggaccguauagcccaga

SEQ ID NO: 3689710 - RNA, 15 nt, Salmonella enterica enterica serovar Typhi Ty2
cguggacgcuggguu

SEQ ID NO: 3689711 - RNA, 21 nt, Salmonella enterica enterica serovar Typhi Ty2
cguggauuuuuugucuguaua

SEQ ID NO: 3689712 - RNA, 16 nt, Salmonella enterica enterica serovar Typhi Ty2
cguggcaaggaacagu

SEQ ID NO: 3689713 - RNA, 11 nt, Salmonella enterica enterica serovar Typhi Ty2
cguggcaucuu

SEQ ID NO: 3689714 - RNA, 12 nt, Salmonella enterica enterica serovar Typhi Ty2
cguggcaucuua

SEQ ID NO: 3689715 - RNA, 21 nt, Salmonella enterica enterica serovar Typhi Ty2
cguggcauucgcuugcccggc

SEQ ID NO: 3689716 - RNA, 14 nt, Salmonella enterica enterica serovar Typhi Ty2
cguggccaaaaaau

SEQ ID NO: 3689717 - RNA, 13 nt, Salmonella enterica enterica serovar Typhi Ty2
cguggccuccggc

SEQ ID NO: 3689718 - RNA, 22 nt, Salmonella enterica enterica serovar Typhi Ty2
cguggcgcgaauuuucgauaau

SEQ ID NO: 3689719 - RNA, 20 nt, Salmonella enterica enterica serovar Typhi Ty2
cguggguucgaaucccauua

SEQ ID NO: 3689720 - RNA, 14 nt, Salmonella enterica enterica serovar Typhi Ty2
cgugguaucgcgac

SEQ ID NO: 3689721 - RNA, 21 nt, Salmonella enterica enterica serovar Typhi Ty2
cgugguaucgcgacagcgcug

SEQ ID NO: 3689722 - RNA, 13 nt, Salmonella enterica enterica serovar Typhi Ty2
cgugguauuacaa

SEQ ID NO: 3689723 - RNA, 21 nt, Salmonella enterica enterica serovar Typhi Ty2
cguggucauuaggcguaauua

SEQ ID NO: 3689724 - RNA, 21 nt, Salmonella enterica enterica serovar Typhi Ty2
cguggugaauaucgagcggca

SEQ ID NO: 3689725 - RNA, 17 nt, Salmonella enterica enterica serovar Typhi Ty2
cgugguuagacaucacg

SEQ ID NO: 3689726 - RNA, 16 nt, Salmonella enterica enterica serovar Typhi Ty2
cguguaaacagaugcu

SEQ ID NO: 3689727 - RNA, 17 nt, Salmonella enterica enterica serovar Typhi Ty2
cguguaaacagaugcuc

SEQ ID NO: 3689728 - RNA, 17 nt, Salmonella enterica enterica serovar Typhi Ty2
cguguaaggcuuccggc

SEQ ID NO: 3689729 - RNA, 20 nt, Salmonella enterica enterica serovar Typhi Ty2
cguguauuccagucgcucca

SEQ ID NO: 3689730 - RNA, 21 nt, Salmonella enterica enterica serovar Typhi Ty2
cguguccaaacuggcugugcc

SEQ ID NO: 3689731 - RNA, 22 nt, Salmonella enterica enterica serovar Typhi Ty2
cgugucgcguaacgccuccacc

SEQ ID NO: 3689732 - RNA, 19 nt, Salmonella enterica enterica serovar Typhi Ty2
cgugucggauaucagacag

SEQ ID NO: 3689733 - RNA, 16 nt, Salmonella enterica enterica serovar Typhi Ty2
cgugucgggaauugcc

SEQ ID NO: 3689734 - RNA, 17 nt, Salmonella enterica enterica serovar Typhi Ty2
cgugucgguacgcuggu

SEQ ID NO: 3689735 - RNA, 16 nt, Salmonella enterica enterica serovar Typhi Ty2
cguguggccugcucua

SEQ ID NO: 3689736 - RNA, 18 nt, Salmonella enterica enterica serovar Typhi Ty2
cguguggcggaaugaccu

SEQ ID NO: 3689737 - RNA, 21 nt, Salmonella enterica enterica serovar Typhi Ty2
cguguggucgcggcucaccag

SEQ ID NO: 3689738 - RNA, 23 nt, Salmonella enterica enterica serovar Typhi Ty2
cguguuacgccgcaaucacuuca

SEQ ID NO: 3689739 - RNA, 21 nt, Salmonella enterica enterica serovar Typhi Ty2
cguguuacugacgaccggcag

SEQ ID NO: 3689740 - RNA, 21 nt, Salmonella enterica enterica serovar Typhi Ty2
cguguuauuuucaaaaacaag

SEQ ID NO: 3689741 - RNA, 20 nt, Salmonella enterica enterica serovar Typhi Ty2
cguguugauuaaugcgauaa

SEQ ID NO: 3689742 - RNA, 21 nt, Salmonella enterica enterica serovar Typhi Ty2
cguguugcagcccaccggcga

SEQ ID NO: 3689743 - RNA, 13 nt, Salmonella enterica enterica serovar Typhi Ty2
cguguuguccggc

SEQ ID NO: 3689744 - RNA, 13 nt, Salmonella enterica enterica serovar Typhi Ty2
cguuaaacgcugu

SEQ ID NO: 3689745 - RNA, 16 nt, Salmonella enterica enterica serovar Typhi Ty2
cguuaaauaccagcac

SEQ ID NO: 3689746 - RNA, 22 nt, Salmonella enterica enterica serovar Typhi Ty2
cguuaaauagccccaacgcgcu

SEQ ID NO: 3689747 - RNA, 19 nt, Salmonella enterica enterica serovar Typhi Ty2
cguuaacaucaucaggccu

SEQ ID NO: 3689748 - RNA, 14 nt, Salmonella enterica enterica serovar Typhi Ty2
cguuaaccagcggc

SEQ ID NO: 3689749 - RNA, 16 nt, Salmonella enterica enterica serovar Typhi Ty2
cguuaaguagcggaac

SEQ ID NO: 3689750 - RNA, 15 nt, Salmonella enterica enterica serovar Typhi Ty2
cguuaauaccgugca

SEQ ID NO: 3689751 - RNA, 18 nt, Salmonella enterica enterica serovar Typhi Ty2
cguuaauccaaauccgca

SEQ ID NO: 3689752 - RNA, 22 nt, Salmonella enterica enterica serovar Typhi Ty2
cguuaauccaaauccgcauuuc

SEQ ID NO: 3689753 - RNA, 18 nt, Salmonella enterica enterica serovar Typhi Ty2
cguuaaucgauuuucucc

SEQ ID NO: 3689754 - RNA, 21 nt, Salmonella enterica enterica serovar Typhi Ty2
cguuaaucgauuuucuccgga

SEQ ID NO: 3689755 - RNA, 19 nt, Salmonella enterica enterica serovar Typhi Ty2
cguuaaucuggccuacgga

SEQ ID NO: 3689756 - RNA, 21 nt, Salmonella enterica enterica serovar Typhi Ty2
cguuaaugcgcgcuucuucau

SEQ ID NO: 3689757 - RNA, 22 nt, Salmonella enterica enterica serovar Typhi Ty2
cguuaaugcgcgcuucuucaug

SEQ ID NO: 3689758 - RNA, 20 nt, Salmonella enterica enterica serovar Typhi Ty2
cguuaaugcuguccugcaaa

SEQ ID NO: 3689759 - RNA, 20 nt, Salmonella enterica enterica serovar Typhi Ty2
cguuaauuuuccccgcacgc

SEQ ID NO: 3689760 - RNA, 14 nt, Salmonella enterica enterica serovar Typhi Ty2
cguuacaaauagcg

SEQ ID NO: 3689761 - RNA, 15 nt, Salmonella enterica enterica serovar Typhi Ty2
cguuaccaaucugcg

SEQ ID NO: 3689762 - RNA, 12 nt, Salmonella enterica enterica serovar Typhi Ty2
cguuaccagcau

SEQ ID NO: 3689763 - RNA, 13 nt, Salmonella enterica enterica serovar Typhi Ty2
cguuaccagcauc

SEQ ID NO: 3689764 - RNA, 18 nt, Salmonella enterica enterica serovar Typhi Ty2
cguuaccagcaucaauag

SEQ ID NO: 3689765 - RNA, 17 nt, Salmonella enterica enterica serovar Typhi Ty2
cguuacccagacagcaa

SEQ ID NO: 3689766 - RNA, 23 nt, Salmonella enterica enterica serovar Typhi Ty2
cguuaccccgcagcgaaaaucca

SEQ ID NO: 3689767 - RNA, 20 nt, Salmonella enterica enterica serovar Typhi Ty2
cguuacccgauaccgccagc

SEQ ID NO: 3689768 - RNA, 22 nt, Salmonella enterica enterica serovar Typhi Ty2
cguugcugucgcgcaauaccug

SEQ ID NO: 3689769 - RNA, 20 nt, Salmonella enterica enterica serovar Typhi Ty2
cguuggaauaaaucacaacg

SEQ ID NO: 3689770 - RNA, 18 nt, Salmonella enterica enterica serovar Typhi Ty2
cguuggcgucaucgacau

SEQ ID NO: 3689771 - RNA, 19 nt, Salmonella enterica enterica serovar Typhi Ty2
cguuggcuugaucaacgcc

SEQ ID NO: 3689772 - RNA, 14 nt, Salmonella enterica enterica serovar Typhi Ty2
cguugguaccgcuu

SEQ ID NO: 3689773 - RNA, 18 nt, Salmonella enterica enterica serovar Typhi Ty2
cguugguagacccggcau

SEQ ID NO: 3689774 - RNA, 18 nt, Salmonella enterica enterica serovar Typhi Ty2
cguuguaguuaucgccga

SEQ ID NO: 3689775 - RNA, 19 nt, Salmonella enterica enterica serovar Typhi Ty2
cguuguaguuaucgccgaa

SEQ ID NO: 3689776 - RNA, 16 nt, Salmonella enterica enterica serovar Typhi Ty2
cguugucauggcgcca

SEQ ID NO: 3689777 - RNA, 21 nt, Salmonella enterica enterica serovar Typhi Ty2
cguugucauggcgccaccagc

SEQ ID NO: 3689778 - RNA, 19 nt, Salmonella enterica enterica serovar Typhi Ty2
cguuguccaacugucgcca

SEQ ID NO: 3689779 - RNA, 16 nt, Salmonella enterica enterica serovar Typhi Ty2
cguuguccagcggcca

SEQ ID NO: 3689780 - RNA, 18 nt, Salmonella enterica enterica serovar Typhi Ty2
cguugucuucaucuaucc

SEQ ID NO: 3689781 - RNA, 15 nt, Salmonella enterica enterica serovar Typhi Ty2
cguugugcugcggca

SEQ ID NO: 3689782 - RNA, 23 nt, Salmonella enterica enterica serovar Typhi Ty2
cguuguggacgaacucagagucg

SEQ ID NO: 3689783 - RNA, 19 nt, Salmonella enterica enterica serovar Typhi Ty2
cguuguuucugccuuuaac

SEQ ID NO: 3689784 - RNA, 15 nt, Salmonella enterica enterica serovar Typhi Ty2
cguuguuuggguaac

SEQ ID NO: 3689785 - RNA, 16 nt, Salmonella enterica enterica serovar Typhi Ty2
cguuuaaaaagcugca

SEQ ID NO: 3689786 - RNA, 13 nt, Salmonella enterica enterica serovar Typhi Ty2
cguuuaaaaugaa

SEQ ID NO: 3689787 - RNA, 12 nt, Salmonella enterica enterica serovar Typhi Ty2
cguuuaaacggg

SEQ ID NO: 3689788 - RNA, 14 nt, Salmonella enterica enterica serovar Typhi Ty2
cguuuacaccuauu

SEQ ID NO: 3689789 - RNA, 17 nt, Salmonella enterica enterica serovar Typhi Ty2
cguuuaccuucgauaac

SEQ ID NO: 3689790 - RNA, 15 nt, Salmonella enterica enterica serovar Typhi Ty2
cguuuacgccgccau

SEQ ID NO: 3689791 - RNA, 16 nt, Salmonella enterica enterica serovar Typhi Ty2
cguuuauaccccacca

SEQ ID NO: 3689792 - RNA, 20 nt, Salmonella enterica enterica serovar Typhi Ty2
cguuuauauaaaaauagcug

SEQ ID NO: 3689793 - RNA, 23 nt, Salmonella enterica enterica serovar Typhi Ty2
cguuuauauaaaaauagcuggcu

SEQ ID NO: 3689794 - RNA, 14 nt, Salmonella enterica enterica serovar Typhi Ty2
cguuuaugcaggaa

SEQ ID NO: 3689795 - RNA, 15 nt, Salmonella enterica enterica serovar Typhi Ty2
cguuuaugccgccau

SEQ ID NO: 3689796 - RNA, 16 nt, Salmonella enterica enterica serovar Typhi Ty2
cguuuaugccgccauc

SEQ ID NO: 3689797 - RNA, 15 nt, Salmonella enterica enterica serovar Typhi Ty2
cguuuauuauaaaca

SEQ ID NO: 3689798 - RNA, 13 nt, Salmonella enterica enterica serovar Typhi Ty2
cguuuauuauuug

SEQ ID NO: 3689799 - RNA, 13 nt, Salmonella enterica enterica serovar Typhi Ty2
cguuuauucuuuu

SEQ ID NO: 3689800 - RNA, 20 nt, Salmonella enterica enterica serovar Typhi Ty2
cguuucaacaaacucagcca

SEQ ID NO: 3689801 - RNA, 19 nt, Salmonella enterica enterica serovar Typhi Ty2
cguuucacaaccuccacgc

SEQ ID NO: 3689802 - RNA, 18 nt, Salmonella enterica enterica serovar Typhi Ty2
cguuucaggacggcauaa

SEQ ID NO: 3689803 - RNA, 16 nt, Salmonella enterica enterica serovar Typhi Ty2
cguuucagucaccagc

SEQ ID NO: 3689804 - RNA, 15 nt, Salmonella enterica enterica serovar Typhi Ty2
cguuucauguaaaug

SEQ ID NO: 3689805 - RNA, 16 nt, Salmonella enterica enterica serovar Typhi Ty2
cguuucauguaaauga

SEQ ID NO: 3689806 - RNA, 21 nt, Salmonella enterica enterica serovar Typhi Ty2
cguuucauguaaaugacgcca

SEQ ID NO: 3689807 - RNA, 12 nt, Salmonella enterica enterica serovar Typhi Ty2
cguuuccagacu

SEQ ID NO: 3689808 - RNA, 22 nt, Salmonella enterica enterica serovar Typhi Ty2
cguuuccugucucuauuaaccg

SEQ ID NO: 3689809 - RNA, 18 nt, Salmonella enterica enterica serovar Typhi Ty2
cguuucgauaaccaccag

SEQ ID NO: 3689810 - RNA, 22 nt, Salmonella enterica enterica serovar Typhi Ty2
cguuucgauaaccaccagcgga

SEQ ID NO: 3689811 - RNA, 18 nt, Salmonella enterica enterica serovar Typhi Ty2
cguuucgauuguaggccg

SEQ ID NO: 3689812 - RNA, 16 nt, Salmonella enterica enterica serovar Typhi Ty2
cguuucgccaguuuac

SEQ ID NO: 3689813 - RNA, 12 nt, Salmonella enterica enterica serovar Typhi Ty2
cguuucgccgua

SEQ ID NO: 3689814 - RNA, 17 nt, Salmonella enterica enterica serovar Typhi Ty2
cguuucgcuaucgccca

SEQ ID NO: 3689815 - RNA, 19 nt, Salmonella enterica enterica serovar Typhi Ty2
cguuucguuuagcgccugc

SEQ ID NO: 3689816 - RNA, 20 nt, Salmonella enterica enterica serovar Typhi Ty2
cguuucuauuauugaucggc

SEQ ID NO: 3689817 - RNA, 19 nt, Salmonella enterica enterica serovar Typhi Ty2
cguuucucgcgaccagaga

SEQ ID NO: 3689818 - RNA, 12 nt, Salmonella enterica enterica serovar Typhi Ty2
cguuucucuugu

SEQ ID NO: 3689819 - RNA, 16 nt, Salmonella enterica enterica serovar Typhi Ty2
cguuucugaacgcggu

SEQ ID NO: 3689820 - RNA, 21 nt, Salmonella enterica enterica serovar Typhi Ty2
cguuucuggggcaagcucuuc

SEQ ID NO: 3689821 - RNA, 15 nt, Salmonella enterica enterica serovar Typhi Ty2
cguuucuuucaucag

SEQ ID NO: 3689822 - RNA, 18 nt, Salmonella enterica enterica serovar Typhi Ty2
cguuugacggauuuuuuu

SEQ ID NO: 3689823 - RNA, 16 nt, Salmonella enterica enterica serovar Typhi Ty2
cguuugcauucgcccg

SEQ ID NO: 3689824 - RNA, 14 nt, Salmonella enterica enterica serovar Typhi Ty2
cguuugcgccgcca

SEQ ID NO: 3689825 - RNA, 15 nt, Salmonella enterica enterica serovar Typhi Ty2
cguuugcgccgccau

SEQ ID NO: 3689826 - RNA, 16 nt, Salmonella enterica enterica serovar Typhi Ty2
cguuugcgcuacgcug

SEQ ID NO: 3689827 - RNA, 15 nt, Salmonella enterica enterica serovar Typhi Ty2
cguuuggcgauguuu

SEQ ID NO: 3689828 - RNA, 16 nt, Salmonella enterica enterica serovar Typhi Ty2
cguuuggucaacucuu

SEQ ID NO: 3689829 - RNA, 13 nt, Salmonella enterica enterica serovar Typhi Ty2
cguuuguaacagc

SEQ ID NO: 3689830 - RNA, 19 nt, Salmonella enterica enterica serovar Typhi Ty2
cguuuguguuauacguucu

SEQ ID NO: 3689831 - RNA, 15 nt, Salmonella enterica enterica serovar Typhi Ty2
cguuuuagcgccauu

SEQ ID NO: 3689832 - RNA, 13 nt, Salmonella enterica enterica serovar Typhi Ty2
cguuuuauaagcc

SEQ ID NO: 3689833 - RNA, 13 nt, Salmonella enterica enterica serovar Typhi Ty2
cguuuucaauaau

SEQ ID NO: 3689834 - RNA, 18 nt, Salmonella enterica enterica serovar Typhi Ty2
cguuuucauuagccgcca

SEQ ID NO: 3689835 - RNA, 19 nt, Salmonella enterica enterica serovar Typhi Ty2
cguuuucauuagccgccag

SEQ ID NO: 3689836 - RNA, 21 nt, Salmonella enterica enterica serovar Typhi Ty2
cguuuuccagcaccaguugcg

SEQ ID NO: 3689837 - RNA, 15 nt, Salmonella enterica enterica serovar Typhi Ty2
cguuuuccagcucac

SEQ ID NO: 3689838 - RNA, 23 nt, Salmonella enterica enterica serovar Typhi Ty2
cguuuuccaggugcugccacauc

SEQ ID NO: 3689839 - RNA, 15 nt, Salmonella enterica enterica serovar Typhi Ty2
cguuuuccaucacca

SEQ ID NO: 3689840 - RNA, 20 nt, Salmonella enterica enterica serovar Typhi Ty2
cguuuucccggcaauuaccg

SEQ ID NO: 3689841 - RNA, 20 nt, Salmonella enterica enterica serovar Typhi Ty2
cguuuucggcgacugccgca

SEQ ID NO: 3689842 - RNA, 16 nt, Salmonella enterica enterica serovar Typhi Ty2
cguuuucgucaacaua

SEQ ID NO: 3689843 - RNA, 20 nt, Salmonella enterica enterica serovar Typhi Ty2
cguuuugauguccagaugcu

SEQ ID NO: 3689844 - RNA, 20 nt, Salmonella enterica enterica serovar Typhi Ty2
cguuuugcucuucuuccggc

SEQ ID NO: 3689845 - RNA, 17 nt, Salmonella enterica enterica serovar Typhi Ty2
cguuuuggcagcgcccg

SEQ ID NO: 3689846 - RNA, 22 nt, Salmonella enterica enterica serovar Typhi Ty2
cguuuugugucaaaaaguuguc

SEQ ID NO: 3689847 - RNA, 17 nt, Salmonella enterica enterica serovar Typhi Ty2
cguuuuucagccgcgca

SEQ ID NO: 3689848 - RNA, 18 nt, Salmonella enterica enterica serovar Typhi Ty2
cguuuuucccgcuggcug

SEQ ID NO: 3689849 - RNA, 15 nt, Salmonella enterica enterica serovar Typhi Ty2
cguuuuucucaucaa

SEQ ID NO: 3689850 - RNA, 13 nt, Salmonella enterica enterica serovar Typhi Ty2
cuaauuuuacuuu

SEQ ID NO: 3689851 - RNA, 18 nt, Salmonella enterica enterica serovar Typhi Ty2
cuaauuuuacuuucauuc

SEQ ID NO: 3689852 - RNA, 12 nt, Salmonella enterica enterica serovar Typhi Ty2
cuacaaagcugg

SEQ ID NO: 3689853 - RNA, 20 nt, Salmonella enterica enterica serovar Typhi Ty2
cuacaauggaaaaaucugua

SEQ ID NO: 3689854 - RNA, 22 nt, Salmonella enterica enterica serovar Typhi Ty2
cuacacacucggugcauuuguc

SEQ ID NO: 3689855 - RNA, 19 nt, Salmonella enterica enterica serovar Typhi Ty2
cuacaccccuucuggagaa

SEQ ID NO: 3689856 - RNA, 19 nt, Salmonella enterica enterica serovar Typhi Ty2
cuacaccguauccggccug

SEQ ID NO: 3689857 - RNA, 22 nt, Salmonella enterica enterica serovar Typhi Ty2
cuacaccguauccggccugcag

SEQ ID NO: 3689858 - RNA, 22 nt, Salmonella enterica enterica serovar Typhi Ty2
cuacaccugggcuugcuuuucu

SEQ ID NO: 3689859 - RNA, 16 nt, Salmonella enterica enterica serovar Typhi Ty2
cuacacgaauaccucu

SEQ ID NO: 3689860 - RNA, 16 nt, Salmonella enterica enterica serovar Typhi Ty2
cuacacgucuccucag

SEQ ID NO: 3689861 - RNA, 22 nt, Salmonella enterica enterica serovar Typhi Ty2
cuacagaaagccauaaaacugg

SEQ ID NO: 3689862 - RNA, 11 nt, Salmonella enterica enterica serovar Typhi Ty2
cuacagcguca

SEQ ID NO: 3689863 - RNA, 20 nt, Salmonella enterica enterica serovar Typhi Ty2
cuacaguguaaaaauuuuug

SEQ ID NO: 3689864 - RNA, 13 nt, Salmonella enterica enterica serovar Typhi Ty2
cuacauaucuaua

SEQ ID NO: 3689865 - RNA, 16 nt, Salmonella enterica enterica serovar Typhi Ty2
cuaccaacaaaucauu

SEQ ID NO: 3689866 - RNA, 17 nt, Salmonella enterica enterica serovar Typhi Ty2
cuaccaacaaaucauuu

SEQ ID NO: 3689867 - RNA, 16 nt, Salmonella enterica enterica serovar Typhi Ty2
cuaccaacugagcuaa

SEQ ID NO: 3689868 - RNA, 18 nt, Salmonella enterica enterica serovar Typhi Ty2
cuaccaauuccaccaccu

SEQ ID NO: 3689869 - RNA, 23 nt, Salmonella enterica enterica serovar Typhi Ty2
cuaccacagaaaucgccgggcua

SEQ ID NO: 3689870 - RNA, 16 nt, Salmonella enterica enterica serovar Typhi Ty2
cuaccacgcugccgcc

SEQ ID NO: 3689871 - RNA, 19 nt, Salmonella enterica enterica serovar Typhi Ty2
cuaccacucccaaauuuug

SEQ ID NO: 3689872 - RNA, 16 nt, Salmonella enterica enterica serovar Typhi Ty2
cuaccagaucgcggua

SEQ ID NO: 3689873 - RNA, 21 nt, Salmonella enterica enterica serovar Typhi Ty2
cuaccagcgcuauccaggccg

SEQ ID NO: 3689874 - RNA, 14 nt, Salmonella enterica enterica serovar Typhi Ty2
cuaccaggcaaagc

SEQ ID NO: 3689875 - RNA, 15 nt, Salmonella enterica enterica serovar Typhi Ty2
cuaccaucgcgcgca

SEQ ID NO: 3689876 - RNA, 15 nt, Salmonella enterica enterica serovar Typhi Ty2
cuaccauuuccggcg

SEQ ID NO: 3689877 - RNA, 23 nt, Salmonella enterica enterica serovar Typhi Ty2
cuacccagacaagcacauaacug

SEQ ID NO: 3689878 - RNA, 14 nt, Salmonella enterica enterica serovar Typhi Ty2
cuaccgccguauca

SEQ ID NO: 3689879 - RNA, 14 nt, Salmonella enterica enterica serovar Typhi Ty2
cuaccggaaaacag

SEQ ID NO: 3689880 - RNA, 17 nt, Salmonella enterica enterica serovar Typhi Ty2
cuaccggggcgcucgcc

SEQ ID NO: 3689881 - RNA, 20 nt, Salmonella enterica enterica serovar Typhi Ty2
cuaccggggcgcucgccuga

SEQ ID NO: 3689882 - RNA, 19 nt, Salmonella enterica enterica serovar Typhi Ty2
cuaccgucgacgucuuucu

SEQ ID NO: 3689883 - RNA, 22 nt, Salmonella enterica enterica serovar Typhi Ty2
cuaccgucgacgucuuucuuaa

SEQ ID NO: 3689884 - RNA, 16 nt, Salmonella enterica enterica serovar Typhi Ty2
cuaccgucgccgacaa

SEQ ID NO: 3689885 - RNA, 16 nt, Salmonella enterica enterica serovar Typhi Ty2
cuaccugcgagcugua

SEQ ID NO: 3689886 - RNA, 16 nt, Salmonella enterica enterica serovar Typhi Ty2
cuaccuucuucccaua

SEQ ID NO: 3689887 - RNA, 17 nt, Salmonella enterica enterica serovar Typhi Ty2
cuacgcaaaaaaagcca

SEQ ID NO: 3689888 - RNA, 16 nt, Salmonella enterica enterica serovar Typhi Ty2
cuacgccaucaggcau

SEQ ID NO: 3689889 - RNA, 23 nt, Salmonella enterica enterica serovar Typhi Ty2
cuacgccugugcuggcgaauccg

SEQ ID NO: 3689890 - RNA, 19 nt, Salmonella enterica enterica serovar Typhi Ty2
cuacgcgauaaaaaacgcc

SEQ ID NO: 3689891 - RNA, 14 nt, Salmonella enterica enterica serovar Typhi Ty2
cuacgcuauccggc

SEQ ID NO: 3689892 - RNA, 22 nt, Salmonella enterica enterica serovar Typhi Ty2
cuacgcuauuuccagaaaucag

SEQ ID NO: 3689893 - RNA, 21 nt, Salmonella enterica enterica serovar Typhi Ty2
cuacgcugccauccucauuuu

SEQ ID NO: 3689894 - RNA, 18 nt, Salmonella enterica enterica serovar Typhi Ty2
cuacgcuuaucaggccua

SEQ ID NO: 3689895 - RNA, 18 nt, Salmonella enterica enterica serovar Typhi Ty2
cuacgcuuauccggcuua

SEQ ID NO: 3689896 - RNA, 18 nt, Salmonella enterica enterica serovar Typhi Ty2
cuacgcuucguauuucuu

SEQ ID NO: 3689897 - RNA, 14 nt, Salmonella enterica enterica serovar Typhi Ty2
cuacgcuucucucc

SEQ ID NO: 3689898 - RNA, 23 nt, Salmonella enterica enterica serovar Typhi Ty2
cuacgucaggaaacgcgccggaa

SEQ ID NO: 3689899 - RNA, 22 nt, Salmonella enterica enterica serovar Typhi Ty2
cuacgugauagaucacuuguuu

SEQ ID NO: 3689900 - RNA, 19 nt, Salmonella enterica enterica serovar Typhi Ty2
cuacguugaccucaucacc

SEQ ID NO: 3689901 - RNA, 16 nt, Salmonella enterica enterica serovar Typhi Ty2
cuacuacacacuuacc

SEQ ID NO: 3689902 - RNA, 13 nt, Salmonella enterica enterica serovar Typhi Ty2
cuacuacauaucu

SEQ ID NO: 3689903 - RNA, 21 nt, Salmonella enterica enterica serovar Typhi Ty2
cuacuccgcgguguccugcuu

SEQ ID NO: 3689904 - RNA, 22 nt, Salmonella enterica enterica serovar Typhi Ty2
cuacucgggccagcucuuuucu

SEQ ID NO: 3689905 - RNA, 23 nt, Salmonella enterica enterica serovar Typhi Ty2
cuacucguaaucuaaaauuauuu

SEQ ID NO: 3689906 - RNA, 12 nt, Salmonella enterica enterica serovar Typhi Ty2
cuacugccgcca

SEQ ID NO: 3689907 - RNA, 17 nt, Salmonella enterica enterica serovar Typhi Ty2
cuacuucaauuuuccag

SEQ ID NO: 3689908 - RNA, 20 nt, Salmonella enterica enterica serovar Typhi Ty2
cuacuuuaaauucggcguua

SEQ ID NO: 3689909 - RNA, 23 nt, Salmonella enterica enterica serovar Typhi Ty2
cuagaugaugauuuaugaauagc

SEQ ID NO: 3689910 - RNA, 20 nt, Salmonella enterica enterica serovar Typhi Ty2
cuagauuuuagaaaauaauu

SEQ ID NO: 3689911 - RNA, 20 nt, Salmonella enterica enterica serovar Typhi Ty2
cuagcacuacggcaaacaca

SEQ ID NO: 3689912 - RNA, 21 nt, Salmonella enterica enterica serovar Typhi Ty2
cuagccaauaaucgaaauaaa

SEQ ID NO: 3689913 - RNA, 16 nt, Salmonella enterica enterica serovar Typhi Ty2
cuagccgcauccggca

SEQ ID NO: 3689914 - RNA, 16 nt, Salmonella enterica enterica serovar Typhi Ty2
cuagcgccuuauccgg

SEQ ID NO: 3689915 - RNA, 16 nt, Salmonella enterica enterica serovar Typhi Ty2
cuagcgucccggcaau

SEQ ID NO: 3689916 - RNA, 21 nt, Salmonella enterica enterica serovar Typhi Ty2
cuagcuuaucgccaaagauau

SEQ ID NO: 3689917 - RNA, 15 nt, Salmonella enterica enterica serovar Typhi Ty2
cuagcuuaucgggcc

SEQ ID NO: 3689918 - RNA, 13 nt, Salmonella enterica enterica serovar Typhi Ty2
cuagggcaucaga

SEQ ID NO: 3689919 - RNA, 15 nt, Salmonella enterica enterica serovar Typhi Ty2
cuagggcaucagacg

SEQ ID NO: 3689920 - RNA, 16 nt, Salmonella enterica enterica serovar Typhi Ty2
cuaggggcucuuuuuu

SEQ ID NO: 3689921 - RNA, 23 nt, Salmonella enterica enterica serovar Typhi Ty2
cuauaaaauugccgauauggaug

SEQ ID NO: 3689922 - RNA, 14 nt, Salmonella enterica enterica serovar Typhi Ty2
cuauaaaccacggu

SEQ ID NO: 3689923 - RNA, 18 nt, Salmonella enterica enterica serovar Typhi Ty2
cuauaaaguucccaugcu

SEQ ID NO: 3689924 - RNA, 12 nt, Salmonella enterica enterica serovar Typhi Ty2
cuauaauaacaa

SEQ ID NO: 3689925 - RNA, 18 nt, Salmonella enterica enterica serovar Typhi Ty2
cuauaauaccuccugucu

SEQ ID NO: 3689926 - RNA, 16 nt, Salmonella enterica enterica serovar Typhi Ty2
cuauaauugcuuuuuu

SEQ ID NO: 3689927 - RNA, 23 nt, Salmonella enterica enterica serovar Typhi Ty2
cuauaauugcuuuuuuccacaga

SEQ ID NO: 3689928 - RNA, 12 nt, Salmonella enterica enterica serovar Typhi Ty2
cuauacaguaaa

SEQ ID NO: 3689929 - RNA, 17 nt, Salmonella enterica enterica serovar Typhi Ty2
cuauacccaaaauaauu

SEQ ID NO: 3689930 - RNA, 23 nt, Salmonella enterica enterica serovar Typhi Ty2
cuauagaaugcaagcagcauaau

SEQ ID NO: 3689931 - RNA, 17 nt, Salmonella enterica enterica serovar Typhi Ty2
cuauagagagauggaac

SEQ ID NO: 3689932 - RNA, 21 nt, Salmonella enterica enterica serovar Typhi Ty2
cucaacgcccgcuuucaccau

SEQ ID NO: 3689933 - RNA, 17 nt, Salmonella enterica enterica serovar Typhi Ty2
cucaagcccgcgucguu

SEQ ID NO: 3689934 - RNA, 16 nt, Salmonella enterica enterica serovar Typhi Ty2
cucaagcguucucacg

SEQ ID NO: 3689935 - RNA, 22 nt, Salmonella enterica enterica serovar Typhi Ty2
cucaaggcaauagaccagcggc

SEQ ID NO: 3689936 - RNA, 18 nt, Salmonella enterica enterica serovar Typhi Ty2
cucaaggcuauuagccaa

SEQ ID NO: 3689937 - RNA, 22 nt, Salmonella enterica enterica serovar Typhi Ty2
cucaagguagcgugucuaccaa

SEQ ID NO: 3689938 - RNA, 18 nt, Salmonella enterica enterica serovar Typhi Ty2
cucaauauacuuaucggc

SEQ ID NO: 3689939 - RNA, 22 nt, Salmonella enterica enterica serovar Typhi Ty2
cucaaucacuuaucaaaccagc

SEQ ID NO: 3689940 - RNA, 21 nt, Salmonella enterica enterica serovar Typhi Ty2
cucaaucacuuuugcgaccca

SEQ ID NO: 3689941 - RNA, 22 nt, Salmonella enterica enterica serovar Typhi Ty2
cucaauccuucuaccuucaccc

SEQ ID NO: 3689942 - RNA, 17 nt, Salmonella enterica enterica serovar Typhi Ty2
cucaaugguuucacgcu

SEQ ID NO: 3689943 - RNA, 15 nt, Salmonella enterica enterica serovar Typhi Ty2
cucaauuauuaaucu

SEQ ID NO: 3689944 - RNA, 17 nt, Salmonella enterica enterica serovar Typhi Ty2
cucaauuuuacagccuc

SEQ ID NO: 3689945 - RNA, 15 nt, Salmonella enterica enterica serovar Typhi Ty2
cucacaaaacuauuu

SEQ ID NO: 3689946 - RNA, 18 nt, Salmonella enterica enterica serovar Typhi Ty2
cucacaaaacuauuuucc

SEQ ID NO: 3689947 - RNA, 19 nt, Salmonella enterica enterica serovar Typhi Ty2
cucacagaaucaucaggcu

SEQ ID NO: 3689948 - RNA, 20 nt, Salmonella enterica enterica serovar Typhi Ty2
cucacagaaucaucaggcua

SEQ ID NO: 3689949 - RNA, 18 nt, Salmonella enterica enterica serovar Typhi Ty2
cucacauucauaaaagau

SEQ ID NO: 3689950 - RNA, 19 nt, Salmonella enterica enterica serovar Typhi Ty2
cucacauucauaaaagauc

SEQ ID NO: 3689951 - RNA, 13 nt, Salmonella enterica enterica serovar Typhi Ty2
cucaccaccgccg

SEQ ID NO: 3689952 - RNA, 17 nt, Salmonella enterica enterica serovar Typhi Ty2
cucaccaccgccgcgag

SEQ ID NO: 3689953 - RNA, 21 nt, Salmonella enterica enterica serovar Typhi Ty2
cucaccagcugacgcagcagu

SEQ ID NO: 3689954 - RNA, 14 nt, Salmonella enterica enterica serovar Typhi Ty2
cucaccaguagcgc

SEQ ID NO: 3689955 - RNA, 18 nt, Salmonella enterica enterica serovar Typhi Ty2
cucaccaguccggcagaa

SEQ ID NO: 3689956 - RNA, 23 nt, Salmonella enterica enterica serovar Typhi Ty2
cucaccaguccggcagaaagcag

SEQ ID NO: 3689957 - RNA, 19 nt, Salmonella enterica enterica serovar Typhi Ty2
cucacccaguuuuuuucug

SEQ ID NO: 3689958 - RNA, 21 nt, Salmonella enterica enterica serovar Typhi Ty2
cucacccauuuuauccucuuc

SEQ ID NO: 3689959 - RNA, 15 nt, Salmonella enterica enterica serovar Typhi Ty2
cucaccccuucuuua

SEQ ID NO: 3689960 - RNA, 11 nt, Salmonella enterica enterica serovar Typhi Ty2
cucacccugaa

SEQ ID NO: 3689961 - RNA, 17 nt, Salmonella enterica enterica serovar Typhi Ty2
cucaccgagacugcccg

SEQ ID NO: 3689962 - RNA, 18 nt, Salmonella enterica enterica serovar Typhi Ty2
cucaccguagcuccagac

SEQ ID NO: 3689963 - RNA, 19 nt, Salmonella enterica enterica serovar Typhi Ty2
cucaccguagcuccagacc

SEQ ID NO: 3689964 - RNA, 13 nt, Salmonella enterica enterica serovar Typhi Ty2
cucaccgugguga

SEQ ID NO: 3689965 - RNA, 13 nt, Salmonella enterica enterica serovar Typhi Ty2
cucaccucccccg

SEQ ID NO: 3689966 - RNA, 14 nt, Salmonella enterica enterica serovar Typhi Ty2
cucaccugaugcga

SEQ ID NO: 3689967 - RNA, 22 nt, Salmonella enterica enterica serovar Typhi Ty2
cucaccuuuuuauuuacugccg

SEQ ID NO: 3689968 - RNA, 18 nt, Salmonella enterica enterica serovar Typhi Ty2
cucacgaauaagaaucag

SEQ ID NO: 3689969 - RNA, 24 nt, Salmonella enterica enterica serovar Typhi Ty2
cucacgaauaagaaucagaugcuc

SEQ ID NO: 3689970 - RNA, 18 nt, Salmonella enterica enterica serovar Typhi Ty2
cucacgcucauagccgcu

SEQ ID NO: 3689971 - RNA, 21 nt, Salmonella enterica enterica serovar Typhi Ty2
cucacgcuuaucgccaaacca

SEQ ID NO: 3689972 - RNA, 16 nt, Salmonella enterica enterica serovar Typhi Ty2
cucacggauauuaccc

SEQ ID NO: 3689973 - RNA, 19 nt, Salmonella enterica enterica serovar Typhi Ty2
cucacggcacgcccuucgu

SEQ ID NO: 3689974 - RNA, 22 nt, Salmonella enterica enterica serovar Typhi Ty2
cucacgggcguagucagcgacg

SEQ ID NO: 3689975 - RNA, 14 nt, Salmonella enterica enterica serovar Typhi Ty2
cucacguuccccag

SEQ ID NO: 3689976 - RNA, 18 nt, Salmonella enterica enterica serovar Typhi Ty2
cucacuuuucuuuccugc

SEQ ID NO: 3689977 - RNA, 20 nt, Salmonella enterica enterica serovar Typhi Ty2
cucagaaaauuauuuuaaau

SEQ ID NO: 3689978 - RNA, 22 nt, Salmonella enterica enterica serovar Typhi Ty2
cucagaccgaucucaugcaacu

SEQ ID NO: 3689979 - RNA, 17 nt, Salmonella enterica enterica serovar Typhi Ty2
cucagaucggcagacag

SEQ ID NO: 3689980 - RNA, 22 nt, Salmonella enterica enterica serovar Typhi Ty2
cucagcaggcgggcuuuuuuug

SEQ ID NO: 3689981 - RNA, 23 nt, Salmonella enterica enterica serovar Typhi Ty2
cucagcauagcgcugaaacggga

SEQ ID NO: 3689982 - RNA, 18 nt, Salmonella enterica enterica serovar Typhi Ty2
cucagcauuggugagaga

SEQ ID NO: 3689983 - RNA, 16 nt, Salmonella enterica enterica serovar Typhi Ty2
cucagccagaaacggu

SEQ ID NO: 3689984 - RNA, 22 nt, Salmonella enterica enterica serovar Typhi Ty2
cucagcgccguagcggcaggga

SEQ ID NO: 3689985 - RNA, 13 nt, Salmonella enterica enterica serovar Typhi Ty2
cucagcggcggcg

SEQ ID NO: 3689986 - RNA, 20 nt, Salmonella enterica enterica serovar Typhi Ty2
cucagcuaaaaacagcgcaa

SEQ ID NO: 3689987 - RNA, 13 nt, Salmonella enterica enterica serovar Typhi Ty2
cucaggaaaacaa

SEQ ID NO: 3689988 - RNA, 19 nt, Salmonella enterica enterica serovar Typhi Ty2
cucaggaaaacaaauugca

SEQ ID NO: 3689989 - RNA, 11 nt, Salmonella enterica enterica serovar Typhi Ty2
cucaggacgcc

SEQ ID NO: 3689990 - RNA, 13 nt, Salmonella enterica enterica serovar Typhi Ty2
cucaggacgccag

SEQ ID NO: 3689991 - RNA, 15 nt, Salmonella enterica enterica serovar Typhi Ty2
cucaggacgccagug

SEQ ID NO: 3689992 - RNA, 22 nt, Salmonella enterica enterica serovar Typhi Ty2
cucaggcaacacgacaaaagca

SEQ ID NO: 3689993 - RNA, 18 nt, Salmonella enterica enterica serovar Typhi Ty2
cucaggccggauaaggcg

SEQ ID NO: 3689994 - RNA, 22 nt, Salmonella enterica enterica serovar Typhi Ty2
cucaggcggggaguggugaucg

SEQ ID NO: 3689995 - RNA, 18 nt, Salmonella enterica enterica serovar Typhi Ty2
cucagggcaaaaaugauc

SEQ ID NO: 3689996 - RNA, 17 nt, Salmonella enterica enterica serovar Typhi Ty2
cucagggucagaauaca

SEQ ID NO: 3689997 - RNA, 21 nt, Salmonella enterica enterica serovar Typhi Ty2
cucaggguuuuacgcuggaca

SEQ ID NO: 3689998 - RNA, 22 nt, Salmonella enterica enterica serovar Typhi Ty2
cucagguuauacugugacgaca

SEQ ID NO: 3689999 - RNA, 19 nt, Salmonella enterica enterica serovar Typhi Ty2
cucagguuauauuccgccu

SEQ ID NO: 3690000 - RNA, 16 nt, Salmonella enterica enterica serovar Typhi Ty2
cucaguccagccgccg

SEQ ID NO: 3690001 - RNA, 19 nt, Salmonella enterica enterica serovar Typhi Ty2
cucaguugguuagagcaca

SEQ ID NO: 3690002 - RNA, 17 nt, Salmonella enterica enterica serovar Typhi Ty2
cucauaaaacauuccug

SEQ ID NO: 3690003 - RNA, 18 nt, Salmonella enterica enterica serovar Typhi Ty2
cucauaacggcuacgcag

SEQ ID NO: 3690004 - RNA, 19 nt, Salmonella enterica enterica serovar Typhi Ty2
cucauacagcccgcgcaga

SEQ ID NO: 3690005 - RNA, 15 nt, Salmonella enterica enterica serovar Typhi Ty2
cucauacccuuccag

SEQ ID NO: 3690006 - RNA, 15 nt, Salmonella enterica enterica serovar Typhi Ty2
cucauacgcuuucug

SEQ ID NO: 3690007 - RNA, 16 nt, Salmonella enterica enterica serovar Typhi Ty2
cucauagccgcuuucc

SEQ ID NO: 3690008 - RNA, 15 nt, Salmonella enterica enterica serovar Typhi Ty2
cucauauacccugcg

SEQ ID NO: 3690009 - RNA, 16 nt, Salmonella enterica enterica serovar Typhi Ty2
cucaucaaacagcggc

SEQ ID NO: 3690010 - RNA, 21 nt, Salmonella enterica enterica serovar Typhi Ty2
cucaucaauggauuuauggca

SEQ ID NO: 3690011 - RNA, 22 nt, Salmonella enterica enterica serovar Typhi Ty2
cucaucaauucuuuaauuugug

SEQ ID NO: 3690012 - RNA, 13 nt, Salmonella enterica enterica serovar Typhi Ty2
cucaucacagcca

SEQ ID NO: 3690013 - RNA, 18 nt, Salmonella enterica enterica serovar Typhi Ty2
cucccaggccgccaccgc

SEQ ID NO: 3690014 - RNA, 23 nt, Salmonella enterica enterica serovar Typhi Ty2
cucccaggccgccaccgccucgc

SEQ ID NO: 3690015 - RNA, 17 nt, Salmonella enterica enterica serovar Typhi Ty2
cucccaggcgcgcagcu

SEQ ID NO: 3690016 - RNA, 15 nt, Salmonella enterica enterica serovar Typhi Ty2
cucccauacccaggu

SEQ ID NO: 3690017 - RNA, 16 nt, Salmonella enterica enterica serovar Typhi Ty2
cuccccaaccgccagc

SEQ ID NO: 3690018 - RNA, 20 nt, Salmonella enterica enterica serovar Typhi Ty2
cuccccacaaucccgccaga

SEQ ID NO: 3690019 - RNA, 12 nt, Salmonella enterica enterica serovar Typhi Ty2
cuccccacauau

SEQ ID NO: 3690020 - RNA, 18 nt, Salmonella enterica enterica serovar Typhi Ty2
cuccccacgaaagucugu

SEQ ID NO: 3690021 - RNA, 12 nt, Salmonella enterica enterica serovar Typhi Ty2
cuccccagaaug

SEQ ID NO: 3690022 - RNA, 21 nt, Salmonella enterica enterica serovar Typhi Ty2
cuccccaggcgcuauucccag

SEQ ID NO: 3690023 - RNA, 23 nt, Salmonella enterica enterica serovar Typhi Ty2
cuccccaggcgcuauucccaggc

SEQ ID NO: 3690024 - RNA, 18 nt, Salmonella enterica enterica serovar Typhi Ty2
cucccccaccgacacaaa

SEQ ID NO: 3690025 - RNA, 14 nt, Salmonella enterica enterica serovar Typhi Ty2
cucccccggcacca

SEQ ID NO: 3690026 - RNA, 18 nt, Salmonella enterica enterica serovar Typhi Ty2
cucccccggcaccacgca

SEQ ID NO: 3690027 - RNA, 21 nt, Salmonella enterica enterica serovar Typhi Ty2
cuccccggcuugcggggagaa

SEQ ID NO: 3690028 - RNA, 22 nt, Salmonella enterica enterica serovar Typhi Ty2
cuccccugucguuaaugggauc

SEQ ID NO: 3690029 - RNA, 15 nt, Salmonella enterica enterica serovar Typhi Ty2
cuccccuuuuuuacu

SEQ ID NO: 3690030 - RNA, 16 nt, Salmonella enterica enterica serovar Typhi Ty2
cucccgcagccacucc

SEQ ID NO: 3690031 - RNA, 13 nt, Salmonella enterica enterica serovar Typhi Ty2
cucccggcgcugg

SEQ ID NO: 3690032 - RNA, 17 nt, Salmonella enterica enterica serovar Typhi Ty2
cucccgucgccuguuuc

SEQ ID NO: 3690033 - RNA, 20 nt, Salmonella enterica enterica serovar Typhi Ty2
cucccguuucgacgggaggu

SEQ ID NO: 3690034 - RNA, 13 nt, Salmonella enterica enterica serovar Typhi Ty2
cucccucaaccag

SEQ ID NO: 3690035 - RNA, 16 nt, Salmonella enterica enterica serovar Typhi Ty2
cucccucacccuucac

SEQ ID NO: 3690036 - RNA, 18 nt, Salmonella enterica enterica serovar Typhi Ty2
cucccugagucuugccug

SEQ ID NO: 3690037 - RNA, 20 nt, Salmonella enterica enterica serovar Typhi Ty2
cucccugagucuugccuguc

SEQ ID NO: 3690038 - RNA, 18 nt, Salmonella enterica enterica serovar Typhi Ty2
cucccugccuaaagaaaa

SEQ ID NO: 3690039 - RNA, 12 nt, Salmonella enterica enterica serovar Typhi Ty2
cucccuggcagu

SEQ ID NO: 3690040 - RNA, 20 nt, Salmonella enterica enterica serovar Typhi Ty2
cucccuuauacaggcgcagg

SEQ ID NO: 3690041 - RNA, 19 nt, Salmonella enterica enterica serovar Typhi Ty2
cuccgaauaauccuucccg

SEQ ID NO: 3690042 - RNA, 21 nt, Salmonella enterica enterica serovar Typhi Ty2
cuccgaauaauccuucccgcu

SEQ ID NO: 3690043 - RNA, 12 nt, Salmonella enterica enterica serovar Typhi Ty2
cuccgacaacaa

SEQ ID NO: 3690044 - RNA, 23 nt, Salmonella enterica enterica serovar Typhi Ty2
cuccgcaaagcccaucagcgcca

SEQ ID NO: 3690045 - RNA, 13 nt, Salmonella enterica enterica serovar Typhi Ty2
cuccgccagcaau

SEQ ID NO: 3690046 - RNA, 21 nt, Salmonella enterica enterica serovar Typhi Ty2
cuccgccagcaaugccgccgc

SEQ ID NO: 3690047 - RNA, 16 nt, Salmonella enterica enterica serovar Typhi Ty2
cuccgccaucgcgcaa

SEQ ID NO: 3690048 - RNA, 14 nt, Salmonella enterica enterica serovar Typhi Ty2
cuccgccugcgguu

SEQ ID NO: 3690049 - RNA, 20 nt, Salmonella enterica enterica serovar Typhi Ty2
cuccgcgacgaccugcauau

SEQ ID NO: 3690050 - RNA, 16 nt, Salmonella enterica enterica serovar Typhi Ty2
cuccgcgagcagccaa

SEQ ID NO: 3690051 - RNA, 14 nt, Salmonella enterica enterica serovar Typhi Ty2
cuccgcgcauguaa

SEQ ID NO: 3690052 - RNA, 19 nt, Salmonella enterica enterica serovar Typhi Ty2
cuccgcgcauguaaccaaa

SEQ ID NO: 3690053 - RNA, 21 nt, Salmonella enterica enterica serovar Typhi Ty2
cuccgcgcauguaaccaaagc

SEQ ID NO: 3690054 - RNA, 13 nt, Salmonella enterica enterica serovar Typhi Ty2
cuccgcgcuggca

SEQ ID NO: 3690055 - RNA, 16 nt, Salmonella enterica enterica serovar Typhi Ty2
cuccgcggggaucggu

SEQ ID NO: 3690056 - RNA, 19 nt, Salmonella enterica enterica serovar Typhi Ty2
cuccgcguaccucagcaug

SEQ ID NO: 3690057 - RNA, 20 nt, Salmonella enterica enterica serovar Typhi Ty2
cuccgcguaccucagcaugu

SEQ ID NO: 3690058 - RNA, 15 nt, Salmonella enterica enterica serovar Typhi Ty2
cuccgcguagcccag

SEQ ID NO: 3690059 - RNA, 11 nt, Salmonella enterica enterica serovar Typhi Ty2
cuccggcacca

SEQ ID NO: 3690060 - RNA, 12 nt, Salmonella enterica enterica serovar Typhi Ty2
cuccggcagcau

SEQ ID NO: 3690061 - RNA, 20 nt, Salmonella enterica enterica serovar Typhi Ty2
cuccggcagcguauugagcu

SEQ ID NO: 3690062 - RNA, 18 nt, Salmonella enterica enterica serovar Typhi Ty2
cuccggcaggcaaaucug

SEQ ID NO: 3690063 - RNA, 23 nt, Salmonella enterica enterica serovar Typhi Ty2
cuccggcaucuuaaagcgggcuu

SEQ ID NO: 3690064 - RNA, 15 nt, Salmonella enterica enterica serovar Typhi Ty2
cuccggccagcgcca

SEQ ID NO: 3690065 - RNA, 14 nt, Salmonella enterica enterica serovar Typhi Ty2
cuccggcgcgcgcg

SEQ ID NO: 3690066 - RNA, 17 nt, Salmonella enterica enterica serovar Typhi Ty2
cuccggcgcgcgcgcca

SEQ ID NO: 3690067 - RNA, 15 nt, Salmonella enterica enterica serovar Typhi Ty2
cuccggcguaaaggc

SEQ ID NO: 3690068 - RNA, 20 nt, Salmonella enterica enterica serovar Typhi Ty2
cuccggcuaugccggaggau

SEQ ID NO: 3690069 - RNA, 19 nt, Salmonella enterica enterica serovar Typhi Ty2
cuccgggauagcaaucucg

SEQ ID NO: 3690070 - RNA, 23 nt, Salmonella enterica enterica serovar Typhi Ty2
cuccgggauagcaaucucgccaa

SEQ ID NO: 3690071 - RNA, 23 nt, Salmonella enterica enterica serovar Typhi Ty2
cuccggguaacggacucaggccu

SEQ ID NO: 3690072 - RNA, 21 nt, Salmonella enterica enterica serovar Typhi Ty2
cuccgguaucgccggcagacg

SEQ ID NO: 3690073 - RNA, 21 nt, Salmonella enterica enterica serovar Typhi Ty2
cuccggucccagaugcgccag

SEQ ID NO: 3690074 - RNA, 15 nt, Salmonella enterica enterica serovar Typhi Ty2
cuccuaagagaaaac

SEQ ID NO: 3690075 - RNA, 15 nt, Salmonella enterica enterica serovar Typhi Ty2
cuccucaacagacau

SEQ ID NO: 3690076 - RNA, 12 nt, Salmonella enterica enterica serovar Typhi Ty2
cuccucagcagg

SEQ ID NO: 3690077 - RNA, 13 nt, Salmonella enterica enterica serovar Typhi Ty2
cuccuccggcuuc

SEQ ID NO: 3690078 - RNA, 22 nt, Salmonella enterica enterica serovar Typhi Ty2
cuccuccgguuucaacugucga

SEQ ID NO: 3690079 - RNA, 14 nt, Salmonella enterica enterica serovar Typhi Ty2
cuccucuuccgaca

SEQ ID NO: 3690080 - RNA, 22 nt, Salmonella enterica enterica serovar Typhi Ty2
cuccugaaucgccgucagugag

SEQ ID NO: 3690081 - RNA, 20 nt, Salmonella enterica enterica serovar Typhi Ty2
cuccugacauagcucacgca

SEQ ID NO: 3690082 - RNA, 21 nt, Salmonella enterica enterica serovar Typhi Ty2
cuccugauaaccuauuuugca

SEQ ID NO: 3690083 - RNA, 21 nt, Salmonella enterica enterica serovar Typhi Ty2
cuccugcaaucguucuugcac

SEQ ID NO: 3690084 - RNA, 12 nt, Salmonella enterica enterica serovar Typhi Ty2
cuccugcauuug

SEQ ID NO: 3690085 - RNA, 23 nt, Salmonella enterica enterica serovar Typhi Ty2
cuccugccugacaaugacgcuuc

SEQ ID NO: 3690086 - RNA, 15 nt, Salmonella enterica enterica serovar Typhi Ty2
cuccugcgauagcug

SEQ ID NO: 3690087 - RNA, 15 nt, Salmonella enterica enterica serovar Typhi Ty2
cuccugcgccagccg

SEQ ID NO: 3690088 - RNA, 15 nt, Salmonella enterica enterica serovar Typhi Ty2
cuccugcggccuugc

SEQ ID NO: 3690089 - RNA, 13 nt, Salmonella enterica enterica serovar Typhi Ty2
cuccugcucccag

SEQ ID NO: 3690090 - RNA, 16 nt, Salmonella enterica enterica serovar Typhi Ty2
cuccuggauuuuaccu

SEQ ID NO: 3690091 - RNA, 22 nt, Salmonella enterica enterica serovar Typhi Ty2
cuccuggcauggcucgccgcug

SEQ ID NO: 3690092 - RNA, 18 nt, Salmonella enterica enterica serovar Typhi Ty2
cuccuggcuuaccugcuc

SEQ ID NO: 3690093 - RNA, 17 nt, Salmonella enterica enterica serovar Typhi Ty2
cuccuguaagucaggua

SEQ ID NO: 3690094 - RNA, 14 nt, Salmonella enterica enterica serovar Typhi Ty2
cuccugucaggcga

SEQ ID NO: 3690095 - RNA, 20 nt, Salmonella enterica enterica serovar Typhi Ty2
cucuaucuuuucaaucaggu

SEQ ID NO: 3690096 - RNA, 18 nt, Salmonella enterica enterica serovar Typhi Ty2
cucuaugaaugccggaug

SEQ ID NO: 3690097 - RNA, 19 nt, Salmonella enterica enterica serovar Typhi Ty2
cucuauugauuggcaagaa

SEQ ID NO: 3690098 - RNA, 16 nt, Salmonella enterica enterica serovar Typhi Ty2
cucucaccgccuaggc

SEQ ID NO: 3690099 - RNA, 23 nt, Salmonella enterica enterica serovar Typhi Ty2
cucucaccgccuaggccagugcc

SEQ ID NO: 3690100 - RNA, 22 nt, Salmonella enterica enterica serovar Typhi Ty2
cucucauagccgacccgcaucg

SEQ ID NO: 3690101 - RNA, 13 nt, Salmonella enterica enterica serovar Typhi Ty2
cucucauauucca

SEQ ID NO: 3690102 - RNA, 14 nt, Salmonella enterica enterica serovar Typhi Ty2
cucucauuuucuuu

SEQ ID NO: 3690103 - RNA, 17 nt, Salmonella enterica enterica serovar Typhi Ty2
cucuccagcaggguauu

SEQ ID NO: 3690104 - RNA, 20 nt, Salmonella enterica enterica serovar Typhi Ty2
cucucccccaccgacacaaa

SEQ ID NO: 3690105 - RNA, 19 nt, Salmonella enterica enterica serovar Typhi Ty2
cucucgccgcgcuccauca

SEQ ID NO: 3690106 - RNA, 20 nt, Salmonella enterica enterica serovar Typhi Ty2
cucucgugcaggccggauaa

SEQ ID NO: 3690107 - RNA, 15 nt, Salmonella enterica enterica serovar Typhi Ty2
cucucguucccgccu

SEQ ID NO: 3690108 - RNA, 21 nt, Salmonella enterica enterica serovar Typhi Ty2
cucucguucccgccugcugca

SEQ ID NO: 3690109 - RNA, 19 nt, Salmonella enterica enterica serovar Typhi Ty2
cucucucaaacuauuuuua

SEQ ID NO: 3690110 - RNA, 21 nt, Salmonella enterica enterica serovar Typhi Ty2
cucucuggcgcauuccagacc

SEQ ID NO: 3690111 - RNA, 16 nt, Salmonella enterica enterica serovar Typhi Ty2
cucucuucgugacccg

SEQ ID NO: 3690112 - RNA, 19 nt, Salmonella enterica enterica serovar Typhi Ty2
cucucuuucaccagcgcca

SEQ ID NO: 3690113 - RNA, 20 nt, Salmonella enterica enterica serovar Typhi Ty2
cucucuuucaccagcgccag

SEQ ID NO: 3690114 - RNA, 15 nt, Salmonella enterica enterica serovar Typhi Ty2
cucucuuucugccua

SEQ ID NO: 3690115 - RNA, 19 nt, Salmonella enterica enterica serovar Typhi Ty2
cucugaaacgcuucaccgg

SEQ ID NO: 3690116 - RNA, 16 nt, Salmonella enterica enterica serovar Typhi Ty2
cucugaaucucuuccc

SEQ ID NO: 3690117 - RNA, 20 nt, Salmonella enterica enterica serovar Typhi Ty2
cucugauuucgacgauaaaa

SEQ ID NO: 3690118 - RNA, 23 nt, Salmonella enterica enterica serovar Typhi Ty2
cucugauuucgacgauaaaaaaa

SEQ ID NO: 3690119 - RNA, 20 nt, Salmonella enterica enterica serovar Typhi Ty2
cucugccgguugaccggccc

SEQ ID NO: 3690120 - RNA, 17 nt, Salmonella enterica enterica serovar Typhi Ty2
cucugcgccuuuuaccu

SEQ ID NO: 3690121 - RNA, 22 nt, Salmonella enterica enterica serovar Typhi Ty2
cucugcgcguaaacgcaacacc

SEQ ID NO: 3690122 - RNA, 19 nt, Salmonella enterica enterica serovar Typhi Ty2
cucugcugugccaguaccg

SEQ ID NO: 3690123 - RNA, 20 nt, Salmonella enterica enterica serovar Typhi Ty2
cucugcuuuucucacaauaa

SEQ ID NO: 3690124 - RNA, 20 nt, Salmonella enterica enterica serovar Typhi Ty2
cucugguaguuguaauaaac

SEQ ID NO: 3690125 - RNA, 22 nt, Salmonella enterica enterica serovar Typhi Ty2
cucugguaguuguaauaaacag

SEQ ID NO: 3690126 - RNA, 16 nt, Salmonella enterica enterica serovar Typhi Ty2
cucuguccacacaggc

SEQ ID NO: 3690127 - RNA, 14 nt, Salmonella enterica enterica serovar Typhi Ty2
cucugucgccgccc

SEQ ID NO: 3690128 - RNA, 15 nt, Salmonella enterica enterica serovar Typhi Ty2
cucugucgccgcccg

SEQ ID NO: 3690129 - RNA, 18 nt, Salmonella enterica enterica serovar Typhi Ty2
cucuuaccgcuaaaauac

SEQ ID NO: 3690130 - RNA, 15 nt, Salmonella enterica enterica serovar Typhi Ty2
cucuuacguugcauu

SEQ ID NO: 3690131 - RNA, 15 nt, Salmonella enterica enterica serovar Typhi Ty2
cucuuaucgugcgcg

SEQ ID NO: 3690132 - RNA, 23 nt, Salmonella enterica enterica serovar Typhi Ty2
cucuucaauuuccaucuguaaca

SEQ ID NO: 3690133 - RNA, 20 nt, Salmonella enterica enterica serovar Typhi Ty2
cucuucaguaaccagggagg

SEQ ID NO: 3690134 - RNA, 22 nt, Salmonella enterica enterica serovar Typhi Ty2
cucuucaguaagcguaccauuc

SEQ ID NO: 3690135 - RNA, 16 nt, Salmonella enterica enterica serovar Typhi Ty2
cucuucaucgcgccuc

SEQ ID NO: 3690136 - RNA, 16 nt, Salmonella enterica enterica serovar Typhi Ty2
cucuucaucuguggca

SEQ ID NO: 3690137 - RNA, 13 nt, Salmonella enterica enterica serovar Typhi Ty2
cucuuccaccauc

SEQ ID NO: 3690138 - RNA, 15 nt, Salmonella enterica enterica serovar Typhi Ty2
cucuuccagcgccaa

SEQ ID NO: 3690139 - RNA, 15 nt, Salmonella enterica enterica serovar Typhi Ty2
cucuuccaucagcca

SEQ ID NO: 3690140 - RNA, 17 nt, Salmonella enterica enterica serovar Typhi Ty2
cucuuccggcauaaaaa

SEQ ID NO: 3690141 - RNA, 17 nt, Salmonella enterica enterica serovar Typhi Ty2
cucuuccuccccaggcg

SEQ ID NO: 3690142 - RNA, 14 nt, Salmonella enterica enterica serovar Typhi Ty2
cucuucgacacauu

SEQ ID NO: 3690143 - RNA, 16 nt, Salmonella enterica enterica serovar Typhi Ty2
cucuucgacaucuuca

SEQ ID NO: 3690144 - RNA, 12 nt, Salmonella enterica enterica serovar Typhi Ty2
cucuucgccaau

SEQ ID NO: 3690145 - RNA, 18 nt, Salmonella enterica enterica serovar Typhi Ty2
cucuucgggaucaauuuu

SEQ ID NO: 3690146 - RNA, 16 nt, Salmonella enterica enterica serovar Typhi Ty2
cucuucguuauuuucc

SEQ ID NO: 3690147 - RNA, 15 nt, Salmonella enterica enterica serovar Typhi Ty2
cucuucguucauccg

SEQ ID NO: 3690148 - RNA, 16 nt, Salmonella enterica enterica serovar Typhi Ty2
cucuucugaccaucuu

SEQ ID NO: 3690149 - RNA, 16 nt, Salmonella enterica enterica serovar Typhi Ty2
cucuucuuccggcgau

SEQ ID NO: 3690150 - RNA, 22 nt, Salmonella enterica enterica serovar Typhi Ty2
cucuucuuccggcgauagcggc

SEQ ID NO: 3690151 - RNA, 20 nt, Salmonella enterica enterica serovar Typhi Ty2
cucuucuuugagcucccggu

SEQ ID NO: 3690152 - RNA, 13 nt, Salmonella enterica enterica serovar Typhi Ty2
cucuucuuuuaau

SEQ ID NO: 3690153 - RNA, 20 nt, Salmonella enterica enterica serovar Typhi Ty2
cucuucuuuuaauugccagg

SEQ ID NO: 3690154 - RNA, 17 nt, Salmonella enterica enterica serovar Typhi Ty2
cucuucuuuuacaagaa

SEQ ID NO: 3690155 - RNA, 15 nt, Salmonella enterica enterica serovar Typhi Ty2
cucuuggucauaaua

SEQ ID NO: 3690156 - RNA, 13 nt, Salmonella enterica enterica serovar Typhi Ty2
cucuuuaaagcgc

SEQ ID NO: 3690157 - RNA, 13 nt, Salmonella enterica enterica serovar Typhi Ty2
cucuuuaacaauu

SEQ ID NO: 3690158 - RNA, 21 nt, Salmonella enterica enterica serovar Typhi Ty2
cucuuuaaugauguccagaau

SEQ ID NO: 3690159 - RNA, 16 nt, Salmonella enterica enterica serovar Typhi Ty2
cucuuuauugcuggug

SEQ ID NO: 3690160 - RNA, 21 nt, Salmonella enterica enterica serovar Typhi Ty2
cucuuucaccagcgccagaau

SEQ ID NO: 3690161 - RNA, 13 nt, Salmonella enterica enterica serovar Typhi Ty2
cucuuucagacca

SEQ ID NO: 3690162 - RNA, 17 nt, Salmonella enterica enterica serovar Typhi Ty2
cucuuucauuucugccu

SEQ ID NO: 3690163 - RNA, 20 nt, Salmonella enterica enterica serovar Typhi Ty2
cucuuucgguagccacagau

SEQ ID NO: 3690164 - RNA, 21 nt, Salmonella enterica enterica serovar Typhi Ty2
cucuuugaacagccagaagcc

SEQ ID NO: 3690165 - RNA, 15 nt, Salmonella enterica enterica serovar Typhi Ty2
cucuuuguuggcugc

SEQ ID NO: 3690166 - RNA, 16 nt, Salmonella enterica enterica serovar Typhi Ty2
cucuuuuaauuuucug

SEQ ID NO: 3690167 - RNA, 17 nt, Salmonella enterica enterica serovar Typhi Ty2
cucuuuuaauuuucugu

SEQ ID NO: 3690168 - RNA, 15 nt, Salmonella enterica enterica serovar Typhi Ty2
cucuuuugcauuaca

SEQ ID NO: 3690169 - RNA, 20 nt, Salmonella enterica enterica serovar Typhi Ty2
cucuuuuucauagaaccacu

SEQ ID NO: 3690170 - RNA, 20 nt, Salmonella enterica enterica serovar Typhi Ty2
cucuuuuuccgccugaucuu

SEQ ID NO: 3690171 - RNA, 12 nt, Salmonella enterica enterica serovar Typhi Ty2
cugaaaaagaac

SEQ ID NO: 3690172 - RNA, 12 nt, Salmonella enterica enterica serovar Typhi Ty2
cugaaaaagggu

SEQ ID NO: 3690173 - RNA, 20 nt, Salmonella enterica enterica serovar Typhi Ty2
cugaaaaaggguaacgggac

SEQ ID NO: 3690174 - RNA, 14 nt, Salmonella enterica enterica serovar Typhi Ty2
cugaaaacagaaau

SEQ ID NO: 3690175 - RNA, 15 nt, Salmonella enterica enterica serovar Typhi Ty2
cugaaaacaggccug

SEQ ID NO: 3690176 - RNA, 14 nt, Salmonella enterica enterica serovar Typhi Ty2
cugaaaaucaaaaa

SEQ ID NO: 3690177 - RNA, 16 nt, Salmonella enterica enterica serovar Typhi Ty2
cugacgaaaaccgucc

SEQ ID NO: 3690178 - RNA, 17 nt, Salmonella enterica enterica serovar Typhi Ty2
cugacgaauagcgcgcu

SEQ ID NO: 3690179 - RNA, 17 nt, Salmonella enterica enterica serovar Typhi Ty2
cugacgacgccagcccu

SEQ ID NO: 3690180 - RNA, 16 nt, Salmonella enterica enterica serovar Typhi Ty2
cugacgauaucgucac

SEQ ID NO: 3690181 - RNA, 16 nt, Salmonella enterica enterica serovar Typhi Ty2
cugacgcagcaguucc

SEQ ID NO: 3690182 - RNA, 19 nt, Salmonella enterica enterica serovar Typhi Ty2
cugacgcagcaguuccccg

SEQ ID NO: 3690183 - RNA, 16 nt, Salmonella enterica enterica serovar Typhi Ty2
cugacgccaggccauc

SEQ ID NO: 3690184 - RNA, 16 nt, Salmonella enterica enterica serovar Typhi Ty2
cugacgccugaaaugc

SEQ ID NO: 3690185 - RNA, 20 nt, Salmonella enterica enterica serovar Typhi Ty2
cugacgcgaugacggcgcgu

SEQ ID NO: 3690186 - RNA, 20 nt, Salmonella enterica enterica serovar Typhi Ty2
cugacgcgcagcgauauagc

SEQ ID NO: 3690187 - RNA, 13 nt, Salmonella enterica enterica serovar Typhi Ty2
cugacgcgccugg

SEQ ID NO: 3690188 - RNA, 22 nt, Salmonella enterica enterica serovar Typhi Ty2
cugacgcguuuuuucaugaauc

SEQ ID NO: 3690189 - RNA, 19 nt, Salmonella enterica enterica serovar Typhi Ty2
cugacgggcauuguuaauc

SEQ ID NO: 3690190 - RNA, 21 nt, Salmonella enterica enterica serovar Typhi Ty2
cugacgggcauuguuaaucca

SEQ ID NO: 3690191 - RNA, 18 nt, Salmonella enterica enterica serovar Typhi Ty2
cugacggugguaaaucag

SEQ ID NO: 3690192 - RNA, 17 nt, Salmonella enterica enterica serovar Typhi Ty2
cugacguagauucugau

SEQ ID NO: 3690193 - RNA, 14 nt, Salmonella enterica enterica serovar Typhi Ty2
cugacguuucucau

SEQ ID NO: 3690194 - RNA, 19 nt, Salmonella enterica enterica serovar Typhi Ty2
cugacuacgguugccuuuc

SEQ ID NO: 3690195 - RNA, 13 nt, Salmonella enterica enterica serovar Typhi Ty2
cugacuauccaca

SEQ ID NO: 3690196 - RNA, 15 nt, Salmonella enterica enterica serovar Typhi Ty2
cugacuauccacagc

SEQ ID NO: 3690197 - RNA, 15 nt, Salmonella enterica enterica serovar Typhi Ty2
cugacuaucuggaua

SEQ ID NO: 3690198 - RNA, 18 nt, Salmonella enterica enterica serovar Typhi Ty2
cugacugcaaaucugccg

SEQ ID NO: 3690199 - RNA, 22 nt, Salmonella enterica enterica serovar Typhi Ty2
cugacugccguauaauccagcu

SEQ ID NO: 3690200 - RNA, 19 nt, Salmonella enterica enterica serovar Typhi Ty2
cugacuuacaggcuggaaa

SEQ ID NO: 3690201 - RNA, 13 nt, Salmonella enterica enterica serovar Typhi Ty2
cugagaaaaauac

SEQ ID NO: 3690202 - RNA, 20 nt, Salmonella enterica enterica serovar Typhi Ty2
cugagaaaaauacgccagau

SEQ ID NO: 3690203 - RNA, 20 nt, Salmonella enterica enterica serovar Typhi Ty2
cugagaaaagggcgcaccaa

SEQ ID NO: 3690204 - RNA, 13 nt, Salmonella enterica enterica serovar Typhi Ty2
cugagaaggucag

SEQ ID NO: 3690205 - RNA, 19 nt, Salmonella enterica enterica serovar Typhi Ty2
cugagacucagcagcgcau

SEQ ID NO: 3690206 - RNA, 18 nt, Salmonella enterica enterica serovar Typhi Ty2
cugagaucaaacaagaga

SEQ ID NO: 3690207 - RNA, 23 nt, Salmonella enterica enterica serovar Typhi Ty2
cugagauggcacgauaaccagau

SEQ ID NO: 3690208 - RNA, 16 nt, Salmonella enterica enterica serovar Typhi Ty2
cugagauggcgccauu

SEQ ID NO: 3690209 - RNA, 14 nt, Salmonella enterica enterica serovar Typhi Ty2
cugagccgcccggc

SEQ ID NO: 3690210 - RNA, 17 nt, Salmonella enterica enterica serovar Typhi Ty2
cugagcgccgccaagau

SEQ ID NO: 3690211 - RNA, 19 nt, Salmonella enterica enterica serovar Typhi Ty2
cugagcgcgagcaugugua

SEQ ID NO: 3690212 - RNA, 12 nt, Salmonella enterica enterica serovar Typhi Ty2
cugagcgcgcag

SEQ ID NO: 3690213 - RNA, 19 nt, Salmonella enterica enterica serovar Typhi Ty2
cugagcggcucauccagca

SEQ ID NO: 3690214 - RNA, 14 nt, Salmonella enterica enterica serovar Typhi Ty2
cugagcuaacgacc

SEQ ID NO: 3690215 - RNA, 16 nt, Salmonella enterica enterica serovar Typhi Ty2
cugagcucacuuuuug

SEQ ID NO: 3690216 - RNA, 14 nt, Salmonella enterica enterica serovar Typhi Ty2
cugaggcgacaauc

SEQ ID NO: 3690217 - RNA, 20 nt, Salmonella enterica enterica serovar Typhi Ty2
cugaggcguugcuccagcag

SEQ ID NO: 3690218 - RNA, 18 nt, Salmonella enterica enterica serovar Typhi Ty2
cugaggcuauugucauug

SEQ ID NO: 3690219 - RNA, 21 nt, Salmonella enterica enterica serovar Typhi Ty2
cugaguaaugaucauaccggc

SEQ ID NO: 3690220 - RNA, 20 nt, Salmonella enterica enterica serovar Typhi Ty2
cugaguauaaaacucgccgc

SEQ ID NO: 3690221 - RNA, 17 nt, Salmonella enterica enterica serovar Typhi Ty2
cugagugacgggcuggc

SEQ ID NO: 3690222 - RNA, 20 nt, Salmonella enterica enterica serovar Typhi Ty2
cugaguuaaugccaucauca

SEQ ID NO: 3690223 - RNA, 17 nt, Salmonella enterica enterica serovar Typhi Ty2
cugaguuuagccagcag

SEQ ID NO: 3690224 - RNA, 20 nt, Salmonella enterica enterica serovar Typhi Ty2
cugauaaagcuuucaucuuu

SEQ ID NO: 3690225 - RNA, 18 nt, Salmonella enterica enterica serovar Typhi Ty2
cugauaacgauaagugaa

SEQ ID NO: 3690226 - RNA, 17 nt, Salmonella enterica enterica serovar Typhi Ty2
cugauaacgugcgcgug

SEQ ID NO: 3690227 - RNA, 20 nt, Salmonella enterica enterica serovar Typhi Ty2
cugauaagacugauauccau

SEQ ID NO: 3690228 - RNA, 14 nt, Salmonella enterica enterica serovar Typhi Ty2
cugauaagcacagg

SEQ ID NO: 3690229 - RNA, 17 nt, Salmonella enterica enterica serovar Typhi Ty2
cugauaagcauagcgcc

SEQ ID NO: 3690230 - RNA, 18 nt, Salmonella enterica enterica serovar Typhi Ty2
cugauaagcgaagcgcca

SEQ ID NO: 3690231 - RNA, 17 nt, Salmonella enterica enterica serovar Typhi Ty2
cugauaagcgcagcgcc

SEQ ID NO: 3690232 - RNA, 18 nt, Salmonella enterica enterica serovar Typhi Ty2
cugauaagcgcagcgcca

SEQ ID NO: 3690233 - RNA, 19 nt, Salmonella enterica enterica serovar Typhi Ty2
cugauaagguaaagccgcc

SEQ ID NO: 3690234 - RNA, 23 nt, Salmonella enterica enterica serovar Typhi Ty2
cugauacuuauuacgguaucagc

SEQ ID NO: 3690235 - RNA, 16 nt, Salmonella enterica enterica serovar Typhi Ty2
cugauagcaaucaucc

SEQ ID NO: 3690236 - RNA, 17 nt, Salmonella enterica enterica serovar Typhi Ty2
cugauagcauuguaucc

SEQ ID NO: 3690237 - RNA, 21 nt, Salmonella enterica enterica serovar Typhi Ty2
cugauagcauuguauccagcc

SEQ ID NO: 3690238 - RNA, 19 nt, Salmonella enterica enterica serovar Typhi Ty2
cugauagcccauccagcac

SEQ ID NO: 3690239 - RNA, 13 nt, Salmonella enterica enterica serovar Typhi Ty2
cugauagcgggua

SEQ ID NO: 3690240 - RNA, 20 nt, Salmonella enterica enterica serovar Typhi Ty2
cugauagggacacauuucuu

SEQ ID NO: 3690241 - RNA, 14 nt, Salmonella enterica enterica serovar Typhi Ty2
cugauaguuuaaau

SEQ ID NO: 3690242 - RNA, 20 nt, Salmonella enterica enterica serovar Typhi Ty2
cugauaguuuaaauccagcg

SEQ ID NO: 3690243 - RNA, 15 nt, Salmonella enterica enterica serovar Typhi Ty2
cugauauaacccuca

SEQ ID NO: 3690244 - RNA, 20 nt, Salmonella enterica enterica serovar Typhi Ty2
cugauauuacuaauaaaauu

SEQ ID NO: 3690245 - RNA, 22 nt, Salmonella enterica enterica serovar Typhi Ty2
cugauauuacuaauaaaauuca

SEQ ID NO: 3690246 - RNA, 21 nt, Salmonella enterica enterica serovar Typhi Ty2
cugauauugcguaagcagcug

SEQ ID NO: 3690247 - RNA, 17 nt, Salmonella enterica enterica serovar Typhi Ty2
cugauauuuuacuuuuu

SEQ ID NO: 3690248 - RNA, 17 nt, Salmonella enterica enterica serovar Typhi Ty2
cugauccagcucuucuu

SEQ ID NO: 3690249 - RNA, 17 nt, Salmonella enterica enterica serovar Typhi Ty2
cugaucccacuuaggca

SEQ ID NO: 3690250 - RNA, 15 nt, Salmonella enterica enterica serovar Typhi Ty2
cugaucccgcgcgcc

SEQ ID NO: 3690251 - RNA, 20 nt, Salmonella enterica enterica serovar Typhi Ty2
cugauccggaauagagauag

SEQ ID NO: 3690252 - RNA, 18 nt, Salmonella enterica enterica serovar Typhi Ty2
cugauccuguaaaaaauc

SEQ ID NO: 3690253 - RNA, 20 nt, Salmonella enterica enterica serovar Typhi Ty2
cugaucgacgaaaucccggc

SEQ ID NO: 3690254 - RNA, 23 nt, Salmonella enterica enterica serovar Typhi Ty2
cugaucgaggacggccugacggu

SEQ ID NO: 3690255 - RNA, 18 nt, Salmonella enterica enterica serovar Typhi Ty2
cugaucgaggucgccaaa

SEQ ID NO: 3690256 - RNA, 17 nt, Salmonella enterica enterica serovar Typhi Ty2
cugaucgauccacuucc

SEQ ID NO: 3690257 - RNA, 16 nt, Salmonella enterica enterica serovar Typhi Ty2
cugaucgcgcagacag

SEQ ID NO: 3690258 - RNA, 19 nt, Salmonella enterica enterica serovar Typhi Ty2
cugaucggccagcgucgcu

SEQ ID NO: 3690259 - RNA, 13 nt, Salmonella enterica enterica serovar Typhi Ty2
cugcagcgccaga

SEQ ID NO: 3690260 - RNA, 15 nt, Salmonella enterica enterica serovar Typhi Ty2
cugcagcuccgcaau

SEQ ID NO: 3690261 - RNA, 14 nt, Salmonella enterica enterica serovar Typhi Ty2
cugcaggcgacuca

SEQ ID NO: 3690262 - RNA, 23 nt, Salmonella enterica enterica serovar Typhi Ty2
cugcaggcgggugcgcagcccca

SEQ ID NO: 3690263 - RNA, 22 nt, Salmonella enterica enterica serovar Typhi Ty2
cugcaggguuugcgcagacugc

SEQ ID NO: 3690264 - RNA, 14 nt, Salmonella enterica enterica serovar Typhi Ty2
cugcaggucacgau

SEQ ID NO: 3690265 - RNA, 15 nt, Salmonella enterica enterica serovar Typhi Ty2
cugcaguauuucaga

SEQ ID NO: 3690266 - RNA, 15 nt, Salmonella enterica enterica serovar Typhi Ty2
cugcauaauccaacg

SEQ ID NO: 3690267 - RNA, 21 nt, Salmonella enterica enterica serovar Typhi Ty2
cugcauacucacauucauaaa

SEQ ID NO: 3690268 - RNA, 15 nt, Salmonella enterica enterica serovar Typhi Ty2
cugcauauuuuucau

SEQ ID NO: 3690269 - RNA, 17 nt, Salmonella enterica enterica serovar Typhi Ty2
cugcauauuuuucauuc

SEQ ID NO: 3690270 - RNA, 19 nt, Salmonella enterica enterica serovar Typhi Ty2
cugcaucguuugcaguucc

SEQ ID NO: 3690271 - RNA, 21 nt, Salmonella enterica enterica serovar Typhi Ty2
cugccaaccauuaacuccgga

SEQ ID NO: 3690272 - RNA, 17 nt, Salmonella enterica enterica serovar Typhi Ty2
cugccacacucucucca

SEQ ID NO: 3690273 - RNA, 14 nt, Salmonella enterica enterica serovar Typhi Ty2
cugccacaggccaa

SEQ ID NO: 3690274 - RNA, 14 nt, Salmonella enterica enterica serovar Typhi Ty2
cugccacaucgcca

SEQ ID NO: 3690275 - RNA, 16 nt, Salmonella enterica enterica serovar Typhi Ty2
cugccacaucgccagc

SEQ ID NO: 3690276 - RNA, 20 nt, Salmonella enterica enterica serovar Typhi Ty2
cugccacgcuuuuccuucca

SEQ ID NO: 3690277 - RNA, 20 nt, Salmonella enterica enterica serovar Typhi Ty2
cugccagcaaggcaagaaag

SEQ ID NO: 3690278 - RNA, 21 nt, Salmonella enterica enterica serovar Typhi Ty2
cugccagccgauuuuucggca

SEQ ID NO: 3690279 - RNA, 13 nt, Salmonella enterica enterica serovar Typhi Ty2
cugccagccgcuc

SEQ ID NO: 3690280 - RNA, 15 nt, Salmonella enterica enterica serovar Typhi Ty2
cugccagccgcucug

SEQ ID NO: 3690281 - RNA, 15 nt, Salmonella enterica enterica serovar Typhi Ty2
cugccagcgaaccgc

SEQ ID NO: 3690282 - RNA, 22 nt, Salmonella enterica enterica serovar Typhi Ty2
cugccagcuuaaaucgcggcgc

SEQ ID NO: 3690283 - RNA, 24 nt, Salmonella enterica enterica serovar Typhi Ty2
cugccaguagcggaauaucuuccc

SEQ ID NO: 3690284 - RNA, 18 nt, Salmonella enterica enterica serovar Typhi Ty2
cugccaguccgcccgccu

SEQ ID NO: 3690285 - RNA, 20 nt, Salmonella enterica enterica serovar Typhi Ty2
cugccaguccgcccgccuca

SEQ ID NO: 3690286 - RNA, 16 nt, Salmonella enterica enterica serovar Typhi Ty2
cugccagucugcccgg

SEQ ID NO: 3690287 - RNA, 18 nt, Salmonella enterica enterica serovar Typhi Ty2
cugccauagcaucaccag

SEQ ID NO: 3690288 - RNA, 12 nt, Salmonella enterica enterica serovar Typhi Ty2
cugccaucaucc

SEQ ID NO: 3690289 - RNA, 15 nt, Salmonella enterica enterica serovar Typhi Ty2
cugccaugccugaug

SEQ ID NO: 3690290 - RNA, 19 nt, Salmonella enterica enterica serovar Typhi Ty2
cugccaugccuuugacucu

SEQ ID NO: 3690291 - RNA, 16 nt, Salmonella enterica enterica serovar Typhi Ty2
cugccauuaucaccau

SEQ ID NO: 3690292 - RNA, 17 nt, Salmonella enterica enterica serovar Typhi Ty2
cugccauuaucaccauu

SEQ ID NO: 3690293 - RNA, 23 nt, Salmonella enterica enterica serovar Typhi Ty2
cugccauuaucaccauucccagc

SEQ ID NO: 3690294 - RNA, 14 nt, Salmonella enterica enterica serovar Typhi Ty2
cugccauuucugcu

SEQ ID NO: 3690295 - RNA, 16 nt, Salmonella enterica enterica serovar Typhi Ty2
cugcccacccgggccg

SEQ ID NO: 3690296 - RNA, 20 nt, Salmonella enterica enterica serovar Typhi Ty2
cugcccauguuuaccaucgc

SEQ ID NO: 3690297 - RNA, 18 nt, Salmonella enterica enterica serovar Typhi Ty2
cugccccgccacagccgc

SEQ ID NO: 3690298 - RNA, 14 nt, Salmonella enterica enterica serovar Typhi Ty2
cugccccggcgccu

SEQ ID NO: 3690299 - RNA, 17 nt, Salmonella enterica enterica serovar Typhi Ty2
cugccccggugagcgcc

SEQ ID NO: 3690300 - RNA, 13 nt, Salmonella enterica enterica serovar Typhi Ty2
cugcccgccaggg

SEQ ID NO: 3690301 - RNA, 11 nt, Salmonella enterica enterica serovar Typhi Ty2
cugcccgccgc

SEQ ID NO: 3690302 - RNA, 19 nt, Salmonella enterica enterica serovar Typhi Ty2
cugcccgccgccaccaugu

SEQ ID NO: 3690303 - RNA, 16 nt, Salmonella enterica enterica serovar Typhi Ty2
cugcccgcguuuccac

SEQ ID NO: 3690304 - RNA, 16 nt, Salmonella enterica enterica serovar Typhi Ty2
cugcccggcaaccuga

SEQ ID NO: 3690305 - RNA, 13 nt, Salmonella enterica enterica serovar Typhi Ty2
cugcccggcauau

SEQ ID NO: 3690306 - RNA, 15 nt, Salmonella enterica enterica serovar Typhi Ty2
cugcccuacgcuucu

SEQ ID NO: 3690307 - RNA, 20 nt, Salmonella enterica enterica serovar Typhi Ty2
cugcccuacgcuucucucca

SEQ ID NO: 3690308 - RNA, 21 nt, Salmonella enterica enterica serovar Typhi Ty2
cugcccuacgcuucucuccau

SEQ ID NO: 3690309 - RNA, 17 nt, Salmonella enterica enterica serovar Typhi Ty2
cugcccugacucgcacc

SEQ ID NO: 3690310 - RNA, 19 nt, Salmonella enterica enterica serovar Typhi Ty2
cugcccugcggcaggcaaa

SEQ ID NO: 3690311 - RNA, 17 nt, Salmonella enterica enterica serovar Typhi Ty2
cugcccuuuuagcacuu

SEQ ID NO: 3690312 - RNA, 17 nt, Salmonella enterica enterica serovar Typhi Ty2
cugccgacaacgccucc

SEQ ID NO: 3690313 - RNA, 22 nt, Salmonella enterica enterica serovar Typhi Ty2
cugccgacgcccucaauaucuu

SEQ ID NO: 3690314 - RNA, 23 nt, Salmonella enterica enterica serovar Typhi Ty2
cugccgauacuccauugucggca

SEQ ID NO: 3690315 - RNA, 23 nt, Salmonella enterica enterica serovar Typhi Ty2
cugccgauuuugaacaugcgcag

SEQ ID NO: 3690316 - RNA, 14 nt, Salmonella enterica enterica serovar Typhi Ty2
cugccgcaaacgcc

SEQ ID NO: 3690317 - RNA, 13 nt, Salmonella enterica enterica serovar Typhi Ty2
cugccgcaccagu

SEQ ID NO: 3690318 - RNA, 19 nt, Salmonella enterica enterica serovar Typhi Ty2
cugccgcaccagucggcaa

SEQ ID NO: 3690319 - RNA, 21 nt, Salmonella enterica enterica serovar Typhi Ty2
cugccgcagcacccgcucgcu

SEQ ID NO: 3690320 - RNA, 14 nt, Salmonella enterica enterica serovar Typhi Ty2
cugccgccacgccg

SEQ ID NO: 3690321 - RNA, 16 nt, Salmonella enterica enterica serovar Typhi Ty2
cugccgccacgccgcu

SEQ ID NO: 3690322 - RNA, 13 nt, Salmonella enterica enterica serovar Typhi Ty2
cugccgccaucgc

SEQ ID NO: 3690323 - RNA, 17 nt, Salmonella enterica enterica serovar Typhi Ty2
cugccgcgcccgcgccg

SEQ ID NO: 3690324 - RNA, 17 nt, Salmonella enterica enterica serovar Typhi Ty2
cugccgcgccugauuca

SEQ ID NO: 3690325 - RNA, 15 nt, Salmonella enterica enterica serovar Typhi Ty2
cugccgcgcgguauu

SEQ ID NO: 3690326 - RNA, 23 nt, Salmonella enterica enterica serovar Typhi Ty2
cugccggcuuaccagcgggccgc

SEQ ID NO: 3690327 - RNA, 16 nt, Salmonella enterica enterica serovar Typhi Ty2
cugccgggacuuuaaa

SEQ ID NO: 3690328 - RNA, 14 nt, Salmonella enterica enterica serovar Typhi Ty2
cugccggucggcgu

SEQ ID NO: 3690329 - RNA, 19 nt, Salmonella enterica enterica serovar Typhi Ty2
cugccggucggcgucugau

SEQ ID NO: 3690330 - RNA, 13 nt, Salmonella enterica enterica serovar Typhi Ty2
cugccgguucggc

SEQ ID NO: 3690331 - RNA, 12 nt, Salmonella enterica enterica serovar Typhi Ty2
cugccguaaaca

SEQ ID NO: 3690332 - RNA, 21 nt, Salmonella enterica enterica serovar Typhi Ty2
cugccgucaaugccuggcaga

SEQ ID NO: 3690333 - RNA, 18 nt, Salmonella enterica enterica serovar Typhi Ty2
cugccgucccagcggaug

SEQ ID NO: 3690334 - RNA, 14 nt, Salmonella enterica enterica serovar Typhi Ty2
cugccguccgcucu

SEQ ID NO: 3690335 - RNA, 21 nt, Salmonella enterica enterica serovar Typhi Ty2
cugccgugguccggcgucaac

SEQ ID NO: 3690336 - RNA, 19 nt, Salmonella enterica enterica serovar Typhi Ty2
cugccguuaaucuggccua

SEQ ID NO: 3690337 - RNA, 13 nt, Salmonella enterica enterica serovar Typhi Ty2
cugccuaaagaaa

SEQ ID NO: 3690338 - RNA, 23 nt, Salmonella enterica enterica serovar Typhi Ty2
cugccucaacaaguccuucuucc

SEQ ID NO: 3690339 - RNA, 13 nt, Salmonella enterica enterica serovar Typhi Ty2
cugccugcagacc

SEQ ID NO: 3690340 - RNA, 22 nt, Salmonella enterica enterica serovar Typhi Ty2
cugccuggcucauucuccggga

SEQ ID NO: 3690341 - RNA, 20 nt, Salmonella enterica enterica serovar Typhi Ty2
cugcuaaaacagcucacccc

SEQ ID NO: 3690342 - RNA, 21 nt, Salmonella enterica enterica serovar Typhi Ty2
cugcucacgguuuagcucugu

SEQ ID NO: 3690343 - RNA, 20 nt, Salmonella enterica enterica serovar Typhi Ty2
cugcucagaaauauucagua

SEQ ID NO: 3690344 - RNA, 18 nt, Salmonella enterica enterica serovar Typhi Ty2
cugcucauuuaugcgcug

SEQ ID NO: 3690345 - RNA, 21 nt, Salmonella enterica enterica serovar Typhi Ty2
cugcucauuuaugcgcugggc

SEQ ID NO: 3690346 - RNA, 21 nt, Salmonella enterica enterica serovar Typhi Ty2
cugcucccccaguugcugcau

SEQ ID NO: 3690347 - RNA, 15 nt, Salmonella enterica enterica serovar Typhi Ty2
cugcuccugcggcgu

SEQ ID NO: 3690348 - RNA, 19 nt, Salmonella enterica enterica serovar Typhi Ty2
cugcucgcgacgcagaccc

SEQ ID NO: 3690349 - RNA, 24 nt, Salmonella enterica enterica serovar Typhi Ty2
cugcucguaaagcaucagacuacu

SEQ ID NO: 3690350 - RNA, 22 nt, Salmonella enterica enterica serovar Typhi Ty2
cugcucguaaguuuccugcgcg

SEQ ID NO: 3690351 - RNA, 21 nt, Salmonella enterica enterica serovar Typhi Ty2
cugcucguuaaauccucccau

SEQ ID NO: 3690352 - RNA, 20 nt, Salmonella enterica enterica serovar Typhi Ty2
cugcucuaccaacugagcua

SEQ ID NO: 3690353 - RNA, 14 nt, Salmonella enterica enterica serovar Typhi Ty2
cugcucuccacgcc

SEQ ID NO: 3690354 - RNA, 14 nt, Salmonella enterica enterica serovar Typhi Ty2
cugcucuugcggca

SEQ ID NO: 3690355 - RNA, 16 nt, Salmonella enterica enterica serovar Typhi Ty2
cugcugacacccucug

SEQ ID NO: 3690356 - RNA, 22 nt, Salmonella enterica enterica serovar Typhi Ty2
cugcugaccuuaauccagcagu

SEQ ID NO: 3690357 - RNA, 19 nt, Salmonella enterica enterica serovar Typhi Ty2
cugcugacguagauucuga

SEQ ID NO: 3690358 - RNA, 15 nt, Salmonella enterica enterica serovar Typhi Ty2
cugcugacguuugca

SEQ ID NO: 3690359 - RNA, 15 nt, Salmonella enterica enterica serovar Typhi Ty2
cugcugauaauacug

SEQ ID NO: 3690360 - RNA, 15 nt, Salmonella enterica enterica serovar Typhi Ty2
cugcugaugcugguu

SEQ ID NO: 3690361 - RNA, 14 nt, Salmonella enterica enterica serovar Typhi Ty2
cugcugccagccgc

SEQ ID NO: 3690362 - RNA, 15 nt, Salmonella enterica enterica serovar Typhi Ty2
cugcugccagcgccg

SEQ ID NO: 3690363 - RNA, 17 nt, Salmonella enterica enterica serovar Typhi Ty2
cugcugccagcgccgcc

SEQ ID NO: 3690364 - RNA, 12 nt, Salmonella enterica enterica serovar Typhi Ty2
cugcugcgccuu

SEQ ID NO: 3690365 - RNA, 14 nt, Salmonella enterica enterica serovar Typhi Ty2
cugcugcgcgugcu

SEQ ID NO: 3690366 - RNA, 21 nt, Salmonella enterica enterica serovar Typhi Ty2
cugcugcguggucguaaaacu

SEQ ID NO: 3690367 - RNA, 12 nt, Salmonella enterica enterica serovar Typhi Ty2
cugcugcucccu

SEQ ID NO: 3690368 - RNA, 20 nt, Salmonella enterica enterica serovar Typhi Ty2
cugcugcugauggccuuugu

SEQ ID NO: 3690369 - RNA, 15 nt, Salmonella enterica enterica serovar Typhi Ty2
cugcugcuggguuga

SEQ ID NO: 3690370 - RNA, 21 nt, Salmonella enterica enterica serovar Typhi Ty2
cugcugcuugcuuuucaucac

SEQ ID NO: 3690371 - RNA, 12 nt, Salmonella enterica enterica serovar Typhi Ty2
cugcuggaaagg

SEQ ID NO: 3690372 - RNA, 16 nt, Salmonella enterica enterica serovar Typhi Ty2
cugcuggcagcgcuga

SEQ ID NO: 3690373 - RNA, 17 nt, Salmonella enterica enterica serovar Typhi Ty2
cugcuggccuaucuguu

SEQ ID NO: 3690374 - RNA, 14 nt, Salmonella enterica enterica serovar Typhi Ty2
cugcuggccuucca

SEQ ID NO: 3690375 - RNA, 17 nt, Salmonella enterica enterica serovar Typhi Ty2
cugcuggcgagcaggaa

SEQ ID NO: 3690376 - RNA, 16 nt, Salmonella enterica enterica serovar Typhi Ty2
cugcugggcgauuuca

SEQ ID NO: 3690377 - RNA, 22 nt, Salmonella enterica enterica serovar Typhi Ty2
cugcugguagagcaucgcggca

SEQ ID NO: 3690378 - RNA, 17 nt, Salmonella enterica enterica serovar Typhi Ty2
cugcuggucauaacgcu

SEQ ID NO: 3690379 - RNA, 17 nt, Salmonella enterica enterica serovar Typhi Ty2
cugcuguccgccagcaa

SEQ ID NO: 3690380 - RNA, 12 nt, Salmonella enterica enterica serovar Typhi Ty2
cugcugugcaua

SEQ ID NO: 3690381 - RNA, 22 nt, Salmonella enterica enterica serovar Typhi Ty2
cugcuguguccaggucaucacc

SEQ ID NO: 3690382 - RNA, 22 nt, Salmonella enterica enterica serovar Typhi Ty2
cugcuguuaaccuugcgccucu

SEQ ID NO: 3690383 - RNA, 15 nt, Salmonella enterica enterica serovar Typhi Ty2
cugcuguuucugguc

SEQ ID NO: 3690384 - RNA, 17 nt, Salmonella enterica enterica serovar Typhi Ty2
cugcuuagcucaucagc

SEQ ID NO: 3690385 - RNA, 18 nt, Salmonella enterica enterica serovar Typhi Ty2
cugcuucggaaugacaaa

SEQ ID NO: 3690386 - RNA, 13 nt, Salmonella enterica enterica serovar Typhi Ty2
cugcuucuggcuu

SEQ ID NO: 3690387 - RNA, 19 nt, Salmonella enterica enterica serovar Typhi Ty2
cugcuugucgaucaucaga

SEQ ID NO: 3690388 - RNA, 15 nt, Salmonella enterica enterica serovar Typhi Ty2
cugcuuguucuuuuc

SEQ ID NO: 3690389 - RNA, 15 nt, Salmonella enterica enterica serovar Typhi Ty2
cugcuuucugucacc

SEQ ID NO: 3690390 - RNA, 22 nt, Salmonella enterica enterica serovar Typhi Ty2
cugcuuuuucacccuugcggcu

SEQ ID NO: 3690391 - RNA, 16 nt, Salmonella enterica enterica serovar Typhi Ty2
cuggaaaaaacggggc

SEQ ID NO: 3690392 - RNA, 20 nt, Salmonella enterica enterica serovar Typhi Ty2
cuggaaaauuucagugaaaa

SEQ ID NO: 3690393 - RNA, 22 nt, Salmonella enterica enterica serovar Typhi Ty2
cuggaaaucuuucuccugguuu

SEQ ID NO: 3690394 - RNA, 17 nt, Salmonella enterica enterica serovar Typhi Ty2
cuggaacagauguuuac

SEQ ID NO: 3690395 - RNA, 18 nt, Salmonella enterica enterica serovar Typhi Ty2
cuggaacaggccaaaccc

SEQ ID NO: 3690396 - RNA, 22 nt, Salmonella enterica enterica serovar Typhi Ty2
cuggaacaguaaucgcacggcu

SEQ ID NO: 3690397 - RNA, 15 nt, Salmonella enterica enterica serovar Typhi Ty2
cuggaaccaggcgcg

SEQ ID NO: 3690398 - RNA, 19 nt, Salmonella enterica enterica serovar Typhi Ty2
cuggaagccccucuuauug

SEQ ID NO: 3690399 - RNA, 14 nt, Salmonella enterica enterica serovar Typhi Ty2
cuggaagccuucaa

SEQ ID NO: 3690400 - RNA, 15 nt, Salmonella enterica enterica serovar Typhi Ty2
cuggaauuuuuccag

SEQ ID NO: 3690401 - RNA, 16 nt, Salmonella enterica enterica serovar Typhi Ty2
cuggaauuuuuccagc

SEQ ID NO: 3690402 - RNA, 22 nt, Salmonella enterica enterica serovar Typhi Ty2
cuggaauuuuuccagcucagaa

SEQ ID NO: 3690403 - RNA, 17 nt, Salmonella enterica enterica serovar Typhi Ty2
cuggacaaaccacagug

SEQ ID NO: 3690404 - RNA, 19 nt, Salmonella enterica enterica serovar Typhi Ty2
cuggacaaagcguuugccg

SEQ ID NO: 3690405 - RNA, 21 nt, Salmonella enterica enterica serovar Typhi Ty2
cuggacaucaaacucuucgcg

SEQ ID NO: 3690406 - RNA, 20 nt, Salmonella enterica enterica serovar Typhi Ty2
cuggacauguuccgccccgc

SEQ ID NO: 3690407 - RNA, 21 nt, Salmonella enterica enterica serovar Typhi Ty2
cuggaccccagauaauagcug

SEQ ID NO: 3690408 - RNA, 15 nt, Salmonella enterica enterica serovar Typhi Ty2
cuggagaaugggauu

SEQ ID NO: 3690409 - RNA, 19 nt, Salmonella enterica enterica serovar Typhi Ty2
cuggagagcagcgccagcg

SEQ ID NO: 3690410 - RNA, 15 nt, Salmonella enterica enterica serovar Typhi Ty2
cuggagaucagcaug

SEQ ID NO: 3690411 - RNA, 20 nt, Salmonella enterica enterica serovar Typhi Ty2
cuggagcaggugcggcuggg

SEQ ID NO: 3690412 - RNA, 13 nt, Salmonella enterica enterica serovar Typhi Ty2
cuggagccacauc

SEQ ID NO: 3690413 - RNA, 21 nt, Salmonella enterica enterica serovar Typhi Ty2
cuggagcgcauuuuacugccg

SEQ ID NO: 3690414 - RNA, 16 nt, Salmonella enterica enterica serovar Typhi Ty2
cuggaggcggaagugc

SEQ ID NO: 3690415 - RNA, 22 nt, Salmonella enterica enterica serovar Typhi Ty2
cuggaguuuaaacacucuccac

SEQ ID NO: 3690416 - RNA, 15 nt, Salmonella enterica enterica serovar Typhi Ty2
cuggauaauaagacg

SEQ ID NO: 3690417 - RNA, 20 nt, Salmonella enterica enterica serovar Typhi Ty2
cuggauaauaagacgccagu

SEQ ID NO: 3690418 - RNA, 19 nt, Salmonella enterica enterica serovar Typhi Ty2
cuggauaccgcgccagcga

SEQ ID NO: 3690419 - RNA, 19 nt, Salmonella enterica enterica serovar Typhi Ty2
cuggauagcaccauaaacg

SEQ ID NO: 3690420 - RNA, 23 nt, Salmonella enterica enterica serovar Typhi Ty2
cuggaucaccugaaugcaaagaa

SEQ ID NO: 3690421 - RNA, 16 nt, Salmonella enterica enterica serovar Typhi Ty2
cuggaucagauucccc

SEQ ID NO: 3690422 - RNA, 18 nt, Salmonella enterica enterica serovar Typhi Ty2
cuggaucauacauaaccg

SEQ ID NO: 3690423 - RNA, 19 nt, Salmonella enterica enterica serovar Typhi Ty2
cuggcucacugacuaucca

SEQ ID NO: 3690424 - RNA, 12 nt, Salmonella enterica enterica serovar Typhi Ty2
cuggcucauucu

SEQ ID NO: 3690425 - RNA, 17 nt, Salmonella enterica enterica serovar Typhi Ty2
cuggcucccgcagccac

SEQ ID NO: 3690426 - RNA, 14 nt, Salmonella enterica enterica serovar Typhi Ty2
cuggcugagaaaaa

SEQ ID NO: 3690427 - RNA, 13 nt, Salmonella enterica enterica serovar Typhi Ty2
cuggcugcgcuuc

SEQ ID NO: 3690428 - RNA, 22 nt, Salmonella enterica enterica serovar Typhi Ty2
cuggcuguccuugcgccaucgg

SEQ ID NO: 3690429 - RNA, 19 nt, Salmonella enterica enterica serovar Typhi Ty2
cuggcugugccaauaacgc

SEQ ID NO: 3690430 - RNA, 15 nt, Salmonella enterica enterica serovar Typhi Ty2
cuggcuuacucgccc

SEQ ID NO: 3690431 - RNA, 22 nt, Salmonella enterica enterica serovar Typhi Ty2
cuggcuucaaccuccugcaauc

SEQ ID NO: 3690432 - RNA, 13 nt, Salmonella enterica enterica serovar Typhi Ty2
cuggcuugccaga

SEQ ID NO: 3690433 - RNA, 21 nt, Salmonella enterica enterica serovar Typhi Ty2
cuggcuugcgcuauccgcgcu

SEQ ID NO: 3690434 - RNA, 11 nt, Salmonella enterica enterica serovar Typhi Ty2
cuggcuuuaua

SEQ ID NO: 3690435 - RNA, 17 nt, Salmonella enterica enterica serovar Typhi Ty2
cuggcuuuauauaaaaa

SEQ ID NO: 3690436 - RNA, 17 nt, Salmonella enterica enterica serovar Typhi Ty2
cuggcuuuccugaucaa

SEQ ID NO: 3690437 - RNA, 19 nt, Salmonella enterica enterica serovar Typhi Ty2
cuggcuuugcgccacuuca

SEQ ID NO: 3690438 - RNA, 16 nt, Salmonella enterica enterica serovar Typhi Ty2
cuggcuuuggcuaauu

SEQ ID NO: 3690439 - RNA, 15 nt, Salmonella enterica enterica serovar Typhi Ty2
cugggaauaggccgc

SEQ ID NO: 3690440 - RNA, 15 nt, Salmonella enterica enterica serovar Typhi Ty2
cugggagccgcugcu

SEQ ID NO: 3690441 - RNA, 18 nt, Salmonella enterica enterica serovar Typhi Ty2
cugggauaagcagaacaa

SEQ ID NO: 3690442 - RNA, 15 nt, Salmonella enterica enterica serovar Typhi Ty2
cugggauuugugcga

SEQ ID NO: 3690443 - RNA, 22 nt, Salmonella enterica enterica serovar Typhi Ty2
cugggcacgcuaugguacggcg

SEQ ID NO: 3690444 - RNA, 22 nt, Salmonella enterica enterica serovar Typhi Ty2
cugggcgagggaggcaaucgca

SEQ ID NO: 3690445 - RNA, 19 nt, Salmonella enterica enterica serovar Typhi Ty2
cugggcgcaugaggccugu

SEQ ID NO: 3690446 - RNA, 23 nt, Salmonella enterica enterica serovar Typhi Ty2
cugggcggcaacccgcuccagaa

SEQ ID NO: 3690447 - RNA, 15 nt, Salmonella enterica enterica serovar Typhi Ty2
cugggcugauaggcc

SEQ ID NO: 3690448 - RNA, 15 nt, Salmonella enterica enterica serovar Typhi Ty2
cuggguaugcagugg

SEQ ID NO: 3690449 - RNA, 23 nt, Salmonella enterica enterica serovar Typhi Ty2
cugggugaugcgggacugcugcu

SEQ ID NO: 3690450 - RNA, 22 nt, Salmonella enterica enterica serovar Typhi Ty2
cuggguuagcuguauccacccg

SEQ ID NO: 3690451 - RNA, 23 nt, Salmonella enterica enterica serovar Typhi Ty2
cuggguucauccagcaauaacac

SEQ ID NO: 3690452 - RNA, 18 nt, Salmonella enterica enterica serovar Typhi Ty2
cuggguuccgggcgcacc

SEQ ID NO: 3690453 - RNA, 18 nt, Salmonella enterica enterica serovar Typhi Ty2
cuggguuucccauugggc

SEQ ID NO: 3690454 - RNA, 22 nt, Salmonella enterica enterica serovar Typhi Ty2
cuggguuuccggaucgccgaag

SEQ ID NO: 3690455 - RNA, 21 nt, Salmonella enterica enterica serovar Typhi Ty2
cuggguuuuuccgcuuuuccu

SEQ ID NO: 3690456 - RNA, 12 nt, Salmonella enterica enterica serovar Typhi Ty2
cugguaaaccgg

SEQ ID NO: 3690457 - RNA, 23 nt, Salmonella enterica enterica serovar Typhi Ty2
cugguaaccguaacgcuccugga

SEQ ID NO: 3690458 - RNA, 19 nt, Salmonella enterica enterica serovar Typhi Ty2
cugguaacggcacugcuuu

SEQ ID NO: 3690459 - RNA, 22 nt, Salmonella enterica enterica serovar Typhi Ty2
cugguaacggcacugcuuuucg

SEQ ID NO: 3690460 - RNA, 14 nt, Salmonella enterica enterica serovar Typhi Ty2
cugguaagagagcc

SEQ ID NO: 3690461 - RNA, 15 nt, Salmonella enterica enterica serovar Typhi Ty2
cugguaaggcaaaua

SEQ ID NO: 3690462 - RNA, 20 nt, Salmonella enterica enterica serovar Typhi Ty2
cugguaaguguuagcucuua

SEQ ID NO: 3690463 - RNA, 21 nt, Salmonella enterica enterica serovar Typhi Ty2
cugguagcccucgcaaagcug

SEQ ID NO: 3690464 - RNA, 15 nt, Salmonella enterica enterica serovar Typhi Ty2
cugguaggccugaua

SEQ ID NO: 3690465 - RNA, 12 nt, Salmonella enterica enterica serovar Typhi Ty2
cugguaguccuc

SEQ ID NO: 3690466 - RNA, 18 nt, Salmonella enterica enterica serovar Typhi Ty2
cugguauaggccaggcua

SEQ ID NO: 3690467 - RNA, 15 nt, Salmonella enterica enterica serovar Typhi Ty2
cugguauugaauauu

SEQ ID NO: 3690468 - RNA, 20 nt, Salmonella enterica enterica serovar Typhi Ty2
cuggucaacacgcggucguc

SEQ ID NO: 3690469 - RNA, 17 nt, Salmonella enterica enterica serovar Typhi Ty2
cuggucaaguauuucug

SEQ ID NO: 3690470 - RNA, 18 nt, Salmonella enterica enterica serovar Typhi Ty2
cuggucagcgcgccaaug

SEQ ID NO: 3690471 - RNA, 13 nt, Salmonella enterica enterica serovar Typhi Ty2
cuggucgggcagg

SEQ ID NO: 3690472 - RNA, 18 nt, Salmonella enterica enterica serovar Typhi Ty2
cuggucggugauugucca

SEQ ID NO: 3690473 - RNA, 16 nt, Salmonella enterica enterica serovar Typhi Ty2
cuggucgucugaaagc

SEQ ID NO: 3690474 - RNA, 17 nt, Salmonella enterica enterica serovar Typhi Ty2
cuggucugaaucugcuc

SEQ ID NO: 3690475 - RNA, 14 nt, Salmonella enterica enterica serovar Typhi Ty2
cuggugaaacaggu

SEQ ID NO: 3690476 - RNA, 20 nt, Salmonella enterica enterica serovar Typhi Ty2
cuggugaaacguguuuaucc

SEQ ID NO: 3690477 - RNA, 21 nt, Salmonella enterica enterica serovar Typhi Ty2
cuggugaaacguguuuauccc

SEQ ID NO: 3690478 - RNA, 18 nt, Salmonella enterica enterica serovar Typhi Ty2
cuggugaagacgcugcaa

SEQ ID NO: 3690479 - RNA, 17 nt, Salmonella enterica enterica serovar Typhi Ty2
cuggugacgaugauaac

SEQ ID NO: 3690480 - RNA, 18 nt, Salmonella enterica enterica serovar Typhi Ty2
cuggugacgaugauaaca

SEQ ID NO: 3690481 - RNA, 20 nt, Salmonella enterica enterica serovar Typhi Ty2
cuggugacuuuccgggguga

SEQ ID NO: 3690482 - RNA, 14 nt, Salmonella enterica enterica serovar Typhi Ty2
cuggugaucuggcc

SEQ ID NO: 3690483 - RNA, 18 nt, Salmonella enterica enterica serovar Typhi Ty2
cuggugcagcaagcggcu

SEQ ID NO: 3690484 - RNA, 18 nt, Salmonella enterica enterica serovar Typhi Ty2
cuggugccaaucuccagc

SEQ ID NO: 3690485 - RNA, 12 nt, Salmonella enterica enterica serovar Typhi Ty2
cuggugcccggu

SEQ ID NO: 3690486 - RNA, 17 nt, Salmonella enterica enterica serovar Typhi Ty2
cuggugcgaauaagcuc

SEQ ID NO: 3690487 - RNA, 19 nt, Salmonella enterica enterica serovar Typhi Ty2
cuggugcgacaccacgcag

SEQ ID NO: 3690488 - RNA, 22 nt, Salmonella enterica enterica serovar Typhi Ty2
cuggugcgacaccacgcaggcg

SEQ ID NO: 3690489 - RNA, 16 nt, Salmonella enterica enterica serovar Typhi Ty2
cuggugcggggaacac

SEQ ID NO: 3690490 - RNA, 17 nt, Salmonella enterica enterica serovar Typhi Ty2
cuggugcugugccugcc

SEQ ID NO: 3690491 - RNA, 18 nt, Salmonella enterica enterica serovar Typhi Ty2
cuggugcugugccugccu

SEQ ID NO: 3690492 - RNA, 13 nt, Salmonella enterica enterica serovar Typhi Ty2
cugguggccuucg

SEQ ID NO: 3690493 - RNA, 19 nt, Salmonella enterica enterica serovar Typhi Ty2
cugguggcgagauaagccg

SEQ ID NO: 3690494 - RNA, 16 nt, Salmonella enterica enterica serovar Typhi Ty2
cuggugggacuguuca

SEQ ID NO: 3690495 - RNA, 22 nt, Salmonella enterica enterica serovar Typhi Ty2
cugguggucuaugguacacaua

SEQ ID NO: 3690496 - RNA, 16 nt, Salmonella enterica enterica serovar Typhi Ty2
cugguggugggcggca

SEQ ID NO: 3690497 - RNA, 22 nt, Salmonella enterica enterica serovar Typhi Ty2
cuggugguuuugggugcugguu

SEQ ID NO: 3690498 - RNA, 14 nt, Salmonella enterica enterica serovar Typhi Ty2
cuggugucgccgug

SEQ ID NO: 3690499 - RNA, 18 nt, Salmonella enterica enterica serovar Typhi Ty2
cuggugugguuauuucug

SEQ ID NO: 3690500 - RNA, 16 nt, Salmonella enterica enterica serovar Typhi Ty2
cugguuaacgccgcca

SEQ ID NO: 3690501 - RNA, 14 nt, Salmonella enterica enterica serovar Typhi Ty2
cugguuaaggauga

SEQ ID NO: 3690502 - RNA, 15 nt, Salmonella enterica enterica serovar Typhi Ty2
cugguuaauaauuuu

SEQ ID NO: 3690503 - RNA, 24 nt, Salmonella enterica enterica serovar Typhi Ty2
cugguuaaugccuucgccgccgcu

SEQ ID NO: 3690504 - RNA, 13 nt, Salmonella enterica enterica serovar Typhi Ty2
cugguucaacauc

SEQ ID NO: 3690505 - RNA, 15 nt, Salmonella enterica enterica serovar Typhi Ty2
cugucggucagauuc

SEQ ID NO: 3690506 - RNA, 15 nt, Salmonella enterica enterica serovar Typhi Ty2
cugucggucuuuuuc

SEQ ID NO: 3690507 - RNA, 13 nt, Salmonella enterica enterica serovar Typhi Ty2
cugucguauuuau

SEQ ID NO: 3690508 - RNA, 16 nt, Salmonella enterica enterica serovar Typhi Ty2
cugucguauuuauuuu

SEQ ID NO: 3690509 - RNA, 19 nt, Salmonella enterica enterica serovar Typhi Ty2
cugucguauuuauuuucug

SEQ ID NO: 3690510 - RNA, 16 nt, Salmonella enterica enterica serovar Typhi Ty2
cugucgucaccagcag

SEQ ID NO: 3690511 - RNA, 23 nt, Salmonella enterica enterica serovar Typhi Ty2
cugucguuucauguaaaugacgc

SEQ ID NO: 3690512 - RNA, 14 nt, Salmonella enterica enterica serovar Typhi Ty2
cugucuccagcgcc

SEQ ID NO: 3690513 - RNA, 20 nt, Salmonella enterica enterica serovar Typhi Ty2
cugucucuuuagaaaaagaa

SEQ ID NO: 3690514 - RNA, 15 nt, Salmonella enterica enterica serovar Typhi Ty2
cugucugccaugccu

SEQ ID NO: 3690515 - RNA, 14 nt, Salmonella enterica enterica serovar Typhi Ty2
cugucuuguuuuuc

SEQ ID NO: 3690516 - RNA, 16 nt, Salmonella enterica enterica serovar Typhi Ty2
cugucuuguuuuucug

SEQ ID NO: 3690517 - RNA, 14 nt, Salmonella enterica enterica serovar Typhi Ty2
cugugaaguaauuc

SEQ ID NO: 3690518 - RNA, 19 nt, Salmonella enterica enterica serovar Typhi Ty2
cugugacgcaggccgggua

SEQ ID NO: 3690519 - RNA, 18 nt, Salmonella enterica enterica serovar Typhi Ty2
cugugagaaggugguggg

SEQ ID NO: 3690520 - RNA, 16 nt, Salmonella enterica enterica serovar Typhi Ty2
cugugagccuaaaaca

SEQ ID NO: 3690521 - RNA, 17 nt, Salmonella enterica enterica serovar Typhi Ty2
cugugcaacaucuuacc

SEQ ID NO: 3690522 - RNA, 21 nt, Salmonella enterica enterica serovar Typhi Ty2
cugugcaacaucuuaccggug

SEQ ID NO: 3690523 - RNA, 23 nt, Salmonella enterica enterica serovar Typhi Ty2
cugugcaacaucuuaccggugcg

SEQ ID NO: 3690524 - RNA, 18 nt, Salmonella enterica enterica serovar Typhi Ty2
cugugcauaucuggcgag

SEQ ID NO: 3690525 - RNA, 20 nt, Salmonella enterica enterica serovar Typhi Ty2
cugugccagcucguuauuuc

SEQ ID NO: 3690526 - RNA, 21 nt, Salmonella enterica enterica serovar Typhi Ty2
cugugccagcucguuauuucc

SEQ ID NO: 3690527 - RNA, 16 nt, Salmonella enterica enterica serovar Typhi Ty2
cugugccgcuggugcu

SEQ ID NO: 3690528 - RNA, 21 nt, Salmonella enterica enterica serovar Typhi Ty2
cugugccgcuggugcuacggg

SEQ ID NO: 3690529 - RNA, 20 nt, Salmonella enterica enterica serovar Typhi Ty2
cugugccgucguacucacca

SEQ ID NO: 3690530 - RNA, 13 nt, Salmonella enterica enterica serovar Typhi Ty2
cugugccugccug

SEQ ID NO: 3690531 - RNA, 15 nt, Salmonella enterica enterica serovar Typhi Ty2
cugugccugccugug

SEQ ID NO: 3690532 - RNA, 13 nt, Salmonella enterica enterica serovar Typhi Ty2
cugugcgagacca

SEQ ID NO: 3690533 - RNA, 16 nt, Salmonella enterica enterica serovar Typhi Ty2
cugugcgugacccaca

SEQ ID NO: 3690534 - RNA, 18 nt, Salmonella enterica enterica serovar Typhi Ty2
cugugcgugacccacagu

SEQ ID NO: 3690535 - RNA, 15 nt, Salmonella enterica enterica serovar Typhi Ty2
cugugcgugaugggc

SEQ ID NO: 3690536 - RNA, 18 nt, Salmonella enterica enterica serovar Typhi Ty2
cugugcuaugauaagccu

SEQ ID NO: 3690537 - RNA, 18 nt, Salmonella enterica enterica serovar Typhi Ty2
cugugcucgauauauuuu

SEQ ID NO: 3690538 - RNA, 19 nt, Salmonella enterica enterica serovar Typhi Ty2
cugugcucgauauauuuuc

SEQ ID NO: 3690539 - RNA, 20 nt, Salmonella enterica enterica serovar Typhi Ty2
cugugcucgauauauuuucc

SEQ ID NO: 3690540 - RNA, 16 nt, Salmonella enterica enterica serovar Typhi Ty2
cugugcuuaccgggcc

SEQ ID NO: 3690541 - RNA, 15 nt, Salmonella enterica enterica serovar Typhi Ty2
cuguggaaaaucugg

SEQ ID NO: 3690542 - RNA, 14 nt, Salmonella enterica enterica serovar Typhi Ty2
cuguggaaacugug

SEQ ID NO: 3690543 - RNA, 14 nt, Salmonella enterica enterica serovar Typhi Ty2
cuguggugugccug

SEQ ID NO: 3690544 - RNA, 16 nt, Salmonella enterica enterica serovar Typhi Ty2
cugugguucugccaga

SEQ ID NO: 3690545 - RNA, 18 nt, Salmonella enterica enterica serovar Typhi Ty2
cuguguaccucuacauaa

SEQ ID NO: 3690546 - RNA, 13 nt, Salmonella enterica enterica serovar Typhi Ty2
cuguguacuuuua

SEQ ID NO: 3690547 - RNA, 24 nt, Salmonella enterica enterica serovar Typhi Ty2
cuguguauucugcgccagccagcu

SEQ ID NO: 3690548 - RNA, 15 nt, Salmonella enterica enterica serovar Typhi Ty2
cugugucguccaggc

SEQ ID NO: 3690549 - RNA, 12 nt, Salmonella enterica enterica serovar Typhi Ty2
cugugugagcgc

SEQ ID NO: 3690550 - RNA, 17 nt, Salmonella enterica enterica serovar Typhi Ty2
cuguguugcucaaaaaa

SEQ ID NO: 3690551 - RNA, 13 nt, Salmonella enterica enterica serovar Typhi Ty2
cuguguuuuuucg

SEQ ID NO: 3690552 - RNA, 17 nt, Salmonella enterica enterica serovar Typhi Ty2
cuguuaaaaccggcugc

SEQ ID NO: 3690553 - RNA, 21 nt, Salmonella enterica enterica serovar Typhi Ty2
cuguuaauaaguccgcgggca

SEQ ID NO: 3690554 - RNA, 14 nt, Salmonella enterica enterica serovar Typhi Ty2
cuguuaauaccgug

SEQ ID NO: 3690555 - RNA, 14 nt, Salmonella enterica enterica serovar Typhi Ty2
cuguuaauuucccg

SEQ ID NO: 3690556 - RNA, 17 nt, Salmonella enterica enterica serovar Typhi Ty2
cuguuacgcugguuugu

SEQ ID NO: 3690557 - RNA, 22 nt, Salmonella enterica enterica serovar Typhi Ty2
cuguuauauauuuuucagcuuc

SEQ ID NO: 3690558 - RNA, 18 nt, Salmonella enterica enterica serovar Typhi Ty2
cuguuaucgccauuauuc

SEQ ID NO: 3690559 - RNA, 19 nt, Salmonella enterica enterica serovar Typhi Ty2
cuguuaucuggauguaaau

SEQ ID NO: 3690560 - RNA, 15 nt, Salmonella enterica enterica serovar Typhi Ty2
cuguuaugccuuuuu

SEQ ID NO: 3690561 - RNA, 19 nt, Salmonella enterica enterica serovar Typhi Ty2
cuguuauugacgauauaaa

SEQ ID NO: 3690562 - RNA, 14 nt, Salmonella enterica enterica serovar Typhi Ty2
cuguucacauccag

SEQ ID NO: 3690563 - RNA, 16 nt, Salmonella enterica enterica serovar Typhi Ty2
cuguucaucaaagaaa

SEQ ID NO: 3690564 - RNA, 11 nt, Salmonella enterica enterica serovar Typhi Ty2
cuguuccagcg

SEQ ID NO: 3690565 - RNA, 15 nt, Salmonella enterica enterica serovar Typhi Ty2
cuguuccagcugcga

SEQ ID NO: 3690566 - RNA, 14 nt, Salmonella enterica enterica serovar Typhi Ty2
cuguuccaggcgaa

SEQ ID NO: 3690567 - RNA, 18 nt, Salmonella enterica enterica serovar Typhi Ty2
cuguuccagguucaagcu

SEQ ID NO: 3690568 - RNA, 14 nt, Salmonella enterica enterica serovar Typhi Ty2
cuguucgccggaug

SEQ ID NO: 3690569 - RNA, 15 nt, Salmonella enterica enterica serovar Typhi Ty2
cuguucgcuuauucc

SEQ ID NO: 3690570 - RNA, 20 nt, Salmonella enterica enterica serovar Typhi Ty2
cuguucggggaauucaaaga

SEQ ID NO: 3690571 - RNA, 16 nt, Salmonella enterica enterica serovar Typhi Ty2
cuguucuacuacagaa

SEQ ID NO: 3690572 - RNA, 23 nt, Salmonella enterica enterica serovar Typhi Ty2
cuguucuggauagucuucaagcc

SEQ ID NO: 3690573 - RNA, 12 nt, Salmonella enterica enterica serovar Typhi Ty2
cuguucuuuuuc

SEQ ID NO: 3690574 - RNA, 13 nt, Salmonella enterica enterica serovar Typhi Ty2
cuguucuuuuucg

SEQ ID NO: 3690575 - RNA, 19 nt, Salmonella enterica enterica serovar Typhi Ty2
cuguucuuuuucggcuggc

SEQ ID NO: 3690576 - RNA, 16 nt, Salmonella enterica enterica serovar Typhi Ty2
cuguugaaagccccgg

SEQ ID NO: 3690577 - RNA, 21 nt, Salmonella enterica enterica serovar Typhi Ty2
cuguugaauaucgcuuuuucu

SEQ ID NO: 3690578 - RNA, 18 nt, Salmonella enterica enterica serovar Typhi Ty2
cuguugaggaaauucuga

SEQ ID NO: 3690579 - RNA, 22 nt, Salmonella enterica enterica serovar Typhi Ty2
cuguugaguucccuucuccuca

SEQ ID NO: 3690580 - RNA, 18 nt, Salmonella enterica enterica serovar Typhi Ty2
cuguugcgcauucaggcg

SEQ ID NO: 3690581 - RNA, 18 nt, Salmonella enterica enterica serovar Typhi Ty2
cuguugcugugcauaucu

SEQ ID NO: 3690582 - RNA, 19 nt, Salmonella enterica enterica serovar Typhi Ty2
cuguuggacugucuuguuu

SEQ ID NO: 3690583 - RNA, 13 nt, Salmonella enterica enterica serovar Typhi Ty2
cuguuggcauccu

SEQ ID NO: 3690584 - RNA, 17 nt, Salmonella enterica enterica serovar Typhi Ty2
cuguuuaagcgccucca

SEQ ID NO: 3690585 - RNA, 19 nt, Salmonella enterica enterica serovar Typhi Ty2
cuguuuaagcgccuccaca

SEQ ID NO: 3690586 - RNA, 21 nt, Salmonella enterica enterica serovar Typhi Ty2
cuguuuaagcgccuccacaaa

SEQ ID NO: 3690587 - RNA, 21 nt, Salmonella enterica enterica serovar Typhi Ty2
cuuauccggccuacagaacug

SEQ ID NO: 3690588 - RNA, 19 nt, Salmonella enterica enterica serovar Typhi Ty2
cuuauccggccuauagcua

SEQ ID NO: 3690589 - RNA, 22 nt, Salmonella enterica enterica serovar Typhi Ty2
cuuauccggccugcaaaccgcc

SEQ ID NO: 3690590 - RNA, 15 nt, Salmonella enterica enterica serovar Typhi Ty2
cuuauccggcugccg

SEQ ID NO: 3690591 - RNA, 23 nt, Salmonella enterica enterica serovar Typhi Ty2
cuuauccggcuuauccggccugc

SEQ ID NO: 3690592 - RNA, 19 nt, Salmonella enterica enterica serovar Typhi Ty2
cuuaucgagugucaauaag

SEQ ID NO: 3690593 - RNA, 15 nt, Salmonella enterica enterica serovar Typhi Ty2
cuuaucgccaaagau

SEQ ID NO: 3690594 - RNA, 16 nt, Salmonella enterica enterica serovar Typhi Ty2
cuuaucgccaaagaua

SEQ ID NO: 3690595 - RNA, 12 nt, Salmonella enterica enterica serovar Typhi Ty2
cuuaucgccgua

SEQ ID NO: 3690596 - RNA, 14 nt, Salmonella enterica enterica serovar Typhi Ty2
cuuaucgcgcuggc

SEQ ID NO: 3690597 - RNA, 20 nt, Salmonella enterica enterica serovar Typhi Ty2
cuuaucggcguguuucaucu

SEQ ID NO: 3690598 - RNA, 18 nt, Salmonella enterica enterica serovar Typhi Ty2
cuuaucggugaugaaagc

SEQ ID NO: 3690599 - RNA, 19 nt, Salmonella enterica enterica serovar Typhi Ty2
cuuaucucuacuuuccuga

SEQ ID NO: 3690600 - RNA, 14 nt, Salmonella enterica enterica serovar Typhi Ty2
cuuaucugcugcug

SEQ ID NO: 3690601 - RNA, 23 nt, Salmonella enterica enterica serovar Typhi Ty2
cuuaugaccgagucuacaucaag

SEQ ID NO: 3690602 - RNA, 16 nt, Salmonella enterica enterica serovar Typhi Ty2
cuuauuaaagccccuu

SEQ ID NO: 3690603 - RNA, 21 nt, Salmonella enterica enterica serovar Typhi Ty2
cuuauuagaggcguaaguaaa

SEQ ID NO: 3690604 - RNA, 23 nt, Salmonella enterica enterica serovar Typhi Ty2
cuuauuagaggcguaaguaaaag

SEQ ID NO: 3690605 - RNA, 12 nt, Salmonella enterica enterica serovar Typhi Ty2
cuuauucaggcg

SEQ ID NO: 3690606 - RNA, 12 nt, Salmonella enterica enterica serovar Typhi Ty2
cuuauuccaguc

SEQ ID NO: 3690607 - RNA, 17 nt, Salmonella enterica enterica serovar Typhi Ty2
cuuauugaugacgcuua

SEQ ID NO: 3690608 - RNA, 15 nt, Salmonella enterica enterica serovar Typhi Ty2
cuuauuucuccugcg

SEQ ID NO: 3690609 - RNA, 13 nt, Salmonella enterica enterica serovar Typhi Ty2
cuuauuuguauug

SEQ ID NO: 3690610 - RNA, 22 nt, Salmonella enterica enterica serovar Typhi Ty2
cuuauuuuauuuuuauauuccg

SEQ ID NO: 3690611 - RNA, 19 nt, Salmonella enterica enterica serovar Typhi Ty2
cuucaaaacagaaccccau

SEQ ID NO: 3690612 - RNA, 18 nt, Salmonella enterica enterica serovar Typhi Ty2
cuucaaagccacacugca

SEQ ID NO: 3690613 - RNA, 13 nt, Salmonella enterica enterica serovar Typhi Ty2
cuucaacgcgccg

SEQ ID NO: 3690614 - RNA, 22 nt, Salmonella enterica enterica serovar Typhi Ty2
cuucaacgcgccgcucacaacc

SEQ ID NO: 3690615 - RNA, 19 nt, Salmonella enterica enterica serovar Typhi Ty2
cuucaacgcucaguacgcu

SEQ ID NO: 3690616 - RNA, 21 nt, Salmonella enterica enterica serovar Typhi Ty2
cuucaacgucuuauuacgcuu

SEQ ID NO: 3690617 - RNA, 15 nt, Salmonella enterica enterica serovar Typhi Ty2
cuucaagaaguucca

SEQ ID NO: 3690618 - RNA, 17 nt, Salmonella enterica enterica serovar Typhi Ty2
cuucaagcguuuccaga

SEQ ID NO: 3690619 - RNA, 22 nt, Salmonella enterica enterica serovar Typhi Ty2
cuucaagcuggugcuuuaugua

SEQ ID NO: 3690620 - RNA, 23 nt, Salmonella enterica enterica serovar Typhi Ty2
cuucaagcuggugcuuuauguag

SEQ ID NO: 3690621 - RNA, 21 nt, Salmonella enterica enterica serovar Typhi Ty2
cuucaagguucgacucgagca

SEQ ID NO: 3690622 - RNA, 16 nt, Salmonella enterica enterica serovar Typhi Ty2
cuucaauaucaacgac

SEQ ID NO: 3690623 - RNA, 14 nt, Salmonella enterica enterica serovar Typhi Ty2
cuucaauauugaug

SEQ ID NO: 3690624 - RNA, 21 nt, Salmonella enterica enterica serovar Typhi Ty2
cuucaaucgucguuccgccag

SEQ ID NO: 3690625 - RNA, 23 nt, Salmonella enterica enterica serovar Typhi Ty2
cuucaaugcgccccgucuguguu

SEQ ID NO: 3690626 - RNA, 22 nt, Salmonella enterica enterica serovar Typhi Ty2
cuucaauguuagcauuauuuuu

SEQ ID NO: 3690627 - RNA, 19 nt, Salmonella enterica enterica serovar Typhi Ty2
cuucaauucagaaaguuac

SEQ ID NO: 3690628 - RNA, 16 nt, Salmonella enterica enterica serovar Typhi Ty2
cuucaauuugccggaa

SEQ ID NO: 3690629 - RNA, 19 nt, Salmonella enterica enterica serovar Typhi Ty2
cuucaauuuuccagauagc

SEQ ID NO: 3690630 - RNA, 14 nt, Salmonella enterica enterica serovar Typhi Ty2
cuucacaaucagcg

SEQ ID NO: 3690631 - RNA, 18 nt, Salmonella enterica enterica serovar Typhi Ty2
cuucacauaucccagacc

SEQ ID NO: 3690632 - RNA, 19 nt, Salmonella enterica enterica serovar Typhi Ty2
cuucacauuuuuaucagcu

SEQ ID NO: 3690633 - RNA, 13 nt, Salmonella enterica enterica serovar Typhi Ty2
cuucaccacgcca

SEQ ID NO: 3690634 - RNA, 23 nt, Salmonella enterica enterica serovar Typhi Ty2
cuucacccgcgggcggcguuuca

SEQ ID NO: 3690635 - RNA, 23 nt, Salmonella enterica enterica serovar Typhi Ty2
cuucacccuucuucuggcucaga

SEQ ID NO: 3690636 - RNA, 14 nt, Salmonella enterica enterica serovar Typhi Ty2
cuucaccggcgugc

SEQ ID NO: 3690637 - RNA, 15 nt, Salmonella enterica enterica serovar Typhi Ty2
cuucaccggcgugcg

SEQ ID NO: 3690638 - RNA, 17 nt, Salmonella enterica enterica serovar Typhi Ty2
cuucaccucagucgcuu

SEQ ID NO: 3690639 - RNA, 22 nt, Salmonella enterica enterica serovar Typhi Ty2
cuucaccuucggugaaaucacg

SEQ ID NO: 3690640 - RNA, 19 nt, Salmonella enterica enterica serovar Typhi Ty2
cuucaccuugcugcgcagg

SEQ ID NO: 3690641 - RNA, 21 nt, Salmonella enterica enterica serovar Typhi Ty2
cuucacgagcggucaggccag

SEQ ID NO: 3690642 - RNA, 19 nt, Salmonella enterica enterica serovar Typhi Ty2
cuucacgcagugcgcgacc

SEQ ID NO: 3690643 - RNA, 19 nt, Salmonella enterica enterica serovar Typhi Ty2
cuucacgccauccaguuua

SEQ ID NO: 3690644 - RNA, 21 nt, Salmonella enterica enterica serovar Typhi Ty2
cuucacguugacgcaaacugc

SEQ ID NO: 3690645 - RNA, 16 nt, Salmonella enterica enterica serovar Typhi Ty2
cuucacguuuuccagg

SEQ ID NO: 3690646 - RNA, 15 nt, Salmonella enterica enterica serovar Typhi Ty2
cuucacuaaaaacag

SEQ ID NO: 3690647 - RNA, 21 nt, Salmonella enterica enterica serovar Typhi Ty2
cuucacucugggauuugcgaa

SEQ ID NO: 3690648 - RNA, 17 nt, Salmonella enterica enterica serovar Typhi Ty2
cuucacuucacaaacaa

SEQ ID NO: 3690649 - RNA, 12 nt, Salmonella enterica enterica serovar Typhi Ty2
cuucagagcagg

SEQ ID NO: 3690650 - RNA, 21 nt, Salmonella enterica enterica serovar Typhi Ty2
cuucagagcugaaaauguggu

SEQ ID NO: 3690651 - RNA, 18 nt, Salmonella enterica enterica serovar Typhi Ty2
cuucagaggccuuuugca

SEQ ID NO: 3690652 - RNA, 14 nt, Salmonella enterica enterica serovar Typhi Ty2
cuucagcaucaucu

SEQ ID NO: 3690653 - RNA, 19 nt, Salmonella enterica enterica serovar Typhi Ty2
cuucagcaucaucucccag

SEQ ID NO: 3690654 - RNA, 15 nt, Salmonella enterica enterica serovar Typhi Ty2
cuucagccagacgcu

SEQ ID NO: 3690655 - RNA, 17 nt, Salmonella enterica enterica serovar Typhi Ty2
cuucagccagacguaaa

SEQ ID NO: 3690656 - RNA, 21 nt, Salmonella enterica enterica serovar Typhi Ty2
cuucagccugugcaaccagcu

SEQ ID NO: 3690657 - RNA, 20 nt, Salmonella enterica enterica serovar Typhi Ty2
cuucagcggcgcguugccgc

SEQ ID NO: 3690658 - RNA, 22 nt, Salmonella enterica enterica serovar Typhi Ty2
cuucagcggcgcguugccgccg

SEQ ID NO: 3690659 - RNA, 15 nt, Salmonella enterica enterica serovar Typhi Ty2
cuucagcguugcuau

SEQ ID NO: 3690660 - RNA, 20 nt, Salmonella enterica enterica serovar Typhi Ty2
cuucaggagaccuaaagucu

SEQ ID NO: 3690661 - RNA, 22 nt, Salmonella enterica enterica serovar Typhi Ty2
cuucaggcuguugcgcauucag

SEQ ID NO: 3690662 - RNA, 22 nt, Salmonella enterica enterica serovar Typhi Ty2
cuucagguuuuuaagcugccca

SEQ ID NO: 3690663 - RNA, 19 nt, Salmonella enterica enterica serovar Typhi Ty2
cuucaguaauuucgaugau

SEQ ID NO: 3690664 - RNA, 19 nt, Salmonella enterica enterica serovar Typhi Ty2
cuucagucuacuacacacu

SEQ ID NO: 3690665 - RNA, 20 nt, Salmonella enterica enterica serovar Typhi Ty2
cuucauaaauagccagcauc

SEQ ID NO: 3690666 - RNA, 23 nt, Salmonella enterica enterica serovar Typhi Ty2
cuucauaaauagccagcaucaug

SEQ ID NO: 3690667 - RNA, 17 nt, Salmonella enterica enterica serovar Typhi Ty2
cuucauacuccgaaugu

SEQ ID NO: 3690668 - RNA, 22 nt, Salmonella enterica enterica serovar Typhi Ty2
cuucgaggauaaaaucgccaaa

SEQ ID NO: 3690669 - RNA, 15 nt, Salmonella enterica enterica serovar Typhi Ty2
cuucgauaaacgccu

SEQ ID NO: 3690670 - RNA, 21 nt, Salmonella enterica enterica serovar Typhi Ty2
cuucgauaguccauuuuccua

SEQ ID NO: 3690671 - RNA, 18 nt, Salmonella enterica enterica serovar Typhi Ty2
cuucgcagaucgccugga

SEQ ID NO: 3690672 - RNA, 19 nt, Salmonella enterica enterica serovar Typhi Ty2
cuucgcagcgauauuucuc

SEQ ID NO: 3690673 - RNA, 23 nt, Salmonella enterica enterica serovar Typhi Ty2
cuucgcccauugccacccauuua

SEQ ID NO: 3690674 - RNA, 20 nt, Salmonella enterica enterica serovar Typhi Ty2
cuucgccccggcgagugccu

SEQ ID NO: 3690675 - RNA, 14 nt, Salmonella enterica enterica serovar Typhi Ty2
cuucgcccggcgua

SEQ ID NO: 3690676 - RNA, 17 nt, Salmonella enterica enterica serovar Typhi Ty2
cuucgccguuaucggcc

SEQ ID NO: 3690677 - RNA, 20 nt, Salmonella enterica enterica serovar Typhi Ty2
cuucgccguuaucggccugc

SEQ ID NO: 3690678 - RNA, 21 nt, Salmonella enterica enterica serovar Typhi Ty2
cuucgcgccuucuaccgcuuc

SEQ ID NO: 3690679 - RNA, 15 nt, Salmonella enterica enterica serovar Typhi Ty2
cuucgcgguuagaaa

SEQ ID NO: 3690680 - RNA, 23 nt, Salmonella enterica enterica serovar Typhi Ty2
cuucgcucucgugccaguaacgu

SEQ ID NO: 3690681 - RNA, 14 nt, Salmonella enterica enterica serovar Typhi Ty2
cuucgcucugaauc

SEQ ID NO: 3690682 - RNA, 15 nt, Salmonella enterica enterica serovar Typhi Ty2
cuucgcuuagcuucc

SEQ ID NO: 3690683 - RNA, 22 nt, Salmonella enterica enterica serovar Typhi Ty2
cuucggaaugacaaacgccacc

SEQ ID NO: 3690684 - RNA, 22 nt, Salmonella enterica enterica serovar Typhi Ty2
cuucggcaaaauauucagcgaa

SEQ ID NO: 3690685 - RNA, 22 nt, Salmonella enterica enterica serovar Typhi Ty2
cuucggcgcgccgcuggcgaug

SEQ ID NO: 3690686 - RNA, 21 nt, Salmonella enterica enterica serovar Typhi Ty2
cuucggcgggaucuccagaag

SEQ ID NO: 3690687 - RNA, 23 nt, Salmonella enterica enterica serovar Typhi Ty2
cuucggcgggaucuccagaagca

SEQ ID NO: 3690688 - RNA, 23 nt, Salmonella enterica enterica serovar Typhi Ty2
cuucgggcgauuuuugcagcaac

SEQ ID NO: 3690689 - RNA, 21 nt, Salmonella enterica enterica serovar Typhi Ty2
cuucgguuucguuaaucggca

SEQ ID NO: 3690690 - RNA, 14 nt, Salmonella enterica enterica serovar Typhi Ty2
cuucgucuuuauuc

SEQ ID NO: 3690691 - RNA, 19 nt, Salmonella enterica enterica serovar Typhi Ty2
cuucguggaacugcagcgc

SEQ ID NO: 3690692 - RNA, 23 nt, Salmonella enterica enterica serovar Typhi Ty2
cuucguggaacugcagcgcgucg

SEQ ID NO: 3690693 - RNA, 17 nt, Salmonella enterica enterica serovar Typhi Ty2
cuucguuagcggcguug

SEQ ID NO: 3690694 - RNA, 15 nt, Salmonella enterica enterica serovar Typhi Ty2
cuucguuauaaggcc

SEQ ID NO: 3690695 - RNA, 15 nt, Salmonella enterica enterica serovar Typhi Ty2
cuucguuauuuuccu

SEQ ID NO: 3690696 - RNA, 20 nt, Salmonella enterica enterica serovar Typhi Ty2
cuucguuauuuuccugaaaa

SEQ ID NO: 3690697 - RNA, 14 nt, Salmonella enterica enterica serovar Typhi Ty2
cuucguucuguauc

SEQ ID NO: 3690698 - RNA, 14 nt, Salmonella enterica enterica serovar Typhi Ty2
cuucguuuuccgca

SEQ ID NO: 3690699 - RNA, 16 nt, Salmonella enterica enterica serovar Typhi Ty2
cuucuaauuccaggau

SEQ ID NO: 3690700 - RNA, 13 nt, Salmonella enterica enterica serovar Typhi Ty2
cuucuaauuuuuc

SEQ ID NO: 3690701 - RNA, 14 nt, Salmonella enterica enterica serovar Typhi Ty2
cuucuaccgcuucg

SEQ ID NO: 3690702 - RNA, 13 nt, Salmonella enterica enterica serovar Typhi Ty2
cuucuaccuggaa

SEQ ID NO: 3690703 - RNA, 15 nt, Salmonella enterica enterica serovar Typhi Ty2
cuucuaccuggaacc

SEQ ID NO: 3690704 - RNA, 18 nt, Salmonella enterica enterica serovar Typhi Ty2
cuucuaccuucaccccca

SEQ ID NO: 3690705 - RNA, 21 nt, Salmonella enterica enterica serovar Typhi Ty2
cuucucacggauccagaacug

SEQ ID NO: 3690706 - RNA, 19 nt, Salmonella enterica enterica serovar Typhi Ty2
cuucucaggcgagcccugu

SEQ ID NO: 3690707 - RNA, 21 nt, Salmonella enterica enterica serovar Typhi Ty2
cuucuccccuucaucaguaac

SEQ ID NO: 3690708 - RNA, 13 nt, Salmonella enterica enterica serovar Typhi Ty2
cuucuccgccauc

SEQ ID NO: 3690709 - RNA, 13 nt, Salmonella enterica enterica serovar Typhi Ty2
cuucuccgccugc

SEQ ID NO: 3690710 - RNA, 16 nt, Salmonella enterica enterica serovar Typhi Ty2
cuucuccgccugcggu

SEQ ID NO: 3690711 - RNA, 16 nt, Salmonella enterica enterica serovar Typhi Ty2
cuucuccuucgccaaa

SEQ ID NO: 3690712 - RNA, 18 nt, Salmonella enterica enterica serovar Typhi Ty2
cuucucgaaguucucaau

SEQ ID NO: 3690713 - RNA, 19 nt, Salmonella enterica enterica serovar Typhi Ty2
cuucucgccuucggccuga

SEQ ID NO: 3690714 - RNA, 14 nt, Salmonella enterica enterica serovar Typhi Ty2
cuucucgcgcauca

SEQ ID NO: 3690715 - RNA, 12 nt, Salmonella enterica enterica serovar Typhi Ty2
cuucugaaaacc

SEQ ID NO: 3690716 - RNA, 17 nt, Salmonella enterica enterica serovar Typhi Ty2
cuucugacagugacggc

SEQ ID NO: 3690717 - RNA, 23 nt, Salmonella enterica enterica serovar Typhi Ty2
cuucugacccaaucagacgccgg

SEQ ID NO: 3690718 - RNA, 16 nt, Salmonella enterica enterica serovar Typhi Ty2
cuucugacucgcugau

SEQ ID NO: 3690719 - RNA, 15 nt, Salmonella enterica enterica serovar Typhi Ty2
cuucugauggcuuug

SEQ ID NO: 3690720 - RNA, 22 nt, Salmonella enterica enterica serovar Typhi Ty2
cuucugcgcaggaggcuuccgc

SEQ ID NO: 3690721 - RNA, 23 nt, Salmonella enterica enterica serovar Typhi Ty2
cuucugcgucaugcuuuuuuucu

SEQ ID NO: 3690722 - RNA, 14 nt, Salmonella enterica enterica serovar Typhi Ty2
cuucugcugugcau

SEQ ID NO: 3690723 - RNA, 18 nt, Salmonella enterica enterica serovar Typhi Ty2
cuucuggcgucccuuucc

SEQ ID NO: 3690724 - RNA, 18 nt, Salmonella enterica enterica serovar Typhi Ty2
cuucugguagccagacau

SEQ ID NO: 3690725 - RNA, 16 nt, Salmonella enterica enterica serovar Typhi Ty2
cuucuguaauacgcug

SEQ ID NO: 3690726 - RNA, 23 nt, Salmonella enterica enterica serovar Typhi Ty2
cuucugucagccuugcaucucau

SEQ ID NO: 3690727 - RNA, 20 nt, Salmonella enterica enterica serovar Typhi Ty2
cuucugucugcgugaagaca

SEQ ID NO: 3690728 - RNA, 12 nt, Salmonella enterica enterica serovar Typhi Ty2
cuucuuaccgug

SEQ ID NO: 3690729 - RNA, 17 nt, Salmonella enterica enterica serovar Typhi Ty2
cuucuucaagccaggcu

SEQ ID NO: 3690730 - RNA, 17 nt, Salmonella enterica enterica serovar Typhi Ty2
cuucuucaguuccgcca

SEQ ID NO: 3690731 - RNA, 14 nt, Salmonella enterica enterica serovar Typhi Ty2
cuucuuccagcccg

SEQ ID NO: 3690732 - RNA, 12 nt, Salmonella enterica enterica serovar Typhi Ty2
cuucuuccagcg

SEQ ID NO: 3690733 - RNA, 21 nt, Salmonella enterica enterica serovar Typhi Ty2
cuucuucggcagcuuccagca

SEQ ID NO: 3690734 - RNA, 15 nt, Salmonella enterica enterica serovar Typhi Ty2
cuucuucuaccaccu

SEQ ID NO: 3690735 - RNA, 14 nt, Salmonella enterica enterica serovar Typhi Ty2
cuucuuuauccuga

SEQ ID NO: 3690736 - RNA, 21 nt, Salmonella enterica enterica serovar Typhi Ty2
cuucuuuauucgcgaugcacc

SEQ ID NO: 3690737 - RNA, 15 nt, Salmonella enterica enterica serovar Typhi Ty2
cuucuuugcgauuug

SEQ ID NO: 3690738 - RNA, 13 nt, Salmonella enterica enterica serovar Typhi Ty2
cuucuuugcgcgu

SEQ ID NO: 3690739 - RNA, 17 nt, Salmonella enterica enterica serovar Typhi Ty2
cuucuuuggcuuaauca

SEQ ID NO: 3690740 - RNA, 15 nt, Salmonella enterica enterica serovar Typhi Ty2
cuugaaagcaguccc

SEQ ID NO: 3690741 - RNA, 22 nt, Salmonella enterica enterica serovar Typhi Ty2
cuugaagccuuucuguucuuug

SEQ ID NO: 3690742 - RNA, 20 nt, Salmonella enterica enterica serovar Typhi Ty2
cuugaauccuuuaaucgccg

SEQ ID NO: 3690743 - RNA, 15 nt, Salmonella enterica enterica serovar Typhi Ty2
cuugaccagcacuuc

SEQ ID NO: 3690744 - RNA, 15 nt, Salmonella enterica enterica serovar Typhi Ty2
cuugaccgccugauc

SEQ ID NO: 3690745 - RNA, 18 nt, Salmonella enterica enterica serovar Typhi Ty2
cuugacgcuuugcauuau

SEQ ID NO: 3690746 - RNA, 16 nt, Salmonella enterica enterica serovar Typhi Ty2
cuugacgucgccauau

SEQ ID NO: 3690747 - RNA, 17 nt, Salmonella enterica enterica serovar Typhi Ty2
cuugacuuugcucuccu

SEQ ID NO: 3690748 - RNA, 11 nt, Salmonella enterica enterica serovar Typhi Ty2
cuugauaaaua

SEQ ID NO: 3690749 - RNA, 17 nt, Salmonella enterica enterica serovar Typhi Ty2
cuugauaaauaucaaga

SEQ ID NO: 3690750 - RNA, 22 nt, Salmonella enterica enterica serovar Typhi Ty2
cuuuaggguugacugccaggua

SEQ ID NO: 3690751 - RNA, 14 nt, Salmonella enterica enterica serovar Typhi Ty2
cuuuagugccgcca

SEQ ID NO: 3690752 - RNA, 20 nt, Salmonella enterica enterica serovar Typhi Ty2
cuuuauaaaucaggaaaaag

SEQ ID NO: 3690753 - RNA, 14 nt, Salmonella enterica enterica serovar Typhi Ty2
cuuuauacaguaag

SEQ ID NO: 3690754 - RNA, 12 nt, Salmonella enterica enterica serovar Typhi Ty2
cuuuauauuuuu

SEQ ID NO: 3690755 - RNA, 21 nt, Salmonella enterica enterica serovar Typhi Ty2
cuuuaucacuccuuaggccgu

SEQ ID NO: 3690756 - RNA, 15 nt, Salmonella enterica enterica serovar Typhi Ty2
cuuuauccggucugc

SEQ ID NO: 3690757 - RNA, 14 nt, Salmonella enterica enterica serovar Typhi Ty2
cuuuaucguaaccg

SEQ ID NO: 3690758 - RNA, 17 nt, Salmonella enterica enterica serovar Typhi Ty2
cuuuaucguaaccgaug

SEQ ID NO: 3690759 - RNA, 22 nt, Salmonella enterica enterica serovar Typhi Ty2
cuuuaucuucugcugcucccuc

SEQ ID NO: 3690760 - RNA, 15 nt, Salmonella enterica enterica serovar Typhi Ty2
cuuuaugucaguaau

SEQ ID NO: 3690761 - RNA, 21 nt, Salmonella enterica enterica serovar Typhi Ty2
cuuuaugucaguaauauauua

SEQ ID NO: 3690762 - RNA, 14 nt, Salmonella enterica enterica serovar Typhi Ty2
cuuuauucgcuugu

SEQ ID NO: 3690763 - RNA, 20 nt, Salmonella enterica enterica serovar Typhi Ty2
cuuuauuuuuaauugcugaa

SEQ ID NO: 3690764 - RNA, 18 nt, Salmonella enterica enterica serovar Typhi Ty2
cuuucaauccuucuucug

SEQ ID NO: 3690765 - RNA, 16 nt, Salmonella enterica enterica serovar Typhi Ty2
cuuucaauuuccgcac

SEQ ID NO: 3690766 - RNA, 24 nt, Salmonella enterica enterica serovar Typhi Ty2
cuuucaccagugauuggcuggaca

SEQ ID NO: 3690767 - RNA, 16 nt, Salmonella enterica enterica serovar Typhi Ty2
cuuucaccaucgcgau

SEQ ID NO: 3690768 - RNA, 14 nt, Salmonella enterica enterica serovar Typhi Ty2
cuuucacccauuga

SEQ ID NO: 3690769 - RNA, 18 nt, Salmonella enterica enterica serovar Typhi Ty2
cuuucaccggucgcaaga

SEQ ID NO: 3690770 - RNA, 21 nt, Salmonella enterica enterica serovar Typhi Ty2
cuuucagaccaaauucagcgu

SEQ ID NO: 3690771 - RNA, 18 nt, Salmonella enterica enterica serovar Typhi Ty2
cuuucagagcccgggaga

SEQ ID NO: 3690772 - RNA, 13 nt, Salmonella enterica enterica serovar Typhi Ty2
cuuucagaucggc

SEQ ID NO: 3690773 - RNA, 16 nt, Salmonella enterica enterica serovar Typhi Ty2
cuuucagaugcagcgg

SEQ ID NO: 3690774 - RNA, 12 nt, Salmonella enterica enterica serovar Typhi Ty2
cuuucagcucuu

SEQ ID NO: 3690775 - RNA, 17 nt, Salmonella enterica enterica serovar Typhi Ty2
cuuucaggaauuuauca

SEQ ID NO: 3690776 - RNA, 13 nt, Salmonella enterica enterica serovar Typhi Ty2
cuuucaucagccg

SEQ ID NO: 3690777 - RNA, 12 nt, Salmonella enterica enterica serovar Typhi Ty2
cuuucaucuuua

SEQ ID NO: 3690778 - RNA, 18 nt, Salmonella enterica enterica serovar Typhi Ty2
cuuucauuacgcuuccug

SEQ ID NO: 3690779 - RNA, 21 nt, Salmonella enterica enterica serovar Typhi Ty2
cuuucauuggauaaaguuuuc

SEQ ID NO: 3690780 - RNA, 13 nt, Salmonella enterica enterica serovar Typhi Ty2
cuuucauuucacu

SEQ ID NO: 3690781 - RNA, 16 nt, Salmonella enterica enterica serovar Typhi Ty2
cuuucauuucuuuaau

SEQ ID NO: 3690782 - RNA, 18 nt, Salmonella enterica enterica serovar Typhi Ty2
cuuuccaaaauccaggga

SEQ ID NO: 3690783 - RNA, 13 nt, Salmonella enterica enterica serovar Typhi Ty2
cuuuccaaccugu

SEQ ID NO: 3690784 - RNA, 13 nt, Salmonella enterica enterica serovar Typhi Ty2
cuuuccagaccaa

SEQ ID NO: 3690785 - RNA, 20 nt, Salmonella enterica enterica serovar Typhi Ty2
cuuuccagcaacugacgcgc

SEQ ID NO: 3690786 - RNA, 15 nt, Salmonella enterica enterica serovar Typhi Ty2
cuuuccagcuccagc

SEQ ID NO: 3690787 - RNA, 19 nt, Salmonella enterica enterica serovar Typhi Ty2
cuuuccagcuccagccgcu

SEQ ID NO: 3690788 - RNA, 15 nt, Salmonella enterica enterica serovar Typhi Ty2
cuuuccagucaacga

SEQ ID NO: 3690789 - RNA, 21 nt, Salmonella enterica enterica serovar Typhi Ty2
cuuuccaguucuggcugcgcu

SEQ ID NO: 3690790 - RNA, 13 nt, Salmonella enterica enterica serovar Typhi Ty2
cuuucccgucguc

SEQ ID NO: 3690791 - RNA, 17 nt, Salmonella enterica enterica serovar Typhi Ty2
cuuucccguuucagccc

SEQ ID NO: 3690792 - RNA, 16 nt, Salmonella enterica enterica serovar Typhi Ty2
cuuuccgaaucaggcg

SEQ ID NO: 3690793 - RNA, 15 nt, Salmonella enterica enterica serovar Typhi Ty2
cuuuccgcaccgcuu

SEQ ID NO: 3690794 - RNA, 17 nt, Salmonella enterica enterica serovar Typhi Ty2
cuuuccgccaugaaaaa

SEQ ID NO: 3690795 - RNA, 16 nt, Salmonella enterica enterica serovar Typhi Ty2
cuuuccggaacgcguu

SEQ ID NO: 3690796 - RNA, 17 nt, Salmonella enterica enterica serovar Typhi Ty2
cuuuccggcgcuuccug

SEQ ID NO: 3690797 - RNA, 15 nt, Salmonella enterica enterica serovar Typhi Ty2
cuuuccguacgguuu

SEQ ID NO: 3690798 - RNA, 13 nt, Salmonella enterica enterica serovar Typhi Ty2
cuuuccugcaaau

SEQ ID NO: 3690799 - RNA, 18 nt, Salmonella enterica enterica serovar Typhi Ty2
cuuuccuuauuaaagccc

SEQ ID NO: 3690800 - RNA, 23 nt, Salmonella enterica enterica serovar Typhi Ty2
cuuuccuuauuaaagccccuucc

SEQ ID NO: 3690801 - RNA, 18 nt, Salmonella enterica enterica serovar Typhi Ty2
cuuuccuuuuucaggcac

SEQ ID NO: 3690802 - RNA, 21 nt, Salmonella enterica enterica serovar Typhi Ty2
cuuucgaagccgaccaccauc

SEQ ID NO: 3690803 - RNA, 22 nt, Salmonella enterica enterica serovar Typhi Ty2
cuuucgauaaucugacgcggcg

SEQ ID NO: 3690804 - RNA, 21 nt, Salmonella enterica enterica serovar Typhi Ty2
cuuucgcaacauccgaaagcu

SEQ ID NO: 3690805 - RNA, 15 nt, Salmonella enterica enterica serovar Typhi Ty2
cuuucgccagcggcg

SEQ ID NO: 3690806 - RNA, 14 nt, Salmonella enterica enterica serovar Typhi Ty2
cuuucgccgccaga

SEQ ID NO: 3690807 - RNA, 22 nt, Salmonella enterica enterica serovar Typhi Ty2
cuuucggucguuugccgugcau

SEQ ID NO: 3690808 - RNA, 21 nt, Salmonella enterica enterica serovar Typhi Ty2
cuuucgucguccacucuuccg

SEQ ID NO: 3690809 - RNA, 20 nt, Salmonella enterica enterica serovar Typhi Ty2
cuuucucgaauccacuuuug

SEQ ID NO: 3690810 - RNA, 19 nt, Salmonella enterica enterica serovar Typhi Ty2
cuuucucggcuuuccagcu

SEQ ID NO: 3690811 - RNA, 13 nt, Salmonella enterica enterica serovar Typhi Ty2
cuuucucgggccu

SEQ ID NO: 3690812 - RNA, 14 nt, Salmonella enterica enterica serovar Typhi Ty2
cuuucugguaaccg

SEQ ID NO: 3690813 - RNA, 19 nt, Salmonella enterica enterica serovar Typhi Ty2
cuuucuuccagguuaaccc

SEQ ID NO: 3690814 - RNA, 15 nt, Salmonella enterica enterica serovar Typhi Ty2
cuuucuucccggcag

SEQ ID NO: 3690815 - RNA, 18 nt, Salmonella enterica enterica serovar Typhi Ty2
cuuucuugccacuggccu

SEQ ID NO: 3690816 - RNA, 16 nt, Salmonella enterica enterica serovar Typhi Ty2
cuuucuuuacaugacc

SEQ ID NO: 3690817 - RNA, 20 nt, Salmonella enterica enterica serovar Typhi Ty2
cuuucuuuuuauauuccccu

SEQ ID NO: 3690818 - RNA, 14 nt, Salmonella enterica enterica serovar Typhi Ty2
cuuucuuuuuuugu

SEQ ID NO: 3690819 - RNA, 14 nt, Salmonella enterica enterica serovar Typhi Ty2
cuuugaaaaucaca

SEQ ID NO: 3690820 - RNA, 18 nt, Salmonella enterica enterica serovar Typhi Ty2
cuuugaaaaucacaucgc

SEQ ID NO: 3690821 - RNA, 14 nt, Salmonella enterica enterica serovar Typhi Ty2
cuuugaacagccag

SEQ ID NO: 3690822 - RNA, 16 nt, Salmonella enterica enterica serovar Typhi Ty2
cuuugaacagccagaa

SEQ ID NO: 3690823 - RNA, 20 nt, Salmonella enterica enterica serovar Typhi Ty2
cuuugaacagccagaagccu

SEQ ID NO: 3690824 - RNA, 21 nt, Salmonella enterica enterica serovar Typhi Ty2
cuuugaccauuaccauuccuc

SEQ ID NO: 3690825 - RNA, 21 nt, Salmonella enterica enterica serovar Typhi Ty2
cuuugacccacgccagcagcu

SEQ ID NO: 3690826 - RNA, 18 nt, Salmonella enterica enterica serovar Typhi Ty2
cuuugacgacccgcuucc

SEQ ID NO: 3690827 - RNA, 22 nt, Salmonella enterica enterica serovar Typhi Ty2
cuuugagcaucaaacuuuuaaa

SEQ ID NO: 3690828 - RNA, 23 nt, Salmonella enterica enterica serovar Typhi Ty2
cuuugagcaucaaacuuuuaaau

SEQ ID NO: 3690829 - RNA, 23 nt, Salmonella enterica enterica serovar Typhi Ty2
cuuugauuacugagauggcgcca

SEQ ID NO: 3690830 - RNA, 13 nt, Salmonella enterica enterica serovar Typhi Ty2
cuuugcaaucgac

SEQ ID NO: 3690831 - RNA, 23 nt, Salmonella enterica enterica serovar Typhi Ty2
cuuugcaccgcuaaaaaacaggc

SEQ ID NO: 3690832 - RNA, 16 nt, Salmonella enterica enterica serovar Typhi Ty2
cuuuugcuacgucgcc

SEQ ID NO: 3690833 - RNA, 14 nt, Salmonella enterica enterica serovar Typhi Ty2
cuuuugcuuccagu

SEQ ID NO: 3690834 - RNA, 20 nt, Salmonella enterica enterica serovar Typhi Ty2
cuuuugcuuccaguuucuca

SEQ ID NO: 3690835 - RNA, 18 nt, Salmonella enterica enterica serovar Typhi Ty2
cuuuuggcgacaggcgcu

SEQ ID NO: 3690836 - RNA, 14 nt, Salmonella enterica enterica serovar Typhi Ty2
cuuuugguggcaac

SEQ ID NO: 3690837 - RNA, 17 nt, Salmonella enterica enterica serovar Typhi Ty2
cuuuugguggcaacaga

SEQ ID NO: 3690838 - RNA, 16 nt, Salmonella enterica enterica serovar Typhi Ty2
cuuuuuaggcuauaaa

SEQ ID NO: 3690839 - RNA, 18 nt, Salmonella enterica enterica serovar Typhi Ty2
cuuuuuaggcuauaaaaa

SEQ ID NO: 3690840 - RNA, 16 nt, Salmonella enterica enterica serovar Typhi Ty2
cuuuuuauauaagcau

SEQ ID NO: 3690841 - RNA, 17 nt, Salmonella enterica enterica serovar Typhi Ty2
cuuuuuauuuacugccg

SEQ ID NO: 3690842 - RNA, 16 nt, Salmonella enterica enterica serovar Typhi Ty2
cuuuuuauuuguuccu

SEQ ID NO: 3690843 - RNA, 15 nt, Salmonella enterica enterica serovar Typhi Ty2
cuuuuuauuuuucug

SEQ ID NO: 3690844 - RNA, 16 nt, Salmonella enterica enterica serovar Typhi Ty2
cuuuuucaauuuccag

SEQ ID NO: 3690845 - RNA, 20 nt, Salmonella enterica enterica serovar Typhi Ty2
cuuuuucauagaaccacuua

SEQ ID NO: 3690846 - RNA, 15 nt, Salmonella enterica enterica serovar Typhi Ty2
cuuuuucccacugcg

SEQ ID NO: 3690847 - RNA, 24 nt, Salmonella enterica enterica serovar Typhi Ty2
cuuuuuccuccugcggagagagca

SEQ ID NO: 3690848 - RNA, 20 nt, Salmonella enterica enterica serovar Typhi Ty2
cuuuuugcagauccuuaacg

SEQ ID NO: 3690849 - RNA, 20 nt, Salmonella enterica enterica serovar Typhi Ty2
cuuuuugcgacacgcugcau

SEQ ID NO: 3690850 - RNA, 19 nt, Salmonella enterica enterica serovar Typhi Ty2
cuuuuugcgccacuuuucc

SEQ ID NO: 3690851 - RNA, 12 nt, Salmonella enterica enterica serovar Typhi Ty2
cuuuuuuaaacg

SEQ ID NO: 3690852 - RNA, 13 nt, Salmonella enterica enterica serovar Typhi Ty2
cuuuuuuaacgau

SEQ ID NO: 3690853 - RNA, 19 nt, Salmonella enterica enterica serovar Typhi Ty2
cuuuuuuaacgauuucccc

SEQ ID NO: 3690854 - RNA, 21 nt, Salmonella enterica enterica serovar Typhi Ty2
cuuuuuuaccggaugggcaga

SEQ ID NO: 3690855 - RNA, 16 nt, Salmonella enterica enterica serovar Typhi Ty2
cuuuuuuggucagaaa

SEQ ID NO: 3690856 - RNA, 21 nt, Salmonella enterica enterica serovar Typhi Ty2
cuuuuuuguauuaacggcgcu

SEQ ID NO: 3690857 - RNA, 17 nt, Salmonella enterica enterica serovar Typhi Ty2
cuuuuuuuaugccuggg

SEQ ID NO: 3690858 - RNA, 16 nt, Salmonella enterica enterica serovar Typhi Ty2
cuuuuuuuccagcguc

SEQ ID NO: 3690859 - RNA, 20 nt, Salmonella enterica enterica serovar Typhi Ty2
gaaaaaaacgcauugcagca

SEQ ID NO: 3690860 - RNA, 14 nt, Salmonella enterica enterica serovar Typhi Ty2
gaaaaaaauccagu

SEQ ID NO: 3690861 - RNA, 22 nt, Salmonella enterica enterica serovar Typhi Ty2
gaaaaaacgggcccgcggcgac

SEQ ID NO: 3690862 - RNA, 17 nt, Salmonella enterica enterica serovar Typhi Ty2
gaaaaaacucaggaaau

SEQ ID NO: 3690863 - RNA, 23 nt, Salmonella enterica enterica serovar Typhi Ty2
gaaaaaagugaucccccagaauc

SEQ ID NO: 3690864 - RNA, 13 nt, Salmonella enterica enterica serovar Typhi Ty2
gaaaaaauacuga

SEQ ID NO: 3690865 - RNA, 19 nt, Salmonella enterica enterica serovar Typhi Ty2
gaaaaaauacugauaaaaa

SEQ ID NO: 3690866 - RNA, 18 nt, Salmonella enterica enterica serovar Typhi Ty2
gaaaaaauuacagccgcg

SEQ ID NO: 3690867 - RNA, 12 nt, Salmonella enterica enterica serovar Typhi Ty2
gaaaaaauuccc

SEQ ID NO: 3690868 - RNA, 21 nt, Salmonella enterica enterica serovar Typhi Ty2
gaaaaaauucccggcaugcca

SEQ ID NO: 3690869 - RNA, 17 nt, Salmonella enterica enterica serovar Typhi Ty2
gaaaaaccaaaaaauau

SEQ ID NO: 3690870 - RNA, 21 nt, Salmonella enterica enterica serovar Typhi Ty2
gaaaaacgcuaccgucgccga

SEQ ID NO: 3690871 - RNA, 18 nt, Salmonella enterica enterica serovar Typhi Ty2
gaaaaagaaaccuccgca

SEQ ID NO: 3690872 - RNA, 19 nt, Salmonella enterica enterica serovar Typhi Ty2
gaaaaagccaaaaggcgcc

SEQ ID NO: 3690873 - RNA, 22 nt, Salmonella enterica enterica serovar Typhi Ty2
gaaaaagcgcacuuuccauaau

SEQ ID NO: 3690874 - RNA, 21 nt, Salmonella enterica enterica serovar Typhi Ty2
gaaaaagcggcuguagccagc

SEQ ID NO: 3690875 - RNA, 14 nt, Salmonella enterica enterica serovar Typhi Ty2
gaaaaagggaaaag

SEQ ID NO: 3690876 - RNA, 16 nt, Salmonella enterica enterica serovar Typhi Ty2
gaaaaagggaauaaua

SEQ ID NO: 3690877 - RNA, 13 nt, Salmonella enterica enterica serovar Typhi Ty2
gaaaaaucauuau

SEQ ID NO: 3690878 - RNA, 16 nt, Salmonella enterica enterica serovar Typhi Ty2
gaaaaaugaauaccaa

SEQ ID NO: 3690879 - RNA, 22 nt, Salmonella enterica enterica serovar Typhi Ty2
gaaaaaugagacgccgaugagc

SEQ ID NO: 3690880 - RNA, 13 nt, Salmonella enterica enterica serovar Typhi Ty2
gaaaaauguucag

SEQ ID NO: 3690881 - RNA, 14 nt, Salmonella enterica enterica serovar Typhi Ty2
gaaaacaaauugca

SEQ ID NO: 3690882 - RNA, 11 nt, Salmonella enterica enterica serovar Typhi Ty2
gaaaacaucac

SEQ ID NO: 3690883 - RNA, 18 nt, Salmonella enterica enterica serovar Typhi Ty2
gaaaaccacaaucacagc

SEQ ID NO: 3690884 - RNA, 13 nt, Salmonella enterica enterica serovar Typhi Ty2
gaaaaccagcgcc

SEQ ID NO: 3690885 - RNA, 20 nt, Salmonella enterica enterica serovar Typhi Ty2
gaaaaccccaucccggcaac

SEQ ID NO: 3690886 - RNA, 18 nt, Salmonella enterica enterica serovar Typhi Ty2
gaaaaccguacucgcugg

SEQ ID NO: 3690887 - RNA, 17 nt, Salmonella enterica enterica serovar Typhi Ty2
gaaaaccuuugcugacg

SEQ ID NO: 3690888 - RNA, 14 nt, Salmonella enterica enterica serovar Typhi Ty2
gaaaacuuuccaac

SEQ ID NO: 3690889 - RNA, 20 nt, Salmonella enterica enterica serovar Typhi Ty2
gaaaacuuuccaaccuguua

SEQ ID NO: 3690890 - RNA, 12 nt, Salmonella enterica enterica serovar Typhi Ty2
gaaaagaaccga

SEQ ID NO: 3690891 - RNA, 12 nt, Salmonella enterica enterica serovar Typhi Ty2
gaaaagcagagg

SEQ ID NO: 3690892 - RNA, 20 nt, Salmonella enterica enterica serovar Typhi Ty2
gaaaagcgggggcgacagcc

SEQ ID NO: 3690893 - RNA, 19 nt, Salmonella enterica enterica serovar Typhi Ty2
gaaaagcuggagguggaag

SEQ ID NO: 3690894 - RNA, 11 nt, Salmonella enterica enterica serovar Typhi Ty2
gaaaagcuggu

SEQ ID NO: 3690895 - RNA, 20 nt, Salmonella enterica enterica serovar Typhi Ty2
gaaaagcuguagcauaaaug

SEQ ID NO: 3690896 - RNA, 20 nt, Salmonella enterica enterica serovar Typhi Ty2
gaaaaggaagaauaaauaac

SEQ ID NO: 3690897 - RNA, 23 nt, Salmonella enterica enterica serovar Typhi Ty2
gaaaaggccuggcugagaaaaau

SEQ ID NO: 3690898 - RNA, 22 nt, Salmonella enterica enterica serovar Typhi Ty2
gaaaagggaugcugaagccgcu

SEQ ID NO: 3690899 - RNA, 17 nt, Salmonella enterica enterica serovar Typhi Ty2
gaaaaggucgucaggcc

SEQ ID NO: 3690900 - RNA, 21 nt, Salmonella enterica enterica serovar Typhi Ty2
gaaaagguuucggcgaucacc

SEQ ID NO: 3690901 - RNA, 22 nt, Salmonella enterica enterica serovar Typhi Ty2
gaaaagguuucggcgaucacca

SEQ ID NO: 3690902 - RNA, 17 nt, Salmonella enterica enterica serovar Typhi Ty2
gaaaagucauuuucaug

SEQ ID NO: 3690903 - RNA, 12 nt, Salmonella enterica enterica serovar Typhi Ty2
gaaaagugaacg

SEQ ID NO: 3690904 - RNA, 22 nt, Salmonella enterica enterica serovar Typhi Ty2
gaaaaguuacaggcuccaagua

SEQ ID NO: 3690905 - RNA, 23 nt, Salmonella enterica enterica serovar Typhi Ty2
gaaaauaaacgcuugacucugaa

SEQ ID NO: 3690906 - RNA, 14 nt, Salmonella enterica enterica serovar Typhi Ty2
gaaaauaacaauau

SEQ ID NO: 3690907 - RNA, 17 nt, Salmonella enterica enterica serovar Typhi Ty2
gaaaauaccgcacauca

SEQ ID NO: 3690908 - RNA, 13 nt, Salmonella enterica enterica serovar Typhi Ty2
gaaaauacucccg

SEQ ID NO: 3690909 - RNA, 13 nt, Salmonella enterica enterica serovar Typhi Ty2
gaaaauauaaucu

SEQ ID NO: 3690910 - RNA, 15 nt, Salmonella enterica enterica serovar Typhi Ty2
gaaaauauacaccug

SEQ ID NO: 3690911 - RNA, 16 nt, Salmonella enterica enterica serovar Typhi Ty2
gaaaauauaugacaac

SEQ ID NO: 3690912 - RNA, 19 nt, Salmonella enterica enterica serovar Typhi Ty2
gaaaauauuagcggcggca

SEQ ID NO: 3690913 - RNA, 20 nt, Salmonella enterica enterica serovar Typhi Ty2
gaaaaucagugaacacccug

SEQ ID NO: 3690914 - RNA, 16 nt, Salmonella enterica enterica serovar Typhi Ty2
gaaauaugacgaggau

SEQ ID NO: 3690915 - RNA, 18 nt, Salmonella enterica enterica serovar Typhi Ty2
gaaauauuauuccgguuc

SEQ ID NO: 3690916 - RNA, 15 nt, Salmonella enterica enterica serovar Typhi Ty2
gaaauauuucacguu

SEQ ID NO: 3690917 - RNA, 13 nt, Salmonella enterica enterica serovar Typhi Ty2
gaaauauuugauc

SEQ ID NO: 3690918 - RNA, 19 nt, Salmonella enterica enterica serovar Typhi Ty2
gaaaucacaaacaccacca

SEQ ID NO: 3690919 - RNA, 23 nt, Salmonella enterica enterica serovar Typhi Ty2
gaaaucacaaacaccaccaguaa

SEQ ID NO: 3690920 - RNA, 22 nt, Salmonella enterica enterica serovar Typhi Ty2
gaaaucacgcucaucggcggca

SEQ ID NO: 3690921 - RNA, 13 nt, Salmonella enterica enterica serovar Typhi Ty2
gaaaucagcaggu

SEQ ID NO: 3690922 - RNA, 14 nt, Salmonella enterica enterica serovar Typhi Ty2
gaaauccagcagaa

SEQ ID NO: 3690923 - RNA, 23 nt, Salmonella enterica enterica serovar Typhi Ty2
gaaauccgcgaauaccuucccgc

SEQ ID NO: 3690924 - RNA, 22 nt, Salmonella enterica enterica serovar Typhi Ty2
gaaaucgccgggcuauccggcu

SEQ ID NO: 3690925 - RNA, 15 nt, Salmonella enterica enterica serovar Typhi Ty2
gaaaucgcggcgaug

SEQ ID NO: 3690926 - RNA, 22 nt, Salmonella enterica enterica serovar Typhi Ty2
gaaaucgucagacggcuccagc

SEQ ID NO: 3690927 - RNA, 14 nt, Salmonella enterica enterica serovar Typhi Ty2
gaaaucuaucugua

SEQ ID NO: 3690928 - RNA, 17 nt, Salmonella enterica enterica serovar Typhi Ty2
gaaaucucccuggcagu

SEQ ID NO: 3690929 - RNA, 23 nt, Salmonella enterica enterica serovar Typhi Ty2
gaaaucugcacguaccugcucca

SEQ ID NO: 3690930 - RNA, 16 nt, Salmonella enterica enterica serovar Typhi Ty2
gaaaugaaaaagauag

SEQ ID NO: 3690931 - RNA, 14 nt, Salmonella enterica enterica serovar Typhi Ty2
gaaaugaaaacucg

SEQ ID NO: 3690932 - RNA, 11 nt, Salmonella enterica enterica serovar Typhi Ty2
gaaaugagaaa

SEQ ID NO: 3690933 - RNA, 15 nt, Salmonella enterica enterica serovar Typhi Ty2
gaaaugagaaaagga

SEQ ID NO: 3690934 - RNA, 22 nt, Salmonella enterica enterica serovar Typhi Ty2
gaaaugagcgcgccaaccugcu

SEQ ID NO: 3690935 - RNA, 16 nt, Salmonella enterica enterica serovar Typhi Ty2
gaaaugauaagugaua

SEQ ID NO: 3690936 - RNA, 20 nt, Salmonella enterica enterica serovar Typhi Ty2
gaaaugcaggcguuuuauug

SEQ ID NO: 3690937 - RNA, 19 nt, Salmonella enterica enterica serovar Typhi Ty2
gaaaugcagggauccugua

SEQ ID NO: 3690938 - RNA, 20 nt, Salmonella enterica enterica serovar Typhi Ty2
gaaaugcccauaaagaaaua

SEQ ID NO: 3690939 - RNA, 17 nt, Salmonella enterica enterica serovar Typhi Ty2
gaaaugccggauggcgu

SEQ ID NO: 3690940 - RNA, 18 nt, Salmonella enterica enterica serovar Typhi Ty2
gaaaugccuuauccggcc

SEQ ID NO: 3690941 - RNA, 19 nt, Salmonella enterica enterica serovar Typhi Ty2
gaaaugcgaauccggcggc

SEQ ID NO: 3690942 - RNA, 17 nt, Salmonella enterica enterica serovar Typhi Ty2
gaaaugcgacaucucag

SEQ ID NO: 3690943 - RNA, 21 nt, Salmonella enterica enterica serovar Typhi Ty2
gaaaugcgcggugucauugac

SEQ ID NO: 3690944 - RNA, 17 nt, Salmonella enterica enterica serovar Typhi Ty2
gaaauggguaucuucau

SEQ ID NO: 3690945 - RNA, 15 nt, Salmonella enterica enterica serovar Typhi Ty2
gaaaugguugcguuu

SEQ ID NO: 3690946 - RNA, 16 nt, Salmonella enterica enterica serovar Typhi Ty2
gaaauuagagccgaua

SEQ ID NO: 3690947 - RNA, 17 nt, Salmonella enterica enterica serovar Typhi Ty2
gaaauucuaugccaggc

SEQ ID NO: 3690948 - RNA, 22 nt, Salmonella enterica enterica serovar Typhi Ty2
gaaauucugacgcagcuucuga

SEQ ID NO: 3690949 - RNA, 16 nt, Salmonella enterica enterica serovar Typhi Ty2
gaaauugaauuauaau

SEQ ID NO: 3690950 - RNA, 13 nt, Salmonella enterica enterica serovar Typhi Ty2
gaaauuuauucau

SEQ ID NO: 3690951 - RNA, 13 nt, Salmonella enterica enterica serovar Typhi Ty2
gaaauuugcagcg

SEQ ID NO: 3690952 - RNA, 14 nt, Salmonella enterica enterica serovar Typhi Ty2
gaacaaaagaaagc

SEQ ID NO: 3690953 - RNA, 20 nt, Salmonella enterica enterica serovar Typhi Ty2
gaacaaaagaaagcaauagc

SEQ ID NO: 3690954 - RNA, 20 nt, Salmonella enterica enterica serovar Typhi Ty2
gaacaaacagaccgccaugc

SEQ ID NO: 3690955 - RNA, 20 nt, Salmonella enterica enterica serovar Typhi Ty2
gaacaacgagauucaauaau

SEQ ID NO: 3690956 - RNA, 21 nt, Salmonella enterica enterica serovar Typhi Ty2
gaacaaguucuucgaagcacu

SEQ ID NO: 3690957 - RNA, 17 nt, Salmonella enterica enterica serovar Typhi Ty2
gaacaauaacaccacaa

SEQ ID NO: 3690958 - RNA, 20 nt, Salmonella enterica enterica serovar Typhi Ty2
gaacaaugccauuauugcau

SEQ ID NO: 3690959 - RNA, 15 nt, Salmonella enterica enterica serovar Typhi Ty2
gaacacagcaugaau

SEQ ID NO: 3690960 - RNA, 18 nt, Salmonella enterica enterica serovar Typhi Ty2
gaacacagcaugaauaac

SEQ ID NO: 3690961 - RNA, 14 nt, Salmonella enterica enterica serovar Typhi Ty2
gaacacuaaaacac

SEQ ID NO: 3690962 - RNA, 16 nt, Salmonella enterica enterica serovar Typhi Ty2
gaacacucuaaaucua

SEQ ID NO: 3690963 - RNA, 17 nt, Salmonella enterica enterica serovar Typhi Ty2
gaacacucuaaaucuac

SEQ ID NO: 3690964 - RNA, 16 nt, Salmonella enterica enterica serovar Typhi Ty2
gaacagaaaaaaugca

SEQ ID NO: 3690965 - RNA, 21 nt, Salmonella enterica enterica serovar Typhi Ty2
gaacagaaaaaaugcaccgcc

SEQ ID NO: 3690966 - RNA, 14 nt, Salmonella enterica enterica serovar Typhi Ty2
gaacagaagcgccg

SEQ ID NO: 3690967 - RNA, 14 nt, Salmonella enterica enterica serovar Typhi Ty2
gaacagacggcggc

SEQ ID NO: 3690968 - RNA, 15 nt, Salmonella enterica enterica serovar Typhi Ty2
gaacagacggcggcu

SEQ ID NO: 3690969 - RNA, 20 nt, Salmonella enterica enterica serovar Typhi Ty2
gaacagcaaugcccaaaaua

SEQ ID NO: 3690970 - RNA, 19 nt, Salmonella enterica enterica serovar Typhi Ty2
gaacagcacguuaccggcg

SEQ ID NO: 3690971 - RNA, 13 nt, Salmonella enterica enterica serovar Typhi Ty2
gaacagcggcagg

SEQ ID NO: 3690972 - RNA, 16 nt, Salmonella enterica enterica serovar Typhi Ty2
gaacagcgucauccag

SEQ ID NO: 3690973 - RNA, 19 nt, Salmonella enterica enterica serovar Typhi Ty2
gaacaggccaaacccugcg

SEQ ID NO: 3690974 - RNA, 18 nt, Salmonella enterica enterica serovar Typhi Ty2
gaacaggcuuuucaggcu

SEQ ID NO: 3690975 - RNA, 21 nt, Salmonella enterica enterica serovar Typhi Ty2
gaacagggcgggcgauagaga

SEQ ID NO: 3690976 - RNA, 22 nt, Salmonella enterica enterica serovar Typhi Ty2
gaacagugacaaacucacguuc

SEQ ID NO: 3690977 - RNA, 18 nt, Salmonella enterica enterica serovar Typhi Ty2
gaacaguguaaacgccag

SEQ ID NO: 3690978 - RNA, 23 nt, Salmonella enterica enterica serovar Typhi Ty2
gaacaguguaaacgccagauaau

SEQ ID NO: 3690979 - RNA, 18 nt, Salmonella enterica enterica serovar Typhi Ty2
gaacaucaagcgguagcg

SEQ ID NO: 3690980 - RNA, 18 nt, Salmonella enterica enterica serovar Typhi Ty2
gaacaucacgaugaaagg

SEQ ID NO: 3690981 - RNA, 13 nt, Salmonella enterica enterica serovar Typhi Ty2
gaacaucagccag

SEQ ID NO: 3690982 - RNA, 18 nt, Salmonella enterica enterica serovar Typhi Ty2
gaacaucagccagcagcu

SEQ ID NO: 3690983 - RNA, 15 nt, Salmonella enterica enterica serovar Typhi Ty2
gaacauccucuccug

SEQ ID NO: 3690984 - RNA, 17 nt, Salmonella enterica enterica serovar Typhi Ty2
gaacauccuugcacgcc

SEQ ID NO: 3690985 - RNA, 23 nt, Salmonella enterica enterica serovar Typhi Ty2
gaacaucgacauucgauguuacu

SEQ ID NO: 3690986 - RNA, 16 nt, Salmonella enterica enterica serovar Typhi Ty2
gaacaucgacccccac

SEQ ID NO: 3690987 - RNA, 19 nt, Salmonella enterica enterica serovar Typhi Ty2
gaacaucgguuuguucaua

SEQ ID NO: 3690988 - RNA, 18 nt, Salmonella enterica enterica serovar Typhi Ty2
gaacaucguguccugggu

SEQ ID NO: 3690989 - RNA, 14 nt, Salmonella enterica enterica serovar Typhi Ty2
gaacaugacggcag

SEQ ID NO: 3690990 - RNA, 12 nt, Salmonella enterica enterica serovar Typhi Ty2
gaacaugcauau

SEQ ID NO: 3690991 - RNA, 15 nt, Salmonella enterica enterica serovar Typhi Ty2
gaacaugccgacgga

SEQ ID NO: 3690992 - RNA, 14 nt, Salmonella enterica enterica serovar Typhi Ty2
gaacauuacauccu

SEQ ID NO: 3690993 - RNA, 18 nt, Salmonella enterica enterica serovar Typhi Ty2
gaacauuggaauauccgc

SEQ ID NO: 3690994 - RNA, 15 nt, Salmonella enterica enterica serovar Typhi Ty2
gaaccaacagcuggg

SEQ ID NO: 3690995 - RNA, 21 nt, Salmonella enterica enterica serovar Typhi Ty2
gaaccaacgcauaaaaacgug

SEQ ID NO: 3690996 - RNA, 18 nt, Salmonella enterica enterica serovar Typhi Ty2
gaagagcucgaccaacau

SEQ ID NO: 3690997 - RNA, 17 nt, Salmonella enterica enterica serovar Typhi Ty2
gaagauaaacagcagcg

SEQ ID NO: 3690998 - RNA, 16 nt, Salmonella enterica enterica serovar Typhi Ty2
gaagauaaagauauuc

SEQ ID NO: 3690999 - RNA, 20 nt, Salmonella enterica enterica serovar Typhi Ty2
gaagauagcgggcaaugcca

SEQ ID NO: 3691000 - RNA, 19 nt, Salmonella enterica enterica serovar Typhi Ty2
gaagaucgcguacagcgcc

SEQ ID NO: 3691001 - RNA, 16 nt, Salmonella enterica enterica serovar Typhi Ty2
gaagaucguuauccag

SEQ ID NO: 3691002 - RNA, 22 nt, Salmonella enterica enterica serovar Typhi Ty2
gaagauuaacccggucauccag

SEQ ID NO: 3691003 - RNA, 14 nt, Salmonella enterica enterica serovar Typhi Ty2
gaagauuagcagag

SEQ ID NO: 3691004 - RNA, 16 nt, Salmonella enterica enterica serovar Typhi Ty2
gaagauuagcagagcg

SEQ ID NO: 3691005 - RNA, 22 nt, Salmonella enterica enterica serovar Typhi Ty2
gaagauuucuuaauuccucaga

SEQ ID NO: 3691006 - RNA, 14 nt, Salmonella enterica enterica serovar Typhi Ty2
gaagcacauccaug

SEQ ID NO: 3691007 - RNA, 17 nt, Salmonella enterica enterica serovar Typhi Ty2
gaagcacgacacaaaag

SEQ ID NO: 3691008 - RNA, 18 nt, Salmonella enterica enterica serovar Typhi Ty2
gaagcacgacacaaaagc

SEQ ID NO: 3691009 - RNA, 17 nt, Salmonella enterica enterica serovar Typhi Ty2
gaagcaggcggagaagg

SEQ ID NO: 3691010 - RNA, 21 nt, Salmonella enterica enterica serovar Typhi Ty2
gaagccaccggauugccuucu

SEQ ID NO: 3691011 - RNA, 21 nt, Salmonella enterica enterica serovar Typhi Ty2
gaagccauccucacgcaacca

SEQ ID NO: 3691012 - RNA, 21 nt, Salmonella enterica enterica serovar Typhi Ty2
gaagcccucggcgaacaggcg

SEQ ID NO: 3691013 - RNA, 13 nt, Salmonella enterica enterica serovar Typhi Ty2
gaagccugcuuca

SEQ ID NO: 3691014 - RNA, 18 nt, Salmonella enterica enterica serovar Typhi Ty2
gaagccuggugcccaacc

SEQ ID NO: 3691015 - RNA, 14 nt, Salmonella enterica enterica serovar Typhi Ty2
gaagccuuucuguu

SEQ ID NO: 3691016 - RNA, 19 nt, Salmonella enterica enterica serovar Typhi Ty2
gaagcgaccggcgucauca

SEQ ID NO: 3691017 - RNA, 18 nt, Salmonella enterica enterica serovar Typhi Ty2
gaagcgacgcuggcggcc

SEQ ID NO: 3691018 - RNA, 17 nt, Salmonella enterica enterica serovar Typhi Ty2
gaagcgauuuauccacc

SEQ ID NO: 3691019 - RNA, 22 nt, Salmonella enterica enterica serovar Typhi Ty2
gaagcgcaaacggaucuuccac

SEQ ID NO: 3691020 - RNA, 21 nt, Salmonella enterica enterica serovar Typhi Ty2
gaagcgccuguuaucaggacg

SEQ ID NO: 3691021 - RNA, 21 nt, Salmonella enterica enterica serovar Typhi Ty2
gaagcgcgcgcacaacgugca

SEQ ID NO: 3691022 - RNA, 18 nt, Salmonella enterica enterica serovar Typhi Ty2
gaagcgcguucgucccac

SEQ ID NO: 3691023 - RNA, 19 nt, Salmonella enterica enterica serovar Typhi Ty2
gaagcggcgcuauccggca

SEQ ID NO: 3691024 - RNA, 14 nt, Salmonella enterica enterica serovar Typhi Ty2
gaagcguaacagcg

SEQ ID NO: 3691025 - RNA, 13 nt, Salmonella enterica enterica serovar Typhi Ty2
gaagcgucaucaa

SEQ ID NO: 3691026 - RNA, 16 nt, Salmonella enterica enterica serovar Typhi Ty2
gaagcguuccgccacu

SEQ ID NO: 3691027 - RNA, 22 nt, Salmonella enterica enterica serovar Typhi Ty2
gaagcucaugugcagcauccag

SEQ ID NO: 3691028 - RNA, 14 nt, Salmonella enterica enterica serovar Typhi Ty2
gaagcugaccaggg

SEQ ID NO: 3691029 - RNA, 17 nt, Salmonella enterica enterica serovar Typhi Ty2
gaagcuggagccacauc

SEQ ID NO: 3691030 - RNA, 13 nt, Salmonella enterica enterica serovar Typhi Ty2
gaagcuuaccacc

SEQ ID NO: 3691031 - RNA, 23 nt, Salmonella enterica enterica serovar Typhi Ty2
gaaggaauuaugcagacgcucgu

SEQ ID NO: 3691032 - RNA, 19 nt, Salmonella enterica enterica serovar Typhi Ty2
gaaggacugauacagccaa

SEQ ID NO: 3691033 - RNA, 21 nt, Salmonella enterica enterica serovar Typhi Ty2
gaaggagcaaugagauccacu

SEQ ID NO: 3691034 - RNA, 14 nt, Salmonella enterica enterica serovar Typhi Ty2
gaaggcaacugauc

SEQ ID NO: 3691035 - RNA, 16 nt, Salmonella enterica enterica serovar Typhi Ty2
gaaggcaacugauccu

SEQ ID NO: 3691036 - RNA, 13 nt, Salmonella enterica enterica serovar Typhi Ty2
gaaggcaucuuca

SEQ ID NO: 3691037 - RNA, 22 nt, Salmonella enterica enterica serovar Typhi Ty2
gaaggcauuucaaucgccacca

SEQ ID NO: 3691038 - RNA, 14 nt, Salmonella enterica enterica serovar Typhi Ty2
gaaggcgugcagcg

SEQ ID NO: 3691039 - RNA, 16 nt, Salmonella enterica enterica serovar Typhi Ty2
gaaggcuaacagcugg

SEQ ID NO: 3691040 - RNA, 22 nt, Salmonella enterica enterica serovar Typhi Ty2
gaaggcucuacucgcggacgac

SEQ ID NO: 3691041 - RNA, 16 nt, Salmonella enterica enterica serovar Typhi Ty2
gaaggcuuugccauac

SEQ ID NO: 3691042 - RNA, 17 nt, Salmonella enterica enterica serovar Typhi Ty2
gaagggcaauaucauga

SEQ ID NO: 3691043 - RNA, 14 nt, Salmonella enterica enterica serovar Typhi Ty2
gaagggcaggggaa

SEQ ID NO: 3691044 - RNA, 15 nt, Salmonella enterica enterica serovar Typhi Ty2
gaagggcggcuggau

SEQ ID NO: 3691045 - RNA, 19 nt, Salmonella enterica enterica serovar Typhi Ty2
gaaggggcgggcagcagca

SEQ ID NO: 3691046 - RNA, 19 nt, Salmonella enterica enterica serovar Typhi Ty2
gaagggugacgugccgcag

SEQ ID NO: 3691047 - RNA, 20 nt, Salmonella enterica enterica serovar Typhi Ty2
gaaggucuugauggcgauca

SEQ ID NO: 3691048 - RNA, 20 nt, Salmonella enterica enterica serovar Typhi Ty2
gaagguuucgauagcaggca

SEQ ID NO: 3691049 - RNA, 14 nt, Salmonella enterica enterica serovar Typhi Ty2
gaagguuuuucccg

SEQ ID NO: 3691050 - RNA, 12 nt, Salmonella enterica enterica serovar Typhi Ty2
gaaguaaaaaaa

SEQ ID NO: 3691051 - RNA, 14 nt, Salmonella enterica enterica serovar Typhi Ty2
gaaguacuggauca

SEQ ID NO: 3691052 - RNA, 17 nt, Salmonella enterica enterica serovar Typhi Ty2
gaaguagcagagaaaag

SEQ ID NO: 3691053 - RNA, 21 nt, Salmonella enterica enterica serovar Typhi Ty2
gaaguagcagagaaaagguug

SEQ ID NO: 3691054 - RNA, 16 nt, Salmonella enterica enterica serovar Typhi Ty2
gaagucaaaggccagu

SEQ ID NO: 3691055 - RNA, 15 nt, Salmonella enterica enterica serovar Typhi Ty2
gaagucauucgcagc

SEQ ID NO: 3691056 - RNA, 21 nt, Salmonella enterica enterica serovar Typhi Ty2
gaaguccguauuauccacccc

SEQ ID NO: 3691057 - RNA, 14 nt, Salmonella enterica enterica serovar Typhi Ty2
gaaguccuucacaa

SEQ ID NO: 3691058 - RNA, 17 nt, Salmonella enterica enterica serovar Typhi Ty2
gaagucgaaauuuucuu

SEQ ID NO: 3691059 - RNA, 20 nt, Salmonella enterica enterica serovar Typhi Ty2
gaagugauccuucaacgucu

SEQ ID NO: 3691060 - RNA, 19 nt, Salmonella enterica enterica serovar Typhi Ty2
gaagugcagcguuuccagc

SEQ ID NO: 3691061 - RNA, 15 nt, Salmonella enterica enterica serovar Typhi Ty2
gaagugccaguaacu

SEQ ID NO: 3691062 - RNA, 20 nt, Salmonella enterica enterica serovar Typhi Ty2
gaagugguggcgaacaggcu

SEQ ID NO: 3691063 - RNA, 15 nt, Salmonella enterica enterica serovar Typhi Ty2
gaaguggugggugau

SEQ ID NO: 3691064 - RNA, 17 nt, Salmonella enterica enterica serovar Typhi Ty2
gaaguucuucuggcgca

SEQ ID NO: 3691065 - RNA, 14 nt, Salmonella enterica enterica serovar Typhi Ty2
gaauaaaacugccg

SEQ ID NO: 3691066 - RNA, 11 nt, Salmonella enterica enterica serovar Typhi Ty2
gaauaaacaca

SEQ ID NO: 3691067 - RNA, 13 nt, Salmonella enterica enterica serovar Typhi Ty2
gaauaaacucccg

SEQ ID NO: 3691068 - RNA, 17 nt, Salmonella enterica enterica serovar Typhi Ty2
gaauaaaggauuguacu

SEQ ID NO: 3691069 - RNA, 15 nt, Salmonella enterica enterica serovar Typhi Ty2
gaauaaaggccggga

SEQ ID NO: 3691070 - RNA, 16 nt, Salmonella enterica enterica serovar Typhi Ty2
gaauaaagguggugcg

SEQ ID NO: 3691071 - RNA, 21 nt, Salmonella enterica enterica serovar Typhi Ty2
gaauaaauauaagaucuauuu

SEQ ID NO: 3691072 - RNA, 11 nt, Salmonella enterica enterica serovar Typhi Ty2
gaauaaauccu

SEQ ID NO: 3691073 - RNA, 12 nt, Salmonella enterica enterica serovar Typhi Ty2
gaauaacagcac

SEQ ID NO: 3691074 - RNA, 17 nt, Salmonella enterica enterica serovar Typhi Ty2
gaauaacaucguaaauc

SEQ ID NO: 3691075 - RNA, 19 nt, Salmonella enterica enterica serovar Typhi Ty2
gaauaacaucguaaaucaa

SEQ ID NO: 3691076 - RNA, 16 nt, Salmonella enterica enterica serovar Typhi Ty2
gaauaacaucuuccau

SEQ ID NO: 3691077 - RNA, 16 nt, Salmonella enterica enterica serovar Typhi Ty2
gaauaaccacugaugg

SEQ ID NO: 3691078 - RNA, 24 nt, Salmonella enterica enterica serovar Typhi Ty2
gaaugccccagguuauagaccugc

SEQ ID NO: 3691079 - RNA, 16 nt, Salmonella enterica enterica serovar Typhi Ty2
gaaugcccuuuuccag

SEQ ID NO: 3691080 - RNA, 18 nt, Salmonella enterica enterica serovar Typhi Ty2
gaaugccgaauggcgggc

SEQ ID NO: 3691081 - RNA, 18 nt, Salmonella enterica enterica serovar Typhi Ty2
gaaugccggauggcggcg

SEQ ID NO: 3691082 - RNA, 19 nt, Salmonella enterica enterica serovar Typhi Ty2
gaaugccuuuuacaauaac

SEQ ID NO: 3691083 - RNA, 23 nt, Salmonella enterica enterica serovar Typhi Ty2
gaaugcgcgcgugaccccaggca

SEQ ID NO: 3691084 - RNA, 14 nt, Salmonella enterica enterica serovar Typhi Ty2
gaaugcuauaugca

SEQ ID NO: 3691085 - RNA, 17 nt, Salmonella enterica enterica serovar Typhi Ty2
gaaugcuauaugcaggc

SEQ ID NO: 3691086 - RNA, 17 nt, Salmonella enterica enterica serovar Typhi Ty2
gaaugcugacgcguuuu

SEQ ID NO: 3691087 - RNA, 12 nt, Salmonella enterica enterica serovar Typhi Ty2
gaauggagaagc

SEQ ID NO: 3691088 - RNA, 16 nt, Salmonella enterica enterica serovar Typhi Ty2
gaauggagaagcgcgc

SEQ ID NO: 3691089 - RNA, 20 nt, Salmonella enterica enterica serovar Typhi Ty2
gaauggcgggccuacgcgca

SEQ ID NO: 3691090 - RNA, 19 nt, Salmonella enterica enterica serovar Typhi Ty2
gaauggggaaauaaauaug

SEQ ID NO: 3691091 - RNA, 23 nt, Salmonella enterica enterica serovar Typhi Ty2
gaauggugcggccuuacccauac

SEQ ID NO: 3691092 - RNA, 17 nt, Salmonella enterica enterica serovar Typhi Ty2
gaauguauaauccaaca

SEQ ID NO: 3691093 - RNA, 19 nt, Salmonella enterica enterica serovar Typhi Ty2
gaauguccccauaucccgc

SEQ ID NO: 3691094 - RNA, 19 nt, Salmonella enterica enterica serovar Typhi Ty2
gaaugugaaauacagccag

SEQ ID NO: 3691095 - RNA, 14 nt, Salmonella enterica enterica serovar Typhi Ty2
gaaugugcaccuua

SEQ ID NO: 3691096 - RNA, 17 nt, Salmonella enterica enterica serovar Typhi Ty2
gaaugugcuuaucacgu

SEQ ID NO: 3691097 - RNA, 16 nt, Salmonella enterica enterica serovar Typhi Ty2
gaauuaagcaauccau

SEQ ID NO: 3691098 - RNA, 12 nt, Salmonella enterica enterica serovar Typhi Ty2
gaauuacgggcg

SEQ ID NO: 3691099 - RNA, 15 nt, Salmonella enterica enterica serovar Typhi Ty2
gaauuaucaggguua

SEQ ID NO: 3691100 - RNA, 17 nt, Salmonella enterica enterica serovar Typhi Ty2
gaauuaugggccgacgu

SEQ ID NO: 3691101 - RNA, 19 nt, Salmonella enterica enterica serovar Typhi Ty2
gaauuauuaaaucaauacu

SEQ ID NO: 3691102 - RNA, 19 nt, Salmonella enterica enterica serovar Typhi Ty2
gaauuauucguguuucgac

SEQ ID NO: 3691103 - RNA, 20 nt, Salmonella enterica enterica serovar Typhi Ty2
gaauuauuuaggguuaagag

SEQ ID NO: 3691104 - RNA, 16 nt, Salmonella enterica enterica serovar Typhi Ty2
gaauuauuucaggaau

SEQ ID NO: 3691105 - RNA, 19 nt, Salmonella enterica enterica serovar Typhi Ty2
gaauucaccgcaugacaau

SEQ ID NO: 3691106 - RNA, 16 nt, Salmonella enterica enterica serovar Typhi Ty2
gaauuccaguccuuuc

SEQ ID NO: 3691107 - RNA, 15 nt, Salmonella enterica enterica serovar Typhi Ty2
gaauucguacguuuu

SEQ ID NO: 3691108 - RNA, 15 nt, Salmonella enterica enterica serovar Typhi Ty2
gaauugaacuaaaaa

SEQ ID NO: 3691109 - RNA, 17 nt, Salmonella enterica enterica serovar Typhi Ty2
gaauugccauuguucgc

SEQ ID NO: 3691110 - RNA, 17 nt, Salmonella enterica enterica serovar Typhi Ty2
gaauugcgguuuauccc

SEQ ID NO: 3691111 - RNA, 20 nt, Salmonella enterica enterica serovar Typhi Ty2
gaauugguagacgcgcuagc

SEQ ID NO: 3691112 - RNA, 16 nt, Salmonella enterica enterica serovar Typhi Ty2
gaauuuaaauagcaau

SEQ ID NO: 3691113 - RNA, 16 nt, Salmonella enterica enterica serovar Typhi Ty2
gaauuuaucccguggu

SEQ ID NO: 3691114 - RNA, 19 nt, Salmonella enterica enterica serovar Typhi Ty2
gaauuuaucccgugguggg

SEQ ID NO: 3691115 - RNA, 17 nt, Salmonella enterica enterica serovar Typhi Ty2
gaauuucaaucaucaua

SEQ ID NO: 3691116 - RNA, 22 nt, Salmonella enterica enterica serovar Typhi Ty2
gaauuucaggguagcauugccg

SEQ ID NO: 3691117 - RNA, 22 nt, Salmonella enterica enterica serovar Typhi Ty2
gaauuuguugguuuaaacucug

SEQ ID NO: 3691118 - RNA, 20 nt, Salmonella enterica enterica serovar Typhi Ty2
gaauuuuauuaagcaggccg

SEQ ID NO: 3691119 - RNA, 21 nt, Salmonella enterica enterica serovar Typhi Ty2
gaauuuuccgccgugauucau

SEQ ID NO: 3691120 - RNA, 20 nt, Salmonella enterica enterica serovar Typhi Ty2
gaauuuuuccagcucagaaa

SEQ ID NO: 3691121 - RNA, 14 nt, Salmonella enterica enterica serovar Typhi Ty2
gacaaaaauaccac

SEQ ID NO: 3691122 - RNA, 14 nt, Salmonella enterica enterica serovar Typhi Ty2
gacaaaaauuaaaa

SEQ ID NO: 3691123 - RNA, 15 nt, Salmonella enterica enterica serovar Typhi Ty2
gacaaaaggugucac

SEQ ID NO: 3691124 - RNA, 17 nt, Salmonella enterica enterica serovar Typhi Ty2
gacaaacagcuauccau

SEQ ID NO: 3691125 - RNA, 20 nt, Salmonella enterica enterica serovar Typhi Ty2
gacaaacucacguuccccag

SEQ ID NO: 3691126 - RNA, 16 nt, Salmonella enterica enterica serovar Typhi Ty2
gacaaagagcucccca

SEQ ID NO: 3691127 - RNA, 21 nt, Salmonella enterica enterica serovar Typhi Ty2
gacaaagccggauaucgcuau

SEQ ID NO: 3691128 - RNA, 16 nt, Salmonella enterica enterica serovar Typhi Ty2
gacaaagcguggggaa

SEQ ID NO: 3691129 - RNA, 17 nt, Salmonella enterica enterica serovar Typhi Ty2
gacaacaaaaagauauu

SEQ ID NO: 3691130 - RNA, 17 nt, Salmonella enterica enterica serovar Typhi Ty2
gacaacaucccagaaaa

SEQ ID NO: 3691131 - RNA, 19 nt, Salmonella enterica enterica serovar Typhi Ty2
gacaaccagcgaaaugacg

SEQ ID NO: 3691132 - RNA, 14 nt, Salmonella enterica enterica serovar Typhi Ty2
gacaacgaccagug

SEQ ID NO: 3691133 - RNA, 14 nt, Salmonella enterica enterica serovar Typhi Ty2
gacaacgccaucag

SEQ ID NO: 3691134 - RNA, 19 nt, Salmonella enterica enterica serovar Typhi Ty2
gacaacguaaacggcagcc

SEQ ID NO: 3691135 - RNA, 18 nt, Salmonella enterica enterica serovar Typhi Ty2
gacaacuagaauuuucac

SEQ ID NO: 3691136 - RNA, 15 nt, Salmonella enterica enterica serovar Typhi Ty2
gacaacuauugcugc

SEQ ID NO: 3691137 - RNA, 21 nt, Salmonella enterica enterica serovar Typhi Ty2
gacaacuucuaauuuuuccag

SEQ ID NO: 3691138 - RNA, 18 nt, Salmonella enterica enterica serovar Typhi Ty2
gacaagcugauuuuucgc

SEQ ID NO: 3691139 - RNA, 21 nt, Salmonella enterica enterica serovar Typhi Ty2
gacaaggccgauaaagcguuu

SEQ ID NO: 3691140 - RNA, 18 nt, Salmonella enterica enterica serovar Typhi Ty2
gacaaggcgcgccagcgc

SEQ ID NO: 3691141 - RNA, 22 nt, Salmonella enterica enterica serovar Typhi Ty2
gacaaggcgguacgccgccauc

SEQ ID NO: 3691142 - RNA, 18 nt, Salmonella enterica enterica serovar Typhi Ty2
gacaauaaacuggcugug

SEQ ID NO: 3691143 - RNA, 19 nt, Salmonella enterica enterica serovar Typhi Ty2
gacaauaacggccucaauu

SEQ ID NO: 3691144 - RNA, 19 nt, Salmonella enterica enterica serovar Typhi Ty2
gacaauacuuaaaccugcg

SEQ ID NO: 3691145 - RNA, 18 nt, Salmonella enterica enterica serovar Typhi Ty2
gacaaucacucucuugua

SEQ ID NO: 3691146 - RNA, 16 nt, Salmonella enterica enterica serovar Typhi Ty2
gacaaucagcaccauu

SEQ ID NO: 3691147 - RNA, 23 nt, Salmonella enterica enterica serovar Typhi Ty2
gacaaucgucacuucaauuugcc

SEQ ID NO: 3691148 - RNA, 23 nt, Salmonella enterica enterica serovar Typhi Ty2
gacaaucuccuccggcuucagca

SEQ ID NO: 3691149 - RNA, 15 nt, Salmonella enterica enterica serovar Typhi Ty2
gacaaugaucagacg

SEQ ID NO: 3691150 - RNA, 16 nt, Salmonella enterica enterica serovar Typhi Ty2
gacaauuuucuucaug

SEQ ID NO: 3691151 - RNA, 22 nt, Salmonella enterica enterica serovar Typhi Ty2
gacaauuuugauaagagaaaau

SEQ ID NO: 3691152 - RNA, 13 nt, Salmonella enterica enterica serovar Typhi Ty2
gacaccagccguu

SEQ ID NO: 3691153 - RNA, 16 nt, Salmonella enterica enterica serovar Typhi Ty2
gacacccaauccggcu

SEQ ID NO: 3691154 - RNA, 13 nt, Salmonella enterica enterica serovar Typhi Ty2
gacacccgcagcc

SEQ ID NO: 3691155 - RNA, 16 nt, Salmonella enterica enterica serovar Typhi Ty2
gacacccgcagccaga

SEQ ID NO: 3691156 - RNA, 21 nt, Salmonella enterica enterica serovar Typhi Ty2
gacacgcgcgcugcgccugga

SEQ ID NO: 3691157 - RNA, 21 nt, Salmonella enterica enterica serovar Typhi Ty2
gacacgcucauaaauugcagc

SEQ ID NO: 3691158 - RNA, 11 nt, Salmonella enterica enterica serovar Typhi Ty2
gacacucaucc

SEQ ID NO: 3691159 - RNA, 20 nt, Salmonella enterica enterica serovar Typhi Ty2
gacacugaaacuccgcagcc

SEQ ID NO: 3691160 - RNA, 14 nt, Salmonella enterica enterica serovar Typhi Ty2
gacauugcgcggcg

SEQ ID NO: 3691161 - RNA, 19 nt, Salmonella enterica enterica serovar Typhi Ty2
gacauuguucuaaacguuc

SEQ ID NO: 3691162 - RNA, 20 nt, Salmonella enterica enterica serovar Typhi Ty2
gacauuuaucuuccggcauc

SEQ ID NO: 3691163 - RNA, 19 nt, Salmonella enterica enterica serovar Typhi Ty2
gaccaaagcgaauacucac

SEQ ID NO: 3691164 - RNA, 18 nt, Salmonella enterica enterica serovar Typhi Ty2
gaccaaagucaaacugau

SEQ ID NO: 3691165 - RNA, 15 nt, Salmonella enterica enterica serovar Typhi Ty2
gaccaacaacagaua

SEQ ID NO: 3691166 - RNA, 14 nt, Salmonella enterica enterica serovar Typhi Ty2
gaccaacaccagcc

SEQ ID NO: 3691167 - RNA, 17 nt, Salmonella enterica enterica serovar Typhi Ty2
gaccaacaccuacgaua

SEQ ID NO: 3691168 - RNA, 21 nt, Salmonella enterica enterica serovar Typhi Ty2
gaccaacaccuacgauaucau

SEQ ID NO: 3691169 - RNA, 21 nt, Salmonella enterica enterica serovar Typhi Ty2
gaccaacgguuggauuucggc

SEQ ID NO: 3691170 - RNA, 22 nt, Salmonella enterica enterica serovar Typhi Ty2
gaccaacgguuggauuucggcg

SEQ ID NO: 3691171 - RNA, 18 nt, Salmonella enterica enterica serovar Typhi Ty2
gaccaacuuuuguagaga

SEQ ID NO: 3691172 - RNA, 17 nt, Salmonella enterica enterica serovar Typhi Ty2
gaccaagcgucagcaug

SEQ ID NO: 3691173 - RNA, 21 nt, Salmonella enterica enterica serovar Typhi Ty2
gaccaauagagagcgacagcc

SEQ ID NO: 3691174 - RNA, 15 nt, Salmonella enterica enterica serovar Typhi Ty2
gaccaaugacgcuau

SEQ ID NO: 3691175 - RNA, 20 nt, Salmonella enterica enterica serovar Typhi Ty2
gaccaaugacgcuauccgca

SEQ ID NO: 3691176 - RNA, 20 nt, Salmonella enterica enterica serovar Typhi Ty2
gaccaaugcuggcaggcgcg

SEQ ID NO: 3691177 - RNA, 17 nt, Salmonella enterica enterica serovar Typhi Ty2
gaccaauugcaggcagc

SEQ ID NO: 3691178 - RNA, 22 nt, Salmonella enterica enterica serovar Typhi Ty2
gaccacaccgucaacaucaucc

SEQ ID NO: 3691179 - RNA, 15 nt, Salmonella enterica enterica serovar Typhi Ty2
gaccaccauauucgc

SEQ ID NO: 3691180 - RNA, 13 nt, Salmonella enterica enterica serovar Typhi Ty2
gaccacccgcgac

SEQ ID NO: 3691181 - RNA, 16 nt, Salmonella enterica enterica serovar Typhi Ty2
gaccaccgcaucggca

SEQ ID NO: 3691182 - RNA, 22 nt, Salmonella enterica enterica serovar Typhi Ty2
gaccaccgcgcuagugccgcca

SEQ ID NO: 3691183 - RNA, 15 nt, Salmonella enterica enterica serovar Typhi Ty2
gaccacgaaucagga

SEQ ID NO: 3691184 - RNA, 16 nt, Salmonella enterica enterica serovar Typhi Ty2
gaccacgaaucaggau

SEQ ID NO: 3691185 - RNA, 15 nt, Salmonella enterica enterica serovar Typhi Ty2
gaccacgccaccgcc

SEQ ID NO: 3691186 - RNA, 20 nt, Salmonella enterica enterica serovar Typhi Ty2
gaccacgccaccgccgccac

SEQ ID NO: 3691187 - RNA, 23 nt, Salmonella enterica enterica serovar Typhi Ty2
gaccacgccaucaacagcggaga

SEQ ID NO: 3691188 - RNA, 14 nt, Salmonella enterica enterica serovar Typhi Ty2
gaccacgccgccgc

SEQ ID NO: 3691189 - RNA, 18 nt, Salmonella enterica enterica serovar Typhi Ty2
gaccacggccacagccau

SEQ ID NO: 3691190 - RNA, 13 nt, Salmonella enterica enterica serovar Typhi Ty2
gaccacggcguca

SEQ ID NO: 3691191 - RNA, 18 nt, Salmonella enterica enterica serovar Typhi Ty2
gaccagacacggugugcc

SEQ ID NO: 3691192 - RNA, 11 nt, Salmonella enterica enterica serovar Typhi Ty2
gaccagcagca

SEQ ID NO: 3691193 - RNA, 12 nt, Salmonella enterica enterica serovar Typhi Ty2
gaccagcaucag

SEQ ID NO: 3691194 - RNA, 14 nt, Salmonella enterica enterica serovar Typhi Ty2
gaccagcaucagaa

SEQ ID NO: 3691195 - RNA, 18 nt, Salmonella enterica enterica serovar Typhi Ty2
gaccagcaucagaauaau

SEQ ID NO: 3691196 - RNA, 17 nt, Salmonella enterica enterica serovar Typhi Ty2
gaccagcaugugccgga

SEQ ID NO: 3691197 - RNA, 15 nt, Salmonella enterica enterica serovar Typhi Ty2
gaccagccaggcgau

SEQ ID NO: 3691198 - RNA, 21 nt, Salmonella enterica enterica serovar Typhi Ty2
gaccagccuaccugccgccau

SEQ ID NO: 3691199 - RNA, 22 nt, Salmonella enterica enterica serovar Typhi Ty2
gaccagccuaccugccgccaua

SEQ ID NO: 3691200 - RNA, 15 nt, Salmonella enterica enterica serovar Typhi Ty2
gaccagcgcgccaaa

SEQ ID NO: 3691201 - RNA, 22 nt, Salmonella enterica enterica serovar Typhi Ty2
gaccagcguaccgucucggccu

SEQ ID NO: 3691202 - RNA, 14 nt, Salmonella enterica enterica serovar Typhi Ty2
gaccagcgucagcc

SEQ ID NO: 3691203 - RNA, 19 nt, Salmonella enterica enterica serovar Typhi Ty2
gaccagcugacgacgccag

SEQ ID NO: 3691204 - RNA, 21 nt, Salmonella enterica enterica serovar Typhi Ty2
gaccagcugacgacgccagcc

SEQ ID NO: 3691205 - RNA, 22 nt, Salmonella enterica enterica serovar Typhi Ty2
gaccagcugacgacgccagccc

SEQ ID NO: 3691206 - RNA, 21 nt, Salmonella enterica enterica serovar Typhi Ty2
gaccaggaauuuaccggugcg

SEQ ID NO: 3691207 - RNA, 16 nt, Salmonella enterica enterica serovar Typhi Ty2
gaccaggauggccagc

SEQ ID NO: 3691208 - RNA, 17 nt, Salmonella enterica enterica serovar Typhi Ty2
gaccaggauggccagca

SEQ ID NO: 3691209 - RNA, 18 nt, Salmonella enterica enterica serovar Typhi Ty2
gaccagucggacagcgac

SEQ ID NO: 3691210 - RNA, 18 nt, Salmonella enterica enterica serovar Typhi Ty2
gaccagugaacgucugca

SEQ ID NO: 3691211 - RNA, 14 nt, Salmonella enterica enterica serovar Typhi Ty2
gaccaguuaagcaa

SEQ ID NO: 3691212 - RNA, 20 nt, Salmonella enterica enterica serovar Typhi Ty2
gaccaguuguaaucggcgcc

SEQ ID NO: 3691213 - RNA, 21 nt, Salmonella enterica enterica serovar Typhi Ty2
gaccaguuuuugcgccagcgc

SEQ ID NO: 3691214 - RNA, 22 nt, Salmonella enterica enterica serovar Typhi Ty2
gaccaguuuuugcgccagcgca

SEQ ID NO: 3691215 - RNA, 16 nt, Salmonella enterica enterica serovar Typhi Ty2
gaccauaaauagccga

SEQ ID NO: 3691216 - RNA, 19 nt, Salmonella enterica enterica serovar Typhi Ty2
gaccauaaauagccgaccg

SEQ ID NO: 3691217 - RNA, 12 nt, Salmonella enterica enterica serovar Typhi Ty2
gaccauacuaau

SEQ ID NO: 3691218 - RNA, 19 nt, Salmonella enterica enterica serovar Typhi Ty2
gaccauaguccaugcccaa

SEQ ID NO: 3691219 - RNA, 16 nt, Salmonella enterica enterica serovar Typhi Ty2
gaccauauaugaaauc

SEQ ID NO: 3691220 - RNA, 14 nt, Salmonella enterica enterica serovar Typhi Ty2
gaccauaugcggca

SEQ ID NO: 3691221 - RNA, 18 nt, Salmonella enterica enterica serovar Typhi Ty2
gaccauauucacgcagcu

SEQ ID NO: 3691222 - RNA, 14 nt, Salmonella enterica enterica serovar Typhi Ty2
gaccaucaacagcg

SEQ ID NO: 3691223 - RNA, 20 nt, Salmonella enterica enterica serovar Typhi Ty2
gaccaucgcguuguaaucgc

SEQ ID NO: 3691224 - RNA, 12 nt, Salmonella enterica enterica serovar Typhi Ty2
gaccaugauauc

SEQ ID NO: 3691225 - RNA, 22 nt, Salmonella enterica enterica serovar Typhi Ty2
gaccaugcauauaagagacgcc

SEQ ID NO: 3691226 - RNA, 20 nt, Salmonella enterica enterica serovar Typhi Ty2
gaccauuggcaccaccagga

SEQ ID NO: 3691227 - RNA, 14 nt, Salmonella enterica enterica serovar Typhi Ty2
gacccacgccagca

SEQ ID NO: 3691228 - RNA, 16 nt, Salmonella enterica enterica serovar Typhi Ty2
gacccacuaacugccg

SEQ ID NO: 3691229 - RNA, 16 nt, Salmonella enterica enterica serovar Typhi Ty2
gacccacuuucagcuc

SEQ ID NO: 3691230 - RNA, 14 nt, Salmonella enterica enterica serovar Typhi Ty2
gaccccaauagcga

SEQ ID NO: 3691231 - RNA, 18 nt, Salmonella enterica enterica serovar Typhi Ty2
gaccccaguaauccggca

SEQ ID NO: 3691232 - RNA, 12 nt, Salmonella enterica enterica serovar Typhi Ty2
gacccccuccuu

SEQ ID NO: 3691233 - RNA, 22 nt, Salmonella enterica enterica serovar Typhi Ty2
gaccccgccgucagacaggccu

SEQ ID NO: 3691234 - RNA, 19 nt, Salmonella enterica enterica serovar Typhi Ty2
gaccccuccggccagcgcc

SEQ ID NO: 3691235 - RNA, 14 nt, Salmonella enterica enterica serovar Typhi Ty2
gacccgcagcaauc

SEQ ID NO: 3691236 - RNA, 18 nt, Salmonella enterica enterica serovar Typhi Ty2
gacccgcaucgccgcggc

SEQ ID NO: 3691237 - RNA, 19 nt, Salmonella enterica enterica serovar Typhi Ty2
gacccgcuuccaguuuugc

SEQ ID NO: 3691238 - RNA, 11 nt, Salmonella enterica enterica serovar Typhi Ty2
gacccggcauu

SEQ ID NO: 3691239 - RNA, 19 nt, Salmonella enterica enterica serovar Typhi Ty2
gacccugagcucaaacgua

SEQ ID NO: 3691240 - RNA, 18 nt, Salmonella enterica enterica serovar Typhi Ty2
gacccuuaugucauucag

SEQ ID NO: 3691241 - RNA, 14 nt, Salmonella enterica enterica serovar Typhi Ty2
gacccuugcgacca

SEQ ID NO: 3691242 - RNA, 12 nt, Salmonella enterica enterica serovar Typhi Ty2
gacgcaccagcc

SEQ ID NO: 3691243 - RNA, 15 nt, Salmonella enterica enterica serovar Typhi Ty2
gacgcagcucauacc

SEQ ID NO: 3691244 - RNA, 15 nt, Salmonella enterica enterica serovar Typhi Ty2
gacgcagcuucgccg

SEQ ID NO: 3691245 - RNA, 12 nt, Salmonella enterica enterica serovar Typhi Ty2
gacgcagcuucu

SEQ ID NO: 3691246 - RNA, 15 nt, Salmonella enterica enterica serovar Typhi Ty2
gacgcauccgccaua

SEQ ID NO: 3691247 - RNA, 16 nt, Salmonella enterica enterica serovar Typhi Ty2
gacgcaugacccaggc

SEQ ID NO: 3691248 - RNA, 19 nt, Salmonella enterica enterica serovar Typhi Ty2
gacgcauugagacaugccg

SEQ ID NO: 3691249 - RNA, 22 nt, Salmonella enterica enterica serovar Typhi Ty2
gacgcauugagacaugccgcca

SEQ ID NO: 3691250 - RNA, 17 nt, Salmonella enterica enterica serovar Typhi Ty2
gacgccaagcugcagaa

SEQ ID NO: 3691251 - RNA, 21 nt, Salmonella enterica enterica serovar Typhi Ty2
gacgccaccggguuaaagccc

SEQ ID NO: 3691252 - RNA, 23 nt, Salmonella enterica enterica serovar Typhi Ty2
gacgccaccggguuaaagcccug

SEQ ID NO: 3691253 - RNA, 13 nt, Salmonella enterica enterica serovar Typhi Ty2
gacgccagccagc

SEQ ID NO: 3691254 - RNA, 21 nt, Salmonella enterica enterica serovar Typhi Ty2
gacgccaggcagauugaggcg

SEQ ID NO: 3691255 - RNA, 17 nt, Salmonella enterica enterica serovar Typhi Ty2
gacgccauaucgccgcc

SEQ ID NO: 3691256 - RNA, 22 nt, Salmonella enterica enterica serovar Typhi Ty2
gacgccauccguacguauuauc

SEQ ID NO: 3691257 - RNA, 16 nt, Salmonella enterica enterica serovar Typhi Ty2
gacgccaugcaaaaaa

SEQ ID NO: 3691258 - RNA, 15 nt, Salmonella enterica enterica serovar Typhi Ty2
gacgccaugggguga

SEQ ID NO: 3691259 - RNA, 14 nt, Salmonella enterica enterica serovar Typhi Ty2
gacgcccaaccagu

SEQ ID NO: 3691260 - RNA, 14 nt, Salmonella enterica enterica serovar Typhi Ty2
gacgcccaucagca

SEQ ID NO: 3691261 - RNA, 17 nt, Salmonella enterica enterica serovar Typhi Ty2
gacgcccaucagcaucc

SEQ ID NO: 3691262 - RNA, 23 nt, Salmonella enterica enterica serovar Typhi Ty2
gacgccccauguggccagcggcc

SEQ ID NO: 3691263 - RNA, 16 nt, Salmonella enterica enterica serovar Typhi Ty2
gacgccgauaaagccc

SEQ ID NO: 3691264 - RNA, 18 nt, Salmonella enterica enterica serovar Typhi Ty2
gacgccgggaaauuuuuc

SEQ ID NO: 3691265 - RNA, 13 nt, Salmonella enterica enterica serovar Typhi Ty2
gacgcgcaggccg

SEQ ID NO: 3691266 - RNA, 17 nt, Salmonella enterica enterica serovar Typhi Ty2
gacgcgccacuuccagc

SEQ ID NO: 3691267 - RNA, 20 nt, Salmonella enterica enterica serovar Typhi Ty2
gacgcgccacuuccagcgcg

SEQ ID NO: 3691268 - RNA, 14 nt, Salmonella enterica enterica serovar Typhi Ty2
gacgcgccagccag

SEQ ID NO: 3691269 - RNA, 16 nt, Salmonella enterica enterica serovar Typhi Ty2
gacgcgcuccagcaac

SEQ ID NO: 3691270 - RNA, 21 nt, Salmonella enterica enterica serovar Typhi Ty2
gacgcggaacuggugaaacag

SEQ ID NO: 3691271 - RNA, 15 nt, Salmonella enterica enterica serovar Typhi Ty2
gacgcgguacccacc

SEQ ID NO: 3691272 - RNA, 16 nt, Salmonella enterica enterica serovar Typhi Ty2
gacgcgguuaucucua

SEQ ID NO: 3691273 - RNA, 23 nt, Salmonella enterica enterica serovar Typhi Ty2
gacgcguagcgucuuauccggcc

SEQ ID NO: 3691274 - RNA, 14 nt, Salmonella enterica enterica serovar Typhi Ty2
gacgcgucagcuga

SEQ ID NO: 3691275 - RNA, 19 nt, Salmonella enterica enterica serovar Typhi Ty2
gacgcguguugccggacca

SEQ ID NO: 3691276 - RNA, 14 nt, Salmonella enterica enterica serovar Typhi Ty2
gacgcguuaauauc

SEQ ID NO: 3691277 - RNA, 21 nt, Salmonella enterica enterica serovar Typhi Ty2
gacgcuacgcgucgccauccg

SEQ ID NO: 3691278 - RNA, 13 nt, Salmonella enterica enterica serovar Typhi Ty2
gacgcuauuuuuc

SEQ ID NO: 3691279 - RNA, 20 nt, Salmonella enterica enterica serovar Typhi Ty2
gacgcuccaucacgguaaac

SEQ ID NO: 3691280 - RNA, 20 nt, Salmonella enterica enterica serovar Typhi Ty2
gacgcucgacgaagccuucg

SEQ ID NO: 3691281 - RNA, 15 nt, Salmonella enterica enterica serovar Typhi Ty2
gacgcucuuccucaa

SEQ ID NO: 3691282 - RNA, 17 nt, Salmonella enterica enterica serovar Typhi Ty2
gacgcugauagccacgg

SEQ ID NO: 3691283 - RNA, 14 nt, Salmonella enterica enterica serovar Typhi Ty2
gacgcugaugaaaa

SEQ ID NO: 3691284 - RNA, 16 nt, Salmonella enterica enterica serovar Typhi Ty2
gacgcugcaacucucc

SEQ ID NO: 3691285 - RNA, 12 nt, Salmonella enterica enterica serovar Typhi Ty2
gacgcugccaca

SEQ ID NO: 3691286 - RNA, 19 nt, Salmonella enterica enterica serovar Typhi Ty2
gacgcugcgccuggaugaa

SEQ ID NO: 3691287 - RNA, 15 nt, Salmonella enterica enterica serovar Typhi Ty2
gacgcuggaaaauuu

SEQ ID NO: 3691288 - RNA, 20 nt, Salmonella enterica enterica serovar Typhi Ty2
gacgcuguucaaagccgcca

SEQ ID NO: 3691289 - RNA, 21 nt, Salmonella enterica enterica serovar Typhi Ty2
gacgcuuacaucgccauccgg

SEQ ID NO: 3691290 - RNA, 14 nt, Salmonella enterica enterica serovar Typhi Ty2
gacgcuuuucagcg

SEQ ID NO: 3691291 - RNA, 17 nt, Salmonella enterica enterica serovar Typhi Ty2
gacgcuuuucagcgucu

SEQ ID NO: 3691292 - RNA, 13 nt, Salmonella enterica enterica serovar Typhi Ty2
gacggaaaccagc

SEQ ID NO: 3691293 - RNA, 14 nt, Salmonella enterica enterica serovar Typhi Ty2
gacggaaaccagca

SEQ ID NO: 3691294 - RNA, 20 nt, Salmonella enterica enterica serovar Typhi Ty2
gacggagauuaacagcgcga

SEQ ID NO: 3691295 - RNA, 22 nt, Salmonella enterica enterica serovar Typhi Ty2
gacggauuggcgcucaauagcc

SEQ ID NO: 3691296 - RNA, 15 nt, Salmonella enterica enterica serovar Typhi Ty2
gacggcaaaaagcau

SEQ ID NO: 3691297 - RNA, 24 nt, Salmonella enterica enterica serovar Typhi Ty2
gacggcaacggcgacaagaauaug

SEQ ID NO: 3691298 - RNA, 18 nt, Salmonella enterica enterica serovar Typhi Ty2
gacggcagcgccauccgg

SEQ ID NO: 3691299 - RNA, 20 nt, Salmonella enterica enterica serovar Typhi Ty2
gacggcagcgccauccggca

SEQ ID NO: 3691300 - RNA, 23 nt, Salmonella enterica enterica serovar Typhi Ty2
gacggcagucgcuacaaccagcg

SEQ ID NO: 3691301 - RNA, 12 nt, Salmonella enterica enterica serovar Typhi Ty2
gacggcaucagg

SEQ ID NO: 3691302 - RNA, 21 nt, Salmonella enterica enterica serovar Typhi Ty2
gacggcccaacagcaauguuu

SEQ ID NO: 3691303 - RNA, 20 nt, Salmonella enterica enterica serovar Typhi Ty2
gacggcccguaucgcucagg

SEQ ID NO: 3691304 - RNA, 16 nt, Salmonella enterica enterica serovar Typhi Ty2
gacggcccuuuugcag

SEQ ID NO: 3691305 - RNA, 18 nt, Salmonella enterica enterica serovar Typhi Ty2
gacggccugucuccucag

SEQ ID NO: 3691306 - RNA, 23 nt, Salmonella enterica enterica serovar Typhi Ty2
gacggcgaaucaauuuacgcacu

SEQ ID NO: 3691307 - RNA, 23 nt, Salmonella enterica enterica serovar Typhi Ty2
gacggcgcgacauccgcuuuugg

SEQ ID NO: 3691308 - RNA, 14 nt, Salmonella enterica enterica serovar Typhi Ty2
gacggcggaccccu

SEQ ID NO: 3691309 - RNA, 13 nt, Salmonella enterica enterica serovar Typhi Ty2
gacggcggcgaau

SEQ ID NO: 3691310 - RNA, 19 nt, Salmonella enterica enterica serovar Typhi Ty2
gacggcguaagucgcgcau

SEQ ID NO: 3691311 - RNA, 15 nt, Salmonella enterica enterica serovar Typhi Ty2
gacggcuaagcugau

SEQ ID NO: 3691312 - RNA, 19 nt, Salmonella enterica enterica serovar Typhi Ty2
gacggcuaauaugccaggc

SEQ ID NO: 3691313 - RNA, 20 nt, Salmonella enterica enterica serovar Typhi Ty2
gacgggaaaucucccuggca

SEQ ID NO: 3691314 - RNA, 21 nt, Salmonella enterica enterica serovar Typhi Ty2
gacgggaaaucucccuggcag

SEQ ID NO: 3691315 - RNA, 23 nt, Salmonella enterica enterica serovar Typhi Ty2
gacgggaugugaccuuugugcag

SEQ ID NO: 3691316 - RNA, 13 nt, Salmonella enterica enterica serovar Typhi Ty2
gacgggccaggcg

SEQ ID NO: 3691317 - RNA, 17 nt, Salmonella enterica enterica serovar Typhi Ty2
gacgggcccuggccgca

SEQ ID NO: 3691318 - RNA, 21 nt, Salmonella enterica enterica serovar Typhi Ty2
gacgggcguccggcuuaggca

SEQ ID NO: 3691319 - RNA, 21 nt, Salmonella enterica enterica serovar Typhi Ty2
gacggguauuacugauaaagu

SEQ ID NO: 3691320 - RNA, 16 nt, Salmonella enterica enterica serovar Typhi Ty2
gacgggugcgcccaga

SEQ ID NO: 3691321 - RNA, 16 nt, Salmonella enterica enterica serovar Typhi Ty2
gacgguaagaauaaua

SEQ ID NO: 3691322 - RNA, 17 nt, Salmonella enterica enterica serovar Typhi Ty2
gacgguaccugaagcca

SEQ ID NO: 3691323 - RNA, 15 nt, Salmonella enterica enterica serovar Typhi Ty2
gacgguccuggccag

SEQ ID NO: 3691324 - RNA, 20 nt, Salmonella enterica enterica serovar Typhi Ty2
gacugguggcgagauaagcc

SEQ ID NO: 3691325 - RNA, 22 nt, Salmonella enterica enterica serovar Typhi Ty2
gacugguggcgagauaagccgu

SEQ ID NO: 3691326 - RNA, 18 nt, Salmonella enterica enterica serovar Typhi Ty2
gacuguaaaucugccguc

SEQ ID NO: 3691327 - RNA, 20 nt, Salmonella enterica enterica serovar Typhi Ty2
gacuguagauaccuacuuua

SEQ ID NO: 3691328 - RNA, 16 nt, Salmonella enterica enterica serovar Typhi Ty2
gacugucgaaaccagc

SEQ ID NO: 3691329 - RNA, 22 nt, Salmonella enterica enterica serovar Typhi Ty2
gacugucugaaggcguaugaau

SEQ ID NO: 3691330 - RNA, 16 nt, Salmonella enterica enterica serovar Typhi Ty2
gacugugauggcgguc

SEQ ID NO: 3691331 - RNA, 16 nt, Salmonella enterica enterica serovar Typhi Ty2
gacuguucacauccag

SEQ ID NO: 3691332 - RNA, 17 nt, Salmonella enterica enterica serovar Typhi Ty2
gacuguucacauccagc

SEQ ID NO: 3691333 - RNA, 17 nt, Salmonella enterica enterica serovar Typhi Ty2
gacuguucagcugacaa

SEQ ID NO: 3691334 - RNA, 22 nt, Salmonella enterica enterica serovar Typhi Ty2
gacuguuucauuacucguccuu

SEQ ID NO: 3691335 - RNA, 22 nt, Salmonella enterica enterica serovar Typhi Ty2
gacuuaaaguacuucacaauca

SEQ ID NO: 3691336 - RNA, 17 nt, Salmonella enterica enterica serovar Typhi Ty2
gacuuacggaaaaaugu

SEQ ID NO: 3691337 - RNA, 17 nt, Salmonella enterica enterica serovar Typhi Ty2
gacuuagcccuggccaa

SEQ ID NO: 3691338 - RNA, 22 nt, Salmonella enterica enterica serovar Typhi Ty2
gacuuaggaaugcccagcucag

SEQ ID NO: 3691339 - RNA, 23 nt, Salmonella enterica enterica serovar Typhi Ty2
gacuucauuuuccacaauaccgu

SEQ ID NO: 3691340 - RNA, 20 nt, Salmonella enterica enterica serovar Typhi Ty2
gacuuccgcacgcgcgcccu

SEQ ID NO: 3691341 - RNA, 13 nt, Salmonella enterica enterica serovar Typhi Ty2
gacuucucccucu

SEQ ID NO: 3691342 - RNA, 11 nt, Salmonella enterica enterica serovar Typhi Ty2
gacuucuucag

SEQ ID NO: 3691343 - RNA, 18 nt, Salmonella enterica enterica serovar Typhi Ty2
gacuugucggcaaucuca

SEQ ID NO: 3691344 - RNA, 20 nt, Salmonella enterica enterica serovar Typhi Ty2
gacuuuaaacgucaugcugu

SEQ ID NO: 3691345 - RNA, 16 nt, Salmonella enterica enterica serovar Typhi Ty2
gacuuugaccagcauc

SEQ ID NO: 3691346 - RNA, 21 nt, Salmonella enterica enterica serovar Typhi Ty2
gacuuugcccuuuuugcauuc

SEQ ID NO: 3691347 - RNA, 13 nt, Salmonella enterica enterica serovar Typhi Ty2
gacuuuggauaaa

SEQ ID NO: 3691348 - RNA, 20 nt, Salmonella enterica enterica serovar Typhi Ty2
gacuuuuuugccuuucagau

SEQ ID NO: 3691349 - RNA, 17 nt, Salmonella enterica enterica serovar Typhi Ty2
gagaaaaaaauccagua

SEQ ID NO: 3691350 - RNA, 22 nt, Salmonella enterica enterica serovar Typhi Ty2
gagaaaaacgaccaggaucaga

SEQ ID NO: 3691351 - RNA, 20 nt, Salmonella enterica enterica serovar Typhi Ty2
gagaaaaagcaauaauccgc

SEQ ID NO: 3691352 - RNA, 22 nt, Salmonella enterica enterica serovar Typhi Ty2
gagaaaaauacgccagauaacg

SEQ ID NO: 3691353 - RNA, 16 nt, Salmonella enterica enterica serovar Typhi Ty2
gagaaaacgcggccug

SEQ ID NO: 3691354 - RNA, 19 nt, Salmonella enterica enterica serovar Typhi Ty2
gagaaaagggcgcaccaaa

SEQ ID NO: 3691355 - RNA, 21 nt, Salmonella enterica enterica serovar Typhi Ty2
gagaaaauaacaauauuaaau

SEQ ID NO: 3691356 - RNA, 20 nt, Salmonella enterica enterica serovar Typhi Ty2
gagaaaauaccgcacaucac

SEQ ID NO: 3691357 - RNA, 23 nt, Salmonella enterica enterica serovar Typhi Ty2
gagaaagugguggcggaaaugcg

SEQ ID NO: 3691358 - RNA, 17 nt, Salmonella enterica enterica serovar Typhi Ty2
gagaaagugguggguga

SEQ ID NO: 3691359 - RNA, 18 nt, Salmonella enterica enterica serovar Typhi Ty2
gagaaauuuagcaguaac

SEQ ID NO: 3691360 - RNA, 23 nt, Salmonella enterica enterica serovar Typhi Ty2
gagaaauuuaggucaaaaaagcg

SEQ ID NO: 3691361 - RNA, 12 nt, Salmonella enterica enterica serovar Typhi Ty2
gagaacagcauc

SEQ ID NO: 3691362 - RNA, 15 nt, Salmonella enterica enterica serovar Typhi Ty2
gagaaccaacugcca

SEQ ID NO: 3691363 - RNA, 21 nt, Salmonella enterica enterica serovar Typhi Ty2
gagaagcccggccacagcgcc

SEQ ID NO: 3691364 - RNA, 22 nt, Salmonella enterica enterica serovar Typhi Ty2
gagaagcccggccacagcgcca

SEQ ID NO: 3691365 - RNA, 16 nt, Salmonella enterica enterica serovar Typhi Ty2
gagaagcgcgccugcc

SEQ ID NO: 3691366 - RNA, 19 nt, Salmonella enterica enterica serovar Typhi Ty2
gagaaucaccuggcagccg

SEQ ID NO: 3691367 - RNA, 15 nt, Salmonella enterica enterica serovar Typhi Ty2
gagaauccuuccagu

SEQ ID NO: 3691368 - RNA, 15 nt, Salmonella enterica enterica serovar Typhi Ty2
gagaauggaugugaa

SEQ ID NO: 3691369 - RNA, 16 nt, Salmonella enterica enterica serovar Typhi Ty2
gagaauggccagcaca

SEQ ID NO: 3691370 - RNA, 19 nt, Salmonella enterica enterica serovar Typhi Ty2
gagaaugucgccauaucuu

SEQ ID NO: 3691371 - RNA, 13 nt, Salmonella enterica enterica serovar Typhi Ty2
gagaauuuuuagc

SEQ ID NO: 3691372 - RNA, 17 nt, Salmonella enterica enterica serovar Typhi Ty2
gagacagagaaccugaa

SEQ ID NO: 3691373 - RNA, 22 nt, Salmonella enterica enterica serovar Typhi Ty2
gagacaggccagaauucagcau

SEQ ID NO: 3691374 - RNA, 16 nt, Salmonella enterica enterica serovar Typhi Ty2
gagacauugccuucca

SEQ ID NO: 3691375 - RNA, 12 nt, Salmonella enterica enterica serovar Typhi Ty2
gagaccaucgcg

SEQ ID NO: 3691376 - RNA, 20 nt, Salmonella enterica enterica serovar Typhi Ty2
gagaccgggcuuuguugucu

SEQ ID NO: 3691377 - RNA, 13 nt, Salmonella enterica enterica serovar Typhi Ty2
gagacgcuggaaa

SEQ ID NO: 3691378 - RNA, 18 nt, Salmonella enterica enterica serovar Typhi Ty2
gagacgcuggaaaauuuc

SEQ ID NO: 3691379 - RNA, 22 nt, Salmonella enterica enterica serovar Typhi Ty2
gagacguucauuucuuccagca

SEQ ID NO: 3691380 - RNA, 13 nt, Salmonella enterica enterica serovar Typhi Ty2
gagacucaaagaa

SEQ ID NO: 3691381 - RNA, 14 nt, Salmonella enterica enterica serovar Typhi Ty2
gagagaaacaacac

SEQ ID NO: 3691382 - RNA, 17 nt, Salmonella enterica enterica serovar Typhi Ty2
gagagcaacgccaucag

SEQ ID NO: 3691383 - RNA, 20 nt, Salmonella enterica enterica serovar Typhi Ty2
gagagcaauggcguggcgcu

SEQ ID NO: 3691384 - RNA, 13 nt, Salmonella enterica enterica serovar Typhi Ty2
gagagcaucaucu

SEQ ID NO: 3691385 - RNA, 17 nt, Salmonella enterica enterica serovar Typhi Ty2
gagagccuuacaggcgc

SEQ ID NO: 3691386 - RNA, 22 nt, Salmonella enterica enterica serovar Typhi Ty2
gagagccuuacaggcgcaucag

SEQ ID NO: 3691387 - RNA, 23 nt, Salmonella enterica enterica serovar Typhi Ty2
gagagccuuacaggcgcaucaga

SEQ ID NO: 3691388 - RNA, 16 nt, Salmonella enterica enterica serovar Typhi Ty2
gagagcgggccguggc

SEQ ID NO: 3691389 - RNA, 15 nt, Salmonella enterica enterica serovar Typhi Ty2
gagagcguauccagc

SEQ ID NO: 3691390 - RNA, 16 nt, Salmonella enterica enterica serovar Typhi Ty2
gagagcguauccagca

SEQ ID NO: 3691391 - RNA, 15 nt, Salmonella enterica enterica serovar Typhi Ty2
gagagcgucaugaaa

SEQ ID NO: 3691392 - RNA, 13 nt, Salmonella enterica enterica serovar Typhi Ty2
gagaggaggagau

SEQ ID NO: 3691393 - RNA, 22 nt, Salmonella enterica enterica serovar Typhi Ty2
gagaggcugaaggcgcuccccu

SEQ ID NO: 3691394 - RNA, 19 nt, Salmonella enterica enterica serovar Typhi Ty2
gagaguaaaaccggcacau

SEQ ID NO: 3691395 - RNA, 15 nt, Salmonella enterica enterica serovar Typhi Ty2
gagaguccagcgcca

SEQ ID NO: 3691396 - RNA, 20 nt, Salmonella enterica enterica serovar Typhi Ty2
gagauaagccgucauaaaau

SEQ ID NO: 3691397 - RNA, 18 nt, Salmonella enterica enterica serovar Typhi Ty2
gagauacgucaucaugcu

SEQ ID NO: 3691398 - RNA, 13 nt, Salmonella enterica enterica serovar Typhi Ty2
gagauagcgaggc

SEQ ID NO: 3691399 - RNA, 15 nt, Salmonella enterica enterica serovar Typhi Ty2
gagauagcggugccu

SEQ ID NO: 3691400 - RNA, 13 nt, Salmonella enterica enterica serovar Typhi Ty2
gagaucagcggau

SEQ ID NO: 3691401 - RNA, 14 nt, Salmonella enterica enterica serovar Typhi Ty2
gagauccauaagau

SEQ ID NO: 3691402 - RNA, 22 nt, Salmonella enterica enterica serovar Typhi Ty2
gagauccgggcuggcaaacagg

SEQ ID NO: 3691403 - RNA, 16 nt, Salmonella enterica enterica serovar Typhi Ty2
gagaucgguaauuucc

SEQ ID NO: 3691404 - RNA, 17 nt, Salmonella enterica enterica serovar Typhi Ty2
gagaucgguaauuucca

SEQ ID NO: 3691405 - RNA, 21 nt, Salmonella enterica enterica serovar Typhi Ty2
gagaucgguaauuuccacgcc

SEQ ID NO: 3691406 - RNA, 17 nt, Salmonella enterica enterica serovar Typhi Ty2
gaggauaaaaucgccaa

SEQ ID NO: 3691407 - RNA, 18 nt, Salmonella enterica enterica serovar Typhi Ty2
gaggaucgcccagaugaa

SEQ ID NO: 3691408 - RNA, 23 nt, Salmonella enterica enterica serovar Typhi Ty2
gaggcaggggcucuaaaaaggaa

SEQ ID NO: 3691409 - RNA, 13 nt, Salmonella enterica enterica serovar Typhi Ty2
gaggcauaaaaaa

SEQ ID NO: 3691410 - RNA, 20 nt, Salmonella enterica enterica serovar Typhi Ty2
gaggcauaccgcccagaacg

SEQ ID NO: 3691411 - RNA, 14 nt, Salmonella enterica enterica serovar Typhi Ty2
gaggccaccagcgc

SEQ ID NO: 3691412 - RNA, 18 nt, Salmonella enterica enterica serovar Typhi Ty2
gaggccagauucaccacc

SEQ ID NO: 3691413 - RNA, 16 nt, Salmonella enterica enterica serovar Typhi Ty2
gaggccggcccugcgg

SEQ ID NO: 3691414 - RNA, 23 nt, Salmonella enterica enterica serovar Typhi Ty2
gaggcgcagccgccauccggcaa

SEQ ID NO: 3691415 - RNA, 20 nt, Salmonella enterica enterica serovar Typhi Ty2
gaggcgcuggcuugaccgcu

SEQ ID NO: 3691416 - RNA, 15 nt, Salmonella enterica enterica serovar Typhi Ty2
gaggcguaucccagu

SEQ ID NO: 3691417 - RNA, 18 nt, Salmonella enterica enterica serovar Typhi Ty2
gaggcgugagcgaacagg

SEQ ID NO: 3691418 - RNA, 21 nt, Salmonella enterica enterica serovar Typhi Ty2
gaggcgugagcgaacaggucg

SEQ ID NO: 3691419 - RNA, 13 nt, Salmonella enterica enterica serovar Typhi Ty2
gaggcguuuccag

SEQ ID NO: 3691420 - RNA, 14 nt, Salmonella enterica enterica serovar Typhi Ty2
gaggcuaagccaga

SEQ ID NO: 3691421 - RNA, 20 nt, Salmonella enterica enterica serovar Typhi Ty2
gaggcuaauuaucugccagc

SEQ ID NO: 3691422 - RNA, 14 nt, Salmonella enterica enterica serovar Typhi Ty2
gaggcuacccagac

SEQ ID NO: 3691423 - RNA, 23 nt, Salmonella enterica enterica serovar Typhi Ty2
gaggcuaccguucagaucgccaa

SEQ ID NO: 3691424 - RNA, 19 nt, Salmonella enterica enterica serovar Typhi Ty2
gaggcuauugaaaaugcgg

SEQ ID NO: 3691425 - RNA, 21 nt, Salmonella enterica enterica serovar Typhi Ty2
gagggagguucgccucccuca

SEQ ID NO: 3691426 - RNA, 17 nt, Salmonella enterica enterica serovar Typhi Ty2
gagggcgaacuggcggu

SEQ ID NO: 3691427 - RNA, 20 nt, Salmonella enterica enterica serovar Typhi Ty2
gagggcgcgccguugaaauc

SEQ ID NO: 3691428 - RNA, 22 nt, Salmonella enterica enterica serovar Typhi Ty2
gaggggcuuugugccgcacaga

SEQ ID NO: 3691429 - RNA, 20 nt, Salmonella enterica enterica serovar Typhi Ty2
gagggggaggugcugguggu

SEQ ID NO: 3691430 - RNA, 19 nt, Salmonella enterica enterica serovar Typhi Ty2
gagguaguccugcucaugc

SEQ ID NO: 3691431 - RNA, 13 nt, Salmonella enterica enterica serovar Typhi Ty2
gaggucucagguu

SEQ ID NO: 3691432 - RNA, 23 nt, Salmonella enterica enterica serovar Typhi Ty2
gaggucugcauucaggccucugc

SEQ ID NO: 3691433 - RNA, 12 nt, Salmonella enterica enterica serovar Typhi Ty2
gaggugauaauc

SEQ ID NO: 3691434 - RNA, 15 nt, Salmonella enterica enterica serovar Typhi Ty2
gaggugcucucccag

SEQ ID NO: 3691435 - RNA, 20 nt, Salmonella enterica enterica serovar Typhi Ty2
gaggugcucucccagcugag

SEQ ID NO: 3691436 - RNA, 14 nt, Salmonella enterica enterica serovar Typhi Ty2
gaggugcugguggu

SEQ ID NO: 3691437 - RNA, 18 nt, Salmonella enterica enterica serovar Typhi Ty2
gagguucccgccgccauu

SEQ ID NO: 3691438 - RNA, 13 nt, Salmonella enterica enterica serovar Typhi Ty2
gagguuucuucau

SEQ ID NO: 3691439 - RNA, 18 nt, Salmonella enterica enterica serovar Typhi Ty2
gagguuuucucauccagc

SEQ ID NO: 3691440 - RNA, 15 nt, Salmonella enterica enterica serovar Typhi Ty2
gaguaaagccugccc

SEQ ID NO: 3691441 - RNA, 14 nt, Salmonella enterica enterica serovar Typhi Ty2
gaguaacgggcagc

SEQ ID NO: 3691442 - RNA, 17 nt, Salmonella enterica enterica serovar Typhi Ty2
gaguaacgggcagcggc

SEQ ID NO: 3691443 - RNA, 22 nt, Salmonella enterica enterica serovar Typhi Ty2
gaguaagcccaaaggaaagguc

SEQ ID NO: 3691444 - RNA, 19 nt, Salmonella enterica enterica serovar Typhi Ty2
gaguaauaacaaaaaacau

SEQ ID NO: 3691445 - RNA, 18 nt, Salmonella enterica enterica serovar Typhi Ty2
gaguaauccauagccaac

SEQ ID NO: 3691446 - RNA, 18 nt, Salmonella enterica enterica serovar Typhi Ty2
gaguaaugacaaaaauua

SEQ ID NO: 3691447 - RNA, 16 nt, Salmonella enterica enterica serovar Typhi Ty2
gaguaaugaccacacc

SEQ ID NO: 3691448 - RNA, 12 nt, Salmonella enterica enterica serovar Typhi Ty2
gaguagauguag

SEQ ID NO: 3691449 - RNA, 21 nt, Salmonella enterica enterica serovar Typhi Ty2
gaguagcgcagcuugguagcg

SEQ ID NO: 3691450 - RNA, 19 nt, Salmonella enterica enterica serovar Typhi Ty2
gaguagcugagcgucaggc

SEQ ID NO: 3691451 - RNA, 16 nt, Salmonella enterica enterica serovar Typhi Ty2
gaguaguuaaaaaagg

SEQ ID NO: 3691452 - RNA, 20 nt, Salmonella enterica enterica serovar Typhi Ty2
gaguauagcggcguuuauau

SEQ ID NO: 3691453 - RNA, 18 nt, Salmonella enterica enterica serovar Typhi Ty2
gaguaugaacaggcagcg

SEQ ID NO: 3691454 - RNA, 21 nt, Salmonella enterica enterica serovar Typhi Ty2
gaguaugcccgcgagagauua

SEQ ID NO: 3691455 - RNA, 21 nt, Salmonella enterica enterica serovar Typhi Ty2
gaguauuuaccuacuguggug

SEQ ID NO: 3691456 - RNA, 17 nt, Salmonella enterica enterica serovar Typhi Ty2
gagucaaggcauccagc

SEQ ID NO: 3691457 - RNA, 18 nt, Salmonella enterica enterica serovar Typhi Ty2
gagucaaggcauccagca

SEQ ID NO: 3691458 - RNA, 18 nt, Salmonella enterica enterica serovar Typhi Ty2
gagucagacaccagcccu

SEQ ID NO: 3691459 - RNA, 14 nt, Salmonella enterica enterica serovar Typhi Ty2
gaguccagcggcag

SEQ ID NO: 3691460 - RNA, 15 nt, Salmonella enterica enterica serovar Typhi Ty2
gaguccagcggcagc

SEQ ID NO: 3691461 - RNA, 19 nt, Salmonella enterica enterica serovar Typhi Ty2
gaguccccucaaacaggcu

SEQ ID NO: 3691462 - RNA, 16 nt, Salmonella enterica enterica serovar Typhi Ty2
gagucgcagcggcggu

SEQ ID NO: 3691463 - RNA, 19 nt, Salmonella enterica enterica serovar Typhi Ty2
gagucggaucaugaaaaau

SEQ ID NO: 3691464 - RNA, 23 nt, Salmonella enterica enterica serovar Typhi Ty2
gagucguuauccagaucuucaga

SEQ ID NO: 3691465 - RNA, 14 nt, Salmonella enterica enterica serovar Typhi Ty2
gagugaaaugguug

SEQ ID NO: 3691466 - RNA, 11 nt, Salmonella enterica enterica serovar Typhi Ty2
gagugaacacg

SEQ ID NO: 3691467 - RNA, 18 nt, Salmonella enterica enterica serovar Typhi Ty2
gagugacgggcuggcgcu

SEQ ID NO: 3691468 - RNA, 18 nt, Salmonella enterica enterica serovar Typhi Ty2
gagugacgguuuucacug

SEQ ID NO: 3691469 - RNA, 21 nt, Salmonella enterica enterica serovar Typhi Ty2
gagugcgcggcgaaaaagccg

SEQ ID NO: 3691470 - RNA, 15 nt, Salmonella enterica enterica serovar Typhi Ty2
gagugcguucuucca

SEQ ID NO: 3691471 - RNA, 13 nt, Salmonella enterica enterica serovar Typhi Ty2
gaguggaaucagc

SEQ ID NO: 3691472 - RNA, 22 nt, Salmonella enterica enterica serovar Typhi Ty2
gaguggaugacaucgcaaugcc

SEQ ID NO: 3691473 - RNA, 17 nt, Salmonella enterica enterica serovar Typhi Ty2
gaguggcgaaauuggua

SEQ ID NO: 3691474 - RNA, 12 nt, Salmonella enterica enterica serovar Typhi Ty2
gaguggcggcgc

SEQ ID NO: 3691475 - RNA, 20 nt, Salmonella enterica enterica serovar Typhi Ty2
gaguuaacuucuccgccauc

SEQ ID NO: 3691476 - RNA, 12 nt, Salmonella enterica enterica serovar Typhi Ty2
gaguuccggaua

SEQ ID NO: 3691477 - RNA, 15 nt, Salmonella enterica enterica serovar Typhi Ty2
gaguucgguuaacug

SEQ ID NO: 3691478 - RNA, 23 nt, Salmonella enterica enterica serovar Typhi Ty2
gaguugcuuaaaagcggcaaggg

SEQ ID NO: 3691479 - RNA, 23 nt, Salmonella enterica enterica serovar Typhi Ty2
gaguuggcauucgaauccuccug

SEQ ID NO: 3691480 - RNA, 13 nt, Salmonella enterica enterica serovar Typhi Ty2
gauaaaaaaagua

SEQ ID NO: 3691481 - RNA, 18 nt, Salmonella enterica enterica serovar Typhi Ty2
gauaaaaacacccgcacc

SEQ ID NO: 3691482 - RNA, 22 nt, Salmonella enterica enterica serovar Typhi Ty2
gauaaaaacccaccagcgccag

SEQ ID NO: 3691483 - RNA, 16 nt, Salmonella enterica enterica serovar Typhi Ty2
gauaaaacgcaggcag

SEQ ID NO: 3691484 - RNA, 19 nt, Salmonella enterica enterica serovar Typhi Ty2
gauaaaauccgaaaugacc

SEQ ID NO: 3691485 - RNA, 15 nt, Salmonella enterica enterica serovar Typhi Ty2
gauaaaaucgccaaa

SEQ ID NO: 3691486 - RNA, 19 nt, Salmonella enterica enterica serovar Typhi Ty2
gauaaaauucccggcggaa

SEQ ID NO: 3691487 - RNA, 16 nt, Salmonella enterica enterica serovar Typhi Ty2
gauaaacaccggaauu

SEQ ID NO: 3691488 - RNA, 13 nt, Salmonella enterica enterica serovar Typhi Ty2
gauaauucugacu

SEQ ID NO: 3691489 - RNA, 19 nt, Salmonella enterica enterica serovar Typhi Ty2
gauaauucugacuugcugu

SEQ ID NO: 3691490 - RNA, 18 nt, Salmonella enterica enterica serovar Typhi Ty2
gauaauuuauccaguaac

SEQ ID NO: 3691491 - RNA, 17 nt, Salmonella enterica enterica serovar Typhi Ty2
gauaauuuuucagacgu

SEQ ID NO: 3691492 - RNA, 21 nt, Salmonella enterica enterica serovar Typhi Ty2
gauacaagguauccgccauau

SEQ ID NO: 3691493 - RNA, 18 nt, Salmonella enterica enterica serovar Typhi Ty2
gauacacgccuuccucca

SEQ ID NO: 3691494 - RNA, 15 nt, Salmonella enterica enterica serovar Typhi Ty2
gauacagaaaaccgg

SEQ ID NO: 3691495 - RNA, 18 nt, Salmonella enterica enterica serovar Typhi Ty2
gauacagaaaaccggcaa

SEQ ID NO: 3691496 - RNA, 15 nt, Salmonella enterica enterica serovar Typhi Ty2
gauacagccaaauca

SEQ ID NO: 3691497 - RNA, 17 nt, Salmonella enterica enterica serovar Typhi Ty2
gauacaggacugacugc

SEQ ID NO: 3691498 - RNA, 18 nt, Salmonella enterica enterica serovar Typhi Ty2
gauacauggcuauuccac

SEQ ID NO: 3691499 - RNA, 13 nt, Salmonella enterica enterica serovar Typhi Ty2
gauacauuuuuug

SEQ ID NO: 3691500 - RNA, 12 nt, Salmonella enterica enterica serovar Typhi Ty2
gauaccagauua

SEQ ID NO: 3691501 - RNA, 16 nt, Salmonella enterica enterica serovar Typhi Ty2
gauacccccuaucugg

SEQ ID NO: 3691502 - RNA, 17 nt, Salmonella enterica enterica serovar Typhi Ty2
gauaccgcacuggauca

SEQ ID NO: 3691503 - RNA, 14 nt, Salmonella enterica enterica serovar Typhi Ty2
gauaccgcgccagc

SEQ ID NO: 3691504 - RNA, 14 nt, Salmonella enterica enterica serovar Typhi Ty2
gauaccggccgccc

SEQ ID NO: 3691505 - RNA, 21 nt, Salmonella enterica enterica serovar Typhi Ty2
gauaccggcgcagcaucugcg

SEQ ID NO: 3691506 - RNA, 21 nt, Salmonella enterica enterica serovar Typhi Ty2
gauaccguaauaaguaucagc

SEQ ID NO: 3691507 - RNA, 14 nt, Salmonella enterica enterica serovar Typhi Ty2
gauacgccagcaga

SEQ ID NO: 3691508 - RNA, 18 nt, Salmonella enterica enterica serovar Typhi Ty2
gauacgcgucaaauagag

SEQ ID NO: 3691509 - RNA, 20 nt, Salmonella enterica enterica serovar Typhi Ty2
gauacgcugcgucaggcgau

SEQ ID NO: 3691510 - RNA, 16 nt, Salmonella enterica enterica serovar Typhi Ty2
gauacgcuggcacagg

SEQ ID NO: 3691511 - RNA, 18 nt, Salmonella enterica enterica serovar Typhi Ty2
gauacggaaauagcgcca

SEQ ID NO: 3691512 - RNA, 18 nt, Salmonella enterica enterica serovar Typhi Ty2
gauacggcgagaccauau

SEQ ID NO: 3691513 - RNA, 15 nt, Salmonella enterica enterica serovar Typhi Ty2
gauacggcuccagca

SEQ ID NO: 3691514 - RNA, 18 nt, Salmonella enterica enterica serovar Typhi Ty2
gauacgggaagucauuag

SEQ ID NO: 3691515 - RNA, 18 nt, Salmonella enterica enterica serovar Typhi Ty2
gauacgucauaucaucca

SEQ ID NO: 3691516 - RNA, 20 nt, Salmonella enterica enterica serovar Typhi Ty2
gauacgucauaucauccagc

SEQ ID NO: 3691517 - RNA, 14 nt, Salmonella enterica enterica serovar Typhi Ty2
gauacgucaucaug

SEQ ID NO: 3691518 - RNA, 17 nt, Salmonella enterica enterica serovar Typhi Ty2
gauacguuuaaaaugaa

SEQ ID NO: 3691519 - RNA, 18 nt, Salmonella enterica enterica serovar Typhi Ty2
gauacucagccccaggcc

SEQ ID NO: 3691520 - RNA, 20 nt, Salmonella enterica enterica serovar Typhi Ty2
gauacuccauugucggcagc

SEQ ID NO: 3691521 - RNA, 17 nt, Salmonella enterica enterica serovar Typhi Ty2
gauacugcaacgccaga

SEQ ID NO: 3691522 - RNA, 21 nt, Salmonella enterica enterica serovar Typhi Ty2
gauacugcaacgccagaugcg

SEQ ID NO: 3691523 - RNA, 14 nt, Salmonella enterica enterica serovar Typhi Ty2
gauacuguuuuugc

SEQ ID NO: 3691524 - RNA, 19 nt, Salmonella enterica enterica serovar Typhi Ty2
gauagaaccacgcaaaggc

SEQ ID NO: 3691525 - RNA, 16 nt, Salmonella enterica enterica serovar Typhi Ty2
gauagaaguuaugcau

SEQ ID NO: 3691526 - RNA, 21 nt, Salmonella enterica enterica serovar Typhi Ty2
gauagacagcaccaucaugca

SEQ ID NO: 3691527 - RNA, 19 nt, Salmonella enterica enterica serovar Typhi Ty2
gauagacggcugaauguuc

SEQ ID NO: 3691528 - RNA, 18 nt, Salmonella enterica enterica serovar Typhi Ty2
gauagagacugccgccgu

SEQ ID NO: 3691529 - RNA, 12 nt, Salmonella enterica enterica serovar Typhi Ty2
gauagaugaaga

SEQ ID NO: 3691530 - RNA, 23 nt, Salmonella enterica enterica serovar Typhi Ty2
gauagauuugauucguuuaagua

SEQ ID NO: 3691531 - RNA, 21 nt, Salmonella enterica enterica serovar Typhi Ty2
gauagcaaucauccugauuuu

SEQ ID NO: 3691532 - RNA, 16 nt, Salmonella enterica enterica serovar Typhi Ty2
gauagcaauuaauaaa

SEQ ID NO: 3691533 - RNA, 12 nt, Salmonella enterica enterica serovar Typhi Ty2
gauagcauuuuu

SEQ ID NO: 3691534 - RNA, 17 nt, Salmonella enterica enterica serovar Typhi Ty2
gauagcccauccagcac

SEQ ID NO: 3691535 - RNA, 22 nt, Salmonella enterica enterica serovar Typhi Ty2
gauagcccgccagcaccagcag

SEQ ID NO: 3691536 - RNA, 12 nt, Salmonella enterica enterica serovar Typhi Ty2
gauagccgccag

SEQ ID NO: 3691537 - RNA, 17 nt, Salmonella enterica enterica serovar Typhi Ty2
gauagccguucuccagc

SEQ ID NO: 3691538 - RNA, 16 nt, Salmonella enterica enterica serovar Typhi Ty2
gauagcgagcaagacu

SEQ ID NO: 3691539 - RNA, 16 nt, Salmonella enterica enterica serovar Typhi Ty2
gauagcgaggcguuuu

SEQ ID NO: 3691540 - RNA, 19 nt, Salmonella enterica enterica serovar Typhi Ty2
gauagcgccauggagaaac

SEQ ID NO: 3691541 - RNA, 15 nt, Salmonella enterica enterica serovar Typhi Ty2
gauagcguagcgcca

SEQ ID NO: 3691542 - RNA, 14 nt, Salmonella enterica enterica serovar Typhi Ty2
gauagcgucaacgc

SEQ ID NO: 3691543 - RNA, 15 nt, Salmonella enterica enterica serovar Typhi Ty2
gauagcgucaacgcu

SEQ ID NO: 3691544 - RNA, 16 nt, Salmonella enterica enterica serovar Typhi Ty2
gauagcuacgauaaag

SEQ ID NO: 3691545 - RNA, 22 nt, Salmonella enterica enterica serovar Typhi Ty2
gauagcuaucacacauaucgcc

SEQ ID NO: 3691546 - RNA, 23 nt, Salmonella enterica enterica serovar Typhi Ty2
gauagcuuguuguuuauccugca

SEQ ID NO: 3691547 - RNA, 18 nt, Salmonella enterica enterica serovar Typhi Ty2
gauagcuuuguauauguu

SEQ ID NO: 3691548 - RNA, 16 nt, Salmonella enterica enterica serovar Typhi Ty2
gauagggcagcaguuc

SEQ ID NO: 3691549 - RNA, 17 nt, Salmonella enterica enterica serovar Typhi Ty2
gauagggccaggcgcga

SEQ ID NO: 3691550 - RNA, 22 nt, Salmonella enterica enterica serovar Typhi Ty2
gauagguucaauaugccaggca

SEQ ID NO: 3691551 - RNA, 22 nt, Salmonella enterica enterica serovar Typhi Ty2
gauagucgcgauucgggccgca

SEQ ID NO: 3691552 - RNA, 14 nt, Salmonella enterica enterica serovar Typhi Ty2
gauagucuucaagc

SEQ ID NO: 3691553 - RNA, 12 nt, Salmonella enterica enterica serovar Typhi Ty2
gauagugcgugu

SEQ ID NO: 3691554 - RNA, 20 nt, Salmonella enterica enterica serovar Typhi Ty2
gauaguggguauugaauccg

SEQ ID NO: 3691555 - RNA, 18 nt, Salmonella enterica enterica serovar Typhi Ty2
gauaguguaaacgcgcca

SEQ ID NO: 3691556 - RNA, 19 nt, Salmonella enterica enterica serovar Typhi Ty2
gauaguguaaacgcgccau

SEQ ID NO: 3691557 - RNA, 20 nt, Salmonella enterica enterica serovar Typhi Ty2
gauaguuuaaauccagcgcg

SEQ ID NO: 3691558 - RNA, 22 nt, Salmonella enterica enterica serovar Typhi Ty2
gauauaaaacgggccacugcug

SEQ ID NO: 3691559 - RNA, 12 nt, Salmonella enterica enterica serovar Typhi Ty2
gauauaaaaugg

SEQ ID NO: 3691560 - RNA, 13 nt, Salmonella enterica enterica serovar Typhi Ty2
gauauaaagguua

SEQ ID NO: 3691561 - RNA, 15 nt, Salmonella enterica enterica serovar Typhi Ty2
gauauacuucaucag

SEQ ID NO: 3691562 - RNA, 23 nt, Salmonella enterica enterica serovar Typhi Ty2
gauauagaguccagccauaauca

SEQ ID NO: 3691563 - RNA, 21 nt, Salmonella enterica enterica serovar Typhi Ty2
gauauagcugcgauccagguc

SEQ ID NO: 3691564 - RNA, 13 nt, Salmonella enterica enterica serovar Typhi Ty2
gauauaugcaaaa

SEQ ID NO: 3691565 - RNA, 17 nt, Salmonella enterica enterica serovar Typhi Ty2
gauauauggcgggaaau

SEQ ID NO: 3691566 - RNA, 16 nt, Salmonella enterica enterica serovar Typhi Ty2
gauauauucagcaaau

SEQ ID NO: 3691567 - RNA, 16 nt, Salmonella enterica enterica serovar Typhi Ty2
gauaucaaacacaaau

SEQ ID NO: 3691568 - RNA, 17 nt, Salmonella enterica enterica serovar Typhi Ty2
gauaucaacccaguuuu

SEQ ID NO: 3691569 - RNA, 20 nt, Salmonella enterica enterica serovar Typhi Ty2
gauaucauucucuacgccca

SEQ ID NO: 3691570 - RNA, 20 nt, Salmonella enterica enterica serovar Typhi Ty2
gauccgaugcgcuuuacugu

SEQ ID NO: 3691571 - RNA, 13 nt, Salmonella enterica enterica serovar Typhi Ty2
gauccggcagcca

SEQ ID NO: 3691572 - RNA, 18 nt, Salmonella enterica enterica serovar Typhi Ty2
gauccggcuguuccagua

SEQ ID NO: 3691573 - RNA, 14 nt, Salmonella enterica enterica serovar Typhi Ty2
gauccguuucagaa

SEQ ID NO: 3691574 - RNA, 16 nt, Salmonella enterica enterica serovar Typhi Ty2
gauccugcaacagcac

SEQ ID NO: 3691575 - RNA, 20 nt, Salmonella enterica enterica serovar Typhi Ty2
gauccuguaaaaaauccagc

SEQ ID NO: 3691576 - RNA, 23 nt, Salmonella enterica enterica serovar Typhi Ty2
gauccuguaacgcauaagcgcga

SEQ ID NO: 3691577 - RNA, 15 nt, Salmonella enterica enterica serovar Typhi Ty2
gauccuucauucaga

SEQ ID NO: 3691578 - RNA, 19 nt, Salmonella enterica enterica serovar Typhi Ty2
gaucgaaaaugcgcaugau

SEQ ID NO: 3691579 - RNA, 15 nt, Salmonella enterica enterica serovar Typhi Ty2
gaucgacaucuucau

SEQ ID NO: 3691580 - RNA, 18 nt, Salmonella enterica enterica serovar Typhi Ty2
gaucgacaucuucaucaa

SEQ ID NO: 3691581 - RNA, 20 nt, Salmonella enterica enterica serovar Typhi Ty2
gaucgacuaauuuuaggaag

SEQ ID NO: 3691582 - RNA, 13 nt, Salmonella enterica enterica serovar Typhi Ty2
gaucgacuggcgg

SEQ ID NO: 3691583 - RNA, 14 nt, Salmonella enterica enterica serovar Typhi Ty2
gaucgaggucagca

SEQ ID NO: 3691584 - RNA, 20 nt, Salmonella enterica enterica serovar Typhi Ty2
gaucgauagcgacggcgcgc

SEQ ID NO: 3691585 - RNA, 17 nt, Salmonella enterica enterica serovar Typhi Ty2
gaucgauauccgugcgc

SEQ ID NO: 3691586 - RNA, 20 nt, Salmonella enterica enterica serovar Typhi Ty2
gaucgauauccgugcgcaau

SEQ ID NO: 3691587 - RNA, 15 nt, Salmonella enterica enterica serovar Typhi Ty2
gaucgaucccggcaa

SEQ ID NO: 3691588 - RNA, 20 nt, Salmonella enterica enterica serovar Typhi Ty2
gaucgcauuuaaucgccugc

SEQ ID NO: 3691589 - RNA, 16 nt, Salmonella enterica enterica serovar Typhi Ty2
gaucgccauccugcac

SEQ ID NO: 3691590 - RNA, 17 nt, Salmonella enterica enterica serovar Typhi Ty2
gaucgccauccugcacc

SEQ ID NO: 3691591 - RNA, 14 nt, Salmonella enterica enterica serovar Typhi Ty2
gaucgcccggauca

SEQ ID NO: 3691592 - RNA, 22 nt, Salmonella enterica enterica serovar Typhi Ty2
gaucgccgguuuugguaucuuc

SEQ ID NO: 3691593 - RNA, 14 nt, Salmonella enterica enterica serovar Typhi Ty2
gaucgccuggaucg

SEQ ID NO: 3691594 - RNA, 21 nt, Salmonella enterica enterica serovar Typhi Ty2
gaucgcgcucccggccaauca

SEQ ID NO: 3691595 - RNA, 19 nt, Salmonella enterica enterica serovar Typhi Ty2
gaucgcgcugcgcaggcgu

SEQ ID NO: 3691596 - RNA, 20 nt, Salmonella enterica enterica serovar Typhi Ty2
gaucgcggcaaccguaucca

SEQ ID NO: 3691597 - RNA, 16 nt, Salmonella enterica enterica serovar Typhi Ty2
gaucgcguacagcgcc

SEQ ID NO: 3691598 - RNA, 13 nt, Salmonella enterica enterica serovar Typhi Ty2
gaucgcuccauuc

SEQ ID NO: 3691599 - RNA, 20 nt, Salmonella enterica enterica serovar Typhi Ty2
gaucgcuggugcccgguacg

SEQ ID NO: 3691600 - RNA, 20 nt, Salmonella enterica enterica serovar Typhi Ty2
gaucggaaaucaaaccaucc

SEQ ID NO: 3691601 - RNA, 13 nt, Salmonella enterica enterica serovar Typhi Ty2
gaucggaacgcga

SEQ ID NO: 3691602 - RNA, 18 nt, Salmonella enterica enterica serovar Typhi Ty2
gaucggcaaacagcuuca

SEQ ID NO: 3691603 - RNA, 21 nt, Salmonella enterica enterica serovar Typhi Ty2
gaucggccagauaguggcuga

SEQ ID NO: 3691604 - RNA, 20 nt, Salmonella enterica enterica serovar Typhi Ty2
gaucggcgcagguccauuuu

SEQ ID NO: 3691605 - RNA, 21 nt, Salmonella enterica enterica serovar Typhi Ty2
gaucggcggcccacucaucca

SEQ ID NO: 3691606 - RNA, 14 nt, Salmonella enterica enterica serovar Typhi Ty2
gaucggcuggcgca

SEQ ID NO: 3691607 - RNA, 17 nt, Salmonella enterica enterica serovar Typhi Ty2
gaucggggcgaccggcu

SEQ ID NO: 3691608 - RNA, 16 nt, Salmonella enterica enterica serovar Typhi Ty2
gaucggguuuuccuga

SEQ ID NO: 3691609 - RNA, 14 nt, Salmonella enterica enterica serovar Typhi Ty2
gaucgguuuauccc

SEQ ID NO: 3691610 - RNA, 18 nt, Salmonella enterica enterica serovar Typhi Ty2
gaucguaaaaugaaaaac

SEQ ID NO: 3691611 - RNA, 22 nt, Salmonella enterica enterica serovar Typhi Ty2
gaucguaaagcgcauccagcuc

SEQ ID NO: 3691612 - RNA, 16 nt, Salmonella enterica enterica serovar Typhi Ty2
gaucguagccauguuc

SEQ ID NO: 3691613 - RNA, 16 nt, Salmonella enterica enterica serovar Typhi Ty2
gaucguaggcggcgga

SEQ ID NO: 3691614 - RNA, 17 nt, Salmonella enterica enterica serovar Typhi Ty2
gaucguauccagcggca

SEQ ID NO: 3691615 - RNA, 17 nt, Salmonella enterica enterica serovar Typhi Ty2
gaucguaugcgccuguu

SEQ ID NO: 3691616 - RNA, 22 nt, Salmonella enterica enterica serovar Typhi Ty2
gaucgucgcgaucgcgccagcc

SEQ ID NO: 3691617 - RNA, 14 nt, Salmonella enterica enterica serovar Typhi Ty2
gaucuaaagccagu

SEQ ID NO: 3691618 - RNA, 17 nt, Salmonella enterica enterica serovar Typhi Ty2
gaucuaaagccaguuuc

SEQ ID NO: 3691619 - RNA, 15 nt, Salmonella enterica enterica serovar Typhi Ty2
gaucuacaaucgucu

SEQ ID NO: 3691620 - RNA, 21 nt, Salmonella enterica enterica serovar Typhi Ty2
gaucuacgcuauuuccagaaa

SEQ ID NO: 3691621 - RNA, 16 nt, Salmonella enterica enterica serovar Typhi Ty2
gaucuacggaucccuu

SEQ ID NO: 3691622 - RNA, 15 nt, Salmonella enterica enterica serovar Typhi Ty2
gaucucaugcaacug

SEQ ID NO: 3691623 - RNA, 12 nt, Salmonella enterica enterica serovar Typhi Ty2
gaucuccagaag

SEQ ID NO: 3691624 - RNA, 17 nt, Salmonella enterica enterica serovar Typhi Ty2
gaucucgauauucacac

SEQ ID NO: 3691625 - RNA, 21 nt, Salmonella enterica enterica serovar Typhi Ty2
gaucugacauuugcaucaaac

SEQ ID NO: 3691626 - RNA, 21 nt, Salmonella enterica enterica serovar Typhi Ty2
gaucugcgccauugaggucgc

SEQ ID NO: 3691627 - RNA, 20 nt, Salmonella enterica enterica serovar Typhi Ty2
gaucuggcgcuuuuccagca

SEQ ID NO: 3691628 - RNA, 16 nt, Salmonella enterica enterica serovar Typhi Ty2
gaucuggcggcgaaag

SEQ ID NO: 3691629 - RNA, 16 nt, Salmonella enterica enterica serovar Typhi Ty2
gaucugucgccaugac

SEQ ID NO: 3691630 - RNA, 22 nt, Salmonella enterica enterica serovar Typhi Ty2
gaucuuagcgguuucggcaaua

SEQ ID NO: 3691631 - RNA, 19 nt, Salmonella enterica enterica serovar Typhi Ty2
gaucuuaucuuucagcgcc

SEQ ID NO: 3691632 - RNA, 12 nt, Salmonella enterica enterica serovar Typhi Ty2
gaucuuccacua

SEQ ID NO: 3691633 - RNA, 12 nt, Salmonella enterica enterica serovar Typhi Ty2
gaucuuccugcg

SEQ ID NO: 3691634 - RNA, 23 nt, Salmonella enterica enterica serovar Typhi Ty2
gaucuuccugcgcgccaaaccgu

SEQ ID NO: 3691635 - RNA, 19 nt, Salmonella enterica enterica serovar Typhi Ty2
gaucuugucacaauaacgc

SEQ ID NO: 3691636 - RNA, 16 nt, Salmonella enterica enterica serovar Typhi Ty2
gaucuuuauccugcac

SEQ ID NO: 3691637 - RNA, 13 nt, Salmonella enterica enterica serovar Typhi Ty2
gaucuuugccgcg

SEQ ID NO: 3691638 - RNA, 11 nt, Salmonella enterica enterica serovar Typhi Ty2
gaugaaaaaga

SEQ ID NO: 3691639 - RNA, 13 nt, Salmonella enterica enterica serovar Typhi Ty2
gaugaaaaagagg

SEQ ID NO: 3691640 - RNA, 20 nt, Salmonella enterica enterica serovar Typhi Ty2
gaugaaaaguacgcaaacag

SEQ ID NO: 3691641 - RNA, 23 nt, Salmonella enterica enterica serovar Typhi Ty2
gaugaaacugcauaucgccgcuu

SEQ ID NO: 3691642 - RNA, 22 nt, Salmonella enterica enterica serovar Typhi Ty2
gaugaaaggucgaaaacggcca

SEQ ID NO: 3691643 - RNA, 23 nt, Salmonella enterica enterica serovar Typhi Ty2
gaugaacucuaugcaaaagaaaa

SEQ ID NO: 3691644 - RNA, 17 nt, Salmonella enterica enterica serovar Typhi Ty2
gaugaagaacagcgucg

SEQ ID NO: 3691645 - RNA, 20 nt, Salmonella enterica enterica serovar Typhi Ty2
gaugaccaguuaagcaaaaa

SEQ ID NO: 3691646 - RNA, 16 nt, Salmonella enterica enterica serovar Typhi Ty2
gaugaccauaaaugaa

SEQ ID NO: 3691647 - RNA, 18 nt, Salmonella enterica enterica serovar Typhi Ty2
gaugacccgcaauauuaa

SEQ ID NO: 3691648 - RNA, 20 nt, Salmonella enterica enterica serovar Typhi Ty2
gaugacgcuucgcuuauccg

SEQ ID NO: 3691649 - RNA, 16 nt, Salmonella enterica enterica serovar Typhi Ty2
gaugacggcaggggcg

SEQ ID NO: 3691650 - RNA, 17 nt, Salmonella enterica enterica serovar Typhi Ty2
gaugacggcgcguuauc

SEQ ID NO: 3691651 - RNA, 13 nt, Salmonella enterica enterica serovar Typhi Ty2
gaugacguccaga

SEQ ID NO: 3691652 - RNA, 19 nt, Salmonella enterica enterica serovar Typhi Ty2
gauggcgcugcgcuuauca

SEQ ID NO: 3691653 - RNA, 20 nt, Salmonella enterica enterica serovar Typhi Ty2
gauggcgcugcgcuuaucag

SEQ ID NO: 3691654 - RNA, 20 nt, Salmonella enterica enterica serovar Typhi Ty2
gauggcgcugcguuuccugu

SEQ ID NO: 3691655 - RNA, 20 nt, Salmonella enterica enterica serovar Typhi Ty2
gauggcgcuucgcuuaucag

SEQ ID NO: 3691656 - RNA, 22 nt, Salmonella enterica enterica serovar Typhi Ty2
gauggcggcgaugccuuauccg

SEQ ID NO: 3691657 - RNA, 14 nt, Salmonella enterica enterica serovar Typhi Ty2
gauggcggcguaaa

SEQ ID NO: 3691658 - RNA, 23 nt, Salmonella enterica enterica serovar Typhi Ty2
gauggcggcuaacgccugauccg

SEQ ID NO: 3691659 - RNA, 15 nt, Salmonella enterica enterica serovar Typhi Ty2
gauggcggcugcgcc

SEQ ID NO: 3691660 - RNA, 22 nt, Salmonella enterica enterica serovar Typhi Ty2
gauggcggcuucgccuuauccg

SEQ ID NO: 3691661 - RNA, 21 nt, Salmonella enterica enterica serovar Typhi Ty2
gauggcguaauuaaccgcgcc

SEQ ID NO: 3691662 - RNA, 17 nt, Salmonella enterica enterica serovar Typhi Ty2
gauggcguuuagcuggc

SEQ ID NO: 3691663 - RNA, 20 nt, Salmonella enterica enterica serovar Typhi Ty2
gauggcuaugaagcuggagc

SEQ ID NO: 3691664 - RNA, 14 nt, Salmonella enterica enterica serovar Typhi Ty2
gaugggcaaugcca

SEQ ID NO: 3691665 - RNA, 14 nt, Salmonella enterica enterica serovar Typhi Ty2
gaugggcuucagau

SEQ ID NO: 3691666 - RNA, 17 nt, Salmonella enterica enterica serovar Typhi Ty2
gaugggcuucagauguu

SEQ ID NO: 3691667 - RNA, 13 nt, Salmonella enterica enterica serovar Typhi Ty2
gauggucgcgcca

SEQ ID NO: 3691668 - RNA, 17 nt, Salmonella enterica enterica serovar Typhi Ty2
gaugguggugcaagcac

SEQ ID NO: 3691669 - RNA, 15 nt, Salmonella enterica enterica serovar Typhi Ty2
gauguaaaaccuggc

SEQ ID NO: 3691670 - RNA, 14 nt, Salmonella enterica enterica serovar Typhi Ty2
gauguaaucugaca

SEQ ID NO: 3691671 - RNA, 18 nt, Salmonella enterica enterica serovar Typhi Ty2
gauguaugaacugcauca

SEQ ID NO: 3691672 - RNA, 18 nt, Salmonella enterica enterica serovar Typhi Ty2
gaugucaauuacgcacca

SEQ ID NO: 3691673 - RNA, 15 nt, Salmonella enterica enterica serovar Typhi Ty2
gaugucauaaucgcc

SEQ ID NO: 3691674 - RNA, 22 nt, Salmonella enterica enterica serovar Typhi Ty2
gaugucauccgguucacccacu

SEQ ID NO: 3691675 - RNA, 21 nt, Salmonella enterica enterica serovar Typhi Ty2
gauguccaccgauuucaucgc

SEQ ID NO: 3691676 - RNA, 20 nt, Salmonella enterica enterica serovar Typhi Ty2
gauguccaggcgacaugaca

SEQ ID NO: 3691677 - RNA, 20 nt, Salmonella enterica enterica serovar Typhi Ty2
gauguccgucuuuucugucg

SEQ ID NO: 3691678 - RNA, 14 nt, Salmonella enterica enterica serovar Typhi Ty2
gaugucgccacgcc

SEQ ID NO: 3691679 - RNA, 20 nt, Salmonella enterica enterica serovar Typhi Ty2
gaugucgcuucgcuuaucug

SEQ ID NO: 3691680 - RNA, 20 nt, Salmonella enterica enterica serovar Typhi Ty2
gaugucggcguaaauccagc

SEQ ID NO: 3691681 - RNA, 23 nt, Salmonella enterica enterica serovar Typhi Ty2
gaugucggcuuacgccuuauccg

SEQ ID NO: 3691682 - RNA, 14 nt, Salmonella enterica enterica serovar Typhi Ty2
gaugucggucauca

SEQ ID NO: 3691683 - RNA, 20 nt, Salmonella enterica enterica serovar Typhi Ty2
gaugugaccuuugugcagga

SEQ ID NO: 3691684 - RNA, 22 nt, Salmonella enterica enterica serovar Typhi Ty2
gaugugaccuuugugcaggauc

SEQ ID NO: 3691685 - RNA, 13 nt, Salmonella enterica enterica serovar Typhi Ty2
gaugugauaaaug

SEQ ID NO: 3691686 - RNA, 15 nt, Salmonella enterica enterica serovar Typhi Ty2
gaugugauuaaacgc

SEQ ID NO: 3691687 - RNA, 23 nt, Salmonella enterica enterica serovar Typhi Ty2
gaugugauuuuugacccgcagca

SEQ ID NO: 3691688 - RNA, 19 nt, Salmonella enterica enterica serovar Typhi Ty2
gaugugcuuuuuauuuuuc

SEQ ID NO: 3691689 - RNA, 17 nt, Salmonella enterica enterica serovar Typhi Ty2
gauguuacgacccagcg

SEQ ID NO: 3691690 - RNA, 12 nt, Salmonella enterica enterica serovar Typhi Ty2
gauguucaacgu

SEQ ID NO: 3691691 - RNA, 22 nt, Salmonella enterica enterica serovar Typhi Ty2
gauguugguuaauauaucgcag

SEQ ID NO: 3691692 - RNA, 14 nt, Salmonella enterica enterica serovar Typhi Ty2
gauguuuuuaaaag

SEQ ID NO: 3691693 - RNA, 20 nt, Salmonella enterica enterica serovar Typhi Ty2
gauguuuuuaucaugcugac

SEQ ID NO: 3691694 - RNA, 23 nt, Salmonella enterica enterica serovar Typhi Ty2
gauuaaauggaucgacaucuuca

SEQ ID NO: 3691695 - RNA, 15 nt, Salmonella enterica enterica serovar Typhi Ty2
gauuaacaagcagau

SEQ ID NO: 3691696 - RNA, 20 nt, Salmonella enterica enterica serovar Typhi Ty2
gauuaacagcgccaucagga

SEQ ID NO: 3691697 - RNA, 13 nt, Salmonella enterica enterica serovar Typhi Ty2
gauuaaccagcag

SEQ ID NO: 3691698 - RNA, 17 nt, Salmonella enterica enterica serovar Typhi Ty2
gauuaagcgaauccagc

SEQ ID NO: 3691699 - RNA, 20 nt, Salmonella enterica enterica serovar Typhi Ty2
gauuaagcgaauccagcgcc

SEQ ID NO: 3691700 - RNA, 15 nt, Salmonella enterica enterica serovar Typhi Ty2
gauuaaggcguuauc

SEQ ID NO: 3691701 - RNA, 17 nt, Salmonella enterica enterica serovar Typhi Ty2
gauuaagggacgguaaa

SEQ ID NO: 3691702 - RNA, 17 nt, Salmonella enterica enterica serovar Typhi Ty2
gauuaauaaccaauaau

SEQ ID NO: 3691703 - RNA, 16 nt, Salmonella enterica enterica serovar Typhi Ty2
gauuaauacaucacuu

SEQ ID NO: 3691704 - RNA, 16 nt, Salmonella enterica enterica serovar Typhi Ty2
gauuaaucagcagaua

SEQ ID NO: 3691705 - RNA, 16 nt, Salmonella enterica enterica serovar Typhi Ty2
gauuacggaacaaaac

SEQ ID NO: 3691706 - RNA, 16 nt, Salmonella enterica enterica serovar Typhi Ty2
gauuacugcgugcugg

SEQ ID NO: 3691707 - RNA, 20 nt, Salmonella enterica enterica serovar Typhi Ty2
gauuacuucaggcugccaac

SEQ ID NO: 3691708 - RNA, 14 nt, Salmonella enterica enterica serovar Typhi Ty2
gauuagcagagcgg

SEQ ID NO: 3691709 - RNA, 21 nt, Salmonella enterica enterica serovar Typhi Ty2
gauuaucaggaugaauaugaa

SEQ ID NO: 3691710 - RNA, 11 nt, Salmonella enterica enterica serovar Typhi Ty2
gauuauccagu

SEQ ID NO: 3691711 - RNA, 16 nt, Salmonella enterica enterica serovar Typhi Ty2
gauuaucggccagcgc

SEQ ID NO: 3691712 - RNA, 15 nt, Salmonella enterica enterica serovar Typhi Ty2
gauuauuguuaaaaa

SEQ ID NO: 3691713 - RNA, 17 nt, Salmonella enterica enterica serovar Typhi Ty2
gauuauuucauuaaucu

SEQ ID NO: 3691714 - RNA, 17 nt, Salmonella enterica enterica serovar Typhi Ty2
gauuauuugaucccguc

SEQ ID NO: 3691715 - RNA, 18 nt, Salmonella enterica enterica serovar Typhi Ty2
gauuauuuuaucaucagc

SEQ ID NO: 3691716 - RNA, 15 nt, Salmonella enterica enterica serovar Typhi Ty2
gauuauuuucacgcc

SEQ ID NO: 3691717 - RNA, 20 nt, Salmonella enterica enterica serovar Typhi Ty2
gauucaaaaggugagaaaaa

SEQ ID NO: 3691718 - RNA, 19 nt, Salmonella enterica enterica serovar Typhi Ty2
gauucaaccaaugcaacgc

SEQ ID NO: 3691719 - RNA, 22 nt, Salmonella enterica enterica serovar Typhi Ty2
gauucaacgcgugauccacagc

SEQ ID NO: 3691720 - RNA, 14 nt, Salmonella enterica enterica serovar Typhi Ty2
gauucaagcgggug

SEQ ID NO: 3691721 - RNA, 21 nt, Salmonella enterica enterica serovar Typhi Ty2
gauucaauauugaacauuuuu

SEQ ID NO: 3691722 - RNA, 16 nt, Salmonella enterica enterica serovar Typhi Ty2
gauucaccaacugcug

SEQ ID NO: 3691723 - RNA, 17 nt, Salmonella enterica enterica serovar Typhi Ty2
gauucaccaacugcuga

SEQ ID NO: 3691724 - RNA, 19 nt, Salmonella enterica enterica serovar Typhi Ty2
gauucacuuucgacgacaa

SEQ ID NO: 3691725 - RNA, 13 nt, Salmonella enterica enterica serovar Typhi Ty2
gauucagcauugg

SEQ ID NO: 3691726 - RNA, 18 nt, Salmonella enterica enterica serovar Typhi Ty2
gauucagcgcaggcaguu

SEQ ID NO: 3691727 - RNA, 17 nt, Salmonella enterica enterica serovar Typhi Ty2
gauucaugaucuuuccu

SEQ ID NO: 3691728 - RNA, 18 nt, Salmonella enterica enterica serovar Typhi Ty2
gauuccaugcccaguuca

SEQ ID NO: 3691729 - RNA, 16 nt, Salmonella enterica enterica serovar Typhi Ty2
gauucccagucauccg

SEQ ID NO: 3691730 - RNA, 22 nt, Salmonella enterica enterica serovar Typhi Ty2
gauuccggacaacgcaaacugu

SEQ ID NO: 3691731 - RNA, 21 nt, Salmonella enterica enterica serovar Typhi Ty2
gauuccgugguuuguugcgcg

SEQ ID NO: 3691732 - RNA, 17 nt, Salmonella enterica enterica serovar Typhi Ty2
gauucgagcgcagcgag

SEQ ID NO: 3691733 - RNA, 16 nt, Salmonella enterica enterica serovar Typhi Ty2
gauucgcccacggaug

SEQ ID NO: 3691734 - RNA, 18 nt, Salmonella enterica enterica serovar Typhi Ty2
gcaaacccacccgguaau

SEQ ID NO: 3691735 - RNA, 14 nt, Salmonella enterica enterica serovar Typhi Ty2
gcaaacccucaucg

SEQ ID NO: 3691736 - RNA, 21 nt, Salmonella enterica enterica serovar Typhi Ty2
gcaaaccgaauucguccacac

SEQ ID NO: 3691737 - RNA, 19 nt, Salmonella enterica enterica serovar Typhi Ty2
gcaaaccgauaaucaccag

SEQ ID NO: 3691738 - RNA, 20 nt, Salmonella enterica enterica serovar Typhi Ty2
gcaaaccgggguaucuguuu

SEQ ID NO: 3691739 - RNA, 17 nt, Salmonella enterica enterica serovar Typhi Ty2
gcaaaccuaccggcaua

SEQ ID NO: 3691740 - RNA, 13 nt, Salmonella enterica enterica serovar Typhi Ty2
gcaaaccucuccc

SEQ ID NO: 3691741 - RNA, 15 nt, Salmonella enterica enterica serovar Typhi Ty2
gcaaacgauaaaagc

SEQ ID NO: 3691742 - RNA, 19 nt, Salmonella enterica enterica serovar Typhi Ty2
gcaaacgccgaagccagcg

SEQ ID NO: 3691743 - RNA, 14 nt, Salmonella enterica enterica serovar Typhi Ty2
gcaaacgccugcuc

SEQ ID NO: 3691744 - RNA, 13 nt, Salmonella enterica enterica serovar Typhi Ty2
gcaaacgcgauac

SEQ ID NO: 3691745 - RNA, 19 nt, Salmonella enterica enterica serovar Typhi Ty2
gcaaacggaauagcgccuu

SEQ ID NO: 3691746 - RNA, 14 nt, Salmonella enterica enterica serovar Typhi Ty2
gcaaacgggauucc

SEQ ID NO: 3691747 - RNA, 16 nt, Salmonella enterica enterica serovar Typhi Ty2
gcaaacguaaaacgcg

SEQ ID NO: 3691748 - RNA, 18 nt, Salmonella enterica enterica serovar Typhi Ty2
gcaaacguaaccggcguu

SEQ ID NO: 3691749 - RNA, 14 nt, Salmonella enterica enterica serovar Typhi Ty2
gcaaacucagcggc

SEQ ID NO: 3691750 - RNA, 18 nt, Salmonella enterica enterica serovar Typhi Ty2
gcaaacucagcggcucug

SEQ ID NO: 3691751 - RNA, 15 nt, Salmonella enterica enterica serovar Typhi Ty2
gcaaacugcgcgccc

SEQ ID NO: 3691752 - RNA, 23 nt, Salmonella enterica enterica serovar Typhi Ty2
gcaaacuucacauuuuuaucagc

SEQ ID NO: 3691753 - RNA, 17 nt, Salmonella enterica enterica serovar Typhi Ty2
gcaaagaagggcagggg

SEQ ID NO: 3691754 - RNA, 16 nt, Salmonella enterica enterica serovar Typhi Ty2
gcaaagauaaucugaa

SEQ ID NO: 3691755 - RNA, 22 nt, Salmonella enterica enterica serovar Typhi Ty2
gcaaagcccacgcccugcaaug

SEQ ID NO: 3691756 - RNA, 22 nt, Salmonella enterica enterica serovar Typhi Ty2
gcaaagcccaucagcgccagcc

SEQ ID NO: 3691757 - RNA, 13 nt, Salmonella enterica enterica serovar Typhi Ty2
gcaaagccccagu

SEQ ID NO: 3691758 - RNA, 16 nt, Salmonella enterica enterica serovar Typhi Ty2
gcaaagccuuuccgca

SEQ ID NO: 3691759 - RNA, 16 nt, Salmonella enterica enterica serovar Typhi Ty2
gcaaagcguugcaacc

SEQ ID NO: 3691760 - RNA, 15 nt, Salmonella enterica enterica serovar Typhi Ty2
gcaaagcucaacgca

SEQ ID NO: 3691761 - RNA, 15 nt, Salmonella enterica enterica serovar Typhi Ty2
gcaaagguugccgca

SEQ ID NO: 3691762 - RNA, 19 nt, Salmonella enterica enterica serovar Typhi Ty2
gcaaaguacgggugaagca

SEQ ID NO: 3691763 - RNA, 17 nt, Salmonella enterica enterica serovar Typhi Ty2
gcaaaguggguauauuu

SEQ ID NO: 3691764 - RNA, 16 nt, Salmonella enterica enterica serovar Typhi Ty2
gcaaauacaucgccac

SEQ ID NO: 3691765 - RNA, 19 nt, Salmonella enterica enterica serovar Typhi Ty2
gcaaauaccggacagacuu

SEQ ID NO: 3691766 - RNA, 21 nt, Salmonella enterica enterica serovar Typhi Ty2
gcaaauacugcuuuuccggca

SEQ ID NO: 3691767 - RNA, 20 nt, Salmonella enterica enterica serovar Typhi Ty2
gcaaauacuggaaaaaacgg

SEQ ID NO: 3691768 - RNA, 17 nt, Salmonella enterica enterica serovar Typhi Ty2
gcaaaucaacauuauua

SEQ ID NO: 3691769 - RNA, 20 nt, Salmonella enterica enterica serovar Typhi Ty2
gcaaaucaacauuauuaaaa

SEQ ID NO: 3691770 - RNA, 19 nt, Salmonella enterica enterica serovar Typhi Ty2
gcaaaucagcuacuuuaaa

SEQ ID NO: 3691771 - RNA, 19 nt, Salmonella enterica enterica serovar Typhi Ty2
gcaaauccaucucaggccg

SEQ ID NO: 3691772 - RNA, 20 nt, Salmonella enterica enterica serovar Typhi Ty2
gcaaaucccugaucggccag

SEQ ID NO: 3691773 - RNA, 13 nt, Salmonella enterica enterica serovar Typhi Ty2
gcaaaucgccauc

SEQ ID NO: 3691774 - RNA, 17 nt, Salmonella enterica enterica serovar Typhi Ty2
gcaaaucgccaucagcg

SEQ ID NO: 3691775 - RNA, 17 nt, Salmonella enterica enterica serovar Typhi Ty2
gcaaaucgcgguaaaaa

SEQ ID NO: 3691776 - RNA, 23 nt, Salmonella enterica enterica serovar Typhi Ty2
gcaaaucgcgguaaaaagcugau

SEQ ID NO: 3691777 - RNA, 19 nt, Salmonella enterica enterica serovar Typhi Ty2
gcaaaugaccagaucaaca

SEQ ID NO: 3691778 - RNA, 12 nt, Salmonella enterica enterica serovar Typhi Ty2
gcaaaugucaga

SEQ ID NO: 3691779 - RNA, 15 nt, Salmonella enterica enterica serovar Typhi Ty2
gcaaauuaugauuca

SEQ ID NO: 3691780 - RNA, 22 nt, Salmonella enterica enterica serovar Typhi Ty2
gcaaauuccaacauauuugccc

SEQ ID NO: 3691781 - RNA, 23 nt, Salmonella enterica enterica serovar Typhi Ty2
gcaaauucuguaucgcuuauuuu

SEQ ID NO: 3691782 - RNA, 15 nt, Salmonella enterica enterica serovar Typhi Ty2
gcaaauucuuccgca

SEQ ID NO: 3691783 - RNA, 13 nt, Salmonella enterica enterica serovar Typhi Ty2
gcaaauucuuuuc

SEQ ID NO: 3691784 - RNA, 14 nt, Salmonella enterica enterica serovar Typhi Ty2
gcaaauucuuuuca

SEQ ID NO: 3691785 - RNA, 12 nt, Salmonella enterica enterica serovar Typhi Ty2
gcaacaaagccu

SEQ ID NO: 3691786 - RNA, 14 nt, Salmonella enterica enterica serovar Typhi Ty2
gcaacaagcaucau

SEQ ID NO: 3691787 - RNA, 18 nt, Salmonella enterica enterica serovar Typhi Ty2
gcaacacagccagcacga

SEQ ID NO: 3691788 - RNA, 13 nt, Salmonella enterica enterica serovar Typhi Ty2
gcaacaccauccc

SEQ ID NO: 3691789 - RNA, 12 nt, Salmonella enterica enterica serovar Typhi Ty2
gcaacagcacca

SEQ ID NO: 3691790 - RNA, 15 nt, Salmonella enterica enterica serovar Typhi Ty2
gcaacaggccgcauc

SEQ ID NO: 3691791 - RNA, 23 nt, Salmonella enterica enterica serovar Typhi Ty2
gcaacaguaccugauaaaauucc

SEQ ID NO: 3691792 - RNA, 16 nt, Salmonella enterica enterica serovar Typhi Ty2
gcaacagucagcuccu

SEQ ID NO: 3691793 - RNA, 21 nt, Salmonella enterica enterica serovar Typhi Ty2
gcaacagugggcuaugaagag

SEQ ID NO: 3691794 - RNA, 15 nt, Salmonella enterica enterica serovar Typhi Ty2
gcaacaguugcugga

SEQ ID NO: 3691795 - RNA, 21 nt, Salmonella enterica enterica serovar Typhi Ty2
gcaacauaaauaaacagcgcc

SEQ ID NO: 3691796 - RNA, 15 nt, Salmonella enterica enterica serovar Typhi Ty2
gcaacauccgaaagc

SEQ ID NO: 3691797 - RNA, 16 nt, Salmonella enterica enterica serovar Typhi Ty2
gcaacauggacaccgg

SEQ ID NO: 3691798 - RNA, 20 nt, Salmonella enterica enterica serovar Typhi Ty2
gcaacccauacagcccauac

SEQ ID NO: 3691799 - RNA, 21 nt, Salmonella enterica enterica serovar Typhi Ty2
gcaaccccuugcggugcagca

SEQ ID NO: 3691800 - RNA, 12 nt, Salmonella enterica enterica serovar Typhi Ty2
gcaacccggcua

SEQ ID NO: 3691801 - RNA, 21 nt, Salmonella enterica enterica serovar Typhi Ty2
gcaacccguaccuccagcgac

SEQ ID NO: 3691802 - RNA, 15 nt, Salmonella enterica enterica serovar Typhi Ty2
gcaacccuuuuucaa

SEQ ID NO: 3691803 - RNA, 14 nt, Salmonella enterica enterica serovar Typhi Ty2
gcaaccgccugcac

SEQ ID NO: 3691804 - RNA, 16 nt, Salmonella enterica enterica serovar Typhi Ty2
gcaaccguccgcucac

SEQ ID NO: 3691805 - RNA, 18 nt, Salmonella enterica enterica serovar Typhi Ty2
gcaaccugacgcugcgcc

SEQ ID NO: 3691806 - RNA, 14 nt, Salmonella enterica enterica serovar Typhi Ty2
gcaaccuuacguuu

SEQ ID NO: 3691807 - RNA, 21 nt, Salmonella enterica enterica serovar Typhi Ty2
gcaacgagaacccacuuugcu

SEQ ID NO: 3691808 - RNA, 21 nt, Salmonella enterica enterica serovar Typhi Ty2
gcaacgaucccuaauaaaaua

SEQ ID NO: 3691809 - RNA, 22 nt, Salmonella enterica enterica serovar Typhi Ty2
gcaacgauucguaaauugacug

SEQ ID NO: 3691810 - RNA, 12 nt, Salmonella enterica enterica serovar Typhi Ty2
gcaacgccgccg

SEQ ID NO: 3691811 - RNA, 13 nt, Salmonella enterica enterica serovar Typhi Ty2
gcaacgccgccga

SEQ ID NO: 3691812 - RNA, 15 nt, Salmonella enterica enterica serovar Typhi Ty2
gcaacgccggugccu

SEQ ID NO: 3691813 - RNA, 19 nt, Salmonella enterica enterica serovar Typhi Ty2
gcaacgccuccagcgggcu

SEQ ID NO: 3691814 - RNA, 14 nt, Salmonella enterica enterica serovar Typhi Ty2
gcaacgcgcaucaa

SEQ ID NO: 3691815 - RNA, 17 nt, Salmonella enterica enterica serovar Typhi Ty2
gcaacgcgccauccggc

SEQ ID NO: 3691816 - RNA, 15 nt, Salmonella enterica enterica serovar Typhi Ty2
gcaaucuuugccgca

SEQ ID NO: 3691817 - RNA, 12 nt, Salmonella enterica enterica serovar Typhi Ty2
gcaaugaccaca

SEQ ID NO: 3691818 - RNA, 19 nt, Salmonella enterica enterica serovar Typhi Ty2
gcaaugagcggccagcggg

SEQ ID NO: 3691819 - RNA, 22 nt, Salmonella enterica enterica serovar Typhi Ty2
gcaaugauuuuaucaagucgcg

SEQ ID NO: 3691820 - RNA, 12 nt, Salmonella enterica enterica serovar Typhi Ty2
gcaaugccacca

SEQ ID NO: 3691821 - RNA, 18 nt, Salmonella enterica enterica serovar Typhi Ty2
gcaaugccaccagcgcca

SEQ ID NO: 3691822 - RNA, 13 nt, Salmonella enterica enterica serovar Typhi Ty2
gcaaugcccacgc

SEQ ID NO: 3691823 - RNA, 18 nt, Salmonella enterica enterica serovar Typhi Ty2
gcaaugcccgguuuuuua

SEQ ID NO: 3691824 - RNA, 16 nt, Salmonella enterica enterica serovar Typhi Ty2
gcaaugccgccgccag

SEQ ID NO: 3691825 - RNA, 14 nt, Salmonella enterica enterica serovar Typhi Ty2
gcaaugccgcgcuu

SEQ ID NO: 3691826 - RNA, 18 nt, Salmonella enterica enterica serovar Typhi Ty2
gcaaugccuaccggcggc

SEQ ID NO: 3691827 - RNA, 16 nt, Salmonella enterica enterica serovar Typhi Ty2
gcaaugcgaauaacau

SEQ ID NO: 3691828 - RNA, 22 nt, Salmonella enterica enterica serovar Typhi Ty2
gcaaugcggguuucguucggca

SEQ ID NO: 3691829 - RNA, 18 nt, Salmonella enterica enterica serovar Typhi Ty2
gcaaugggggcuugcgcc

SEQ ID NO: 3691830 - RNA, 24 nt, Salmonella enterica enterica serovar Typhi Ty2
gcaaugucaucguuugcgcuacgc

SEQ ID NO: 3691831 - RNA, 21 nt, Salmonella enterica enterica serovar Typhi Ty2
gcaaugugcgccagaauugcc

SEQ ID NO: 3691832 - RNA, 20 nt, Salmonella enterica enterica serovar Typhi Ty2
gcaauguuccccugaugcgu

SEQ ID NO: 3691833 - RNA, 15 nt, Salmonella enterica enterica serovar Typhi Ty2
gcaauuaaauuagaa

SEQ ID NO: 3691834 - RNA, 16 nt, Salmonella enterica enterica serovar Typhi Ty2
gcaauuaacaaauaaa

SEQ ID NO: 3691835 - RNA, 12 nt, Salmonella enterica enterica serovar Typhi Ty2
gcaauuaauauu

SEQ ID NO: 3691836 - RNA, 19 nt, Salmonella enterica enterica serovar Typhi Ty2
gcaauucaaacugacugau

SEQ ID NO: 3691837 - RNA, 12 nt, Salmonella enterica enterica serovar Typhi Ty2
gcaauucauccu

SEQ ID NO: 3691838 - RNA, 18 nt, Salmonella enterica enterica serovar Typhi Ty2
gcaauuccgccaucucau

SEQ ID NO: 3691839 - RNA, 17 nt, Salmonella enterica enterica serovar Typhi Ty2
gcaauuccgcuuucuuc

SEQ ID NO: 3691840 - RNA, 21 nt, Salmonella enterica enterica serovar Typhi Ty2
gcaauugguaauuaaaggcag

SEQ ID NO: 3691841 - RNA, 22 nt, Salmonella enterica enterica serovar Typhi Ty2
gcaauuuaucgugccggauggc

SEQ ID NO: 3691842 - RNA, 12 nt, Salmonella enterica enterica serovar Typhi Ty2
gcaauuucucgc

SEQ ID NO: 3691843 - RNA, 21 nt, Salmonella enterica enterica serovar Typhi Ty2
gcaauuucucgcucgcccauc

SEQ ID NO: 3691844 - RNA, 22 nt, Salmonella enterica enterica serovar Typhi Ty2
gcaauuugguuagggaucaucu

SEQ ID NO: 3691845 - RNA, 17 nt, Salmonella enterica enterica serovar Typhi Ty2
gcacaaaaaaaccgcuc

SEQ ID NO: 3691846 - RNA, 20 nt, Salmonella enterica enterica serovar Typhi Ty2
gcacaaaaaguaguuccagc

SEQ ID NO: 3691847 - RNA, 17 nt, Salmonella enterica enterica serovar Typhi Ty2
gcacaaaguccgccguc

SEQ ID NO: 3691848 - RNA, 18 nt, Salmonella enterica enterica serovar Typhi Ty2
gcacaacgaguccccuca

SEQ ID NO: 3691849 - RNA, 21 nt, Salmonella enterica enterica serovar Typhi Ty2
gcacaacgcauuggcaauuaa

SEQ ID NO: 3691850 - RNA, 18 nt, Salmonella enterica enterica serovar Typhi Ty2
gcacaagaaacauguugu

SEQ ID NO: 3691851 - RNA, 11 nt, Salmonella enterica enterica serovar Typhi Ty2
gcacaagccau

SEQ ID NO: 3691852 - RNA, 14 nt, Salmonella enterica enterica serovar Typhi Ty2
gcacaauaccaaua

SEQ ID NO: 3691853 - RNA, 22 nt, Salmonella enterica enterica serovar Typhi Ty2
gcacaauaccgagaauguguuc

SEQ ID NO: 3691854 - RNA, 13 nt, Salmonella enterica enterica serovar Typhi Ty2
gcacaaucgccag

SEQ ID NO: 3691855 - RNA, 17 nt, Salmonella enterica enterica serovar Typhi Ty2
gcacaaugcccggcaua

SEQ ID NO: 3691856 - RNA, 12 nt, Salmonella enterica enterica serovar Typhi Ty2
gcacacagcgcu

SEQ ID NO: 3691857 - RNA, 12 nt, Salmonella enterica enterica serovar Typhi Ty2
gcacacaggccg

SEQ ID NO: 3691858 - RNA, 18 nt, Salmonella enterica enterica serovar Typhi Ty2
gcacacgaaauccaaaca

SEQ ID NO: 3691859 - RNA, 18 nt, Salmonella enterica enterica serovar Typhi Ty2
gcacacgccaaaaucgcc

SEQ ID NO: 3691860 - RNA, 14 nt, Salmonella enterica enterica serovar Typhi Ty2
gcacacgucugagc

SEQ ID NO: 3691861 - RNA, 15 nt, Salmonella enterica enterica serovar Typhi Ty2
gcacacuuucaucag

SEQ ID NO: 3691862 - RNA, 17 nt, Salmonella enterica enterica serovar Typhi Ty2
gcacacuuucaucagcc

SEQ ID NO: 3691863 - RNA, 15 nt, Salmonella enterica enterica serovar Typhi Ty2
gcacagcacauagaa

SEQ ID NO: 3691864 - RNA, 17 nt, Salmonella enterica enterica serovar Typhi Ty2
gcacagcacuaacgagg

SEQ ID NO: 3691865 - RNA, 14 nt, Salmonella enterica enterica serovar Typhi Ty2
gcacagcauaccgu

SEQ ID NO: 3691866 - RNA, 15 nt, Salmonella enterica enterica serovar Typhi Ty2
gcacagccaguaaga

SEQ ID NO: 3691867 - RNA, 19 nt, Salmonella enterica enterica serovar Typhi Ty2
gcacagccaguaagaacga

SEQ ID NO: 3691868 - RNA, 20 nt, Salmonella enterica enterica serovar Typhi Ty2
gcacagcccuaccgccacca

SEQ ID NO: 3691869 - RNA, 17 nt, Salmonella enterica enterica serovar Typhi Ty2
gcacagcgcuaucaggc

SEQ ID NO: 3691870 - RNA, 22 nt, Salmonella enterica enterica serovar Typhi Ty2
gcacaggcgcggagacgugacc

SEQ ID NO: 3691871 - RNA, 20 nt, Salmonella enterica enterica serovar Typhi Ty2
gcacagguacaggccgccgc

SEQ ID NO: 3691872 - RNA, 21 nt, Salmonella enterica enterica serovar Typhi Ty2
gcacagguacaggccgccgcc

SEQ ID NO: 3691873 - RNA, 14 nt, Salmonella enterica enterica serovar Typhi Ty2
gcacauaacgugcc

SEQ ID NO: 3691874 - RNA, 21 nt, Salmonella enterica enterica serovar Typhi Ty2
gcacauaggcaaacaccucag

SEQ ID NO: 3691875 - RNA, 20 nt, Salmonella enterica enterica serovar Typhi Ty2
gcacaucaauaaauccgcgc

SEQ ID NO: 3691876 - RNA, 12 nt, Salmonella enterica enterica serovar Typhi Ty2
gcacaucagccg

SEQ ID NO: 3691877 - RNA, 21 nt, Salmonella enterica enterica serovar Typhi Ty2
gcacaucaugaugaucuucag

SEQ ID NO: 3691878 - RNA, 22 nt, Salmonella enterica enterica serovar Typhi Ty2
gcacaucaugaugaucuucagc

SEQ ID NO: 3691879 - RNA, 15 nt, Salmonella enterica enterica serovar Typhi Ty2
gcacaucccgaauac

SEQ ID NO: 3691880 - RNA, 18 nt, Salmonella enterica enterica serovar Typhi Ty2
gcacaucgccauuaaaag

SEQ ID NO: 3691881 - RNA, 22 nt, Salmonella enterica enterica serovar Typhi Ty2
gcacaucgucuuuuaccgcguc

SEQ ID NO: 3691882 - RNA, 14 nt, Salmonella enterica enterica serovar Typhi Ty2
gcacaugggcagga

SEQ ID NO: 3691883 - RNA, 22 nt, Salmonella enterica enterica serovar Typhi Ty2
gcacauucgauaaccgccgaca

SEQ ID NO: 3691884 - RNA, 17 nt, Salmonella enterica enterica serovar Typhi Ty2
gcacauuguugcaggga

SEQ ID NO: 3691885 - RNA, 15 nt, Salmonella enterica enterica serovar Typhi Ty2
gcacauuuacgccag

SEQ ID NO: 3691886 - RNA, 23 nt, Salmonella enterica enterica serovar Typhi Ty2
gcacauuuuuaucaggccugccu

SEQ ID NO: 3691887 - RNA, 15 nt, Salmonella enterica enterica serovar Typhi Ty2
gcaccaacgccgcuu

SEQ ID NO: 3691888 - RNA, 20 nt, Salmonella enterica enterica serovar Typhi Ty2
gcaccaccaggaacgccaua

SEQ ID NO: 3691889 - RNA, 13 nt, Salmonella enterica enterica serovar Typhi Ty2
gcaccaccugguu

SEQ ID NO: 3691890 - RNA, 19 nt, Salmonella enterica enterica serovar Typhi Ty2
gcaccacuuuguuuuuguc

SEQ ID NO: 3691891 - RNA, 21 nt, Salmonella enterica enterica serovar Typhi Ty2
gcaccagaacucccuguuccu

SEQ ID NO: 3691892 - RNA, 16 nt, Salmonella enterica enterica serovar Typhi Ty2
gcaccagaaucauuaa

SEQ ID NO: 3691893 - RNA, 16 nt, Salmonella enterica enterica serovar Typhi Ty2
gcaccagcaacacauc

SEQ ID NO: 3691894 - RNA, 15 nt, Salmonella enterica enterica serovar Typhi Ty2
gcaccagcaaugaua

SEQ ID NO: 3691895 - RNA, 13 nt, Salmonella enterica enterica serovar Typhi Ty2
gcaccagccagga

SEQ ID NO: 3691896 - RNA, 14 nt, Salmonella enterica enterica serovar Typhi Ty2
gcaccagccaggcg

SEQ ID NO: 3691897 - RNA, 23 nt, Salmonella enterica enterica serovar Typhi Ty2
gcaccagccaggcgaucgcacag

SEQ ID NO: 3691898 - RNA, 23 nt, Salmonella enterica enterica serovar Typhi Ty2
gcaccaguucacuccuaagagaa

SEQ ID NO: 3691899 - RNA, 20 nt, Salmonella enterica enterica serovar Typhi Ty2
gcaccaguuccccauacuga

SEQ ID NO: 3691900 - RNA, 20 nt, Salmonella enterica enterica serovar Typhi Ty2
gcaccauaccuauaaaaaug

SEQ ID NO: 3691901 - RNA, 17 nt, Salmonella enterica enterica serovar Typhi Ty2
gcaccauucccacgcau

SEQ ID NO: 3691902 - RNA, 14 nt, Salmonella enterica enterica serovar Typhi Ty2
gcaccauucuucaa

SEQ ID NO: 3691903 - RNA, 14 nt, Salmonella enterica enterica serovar Typhi Ty2
gcacccaucuuuac

SEQ ID NO: 3691904 - RNA, 17 nt, Salmonella enterica enterica serovar Typhi Ty2
gcacccaucuuuaccaa

SEQ ID NO: 3691905 - RNA, 21 nt, Salmonella enterica enterica serovar Typhi Ty2
gcaccccucuucuuuaagaac

SEQ ID NO: 3691906 - RNA, 13 nt, Salmonella enterica enterica serovar Typhi Ty2
gcaccgaauguuc

SEQ ID NO: 3691907 - RNA, 16 nt, Salmonella enterica enterica serovar Typhi Ty2
gcaccgccagcgccgc

SEQ ID NO: 3691908 - RNA, 13 nt, Salmonella enterica enterica serovar Typhi Ty2
gcaccgccgcauc

SEQ ID NO: 3691909 - RNA, 20 nt, Salmonella enterica enterica serovar Typhi Ty2
gcaccgcuaaaaaacaggcg

SEQ ID NO: 3691910 - RNA, 17 nt, Salmonella enterica enterica serovar Typhi Ty2
gcaccggaaccggcauc

SEQ ID NO: 3691911 - RNA, 19 nt, Salmonella enterica enterica serovar Typhi Ty2
gcaccguaucggcagucac

SEQ ID NO: 3691912 - RNA, 18 nt, Salmonella enterica enterica serovar Typhi Ty2
gcaccucaauaugaaauu

SEQ ID NO: 3691913 - RNA, 21 nt, Salmonella enterica enterica serovar Typhi Ty2
gcaccucaauaugaaauucuu

SEQ ID NO: 3691914 - RNA, 14 nt, Salmonella enterica enterica serovar Typhi Ty2
gcaccuccagcgcc

SEQ ID NO: 3691915 - RNA, 16 nt, Salmonella enterica enterica serovar Typhi Ty2
gcaccucgcaauauuc

SEQ ID NO: 3691916 - RNA, 16 nt, Salmonella enterica enterica serovar Typhi Ty2
gcaccucuuuaugcgg

SEQ ID NO: 3691917 - RNA, 12 nt, Salmonella enterica enterica serovar Typhi Ty2
gcaccuggaagu

SEQ ID NO: 3691918 - RNA, 17 nt, Salmonella enterica enterica serovar Typhi Ty2
gcaccuggguauuccac

SEQ ID NO: 3691919 - RNA, 20 nt, Salmonella enterica enterica serovar Typhi Ty2
gcaccuguuucugcuggccu

SEQ ID NO: 3691920 - RNA, 21 nt, Salmonella enterica enterica serovar Typhi Ty2
gcaccuuaaccgucugcucag

SEQ ID NO: 3691921 - RNA, 14 nt, Salmonella enterica enterica serovar Typhi Ty2
gcaccuuauccggc

SEQ ID NO: 3691922 - RNA, 15 nt, Salmonella enterica enterica serovar Typhi Ty2
gcaccuucaacagcu

SEQ ID NO: 3691923 - RNA, 20 nt, Salmonella enterica enterica serovar Typhi Ty2
gcaccuucaacagcucgcca

SEQ ID NO: 3691924 - RNA, 13 nt, Salmonella enterica enterica serovar Typhi Ty2
gcacgaaaaauaa

SEQ ID NO: 3691925 - RNA, 14 nt, Salmonella enterica enterica serovar Typhi Ty2
gcacgaaaaauaaa

SEQ ID NO: 3691926 - RNA, 15 nt, Salmonella enterica enterica serovar Typhi Ty2
gcacgaaaaauaaaa

SEQ ID NO: 3691927 - RNA, 18 nt, Salmonella enterica enterica serovar Typhi Ty2
gcacgaacauaccggagc

SEQ ID NO: 3691928 - RNA, 16 nt, Salmonella enterica enterica serovar Typhi Ty2
gcacgacacaaaagca

SEQ ID NO: 3691929 - RNA, 17 nt, Salmonella enterica enterica serovar Typhi Ty2
gcacgacagagaucagg

SEQ ID NO: 3691930 - RNA, 16 nt, Salmonella enterica enterica serovar Typhi Ty2
gcacgacagugcuaua

SEQ ID NO: 3691931 - RNA, 16 nt, Salmonella enterica enterica serovar Typhi Ty2
gcacgacguagcccau

SEQ ID NO: 3691932 - RNA, 18 nt, Salmonella enterica enterica serovar Typhi Ty2
gcacgauauccagcaccu

SEQ ID NO: 3691933 - RNA, 21 nt, Salmonella enterica enterica serovar Typhi Ty2
gcacgaugcauaugcacagcg

SEQ ID NO: 3691934 - RNA, 15 nt, Salmonella enterica enterica serovar Typhi Ty2
gcacgccaucgccug

SEQ ID NO: 3691935 - RNA, 15 nt, Salmonella enterica enterica serovar Typhi Ty2
gcacgccggccccgc

SEQ ID NO: 3691936 - RNA, 16 nt, Salmonella enterica enterica serovar Typhi Ty2
gcacgccugcauaaag

SEQ ID NO: 3691937 - RNA, 22 nt, Salmonella enterica enterica serovar Typhi Ty2
gcacgcgacgcgccagccagcg

SEQ ID NO: 3691938 - RNA, 16 nt, Salmonella enterica enterica serovar Typhi Ty2
gcacgcgauuugcagc

SEQ ID NO: 3691939 - RNA, 19 nt, Salmonella enterica enterica serovar Typhi Ty2
gcacgcgccgaaugcguuu

SEQ ID NO: 3691940 - RNA, 20 nt, Salmonella enterica enterica serovar Typhi Ty2
gcacgcgccgaaugcguuuu

SEQ ID NO: 3691941 - RNA, 17 nt, Salmonella enterica enterica serovar Typhi Ty2
gcacgcgucaucggcgc

SEQ ID NO: 3691942 - RNA, 20 nt, Salmonella enterica enterica serovar Typhi Ty2
gcacgcgucaucggcgcgcu

SEQ ID NO: 3691943 - RNA, 22 nt, Salmonella enterica enterica serovar Typhi Ty2
gcacgcuaaagcgcuggcggcg

SEQ ID NO: 3691944 - RNA, 22 nt, Salmonella enterica enterica serovar Typhi Ty2
gcacgcuauauuccagccagga

SEQ ID NO: 3691945 - RNA, 12 nt, Salmonella enterica enterica serovar Typhi Ty2
gcacgcugcgca

SEQ ID NO: 3691946 - RNA, 15 nt, Salmonella enterica enterica serovar Typhi Ty2
gcacgcuggcaucaa

SEQ ID NO: 3691947 - RNA, 17 nt, Salmonella enterica enterica serovar Typhi Ty2
gcacgcuuuauccgguc

SEQ ID NO: 3691948 - RNA, 21 nt, Salmonella enterica enterica serovar Typhi Ty2
gcacgcuuuuuugcuggcugg

SEQ ID NO: 3691949 - RNA, 22 nt, Salmonella enterica enterica serovar Typhi Ty2
gcacgcuuuuuugcuggcuggc

SEQ ID NO: 3691950 - RNA, 17 nt, Salmonella enterica enterica serovar Typhi Ty2
gcacggcaagcgcggcg

SEQ ID NO: 3691951 - RNA, 17 nt, Salmonella enterica enterica serovar Typhi Ty2
gcacgggcaaagccgcc

SEQ ID NO: 3691952 - RNA, 22 nt, Salmonella enterica enterica serovar Typhi Ty2
gcacguagccccuaucuggugc

SEQ ID NO: 3691953 - RNA, 20 nt, Salmonella enterica enterica serovar Typhi Ty2
gcacgucauuacgguauuua

SEQ ID NO: 3691954 - RNA, 18 nt, Salmonella enterica enterica serovar Typhi Ty2
gcacguccagauacgcgc

SEQ ID NO: 3691955 - RNA, 15 nt, Salmonella enterica enterica serovar Typhi Ty2
gcacgucgcgcucgc

SEQ ID NO: 3691956 - RNA, 20 nt, Salmonella enterica enterica serovar Typhi Ty2
gcacguuaaagccgaccauc

SEQ ID NO: 3691957 - RNA, 16 nt, Salmonella enterica enterica serovar Typhi Ty2
gcacuaacagcagcag

SEQ ID NO: 3691958 - RNA, 14 nt, Salmonella enterica enterica serovar Typhi Ty2
gcacuaccaccuca

SEQ ID NO: 3691959 - RNA, 18 nt, Salmonella enterica enterica serovar Typhi Ty2
gcacuacggcaaacacaa

SEQ ID NO: 3691960 - RNA, 17 nt, Salmonella enterica enterica serovar Typhi Ty2
gcacuacggcaaacgcu

SEQ ID NO: 3691961 - RNA, 19 nt, Salmonella enterica enterica serovar Typhi Ty2
gcacuaucgggcauuucag

SEQ ID NO: 3691962 - RNA, 14 nt, Salmonella enterica enterica serovar Typhi Ty2
gcacucaccucuuc

SEQ ID NO: 3691963 - RNA, 15 nt, Salmonella enterica enterica serovar Typhi Ty2
gcacucagaaaauua

SEQ ID NO: 3691964 - RNA, 22 nt, Salmonella enterica enterica serovar Typhi Ty2
gcacucagaaaauuauuuuaaa

SEQ ID NO: 3691965 - RNA, 18 nt, Salmonella enterica enterica serovar Typhi Ty2
gcacuccccggcuugcgg

SEQ ID NO: 3691966 - RNA, 19 nt, Salmonella enterica enterica serovar Typhi Ty2
gcacucuauucaugcauua

SEQ ID NO: 3691967 - RNA, 14 nt, Salmonella enterica enterica serovar Typhi Ty2
gcacugcaccuggu

SEQ ID NO: 3691968 - RNA, 18 nt, Salmonella enterica enterica serovar Typhi Ty2
gcacugcgcuuauccggc

SEQ ID NO: 3691969 - RNA, 21 nt, Salmonella enterica enterica serovar Typhi Ty2
gcacuggcuuacucgcccugc

SEQ ID NO: 3691970 - RNA, 18 nt, Salmonella enterica enterica serovar Typhi Ty2
gcacuguaacgcacuggu

SEQ ID NO: 3691971 - RNA, 14 nt, Salmonella enterica enterica serovar Typhi Ty2
gcacuucagaacgg

SEQ ID NO: 3691972 - RNA, 14 nt, Salmonella enterica enterica serovar Typhi Ty2
gcacuucgcugaua

SEQ ID NO: 3691973 - RNA, 14 nt, Salmonella enterica enterica serovar Typhi Ty2
gcacuucucgcgca

SEQ ID NO: 3691974 - RNA, 17 nt, Salmonella enterica enterica serovar Typhi Ty2
gcacuugagaaauuauu

SEQ ID NO: 3691975 - RNA, 13 nt, Salmonella enterica enterica serovar Typhi Ty2
gcacuuuaaacca

SEQ ID NO: 3691976 - RNA, 16 nt, Salmonella enterica enterica serovar Typhi Ty2
gcacuuucagaccacu

SEQ ID NO: 3691977 - RNA, 13 nt, Salmonella enterica enterica serovar Typhi Ty2
gcacuuuuaucgg

SEQ ID NO: 3691978 - RNA, 16 nt, Salmonella enterica enterica serovar Typhi Ty2
gcacuuuugccaggcg

SEQ ID NO: 3691979 - RNA, 17 nt, Salmonella enterica enterica serovar Typhi Ty2
gcacuuuuuccuccugc

SEQ ID NO: 3691980 - RNA, 18 nt, Salmonella enterica enterica serovar Typhi Ty2
gcaggagcgcgacgacgg

SEQ ID NO: 3691981 - RNA, 20 nt, Salmonella enterica enterica serovar Typhi Ty2
gcaggagcggagagagcgcu

SEQ ID NO: 3691982 - RNA, 19 nt, Salmonella enterica enterica serovar Typhi Ty2
gcaggagggagguucgccu

SEQ ID NO: 3691983 - RNA, 20 nt, Salmonella enterica enterica serovar Typhi Ty2
gcaggauaaagaccggcaca

SEQ ID NO: 3691984 - RNA, 14 nt, Salmonella enterica enterica serovar Typhi Ty2
gcaggauccccauc

SEQ ID NO: 3691985 - RNA, 18 nt, Salmonella enterica enterica serovar Typhi Ty2
gcaggauccccaucccaa

SEQ ID NO: 3691986 - RNA, 23 nt, Salmonella enterica enterica serovar Typhi Ty2
gcaggaucuccagaucgccacga

SEQ ID NO: 3691987 - RNA, 21 nt, Salmonella enterica enterica serovar Typhi Ty2
gcaggauuuguaucacaauca

SEQ ID NO: 3691988 - RNA, 22 nt, Salmonella enterica enterica serovar Typhi Ty2
gcaggcaaaucaacauuauuaa

SEQ ID NO: 3691989 - RNA, 21 nt, Salmonella enterica enterica serovar Typhi Ty2
gcaggcacuguggugugccug

SEQ ID NO: 3691990 - RNA, 19 nt, Salmonella enterica enterica serovar Typhi Ty2
gcaggcaguuuauucagaa

SEQ ID NO: 3691991 - RNA, 18 nt, Salmonella enterica enterica serovar Typhi Ty2
gcaggcauaaaaaagagg

SEQ ID NO: 3691992 - RNA, 13 nt, Salmonella enterica enterica serovar Typhi Ty2
gcaggcauggcca

SEQ ID NO: 3691993 - RNA, 14 nt, Salmonella enterica enterica serovar Typhi Ty2
gcaggccuggcugg

SEQ ID NO: 3691994 - RNA, 18 nt, Salmonella enterica enterica serovar Typhi Ty2
gcaggccuuucggcagcg

SEQ ID NO: 3691995 - RNA, 21 nt, Salmonella enterica enterica serovar Typhi Ty2
gcaggcgaccucgcagguacg

SEQ ID NO: 3691996 - RNA, 22 nt, Salmonella enterica enterica serovar Typhi Ty2
gcaggcgauagccccaguaaau

SEQ ID NO: 3691997 - RNA, 20 nt, Salmonella enterica enterica serovar Typhi Ty2
gcaggcgcgaccucaucaaa

SEQ ID NO: 3691998 - RNA, 23 nt, Salmonella enterica enterica serovar Typhi Ty2
gcaggcggcaaaaaaugcauuga

SEQ ID NO: 3691999 - RNA, 16 nt, Salmonella enterica enterica serovar Typhi Ty2
gcaggcggcuucgcau

SEQ ID NO: 3692000 - RNA, 19 nt, Salmonella enterica enterica serovar Typhi Ty2
gcaggcgggugcgcagccc

SEQ ID NO: 3692001 - RNA, 18 nt, Salmonella enterica enterica serovar Typhi Ty2
gcaggcgucaaaacaggu

SEQ ID NO: 3692002 - RNA, 22 nt, Salmonella enterica enterica serovar Typhi Ty2
gcaggcgucaaaacaggucugu

SEQ ID NO: 3692003 - RNA, 22 nt, Salmonella enterica enterica serovar Typhi Ty2
gcaggcgucauagccgcgcguc

SEQ ID NO: 3692004 - RNA, 13 nt, Salmonella enterica enterica serovar Typhi Ty2
gcaggcguuucaa

SEQ ID NO: 3692005 - RNA, 17 nt, Salmonella enterica enterica serovar Typhi Ty2
gcaggcucaccagccca

SEQ ID NO: 3692006 - RNA, 23 nt, Salmonella enterica enterica serovar Typhi Ty2
gcaggcucccuuauacaggcgca

SEQ ID NO: 3692007 - RNA, 17 nt, Salmonella enterica enterica serovar Typhi Ty2
gcaggcuggagagcaac

SEQ ID NO: 3692008 - RNA, 16 nt, Salmonella enterica enterica serovar Typhi Ty2
gcaggcuggcgguaac

SEQ ID NO: 3692009 - RNA, 22 nt, Salmonella enterica enterica serovar Typhi Ty2
gcaggcuuccacgcacgccggc

SEQ ID NO: 3692010 - RNA, 24 nt, Salmonella enterica enterica serovar Typhi Ty2
gcaggcuugcccauucgccgacgc

SEQ ID NO: 3692011 - RNA, 16 nt, Salmonella enterica enterica serovar Typhi Ty2
gcaggcuuugcugcug

SEQ ID NO: 3692012 - RNA, 18 nt, Salmonella enterica enterica serovar Typhi Ty2
gcagggacgcugcugacg

SEQ ID NO: 3692013 - RNA, 17 nt, Salmonella enterica enterica serovar Typhi Ty2
gcagggacuuauuaaaa

SEQ ID NO: 3692014 - RNA, 21 nt, Salmonella enterica enterica serovar Typhi Ty2
gcagggaucauguugagcuua

SEQ ID NO: 3692015 - RNA, 14 nt, Salmonella enterica enterica serovar Typhi Ty2
gcagggauccugua

SEQ ID NO: 3692016 - RNA, 15 nt, Salmonella enterica enterica serovar Typhi Ty2
gcaggggcuccugcg

SEQ ID NO: 3692017 - RNA, 19 nt, Salmonella enterica enterica serovar Typhi Ty2
gcagggucaggaacugcgg

SEQ ID NO: 3692018 - RNA, 21 nt, Salmonella enterica enterica serovar Typhi Ty2
gcagguaacgacuacuuccag

SEQ ID NO: 3692019 - RNA, 22 nt, Salmonella enterica enterica serovar Typhi Ty2
gcagguaguaaccccaguagcc

SEQ ID NO: 3692020 - RNA, 18 nt, Salmonella enterica enterica serovar Typhi Ty2
gcagguagucauauucac

SEQ ID NO: 3692021 - RNA, 17 nt, Salmonella enterica enterica serovar Typhi Ty2
gcagguaucguauccgg

SEQ ID NO: 3692022 - RNA, 19 nt, Salmonella enterica enterica serovar Typhi Ty2
gcagguaucguauccgguc

SEQ ID NO: 3692023 - RNA, 17 nt, Salmonella enterica enterica serovar Typhi Ty2
gcaggucaaagacgaaa

SEQ ID NO: 3692024 - RNA, 14 nt, Salmonella enterica enterica serovar Typhi Ty2
gcaggucggcccga

SEQ ID NO: 3692025 - RNA, 19 nt, Salmonella enterica enterica serovar Typhi Ty2
gcaggugauggcggcuugg

SEQ ID NO: 3692026 - RNA, 15 nt, Salmonella enterica enterica serovar Typhi Ty2
gcaggugcggcuggg

SEQ ID NO: 3692027 - RNA, 16 nt, Salmonella enterica enterica serovar Typhi Ty2
gcagguggaucugaau

SEQ ID NO: 3692028 - RNA, 12 nt, Salmonella enterica enterica serovar Typhi Ty2
gcagguggccca

SEQ ID NO: 3692029 - RNA, 16 nt, Salmonella enterica enterica serovar Typhi Ty2
gcaggugguacaucaa

SEQ ID NO: 3692030 - RNA, 20 nt, Salmonella enterica enterica serovar Typhi Ty2
gcagguuacucacugccgcc

SEQ ID NO: 3692031 - RNA, 22 nt, Salmonella enterica enterica serovar Typhi Ty2
gcagguuacucuuccaccaucc

SEQ ID NO: 3692032 - RNA, 18 nt, Salmonella enterica enterica serovar Typhi Ty2
gcagguugagucugcucg

SEQ ID NO: 3692033 - RNA, 20 nt, Salmonella enterica enterica serovar Typhi Ty2
gcagguuuuacuucuucagg

SEQ ID NO: 3692034 - RNA, 22 nt, Salmonella enterica enterica serovar Typhi Ty2
gcaguaaacuccucuuccgaca

SEQ ID NO: 3692035 - RNA, 22 nt, Salmonella enterica enterica serovar Typhi Ty2
gcaguaacgcacuuuuccagcc

SEQ ID NO: 3692036 - RNA, 14 nt, Salmonella enterica enterica serovar Typhi Ty2
gcaguaacgcauac

SEQ ID NO: 3692037 - RNA, 17 nt, Salmonella enterica enterica serovar Typhi Ty2
gcaguacacgcaucggg

SEQ ID NO: 3692038 - RNA, 19 nt, Salmonella enterica enterica serovar Typhi Ty2
gcaguagauucuaucuguu

SEQ ID NO: 3692039 - RNA, 21 nt, Salmonella enterica enterica serovar Typhi Ty2
gcaguagccacgguaacagcu

SEQ ID NO: 3692040 - RNA, 13 nt, Salmonella enterica enterica serovar Typhi Ty2
gcaguagccaugc

SEQ ID NO: 3692041 - RNA, 22 nt, Salmonella enterica enterica serovar Typhi Ty2
gcaguagcgcuuugacaucggg

SEQ ID NO: 3692042 - RNA, 22 nt, Salmonella enterica enterica serovar Typhi Ty2
gcaguauccgugccgagguggu

SEQ ID NO: 3692043 - RNA, 18 nt, Salmonella enterica enterica serovar Typhi Ty2
gcaguaugaccccuccgg

SEQ ID NO: 3692044 - RNA, 20 nt, Salmonella enterica enterica serovar Typhi Ty2
gcaguauugcaccaggaaga

SEQ ID NO: 3692045 - RNA, 15 nt, Salmonella enterica enterica serovar Typhi Ty2
gcaguauuucagaac

SEQ ID NO: 3692046 - RNA, 22 nt, Salmonella enterica enterica serovar Typhi Ty2
gcagucaaaacgacauaaccgg

SEQ ID NO: 3692047 - RNA, 21 nt, Salmonella enterica enterica serovar Typhi Ty2
gcagucagccuugaccgccug

SEQ ID NO: 3692048 - RNA, 15 nt, Salmonella enterica enterica serovar Typhi Ty2
gcagucccaaugcgg

SEQ ID NO: 3692049 - RNA, 17 nt, Salmonella enterica enterica serovar Typhi Ty2
gcaguccuugcagccag

SEQ ID NO: 3692050 - RNA, 17 nt, Salmonella enterica enterica serovar Typhi Ty2
gcagucgcaucauggcg

SEQ ID NO: 3692051 - RNA, 17 nt, Salmonella enterica enterica serovar Typhi Ty2
gcagucgcuacaaccag

SEQ ID NO: 3692052 - RNA, 16 nt, Salmonella enterica enterica serovar Typhi Ty2
gcagucguuucuauua

SEQ ID NO: 3692053 - RNA, 15 nt, Salmonella enterica enterica serovar Typhi Ty2
gcagucuggcggcag

SEQ ID NO: 3692054 - RNA, 17 nt, Salmonella enterica enterica serovar Typhi Ty2
gcagucuggcggcagcc

SEQ ID NO: 3692055 - RNA, 15 nt, Salmonella enterica enterica serovar Typhi Ty2
gcagugacagaggaa

SEQ ID NO: 3692056 - RNA, 16 nt, Salmonella enterica enterica serovar Typhi Ty2
gcagugacauuuaucu

SEQ ID NO: 3692057 - RNA, 23 nt, Salmonella enterica enterica serovar Typhi Ty2
gcagugacauuuaucuuccggca

SEQ ID NO: 3692058 - RNA, 16 nt, Salmonella enterica enterica serovar Typhi Ty2
gcagugaccagcauca

SEQ ID NO: 3692059 - RNA, 19 nt, Salmonella enterica enterica serovar Typhi Ty2
gcagugaggauaaggcaag

SEQ ID NO: 3692060 - RNA, 22 nt, Salmonella enterica enterica serovar Typhi Ty2
gcagugcaguauugcaccagga

SEQ ID NO: 3692061 - RNA, 14 nt, Salmonella enterica enterica serovar Typhi Ty2
gcaucauccccacc

SEQ ID NO: 3692062 - RNA, 21 nt, Salmonella enterica enterica serovar Typhi Ty2
gcaucauccccaccgcugaug

SEQ ID NO: 3692063 - RNA, 21 nt, Salmonella enterica enterica serovar Typhi Ty2
gcaucaucgguguucacaauu

SEQ ID NO: 3692064 - RNA, 13 nt, Salmonella enterica enterica serovar Typhi Ty2
gcaucaugucccc

SEQ ID NO: 3692065 - RNA, 16 nt, Salmonella enterica enterica serovar Typhi Ty2
gcauccaccgcggagu

SEQ ID NO: 3692066 - RNA, 21 nt, Salmonella enterica enterica serovar Typhi Ty2
gcauccagcacgagcgccagc

SEQ ID NO: 3692067 - RNA, 13 nt, Salmonella enterica enterica serovar Typhi Ty2
gcauccagcucau

SEQ ID NO: 3692068 - RNA, 19 nt, Salmonella enterica enterica serovar Typhi Ty2
gcauccauauaagcgguau

SEQ ID NO: 3692069 - RNA, 14 nt, Salmonella enterica enterica serovar Typhi Ty2
gcauccccugcagg

SEQ ID NO: 3692070 - RNA, 15 nt, Salmonella enterica enterica serovar Typhi Ty2
gcaucccgcaggcgg

SEQ ID NO: 3692071 - RNA, 16 nt, Salmonella enterica enterica serovar Typhi Ty2
gcaucccggucaacgu

SEQ ID NO: 3692072 - RNA, 21 nt, Salmonella enterica enterica serovar Typhi Ty2
gcaucccggugucaaagcgcc

SEQ ID NO: 3692073 - RNA, 23 nt, Salmonella enterica enterica serovar Typhi Ty2
gcaucccggugucaaagcgccag

SEQ ID NO: 3692074 - RNA, 17 nt, Salmonella enterica enterica serovar Typhi Ty2
gcaucccgucccaccac

SEQ ID NO: 3692075 - RNA, 18 nt, Salmonella enterica enterica serovar Typhi Ty2
gcauccgcaagacacgcu

SEQ ID NO: 3692076 - RNA, 16 nt, Salmonella enterica enterica serovar Typhi Ty2
gcauccgccgccgcaa

SEQ ID NO: 3692077 - RNA, 16 nt, Salmonella enterica enterica serovar Typhi Ty2
gcauccggaaucgccg

SEQ ID NO: 3692078 - RNA, 14 nt, Salmonella enterica enterica serovar Typhi Ty2
gcauccggcaucaa

SEQ ID NO: 3692079 - RNA, 17 nt, Salmonella enterica enterica serovar Typhi Ty2
gcauccggccagcgacu

SEQ ID NO: 3692080 - RNA, 15 nt, Salmonella enterica enterica serovar Typhi Ty2
gcauccgugaccugc

SEQ ID NO: 3692081 - RNA, 18 nt, Salmonella enterica enterica serovar Typhi Ty2
gcauccgugaccugcuga

SEQ ID NO: 3692082 - RNA, 18 nt, Salmonella enterica enterica serovar Typhi Ty2
gcauccuccauccaggua

SEQ ID NO: 3692083 - RNA, 23 nt, Salmonella enterica enterica serovar Typhi Ty2
gcauccugacuauugcugagcug

SEQ ID NO: 3692084 - RNA, 20 nt, Salmonella enterica enterica serovar Typhi Ty2
gcauccugcggguucaucgc

SEQ ID NO: 3692085 - RNA, 23 nt, Salmonella enterica enterica serovar Typhi Ty2
gcauccuuaugggucacauccag

SEQ ID NO: 3692086 - RNA, 20 nt, Salmonella enterica enterica serovar Typhi Ty2
gcaucgacauccgauuucau

SEQ ID NO: 3692087 - RNA, 20 nt, Salmonella enterica enterica serovar Typhi Ty2
gcaucgauuccccaccagga

SEQ ID NO: 3692088 - RNA, 15 nt, Salmonella enterica enterica serovar Typhi Ty2
gcaucgauuccgccu

SEQ ID NO: 3692089 - RNA, 23 nt, Salmonella enterica enterica serovar Typhi Ty2
gcaucgauuuuucaucuucagua

SEQ ID NO: 3692090 - RNA, 12 nt, Salmonella enterica enterica serovar Typhi Ty2
gcaucgccgcaa

SEQ ID NO: 3692091 - RNA, 19 nt, Salmonella enterica enterica serovar Typhi Ty2
gcaucgccgcaagcggcaa

SEQ ID NO: 3692092 - RNA, 15 nt, Salmonella enterica enterica serovar Typhi Ty2
gcaucgccgcccagu

SEQ ID NO: 3692093 - RNA, 21 nt, Salmonella enterica enterica serovar Typhi Ty2
gcaucgcugcgcuuacacacc

SEQ ID NO: 3692094 - RNA, 15 nt, Salmonella enterica enterica serovar Typhi Ty2
gcaucggcagcgcca

SEQ ID NO: 3692095 - RNA, 18 nt, Salmonella enterica enterica serovar Typhi Ty2
gcaucgggccguccggca

SEQ ID NO: 3692096 - RNA, 22 nt, Salmonella enterica enterica serovar Typhi Ty2
gcaucgguagaaugaauguagc

SEQ ID NO: 3692097 - RNA, 17 nt, Salmonella enterica enterica serovar Typhi Ty2
gcaucguaagccgcauu

SEQ ID NO: 3692098 - RNA, 14 nt, Salmonella enterica enterica serovar Typhi Ty2
gcaucgugagcgcg

SEQ ID NO: 3692099 - RNA, 15 nt, Salmonella enterica enterica serovar Typhi Ty2
gcaucgugagcgcgu

SEQ ID NO: 3692100 - RNA, 22 nt, Salmonella enterica enterica serovar Typhi Ty2
gcaucgugguuaauacaucaac

SEQ ID NO: 3692101 - RNA, 22 nt, Salmonella enterica enterica serovar Typhi Ty2
gcaucguuaucauuaucgccaa

SEQ ID NO: 3692102 - RNA, 22 nt, Salmonella enterica enterica serovar Typhi Ty2
gcaucguuugcaguuccgcaau

SEQ ID NO: 3692103 - RNA, 22 nt, Salmonella enterica enterica serovar Typhi Ty2
gcaucuacccguacauuauugc

SEQ ID NO: 3692104 - RNA, 18 nt, Salmonella enterica enterica serovar Typhi Ty2
gcaucuaccgcauacuga

SEQ ID NO: 3692105 - RNA, 14 nt, Salmonella enterica enterica serovar Typhi Ty2
gcaucuccagcgca

SEQ ID NO: 3692106 - RNA, 21 nt, Salmonella enterica enterica serovar Typhi Ty2
gcaucuccucgcacuggcgag

SEQ ID NO: 3692107 - RNA, 20 nt, Salmonella enterica enterica serovar Typhi Ty2
gcaucucgccauaauuguuc

SEQ ID NO: 3692108 - RNA, 21 nt, Salmonella enterica enterica serovar Typhi Ty2
gcaucugaucuacaaucgucu

SEQ ID NO: 3692109 - RNA, 17 nt, Salmonella enterica enterica serovar Typhi Ty2
gcaucuuuaaccgccug

SEQ ID NO: 3692110 - RNA, 15 nt, Salmonella enterica enterica serovar Typhi Ty2
gcaucuuuccggaac

SEQ ID NO: 3692111 - RNA, 13 nt, Salmonella enterica enterica serovar Typhi Ty2
gcaucuuuguucu

SEQ ID NO: 3692112 - RNA, 14 nt, Salmonella enterica enterica serovar Typhi Ty2
gcaucuuuguucug

SEQ ID NO: 3692113 - RNA, 17 nt, Salmonella enterica enterica serovar Typhi Ty2
gcaugaagaaaauacug

SEQ ID NO: 3692114 - RNA, 18 nt, Salmonella enterica enterica serovar Typhi Ty2
gcaugaauaaccucccgc

SEQ ID NO: 3692115 - RNA, 20 nt, Salmonella enterica enterica serovar Typhi Ty2
gcaugaauaauuucuucuuu

SEQ ID NO: 3692116 - RNA, 13 nt, Salmonella enterica enterica serovar Typhi Ty2
gcaugaauaucaa

SEQ ID NO: 3692117 - RNA, 14 nt, Salmonella enterica enterica serovar Typhi Ty2
gcaugaccauccac

SEQ ID NO: 3692118 - RNA, 14 nt, Salmonella enterica enterica serovar Typhi Ty2
gcaugagcacgcgg

SEQ ID NO: 3692119 - RNA, 14 nt, Salmonella enterica enterica serovar Typhi Ty2
gcaugagccagccc

SEQ ID NO: 3692120 - RNA, 16 nt, Salmonella enterica enterica serovar Typhi Ty2
gcaugagccagcccuc

SEQ ID NO: 3692121 - RNA, 21 nt, Salmonella enterica enterica serovar Typhi Ty2
gcaugauaccgauagcgcgga

SEQ ID NO: 3692122 - RNA, 23 nt, Salmonella enterica enterica serovar Typhi Ty2
gcaugauccaccaucggcgcgua

SEQ ID NO: 3692123 - RNA, 14 nt, Salmonella enterica enterica serovar Typhi Ty2
gcaugaugccacga

SEQ ID NO: 3692124 - RNA, 22 nt, Salmonella enterica enterica serovar Typhi Ty2
gcaugaugggcgcacagcgcca

SEQ ID NO: 3692125 - RNA, 18 nt, Salmonella enterica enterica serovar Typhi Ty2
gcaugauguccagcgcgc

SEQ ID NO: 3692126 - RNA, 22 nt, Salmonella enterica enterica serovar Typhi Ty2
gcaugcgccccguuuccgcgac

SEQ ID NO: 3692127 - RNA, 12 nt, Salmonella enterica enterica serovar Typhi Ty2
gcaugcgcugga

SEQ ID NO: 3692128 - RNA, 15 nt, Salmonella enterica enterica serovar Typhi Ty2
gcauggagcaucagc

SEQ ID NO: 3692129 - RNA, 20 nt, Salmonella enterica enterica serovar Typhi Ty2
gcauggaugcaugagcacgc

SEQ ID NO: 3692130 - RNA, 23 nt, Salmonella enterica enterica serovar Typhi Ty2
gcauggcagauaaaccacgccgu

SEQ ID NO: 3692131 - RNA, 17 nt, Salmonella enterica enterica serovar Typhi Ty2
gcauggcggucagcuuu

SEQ ID NO: 3692132 - RNA, 20 nt, Salmonella enterica enterica serovar Typhi Ty2
gcauggcgucguaccguuaa

SEQ ID NO: 3692133 - RNA, 14 nt, Salmonella enterica enterica serovar Typhi Ty2
gcaugggaaauaac

SEQ ID NO: 3692134 - RNA, 21 nt, Salmonella enterica enterica serovar Typhi Ty2
gcaugggauacgccagcagac

SEQ ID NO: 3692135 - RNA, 14 nt, Salmonella enterica enterica serovar Typhi Ty2
gcauggggagaccc

SEQ ID NO: 3692136 - RNA, 17 nt, Salmonella enterica enterica serovar Typhi Ty2
gcauggguaaagcccau

SEQ ID NO: 3692137 - RNA, 19 nt, Salmonella enterica enterica serovar Typhi Ty2
gcauggguauaagcgugca

SEQ ID NO: 3692138 - RNA, 18 nt, Salmonella enterica enterica serovar Typhi Ty2
gcauggucagcauaauau

SEQ ID NO: 3692139 - RNA, 14 nt, Salmonella enterica enterica serovar Typhi Ty2
gcaugguccggugc

SEQ ID NO: 3692140 - RNA, 23 nt, Salmonella enterica enterica serovar Typhi Ty2
gcauggugacuccccacaauccc

SEQ ID NO: 3692141 - RNA, 18 nt, Salmonella enterica enterica serovar Typhi Ty2
gcaugguguucagauggc

SEQ ID NO: 3692142 - RNA, 16 nt, Salmonella enterica enterica serovar Typhi Ty2
gcauguaccauuguca

SEQ ID NO: 3692143 - RNA, 19 nt, Salmonella enterica enterica serovar Typhi Ty2
gccaaugaacucgccucgc

SEQ ID NO: 3692144 - RNA, 18 nt, Salmonella enterica enterica serovar Typhi Ty2
gccaaugccggacgccac

SEQ ID NO: 3692145 - RNA, 19 nt, Salmonella enterica enterica serovar Typhi Ty2
gccaaugccggacgccacc

SEQ ID NO: 3692146 - RNA, 20 nt, Salmonella enterica enterica serovar Typhi Ty2
gccaaugcgaaaauacuccc

SEQ ID NO: 3692147 - RNA, 19 nt, Salmonella enterica enterica serovar Typhi Ty2
gccaauguacguaaaacca

SEQ ID NO: 3692148 - RNA, 21 nt, Salmonella enterica enterica serovar Typhi Ty2
gccaauguacguaaaaccagc

SEQ ID NO: 3692149 - RNA, 15 nt, Salmonella enterica enterica serovar Typhi Ty2
gccaauuccgccaua

SEQ ID NO: 3692150 - RNA, 14 nt, Salmonella enterica enterica serovar Typhi Ty2
gccacaacagaagc

SEQ ID NO: 3692151 - RNA, 18 nt, Salmonella enterica enterica serovar Typhi Ty2
gccacaacagaagcggcc

SEQ ID NO: 3692152 - RNA, 21 nt, Salmonella enterica enterica serovar Typhi Ty2
gccacaaccgcccccaacuga

SEQ ID NO: 3692153 - RNA, 23 nt, Salmonella enterica enterica serovar Typhi Ty2
gccacaacggcaauuuuuacaaa

SEQ ID NO: 3692154 - RNA, 15 nt, Salmonella enterica enterica serovar Typhi Ty2
gccacaacguugacc

SEQ ID NO: 3692155 - RNA, 13 nt, Salmonella enterica enterica serovar Typhi Ty2
gccacaauauccg

SEQ ID NO: 3692156 - RNA, 14 nt, Salmonella enterica enterica serovar Typhi Ty2
gccacaauugccag

SEQ ID NO: 3692157 - RNA, 18 nt, Salmonella enterica enterica serovar Typhi Ty2
gccacaccacaugcgagc

SEQ ID NO: 3692158 - RNA, 14 nt, Salmonella enterica enterica serovar Typhi Ty2
gccacacccauagc

SEQ ID NO: 3692159 - RNA, 12 nt, Salmonella enterica enterica serovar Typhi Ty2
gccacagcaaau

SEQ ID NO: 3692160 - RNA, 18 nt, Salmonella enterica enterica serovar Typhi Ty2
gccacagccauccgacgc

SEQ ID NO: 3692161 - RNA, 12 nt, Salmonella enterica enterica serovar Typhi Ty2
gccacagccgca

SEQ ID NO: 3692162 - RNA, 15 nt, Salmonella enterica enterica serovar Typhi Ty2
gccacagcgccagac

SEQ ID NO: 3692163 - RNA, 20 nt, Salmonella enterica enterica serovar Typhi Ty2
gccacagcgguauaucugua

SEQ ID NO: 3692164 - RNA, 18 nt, Salmonella enterica enterica serovar Typhi Ty2
gccacaggcggcaugggu

SEQ ID NO: 3692165 - RNA, 13 nt, Salmonella enterica enterica serovar Typhi Ty2
gccacaucgccag

SEQ ID NO: 3692166 - RNA, 13 nt, Salmonella enterica enterica serovar Typhi Ty2
gccacaucguuac

SEQ ID NO: 3692167 - RNA, 16 nt, Salmonella enterica enterica serovar Typhi Ty2
gccacaugcggcaggc

SEQ ID NO: 3692168 - RNA, 19 nt, Salmonella enterica enterica serovar Typhi Ty2
gccacauuguaugcaagaa

SEQ ID NO: 3692169 - RNA, 12 nt, Salmonella enterica enterica serovar Typhi Ty2
gccaccaaaaac

SEQ ID NO: 3692170 - RNA, 23 nt, Salmonella enterica enterica serovar Typhi Ty2
gccaccaaaaacgcccccagaua

SEQ ID NO: 3692171 - RNA, 19 nt, Salmonella enterica enterica serovar Typhi Ty2
gccaccacaaacgccguca

SEQ ID NO: 3692172 - RNA, 13 nt, Salmonella enterica enterica serovar Typhi Ty2
gccaccacaaagc

SEQ ID NO: 3692173 - RNA, 14 nt, Salmonella enterica enterica serovar Typhi Ty2
gccaccacaaagcg

SEQ ID NO: 3692174 - RNA, 15 nt, Salmonella enterica enterica serovar Typhi Ty2
gccaccacauaccgu

SEQ ID NO: 3692175 - RNA, 22 nt, Salmonella enterica enterica serovar Typhi Ty2
gccaccacucggcgagcaguac

SEQ ID NO: 3692176 - RNA, 16 nt, Salmonella enterica enterica serovar Typhi Ty2
gccaccagaucuucaa

SEQ ID NO: 3692177 - RNA, 15 nt, Salmonella enterica enterica serovar Typhi Ty2
gccaccagcacagcc

SEQ ID NO: 3692178 - RNA, 18 nt, Salmonella enterica enterica serovar Typhi Ty2
gccaccagcacagcccag

SEQ ID NO: 3692179 - RNA, 13 nt, Salmonella enterica enterica serovar Typhi Ty2
gccaccagcgcca

SEQ ID NO: 3692180 - RNA, 16 nt, Salmonella enterica enterica serovar Typhi Ty2
gccaccagcguaccgg

SEQ ID NO: 3692181 - RNA, 14 nt, Salmonella enterica enterica serovar Typhi Ty2
gccaccaucacuac

SEQ ID NO: 3692182 - RNA, 17 nt, Salmonella enterica enterica serovar Typhi Ty2
gccaccaucgucgccag

SEQ ID NO: 3692183 - RNA, 22 nt, Salmonella enterica enterica serovar Typhi Ty2
gccaccaucgucgccagaccca

SEQ ID NO: 3692184 - RNA, 18 nt, Salmonella enterica enterica serovar Typhi Ty2
gccaccaucuuuuuugcg

SEQ ID NO: 3692185 - RNA, 14 nt, Salmonella enterica enterica serovar Typhi Ty2
gccacccgacaagg

SEQ ID NO: 3692186 - RNA, 13 nt, Salmonella enterica enterica serovar Typhi Ty2
gccacccggcuuu

SEQ ID NO: 3692187 - RNA, 15 nt, Salmonella enterica enterica serovar Typhi Ty2
gccaccgccagcagu

SEQ ID NO: 3692188 - RNA, 16 nt, Salmonella enterica enterica serovar Typhi Ty2
gccaccgccgccacca

SEQ ID NO: 3692189 - RNA, 17 nt, Salmonella enterica enterica serovar Typhi Ty2
gccaccgcuauucuuca

SEQ ID NO: 3692190 - RNA, 17 nt, Salmonella enterica enterica serovar Typhi Ty2
gccaccggcacauccag

SEQ ID NO: 3692191 - RNA, 17 nt, Salmonella enterica enterica serovar Typhi Ty2
gccaccgggcaacccgg

SEQ ID NO: 3692192 - RNA, 22 nt, Salmonella enterica enterica serovar Typhi Ty2
gccaccgggcagugcaacggcu

SEQ ID NO: 3692193 - RNA, 22 nt, Salmonella enterica enterica serovar Typhi Ty2
gccaccgguauuaaagcgcggg

SEQ ID NO: 3692194 - RNA, 22 nt, Salmonella enterica enterica serovar Typhi Ty2
gccaccugcacggcgucauuca

SEQ ID NO: 3692195 - RNA, 22 nt, Salmonella enterica enterica serovar Typhi Ty2
gccaccuuaaucgacuucaugc

SEQ ID NO: 3692196 - RNA, 20 nt, Salmonella enterica enterica serovar Typhi Ty2
gccacgagaaauccacauua

SEQ ID NO: 3692197 - RNA, 17 nt, Salmonella enterica enterica serovar Typhi Ty2
gccacgauauagucgcc

SEQ ID NO: 3692198 - RNA, 16 nt, Salmonella enterica enterica serovar Typhi Ty2
gccacgcaagcagcac

SEQ ID NO: 3692199 - RNA, 20 nt, Salmonella enterica enterica serovar Typhi Ty2
gccacgcagauaucuuccag

SEQ ID NO: 3692200 - RNA, 21 nt, Salmonella enterica enterica serovar Typhi Ty2
gccacgcagauaucuuccagc

SEQ ID NO: 3692201 - RNA, 21 nt, Salmonella enterica enterica serovar Typhi Ty2
gccacgccaucggcuaagcca

SEQ ID NO: 3692202 - RNA, 14 nt, Salmonella enterica enterica serovar Typhi Ty2
gccacgccauugcu

SEQ ID NO: 3692203 - RNA, 15 nt, Salmonella enterica enterica serovar Typhi Ty2
gccacgcccacgcug

SEQ ID NO: 3692204 - RNA, 22 nt, Salmonella enterica enterica serovar Typhi Ty2
gccacgccccuaaggcagcaag

SEQ ID NO: 3692205 - RNA, 14 nt, Salmonella enterica enterica serovar Typhi Ty2
gccacgcccgccgc

SEQ ID NO: 3692206 - RNA, 12 nt, Salmonella enterica enterica serovar Typhi Ty2
gccacgccgcca

SEQ ID NO: 3692207 - RNA, 13 nt, Salmonella enterica enterica serovar Typhi Ty2
gccacgccgccau

SEQ ID NO: 3692208 - RNA, 18 nt, Salmonella enterica enterica serovar Typhi Ty2
gccacgccgccauccggc

SEQ ID NO: 3692209 - RNA, 12 nt, Salmonella enterica enterica serovar Typhi Ty2
gccacgccgccc

SEQ ID NO: 3692210 - RNA, 16 nt, Salmonella enterica enterica serovar Typhi Ty2
gccacgccgcccgcgu

SEQ ID NO: 3692211 - RNA, 16 nt, Salmonella enterica enterica serovar Typhi Ty2
gccacgccgcuccaca

SEQ ID NO: 3692212 - RNA, 14 nt, Salmonella enterica enterica serovar Typhi Ty2
gccacgcgacgcca

SEQ ID NO: 3692213 - RNA, 22 nt, Salmonella enterica enterica serovar Typhi Ty2
gccacgcgaugcaaccccugac

SEQ ID NO: 3692214 - RNA, 14 nt, Salmonella enterica enterica serovar Typhi Ty2
gccacgcgccagcc

SEQ ID NO: 3692215 - RNA, 16 nt, Salmonella enterica enterica serovar Typhi Ty2
gccacgcgccagccgu

SEQ ID NO: 3692216 - RNA, 19 nt, Salmonella enterica enterica serovar Typhi Ty2
gccacgcucgcuggugcca

SEQ ID NO: 3692217 - RNA, 15 nt, Salmonella enterica enterica serovar Typhi Ty2
gccacggauggccuc

SEQ ID NO: 3692218 - RNA, 17 nt, Salmonella enterica enterica serovar Typhi Ty2
gccacggccagcagcca

SEQ ID NO: 3692219 - RNA, 21 nt, Salmonella enterica enterica serovar Typhi Ty2
gccacggcguguugaaauccu

SEQ ID NO: 3692220 - RNA, 24 nt, Salmonella enterica enterica serovar Typhi Ty2
gccacggcuuucacgccauuggca

SEQ ID NO: 3692221 - RNA, 16 nt, Salmonella enterica enterica serovar Typhi Ty2
gccacgguacggcuuu

SEQ ID NO: 3692222 - RNA, 19 nt, Salmonella enterica enterica serovar Typhi Ty2
gccacgguguggcccagcg

SEQ ID NO: 3692223 - RNA, 15 nt, Salmonella enterica enterica serovar Typhi Ty2
gccacgguuggccca

SEQ ID NO: 3692224 - RNA, 16 nt, Salmonella enterica enterica serovar Typhi Ty2
gccacgguuggcccag

SEQ ID NO: 3692225 - RNA, 19 nt, Salmonella enterica enterica serovar Typhi Ty2
gccagccggauacugcgcu

SEQ ID NO: 3692226 - RNA, 16 nt, Salmonella enterica enterica serovar Typhi Ty2
gccagccuaucgccau

SEQ ID NO: 3692227 - RNA, 21 nt, Salmonella enterica enterica serovar Typhi Ty2
gccagccugaacaucuuccag

SEQ ID NO: 3692228 - RNA, 15 nt, Salmonella enterica enterica serovar Typhi Ty2
gccagcgaaguaauc

SEQ ID NO: 3692229 - RNA, 22 nt, Salmonella enterica enterica serovar Typhi Ty2
gccagcgacaacgcuuccggcg

SEQ ID NO: 3692230 - RNA, 17 nt, Salmonella enterica enterica serovar Typhi Ty2
gccagcgacaucccaga

SEQ ID NO: 3692231 - RNA, 14 nt, Salmonella enterica enterica serovar Typhi Ty2
gccagcgacgcaug

SEQ ID NO: 3692232 - RNA, 14 nt, Salmonella enterica enterica serovar Typhi Ty2
gccagcgaucaggc

SEQ ID NO: 3692233 - RNA, 22 nt, Salmonella enterica enterica serovar Typhi Ty2
gccagcgauccugcggcauuag

SEQ ID NO: 3692234 - RNA, 17 nt, Salmonella enterica enterica serovar Typhi Ty2
gccagcgcaacgcgcau

SEQ ID NO: 3692235 - RNA, 14 nt, Salmonella enterica enterica serovar Typhi Ty2
gccagcgcauacuu

SEQ ID NO: 3692236 - RNA, 14 nt, Salmonella enterica enterica serovar Typhi Ty2
gccagcgcauccac

SEQ ID NO: 3692237 - RNA, 17 nt, Salmonella enterica enterica serovar Typhi Ty2
gccagcgccaccaaagc

SEQ ID NO: 3692238 - RNA, 23 nt, Salmonella enterica enterica serovar Typhi Ty2
gccagcgccaccaaagccaggcc

SEQ ID NO: 3692239 - RNA, 15 nt, Salmonella enterica enterica serovar Typhi Ty2
gccagcgccagcagc

SEQ ID NO: 3692240 - RNA, 13 nt, Salmonella enterica enterica serovar Typhi Ty2
gccagcgccgccg

SEQ ID NO: 3692241 - RNA, 16 nt, Salmonella enterica enterica serovar Typhi Ty2
gccagcgccgccgcuu

SEQ ID NO: 3692242 - RNA, 14 nt, Salmonella enterica enterica serovar Typhi Ty2
gccagcgcgggcga

SEQ ID NO: 3692243 - RNA, 19 nt, Salmonella enterica enterica serovar Typhi Ty2
gccagcgcguuuuccauuu

SEQ ID NO: 3692244 - RNA, 20 nt, Salmonella enterica enterica serovar Typhi Ty2
gccagcgcuaauugugcggg

SEQ ID NO: 3692245 - RNA, 23 nt, Salmonella enterica enterica serovar Typhi Ty2
gccagcgcuaauugugcgggggu

SEQ ID NO: 3692246 - RNA, 24 nt, Salmonella enterica enterica serovar Typhi Ty2
gccagcgcuacccgcugacgcugc

SEQ ID NO: 3692247 - RNA, 12 nt, Salmonella enterica enterica serovar Typhi Ty2
gccagcgcugag

SEQ ID NO: 3692248 - RNA, 11 nt, Salmonella enterica enterica serovar Typhi Ty2
gccagcgcugc

SEQ ID NO: 3692249 - RNA, 22 nt, Salmonella enterica enterica serovar Typhi Ty2
gccagcgcugcauuugcugccg

SEQ ID NO: 3692250 - RNA, 15 nt, Salmonella enterica enterica serovar Typhi Ty2
gccagcggcgcgaug

SEQ ID NO: 3692251 - RNA, 21 nt, Salmonella enterica enterica serovar Typhi Ty2
gccagcggcguuuuuuccugc

SEQ ID NO: 3692252 - RNA, 15 nt, Salmonella enterica enterica serovar Typhi Ty2
gccagcgggcgucga

SEQ ID NO: 3692253 - RNA, 22 nt, Salmonella enterica enterica serovar Typhi Ty2
gccagcggucgcggagaucauc

SEQ ID NO: 3692254 - RNA, 13 nt, Salmonella enterica enterica serovar Typhi Ty2
gccagcguauuuu

SEQ ID NO: 3692255 - RNA, 13 nt, Salmonella enterica enterica serovar Typhi Ty2
gccagcgucauca

SEQ ID NO: 3692256 - RNA, 17 nt, Salmonella enterica enterica serovar Typhi Ty2
gccagcgucaucagauc

SEQ ID NO: 3692257 - RNA, 20 nt, Salmonella enterica enterica serovar Typhi Ty2
gccagcgucucagcaggcgg

SEQ ID NO: 3692258 - RNA, 19 nt, Salmonella enterica enterica serovar Typhi Ty2
gccagcguggaugaacuca

SEQ ID NO: 3692259 - RNA, 16 nt, Salmonella enterica enterica serovar Typhi Ty2
gccagcuaauuuuacu

SEQ ID NO: 3692260 - RNA, 18 nt, Salmonella enterica enterica serovar Typhi Ty2
gccagcuaccgcucaggc

SEQ ID NO: 3692261 - RNA, 21 nt, Salmonella enterica enterica serovar Typhi Ty2
gccagcuaccgcucaggcgcg

SEQ ID NO: 3692262 - RNA, 15 nt, Salmonella enterica enterica serovar Typhi Ty2
gccagcucaaaugac

SEQ ID NO: 3692263 - RNA, 23 nt, Salmonella enterica enterica serovar Typhi Ty2
gccagcucaugcaagacaucuaa

SEQ ID NO: 3692264 - RNA, 20 nt, Salmonella enterica enterica serovar Typhi Ty2
gccagcucaugcgcggcggg

SEQ ID NO: 3692265 - RNA, 13 nt, Salmonella enterica enterica serovar Typhi Ty2
gccagcuccgcgc

SEQ ID NO: 3692266 - RNA, 23 nt, Salmonella enterica enterica serovar Typhi Ty2
gccagcugaaacagaauaaacgg

SEQ ID NO: 3692267 - RNA, 15 nt, Salmonella enterica enterica serovar Typhi Ty2
gccaggaaccgccga

SEQ ID NO: 3692268 - RNA, 22 nt, Salmonella enterica enterica serovar Typhi Ty2
gccaggaaccgccgaugcacaa

SEQ ID NO: 3692269 - RNA, 20 nt, Salmonella enterica enterica serovar Typhi Ty2
gccaggaaccgcggucggca

SEQ ID NO: 3692270 - RNA, 23 nt, Salmonella enterica enterica serovar Typhi Ty2
gccaggaaccgcggucggcaggc

SEQ ID NO: 3692271 - RNA, 15 nt, Salmonella enterica enterica serovar Typhi Ty2
gccaggaacgagcug

SEQ ID NO: 3692272 - RNA, 15 nt, Salmonella enterica enterica serovar Typhi Ty2
gccaggaagucagcu

SEQ ID NO: 3692273 - RNA, 19 nt, Salmonella enterica enterica serovar Typhi Ty2
gccaggaagucagcuuccu

SEQ ID NO: 3692274 - RNA, 13 nt, Salmonella enterica enterica serovar Typhi Ty2
gccaggaauaaag

SEQ ID NO: 3692275 - RNA, 17 nt, Salmonella enterica enterica serovar Typhi Ty2
gccaggaauggcuacug

SEQ ID NO: 3692276 - RNA, 21 nt, Salmonella enterica enterica serovar Typhi Ty2
gccaggacugacggaagagcu

SEQ ID NO: 3692277 - RNA, 15 nt, Salmonella enterica enterica serovar Typhi Ty2
gccaggauaauaaug

SEQ ID NO: 3692278 - RNA, 16 nt, Salmonella enterica enterica serovar Typhi Ty2
gccaggaucgccgccg

SEQ ID NO: 3692279 - RNA, 16 nt, Salmonella enterica enterica serovar Typhi Ty2
gccaggcaaucagcag

SEQ ID NO: 3692280 - RNA, 18 nt, Salmonella enterica enterica serovar Typhi Ty2
gccaggcaaucagcagcc

SEQ ID NO: 3692281 - RNA, 18 nt, Salmonella enterica enterica serovar Typhi Ty2
gccaggcacguuaaacac

SEQ ID NO: 3692282 - RNA, 14 nt, Salmonella enterica enterica serovar Typhi Ty2
gccaggcauccggc

SEQ ID NO: 3692283 - RNA, 16 nt, Salmonella enterica enterica serovar Typhi Ty2
gccaggccauugcuga

SEQ ID NO: 3692284 - RNA, 13 nt, Salmonella enterica enterica serovar Typhi Ty2
gccaggcccagcc

SEQ ID NO: 3692285 - RNA, 16 nt, Salmonella enterica enterica serovar Typhi Ty2
gccaggcccaugauca

SEQ ID NO: 3692286 - RNA, 22 nt, Salmonella enterica enterica serovar Typhi Ty2
gccaggcccgguggcgccacgc

SEQ ID NO: 3692287 - RNA, 16 nt, Salmonella enterica enterica serovar Typhi Ty2
gccaggccgcggcugu

SEQ ID NO: 3692288 - RNA, 22 nt, Salmonella enterica enterica serovar Typhi Ty2
gccaggccguugugucccugga

SEQ ID NO: 3692289 - RNA, 12 nt, Salmonella enterica enterica serovar Typhi Ty2
gccaggcgcugc

SEQ ID NO: 3692290 - RNA, 19 nt, Salmonella enterica enterica serovar Typhi Ty2
gccaggcggcaaagucuuc

SEQ ID NO: 3692291 - RNA, 20 nt, Salmonella enterica enterica serovar Typhi Ty2
gccagggaaauggcgaacag

SEQ ID NO: 3692292 - RNA, 18 nt, Salmonella enterica enterica serovar Typhi Ty2
gccagggcggaagcagau

SEQ ID NO: 3692293 - RNA, 12 nt, Salmonella enterica enterica serovar Typhi Ty2
gccagggcggca

SEQ ID NO: 3692294 - RNA, 17 nt, Salmonella enterica enterica serovar Typhi Ty2
gccaggggaugauuuuc

SEQ ID NO: 3692295 - RNA, 19 nt, Salmonella enterica enterica serovar Typhi Ty2
gccaggggaugauuuucag

SEQ ID NO: 3692296 - RNA, 18 nt, Salmonella enterica enterica serovar Typhi Ty2
gccaggucucauagcgcc

SEQ ID NO: 3692297 - RNA, 18 nt, Salmonella enterica enterica serovar Typhi Ty2
gccaggugacuuugcccu

SEQ ID NO: 3692298 - RNA, 22 nt, Salmonella enterica enterica serovar Typhi Ty2
gccagguugcgcccggcgcauc

SEQ ID NO: 3692299 - RNA, 17 nt, Salmonella enterica enterica serovar Typhi Ty2
gccagguuuucaggccg

SEQ ID NO: 3692300 - RNA, 20 nt, Salmonella enterica enterica serovar Typhi Ty2
gccaguaacucaucgccagc

SEQ ID NO: 3692301 - RNA, 22 nt, Salmonella enterica enterica serovar Typhi Ty2
gccaguaaucccggucgcgcca

SEQ ID NO: 3692302 - RNA, 18 nt, Salmonella enterica enterica serovar Typhi Ty2
gccaguacagcacgccgg

SEQ ID NO: 3692303 - RNA, 18 nt, Salmonella enterica enterica serovar Typhi Ty2
gccaguacagcagcgacg

SEQ ID NO: 3692304 - RNA, 15 nt, Salmonella enterica enterica serovar Typhi Ty2
gccaguaccgccgcc

SEQ ID NO: 3692305 - RNA, 18 nt, Salmonella enterica enterica serovar Typhi Ty2
gccaguagauggcgcuaa

SEQ ID NO: 3692306 - RNA, 17 nt, Salmonella enterica enterica serovar Typhi Ty2
gccaguagcucgccgcu

SEQ ID NO: 3692307 - RNA, 16 nt, Salmonella enterica enterica serovar Typhi Ty2
gccauccugcgugccg

SEQ ID NO: 3692308 - RNA, 22 nt, Salmonella enterica enterica serovar Typhi Ty2
gccaucgacgcgcaucacaaug

SEQ ID NO: 3692309 - RNA, 14 nt, Salmonella enterica enterica serovar Typhi Ty2
gccaucgccuccag

SEQ ID NO: 3692310 - RNA, 14 nt, Salmonella enterica enterica serovar Typhi Ty2
gccaucgccucgau

SEQ ID NO: 3692311 - RNA, 21 nt, Salmonella enterica enterica serovar Typhi Ty2
gccaucggcuaagccaaaaau

SEQ ID NO: 3692312 - RNA, 18 nt, Salmonella enterica enterica serovar Typhi Ty2
gccaucggcuuuggcaaa

SEQ ID NO: 3692313 - RNA, 20 nt, Salmonella enterica enterica serovar Typhi Ty2
gccaucguaggcgcaaaccg

SEQ ID NO: 3692314 - RNA, 14 nt, Salmonella enterica enterica serovar Typhi Ty2
gccaucguccagcc

SEQ ID NO: 3692315 - RNA, 17 nt, Salmonella enterica enterica serovar Typhi Ty2
gccaucuccaucauuuc

SEQ ID NO: 3692316 - RNA, 13 nt, Salmonella enterica enterica serovar Typhi Ty2
gccaucuccugcg

SEQ ID NO: 3692317 - RNA, 17 nt, Salmonella enterica enterica serovar Typhi Ty2
gccaucuggccuggcga

SEQ ID NO: 3692318 - RNA, 17 nt, Salmonella enterica enterica serovar Typhi Ty2
gccaucugugccagccc

SEQ ID NO: 3692319 - RNA, 16 nt, Salmonella enterica enterica serovar Typhi Ty2
gccaucuucacgcagc

SEQ ID NO: 3692320 - RNA, 18 nt, Salmonella enterica enterica serovar Typhi Ty2
gccaucuuccagcaucag

SEQ ID NO: 3692321 - RNA, 13 nt, Salmonella enterica enterica serovar Typhi Ty2
gccaucuuccuca

SEQ ID NO: 3692322 - RNA, 15 nt, Salmonella enterica enterica serovar Typhi Ty2
gccaucuuccucaca

SEQ ID NO: 3692323 - RNA, 21 nt, Salmonella enterica enterica serovar Typhi Ty2
gccaucuuucuuuucgcguuu

SEQ ID NO: 3692324 - RNA, 14 nt, Salmonella enterica enterica serovar Typhi Ty2
gccaucuuugcacc

SEQ ID NO: 3692325 - RNA, 15 nt, Salmonella enterica enterica serovar Typhi Ty2
gccaucuuuuuucac

SEQ ID NO: 3692326 - RNA, 14 nt, Salmonella enterica enterica serovar Typhi Ty2
gccaugaaaaaaac

SEQ ID NO: 3692327 - RNA, 22 nt, Salmonella enterica enterica serovar Typhi Ty2
gccaugaccauucacacuccag

SEQ ID NO: 3692328 - RNA, 20 nt, Salmonella enterica enterica serovar Typhi Ty2
gccaugagacgcguaaauca

SEQ ID NO: 3692329 - RNA, 18 nt, Salmonella enterica enterica serovar Typhi Ty2
gccaugagccuguauggg

SEQ ID NO: 3692330 - RNA, 16 nt, Salmonella enterica enterica serovar Typhi Ty2
gccaugaucgccgcca

SEQ ID NO: 3692331 - RNA, 18 nt, Salmonella enterica enterica serovar Typhi Ty2
gccaugaucgccgccauc

SEQ ID NO: 3692332 - RNA, 19 nt, Salmonella enterica enterica serovar Typhi Ty2
gccaugaugagcgccauau

SEQ ID NO: 3692333 - RNA, 12 nt, Salmonella enterica enterica serovar Typhi Ty2
gccaugauucau

SEQ ID NO: 3692334 - RNA, 21 nt, Salmonella enterica enterica serovar Typhi Ty2
gccaugauucaucccgcugug

SEQ ID NO: 3692335 - RNA, 14 nt, Salmonella enterica enterica serovar Typhi Ty2
gccaugccagcagu

SEQ ID NO: 3692336 - RNA, 18 nt, Salmonella enterica enterica serovar Typhi Ty2
gccaugccuuugacucug

SEQ ID NO: 3692337 - RNA, 14 nt, Salmonella enterica enterica serovar Typhi Ty2
gccaugcggcgcca

SEQ ID NO: 3692338 - RNA, 17 nt, Salmonella enterica enterica serovar Typhi Ty2
gccaugcuauucagcag

SEQ ID NO: 3692339 - RNA, 22 nt, Salmonella enterica enterica serovar Typhi Ty2
gccaugcucauccaacugcgcc

SEQ ID NO: 3692340 - RNA, 19 nt, Salmonella enterica enterica serovar Typhi Ty2
gccaugcuggcucuugguu

SEQ ID NO: 3692341 - RNA, 12 nt, Salmonella enterica enterica serovar Typhi Ty2
gccauggagaaa

SEQ ID NO: 3692342 - RNA, 14 nt, Salmonella enterica enterica serovar Typhi Ty2
gccauggagaaaca

SEQ ID NO: 3692343 - RNA, 13 nt, Salmonella enterica enterica serovar Typhi Ty2
gccauggcccuuu

SEQ ID NO: 3692344 - RNA, 13 nt, Salmonella enterica enterica serovar Typhi Ty2
gccauggccgcag

SEQ ID NO: 3692345 - RNA, 14 nt, Salmonella enterica enterica serovar Typhi Ty2
gccaugucuucacu

SEQ ID NO: 3692346 - RNA, 16 nt, Salmonella enterica enterica serovar Typhi Ty2
gccauguuaauaccag

SEQ ID NO: 3692347 - RNA, 19 nt, Salmonella enterica enterica serovar Typhi Ty2
gccauguugcguaaauaaa

SEQ ID NO: 3692348 - RNA, 17 nt, Salmonella enterica enterica serovar Typhi Ty2
gccauuaacgccaugac

SEQ ID NO: 3692349 - RNA, 23 nt, Salmonella enterica enterica serovar Typhi Ty2
gccauuaacgccaugacgccaag

SEQ ID NO: 3692350 - RNA, 14 nt, Salmonella enterica enterica serovar Typhi Ty2
gccauuaucaccau

SEQ ID NO: 3692351 - RNA, 16 nt, Salmonella enterica enterica serovar Typhi Ty2
gccauuaugcaggccg

SEQ ID NO: 3692352 - RNA, 15 nt, Salmonella enterica enterica serovar Typhi Ty2
gccauuauucugaau

SEQ ID NO: 3692353 - RNA, 13 nt, Salmonella enterica enterica serovar Typhi Ty2
gccauuauuuauu

SEQ ID NO: 3692354 - RNA, 13 nt, Salmonella enterica enterica serovar Typhi Ty2
gccauucaccacu

SEQ ID NO: 3692355 - RNA, 16 nt, Salmonella enterica enterica serovar Typhi Ty2
gccauucacgcugggu

SEQ ID NO: 3692356 - RNA, 23 nt, Salmonella enterica enterica serovar Typhi Ty2
gccauucauuaaaauugaacgga

SEQ ID NO: 3692357 - RNA, 13 nt, Salmonella enterica enterica serovar Typhi Ty2
gccauuccaagaa

SEQ ID NO: 3692358 - RNA, 17 nt, Salmonella enterica enterica serovar Typhi Ty2
gccauuccaagaaugaa

SEQ ID NO: 3692359 - RNA, 18 nt, Salmonella enterica enterica serovar Typhi Ty2
gccauucccagccgagcg

SEQ ID NO: 3692360 - RNA, 18 nt, Salmonella enterica enterica serovar Typhi Ty2
gccauuccccacgccauc

SEQ ID NO: 3692361 - RNA, 21 nt, Salmonella enterica enterica serovar Typhi Ty2
gccauuccccacgccaucgcg

SEQ ID NO: 3692362 - RNA, 15 nt, Salmonella enterica enterica serovar Typhi Ty2
gccauucgcuuccgc

SEQ ID NO: 3692363 - RNA, 18 nt, Salmonella enterica enterica serovar Typhi Ty2
gccauucgcuuccgccgg

SEQ ID NO: 3692364 - RNA, 23 nt, Salmonella enterica enterica serovar Typhi Ty2
gccauucucuucuaccacgcugc

SEQ ID NO: 3692365 - RNA, 13 nt, Salmonella enterica enterica serovar Typhi Ty2
gccauugaagucc

SEQ ID NO: 3692366 - RNA, 13 nt, Salmonella enterica enterica serovar Typhi Ty2
gccauugcgacga

SEQ ID NO: 3692367 - RNA, 19 nt, Salmonella enterica enterica serovar Typhi Ty2
gccauugcugucgacaaua

SEQ ID NO: 3692368 - RNA, 22 nt, Salmonella enterica enterica serovar Typhi Ty2
gccauuggcuauuuuuugcugg

SEQ ID NO: 3692369 - RNA, 19 nt, Salmonella enterica enterica serovar Typhi Ty2
gccauuguucgcgcgucca

SEQ ID NO: 3692370 - RNA, 15 nt, Salmonella enterica enterica serovar Typhi Ty2
gccauuuacgccaac

SEQ ID NO: 3692371 - RNA, 20 nt, Salmonella enterica enterica serovar Typhi Ty2
gccauuucgccuauuuucuc

SEQ ID NO: 3692372 - RNA, 14 nt, Salmonella enterica enterica serovar Typhi Ty2
gccauuugcauccg

SEQ ID NO: 3692373 - RNA, 20 nt, Salmonella enterica enterica serovar Typhi Ty2
gccauuuuaaaaauauccug

SEQ ID NO: 3692374 - RNA, 13 nt, Salmonella enterica enterica serovar Typhi Ty2
gccauuuuugcca

SEQ ID NO: 3692375 - RNA, 20 nt, Salmonella enterica enterica serovar Typhi Ty2
gcccaaauaaaagccgccgu

SEQ ID NO: 3692376 - RNA, 20 nt, Salmonella enterica enterica serovar Typhi Ty2
gcccaaauaguccagcagcc

SEQ ID NO: 3692377 - RNA, 19 nt, Salmonella enterica enterica serovar Typhi Ty2
gcccaacaucaguucagaa

SEQ ID NO: 3692378 - RNA, 15 nt, Salmonella enterica enterica serovar Typhi Ty2
gcccaaccagcccag

SEQ ID NO: 3692379 - RNA, 16 nt, Salmonella enterica enterica serovar Typhi Ty2
gcccaaccugcgcaga

SEQ ID NO: 3692380 - RNA, 14 nt, Salmonella enterica enterica serovar Typhi Ty2
gcccaacgcaauac

SEQ ID NO: 3692381 - RNA, 19 nt, Salmonella enterica enterica serovar Typhi Ty2
gcccaacggaugcgccauc

SEQ ID NO: 3692382 - RNA, 15 nt, Salmonella enterica enterica serovar Typhi Ty2
gcccaagcugacgga

SEQ ID NO: 3692383 - RNA, 14 nt, Salmonella enterica enterica serovar Typhi Ty2
gcccaauacgccag

SEQ ID NO: 3692384 - RNA, 13 nt, Salmonella enterica enterica serovar Typhi Ty2
gcccaauagcgcu

SEQ ID NO: 3692385 - RNA, 14 nt, Salmonella enterica enterica serovar Typhi Ty2
gcccaaugccccca

SEQ ID NO: 3692386 - RNA, 15 nt, Salmonella enterica enterica serovar Typhi Ty2
gcccaaugcccccau

SEQ ID NO: 3692387 - RNA, 20 nt, Salmonella enterica enterica serovar Typhi Ty2
gcccaaugcuuagucagccu

SEQ ID NO: 3692388 - RNA, 19 nt, Salmonella enterica enterica serovar Typhi Ty2
gcccaauguuuuaccggca

SEQ ID NO: 3692389 - RNA, 20 nt, Salmonella enterica enterica serovar Typhi Ty2
gcccacccagcuugcauggc

SEQ ID NO: 3692390 - RNA, 23 nt, Salmonella enterica enterica serovar Typhi Ty2
gccccgggcgaccacccgcgacc

SEQ ID NO: 3692391 - RNA, 17 nt, Salmonella enterica enterica serovar Typhi Ty2
gccccggucaacgcgcc

SEQ ID NO: 3692392 - RNA, 16 nt, Salmonella enterica enterica serovar Typhi Ty2
gccccggugagcgccg

SEQ ID NO: 3692393 - RNA, 17 nt, Salmonella enterica enterica serovar Typhi Ty2
gccccggugagcgccgc

SEQ ID NO: 3692394 - RNA, 22 nt, Salmonella enterica enterica serovar Typhi Ty2
gccccggugcuuucuccugcgg

SEQ ID NO: 3692395 - RNA, 23 nt, Salmonella enterica enterica serovar Typhi Ty2
gccccgguggcgguaccggcauu

SEQ ID NO: 3692396 - RNA, 23 nt, Salmonella enterica enterica serovar Typhi Ty2
gccccguaucauuaggcggcgga

SEQ ID NO: 3692397 - RNA, 20 nt, Salmonella enterica enterica serovar Typhi Ty2
gccccucaauuauguauuuc

SEQ ID NO: 3692398 - RNA, 12 nt, Salmonella enterica enterica serovar Typhi Ty2
gccccucccuga

SEQ ID NO: 3692399 - RNA, 23 nt, Salmonella enterica enterica serovar Typhi Ty2
gccccucgucuucgaccgccaua

SEQ ID NO: 3692400 - RNA, 16 nt, Salmonella enterica enterica serovar Typhi Ty2
gccccucuugcagcaa

SEQ ID NO: 3692401 - RNA, 19 nt, Salmonella enterica enterica serovar Typhi Ty2
gccccugaaauaacagacu

SEQ ID NO: 3692402 - RNA, 17 nt, Salmonella enterica enterica serovar Typhi Ty2
gccccugcaggcgaucc

SEQ ID NO: 3692403 - RNA, 23 nt, Salmonella enterica enterica serovar Typhi Ty2
gccccugcuggcgaaccaccagc

SEQ ID NO: 3692404 - RNA, 14 nt, Salmonella enterica enterica serovar Typhi Ty2
gccccuuccgccac

SEQ ID NO: 3692405 - RNA, 17 nt, Salmonella enterica enterica serovar Typhi Ty2
gcccgaaagcaauacug

SEQ ID NO: 3692406 - RNA, 18 nt, Salmonella enterica enterica serovar Typhi Ty2
gcccgaccacgcccagcu

SEQ ID NO: 3692407 - RNA, 22 nt, Salmonella enterica enterica serovar Typhi Ty2
gcccgaccccauuaaacuggcc

SEQ ID NO: 3692408 - RNA, 13 nt, Salmonella enterica enterica serovar Typhi Ty2
gcccgauaaacaa

SEQ ID NO: 3692409 - RNA, 19 nt, Salmonella enterica enterica serovar Typhi Ty2
gcccgauaagcaagcgcca

SEQ ID NO: 3692410 - RNA, 18 nt, Salmonella enterica enterica serovar Typhi Ty2
gcccgauacccgcccaga

SEQ ID NO: 3692411 - RNA, 17 nt, Salmonella enterica enterica serovar Typhi Ty2
gcccgaugagcuugcac

SEQ ID NO: 3692412 - RNA, 23 nt, Salmonella enterica enterica serovar Typhi Ty2
gcccgauggcgcugcguuuauca

SEQ ID NO: 3692413 - RNA, 21 nt, Salmonella enterica enterica serovar Typhi Ty2
gcccgcaaacagagcgccggc

SEQ ID NO: 3692414 - RNA, 22 nt, Salmonella enterica enterica serovar Typhi Ty2
gcccgcaaaggaccaacaccag

SEQ ID NO: 3692415 - RNA, 13 nt, Salmonella enterica enterica serovar Typhi Ty2
gcccgcagaucug

SEQ ID NO: 3692416 - RNA, 16 nt, Salmonella enterica enterica serovar Typhi Ty2
gcccgcauucgcggca

SEQ ID NO: 3692417 - RNA, 13 nt, Salmonella enterica enterica serovar Typhi Ty2
gcccgccagcacc

SEQ ID NO: 3692418 - RNA, 14 nt, Salmonella enterica enterica serovar Typhi Ty2
gcccgcccagcauu

SEQ ID NO: 3692419 - RNA, 16 nt, Salmonella enterica enterica serovar Typhi Ty2
gcccgccgcaaaaaau

SEQ ID NO: 3692420 - RNA, 18 nt, Salmonella enterica enterica serovar Typhi Ty2
gcccgccgccugaugcug

SEQ ID NO: 3692421 - RNA, 12 nt, Salmonella enterica enterica serovar Typhi Ty2
gcccgccgggcg

SEQ ID NO: 3692422 - RNA, 16 nt, Salmonella enterica enterica serovar Typhi Ty2
gcccgccugagcgcgc

SEQ ID NO: 3692423 - RNA, 17 nt, Salmonella enterica enterica serovar Typhi Ty2
gcccgccugagcgcgca

SEQ ID NO: 3692424 - RNA, 22 nt, Salmonella enterica enterica serovar Typhi Ty2
gcccgccugagcgcgcaguggg

SEQ ID NO: 3692425 - RNA, 22 nt, Salmonella enterica enterica serovar Typhi Ty2
gcccgccugcuguaaccccugc

SEQ ID NO: 3692426 - RNA, 13 nt, Salmonella enterica enterica serovar Typhi Ty2
gcccgcgcguuca

SEQ ID NO: 3692427 - RNA, 15 nt, Salmonella enterica enterica serovar Typhi Ty2
gcccgcucgcuaccu

SEQ ID NO: 3692428 - RNA, 22 nt, Salmonella enterica enterica serovar Typhi Ty2
gcccgcuucauuggcgucugcu

SEQ ID NO: 3692429 - RNA, 14 nt, Salmonella enterica enterica serovar Typhi Ty2
gcccgcuuuaccga

SEQ ID NO: 3692430 - RNA, 21 nt, Salmonella enterica enterica serovar Typhi Ty2
gcccggacaaggcgcgccagc

SEQ ID NO: 3692431 - RNA, 18 nt, Salmonella enterica enterica serovar Typhi Ty2
gcccggacgaaccuggcg

SEQ ID NO: 3692432 - RNA, 20 nt, Salmonella enterica enterica serovar Typhi Ty2
gcccggacgaaccuggcggu

SEQ ID NO: 3692433 - RNA, 19 nt, Salmonella enterica enterica serovar Typhi Ty2
gcccggacgccguccaggc

SEQ ID NO: 3692434 - RNA, 21 nt, Salmonella enterica enterica serovar Typhi Ty2
gcccggaugauuaucaucuau

SEQ ID NO: 3692435 - RNA, 13 nt, Salmonella enterica enterica serovar Typhi Ty2
gcccggcaaacgg

SEQ ID NO: 3692436 - RNA, 14 nt, Salmonella enterica enterica serovar Typhi Ty2
gcccggcaaacggg

SEQ ID NO: 3692437 - RNA, 14 nt, Salmonella enterica enterica serovar Typhi Ty2
gcccggcaaccuga

SEQ ID NO: 3692438 - RNA, 14 nt, Salmonella enterica enterica serovar Typhi Ty2
gcccggcaggcugg

SEQ ID NO: 3692439 - RNA, 15 nt, Salmonella enterica enterica serovar Typhi Ty2
gcccggcaguugcug

SEQ ID NO: 3692440 - RNA, 15 nt, Salmonella enterica enterica serovar Typhi Ty2
gcccggccuacguuu

SEQ ID NO: 3692441 - RNA, 14 nt, Salmonella enterica enterica serovar Typhi Ty2
gcccggcgccagcu

SEQ ID NO: 3692442 - RNA, 17 nt, Salmonella enterica enterica serovar Typhi Ty2
gcccggcgcgacaccuu

SEQ ID NO: 3692443 - RNA, 23 nt, Salmonella enterica enterica serovar Typhi Ty2
gcccggcgcgcguugcgucaccg

SEQ ID NO: 3692444 - RNA, 13 nt, Salmonella enterica enterica serovar Typhi Ty2
gcccggcgcggca

SEQ ID NO: 3692445 - RNA, 14 nt, Salmonella enterica enterica serovar Typhi Ty2
gcccggcggcgcga

SEQ ID NO: 3692446 - RNA, 21 nt, Salmonella enterica enterica serovar Typhi Ty2
gcccggcggcgcgaugccugc

SEQ ID NO: 3692447 - RNA, 21 nt, Salmonella enterica enterica serovar Typhi Ty2
gcccggcguucucccgggccg

SEQ ID NO: 3692448 - RNA, 15 nt, Salmonella enterica enterica serovar Typhi Ty2
gcccggcguugaaau

SEQ ID NO: 3692449 - RNA, 19 nt, Salmonella enterica enterica serovar Typhi Ty2
gcccggcuuuuugccgggc

SEQ ID NO: 3692450 - RNA, 21 nt, Salmonella enterica enterica serovar Typhi Ty2
gcccgggagaacgccgggccu

SEQ ID NO: 3692451 - RNA, 19 nt, Salmonella enterica enterica serovar Typhi Ty2
gcccgggcgauaucacgga

SEQ ID NO: 3692452 - RNA, 21 nt, Salmonella enterica enterica serovar Typhi Ty2
gcccgguaagaaugcgcguca

SEQ ID NO: 3692453 - RNA, 21 nt, Salmonella enterica enterica serovar Typhi Ty2
gcccgguaagcgcuagcgcca

SEQ ID NO: 3692454 - RNA, 17 nt, Salmonella enterica enterica serovar Typhi Ty2
gcccgguacguuaaccg

SEQ ID NO: 3692455 - RNA, 19 nt, Salmonella enterica enterica serovar Typhi Ty2
gcccgguacguuaaccgga

SEQ ID NO: 3692456 - RNA, 15 nt, Salmonella enterica enterica serovar Typhi Ty2
gcccggugauggugc

SEQ ID NO: 3692457 - RNA, 19 nt, Salmonella enterica enterica serovar Typhi Ty2
gcccggugauggugcagcc

SEQ ID NO: 3692458 - RNA, 19 nt, Salmonella enterica enterica serovar Typhi Ty2
gcccgguggcguggcgcca

SEQ ID NO: 3692459 - RNA, 14 nt, Salmonella enterica enterica serovar Typhi Ty2
gcccguaaacaggc

SEQ ID NO: 3692460 - RNA, 19 nt, Salmonella enterica enterica serovar Typhi Ty2
gcccguaaacaggcugccc

SEQ ID NO: 3692461 - RNA, 19 nt, Salmonella enterica enterica serovar Typhi Ty2
gcccguaaacgggcugccc

SEQ ID NO: 3692462 - RNA, 18 nt, Salmonella enterica enterica serovar Typhi Ty2
gcccguagauaagcgcca

SEQ ID NO: 3692463 - RNA, 15 nt, Salmonella enterica enterica serovar Typhi Ty2
gcccguaucacugau

SEQ ID NO: 3692464 - RNA, 12 nt, Salmonella enterica enterica serovar Typhi Ty2
gcccgucagggg

SEQ ID NO: 3692465 - RNA, 21 nt, Salmonella enterica enterica serovar Typhi Ty2
gcccgucaucuucuaccugga

SEQ ID NO: 3692466 - RNA, 20 nt, Salmonella enterica enterica serovar Typhi Ty2
gcccgucugggagccgcugc

SEQ ID NO: 3692467 - RNA, 18 nt, Salmonella enterica enterica serovar Typhi Ty2
gcccgugguuuuacugca

SEQ ID NO: 3692468 - RNA, 18 nt, Salmonella enterica enterica serovar Typhi Ty2
gcccuaaaaauagcacca

SEQ ID NO: 3692469 - RNA, 15 nt, Salmonella enterica enterica serovar Typhi Ty2
gcccuaacaggcgca

SEQ ID NO: 3692470 - RNA, 17 nt, Salmonella enterica enterica serovar Typhi Ty2
gcccuacgcuucucucc

SEQ ID NO: 3692471 - RNA, 17 nt, Salmonella enterica enterica serovar Typhi Ty2
gcccuauaacagcgcug

SEQ ID NO: 3692472 - RNA, 14 nt, Salmonella enterica enterica serovar Typhi Ty2
gccgaucagcacca

SEQ ID NO: 3692473 - RNA, 20 nt, Salmonella enterica enterica serovar Typhi Ty2
gccgaucagcaccacgcccg

SEQ ID NO: 3692474 - RNA, 12 nt, Salmonella enterica enterica serovar Typhi Ty2
gccgaucaggcc

SEQ ID NO: 3692475 - RNA, 13 nt, Salmonella enterica enterica serovar Typhi Ty2
gccgaucaggccg

SEQ ID NO: 3692476 - RNA, 14 nt, Salmonella enterica enterica serovar Typhi Ty2
gccgaucaucccgc

SEQ ID NO: 3692477 - RNA, 20 nt, Salmonella enterica enterica serovar Typhi Ty2
gccgaugaaagagcgcgcgc

SEQ ID NO: 3692478 - RNA, 12 nt, Salmonella enterica enterica serovar Typhi Ty2
gccgaugaccag

SEQ ID NO: 3692479 - RNA, 21 nt, Salmonella enterica enterica serovar Typhi Ty2
gccgaugagaugucaucggcu

SEQ ID NO: 3692480 - RNA, 13 nt, Salmonella enterica enterica serovar Typhi Ty2
gccgaugagcuga

SEQ ID NO: 3692481 - RNA, 21 nt, Salmonella enterica enterica serovar Typhi Ty2
gccgaugcugaauagccagcc

SEQ ID NO: 3692482 - RNA, 13 nt, Salmonella enterica enterica serovar Typhi Ty2
gccgcaaaagccg

SEQ ID NO: 3692483 - RNA, 17 nt, Salmonella enterica enterica serovar Typhi Ty2
gccgcaaacagcacgcc

SEQ ID NO: 3692484 - RNA, 14 nt, Salmonella enterica enterica serovar Typhi Ty2
gccgcaaacgccga

SEQ ID NO: 3692485 - RNA, 17 nt, Salmonella enterica enterica serovar Typhi Ty2
gccgcaaauacuuuggc

SEQ ID NO: 3692486 - RNA, 23 nt, Salmonella enterica enterica serovar Typhi Ty2
gccgcaaaugaccagaucaacau

SEQ ID NO: 3692487 - RNA, 18 nt, Salmonella enterica enterica serovar Typhi Ty2
gccgcaaccgccaauaau

SEQ ID NO: 3692488 - RNA, 20 nt, Salmonella enterica enterica serovar Typhi Ty2
gccgcaaucacuucauacga

SEQ ID NO: 3692489 - RNA, 18 nt, Salmonella enterica enterica serovar Typhi Ty2
gccgcaauuccugacugc

SEQ ID NO: 3692490 - RNA, 17 nt, Salmonella enterica enterica serovar Typhi Ty2
gccgcacaccagcgcau

SEQ ID NO: 3692491 - RNA, 15 nt, Salmonella enterica enterica serovar Typhi Ty2
gccgcacgcaccgua

SEQ ID NO: 3692492 - RNA, 16 nt, Salmonella enterica enterica serovar Typhi Ty2
gccgcacgccugcggc

SEQ ID NO: 3692493 - RNA, 16 nt, Salmonella enterica enterica serovar Typhi Ty2
gccgcacuccccagaa

SEQ ID NO: 3692494 - RNA, 19 nt, Salmonella enterica enterica serovar Typhi Ty2
gccgcagaaaauggucugc

SEQ ID NO: 3692495 - RNA, 22 nt, Salmonella enterica enterica serovar Typhi Ty2
gccgcagaaaauggucugccag

SEQ ID NO: 3692496 - RNA, 14 nt, Salmonella enterica enterica serovar Typhi Ty2
gccgcagacggaga

SEQ ID NO: 3692497 - RNA, 15 nt, Salmonella enterica enterica serovar Typhi Ty2
gccgcagcgccauaa

SEQ ID NO: 3692498 - RNA, 12 nt, Salmonella enterica enterica serovar Typhi Ty2
gccgcagcgccg

SEQ ID NO: 3692499 - RNA, 17 nt, Salmonella enterica enterica serovar Typhi Ty2
gccgcagcuccaugucu

SEQ ID NO: 3692500 - RNA, 16 nt, Salmonella enterica enterica serovar Typhi Ty2
gccgcaggacagcgac

SEQ ID NO: 3692501 - RNA, 17 nt, Salmonella enterica enterica serovar Typhi Ty2
gccgcaggacagcgaca

SEQ ID NO: 3692502 - RNA, 20 nt, Salmonella enterica enterica serovar Typhi Ty2
gccgcagugaagaauggcgc

SEQ ID NO: 3692503 - RNA, 14 nt, Salmonella enterica enterica serovar Typhi Ty2
gccgcauccccaua

SEQ ID NO: 3692504 - RNA, 13 nt, Salmonella enterica enterica serovar Typhi Ty2
gccgcauccggca

SEQ ID NO: 3692505 - RNA, 23 nt, Salmonella enterica enterica serovar Typhi Ty2
gccgcaucgauaucuuuauucgc

SEQ ID NO: 3692506 - RNA, 14 nt, Salmonella enterica enterica serovar Typhi Ty2
gccgcaucgccaua

SEQ ID NO: 3692507 - RNA, 16 nt, Salmonella enterica enterica serovar Typhi Ty2
gccgcaucggcccugu

SEQ ID NO: 3692508 - RNA, 17 nt, Salmonella enterica enterica serovar Typhi Ty2
gccgccaaagcgcccga

SEQ ID NO: 3692509 - RNA, 14 nt, Salmonella enterica enterica serovar Typhi Ty2
gccgccaacgccag

SEQ ID NO: 3692510 - RNA, 15 nt, Salmonella enterica enterica serovar Typhi Ty2
gccgccaacgccagc

SEQ ID NO: 3692511 - RNA, 16 nt, Salmonella enterica enterica serovar Typhi Ty2
gccgccaacgccagca

SEQ ID NO: 3692512 - RNA, 19 nt, Salmonella enterica enterica serovar Typhi Ty2
gccgccacauugcgcgccg

SEQ ID NO: 3692513 - RNA, 19 nt, Salmonella enterica enterica serovar Typhi Ty2
gccgccagauuauccaguc

SEQ ID NO: 3692514 - RNA, 22 nt, Salmonella enterica enterica serovar Typhi Ty2
gccgccagcauuucaaucgcgc

SEQ ID NO: 3692515 - RNA, 13 nt, Salmonella enterica enterica serovar Typhi Ty2
gccgccagccacu

SEQ ID NO: 3692516 - RNA, 13 nt, Salmonella enterica enterica serovar Typhi Ty2
gccgccaggaacg

SEQ ID NO: 3692517 - RNA, 22 nt, Salmonella enterica enterica serovar Typhi Ty2
gccgccaguaauuuuucuccca

SEQ ID NO: 3692518 - RNA, 23 nt, Salmonella enterica enterica serovar Typhi Ty2
gccgccaucaacgaccaugguuc

SEQ ID NO: 3692519 - RNA, 17 nt, Salmonella enterica enterica serovar Typhi Ty2
gccgccauccgacaacc

SEQ ID NO: 3692520 - RNA, 13 nt, Salmonella enterica enterica serovar Typhi Ty2
gccgccauccggc

SEQ ID NO: 3692521 - RNA, 17 nt, Salmonella enterica enterica serovar Typhi Ty2
gccgccauccggcaaac

SEQ ID NO: 3692522 - RNA, 16 nt, Salmonella enterica enterica serovar Typhi Ty2
gccgccauccggcaac

SEQ ID NO: 3692523 - RNA, 20 nt, Salmonella enterica enterica serovar Typhi Ty2
gccgccauccggcacaguau

SEQ ID NO: 3692524 - RNA, 16 nt, Salmonella enterica enterica serovar Typhi Ty2
gccgccauccggccug

SEQ ID NO: 3692525 - RNA, 16 nt, Salmonella enterica enterica serovar Typhi Ty2
gccgccaucuccggca

SEQ ID NO: 3692526 - RNA, 23 nt, Salmonella enterica enterica serovar Typhi Ty2
gccgccaucuuuacccugagccu

SEQ ID NO: 3692527 - RNA, 14 nt, Salmonella enterica enterica serovar Typhi Ty2
gccgccauggcgaa

SEQ ID NO: 3692528 - RNA, 15 nt, Salmonella enterica enterica serovar Typhi Ty2
gccgccauggcgaau

SEQ ID NO: 3692529 - RNA, 14 nt, Salmonella enterica enterica serovar Typhi Ty2
gccgccauuaauac

SEQ ID NO: 3692530 - RNA, 15 nt, Salmonella enterica enterica serovar Typhi Ty2
gccgccauuugcgcg

SEQ ID NO: 3692531 - RNA, 20 nt, Salmonella enterica enterica serovar Typhi Ty2
gccgccauuuuauccaggcc

SEQ ID NO: 3692532 - RNA, 23 nt, Salmonella enterica enterica serovar Typhi Ty2
gccgccauuuuauccaggccagc

SEQ ID NO: 3692533 - RNA, 14 nt, Salmonella enterica enterica serovar Typhi Ty2
gccgcccaaccagc

SEQ ID NO: 3692534 - RNA, 11 nt, Salmonella enterica enterica serovar Typhi Ty2
gccgcccaggc

SEQ ID NO: 3692535 - RNA, 16 nt, Salmonella enterica enterica serovar Typhi Ty2
gccgcccaggccaugc

SEQ ID NO: 3692536 - RNA, 22 nt, Salmonella enterica enterica serovar Typhi Ty2
gccgcccagggaaagaucaaac

SEQ ID NO: 3692537 - RNA, 20 nt, Salmonella enterica enterica serovar Typhi Ty2
gccgcccauuaauaucagcc

SEQ ID NO: 3692538 - RNA, 22 nt, Salmonella enterica enterica serovar Typhi Ty2
gccgcccauuaauaucagcccc

SEQ ID NO: 3692539 - RNA, 23 nt, Salmonella enterica enterica serovar Typhi Ty2
gccgcccauuaauaucagcccca

SEQ ID NO: 3692540 - RNA, 23 nt, Salmonella enterica enterica serovar Typhi Ty2
gccgcccgcaugguaaacgcauc

SEQ ID NO: 3692541 - RNA, 11 nt, Salmonella enterica enterica serovar Typhi Ty2
gccgcccugcg

SEQ ID NO: 3692542 - RNA, 12 nt, Salmonella enterica enterica serovar Typhi Ty2
gccgccgagcgc

SEQ ID NO: 3692543 - RNA, 18 nt, Salmonella enterica enterica serovar Typhi Ty2
gccgccgaggcuaagcca

SEQ ID NO: 3692544 - RNA, 19 nt, Salmonella enterica enterica serovar Typhi Ty2
gccgccgcaacgcgcacgg

SEQ ID NO: 3692545 - RNA, 18 nt, Salmonella enterica enterica serovar Typhi Ty2
gccgccgcaccacugcug

SEQ ID NO: 3692546 - RNA, 14 nt, Salmonella enterica enterica serovar Typhi Ty2
gccgccgcaggaca

SEQ ID NO: 3692547 - RNA, 13 nt, Salmonella enterica enterica serovar Typhi Ty2
gccgccgccagau

SEQ ID NO: 3692548 - RNA, 16 nt, Salmonella enterica enterica serovar Typhi Ty2
gccgccgcgcggaccg

SEQ ID NO: 3692549 - RNA, 13 nt, Salmonella enterica enterica serovar Typhi Ty2
gccgccggaaauu

SEQ ID NO: 3692550 - RNA, 12 nt, Salmonella enterica enterica serovar Typhi Ty2
gccgccggacca

SEQ ID NO: 3692551 - RNA, 17 nt, Salmonella enterica enterica serovar Typhi Ty2
gccgccgucaucugcgc

SEQ ID NO: 3692552 - RNA, 18 nt, Salmonella enterica enterica serovar Typhi Ty2
gccgccuccagcauacug

SEQ ID NO: 3692553 - RNA, 14 nt, Salmonella enterica enterica serovar Typhi Ty2
gccgccucccccuc

SEQ ID NO: 3692554 - RNA, 23 nt, Salmonella enterica enterica serovar Typhi Ty2
gccgccuccggggaagcgcgcgc

SEQ ID NO: 3692555 - RNA, 16 nt, Salmonella enterica enterica serovar Typhi Ty2
gccggagguuuuucug

SEQ ID NO: 3692556 - RNA, 15 nt, Salmonella enterica enterica serovar Typhi Ty2
gccggauaagacgcu

SEQ ID NO: 3692557 - RNA, 21 nt, Salmonella enterica enterica serovar Typhi Ty2
gccggauaagcauuagcgcca

SEQ ID NO: 3692558 - RNA, 14 nt, Salmonella enterica enterica serovar Typhi Ty2
gccggauaagccgg

SEQ ID NO: 3692559 - RNA, 15 nt, Salmonella enterica enterica serovar Typhi Ty2
gccggauaagcgcag

SEQ ID NO: 3692560 - RNA, 19 nt, Salmonella enterica enterica serovar Typhi Ty2
gccggauaagcguagcgca

SEQ ID NO: 3692561 - RNA, 21 nt, Salmonella enterica enterica serovar Typhi Ty2
gccggauaagcguagcgccau

SEQ ID NO: 3692562 - RNA, 16 nt, Salmonella enterica enterica serovar Typhi Ty2
gccggauaaggccacg

SEQ ID NO: 3692563 - RNA, 17 nt, Salmonella enterica enterica serovar Typhi Ty2
gccggauaaggccacgc

SEQ ID NO: 3692564 - RNA, 17 nt, Salmonella enterica enterica serovar Typhi Ty2
gccggauaaggcgcagc

SEQ ID NO: 3692565 - RNA, 17 nt, Salmonella enterica enterica serovar Typhi Ty2
gccggauagggcguaag

SEQ ID NO: 3692566 - RNA, 15 nt, Salmonella enterica enterica serovar Typhi Ty2
gccggauaucgcuau

SEQ ID NO: 3692567 - RNA, 17 nt, Salmonella enterica enterica serovar Typhi Ty2
gccggaucgggcuucca

SEQ ID NO: 3692568 - RNA, 21 nt, Salmonella enterica enterica serovar Typhi Ty2
gccggaugagcguuagcgcca

SEQ ID NO: 3692569 - RNA, 14 nt, Salmonella enterica enterica serovar Typhi Ty2
gccggaugcagucu

SEQ ID NO: 3692570 - RNA, 13 nt, Salmonella enterica enterica serovar Typhi Ty2
gccggauggcggc

SEQ ID NO: 3692571 - RNA, 15 nt, Salmonella enterica enterica serovar Typhi Ty2
gccggauggcggcug

SEQ ID NO: 3692572 - RNA, 17 nt, Salmonella enterica enterica serovar Typhi Ty2
gccggauggcggcugcg

SEQ ID NO: 3692573 - RNA, 23 nt, Salmonella enterica enterica serovar Typhi Ty2
gccggauggggcauuagccgcca

SEQ ID NO: 3692574 - RNA, 20 nt, Salmonella enterica enterica serovar Typhi Ty2
gccggauuagcgacagcgcu

SEQ ID NO: 3692575 - RNA, 23 nt, Salmonella enterica enterica serovar Typhi Ty2
gccggauuuaccagcgcuucugu

SEQ ID NO: 3692576 - RNA, 22 nt, Salmonella enterica enterica serovar Typhi Ty2
gccggauuuuacauagcagcaa

SEQ ID NO: 3692577 - RNA, 18 nt, Salmonella enterica enterica serovar Typhi Ty2
gccggcaacacccgccga

SEQ ID NO: 3692578 - RNA, 22 nt, Salmonella enterica enterica serovar Typhi Ty2
gccggcagacgauagcggguga

SEQ ID NO: 3692579 - RNA, 14 nt, Salmonella enterica enterica serovar Typhi Ty2
gccggcagcagcuu

SEQ ID NO: 3692580 - RNA, 16 nt, Salmonella enterica enterica serovar Typhi Ty2
gccggcaggcagcgcc

SEQ ID NO: 3692581 - RNA, 15 nt, Salmonella enterica enterica serovar Typhi Ty2
gccggcaucauucug

SEQ ID NO: 3692582 - RNA, 17 nt, Salmonella enterica enterica serovar Typhi Ty2
gccggcgaccaugccag

SEQ ID NO: 3692583 - RNA, 18 nt, Salmonella enterica enterica serovar Typhi Ty2
gccggcgaccaugccagc

SEQ ID NO: 3692584 - RNA, 19 nt, Salmonella enterica enterica serovar Typhi Ty2
gccggcgcguaauuccgca

SEQ ID NO: 3692585 - RNA, 14 nt, Salmonella enterica enterica serovar Typhi Ty2
gccggcggcggaau

SEQ ID NO: 3692586 - RNA, 17 nt, Salmonella enterica enterica serovar Typhi Ty2
gccggcgucaucggcgc

SEQ ID NO: 3692587 - RNA, 14 nt, Salmonella enterica enterica serovar Typhi Ty2
gccggcguuccgca

SEQ ID NO: 3692588 - RNA, 18 nt, Salmonella enterica enterica serovar Typhi Ty2
gccggcuuaccagcgggc

SEQ ID NO: 3692589 - RNA, 20 nt, Salmonella enterica enterica serovar Typhi Ty2
gccgggacuuuaaacgucau

SEQ ID NO: 3692590 - RNA, 21 nt, Salmonella enterica enterica serovar Typhi Ty2
gccgggcagacaucgccgugc

SEQ ID NO: 3692591 - RNA, 12 nt, Salmonella enterica enterica serovar Typhi Ty2
gccgggcauaug

SEQ ID NO: 3692592 - RNA, 20 nt, Salmonella enterica enterica serovar Typhi Ty2
gccgggcauugugccgggua

SEQ ID NO: 3692593 - RNA, 14 nt, Salmonella enterica enterica serovar Typhi Ty2
gccgggccugccag

SEQ ID NO: 3692594 - RNA, 23 nt, Salmonella enterica enterica serovar Typhi Ty2
gccgggcggcuguguccgccaug

SEQ ID NO: 3692595 - RNA, 15 nt, Salmonella enterica enterica serovar Typhi Ty2
gccgggcuauccggc

SEQ ID NO: 3692596 - RNA, 21 nt, Salmonella enterica enterica serovar Typhi Ty2
gccgggcuauccggcuguucg

SEQ ID NO: 3692597 - RNA, 14 nt, Salmonella enterica enterica serovar Typhi Ty2
gccgggcuggcgga

SEQ ID NO: 3692598 - RNA, 15 nt, Salmonella enterica enterica serovar Typhi Ty2
gccgggcuggcggaa

SEQ ID NO: 3692599 - RNA, 14 nt, Salmonella enterica enterica serovar Typhi Ty2
gccggggcgcuggc

SEQ ID NO: 3692600 - RNA, 22 nt, Salmonella enterica enterica serovar Typhi Ty2
gccggggcucccacucuuccag

SEQ ID NO: 3692601 - RNA, 16 nt, Salmonella enterica enterica serovar Typhi Ty2
gccggggcuggcggcg

SEQ ID NO: 3692602 - RNA, 18 nt, Salmonella enterica enterica serovar Typhi Ty2
gccgggugacgcuuacgc

SEQ ID NO: 3692603 - RNA, 16 nt, Salmonella enterica enterica serovar Typhi Ty2
gccggguggcgcugug

SEQ ID NO: 3692604 - RNA, 14 nt, Salmonella enterica enterica serovar Typhi Ty2
gccggguuuaaugc

SEQ ID NO: 3692605 - RNA, 17 nt, Salmonella enterica enterica serovar Typhi Ty2
gccggguuugccgugcg

SEQ ID NO: 3692606 - RNA, 23 nt, Salmonella enterica enterica serovar Typhi Ty2
gccgguaagaagaaccagcgcga

SEQ ID NO: 3692607 - RNA, 15 nt, Salmonella enterica enterica serovar Typhi Ty2
gccgguacgcagcag

SEQ ID NO: 3692608 - RNA, 17 nt, Salmonella enterica enterica serovar Typhi Ty2
gccgguacgcagcaggc

SEQ ID NO: 3692609 - RNA, 21 nt, Salmonella enterica enterica serovar Typhi Ty2
gccgguacgcagcaggcagac

SEQ ID NO: 3692610 - RNA, 14 nt, Salmonella enterica enterica serovar Typhi Ty2
gccgguacguccac

SEQ ID NO: 3692611 - RNA, 14 nt, Salmonella enterica enterica serovar Typhi Ty2
gccgguagcgagaa

SEQ ID NO: 3692612 - RNA, 15 nt, Salmonella enterica enterica serovar Typhi Ty2
gccgguauccagcgc

SEQ ID NO: 3692613 - RNA, 17 nt, Salmonella enterica enterica serovar Typhi Ty2
gccgguauccagcgcgu

SEQ ID NO: 3692614 - RNA, 22 nt, Salmonella enterica enterica serovar Typhi Ty2
gccggucaggauacagccgacu

SEQ ID NO: 3692615 - RNA, 13 nt, Salmonella enterica enterica serovar Typhi Ty2
gccggucaugcca

SEQ ID NO: 3692616 - RNA, 16 nt, Salmonella enterica enterica serovar Typhi Ty2
gccggucgccagcaua

SEQ ID NO: 3692617 - RNA, 18 nt, Salmonella enterica enterica serovar Typhi Ty2
gccggugaucccaccagc

SEQ ID NO: 3692618 - RNA, 17 nt, Salmonella enterica enterica serovar Typhi Ty2
gccggugccauuccagc

SEQ ID NO: 3692619 - RNA, 14 nt, Salmonella enterica enterica serovar Typhi Ty2
gccggugcgagaaa

SEQ ID NO: 3692620 - RNA, 16 nt, Salmonella enterica enterica serovar Typhi Ty2
gccgguguacgacccu

SEQ ID NO: 3692621 - RNA, 16 nt, Salmonella enterica enterica serovar Typhi Ty2
gccgguguuaaccaga

SEQ ID NO: 3692622 - RNA, 18 nt, Salmonella enterica enterica serovar Typhi Ty2
gccgguuauaccgccauc

SEQ ID NO: 3692623 - RNA, 21 nt, Salmonella enterica enterica serovar Typhi Ty2
gccgguucggccagucgcaga

SEQ ID NO: 3692624 - RNA, 16 nt, Salmonella enterica enterica serovar Typhi Ty2
gccgguugcgcugguu

SEQ ID NO: 3692625 - RNA, 16 nt, Salmonella enterica enterica serovar Typhi Ty2
gccgguuuauccccgc

SEQ ID NO: 3692626 - RNA, 21 nt, Salmonella enterica enterica serovar Typhi Ty2
gccgguuuauccccgcuggcg

SEQ ID NO: 3692627 - RNA, 20 nt, Salmonella enterica enterica serovar Typhi Ty2
gccgguuucuccagccucgc

SEQ ID NO: 3692628 - RNA, 21 nt, Salmonella enterica enterica serovar Typhi Ty2
gccgguuuuagcguauccggc

SEQ ID NO: 3692629 - RNA, 18 nt, Salmonella enterica enterica serovar Typhi Ty2
gccguaaagggaagauca

SEQ ID NO: 3692630 - RNA, 17 nt, Salmonella enterica enterica serovar Typhi Ty2
gccguaaauugagugga

SEQ ID NO: 3692631 - RNA, 20 nt, Salmonella enterica enterica serovar Typhi Ty2
gccguaacgaacgcggauca

SEQ ID NO: 3692632 - RNA, 17 nt, Salmonella enterica enterica serovar Typhi Ty2
gccguaaggcguaccgc

SEQ ID NO: 3692633 - RNA, 19 nt, Salmonella enterica enterica serovar Typhi Ty2
gccguagaaaaugcgcugg

SEQ ID NO: 3692634 - RNA, 14 nt, Salmonella enterica enterica serovar Typhi Ty2
gccguagcagaaga

SEQ ID NO: 3692635 - RNA, 14 nt, Salmonella enterica enterica serovar Typhi Ty2
gccguagcgcgcuu

SEQ ID NO: 3692636 - RNA, 19 nt, Salmonella enterica enterica serovar Typhi Ty2
gccguagcgcgcuuccugc

SEQ ID NO: 3692637 - RNA, 18 nt, Salmonella enterica enterica serovar Typhi Ty2
gccuacccgcgugcggac

SEQ ID NO: 3692638 - RNA, 13 nt, Salmonella enterica enterica serovar Typhi Ty2
gccuaccgccaua

SEQ ID NO: 3692639 - RNA, 15 nt, Salmonella enterica enterica serovar Typhi Ty2
gccuaccugccgcca

SEQ ID NO: 3692640 - RNA, 24 nt, Salmonella enterica enterica serovar Typhi Ty2
gccuacggaaagcuguuguugcuc

SEQ ID NO: 3692641 - RNA, 18 nt, Salmonella enterica enterica serovar Typhi Ty2
gccuacugcccuacgcuu

SEQ ID NO: 3692642 - RNA, 18 nt, Salmonella enterica enterica serovar Typhi Ty2
gccuagcgcgcgcaguuu

SEQ ID NO: 3692643 - RNA, 21 nt, Salmonella enterica enterica serovar Typhi Ty2
gccuagcugcguuuccagcca

SEQ ID NO: 3692644 - RNA, 18 nt, Salmonella enterica enterica serovar Typhi Ty2
gccuauuuucucuuccac

SEQ ID NO: 3692645 - RNA, 22 nt, Salmonella enterica enterica serovar Typhi Ty2
gccucaaacgccgauggcgcca

SEQ ID NO: 3692646 - RNA, 22 nt, Salmonella enterica enterica serovar Typhi Ty2
gccucaacaaguccuucuuccc

SEQ ID NO: 3692647 - RNA, 21 nt, Salmonella enterica enterica serovar Typhi Ty2
gccucacccugaaauccggcu

SEQ ID NO: 3692648 - RNA, 16 nt, Salmonella enterica enterica serovar Typhi Ty2
gccucacguagaucuu

SEQ ID NO: 3692649 - RNA, 10 nt, Salmonella enterica enterica serovar Typhi Ty2
gccucaggcg

SEQ ID NO: 3692650 - RNA, 21 nt, Salmonella enterica enterica serovar Typhi Ty2
gccucauccccugacgcgcgc

SEQ ID NO: 3692651 - RNA, 19 nt, Salmonella enterica enterica serovar Typhi Ty2
gccucauccgcauagcgca

SEQ ID NO: 3692652 - RNA, 16 nt, Salmonella enterica enterica serovar Typhi Ty2
gccucaucggcguugc

SEQ ID NO: 3692653 - RNA, 20 nt, Salmonella enterica enterica serovar Typhi Ty2
gccucaucgggacggcgguc

SEQ ID NO: 3692654 - RNA, 14 nt, Salmonella enterica enterica serovar Typhi Ty2
gccucaucugcuuc

SEQ ID NO: 3692655 - RNA, 16 nt, Salmonella enterica enterica serovar Typhi Ty2
gccuccacaaagcgcg

SEQ ID NO: 3692656 - RNA, 19 nt, Salmonella enterica enterica serovar Typhi Ty2
gccuccaccaccucuuucg

SEQ ID NO: 3692657 - RNA, 22 nt, Salmonella enterica enterica serovar Typhi Ty2
gccuccagacuggcgaccgcca

SEQ ID NO: 3692658 - RNA, 17 nt, Salmonella enterica enterica serovar Typhi Ty2
gccuccagcgggcuggc

SEQ ID NO: 3692659 - RNA, 20 nt, Salmonella enterica enterica serovar Typhi Ty2
gccuccauuuuggggaaaau

SEQ ID NO: 3692660 - RNA, 18 nt, Salmonella enterica enterica serovar Typhi Ty2
gccuccgcguagcccagc

SEQ ID NO: 3692661 - RNA, 16 nt, Salmonella enterica enterica serovar Typhi Ty2
gccuccggaucgacag

SEQ ID NO: 3692662 - RNA, 18 nt, Salmonella enterica enterica serovar Typhi Ty2
gccuccggaugacgccgc

SEQ ID NO: 3692663 - RNA, 14 nt, Salmonella enterica enterica serovar Typhi Ty2
gccuccggcgguga

SEQ ID NO: 3692664 - RNA, 16 nt, Salmonella enterica enterica serovar Typhi Ty2
gccuccguaugaccgc

SEQ ID NO: 3692665 - RNA, 18 nt, Salmonella enterica enterica serovar Typhi Ty2
gccucgccaaagcgcugc

SEQ ID NO: 3692666 - RNA, 15 nt, Salmonella enterica enterica serovar Typhi Ty2
gccucgcgauccgcc

SEQ ID NO: 3692667 - RNA, 17 nt, Salmonella enterica enterica serovar Typhi Ty2
gccucgcgauccgccag

SEQ ID NO: 3692668 - RNA, 18 nt, Salmonella enterica enterica serovar Typhi Ty2
gccucgcgcauccgggcc

SEQ ID NO: 3692669 - RNA, 17 nt, Salmonella enterica enterica serovar Typhi Ty2
gccucggguggcaucug

SEQ ID NO: 3692670 - RNA, 21 nt, Salmonella enterica enterica serovar Typhi Ty2
gccucguaucugucccagccu

SEQ ID NO: 3692671 - RNA, 17 nt, Salmonella enterica enterica serovar Typhi Ty2
gccucuacccaugaagc

SEQ ID NO: 3692672 - RNA, 16 nt, Salmonella enterica enterica serovar Typhi Ty2
gccucuaucuucucag

SEQ ID NO: 3692673 - RNA, 13 nt, Salmonella enterica enterica serovar Typhi Ty2
gccucucccgaac

SEQ ID NO: 3692674 - RNA, 18 nt, Salmonella enterica enterica serovar Typhi Ty2
gccucucguaagagaggc

SEQ ID NO: 3692675 - RNA, 13 nt, Salmonella enterica enterica serovar Typhi Ty2
gccucugauuuuu

SEQ ID NO: 3692676 - RNA, 22 nt, Salmonella enterica enterica serovar Typhi Ty2
gccucuggccgcgcuuuuuuaa

SEQ ID NO: 3692677 - RNA, 14 nt, Salmonella enterica enterica serovar Typhi Ty2
gccucuuacagggc

SEQ ID NO: 3692678 - RNA, 16 nt, Salmonella enterica enterica serovar Typhi Ty2
gccucuucaaauuugu

SEQ ID NO: 3692679 - RNA, 14 nt, Salmonella enterica enterica serovar Typhi Ty2
gccucuuccgccug

SEQ ID NO: 3692680 - RNA, 22 nt, Salmonella enterica enterica serovar Typhi Ty2
gccucuuccgccugauaaaacg

SEQ ID NO: 3692681 - RNA, 21 nt, Salmonella enterica enterica serovar Typhi Ty2
gccucuucuggcucccgcagc

SEQ ID NO: 3692682 - RNA, 20 nt, Salmonella enterica enterica serovar Typhi Ty2
gccucuuggaugauuuucuu

SEQ ID NO: 3692683 - RNA, 18 nt, Salmonella enterica enterica serovar Typhi Ty2
gccucuuucagaucgccg

SEQ ID NO: 3692684 - RNA, 17 nt, Salmonella enterica enterica serovar Typhi Ty2
gccucuuuugcauuaca

SEQ ID NO: 3692685 - RNA, 22 nt, Salmonella enterica enterica serovar Typhi Ty2
gccucuuuugucguccccugga

SEQ ID NO: 3692686 - RNA, 19 nt, Salmonella enterica enterica serovar Typhi Ty2
gccucuuuuuucgccacgc

SEQ ID NO: 3692687 - RNA, 16 nt, Salmonella enterica enterica serovar Typhi Ty2
gccugaagauacgcca

SEQ ID NO: 3692688 - RNA, 17 nt, Salmonella enterica enterica serovar Typhi Ty2
gccugaagcgcaguguu

SEQ ID NO: 3692689 - RNA, 21 nt, Salmonella enterica enterica serovar Typhi Ty2
gccugaaguaucgacgcagac

SEQ ID NO: 3692690 - RNA, 18 nt, Salmonella enterica enterica serovar Typhi Ty2
gccugaauaaucggcguc

SEQ ID NO: 3692691 - RNA, 13 nt, Salmonella enterica enterica serovar Typhi Ty2
gccugaauaauga

SEQ ID NO: 3692692 - RNA, 18 nt, Salmonella enterica enterica serovar Typhi Ty2
gccugaaugcacugcuga

SEQ ID NO: 3692693 - RNA, 21 nt, Salmonella enterica enterica serovar Typhi Ty2
gccugacgaaagucauccagu

SEQ ID NO: 3692694 - RNA, 18 nt, Salmonella enterica enterica serovar Typhi Ty2
gccugacgaauagcgcgc

SEQ ID NO: 3692695 - RNA, 17 nt, Salmonella enterica enterica serovar Typhi Ty2
gccugacuccggguaac

SEQ ID NO: 3692696 - RNA, 12 nt, Salmonella enterica enterica serovar Typhi Ty2
gccugagcgcga

SEQ ID NO: 3692697 - RNA, 15 nt, Salmonella enterica enterica serovar Typhi Ty2
gccugagguuucgcc

SEQ ID NO: 3692698 - RNA, 16 nt, Salmonella enterica enterica serovar Typhi Ty2
gccugauaaaacgcag

SEQ ID NO: 3692699 - RNA, 20 nt, Salmonella enterica enterica serovar Typhi Ty2
gccugauaaacguagcguca

SEQ ID NO: 3692700 - RNA, 21 nt, Salmonella enterica enterica serovar Typhi Ty2
gccugauaaauaugucggccc

SEQ ID NO: 3692701 - RNA, 16 nt, Salmonella enterica enterica serovar Typhi Ty2
gccugauaagcacagg

SEQ ID NO: 3692702 - RNA, 17 nt, Salmonella enterica enterica serovar Typhi Ty2
gccugauaagcgaagcg

SEQ ID NO: 3692703 - RNA, 20 nt, Salmonella enterica enterica serovar Typhi Ty2
gccugauaagcgaagcgcca

SEQ ID NO: 3692704 - RNA, 20 nt, Salmonella enterica enterica serovar Typhi Ty2
gccugauaagcgcagcgcca

SEQ ID NO: 3692705 - RNA, 20 nt, Salmonella enterica enterica serovar Typhi Ty2
gccugauaagcguagcgcca

SEQ ID NO: 3692706 - RNA, 18 nt, Salmonella enterica enterica serovar Typhi Ty2
gccugauagcacagcgcu

SEQ ID NO: 3692707 - RNA, 13 nt, Salmonella enterica enterica serovar Typhi Ty2
gccugaucgccac

SEQ ID NO: 3692708 - RNA, 16 nt, Salmonella enterica enterica serovar Typhi Ty2
gccugaucgcgcagac

SEQ ID NO: 3692709 - RNA, 18 nt, Salmonella enterica enterica serovar Typhi Ty2
gccugaucgcgcagacag

SEQ ID NO: 3692710 - RNA, 12 nt, Salmonella enterica enterica serovar Typhi Ty2
gccugaucuuuc

SEQ ID NO: 3692711 - RNA, 13 nt, Salmonella enterica enterica serovar Typhi Ty2
gccugaugaccgc

SEQ ID NO: 3692712 - RNA, 16 nt, Salmonella enterica enterica serovar Typhi Ty2
gccugaugacgcuacg

SEQ ID NO: 3692713 - RNA, 17 nt, Salmonella enterica enterica serovar Typhi Ty2
gccugaugacgcugcgc

SEQ ID NO: 3692714 - RNA, 16 nt, Salmonella enterica enterica serovar Typhi Ty2
gccugaugagcgcagc

SEQ ID NO: 3692715 - RNA, 20 nt, Salmonella enterica enterica serovar Typhi Ty2
gccugaugagcgcagcgacu

SEQ ID NO: 3692716 - RNA, 23 nt, Salmonella enterica enterica serovar Typhi Ty2
gccugaugagguuacguucauca

SEQ ID NO: 3692717 - RNA, 13 nt, Salmonella enterica enterica serovar Typhi Ty2
gccugaugcgccg

SEQ ID NO: 3692718 - RNA, 15 nt, Salmonella enterica enterica serovar Typhi Ty2
gccugaugcgccgcc

SEQ ID NO: 3692719 - RNA, 19 nt, Salmonella enterica enterica serovar Typhi Ty2
gccuuacccauacaguaca

SEQ ID NO: 3692720 - RNA, 12 nt, Salmonella enterica enterica serovar Typhi Ty2
gccuuagcgccc

SEQ ID NO: 3692721 - RNA, 22 nt, Salmonella enterica enterica serovar Typhi Ty2
gccuuauaagaaccaucuacca

SEQ ID NO: 3692722 - RNA, 19 nt, Salmonella enterica enterica serovar Typhi Ty2
gccuuaucaagccuacacc

SEQ ID NO: 3692723 - RNA, 19 nt, Salmonella enterica enterica serovar Typhi Ty2
gccuuaucaggccuguggu

SEQ ID NO: 3692724 - RNA, 13 nt, Salmonella enterica enterica serovar Typhi Ty2
gccuuauccggcc

SEQ ID NO: 3692725 - RNA, 14 nt, Salmonella enterica enterica serovar Typhi Ty2
gccuuauccggccu

SEQ ID NO: 3692726 - RNA, 18 nt, Salmonella enterica enterica serovar Typhi Ty2
gccuuauccggccuacac

SEQ ID NO: 3692727 - RNA, 19 nt, Salmonella enterica enterica serovar Typhi Ty2
gccuuauccggccuacaga

SEQ ID NO: 3692728 - RNA, 18 nt, Salmonella enterica enterica serovar Typhi Ty2
gccuuauccggccuacuc

SEQ ID NO: 3692729 - RNA, 23 nt, Salmonella enterica enterica serovar Typhi Ty2
gccuuauggccagggacaggaga

SEQ ID NO: 3692730 - RNA, 20 nt, Salmonella enterica enterica serovar Typhi Ty2
gccuuauugugccgcggcuu

SEQ ID NO: 3692731 - RNA, 19 nt, Salmonella enterica enterica serovar Typhi Ty2
gccuuauuuuucagcgcca

SEQ ID NO: 3692732 - RNA, 18 nt, Salmonella enterica enterica serovar Typhi Ty2
gccuucaaauauauugaa

SEQ ID NO: 3692733 - RNA, 18 nt, Salmonella enterica enterica serovar Typhi Ty2
gccuucaauuugaccuga

SEQ ID NO: 3692734 - RNA, 15 nt, Salmonella enterica enterica serovar Typhi Ty2
gccuucagcgcgccc

SEQ ID NO: 3692735 - RNA, 15 nt, Salmonella enterica enterica serovar Typhi Ty2
gccuucaggcaucag

SEQ ID NO: 3692736 - RNA, 13 nt, Salmonella enterica enterica serovar Typhi Ty2
gccuucagguuuu

SEQ ID NO: 3692737 - RNA, 13 nt, Salmonella enterica enterica serovar Typhi Ty2
gccuucauaauga

SEQ ID NO: 3692738 - RNA, 22 nt, Salmonella enterica enterica serovar Typhi Ty2
gccuucauauuaaauuccggcu

SEQ ID NO: 3692739 - RNA, 16 nt, Salmonella enterica enterica serovar Typhi Ty2
gccuuccagaaauaaa

SEQ ID NO: 3692740 - RNA, 12 nt, Salmonella enterica enterica serovar Typhi Ty2
gccuuccagcaa

SEQ ID NO: 3692741 - RNA, 13 nt, Salmonella enterica enterica serovar Typhi Ty2
gccuuccaggcgg

SEQ ID NO: 3692742 - RNA, 21 nt, Salmonella enterica enterica serovar Typhi Ty2
gccuuccucgucggcaagaau

SEQ ID NO: 3692743 - RNA, 14 nt, Salmonella enterica enterica serovar Typhi Ty2
gccuuccuggucug

SEQ ID NO: 3692744 - RNA, 16 nt, Salmonella enterica enterica serovar Typhi Ty2
gccuucgacuuccgca

SEQ ID NO: 3692745 - RNA, 14 nt, Salmonella enterica enterica serovar Typhi Ty2
gccuucgccgccgc

SEQ ID NO: 3692746 - RNA, 20 nt, Salmonella enterica enterica serovar Typhi Ty2
gccuucgcggugaucccagg

SEQ ID NO: 3692747 - RNA, 13 nt, Salmonella enterica enterica serovar Typhi Ty2
gccuucggccuga

SEQ ID NO: 3692748 - RNA, 19 nt, Salmonella enterica enterica serovar Typhi Ty2
gccuucggcgucgugcugg

SEQ ID NO: 3692749 - RNA, 14 nt, Salmonella enterica enterica serovar Typhi Ty2
gccuucuuccguca

SEQ ID NO: 3692750 - RNA, 12 nt, Salmonella enterica enterica serovar Typhi Ty2
gccuucuuucuc

SEQ ID NO: 3692751 - RNA, 21 nt, Salmonella enterica enterica serovar Typhi Ty2
gccuucuuucucgaauccacu

SEQ ID NO: 3692752 - RNA, 22 nt, Salmonella enterica enterica serovar Typhi Ty2
gccuucuuuggugcgacgccag

SEQ ID NO: 3692753 - RNA, 13 nt, Salmonella enterica enterica serovar Typhi Ty2
gccuugccgccag

SEQ ID NO: 3692754 - RNA, 16 nt, Salmonella enterica enterica serovar Typhi Ty2
gccuugcggcgccagg

SEQ ID NO: 3692755 - RNA, 17 nt, Salmonella enterica enterica serovar Typhi Ty2
gccuugcggcgccagga

SEQ ID NO: 3692756 - RNA, 15 nt, Salmonella enterica enterica serovar Typhi Ty2
gccuugcggcggcgu

SEQ ID NO: 3692757 - RNA, 21 nt, Salmonella enterica enterica serovar Typhi Ty2
gccuugcgggauacaugcccg

SEQ ID NO: 3692758 - RNA, 21 nt, Salmonella enterica enterica serovar Typhi Ty2
gccuugcuggccuguucaagu

SEQ ID NO: 3692759 - RNA, 21 nt, Salmonella enterica enterica serovar Typhi Ty2
gccuuguaggccugauagcac

SEQ ID NO: 3692760 - RNA, 15 nt, Salmonella enterica enterica serovar Typhi Ty2
gccuuuaccacccgu

SEQ ID NO: 3692761 - RNA, 19 nt, Salmonella enterica enterica serovar Typhi Ty2
gccuuuacccuuacggcca

SEQ ID NO: 3692762 - RNA, 13 nt, Salmonella enterica enterica serovar Typhi Ty2
gccuuuauccagc

SEQ ID NO: 3692763 - RNA, 18 nt, Salmonella enterica enterica serovar Typhi Ty2
gccuuuaugcaguuccgu

SEQ ID NO: 3692764 - RNA, 13 nt, Salmonella enterica enterica serovar Typhi Ty2
gccuuuauuucaa

SEQ ID NO: 3692765 - RNA, 13 nt, Salmonella enterica enterica serovar Typhi Ty2
gccuuuccgcaug

SEQ ID NO: 3692766 - RNA, 18 nt, Salmonella enterica enterica serovar Typhi Ty2
gccuuucuccauggucag

SEQ ID NO: 3692767 - RNA, 16 nt, Salmonella enterica enterica serovar Typhi Ty2
gccuuugcguaccgca

SEQ ID NO: 3692768 - RNA, 22 nt, Salmonella enterica enterica serovar Typhi Ty2
gccuuuggcaaucauaccguca

SEQ ID NO: 3692769 - RNA, 12 nt, Salmonella enterica enterica serovar Typhi Ty2
gccuuuggccug

SEQ ID NO: 3692770 - RNA, 15 nt, Salmonella enterica enterica serovar Typhi Ty2
gccuuuggccuggag

SEQ ID NO: 3692771 - RNA, 21 nt, Salmonella enterica enterica serovar Typhi Ty2
gccuuuuaucaaugcacugac

SEQ ID NO: 3692772 - RNA, 22 nt, Salmonella enterica enterica serovar Typhi Ty2
gccuuuucauauggaagcuguu

SEQ ID NO: 3692773 - RNA, 20 nt, Salmonella enterica enterica serovar Typhi Ty2
gccuuuuugcagcgcggcca

SEQ ID NO: 3692774 - RNA, 18 nt, Salmonella enterica enterica serovar Typhi Ty2
gccuuuuuuaauccagga

SEQ ID NO: 3692775 - RNA, 13 nt, Salmonella enterica enterica serovar Typhi Ty2
gcgaaaaagccgg

SEQ ID NO: 3692776 - RNA, 14 nt, Salmonella enterica enterica serovar Typhi Ty2
gcgaaaaagccggc

SEQ ID NO: 3692777 - RNA, 18 nt, Salmonella enterica enterica serovar Typhi Ty2
gcgaaaaaguucacgcuu

SEQ ID NO: 3692778 - RNA, 23 nt, Salmonella enterica enterica serovar Typhi Ty2
gcgaaaaauaggauggcgcagca

SEQ ID NO: 3692779 - RNA, 12 nt, Salmonella enterica enterica serovar Typhi Ty2
gcgaaaaccagc

SEQ ID NO: 3692780 - RNA, 15 nt, Salmonella enterica enterica serovar Typhi Ty2
gcgaaaaggccuggc

SEQ ID NO: 3692781 - RNA, 12 nt, Salmonella enterica enterica serovar Typhi Ty2
gcgaaaauaaac

SEQ ID NO: 3692782 - RNA, 22 nt, Salmonella enterica enterica serovar Typhi Ty2
gcgaaaauaccccagcgcgccg

SEQ ID NO: 3692783 - RNA, 20 nt, Salmonella enterica enterica serovar Typhi Ty2
gcgaaaccgcuacccggcac

SEQ ID NO: 3692784 - RNA, 17 nt, Salmonella enterica enterica serovar Typhi Ty2
gcgaaacuccagcgaua

SEQ ID NO: 3692785 - RNA, 12 nt, Salmonella enterica enterica serovar Typhi Ty2
gcgaaagaaaau

SEQ ID NO: 3692786 - RNA, 19 nt, Salmonella enterica enterica serovar Typhi Ty2
gcgaaagagaaagcgcuga

SEQ ID NO: 3692787 - RNA, 21 nt, Salmonella enterica enterica serovar Typhi Ty2
gcgaaagagaaagcgcugacg

SEQ ID NO: 3692788 - RNA, 19 nt, Salmonella enterica enterica serovar Typhi Ty2
gcgaaauaggccgcgauac

SEQ ID NO: 3692789 - RNA, 20 nt, Salmonella enterica enterica serovar Typhi Ty2
gcgaaauuuaauauaugaac

SEQ ID NO: 3692790 - RNA, 15 nt, Salmonella enterica enterica serovar Typhi Ty2
gcgaacaaagccccg

SEQ ID NO: 3692791 - RNA, 23 nt, Salmonella enterica enterica serovar Typhi Ty2
gcgaacaaagccccgggcgcugg

SEQ ID NO: 3692792 - RNA, 20 nt, Salmonella enterica enterica serovar Typhi Ty2
gcgaacagccccaccgccag

SEQ ID NO: 3692793 - RNA, 23 nt, Salmonella enterica enterica serovar Typhi Ty2
gcgaacagcccgcuauuucucgc

SEQ ID NO: 3692794 - RNA, 22 nt, Salmonella enterica enterica serovar Typhi Ty2
gcgaacaggcucagcgccacgc

SEQ ID NO: 3692795 - RNA, 11 nt, Salmonella enterica enterica serovar Typhi Ty2
gcgaacauugg

SEQ ID NO: 3692796 - RNA, 16 nt, Salmonella enterica enterica serovar Typhi Ty2
gcgaacauuucagcgc

SEQ ID NO: 3692797 - RNA, 14 nt, Salmonella enterica enterica serovar Typhi Ty2
gcgaaccaccagcc

SEQ ID NO: 3692798 - RNA, 20 nt, Salmonella enterica enterica serovar Typhi Ty2
gcgaaccggaccagcacaaa

SEQ ID NO: 3692799 - RNA, 21 nt, Salmonella enterica enterica serovar Typhi Ty2
gcgaacgacucacgcgcgcuu

SEQ ID NO: 3692800 - RNA, 14 nt, Salmonella enterica enterica serovar Typhi Ty2
gcgaacgcgauugc

SEQ ID NO: 3692801 - RNA, 22 nt, Salmonella enterica enterica serovar Typhi Ty2
gcgacgauaggcauacacaucu

SEQ ID NO: 3692802 - RNA, 14 nt, Salmonella enterica enterica serovar Typhi Ty2
gcgacgaucagcgc

SEQ ID NO: 3692803 - RNA, 16 nt, Salmonella enterica enterica serovar Typhi Ty2
gcgacgaucagcgcca

SEQ ID NO: 3692804 - RNA, 12 nt, Salmonella enterica enterica serovar Typhi Ty2
gcgacgaugcgc

SEQ ID NO: 3692805 - RNA, 21 nt, Salmonella enterica enterica serovar Typhi Ty2
gcgacgaugugcauaaccgcg

SEQ ID NO: 3692806 - RNA, 15 nt, Salmonella enterica enterica serovar Typhi Ty2
gcgacgcgccagcca

SEQ ID NO: 3692807 - RNA, 20 nt, Salmonella enterica enterica serovar Typhi Ty2
gcgacgcgccagccagcgcc

SEQ ID NO: 3692808 - RNA, 16 nt, Salmonella enterica enterica serovar Typhi Ty2
gcgacgcgcgagcgca

SEQ ID NO: 3692809 - RNA, 16 nt, Salmonella enterica enterica serovar Typhi Ty2
gcgacggaccggcagc

SEQ ID NO: 3692810 - RNA, 16 nt, Salmonella enterica enterica serovar Typhi Ty2
gcgacggacucgcgca

SEQ ID NO: 3692811 - RNA, 16 nt, Salmonella enterica enterica serovar Typhi Ty2
gcgacggcccaacagc

SEQ ID NO: 3692812 - RNA, 16 nt, Salmonella enterica enterica serovar Typhi Ty2
gcgacggcgcgccggc

SEQ ID NO: 3692813 - RNA, 17 nt, Salmonella enterica enterica serovar Typhi Ty2
gcgacggcguaagcgcu

SEQ ID NO: 3692814 - RNA, 16 nt, Salmonella enterica enterica serovar Typhi Ty2
gcgacgguccuggcca

SEQ ID NO: 3692815 - RNA, 20 nt, Salmonella enterica enterica serovar Typhi Ty2
gcgacgguccuggccaggcu

SEQ ID NO: 3692816 - RNA, 18 nt, Salmonella enterica enterica serovar Typhi Ty2
gcgacguauuacgcaggc

SEQ ID NO: 3692817 - RNA, 18 nt, Salmonella enterica enterica serovar Typhi Ty2
gcgacguccgccaacagc

SEQ ID NO: 3692818 - RNA, 12 nt, Salmonella enterica enterica serovar Typhi Ty2
gcgacguuaucu

SEQ ID NO: 3692819 - RNA, 17 nt, Salmonella enterica enterica serovar Typhi Ty2
gcgacguuaucucgcca

SEQ ID NO: 3692820 - RNA, 18 nt, Salmonella enterica enterica serovar Typhi Ty2
gcgacguuaucucgccag

SEQ ID NO: 3692821 - RNA, 14 nt, Salmonella enterica enterica serovar Typhi Ty2
gcgacguuccgcga

SEQ ID NO: 3692822 - RNA, 15 nt, Salmonella enterica enterica serovar Typhi Ty2
gcgacuaaccagcgc

SEQ ID NO: 3692823 - RNA, 17 nt, Salmonella enterica enterica serovar Typhi Ty2
gcgacuaaccagcgcaa

SEQ ID NO: 3692824 - RNA, 14 nt, Salmonella enterica enterica serovar Typhi Ty2
gcgacuaaccugau

SEQ ID NO: 3692825 - RNA, 18 nt, Salmonella enterica enterica serovar Typhi Ty2
gcgacuaacgucuuaucc

SEQ ID NO: 3692826 - RNA, 21 nt, Salmonella enterica enterica serovar Typhi Ty2
gcgacuaacgucuuauccggc

SEQ ID NO: 3692827 - RNA, 22 nt, Salmonella enterica enterica serovar Typhi Ty2
gcgacuaccguucacggcgaua

SEQ ID NO: 3692828 - RNA, 23 nt, Salmonella enterica enterica serovar Typhi Ty2
gcgacuacgguaaaccaggccag

SEQ ID NO: 3692829 - RNA, 13 nt, Salmonella enterica enterica serovar Typhi Ty2
gcgacucauccac

SEQ ID NO: 3692830 - RNA, 22 nt, Salmonella enterica enterica serovar Typhi Ty2
gcgacucgccguuuuaucgccc

SEQ ID NO: 3692831 - RNA, 23 nt, Salmonella enterica enterica serovar Typhi Ty2
gcgacucgccguuuuaucgcccg

SEQ ID NO: 3692832 - RNA, 16 nt, Salmonella enterica enterica serovar Typhi Ty2
gcgacucggugccgcu

SEQ ID NO: 3692833 - RNA, 14 nt, Salmonella enterica enterica serovar Typhi Ty2
gcgacugauaagcg

SEQ ID NO: 3692834 - RNA, 14 nt, Salmonella enterica enterica serovar Typhi Ty2
gcgacugaucaggc

SEQ ID NO: 3692835 - RNA, 14 nt, Salmonella enterica enterica serovar Typhi Ty2
gcgacuuauccggc

SEQ ID NO: 3692836 - RNA, 14 nt, Salmonella enterica enterica serovar Typhi Ty2
gcgacuucauucag

SEQ ID NO: 3692837 - RNA, 23 nt, Salmonella enterica enterica serovar Typhi Ty2
gcgacuuccgucuccggacguuu

SEQ ID NO: 3692838 - RNA, 16 nt, Salmonella enterica enterica serovar Typhi Ty2
gcgacuucgcuuccug

SEQ ID NO: 3692839 - RNA, 18 nt, Salmonella enterica enterica serovar Typhi Ty2
gcgacuucgcuuccugca

SEQ ID NO: 3692840 - RNA, 22 nt, Salmonella enterica enterica serovar Typhi Ty2
gcgacuuuaaacuuauccgcca

SEQ ID NO: 3692841 - RNA, 18 nt, Salmonella enterica enterica serovar Typhi Ty2
gcgacuuuuuucacccag

SEQ ID NO: 3692842 - RNA, 22 nt, Salmonella enterica enterica serovar Typhi Ty2
gcgagaacggguaaaugcgcgc

SEQ ID NO: 3692843 - RNA, 13 nt, Salmonella enterica enterica serovar Typhi Ty2
gcgagaacugcug

SEQ ID NO: 3692844 - RNA, 22 nt, Salmonella enterica enterica serovar Typhi Ty2
gcgagaacugcugcauccgcgc

SEQ ID NO: 3692845 - RNA, 15 nt, Salmonella enterica enterica serovar Typhi Ty2
gcgagaagcugggcg

SEQ ID NO: 3692846 - RNA, 18 nt, Salmonella enterica enterica serovar Typhi Ty2
gcgagaagcugggcguca

SEQ ID NO: 3692847 - RNA, 14 nt, Salmonella enterica enterica serovar Typhi Ty2
gcgagaaguucuca

SEQ ID NO: 3692848 - RNA, 16 nt, Salmonella enterica enterica serovar Typhi Ty2
gcgagaauuuuaugga

SEQ ID NO: 3692849 - RNA, 13 nt, Salmonella enterica enterica serovar Typhi Ty2
gcgagaccauauu

SEQ ID NO: 3692850 - RNA, 14 nt, Salmonella enterica enterica serovar Typhi Ty2
gcgagacgcgccga

SEQ ID NO: 3692851 - RNA, 23 nt, Salmonella enterica enterica serovar Typhi Ty2
gcgagagaauuaacagcgcgacc

SEQ ID NO: 3692852 - RNA, 18 nt, Salmonella enterica enterica serovar Typhi Ty2
gcgagaguaagcccaaag

SEQ ID NO: 3692853 - RNA, 19 nt, Salmonella enterica enterica serovar Typhi Ty2
gcgagauuacugcgugcug

SEQ ID NO: 3692854 - RNA, 20 nt, Salmonella enterica enterica serovar Typhi Ty2
gcgagcaaaacccggugcgg

SEQ ID NO: 3692855 - RNA, 20 nt, Salmonella enterica enterica serovar Typhi Ty2
gcgagccguaaacggaacca

SEQ ID NO: 3692856 - RNA, 14 nt, Salmonella enterica enterica serovar Typhi Ty2
gcgagcgauagaga

SEQ ID NO: 3692857 - RNA, 19 nt, Salmonella enterica enterica serovar Typhi Ty2
gcgagcguuuugaugucca

SEQ ID NO: 3692858 - RNA, 20 nt, Salmonella enterica enterica serovar Typhi Ty2
gcgagcugccaguucauucc

SEQ ID NO: 3692859 - RNA, 15 nt, Salmonella enterica enterica serovar Typhi Ty2
gcgaggaacaucagc

SEQ ID NO: 3692860 - RNA, 12 nt, Salmonella enterica enterica serovar Typhi Ty2
gcgaggacugua

SEQ ID NO: 3692861 - RNA, 17 nt, Salmonella enterica enterica serovar Typhi Ty2
gcgaggccacgcaccgu

SEQ ID NO: 3692862 - RNA, 15 nt, Salmonella enterica enterica serovar Typhi Ty2
gcgagggauuuccug

SEQ ID NO: 3692863 - RNA, 19 nt, Salmonella enterica enterica serovar Typhi Ty2
gcgagggauuuccuggcag

SEQ ID NO: 3692864 - RNA, 15 nt, Salmonella enterica enterica serovar Typhi Ty2
gcgaggucgagcuca

SEQ ID NO: 3692865 - RNA, 20 nt, Salmonella enterica enterica serovar Typhi Ty2
gcgaggucuggucagcgaug

SEQ ID NO: 3692866 - RNA, 22 nt, Salmonella enterica enterica serovar Typhi Ty2
gcgaggugcuggugaccgccuu

SEQ ID NO: 3692867 - RNA, 15 nt, Salmonella enterica enterica serovar Typhi Ty2
gcgagguucccgccg

SEQ ID NO: 3692868 - RNA, 17 nt, Salmonella enterica enterica serovar Typhi Ty2
gcgagguucccgccgcc

SEQ ID NO: 3692869 - RNA, 20 nt, Salmonella enterica enterica serovar Typhi Ty2
gcgagguucccgccgccauu

SEQ ID NO: 3692870 - RNA, 16 nt, Salmonella enterica enterica serovar Typhi Ty2
gcgaguacgcacaaca

SEQ ID NO: 3692871 - RNA, 17 nt, Salmonella enterica enterica serovar Typhi Ty2
gcgagucagacaccagc

SEQ ID NO: 3692872 - RNA, 18 nt, Salmonella enterica enterica serovar Typhi Ty2
gcgagucagacaccagcc

SEQ ID NO: 3692873 - RNA, 13 nt, Salmonella enterica enterica serovar Typhi Ty2
gcgaguccugccg

SEQ ID NO: 3692874 - RNA, 14 nt, Salmonella enterica enterica serovar Typhi Ty2
gcgagugccugcug

SEQ ID NO: 3692875 - RNA, 23 nt, Salmonella enterica enterica serovar Typhi Ty2
gcgauaaaaacccaccagcgcca

SEQ ID NO: 3692876 - RNA, 21 nt, Salmonella enterica enterica serovar Typhi Ty2
gcgauaaaaauauccgccauc

SEQ ID NO: 3692877 - RNA, 19 nt, Salmonella enterica enterica serovar Typhi Ty2
gcgauaaaaccaccuacgc

SEQ ID NO: 3692878 - RNA, 17 nt, Salmonella enterica enterica serovar Typhi Ty2
gcgauaaaccaacagcc

SEQ ID NO: 3692879 - RNA, 23 nt, Salmonella enterica enterica serovar Typhi Ty2
gcgauaaccgguuuaugaugccg

SEQ ID NO: 3692880 - RNA, 14 nt, Salmonella enterica enterica serovar Typhi Ty2
gcgauaagcgucuu

SEQ ID NO: 3692881 - RNA, 17 nt, Salmonella enterica enterica serovar Typhi Ty2
gcgauaaggauaucuug

SEQ ID NO: 3692882 - RNA, 20 nt, Salmonella enterica enterica serovar Typhi Ty2
gcgauaaggucgcuauccag

SEQ ID NO: 3692883 - RNA, 22 nt, Salmonella enterica enterica serovar Typhi Ty2
gcgcaaccuccgcggggaucgg

SEQ ID NO: 3692884 - RNA, 19 nt, Salmonella enterica enterica serovar Typhi Ty2
gcgcaacgcuuaaucccuu

SEQ ID NO: 3692885 - RNA, 18 nt, Salmonella enterica enterica serovar Typhi Ty2
gcgcaacgcuuccaccuc

SEQ ID NO: 3692886 - RNA, 15 nt, Salmonella enterica enterica serovar Typhi Ty2
gcgcaaggccgagcg

SEQ ID NO: 3692887 - RNA, 13 nt, Salmonella enterica enterica serovar Typhi Ty2
gcgcaauccgcgc

SEQ ID NO: 3692888 - RNA, 16 nt, Salmonella enterica enterica serovar Typhi Ty2
gcgcaauccgcgccgc

SEQ ID NO: 3692889 - RNA, 22 nt, Salmonella enterica enterica serovar Typhi Ty2
gcgcaaucgguaaaggucgccg

SEQ ID NO: 3692890 - RNA, 20 nt, Salmonella enterica enterica serovar Typhi Ty2
gcgcaaucugcucgacgcgc

SEQ ID NO: 3692891 - RNA, 21 nt, Salmonella enterica enterica serovar Typhi Ty2
gcgcaaugucccugacagcgc

SEQ ID NO: 3692892 - RNA, 19 nt, Salmonella enterica enterica serovar Typhi Ty2
gcgcaauuuuguugcgccc

SEQ ID NO: 3692893 - RNA, 19 nt, Salmonella enterica enterica serovar Typhi Ty2
gcgcacacaauagcaaucu

SEQ ID NO: 3692894 - RNA, 22 nt, Salmonella enterica enterica serovar Typhi Ty2
gcgcacgagugaucccgacaua

SEQ ID NO: 3692895 - RNA, 14 nt, Salmonella enterica enterica serovar Typhi Ty2
gcgcacgcgcgcgc

SEQ ID NO: 3692896 - RNA, 17 nt, Salmonella enterica enterica serovar Typhi Ty2
gcgcacggcgcguccuc

SEQ ID NO: 3692897 - RNA, 16 nt, Salmonella enterica enterica serovar Typhi Ty2
gcgcacucagaaaauu

SEQ ID NO: 3692898 - RNA, 14 nt, Salmonella enterica enterica serovar Typhi Ty2
gcgcagacacugcc

SEQ ID NO: 3692899 - RNA, 20 nt, Salmonella enterica enterica serovar Typhi Ty2
gcgcagaccuacgcuauccg

SEQ ID NO: 3692900 - RNA, 19 nt, Salmonella enterica enterica serovar Typhi Ty2
gcgcagagugaccagcggu

SEQ ID NO: 3692901 - RNA, 23 nt, Salmonella enterica enterica serovar Typhi Ty2
gcgcagauuuugcagauccgcga

SEQ ID NO: 3692902 - RNA, 18 nt, Salmonella enterica enterica serovar Typhi Ty2
gcgcagcaucucauccac

SEQ ID NO: 3692903 - RNA, 18 nt, Salmonella enterica enterica serovar Typhi Ty2
gcgcagcaugaucggcug

SEQ ID NO: 3692904 - RNA, 17 nt, Salmonella enterica enterica serovar Typhi Ty2
gcgcagccccagcgcca

SEQ ID NO: 3692905 - RNA, 20 nt, Salmonella enterica enterica serovar Typhi Ty2
gcgcagcgaaacugcgcgcc

SEQ ID NO: 3692906 - RNA, 22 nt, Salmonella enterica enterica serovar Typhi Ty2
gcgcagcgaaacugcgcgccgg

SEQ ID NO: 3692907 - RNA, 11 nt, Salmonella enterica enterica serovar Typhi Ty2
gcgcagcgacu

SEQ ID NO: 3692908 - RNA, 19 nt, Salmonella enterica enterica serovar Typhi Ty2
gcgcagcgacuucaggcgu

SEQ ID NO: 3692909 - RNA, 17 nt, Salmonella enterica enterica serovar Typhi Ty2
gcgcagcgauauagcgc

SEQ ID NO: 3692910 - RNA, 16 nt, Salmonella enterica enterica serovar Typhi Ty2
gcgcagcgcaucaggc

SEQ ID NO: 3692911 - RNA, 17 nt, Salmonella enterica enterica serovar Typhi Ty2
gcgcagcgccaucaggc

SEQ ID NO: 3692912 - RNA, 20 nt, Salmonella enterica enterica serovar Typhi Ty2
gcgcagcgccaucaggcaau

SEQ ID NO: 3692913 - RNA, 20 nt, Salmonella enterica enterica serovar Typhi Ty2
gcgcagcgccaucaggcaug

SEQ ID NO: 3692914 - RNA, 18 nt, Salmonella enterica enterica serovar Typhi Ty2
gcgcagcgccaucaggcc

SEQ ID NO: 3692915 - RNA, 19 nt, Salmonella enterica enterica serovar Typhi Ty2
gcgcagcgccaucaggccc

SEQ ID NO: 3692916 - RNA, 15 nt, Salmonella enterica enterica serovar Typhi Ty2
gcgcagcgcgcgacc

SEQ ID NO: 3692917 - RNA, 21 nt, Salmonella enterica enterica serovar Typhi Ty2
gcgcagcgcgcgacccagcgc

SEQ ID NO: 3692918 - RNA, 19 nt, Salmonella enterica enterica serovar Typhi Ty2
gcgcagcgcgucggcgggc

SEQ ID NO: 3692919 - RNA, 22 nt, Salmonella enterica enterica serovar Typhi Ty2
gcgcagcgcuuuugccgcgccc

SEQ ID NO: 3692920 - RNA, 21 nt, Salmonella enterica enterica serovar Typhi Ty2
gcgcagcugggccugcuccgu

SEQ ID NO: 3692921 - RNA, 17 nt, Salmonella enterica enterica serovar Typhi Ty2
gcgcaggccgcgccgcu

SEQ ID NO: 3692922 - RNA, 20 nt, Salmonella enterica enterica serovar Typhi Ty2
gcgcaggccgcgccgcugcu

SEQ ID NO: 3692923 - RNA, 14 nt, Salmonella enterica enterica serovar Typhi Ty2
gcgcaggcgagcgg

SEQ ID NO: 3692924 - RNA, 15 nt, Salmonella enterica enterica serovar Typhi Ty2
gcgcaggcgagcggc

SEQ ID NO: 3692925 - RNA, 17 nt, Salmonella enterica enterica serovar Typhi Ty2
gcgcagugaccagcauc

SEQ ID NO: 3692926 - RNA, 21 nt, Salmonella enterica enterica serovar Typhi Ty2
gcgcagugaccagcaucagcg

SEQ ID NO: 3692927 - RNA, 19 nt, Salmonella enterica enterica serovar Typhi Ty2
gcgcaguucgccgccagga

SEQ ID NO: 3692928 - RNA, 21 nt, Salmonella enterica enterica serovar Typhi Ty2
gcgcaguuuacgcagcgccuu

SEQ ID NO: 3692929 - RNA, 20 nt, Salmonella enterica enterica serovar Typhi Ty2
gcgcauaaaaaaggccgcuu

SEQ ID NO: 3692930 - RNA, 19 nt, Salmonella enterica enterica serovar Typhi Ty2
gcgcauaccggccacgagc

SEQ ID NO: 3692931 - RNA, 23 nt, Salmonella enterica enterica serovar Typhi Ty2
gcgcauacgcuguccagucaaaa

SEQ ID NO: 3692932 - RNA, 23 nt, Salmonella enterica enterica serovar Typhi Ty2
gcgcauacucauuaccggcugcc

SEQ ID NO: 3692933 - RNA, 17 nt, Salmonella enterica enterica serovar Typhi Ty2
gcgcauaggcuuugcug

SEQ ID NO: 3692934 - RNA, 15 nt, Salmonella enterica enterica serovar Typhi Ty2
gcgcaucagaaaaac

SEQ ID NO: 3692935 - RNA, 12 nt, Salmonella enterica enterica serovar Typhi Ty2
gcgcaucaguac

SEQ ID NO: 3692936 - RNA, 15 nt, Salmonella enterica enterica serovar Typhi Ty2
gcgcaucauggucgu

SEQ ID NO: 3692937 - RNA, 19 nt, Salmonella enterica enterica serovar Typhi Ty2
gcgcaucccacaccacacg

SEQ ID NO: 3692938 - RNA, 17 nt, Salmonella enterica enterica serovar Typhi Ty2
gcgcauccgcggcgcuu

SEQ ID NO: 3692939 - RNA, 12 nt, Salmonella enterica enterica serovar Typhi Ty2
gcgcauccggca

SEQ ID NO: 3692940 - RNA, 22 nt, Salmonella enterica enterica serovar Typhi Ty2
gcgcauccgggccgcuagcugc

SEQ ID NO: 3692941 - RNA, 23 nt, Salmonella enterica enterica serovar Typhi Ty2
gcgcaucucccugccagugaaag

SEQ ID NO: 3692942 - RNA, 18 nt, Salmonella enterica enterica serovar Typhi Ty2
gcgcaugagcaaacugcu

SEQ ID NO: 3692943 - RNA, 11 nt, Salmonella enterica enterica serovar Typhi Ty2
gcgcauggcca

SEQ ID NO: 3692944 - RNA, 15 nt, Salmonella enterica enterica serovar Typhi Ty2
gcgcauguuagcaaa

SEQ ID NO: 3692945 - RNA, 14 nt, Salmonella enterica enterica serovar Typhi Ty2
gcgcauuaacgcca

SEQ ID NO: 3692946 - RNA, 21 nt, Salmonella enterica enterica serovar Typhi Ty2
gcgcauuaacgccaugcucau

SEQ ID NO: 3692947 - RNA, 15 nt, Salmonella enterica enterica serovar Typhi Ty2
gcgcauucaccccag

SEQ ID NO: 3692948 - RNA, 14 nt, Salmonella enterica enterica serovar Typhi Ty2
gcgcauucaggcga

SEQ ID NO: 3692949 - RNA, 15 nt, Salmonella enterica enterica serovar Typhi Ty2
gcgcauuccagaccc

SEQ ID NO: 3692950 - RNA, 16 nt, Salmonella enterica enterica serovar Typhi Ty2
gcgcauuccagacccg

SEQ ID NO: 3692951 - RNA, 21 nt, Salmonella enterica enterica serovar Typhi Ty2
gcgcauucucugucgccgccc

SEQ ID NO: 3692952 - RNA, 18 nt, Salmonella enterica enterica serovar Typhi Ty2
gcgcauugcgccccagca

SEQ ID NO: 3692953 - RNA, 19 nt, Salmonella enterica enterica serovar Typhi Ty2
gcgcauugcgcuauuacuc

SEQ ID NO: 3692954 - RNA, 17 nt, Salmonella enterica enterica serovar Typhi Ty2
gcgcauuucguggcgga

SEQ ID NO: 3692955 - RNA, 20 nt, Salmonella enterica enterica serovar Typhi Ty2
gcgcauuuuauuuaaaaagg

SEQ ID NO: 3692956 - RNA, 18 nt, Salmonella enterica enterica serovar Typhi Ty2
gcgccaaaagaggcagca

SEQ ID NO: 3692957 - RNA, 19 nt, Salmonella enterica enterica serovar Typhi Ty2
gcgccaaaagaggcagcaa

SEQ ID NO: 3692958 - RNA, 21 nt, Salmonella enterica enterica serovar Typhi Ty2
gcgccaaacgggcaagccagc

SEQ ID NO: 3692959 - RNA, 20 nt, Salmonella enterica enterica serovar Typhi Ty2
gcgccaaagcaaucgccagc

SEQ ID NO: 3692960 - RNA, 19 nt, Salmonella enterica enterica serovar Typhi Ty2
gcgccaaccgugagcgcgc

SEQ ID NO: 3692961 - RNA, 19 nt, Salmonella enterica enterica serovar Typhi Ty2
gcgccaacggccucccagc

SEQ ID NO: 3692962 - RNA, 16 nt, Salmonella enterica enterica serovar Typhi Ty2
gcgccaagaccgccua

SEQ ID NO: 3692963 - RNA, 15 nt, Salmonella enterica enterica serovar Typhi Ty2
gcgccaagcggcaac

SEQ ID NO: 3692964 - RNA, 21 nt, Salmonella enterica enterica serovar Typhi Ty2
gcgccccucuugcagcaagaa

SEQ ID NO: 3692965 - RNA, 20 nt, Salmonella enterica enterica serovar Typhi Ty2
gcgcccgacgcgccacuucc

SEQ ID NO: 3692966 - RNA, 17 nt, Salmonella enterica enterica serovar Typhi Ty2
gcgcccgagcgacgccc

SEQ ID NO: 3692967 - RNA, 15 nt, Salmonella enterica enterica serovar Typhi Ty2
gcgcccgccaccagc

SEQ ID NO: 3692968 - RNA, 12 nt, Salmonella enterica enterica serovar Typhi Ty2
gcgcccgccauc

SEQ ID NO: 3692969 - RNA, 19 nt, Salmonella enterica enterica serovar Typhi Ty2
gcgcccgccaucgcccggc

SEQ ID NO: 3692970 - RNA, 14 nt, Salmonella enterica enterica serovar Typhi Ty2
gcgcccgccgccaa

SEQ ID NO: 3692971 - RNA, 23 nt, Salmonella enterica enterica serovar Typhi Ty2
gcgcccgccugcuguaaccccug

SEQ ID NO: 3692972 - RNA, 13 nt, Salmonella enterica enterica serovar Typhi Ty2
gcgcccuccucca

SEQ ID NO: 3692973 - RNA, 15 nt, Salmonella enterica enterica serovar Typhi Ty2
gcgcccugcgggccg

SEQ ID NO: 3692974 - RNA, 21 nt, Salmonella enterica enterica serovar Typhi Ty2
gcgccgaaugcguuuuuucac

SEQ ID NO: 3692975 - RNA, 14 nt, Salmonella enterica enterica serovar Typhi Ty2
gcgccgacaggcuc

SEQ ID NO: 3692976 - RNA, 20 nt, Salmonella enterica enterica serovar Typhi Ty2
gcgccgacauagcugaacaa

SEQ ID NO: 3692977 - RNA, 16 nt, Salmonella enterica enterica serovar Typhi Ty2
gcgccgacaucgccac

SEQ ID NO: 3692978 - RNA, 19 nt, Salmonella enterica enterica serovar Typhi Ty2
gcgccgacaucgccaccgc

SEQ ID NO: 3692979 - RNA, 20 nt, Salmonella enterica enterica serovar Typhi Ty2
gcgccgauaaauccuccggc

SEQ ID NO: 3692980 - RNA, 15 nt, Salmonella enterica enterica serovar Typhi Ty2
gcgccgaucaucccg

SEQ ID NO: 3692981 - RNA, 16 nt, Salmonella enterica enterica serovar Typhi Ty2
gcgccgaucaucccgc

SEQ ID NO: 3692982 - RNA, 18 nt, Salmonella enterica enterica serovar Typhi Ty2
gcgccgcaaugccgccug

SEQ ID NO: 3692983 - RNA, 21 nt, Salmonella enterica enterica serovar Typhi Ty2
gcgccgccaacgauacagcac

SEQ ID NO: 3692984 - RNA, 15 nt, Salmonella enterica enterica serovar Typhi Ty2
gcgccgccagcgaca

SEQ ID NO: 3692985 - RNA, 22 nt, Salmonella enterica enterica serovar Typhi Ty2
gcgccgccagcgacauggcggu

SEQ ID NO: 3692986 - RNA, 14 nt, Salmonella enterica enterica serovar Typhi Ty2
gcgccgccauccgg

SEQ ID NO: 3692987 - RNA, 15 nt, Salmonella enterica enterica serovar Typhi Ty2
gcgccgccauccggc

SEQ ID NO: 3692988 - RNA, 19 nt, Salmonella enterica enterica serovar Typhi Ty2
gcgccgccauccggcacaa

SEQ ID NO: 3692989 - RNA, 23 nt, Salmonella enterica enterica serovar Typhi Ty2
gcgccgccgaacagacggcggcu

SEQ ID NO: 3692990 - RNA, 19 nt, Salmonella enterica enterica serovar Typhi Ty2
gcgccgcgacaacgccauc

SEQ ID NO: 3692991 - RNA, 15 nt, Salmonella enterica enterica serovar Typhi Ty2
gcgccgcgauacgga

SEQ ID NO: 3692992 - RNA, 13 nt, Salmonella enterica enterica serovar Typhi Ty2
gcgccgcgccacc

SEQ ID NO: 3692993 - RNA, 16 nt, Salmonella enterica enterica serovar Typhi Ty2
gcgccgcgccgccgua

SEQ ID NO: 3692994 - RNA, 12 nt, Salmonella enterica enterica serovar Typhi Ty2
gcgccgcucaca

SEQ ID NO: 3692995 - RNA, 15 nt, Salmonella enterica enterica serovar Typhi Ty2
gcgccgcucaucacc

SEQ ID NO: 3692996 - RNA, 23 nt, Salmonella enterica enterica serovar Typhi Ty2
gcgccgcuggcgaccagccugcc

SEQ ID NO: 3692997 - RNA, 15 nt, Salmonella enterica enterica serovar Typhi Ty2
gcgccgcuuccggca

SEQ ID NO: 3692998 - RNA, 14 nt, Salmonella enterica enterica serovar Typhi Ty2
gcgccggacagcag

SEQ ID NO: 3692999 - RNA, 16 nt, Salmonella enterica enterica serovar Typhi Ty2
gcgccggacgccacgc

SEQ ID NO: 3693000 - RNA, 18 nt, Salmonella enterica enterica serovar Typhi Ty2
gcgccggauaauccagac

SEQ ID NO: 3693001 - RNA, 18 nt, Salmonella enterica enterica serovar Typhi Ty2
gcgccggaucgggcuucc

SEQ ID NO: 3693002 - RNA, 19 nt, Salmonella enterica enterica serovar Typhi Ty2
gcgccggaucgggcuucca

SEQ ID NO: 3693003 - RNA, 17 nt, Salmonella enterica enterica serovar Typhi Ty2
gcgccggaugacggcag

SEQ ID NO: 3693004 - RNA, 16 nt, Salmonella enterica enterica serovar Typhi Ty2
gcgccggauuuaccag

SEQ ID NO: 3693005 - RNA, 13 nt, Salmonella enterica enterica serovar Typhi Ty2
gcgccggggcagc

SEQ ID NO: 3693006 - RNA, 19 nt, Salmonella enterica enterica serovar Typhi Ty2
gcgccggguuuggcgggcu

SEQ ID NO: 3693007 - RNA, 16 nt, Salmonella enterica enterica serovar Typhi Ty2
gcgccggucgccagca

SEQ ID NO: 3693008 - RNA, 16 nt, Salmonella enterica enterica serovar Typhi Ty2
gcgccgguuucuccag

SEQ ID NO: 3693009 - RNA, 21 nt, Salmonella enterica enterica serovar Typhi Ty2
gcgccgucaggcuugccgcgc

SEQ ID NO: 3693010 - RNA, 13 nt, Salmonella enterica enterica serovar Typhi Ty2
gcgccgucauccg

SEQ ID NO: 3693011 - RNA, 14 nt, Salmonella enterica enterica serovar Typhi Ty2
gcgccgucauccgc

SEQ ID NO: 3693012 - RNA, 15 nt, Salmonella enterica enterica serovar Typhi Ty2
gcgccguccauaaug

SEQ ID NO: 3693013 - RNA, 14 nt, Salmonella enterica enterica serovar Typhi Ty2
gcgccguccugcaa

SEQ ID NO: 3693014 - RNA, 21 nt, Salmonella enterica enterica serovar Typhi Ty2
gcgccgugcccagcaucccgc

SEQ ID NO: 3693015 - RNA, 17 nt, Salmonella enterica enterica serovar Typhi Ty2
gcgccguugaaaucggu

SEQ ID NO: 3693016 - RNA, 13 nt, Salmonella enterica enterica serovar Typhi Ty2
gcgccuaccgcca

SEQ ID NO: 3693017 - RNA, 17 nt, Salmonella enterica enterica serovar Typhi Ty2
gcgccuaccgccauaga

SEQ ID NO: 3693018 - RNA, 19 nt, Salmonella enterica enterica serovar Typhi Ty2
gcgccuccacaaagcgcga

SEQ ID NO: 3693019 - RNA, 17 nt, Salmonella enterica enterica serovar Typhi Ty2
gcgccuccccugccggc

SEQ ID NO: 3693020 - RNA, 23 nt, Salmonella enterica enterica serovar Typhi Ty2
gcgccuccgcguagcccagcgcc

SEQ ID NO: 3693021 - RNA, 14 nt, Salmonella enterica enterica serovar Typhi Ty2
gcgccucgcgcggc

SEQ ID NO: 3693022 - RNA, 16 nt, Salmonella enterica enterica serovar Typhi Ty2
gcgccugacgcggacg

SEQ ID NO: 3693023 - RNA, 17 nt, Salmonella enterica enterica serovar Typhi Ty2
gcgccugaugccgccgu

SEQ ID NO: 3693024 - RNA, 14 nt, Salmonella enterica enterica serovar Typhi Ty2
gcgccugccauagc

SEQ ID NO: 3693025 - RNA, 13 nt, Salmonella enterica enterica serovar Typhi Ty2
gcgccugcgcggc

SEQ ID NO: 3693026 - RNA, 14 nt, Salmonella enterica enterica serovar Typhi Ty2
gcgccugcgcugca

SEQ ID NO: 3693027 - RNA, 16 nt, Salmonella enterica enterica serovar Typhi Ty2
gcgccugcucagcauu

SEQ ID NO: 3693028 - RNA, 14 nt, Salmonella enterica enterica serovar Typhi Ty2
gcgccugcucccgc

SEQ ID NO: 3693029 - RNA, 18 nt, Salmonella enterica enterica serovar Typhi Ty2
gcgccugcugccagccgc

SEQ ID NO: 3693030 - RNA, 14 nt, Salmonella enterica enterica serovar Typhi Ty2
gcgccugcugccug

SEQ ID NO: 3693031 - RNA, 22 nt, Salmonella enterica enterica serovar Typhi Ty2
gcgccugucuccagcgccgcuu

SEQ ID NO: 3693032 - RNA, 16 nt, Salmonella enterica enterica serovar Typhi Ty2
gcgccuguuagggcgc

SEQ ID NO: 3693033 - RNA, 19 nt, Salmonella enterica enterica serovar Typhi Ty2
gcgccuguuagggcgcggc

SEQ ID NO: 3693034 - RNA, 21 nt, Salmonella enterica enterica serovar Typhi Ty2
gcgccuguuagggcgcggcug

SEQ ID NO: 3693035 - RNA, 23 nt, Salmonella enterica enterica serovar Typhi Ty2
gcgccuguuagggcgcggcuggu

SEQ ID NO: 3693036 - RNA, 23 nt, Salmonella enterica enterica serovar Typhi Ty2
gcgccuuaaaccgucgggcgucg

SEQ ID NO: 3693037 - RNA, 14 nt, Salmonella enterica enterica serovar Typhi Ty2
gcgccuuauccggc

SEQ ID NO: 3693038 - RNA, 19 nt, Salmonella enterica enterica serovar Typhi Ty2
gcgccuuaucgaccaggcg

SEQ ID NO: 3693039 - RNA, 14 nt, Salmonella enterica enterica serovar Typhi Ty2
gcgccuucaggcau

SEQ ID NO: 3693040 - RNA, 15 nt, Salmonella enterica enterica serovar Typhi Ty2
gcgccuuccagcaau

SEQ ID NO: 3693041 - RNA, 13 nt, Salmonella enterica enterica serovar Typhi Ty2
gcgccuuccggga

SEQ ID NO: 3693042 - RNA, 23 nt, Salmonella enterica enterica serovar Typhi Ty2
gcgccuucgcggugaucccaggc

SEQ ID NO: 3693043 - RNA, 20 nt, Salmonella enterica enterica serovar Typhi Ty2
gcgccuugucugaccgggcg

SEQ ID NO: 3693044 - RNA, 23 nt, Salmonella enterica enterica serovar Typhi Ty2
gcgccuuuaauuccgccgggcaa

SEQ ID NO: 3693045 - RNA, 14 nt, Salmonella enterica enterica serovar Typhi Ty2
gcgccuuuccggcc

SEQ ID NO: 3693046 - RNA, 17 nt, Salmonella enterica enterica serovar Typhi Ty2
gcgcguccucacacuga

SEQ ID NO: 3693047 - RNA, 16 nt, Salmonella enterica enterica serovar Typhi Ty2
gcgcguccuuauaaug

SEQ ID NO: 3693048 - RNA, 17 nt, Salmonella enterica enterica serovar Typhi Ty2
gcgcguccuuauaaugc

SEQ ID NO: 3693049 - RNA, 13 nt, Salmonella enterica enterica serovar Typhi Ty2
gcgcgucgccuga

SEQ ID NO: 3693050 - RNA, 22 nt, Salmonella enterica enterica serovar Typhi Ty2
gcgcgugaccccaggcauagaa

SEQ ID NO: 3693051 - RNA, 13 nt, Salmonella enterica enterica serovar Typhi Ty2
gcgcgugcggcgg

SEQ ID NO: 3693052 - RNA, 13 nt, Salmonella enterica enterica serovar Typhi Ty2
gcgcguggcuucc

SEQ ID NO: 3693053 - RNA, 22 nt, Salmonella enterica enterica serovar Typhi Ty2
gcgcguuaucguagugccacaa

SEQ ID NO: 3693054 - RNA, 17 nt, Salmonella enterica enterica serovar Typhi Ty2
gcgcguuccccaacagc

SEQ ID NO: 3693055 - RNA, 15 nt, Salmonella enterica enterica serovar Typhi Ty2
gcgcguucgccguca

SEQ ID NO: 3693056 - RNA, 23 nt, Salmonella enterica enterica serovar Typhi Ty2
gcgcguuguccaacugucgccau

SEQ ID NO: 3693057 - RNA, 19 nt, Salmonella enterica enterica serovar Typhi Ty2
gcgcguuuagcgccagcag

SEQ ID NO: 3693058 - RNA, 20 nt, Salmonella enterica enterica serovar Typhi Ty2
gcgcguuuagcgccagcagc

SEQ ID NO: 3693059 - RNA, 18 nt, Salmonella enterica enterica serovar Typhi Ty2
gcgcguuuuccaucauca

SEQ ID NO: 3693060 - RNA, 15 nt, Salmonella enterica enterica serovar Typhi Ty2
gcgcuaacgcgaaga

SEQ ID NO: 3693061 - RNA, 15 nt, Salmonella enterica enterica serovar Typhi Ty2
gcgcuaacggcggua

SEQ ID NO: 3693062 - RNA, 22 nt, Salmonella enterica enterica serovar Typhi Ty2
gcgcuaagcgcccguagcucag

SEQ ID NO: 3693063 - RNA, 19 nt, Salmonella enterica enterica serovar Typhi Ty2
gcgcuaauguacgccuaaa

SEQ ID NO: 3693064 - RNA, 17 nt, Salmonella enterica enterica serovar Typhi Ty2
gcgcuaauguggauagu

SEQ ID NO: 3693065 - RNA, 13 nt, Salmonella enterica enterica serovar Typhi Ty2
gcgcuacauccgc

SEQ ID NO: 3693066 - RNA, 15 nt, Salmonella enterica enterica serovar Typhi Ty2
gcgcuacauccgcca

SEQ ID NO: 3693067 - RNA, 16 nt, Salmonella enterica enterica serovar Typhi Ty2
gcgcuacauccgccag

SEQ ID NO: 3693068 - RNA, 12 nt, Salmonella enterica enterica serovar Typhi Ty2
gcgcuaccagcg

SEQ ID NO: 3693069 - RNA, 20 nt, Salmonella enterica enterica serovar Typhi Ty2
gcgcuacgcuuaucaggccu

SEQ ID NO: 3693070 - RNA, 22 nt, Salmonella enterica enterica serovar Typhi Ty2
gcgcuagcuuaucgggccuacc

SEQ ID NO: 3693071 - RNA, 18 nt, Salmonella enterica enterica serovar Typhi Ty2
gcgcuagugccgccaggc

SEQ ID NO: 3693072 - RNA, 22 nt, Salmonella enterica enterica serovar Typhi Ty2
gcgcuaucaaaaugcaccggcg

SEQ ID NO: 3693073 - RNA, 23 nt, Salmonella enterica enterica serovar Typhi Ty2
gcgcuaucaggaagaacacgccg

SEQ ID NO: 3693074 - RNA, 16 nt, Salmonella enterica enterica serovar Typhi Ty2
gcgcuaucgguaucau

SEQ ID NO: 3693075 - RNA, 17 nt, Salmonella enterica enterica serovar Typhi Ty2
gcgcuaucgguaucaug

SEQ ID NO: 3693076 - RNA, 13 nt, Salmonella enterica enterica serovar Typhi Ty2
gcgcuaucuucaa

SEQ ID NO: 3693077 - RNA, 18 nt, Salmonella enterica enterica serovar Typhi Ty2
gcgcuaugcgcuccagga

SEQ ID NO: 3693078 - RNA, 23 nt, Salmonella enterica enterica serovar Typhi Ty2
gcgcuauucccaggcaaaugauu

SEQ ID NO: 3693079 - RNA, 14 nt, Salmonella enterica enterica serovar Typhi Ty2
gcgcucaaaugguc

SEQ ID NO: 3693080 - RNA, 20 nt, Salmonella enterica enterica serovar Typhi Ty2
gcgcucaacacauaacgccc

SEQ ID NO: 3693081 - RNA, 13 nt, Salmonella enterica enterica serovar Typhi Ty2
gcgcucaagcgaa

SEQ ID NO: 3693082 - RNA, 15 nt, Salmonella enterica enterica serovar Typhi Ty2
gcgcucaauagccag

SEQ ID NO: 3693083 - RNA, 16 nt, Salmonella enterica enterica serovar Typhi Ty2
gcgcucaggaucgccg

SEQ ID NO: 3693084 - RNA, 20 nt, Salmonella enterica enterica serovar Typhi Ty2
gcgcucauacgaucgcgcac

SEQ ID NO: 3693085 - RNA, 12 nt, Salmonella enterica enterica serovar Typhi Ty2
gcgcucaucagg

SEQ ID NO: 3693086 - RNA, 15 nt, Salmonella enterica enterica serovar Typhi Ty2
gcgcucaucaggccu

SEQ ID NO: 3693087 - RNA, 12 nt, Salmonella enterica enterica serovar Typhi Ty2
gcgcucaugcca

SEQ ID NO: 3693088 - RNA, 19 nt, Salmonella enterica enterica serovar Typhi Ty2
gcgcuccaccaaccaggca

SEQ ID NO: 3693089 - RNA, 19 nt, Salmonella enterica enterica serovar Typhi Ty2
gcgcuccagaccaccagcg

SEQ ID NO: 3693090 - RNA, 12 nt, Salmonella enterica enterica serovar Typhi Ty2
gcgcuccaggau

SEQ ID NO: 3693091 - RNA, 14 nt, Salmonella enterica enterica serovar Typhi Ty2
gcgcuccgacugaa

SEQ ID NO: 3693092 - RNA, 16 nt, Salmonella enterica enterica serovar Typhi Ty2
gcgcuccggcgcuggc

SEQ ID NO: 3693093 - RNA, 16 nt, Salmonella enterica enterica serovar Typhi Ty2
gcgcuccugucaggcg

SEQ ID NO: 3693094 - RNA, 18 nt, Salmonella enterica enterica serovar Typhi Ty2
gcgcuccugucaggcgag

SEQ ID NO: 3693095 - RNA, 15 nt, Salmonella enterica enterica serovar Typhi Ty2
gcgcucuaucaccgc

SEQ ID NO: 3693096 - RNA, 19 nt, Salmonella enterica enterica serovar Typhi Ty2
gcgcucuaucaccgcccgc

SEQ ID NO: 3693097 - RNA, 16 nt, Salmonella enterica enterica serovar Typhi Ty2
gcgcucuuccgccagc

SEQ ID NO: 3693098 - RNA, 21 nt, Salmonella enterica enterica serovar Typhi Ty2
gcgcucuuuuucuuuucuccg

SEQ ID NO: 3693099 - RNA, 14 nt, Salmonella enterica enterica serovar Typhi Ty2
gcgcucuuuuuuaa

SEQ ID NO: 3693100 - RNA, 18 nt, Salmonella enterica enterica serovar Typhi Ty2
gcgcugaauagcgaccuu

SEQ ID NO: 3693101 - RNA, 17 nt, Salmonella enterica enterica serovar Typhi Ty2
gcgcugaggcgcuggcu

SEQ ID NO: 3693102 - RNA, 15 nt, Salmonella enterica enterica serovar Typhi Ty2
gcgcugagucauccu

SEQ ID NO: 3693103 - RNA, 17 nt, Salmonella enterica enterica serovar Typhi Ty2
gcgcugaguuucucccg

SEQ ID NO: 3693104 - RNA, 13 nt, Salmonella enterica enterica serovar Typhi Ty2
gcgcugaugaaaa

SEQ ID NO: 3693105 - RNA, 17 nt, Salmonella enterica enterica serovar Typhi Ty2
gcgcugaugcagcuugc

SEQ ID NO: 3693106 - RNA, 21 nt, Salmonella enterica enterica serovar Typhi Ty2
gcgcugauuuucuccagcaga

SEQ ID NO: 3693107 - RNA, 18 nt, Salmonella enterica enterica serovar Typhi Ty2
gcgcugcauuugcugccg

SEQ ID NO: 3693108 - RNA, 23 nt, Salmonella enterica enterica serovar Typhi Ty2
gcgcugccgucaaugccuggcag

SEQ ID NO: 3693109 - RNA, 21 nt, Salmonella enterica enterica serovar Typhi Ty2
gcgcugcgccagaucaggcgu

SEQ ID NO: 3693110 - RNA, 18 nt, Salmonella enterica enterica serovar Typhi Ty2
gcgcugcgcggcgugcag

SEQ ID NO: 3693111 - RNA, 22 nt, Salmonella enterica enterica serovar Typhi Ty2
gcgcugcgcuuaccgggccuac

SEQ ID NO: 3693112 - RNA, 16 nt, Salmonella enterica enterica serovar Typhi Ty2
gcgcugcggcuacacg

SEQ ID NO: 3693113 - RNA, 20 nt, Salmonella enterica enterica serovar Typhi Ty2
gcgcugcggguagucaucgc

SEQ ID NO: 3693114 - RNA, 18 nt, Salmonella enterica enterica serovar Typhi Ty2
gcgcugcguuuaucaggc

SEQ ID NO: 3693115 - RNA, 20 nt, Salmonella enterica enterica serovar Typhi Ty2
gcgcugcguuuaucaggccu

SEQ ID NO: 3693116 - RNA, 13 nt, Salmonella enterica enterica serovar Typhi Ty2
gcgcuggaggcgg

SEQ ID NO: 3693117 - RNA, 18 nt, Salmonella enterica enterica serovar Typhi Ty2
gcgcuggcaguuugcgcu

SEQ ID NO: 3693118 - RNA, 14 nt, Salmonella enterica enterica serovar Typhi Ty2
gcgcuggcgagcga

SEQ ID NO: 3693119 - RNA, 23 nt, Salmonella enterica enterica serovar Typhi Ty2
gcgcuggcgcacgcgucaucggc

SEQ ID NO: 3693120 - RNA, 20 nt, Salmonella enterica enterica serovar Typhi Ty2
gcgcuggcgccgcaaaccag

SEQ ID NO: 3693121 - RNA, 14 nt, Salmonella enterica enterica serovar Typhi Ty2
gcgcuggcggcgac

SEQ ID NO: 3693122 - RNA, 12 nt, Salmonella enterica enterica serovar Typhi Ty2
gcgcuggcguga

SEQ ID NO: 3693123 - RNA, 19 nt, Salmonella enterica enterica serovar Typhi Ty2
gcgcuggcugaaucccugu

SEQ ID NO: 3693124 - RNA, 17 nt, Salmonella enterica enterica serovar Typhi Ty2
gcgcuggcuugaccgcu

SEQ ID NO: 3693125 - RNA, 20 nt, Salmonella enterica enterica serovar Typhi Ty2
gcgcuggggguaggauaaaa

SEQ ID NO: 3693126 - RNA, 16 nt, Salmonella enterica enterica serovar Typhi Ty2
gcgcugguagcaccga

SEQ ID NO: 3693127 - RNA, 16 nt, Salmonella enterica enterica serovar Typhi Ty2
gcgcuguacgccucuu

SEQ ID NO: 3693128 - RNA, 19 nt, Salmonella enterica enterica serovar Typhi Ty2
gcggauugccauacacgcg

SEQ ID NO: 3693129 - RNA, 13 nt, Salmonella enterica enterica serovar Typhi Ty2
gcggauugccgcg

SEQ ID NO: 3693130 - RNA, 13 nt, Salmonella enterica enterica serovar Typhi Ty2
gcggcaaaagagg

SEQ ID NO: 3693131 - RNA, 16 nt, Salmonella enterica enterica serovar Typhi Ty2
gcggcaaaauugauuc

SEQ ID NO: 3693132 - RNA, 16 nt, Salmonella enterica enterica serovar Typhi Ty2
gcggcaaagauaaucu

SEQ ID NO: 3693133 - RNA, 20 nt, Salmonella enterica enterica serovar Typhi Ty2
gcggcaaagauaaucugaau

SEQ ID NO: 3693134 - RNA, 23 nt, Salmonella enterica enterica serovar Typhi Ty2
gcggcaacccuuuggccaccagc

SEQ ID NO: 3693135 - RNA, 22 nt, Salmonella enterica enterica serovar Typhi Ty2
gcggcaauggccgcagcgccau

SEQ ID NO: 3693136 - RNA, 23 nt, Salmonella enterica enterica serovar Typhi Ty2
gcggcaauggccgcagcgccaua

SEQ ID NO: 3693137 - RNA, 15 nt, Salmonella enterica enterica serovar Typhi Ty2
gcggcaauuuguagc

SEQ ID NO: 3693138 - RNA, 20 nt, Salmonella enterica enterica serovar Typhi Ty2
gcggcacacuuucaucagcc

SEQ ID NO: 3693139 - RNA, 14 nt, Salmonella enterica enterica serovar Typhi Ty2
gcggcacaucgcgc

SEQ ID NO: 3693140 - RNA, 19 nt, Salmonella enterica enterica serovar Typhi Ty2
gcggcacuggcguagucuc

SEQ ID NO: 3693141 - RNA, 19 nt, Salmonella enterica enterica serovar Typhi Ty2
gcggcagaauuaacucauc

SEQ ID NO: 3693142 - RNA, 24 nt, Salmonella enterica enterica serovar Typhi Ty2
gcggcagaauuaacucaucacagc

SEQ ID NO: 3693143 - RNA, 22 nt, Salmonella enterica enterica serovar Typhi Ty2
gcggcaggauccccaucccaau

SEQ ID NO: 3693144 - RNA, 13 nt, Salmonella enterica enterica serovar Typhi Ty2
gcggcaggcaaaa

SEQ ID NO: 3693145 - RNA, 17 nt, Salmonella enterica enterica serovar Typhi Ty2
gcggcagggcagcgagc

SEQ ID NO: 3693146 - RNA, 20 nt, Salmonella enterica enterica serovar Typhi Ty2
gcggcagggcggucugguac

SEQ ID NO: 3693147 - RNA, 19 nt, Salmonella enterica enterica serovar Typhi Ty2
gcggcaggugagggcgucg

SEQ ID NO: 3693148 - RNA, 21 nt, Salmonella enterica enterica serovar Typhi Ty2
gcggcaguacgagcauccaga

SEQ ID NO: 3693149 - RNA, 22 nt, Salmonella enterica enterica serovar Typhi Ty2
gcggcaguacgagcauccagau

SEQ ID NO: 3693150 - RNA, 15 nt, Salmonella enterica enterica serovar Typhi Ty2
gcggcaguuccggcg

SEQ ID NO: 3693151 - RNA, 18 nt, Salmonella enterica enterica serovar Typhi Ty2
gcggcauaauaugccgga

SEQ ID NO: 3693152 - RNA, 18 nt, Salmonella enterica enterica serovar Typhi Ty2
gcggcauacuuucgcgcg

SEQ ID NO: 3693153 - RNA, 16 nt, Salmonella enterica enterica serovar Typhi Ty2
gcggcaucaggcauag

SEQ ID NO: 3693154 - RNA, 19 nt, Salmonella enterica enterica serovar Typhi Ty2
gcggcaucucgccaaacca

SEQ ID NO: 3693155 - RNA, 16 nt, Salmonella enterica enterica serovar Typhi Ty2
gcggcaugauccacca

SEQ ID NO: 3693156 - RNA, 23 nt, Salmonella enterica enterica serovar Typhi Ty2
gcggcaugauccaccaucggcgc

SEQ ID NO: 3693157 - RNA, 19 nt, Salmonella enterica enterica serovar Typhi Ty2
gcggcauuggcguuaccgg

SEQ ID NO: 3693158 - RNA, 18 nt, Salmonella enterica enterica serovar Typhi Ty2
gcggccaaagggagcaga

SEQ ID NO: 3693159 - RNA, 13 nt, Salmonella enterica enterica serovar Typhi Ty2
gcggccagauaag

SEQ ID NO: 3693160 - RNA, 12 nt, Salmonella enterica enterica serovar Typhi Ty2
gcggccagcaug

SEQ ID NO: 3693161 - RNA, 13 nt, Salmonella enterica enterica serovar Typhi Ty2
gcggccagcgccu

SEQ ID NO: 3693162 - RNA, 16 nt, Salmonella enterica enterica serovar Typhi Ty2
gcggccagcgggcguc

SEQ ID NO: 3693163 - RNA, 21 nt, Salmonella enterica enterica serovar Typhi Ty2
gcggccaggcaaagauccacc

SEQ ID NO: 3693164 - RNA, 20 nt, Salmonella enterica enterica serovar Typhi Ty2
gcggccaguuguucuuucac

SEQ ID NO: 3693165 - RNA, 13 nt, Salmonella enterica enterica serovar Typhi Ty2
gcggccauccugc

SEQ ID NO: 3693166 - RNA, 11 nt, Salmonella enterica enterica serovar Typhi Ty2
gcggcccaaug

SEQ ID NO: 3693167 - RNA, 14 nt, Salmonella enterica enterica serovar Typhi Ty2
gcggcccgcgcuga

SEQ ID NO: 3693168 - RNA, 15 nt, Salmonella enterica enterica serovar Typhi Ty2
gcggcccgcgcugaa

SEQ ID NO: 3693169 - RNA, 23 nt, Salmonella enterica enterica serovar Typhi Ty2
gcggcccgugguuuuacugcaag

SEQ ID NO: 3693170 - RNA, 16 nt, Salmonella enterica enterica serovar Typhi Ty2
gcggccgcuccgggcc

SEQ ID NO: 3693171 - RNA, 19 nt, Salmonella enterica enterica serovar Typhi Ty2
gcggccuaaaucgcugcug

SEQ ID NO: 3693172 - RNA, 21 nt, Salmonella enterica enterica serovar Typhi Ty2
gcggccuaaaucgcugcugau

SEQ ID NO: 3693173 - RNA, 21 nt, Salmonella enterica enterica serovar Typhi Ty2
gcggccuaugacuauaucagc

SEQ ID NO: 3693174 - RNA, 13 nt, Salmonella enterica enterica serovar Typhi Ty2
gcggccuccggau

SEQ ID NO: 3693175 - RNA, 14 nt, Salmonella enterica enterica serovar Typhi Ty2
gcggccugcgugcg

SEQ ID NO: 3693176 - RNA, 21 nt, Salmonella enterica enterica serovar Typhi Ty2
gcggccuuuauccagcggcgc

SEQ ID NO: 3693177 - RNA, 20 nt, Salmonella enterica enterica serovar Typhi Ty2
gcggcgaaauauuaucgcca

SEQ ID NO: 3693178 - RNA, 20 nt, Salmonella enterica enterica serovar Typhi Ty2
gcggcgaagcaucuuuccgg

SEQ ID NO: 3693179 - RNA, 22 nt, Salmonella enterica enterica serovar Typhi Ty2
gcggcgaauauagcuaaugcaa

SEQ ID NO: 3693180 - RNA, 19 nt, Salmonella enterica enterica serovar Typhi Ty2
gcggcgacacaacggcaca

SEQ ID NO: 3693181 - RNA, 14 nt, Salmonella enterica enterica serovar Typhi Ty2
gcggcgacaccagc

SEQ ID NO: 3693182 - RNA, 15 nt, Salmonella enterica enterica serovar Typhi Ty2
gcggcgacaccagcg

SEQ ID NO: 3693183 - RNA, 15 nt, Salmonella enterica enterica serovar Typhi Ty2
gcggcgacaucgcca

SEQ ID NO: 3693184 - RNA, 20 nt, Salmonella enterica enterica serovar Typhi Ty2
gcggcgaguuguuucaacau

SEQ ID NO: 3693185 - RNA, 21 nt, Salmonella enterica enterica serovar Typhi Ty2
gcggcgauuuauagagcagca

SEQ ID NO: 3693186 - RNA, 22 nt, Salmonella enterica enterica serovar Typhi Ty2
gcggcgcacugccugauggcgc

SEQ ID NO: 3693187 - RNA, 16 nt, Salmonella enterica enterica serovar Typhi Ty2
gcggcgcagcgcgcga

SEQ ID NO: 3693188 - RNA, 14 nt, Salmonella enterica enterica serovar Typhi Ty2
gcggcgccaguacu

SEQ ID NO: 3693189 - RNA, 15 nt, Salmonella enterica enterica serovar Typhi Ty2
gcggcgccaucgccu

SEQ ID NO: 3693190 - RNA, 18 nt, Salmonella enterica enterica serovar Typhi Ty2
gcggcgccgaagcaggcg

SEQ ID NO: 3693191 - RNA, 13 nt, Salmonella enterica enterica serovar Typhi Ty2
gcggcgcgcccgg

SEQ ID NO: 3693192 - RNA, 22 nt, Salmonella enterica enterica serovar Typhi Ty2
gcggcgcgucuucccggcgcuc

SEQ ID NO: 3693193 - RNA, 15 nt, Salmonella enterica enterica serovar Typhi Ty2
gcggcgcuauccggc

SEQ ID NO: 3693194 - RNA, 17 nt, Salmonella enterica enterica serovar Typhi Ty2
gcggcgcuauccggcau

SEQ ID NO: 3693195 - RNA, 21 nt, Salmonella enterica enterica serovar Typhi Ty2
gcggcgcuuccagacuacgga

SEQ ID NO: 3693196 - RNA, 13 nt, Salmonella enterica enterica serovar Typhi Ty2
gcggcggaaugcu

SEQ ID NO: 3693197 - RNA, 18 nt, Salmonella enterica enterica serovar Typhi Ty2
gcggcggcaagcuggcga

SEQ ID NO: 3693198 - RNA, 18 nt, Salmonella enterica enterica serovar Typhi Ty2
gcggcggucugcgccugc

SEQ ID NO: 3693199 - RNA, 19 nt, Salmonella enterica enterica serovar Typhi Ty2
gcggcgguuauccgccagc

SEQ ID NO: 3693200 - RNA, 21 nt, Salmonella enterica enterica serovar Typhi Ty2
gcggcgguuauccgccagcgc

SEQ ID NO: 3693201 - RNA, 15 nt, Salmonella enterica enterica serovar Typhi Ty2
gcggcgguucauccu

SEQ ID NO: 3693202 - RNA, 21 nt, Salmonella enterica enterica serovar Typhi Ty2
gcggcguaaaagcgauaaaga

SEQ ID NO: 3693203 - RNA, 22 nt, Salmonella enterica enterica serovar Typhi Ty2
gcggcguaaacacguuaucuga

SEQ ID NO: 3693204 - RNA, 14 nt, Salmonella enterica enterica serovar Typhi Ty2
gcggcguaaacgcc

SEQ ID NO: 3693205 - RNA, 19 nt, Salmonella enterica enterica serovar Typhi Ty2
gcggcguacacuucauccg

SEQ ID NO: 3693206 - RNA, 18 nt, Salmonella enterica enterica serovar Typhi Ty2
gcggcguaccgcgcgccc

SEQ ID NO: 3693207 - RNA, 21 nt, Salmonella enterica enterica serovar Typhi Ty2
gcggcguaccgcgcgcccgac

SEQ ID NO: 3693208 - RNA, 16 nt, Salmonella enterica enterica serovar Typhi Ty2
gcggcguagccgccga

SEQ ID NO: 3693209 - RNA, 20 nt, Salmonella enterica enterica serovar Typhi Ty2
gcggcguaucauagcggcua

SEQ ID NO: 3693210 - RNA, 14 nt, Salmonella enterica enterica serovar Typhi Ty2
gcggugaagcagaa

SEQ ID NO: 3693211 - RNA, 20 nt, Salmonella enterica enterica serovar Typhi Ty2
gcggugaucccaggccggca

SEQ ID NO: 3693212 - RNA, 22 nt, Salmonella enterica enterica serovar Typhi Ty2
gcggugcagguugccugauggc

SEQ ID NO: 3693213 - RNA, 15 nt, Salmonella enterica enterica serovar Typhi Ty2
gcgguggcgcacagu

SEQ ID NO: 3693214 - RNA, 23 nt, Salmonella enterica enterica serovar Typhi Ty2
gcggugucgauacgauugcgcgu

SEQ ID NO: 3693215 - RNA, 16 nt, Salmonella enterica enterica serovar Typhi Ty2
gcgguuaacagccgcu

SEQ ID NO: 3693216 - RNA, 19 nt, Salmonella enterica enterica serovar Typhi Ty2
gcgguuaugcgggauauaa

SEQ ID NO: 3693217 - RNA, 18 nt, Salmonella enterica enterica serovar Typhi Ty2
gcgguucaaucacgcgua

SEQ ID NO: 3693218 - RNA, 15 nt, Salmonella enterica enterica serovar Typhi Ty2
gcgguucucccggca

SEQ ID NO: 3693219 - RNA, 14 nt, Salmonella enterica enterica serovar Typhi Ty2
gcgguucuuuugcu

SEQ ID NO: 3693220 - RNA, 15 nt, Salmonella enterica enterica serovar Typhi Ty2
gcgguugcagcaaaa

SEQ ID NO: 3693221 - RNA, 23 nt, Salmonella enterica enterica serovar Typhi Ty2
gcgguuuaaugcuaucccaggcg

SEQ ID NO: 3693222 - RNA, 13 nt, Salmonella enterica enterica serovar Typhi Ty2
gcgguuuacgcca

SEQ ID NO: 3693223 - RNA, 20 nt, Salmonella enterica enterica serovar Typhi Ty2
gcgguuuauccccgcuggcg

SEQ ID NO: 3693224 - RNA, 18 nt, Salmonella enterica enterica serovar Typhi Ty2
gcgguuucguggcgcugu

SEQ ID NO: 3693225 - RNA, 14 nt, Salmonella enterica enterica serovar Typhi Ty2
gcguaaaaauuuuc

SEQ ID NO: 3693226 - RNA, 15 nt, Salmonella enterica enterica serovar Typhi Ty2
gcguaaaaccgcgcu

SEQ ID NO: 3693227 - RNA, 22 nt, Salmonella enterica enterica serovar Typhi Ty2
gcguaaaagcgauaaagacagg

SEQ ID NO: 3693228 - RNA, 16 nt, Salmonella enterica enterica serovar Typhi Ty2
gcguaaacaggcgcgg

SEQ ID NO: 3693229 - RNA, 16 nt, Salmonella enterica enterica serovar Typhi Ty2
gcguaaacuuccgcca

SEQ ID NO: 3693230 - RNA, 14 nt, Salmonella enterica enterica serovar Typhi Ty2
gcguaaagauuguu

SEQ ID NO: 3693231 - RNA, 17 nt, Salmonella enterica enterica serovar Typhi Ty2
gcguaacagcgguauac

SEQ ID NO: 3693232 - RNA, 14 nt, Salmonella enterica enterica serovar Typhi Ty2
gcguaacgccacau

SEQ ID NO: 3693233 - RNA, 18 nt, Salmonella enterica enterica serovar Typhi Ty2
gcguaacgccuccaccgu

SEQ ID NO: 3693234 - RNA, 21 nt, Salmonella enterica enterica serovar Typhi Ty2
gcguaagguauuuagccguuc

SEQ ID NO: 3693235 - RNA, 22 nt, Salmonella enterica enterica serovar Typhi Ty2
gcguaauaugaauauccgccgc

SEQ ID NO: 3693236 - RNA, 21 nt, Salmonella enterica enterica serovar Typhi Ty2
gcguaauccggccuggcgcag

SEQ ID NO: 3693237 - RNA, 18 nt, Salmonella enterica enterica serovar Typhi Ty2
gcguaaucggcaggccaa

SEQ ID NO: 3693238 - RNA, 17 nt, Salmonella enterica enterica serovar Typhi Ty2
gcguaaugcgccaggca

SEQ ID NO: 3693239 - RNA, 21 nt, Salmonella enterica enterica serovar Typhi Ty2
gcguaaugcgccaggcagcac

SEQ ID NO: 3693240 - RNA, 13 nt, Salmonella enterica enterica serovar Typhi Ty2
gcguaauuccgca

SEQ ID NO: 3693241 - RNA, 17 nt, Salmonella enterica enterica serovar Typhi Ty2
gcguaauuuuuccaguu

SEQ ID NO: 3693242 - RNA, 18 nt, Salmonella enterica enterica serovar Typhi Ty2
gcguacaauggcaggcau

SEQ ID NO: 3693243 - RNA, 14 nt, Salmonella enterica enterica serovar Typhi Ty2
gcguacagcgccau

SEQ ID NO: 3693244 - RNA, 16 nt, Salmonella enterica enterica serovar Typhi Ty2
gcguacaggcggauga

SEQ ID NO: 3693245 - RNA, 15 nt, Salmonella enterica enterica serovar Typhi Ty2
gcguaccacgccgca

SEQ ID NO: 3693246 - RNA, 18 nt, Salmonella enterica enterica serovar Typhi Ty2
gcguaccagaaacagcgc

SEQ ID NO: 3693247 - RNA, 20 nt, Salmonella enterica enterica serovar Typhi Ty2
gcguaccagaaacagcgcgc

SEQ ID NO: 3693248 - RNA, 15 nt, Salmonella enterica enterica serovar Typhi Ty2
gcguaccaucagcgu

SEQ ID NO: 3693249 - RNA, 12 nt, Salmonella enterica enterica serovar Typhi Ty2
gcguacccgcgg

SEQ ID NO: 3693250 - RNA, 14 nt, Salmonella enterica enterica serovar Typhi Ty2
gcguaccgccuugu

SEQ ID NO: 3693251 - RNA, 15 nt, Salmonella enterica enterica serovar Typhi Ty2
gcguaccgcgcgccc

SEQ ID NO: 3693252 - RNA, 15 nt, Salmonella enterica enterica serovar Typhi Ty2
gcguacucagcagac

SEQ ID NO: 3693253 - RNA, 21 nt, Salmonella enterica enterica serovar Typhi Ty2
gcguacugcccguggcggagg

SEQ ID NO: 3693254 - RNA, 19 nt, Salmonella enterica enterica serovar Typhi Ty2
gcguacuuucacuaccacu

SEQ ID NO: 3693255 - RNA, 19 nt, Salmonella enterica enterica serovar Typhi Ty2
gcguacuuucgccaguuca

SEQ ID NO: 3693256 - RNA, 13 nt, Salmonella enterica enterica serovar Typhi Ty2
gcguagagagcgg

SEQ ID NO: 3693257 - RNA, 18 nt, Salmonella enterica enterica serovar Typhi Ty2
gcguagagaggcauccgc

SEQ ID NO: 3693258 - RNA, 16 nt, Salmonella enterica enterica serovar Typhi Ty2
gcguagccaacacaua

SEQ ID NO: 3693259 - RNA, 22 nt, Salmonella enterica enterica serovar Typhi Ty2
gcguagcgagucaaaccucacg

SEQ ID NO: 3693260 - RNA, 18 nt, Salmonella enterica enterica serovar Typhi Ty2
gcguagcgcauccggcag

SEQ ID NO: 3693261 - RNA, 19 nt, Salmonella enterica enterica serovar Typhi Ty2
gcguagcgucuuauccggc

SEQ ID NO: 3693262 - RNA, 21 nt, Salmonella enterica enterica serovar Typhi Ty2
gcguagcuggccuucuccacu

SEQ ID NO: 3693263 - RNA, 18 nt, Salmonella enterica enterica serovar Typhi Ty2
gcguaggguagaucacgc

SEQ ID NO: 3693264 - RNA, 16 nt, Salmonella enterica enterica serovar Typhi Ty2
gcguagguaagauauu

SEQ ID NO: 3693265 - RNA, 16 nt, Salmonella enterica enterica serovar Typhi Ty2
gcguauaacgccgccc

SEQ ID NO: 3693266 - RNA, 15 nt, Salmonella enterica enterica serovar Typhi Ty2
gcguauagccaggca

SEQ ID NO: 3693267 - RNA, 17 nt, Salmonella enterica enterica serovar Typhi Ty2
gcguauagccaggcaga

SEQ ID NO: 3693268 - RNA, 19 nt, Salmonella enterica enterica serovar Typhi Ty2
gcguaucucauugaugguc

SEQ ID NO: 3693269 - RNA, 23 nt, Salmonella enterica enterica serovar Typhi Ty2
gcguaucucgcgguugacgcugc

SEQ ID NO: 3693270 - RNA, 14 nt, Salmonella enterica enterica serovar Typhi Ty2
gcguauugagcgca

SEQ ID NO: 3693271 - RNA, 13 nt, Salmonella enterica enterica serovar Typhi Ty2
gcgucaaaacagg

SEQ ID NO: 3693272 - RNA, 20 nt, Salmonella enterica enterica serovar Typhi Ty2
gcgucaaaaucccggcuggg

SEQ ID NO: 3693273 - RNA, 15 nt, Salmonella enterica enterica serovar Typhi Ty2
gcgucaaagcacaug

SEQ ID NO: 3693274 - RNA, 17 nt, Salmonella enterica enterica serovar Typhi Ty2
gcgucaaaguugcauca

SEQ ID NO: 3693275 - RNA, 15 nt, Salmonella enterica enterica serovar Typhi Ty2
gcgucaaaucgccga

SEQ ID NO: 3693276 - RNA, 15 nt, Salmonella enterica enterica serovar Typhi Ty2
gcgucaacguccagu

SEQ ID NO: 3693277 - RNA, 21 nt, Salmonella enterica enterica serovar Typhi Ty2
gcgucaacucagcaauauaug

SEQ ID NO: 3693278 - RNA, 13 nt, Salmonella enterica enterica serovar Typhi Ty2
gcgucaauauuaa

SEQ ID NO: 3693279 - RNA, 17 nt, Salmonella enterica enterica serovar Typhi Ty2
gcgucacaaaaacaccc

SEQ ID NO: 3693280 - RNA, 13 nt, Salmonella enterica enterica serovar Typhi Ty2
gcgucacaacagc

SEQ ID NO: 3693281 - RNA, 13 nt, Salmonella enterica enterica serovar Typhi Ty2
gcgucacaggcuu

SEQ ID NO: 3693282 - RNA, 18 nt, Salmonella enterica enterica serovar Typhi Ty2
gcgucacccgccggcagc

SEQ ID NO: 3693283 - RNA, 21 nt, Salmonella enterica enterica serovar Typhi Ty2
gcgucacccgccggcagcagc

SEQ ID NO: 3693284 - RNA, 18 nt, Salmonella enterica enterica serovar Typhi Ty2
gcgucacgcgcaaagcug

SEQ ID NO: 3693285 - RNA, 17 nt, Salmonella enterica enterica serovar Typhi Ty2
gcgucagcacgccgccc

SEQ ID NO: 3693286 - RNA, 15 nt, Salmonella enterica enterica serovar Typhi Ty2
gcgucagcauggugu

SEQ ID NO: 3693287 - RNA, 16 nt, Salmonella enterica enterica serovar Typhi Ty2
gcgucagcccaagcug

SEQ ID NO: 3693288 - RNA, 20 nt, Salmonella enterica enterica serovar Typhi Ty2
gcgucagcgcuugccgcagc

SEQ ID NO: 3693289 - RNA, 15 nt, Salmonella enterica enterica serovar Typhi Ty2
gcgucagcgugcggu

SEQ ID NO: 3693290 - RNA, 17 nt, Salmonella enterica enterica serovar Typhi Ty2
gcgucagcgugcgguaa

SEQ ID NO: 3693291 - RNA, 20 nt, Salmonella enterica enterica serovar Typhi Ty2
gcgucagcguguaaucgccg

SEQ ID NO: 3693292 - RNA, 13 nt, Salmonella enterica enterica serovar Typhi Ty2
gcguguggugagg

SEQ ID NO: 3693293 - RNA, 22 nt, Salmonella enterica enterica serovar Typhi Ty2
gcgugugucccggacaauguaa

SEQ ID NO: 3693294 - RNA, 16 nt, Salmonella enterica enterica serovar Typhi Ty2
gcguguucaugcgcgg

SEQ ID NO: 3693295 - RNA, 18 nt, Salmonella enterica enterica serovar Typhi Ty2
gcguguugaaauccucua

SEQ ID NO: 3693296 - RNA, 23 nt, Salmonella enterica enterica serovar Typhi Ty2
gcguguuguacagcaauaaaagg

SEQ ID NO: 3693297 - RNA, 17 nt, Salmonella enterica enterica serovar Typhi Ty2
gcguguuuguaaaaaua

SEQ ID NO: 3693298 - RNA, 18 nt, Salmonella enterica enterica serovar Typhi Ty2
gcguuaacguuuucccgc

SEQ ID NO: 3693299 - RNA, 22 nt, Salmonella enterica enterica serovar Typhi Ty2
gcguuaaugcgcgcuucuucau

SEQ ID NO: 3693300 - RNA, 22 nt, Salmonella enterica enterica serovar Typhi Ty2
gcguuaccuauuuguuccggca

SEQ ID NO: 3693301 - RNA, 14 nt, Salmonella enterica enterica serovar Typhi Ty2
gcguuacuggccuu

SEQ ID NO: 3693302 - RNA, 16 nt, Salmonella enterica enterica serovar Typhi Ty2
gcguuacuggccuucu

SEQ ID NO: 3693303 - RNA, 20 nt, Salmonella enterica enterica serovar Typhi Ty2
gcguuacuggcgaccggcag

SEQ ID NO: 3693304 - RNA, 17 nt, Salmonella enterica enterica serovar Typhi Ty2
gcguuauccgccugcug

SEQ ID NO: 3693305 - RNA, 22 nt, Salmonella enterica enterica serovar Typhi Ty2
gcguuaucguccgucagauccg

SEQ ID NO: 3693306 - RNA, 16 nt, Salmonella enterica enterica serovar Typhi Ty2
gcguuaucuguaauug

SEQ ID NO: 3693307 - RNA, 23 nt, Salmonella enterica enterica serovar Typhi Ty2
gcguuauguuguugagacgguga

SEQ ID NO: 3693308 - RNA, 17 nt, Salmonella enterica enterica serovar Typhi Ty2
gcguuauuugcauuuuc

SEQ ID NO: 3693309 - RNA, 23 nt, Salmonella enterica enterica serovar Typhi Ty2
gcguucaaagaucucgucaaggu

SEQ ID NO: 3693310 - RNA, 19 nt, Salmonella enterica enterica serovar Typhi Ty2
gcguuccaucacuuccugu

SEQ ID NO: 3693311 - RNA, 15 nt, Salmonella enterica enterica serovar Typhi Ty2
gcguuccuuaucagc

SEQ ID NO: 3693312 - RNA, 20 nt, Salmonella enterica enterica serovar Typhi Ty2
gcguucgcgcaguucaucca

SEQ ID NO: 3693313 - RNA, 22 nt, Salmonella enterica enterica serovar Typhi Ty2
gcguucggaagacugcuccggc

SEQ ID NO: 3693314 - RNA, 17 nt, Salmonella enterica enterica serovar Typhi Ty2
gcguucggguuuuccug

SEQ ID NO: 3693315 - RNA, 20 nt, Salmonella enterica enterica serovar Typhi Ty2
gcguucuagcuuaucgccaa

SEQ ID NO: 3693316 - RNA, 19 nt, Salmonella enterica enterica serovar Typhi Ty2
gcguucugcgccauuucca

SEQ ID NO: 3693317 - RNA, 13 nt, Salmonella enterica enterica serovar Typhi Ty2
gcguucuuccacu

SEQ ID NO: 3693318 - RNA, 24 nt, Salmonella enterica enterica serovar Typhi Ty2
gcguugaccagccuaccugccgcc

SEQ ID NO: 3693319 - RNA, 14 nt, Salmonella enterica enterica serovar Typhi Ty2
gcguugaccgcuuc

SEQ ID NO: 3693320 - RNA, 13 nt, Salmonella enterica enterica serovar Typhi Ty2
gcguugauggcgu

SEQ ID NO: 3693321 - RNA, 16 nt, Salmonella enterica enterica serovar Typhi Ty2
gcguugccuggccucc

SEQ ID NO: 3693322 - RNA, 17 nt, Salmonella enterica enterica serovar Typhi Ty2
gcguugcgcccaggcca

SEQ ID NO: 3693323 - RNA, 19 nt, Salmonella enterica enterica serovar Typhi Ty2
gcguugcgccgccaggcau

SEQ ID NO: 3693324 - RNA, 18 nt, Salmonella enterica enterica serovar Typhi Ty2
gcguugcuuaucaggccu

SEQ ID NO: 3693325 - RNA, 21 nt, Salmonella enterica enterica serovar Typhi Ty2
gcguuguaauaaugucggaug

SEQ ID NO: 3693326 - RNA, 17 nt, Salmonella enterica enterica serovar Typhi Ty2
gcguuguaaucgccuga

SEQ ID NO: 3693327 - RNA, 18 nt, Salmonella enterica enterica serovar Typhi Ty2
gcguuguaaucgccugaa

SEQ ID NO: 3693328 - RNA, 13 nt, Salmonella enterica enterica serovar Typhi Ty2
gcguuguaccguu

SEQ ID NO: 3693329 - RNA, 21 nt, Salmonella enterica enterica serovar Typhi Ty2
gcguuguccuauugcaacgcc

SEQ ID NO: 3693330 - RNA, 23 nt, Salmonella enterica enterica serovar Typhi Ty2
gcguuguccuauugcaacgccga

SEQ ID NO: 3693331 - RNA, 15 nt, Salmonella enterica enterica serovar Typhi Ty2
gcguugucgcugauu

SEQ ID NO: 3693332 - RNA, 16 nt, Salmonella enterica enterica serovar Typhi Ty2
gcguugugcagaauca

SEQ ID NO: 3693333 - RNA, 21 nt, Salmonella enterica enterica serovar Typhi Ty2
gcguuguuuuuucagaauuag

SEQ ID NO: 3693334 - RNA, 13 nt, Salmonella enterica enterica serovar Typhi Ty2
gcguuuagcgcca

SEQ ID NO: 3693335 - RNA, 15 nt, Salmonella enterica enterica serovar Typhi Ty2
gcguuuagcgccagc

SEQ ID NO: 3693336 - RNA, 21 nt, Salmonella enterica enterica serovar Typhi Ty2
gcguuucaagcaguuccagca

SEQ ID NO: 3693337 - RNA, 17 nt, Salmonella enterica enterica serovar Typhi Ty2
gcguuucacaucgccag

SEQ ID NO: 3693338 - RNA, 18 nt, Salmonella enterica enterica serovar Typhi Ty2
gcguuucacaucgccagu

SEQ ID NO: 3693339 - RNA, 23 nt, Salmonella enterica enterica serovar Typhi Ty2
gcguuucacaucgccaguuauca

SEQ ID NO: 3693340 - RNA, 22 nt, Salmonella enterica enterica serovar Typhi Ty2
gcguuucacgcgcgccugccgc

SEQ ID NO: 3693341 - RNA, 23 nt, Salmonella enterica enterica serovar Typhi Ty2
gcguuucccgcgcggaaggcgcc

SEQ ID NO: 3693342 - RNA, 13 nt, Salmonella enterica enterica serovar Typhi Ty2
gcguuucguaaug

SEQ ID NO: 3693343 - RNA, 20 nt, Salmonella enterica enterica serovar Typhi Ty2
gcguuucguaauggccuaca

SEQ ID NO: 3693344 - RNA, 18 nt, Salmonella enterica enterica serovar Typhi Ty2
gcguuucuacgccauggc

SEQ ID NO: 3693345 - RNA, 12 nt, Salmonella enterica enterica serovar Typhi Ty2
gcguuucugaac

SEQ ID NO: 3693346 - RNA, 20 nt, Salmonella enterica enterica serovar Typhi Ty2
gcguuugggcgcaacaguca

SEQ ID NO: 3693347 - RNA, 17 nt, Salmonella enterica enterica serovar Typhi Ty2
gcguuuuaccgcccgac

SEQ ID NO: 3693348 - RNA, 18 nt, Salmonella enterica enterica serovar Typhi Ty2
gcguuuuacguacccgcu

SEQ ID NO: 3693349 - RNA, 13 nt, Salmonella enterica enterica serovar Typhi Ty2
gcguuuuauccgu

SEQ ID NO: 3693350 - RNA, 13 nt, Salmonella enterica enterica serovar Typhi Ty2
gcguuuuccagcu

SEQ ID NO: 3693351 - RNA, 18 nt, Salmonella enterica enterica serovar Typhi Ty2
gcguuuuccaucaucagg

SEQ ID NO: 3693352 - RNA, 13 nt, Salmonella enterica enterica serovar Typhi Ty2
gcguuuugcgcgu

SEQ ID NO: 3693353 - RNA, 23 nt, Salmonella enterica enterica serovar Typhi Ty2
gcguuuuuaucuuuuacgcuguc

SEQ ID NO: 3693354 - RNA, 17 nt, Salmonella enterica enterica serovar Typhi Ty2
gcguuuuuucaucggca

SEQ ID NO: 3693355 - RNA, 18 nt, Salmonella enterica enterica serovar Typhi Ty2
gcguuuuuucaucggcag

SEQ ID NO: 3693356 - RNA, 12 nt, Salmonella enterica enterica serovar Typhi Ty2
gcuaaaauaccc

SEQ ID NO: 3693357 - RNA, 20 nt, Salmonella enterica enterica serovar Typhi Ty2
gcuaaacaauuugcccagcg

SEQ ID NO: 3693358 - RNA, 19 nt, Salmonella enterica enterica serovar Typhi Ty2
gcuaaaccacaugaccagc

SEQ ID NO: 3693359 - RNA, 22 nt, Salmonella enterica enterica serovar Typhi Ty2
gcuaaaccacaugaccagcgcc

SEQ ID NO: 3693360 - RNA, 23 nt, Salmonella enterica enterica serovar Typhi Ty2
gcuaaagcgacuuauccggccua

SEQ ID NO: 3693361 - RNA, 18 nt, Salmonella enterica enterica serovar Typhi Ty2
gcuaaagcgcuggcggcg

SEQ ID NO: 3693362 - RNA, 15 nt, Salmonella enterica enterica serovar Typhi Ty2
gcuaaauaaaaauaa

SEQ ID NO: 3693363 - RNA, 15 nt, Salmonella enterica enterica serovar Typhi Ty2
gcuaaaucagugaug

SEQ ID NO: 3693364 - RNA, 23 nt, Salmonella enterica enterica serovar Typhi Ty2
gcuaaaugacaaauagaagccac

SEQ ID NO: 3693365 - RNA, 15 nt, Salmonella enterica enterica serovar Typhi Ty2
gcuaaccaucagcgg

SEQ ID NO: 3693366 - RNA, 21 nt, Salmonella enterica enterica serovar Typhi Ty2
gcuaacgccugauccggccua

SEQ ID NO: 3693367 - RNA, 16 nt, Salmonella enterica enterica serovar Typhi Ty2
gcuaacgcgccccagg

SEQ ID NO: 3693368 - RNA, 17 nt, Salmonella enterica enterica serovar Typhi Ty2
gcuaacgcuuauccggc

SEQ ID NO: 3693369 - RNA, 19 nt, Salmonella enterica enterica serovar Typhi Ty2
gcuaacggcaccagcaaca

SEQ ID NO: 3693370 - RNA, 20 nt, Salmonella enterica enterica serovar Typhi Ty2
gcuaacuuauugaaaccuaa

SEQ ID NO: 3693371 - RNA, 17 nt, Salmonella enterica enterica serovar Typhi Ty2
gcuaagcaacaguucac

SEQ ID NO: 3693372 - RNA, 22 nt, Salmonella enterica enterica serovar Typhi Ty2
gcuaagcguuacggaaaaaaua

SEQ ID NO: 3693373 - RNA, 20 nt, Salmonella enterica enterica serovar Typhi Ty2
gcuauuccaaaauaauaaaa

SEQ ID NO: 3693374 - RNA, 16 nt, Salmonella enterica enterica serovar Typhi Ty2
gcuauucugcuguucc

SEQ ID NO: 3693375 - RNA, 12 nt, Salmonella enterica enterica serovar Typhi Ty2
gcuauuuaaccc

SEQ ID NO: 3693376 - RNA, 15 nt, Salmonella enterica enterica serovar Typhi Ty2
gcuauuucaguggcu

SEQ ID NO: 3693377 - RNA, 19 nt, Salmonella enterica enterica serovar Typhi Ty2
gcuauuuucucuugcucac

SEQ ID NO: 3693378 - RNA, 15 nt, Salmonella enterica enterica serovar Typhi Ty2
gcucaaaaaagagua

SEQ ID NO: 3693379 - RNA, 22 nt, Salmonella enterica enterica serovar Typhi Ty2
gcucaaaaaagaguaaaguuau

SEQ ID NO: 3693380 - RNA, 12 nt, Salmonella enterica enterica serovar Typhi Ty2
gcucaaauauga

SEQ ID NO: 3693381 - RNA, 13 nt, Salmonella enterica enterica serovar Typhi Ty2
gcucaaauaugau

SEQ ID NO: 3693382 - RNA, 20 nt, Salmonella enterica enterica serovar Typhi Ty2
gcucaaauaugauaugugua

SEQ ID NO: 3693383 - RNA, 21 nt, Salmonella enterica enterica serovar Typhi Ty2
gcucaaccgcgcggcguucug

SEQ ID NO: 3693384 - RNA, 14 nt, Salmonella enterica enterica serovar Typhi Ty2
gcucaacuggauga

SEQ ID NO: 3693385 - RNA, 19 nt, Salmonella enterica enterica serovar Typhi Ty2
gcucaagccagguugcgcc

SEQ ID NO: 3693386 - RNA, 20 nt, Salmonella enterica enterica serovar Typhi Ty2
gcucaauaccuuaguaaaac

SEQ ID NO: 3693387 - RNA, 21 nt, Salmonella enterica enterica serovar Typhi Ty2
gcucaauccuucuaccuucac

SEQ ID NO: 3693388 - RNA, 22 nt, Salmonella enterica enterica serovar Typhi Ty2
gcucaauguagcgucagccggc

SEQ ID NO: 3693389 - RNA, 19 nt, Salmonella enterica enterica serovar Typhi Ty2
gcucaauuauacgcuggug

SEQ ID NO: 3693390 - RNA, 12 nt, Salmonella enterica enterica serovar Typhi Ty2
gcucaauuuuuu

SEQ ID NO: 3693391 - RNA, 14 nt, Salmonella enterica enterica serovar Typhi Ty2
gcucaauuuuuuuc

SEQ ID NO: 3693392 - RNA, 13 nt, Salmonella enterica enterica serovar Typhi Ty2
gcucaccagccca

SEQ ID NO: 3693393 - RNA, 23 nt, Salmonella enterica enterica serovar Typhi Ty2
gcucaccagcugacgcagcaguu

SEQ ID NO: 3693394 - RNA, 23 nt, Salmonella enterica enterica serovar Typhi Ty2
gcucacccaguuuuuuucugcca

SEQ ID NO: 3693395 - RNA, 20 nt, Salmonella enterica enterica serovar Typhi Ty2
gcucaccgagacugcccggc

SEQ ID NO: 3693396 - RNA, 22 nt, Salmonella enterica enterica serovar Typhi Ty2
gcucaccgagacugcccggcau

SEQ ID NO: 3693397 - RNA, 14 nt, Salmonella enterica enterica serovar Typhi Ty2
gcucaccugguaag

SEQ ID NO: 3693398 - RNA, 13 nt, Salmonella enterica enterica serovar Typhi Ty2
gcucacgcuggug

SEQ ID NO: 3693399 - RNA, 20 nt, Salmonella enterica enterica serovar Typhi Ty2
gcucacgcuuauccggccua

SEQ ID NO: 3693400 - RNA, 23 nt, Salmonella enterica enterica serovar Typhi Ty2
gcucacgguuucaacuuccacca

SEQ ID NO: 3693401 - RNA, 15 nt, Salmonella enterica enterica serovar Typhi Ty2
gcucagaaauauuca

SEQ ID NO: 3693402 - RNA, 19 nt, Salmonella enterica enterica serovar Typhi Ty2
gcucagaccauauucacgc

SEQ ID NO: 3693403 - RNA, 13 nt, Salmonella enterica enterica serovar Typhi Ty2
gcucagaccgauc

SEQ ID NO: 3693404 - RNA, 13 nt, Salmonella enterica enterica serovar Typhi Ty2
gcucagcgcggca

SEQ ID NO: 3693405 - RNA, 16 nt, Salmonella enterica enterica serovar Typhi Ty2
gcucagcgcggcagcc

SEQ ID NO: 3693406 - RNA, 13 nt, Salmonella enterica enterica serovar Typhi Ty2
gcucagcggcaau

SEQ ID NO: 3693407 - RNA, 14 nt, Salmonella enterica enterica serovar Typhi Ty2
gcucagcggcggcg

SEQ ID NO: 3693408 - RNA, 19 nt, Salmonella enterica enterica serovar Typhi Ty2
gcucagcggcggcgggaac

SEQ ID NO: 3693409 - RNA, 20 nt, Salmonella enterica enterica serovar Typhi Ty2
gcucagcuggauagagcgcu

SEQ ID NO: 3693410 - RNA, 19 nt, Salmonella enterica enterica serovar Typhi Ty2
gcucaggagcgccugacag

SEQ ID NO: 3693411 - RNA, 21 nt, Salmonella enterica enterica serovar Typhi Ty2
gcucaggaucgccggauuguu

SEQ ID NO: 3693412 - RNA, 14 nt, Salmonella enterica enterica serovar Typhi Ty2
gcucaggcgcgaau

SEQ ID NO: 3693413 - RNA, 19 nt, Salmonella enterica enterica serovar Typhi Ty2
gcucaggcgcgaauaaugc

SEQ ID NO: 3693414 - RNA, 14 nt, Salmonella enterica enterica serovar Typhi Ty2
gcucaggcgcgcgc

SEQ ID NO: 3693415 - RNA, 22 nt, Salmonella enterica enterica serovar Typhi Ty2
gcucaggcuccgcgcaggguga

SEQ ID NO: 3693416 - RNA, 16 nt, Salmonella enterica enterica serovar Typhi Ty2
gcucagggcauccgcc

SEQ ID NO: 3693417 - RNA, 13 nt, Salmonella enterica enterica serovar Typhi Ty2
gcucagggucaga

SEQ ID NO: 3693418 - RNA, 23 nt, Salmonella enterica enterica serovar Typhi Ty2
gcucagggucagaauacagaauc

SEQ ID NO: 3693419 - RNA, 22 nt, Salmonella enterica enterica serovar Typhi Ty2
gcucaggguuuucuaccgcagc

SEQ ID NO: 3693420 - RNA, 18 nt, Salmonella enterica enterica serovar Typhi Ty2
gcucaguccagccgccgc

SEQ ID NO: 3693421 - RNA, 15 nt, Salmonella enterica enterica serovar Typhi Ty2
gcucaguugguuaga

SEQ ID NO: 3693422 - RNA, 21 nt, Salmonella enterica enterica serovar Typhi Ty2
gcucaguugguuagagcacau

SEQ ID NO: 3693423 - RNA, 21 nt, Salmonella enterica enterica serovar Typhi Ty2
gcucauagccgcuuuccgccg

SEQ ID NO: 3693424 - RNA, 15 nt, Salmonella enterica enterica serovar Typhi Ty2
gcucauauacccugc

SEQ ID NO: 3693425 - RNA, 22 nt, Salmonella enterica enterica serovar Typhi Ty2
gcucaucaaacagcggcacuuc

SEQ ID NO: 3693426 - RNA, 16 nt, Salmonella enterica enterica serovar Typhi Ty2
gcucaucagcgccauu

SEQ ID NO: 3693427 - RNA, 12 nt, Salmonella enterica enterica serovar Typhi Ty2
gcucauccagcg

SEQ ID NO: 3693428 - RNA, 13 nt, Salmonella enterica enterica serovar Typhi Ty2
gcucaucucaagc

SEQ ID NO: 3693429 - RNA, 24 nt, Salmonella enterica enterica serovar Typhi Ty2
gcucaugacaucgcccugggucac

SEQ ID NO: 3693430 - RNA, 17 nt, Salmonella enterica enterica serovar Typhi Ty2
gcucaugauagggcagc

SEQ ID NO: 3693431 - RNA, 19 nt, Salmonella enterica enterica serovar Typhi Ty2
gcucaugauagggcagcag

SEQ ID NO: 3693432 - RNA, 15 nt, Salmonella enterica enterica serovar Typhi Ty2
gcucaugcgccuggc

SEQ ID NO: 3693433 - RNA, 22 nt, Salmonella enterica enterica serovar Typhi Ty2
gcucaugcgcgucccggcagug

SEQ ID NO: 3693434 - RNA, 19 nt, Salmonella enterica enterica serovar Typhi Ty2
gcucaugugcagcauccag

SEQ ID NO: 3693435 - RNA, 20 nt, Salmonella enterica enterica serovar Typhi Ty2
gcucaugugcagcauccagc

SEQ ID NO: 3693436 - RNA, 23 nt, Salmonella enterica enterica serovar Typhi Ty2
gcucaugugcagcauccagcuca

SEQ ID NO: 3693437 - RNA, 17 nt, Salmonella enterica enterica serovar Typhi Ty2
gcucauuggcagaacga

SEQ ID NO: 3693438 - RNA, 13 nt, Salmonella enterica enterica serovar Typhi Ty2
gcucauuucccaa

SEQ ID NO: 3693439 - RNA, 15 nt, Salmonella enterica enterica serovar Typhi Ty2
gcucauuugcggcgu

SEQ ID NO: 3693440 - RNA, 22 nt, Salmonella enterica enterica serovar Typhi Ty2
gcucauuugcggcgucgccugg

SEQ ID NO: 3693441 - RNA, 18 nt, Salmonella enterica enterica serovar Typhi Ty2
gcuccaauaaauauugca

SEQ ID NO: 3693442 - RNA, 21 nt, Salmonella enterica enterica serovar Typhi Ty2
gcuccagaagcacuucuccac

SEQ ID NO: 3693443 - RNA, 17 nt, Salmonella enterica enterica serovar Typhi Ty2
gcuccagacaggacgcc

SEQ ID NO: 3693444 - RNA, 19 nt, Salmonella enterica enterica serovar Typhi Ty2
gcuccagacaggacgccag

SEQ ID NO: 3693445 - RNA, 20 nt, Salmonella enterica enterica serovar Typhi Ty2
gcuccagacaggacgccagc

SEQ ID NO: 3693446 - RNA, 15 nt, Salmonella enterica enterica serovar Typhi Ty2
gcuccagcccgccgc

SEQ ID NO: 3693447 - RNA, 12 nt, Salmonella enterica enterica serovar Typhi Ty2
gcuccagccgcu

SEQ ID NO: 3693448 - RNA, 17 nt, Salmonella enterica enterica serovar Typhi Ty2
gcuccagcgccagcucc

SEQ ID NO: 3693449 - RNA, 16 nt, Salmonella enterica enterica serovar Typhi Ty2
gcuccagcuggcuggc

SEQ ID NO: 3693450 - RNA, 23 nt, Salmonella enterica enterica serovar Typhi Ty2
gcuccagggauugauggccagcc

SEQ ID NO: 3693451 - RNA, 23 nt, Salmonella enterica enterica serovar Typhi Ty2
gcuccagggcugcuggccuucca

SEQ ID NO: 3693452 - RNA, 20 nt, Salmonella enterica enterica serovar Typhi Ty2
gcuccaguuguuccagcagc

SEQ ID NO: 3693453 - RNA, 21 nt, Salmonella enterica enterica serovar Typhi Ty2
gcuccaguuguuccagcagcu

SEQ ID NO: 3693454 - RNA, 18 nt, Salmonella enterica enterica serovar Typhi Ty2
gcuccauagaaaucagca

SEQ ID NO: 3693455 - RNA, 16 nt, Salmonella enterica enterica serovar Typhi Ty2
gcugacaaucugcugg

SEQ ID NO: 3693456 - RNA, 18 nt, Salmonella enterica enterica serovar Typhi Ty2
gcugacacccucugcgcc

SEQ ID NO: 3693457 - RNA, 17 nt, Salmonella enterica enterica serovar Typhi Ty2
gcugacacucauccaga

SEQ ID NO: 3693458 - RNA, 18 nt, Salmonella enterica enterica serovar Typhi Ty2
gcugacacucauccagac

SEQ ID NO: 3693459 - RNA, 17 nt, Salmonella enterica enterica serovar Typhi Ty2
gcugacauccaucaucu

SEQ ID NO: 3693460 - RNA, 20 nt, Salmonella enterica enterica serovar Typhi Ty2
gcugaccacgccgccgcguc

SEQ ID NO: 3693461 - RNA, 21 nt, Salmonella enterica enterica serovar Typhi Ty2
gcugaccgcuuucccggcaug

SEQ ID NO: 3693462 - RNA, 15 nt, Salmonella enterica enterica serovar Typhi Ty2
gcugaccucaauccg

SEQ ID NO: 3693463 - RNA, 18 nt, Salmonella enterica enterica serovar Typhi Ty2
gcugaccucaauccgugc

SEQ ID NO: 3693464 - RNA, 18 nt, Salmonella enterica enterica serovar Typhi Ty2
gcugaccugaacgccuac

SEQ ID NO: 3693465 - RNA, 17 nt, Salmonella enterica enterica serovar Typhi Ty2
gcugaccuuaauccagc

SEQ ID NO: 3693466 - RNA, 16 nt, Salmonella enterica enterica serovar Typhi Ty2
gcugacgacauucagc

SEQ ID NO: 3693467 - RNA, 19 nt, Salmonella enterica enterica serovar Typhi Ty2
gcugacgacauucagcaca

SEQ ID NO: 3693468 - RNA, 21 nt, Salmonella enterica enterica serovar Typhi Ty2
gcugacgacauucagcacaug

SEQ ID NO: 3693469 - RNA, 15 nt, Salmonella enterica enterica serovar Typhi Ty2
gcugacgacgccagc

SEQ ID NO: 3693470 - RNA, 17 nt, Salmonella enterica enterica serovar Typhi Ty2
gcugacgacgccagccc

SEQ ID NO: 3693471 - RNA, 22 nt, Salmonella enterica enterica serovar Typhi Ty2
gcugacgauacucagccccagg

SEQ ID NO: 3693472 - RNA, 16 nt, Salmonella enterica enterica serovar Typhi Ty2
gcugacgaucaugccg

SEQ ID NO: 3693473 - RNA, 16 nt, Salmonella enterica enterica serovar Typhi Ty2
gcugacgcccaucagc

SEQ ID NO: 3693474 - RNA, 21 nt, Salmonella enterica enterica serovar Typhi Ty2
gcugacgcgccuggaucugcg

SEQ ID NO: 3693475 - RNA, 17 nt, Salmonella enterica enterica serovar Typhi Ty2
gcugacggagcuggcac

SEQ ID NO: 3693476 - RNA, 21 nt, Salmonella enterica enterica serovar Typhi Ty2
gcugacggauacgcugcguca

SEQ ID NO: 3693477 - RNA, 18 nt, Salmonella enterica enterica serovar Typhi Ty2
gcugacguuacgcggcgc

SEQ ID NO: 3693478 - RNA, 21 nt, Salmonella enterica enterica serovar Typhi Ty2
gcugacguucgacccgcaaug

SEQ ID NO: 3693479 - RNA, 19 nt, Salmonella enterica enterica serovar Typhi Ty2
gcugacugcaaaucugccg

SEQ ID NO: 3693480 - RNA, 12 nt, Salmonella enterica enterica serovar Typhi Ty2
gcugacugccgu

SEQ ID NO: 3693481 - RNA, 17 nt, Salmonella enterica enterica serovar Typhi Ty2
gcugacugguuuguugc

SEQ ID NO: 3693482 - RNA, 14 nt, Salmonella enterica enterica serovar Typhi Ty2
gcugagaaaaauac

SEQ ID NO: 3693483 - RNA, 21 nt, Salmonella enterica enterica serovar Typhi Ty2
gcugagaaaaauacgccagau

SEQ ID NO: 3693484 - RNA, 21 nt, Salmonella enterica enterica serovar Typhi Ty2
gcugagcacgcccggucuguc

SEQ ID NO: 3693485 - RNA, 17 nt, Salmonella enterica enterica serovar Typhi Ty2
gcugagcgucaggcgca

SEQ ID NO: 3693486 - RNA, 17 nt, Salmonella enterica enterica serovar Typhi Ty2
gcugagcuaaucaccca

SEQ ID NO: 3693487 - RNA, 13 nt, Salmonella enterica enterica serovar Typhi Ty2
gcugaggcgcugg

SEQ ID NO: 3693488 - RNA, 20 nt, Salmonella enterica enterica serovar Typhi Ty2
gcugagucauccuuccccca

SEQ ID NO: 3693489 - RNA, 16 nt, Salmonella enterica enterica serovar Typhi Ty2
gcugaguucaggcacg

SEQ ID NO: 3693490 - RNA, 19 nt, Salmonella enterica enterica serovar Typhi Ty2
gcugaguuuagccagcagc

SEQ ID NO: 3693491 - RNA, 14 nt, Salmonella enterica enterica serovar Typhi Ty2
gcugaguuucuccc

SEQ ID NO: 3693492 - RNA, 22 nt, Salmonella enterica enterica serovar Typhi Ty2
gcugaguuucucccgccagaug

SEQ ID NO: 3693493 - RNA, 21 nt, Salmonella enterica enterica serovar Typhi Ty2
gcugauaagcuaguaaagaaa

SEQ ID NO: 3693494 - RNA, 14 nt, Salmonella enterica enterica serovar Typhi Ty2
gcugauacgcacca

SEQ ID NO: 3693495 - RNA, 22 nt, Salmonella enterica enterica serovar Typhi Ty2
gcugauacuuauuacgguauca

SEQ ID NO: 3693496 - RNA, 16 nt, Salmonella enterica enterica serovar Typhi Ty2
gcugauaggccuggau

SEQ ID NO: 3693497 - RNA, 20 nt, Salmonella enterica enterica serovar Typhi Ty2
gcugauauuuuuacugauua

SEQ ID NO: 3693498 - RNA, 16 nt, Salmonella enterica enterica serovar Typhi Ty2
gcugaucccgcgcgcc

SEQ ID NO: 3693499 - RNA, 17 nt, Salmonella enterica enterica serovar Typhi Ty2
gcugaucccgcgcgccu

SEQ ID NO: 3693500 - RNA, 21 nt, Salmonella enterica enterica serovar Typhi Ty2
gcugauccuguuaaucaucgc

SEQ ID NO: 3693501 - RNA, 17 nt, Salmonella enterica enterica serovar Typhi Ty2
gcugaucgugauaggcc

SEQ ID NO: 3693502 - RNA, 15 nt, Salmonella enterica enterica serovar Typhi Ty2
gcugaugacgcgccg

SEQ ID NO: 3693503 - RNA, 17 nt, Salmonella enterica enterica serovar Typhi Ty2
gcugaugauuggccucc

SEQ ID NO: 3693504 - RNA, 13 nt, Salmonella enterica enterica serovar Typhi Ty2
gcugaugcagaua

SEQ ID NO: 3693505 - RNA, 13 nt, Salmonella enterica enterica serovar Typhi Ty2
gcugaugcagcuu

SEQ ID NO: 3693506 - RNA, 18 nt, Salmonella enterica enterica serovar Typhi Ty2
gcugaugcagcuugcagg

SEQ ID NO: 3693507 - RNA, 21 nt, Salmonella enterica enterica serovar Typhi Ty2
gcugaugccagauggcaagau

SEQ ID NO: 3693508 - RNA, 18 nt, Salmonella enterica enterica serovar Typhi Ty2
gcugaugcuguaggccgg

SEQ ID NO: 3693509 - RNA, 16 nt, Salmonella enterica enterica serovar Typhi Ty2
gcugauguccgcagcc

SEQ ID NO: 3693510 - RNA, 20 nt, Salmonella enterica enterica serovar Typhi Ty2
gcugaugugauuaaacgcaa

SEQ ID NO: 3693511 - RNA, 17 nt, Salmonella enterica enterica serovar Typhi Ty2
gcugcaaaucaccacau

SEQ ID NO: 3693512 - RNA, 15 nt, Salmonella enterica enterica serovar Typhi Ty2
gcugcaacucuccca

SEQ ID NO: 3693513 - RNA, 19 nt, Salmonella enterica enterica serovar Typhi Ty2
gcugcacaaaauacuguuu

SEQ ID NO: 3693514 - RNA, 17 nt, Salmonella enterica enterica serovar Typhi Ty2
gcugcacgccaucggcu

SEQ ID NO: 3693515 - RNA, 21 nt, Salmonella enterica enterica serovar Typhi Ty2
gcugcagcuuaggauucgcca

SEQ ID NO: 3693516 - RNA, 16 nt, Salmonella enterica enterica serovar Typhi Ty2
gcugcauaaugcgcga

SEQ ID NO: 3693517 - RNA, 13 nt, Salmonella enterica enterica serovar Typhi Ty2
gcugcauauacuc

SEQ ID NO: 3693518 - RNA, 20 nt, Salmonella enterica enterica serovar Typhi Ty2
gcugcauccuguaccaccac

SEQ ID NO: 3693519 - RNA, 22 nt, Salmonella enterica enterica serovar Typhi Ty2
gcugcaucuuacugaccggccc

SEQ ID NO: 3693520 - RNA, 14 nt, Salmonella enterica enterica serovar Typhi Ty2
gcugccacacucuc

SEQ ID NO: 3693521 - RNA, 13 nt, Salmonella enterica enterica serovar Typhi Ty2
gcugccagcugcg

SEQ ID NO: 3693522 - RNA, 18 nt, Salmonella enterica enterica serovar Typhi Ty2
gcugccagucugcccggc

SEQ ID NO: 3693523 - RNA, 13 nt, Salmonella enterica enterica serovar Typhi Ty2
gcugccaucaggc

SEQ ID NO: 3693524 - RNA, 17 nt, Salmonella enterica enterica serovar Typhi Ty2
gcugccauuaucaccau

SEQ ID NO: 3693525 - RNA, 15 nt, Salmonella enterica enterica serovar Typhi Ty2
gcugcccggauaacc

SEQ ID NO: 3693526 - RNA, 13 nt, Salmonella enterica enterica serovar Typhi Ty2
gcugcccugcggu

SEQ ID NO: 3693527 - RNA, 21 nt, Salmonella enterica enterica serovar Typhi Ty2
gcugcccugcgguagcuccag

SEQ ID NO: 3693528 - RNA, 22 nt, Salmonella enterica enterica serovar Typhi Ty2
gcugccgacaacgccuccugcc

SEQ ID NO: 3693529 - RNA, 15 nt, Salmonella enterica enterica serovar Typhi Ty2
gcugccgaccuggcu

SEQ ID NO: 3693530 - RNA, 19 nt, Salmonella enterica enterica serovar Typhi Ty2
gcugccgauacuccauugu

SEQ ID NO: 3693531 - RNA, 22 nt, Salmonella enterica enterica serovar Typhi Ty2
gcugccgauagcaucgcugaug

SEQ ID NO: 3693532 - RNA, 16 nt, Salmonella enterica enterica serovar Typhi Ty2
gcugccgaucagauug

SEQ ID NO: 3693533 - RNA, 9 nt, Salmonella enterica enterica serovar Typhi Ty2
gcugccgca

SEQ ID NO: 3693534 - RNA, 19 nt, Salmonella enterica enterica serovar Typhi Ty2
gcugccggaaagggaagag

SEQ ID NO: 3693535 - RNA, 14 nt, Salmonella enterica enterica serovar Typhi Ty2
gcugccgucaaagu

SEQ ID NO: 3693536 - RNA, 14 nt, Salmonella enterica enterica serovar Typhi Ty2
gcugccugccggau

SEQ ID NO: 3693537 - RNA, 18 nt, Salmonella enterica enterica serovar Typhi Ty2
gcuggguuucgguauaaa

SEQ ID NO: 3693538 - RNA, 18 nt, Salmonella enterica enterica serovar Typhi Ty2
gcugguagacaaacagcg

SEQ ID NO: 3693539 - RNA, 16 nt, Salmonella enterica enterica serovar Typhi Ty2
gcuggucaccuggcug

SEQ ID NO: 3693540 - RNA, 22 nt, Salmonella enterica enterica serovar Typhi Ty2
gcuggucaccuggcugguggcc

SEQ ID NO: 3693541 - RNA, 15 nt, Salmonella enterica enterica serovar Typhi Ty2
gcuggucagcgcaau

SEQ ID NO: 3693542 - RNA, 13 nt, Salmonella enterica enterica serovar Typhi Ty2
gcuggucgagaua

SEQ ID NO: 3693543 - RNA, 18 nt, Salmonella enterica enterica serovar Typhi Ty2
gcuggucgagauacugca

SEQ ID NO: 3693544 - RNA, 15 nt, Salmonella enterica enterica serovar Typhi Ty2
gcuggucgccagcgc

SEQ ID NO: 3693545 - RNA, 19 nt, Salmonella enterica enterica serovar Typhi Ty2
gcuggucgccgcccaucgg

SEQ ID NO: 3693546 - RNA, 13 nt, Salmonella enterica enterica serovar Typhi Ty2
gcuggugcagccc

SEQ ID NO: 3693547 - RNA, 19 nt, Salmonella enterica enterica serovar Typhi Ty2
gcuggugccaaucuccagc

SEQ ID NO: 3693548 - RNA, 15 nt, Salmonella enterica enterica serovar Typhi Ty2
gcuggugcugugccu

SEQ ID NO: 3693549 - RNA, 17 nt, Salmonella enterica enterica serovar Typhi Ty2
gcuggugcuuggcguga

SEQ ID NO: 3693550 - RNA, 21 nt, Salmonella enterica enterica serovar Typhi Ty2
gcugguggugccgacgccagc

SEQ ID NO: 3693551 - RNA, 13 nt, Salmonella enterica enterica serovar Typhi Ty2
gcugguggugggc

SEQ ID NO: 3693552 - RNA, 21 nt, Salmonella enterica enterica serovar Typhi Ty2
gcugguguaauugcgccaggc

SEQ ID NO: 3693553 - RNA, 15 nt, Salmonella enterica enterica serovar Typhi Ty2
gcugguuauuccgcu

SEQ ID NO: 3693554 - RNA, 22 nt, Salmonella enterica enterica serovar Typhi Ty2
gcugguuccccgugcccggcau

SEQ ID NO: 3693555 - RNA, 19 nt, Salmonella enterica enterica serovar Typhi Ty2
gcuguaacccgccgccauc

SEQ ID NO: 3693556 - RNA, 18 nt, Salmonella enterica enterica serovar Typhi Ty2
gcuguaauagauaugaaa

SEQ ID NO: 3693557 - RNA, 22 nt, Salmonella enterica enterica serovar Typhi Ty2
gcuguaccaucaccugaugucc

SEQ ID NO: 3693558 - RNA, 14 nt, Salmonella enterica enterica serovar Typhi Ty2
gcuguacuuuugcu

SEQ ID NO: 3693559 - RNA, 22 nt, Salmonella enterica enterica serovar Typhi Ty2
gcuguagcguuucacgcgcgcc

SEQ ID NO: 3693560 - RNA, 17 nt, Salmonella enterica enterica serovar Typhi Ty2
gcuguagcugcccggau

SEQ ID NO: 3693561 - RNA, 15 nt, Salmonella enterica enterica serovar Typhi Ty2
gcuguauuucccucu

SEQ ID NO: 3693562 - RNA, 15 nt, Salmonella enterica enterica serovar Typhi Ty2
gcugucaccagcagc

SEQ ID NO: 3693563 - RNA, 18 nt, Salmonella enterica enterica serovar Typhi Ty2
gcugucagaagaucggga

SEQ ID NO: 3693564 - RNA, 16 nt, Salmonella enterica enterica serovar Typhi Ty2
gcugucaucaaugagc

SEQ ID NO: 3693565 - RNA, 20 nt, Salmonella enterica enterica serovar Typhi Ty2
gcugucaucgaaggcgauac

SEQ ID NO: 3693566 - RNA, 21 nt, Salmonella enterica enterica serovar Typhi Ty2
gcuguccagauagggccaggc

SEQ ID NO: 3693567 - RNA, 14 nt, Salmonella enterica enterica serovar Typhi Ty2
gcuguccagccgcc

SEQ ID NO: 3693568 - RNA, 15 nt, Salmonella enterica enterica serovar Typhi Ty2
gcuguccagccgccc

SEQ ID NO: 3693569 - RNA, 14 nt, Salmonella enterica enterica serovar Typhi Ty2
gcuguccagucaaa

SEQ ID NO: 3693570 - RNA, 15 nt, Salmonella enterica enterica serovar Typhi Ty2
gcugucccaguguca

SEQ ID NO: 3693571 - RNA, 18 nt, Salmonella enterica enterica serovar Typhi Ty2
gcugucccagugucaacu

SEQ ID NO: 3693572 - RNA, 17 nt, Salmonella enterica enterica serovar Typhi Ty2
gcuguccuuaaccagcu

SEQ ID NO: 3693573 - RNA, 18 nt, Salmonella enterica enterica serovar Typhi Ty2
gcugucgaugauauccag

SEQ ID NO: 3693574 - RNA, 12 nt, Salmonella enterica enterica serovar Typhi Ty2
gcugucgccaga

SEQ ID NO: 3693575 - RNA, 21 nt, Salmonella enterica enterica serovar Typhi Ty2
gcugucggucaggcugcggac

SEQ ID NO: 3693576 - RNA, 20 nt, Salmonella enterica enterica serovar Typhi Ty2
gcugucggucggcuuuuguu

SEQ ID NO: 3693577 - RNA, 12 nt, Salmonella enterica enterica serovar Typhi Ty2
gcugucguuuca

SEQ ID NO: 3693578 - RNA, 18 nt, Salmonella enterica enterica serovar Typhi Ty2
gcugucugccggcguucc

SEQ ID NO: 3693579 - RNA, 23 nt, Salmonella enterica enterica serovar Typhi Ty2
gcugugacggcaacugaaaacag

SEQ ID NO: 3693580 - RNA, 23 nt, Salmonella enterica enterica serovar Typhi Ty2
gcugugcaacaucuuaccggugc

SEQ ID NO: 3693581 - RNA, 22 nt, Salmonella enterica enterica serovar Typhi Ty2
gcugugcagacugcacuuccug

SEQ ID NO: 3693582 - RNA, 16 nt, Salmonella enterica enterica serovar Typhi Ty2
gcugugccaauaacgc

SEQ ID NO: 3693583 - RNA, 18 nt, Salmonella enterica enterica serovar Typhi Ty2
gcugugccggguucugcg

SEQ ID NO: 3693584 - RNA, 13 nt, Salmonella enterica enterica serovar Typhi Ty2
gcugugccugccu

SEQ ID NO: 3693585 - RNA, 17 nt, Salmonella enterica enterica serovar Typhi Ty2
gcugugcuaucaggccu

SEQ ID NO: 3693586 - RNA, 15 nt, Salmonella enterica enterica serovar Typhi Ty2
gcuguggaaacugug

SEQ ID NO: 3693587 - RNA, 20 nt, Salmonella enterica enterica serovar Typhi Ty2
gcuguggaggguaagaaagu

SEQ ID NO: 3693588 - RNA, 16 nt, Salmonella enterica enterica serovar Typhi Ty2
gcuguggccaggcacg

SEQ ID NO: 3693589 - RNA, 18 nt, Salmonella enterica enterica serovar Typhi Ty2
gcugugggcgugucgccg

SEQ ID NO: 3693590 - RNA, 15 nt, Salmonella enterica enterica serovar Typhi Ty2
gcuguggucgucugg

SEQ ID NO: 3693591 - RNA, 22 nt, Salmonella enterica enterica serovar Typhi Ty2
gcugugguugcccgcaggcuuc

SEQ ID NO: 3693592 - RNA, 16 nt, Salmonella enterica enterica serovar Typhi Ty2
gcuguguccaggucau

SEQ ID NO: 3693593 - RNA, 19 nt, Salmonella enterica enterica serovar Typhi Ty2
gcuguuaaaaccggcugcc

SEQ ID NO: 3693594 - RNA, 17 nt, Salmonella enterica enterica serovar Typhi Ty2
gcuguuaaccuugcgcc

SEQ ID NO: 3693595 - RNA, 19 nt, Salmonella enterica enterica serovar Typhi Ty2
gcuguuaaucucauaaaug

SEQ ID NO: 3693596 - RNA, 23 nt, Salmonella enterica enterica serovar Typhi Ty2
gcuguuaccaaugccaaaaaaac

SEQ ID NO: 3693597 - RNA, 16 nt, Salmonella enterica enterica serovar Typhi Ty2
gcuguuaccguaagcg

SEQ ID NO: 3693598 - RNA, 17 nt, Salmonella enterica enterica serovar Typhi Ty2
gcuguuaguaagcuggg

SEQ ID NO: 3693599 - RNA, 20 nt, Salmonella enterica enterica serovar Typhi Ty2
gcuguucaaucacugaugcc

SEQ ID NO: 3693600 - RNA, 22 nt, Salmonella enterica enterica serovar Typhi Ty2
gcuguucaaucacugaugccac

SEQ ID NO: 3693601 - RNA, 21 nt, Salmonella enterica enterica serovar Typhi Ty2
gcuguuccaccaacgaccauc

SEQ ID NO: 3693602 - RNA, 13 nt, Salmonella enterica enterica serovar Typhi Ty2
gcuguuccacggg

SEQ ID NO: 3693603 - RNA, 20 nt, Salmonella enterica enterica serovar Typhi Ty2
gcuguuccugcgggaacaga

SEQ ID NO: 3693604 - RNA, 13 nt, Salmonella enterica enterica serovar Typhi Ty2
gcuguuccuggug

SEQ ID NO: 3693605 - RNA, 23 nt, Salmonella enterica enterica serovar Typhi Ty2
gcuguugugucccggcccauacu

SEQ ID NO: 3693606 - RNA, 19 nt, Salmonella enterica enterica serovar Typhi Ty2
gcuguuguugcucggcguc

SEQ ID NO: 3693607 - RNA, 18 nt, Salmonella enterica enterica serovar Typhi Ty2
gcuguuuauccacaggcg

SEQ ID NO: 3693608 - RNA, 13 nt, Salmonella enterica enterica serovar Typhi Ty2
gcuguuucucgau

SEQ ID NO: 3693609 - RNA, 20 nt, Salmonella enterica enterica serovar Typhi Ty2
gcuguuucuggucauacugu

SEQ ID NO: 3693610 - RNA, 13 nt, Salmonella enterica enterica serovar Typhi Ty2
gcuguuuuccgcu

SEQ ID NO: 3693611 - RNA, 15 nt, Salmonella enterica enterica serovar Typhi Ty2
gcuguuuuuacgcca

SEQ ID NO: 3693612 - RNA, 16 nt, Salmonella enterica enterica serovar Typhi Ty2
gcuguuuuucaucauc

SEQ ID NO: 3693613 - RNA, 21 nt, Salmonella enterica enterica serovar Typhi Ty2
gcuguuuuucaucaucaucca

SEQ ID NO: 3693614 - RNA, 23 nt, Salmonella enterica enterica serovar Typhi Ty2
gcuguuuuucaucaucauccaga

SEQ ID NO: 3693615 - RNA, 13 nt, Salmonella enterica enterica serovar Typhi Ty2
gcuguuuuuuguu

SEQ ID NO: 3693616 - RNA, 13 nt, Salmonella enterica enterica serovar Typhi Ty2
gcuuaaaaaaucc

SEQ ID NO: 3693617 - RNA, 16 nt, Salmonella enterica enterica serovar Typhi Ty2
gcuuaaaagcggcaag

SEQ ID NO: 3693618 - RNA, 18 nt, Salmonella enterica enterica serovar Typhi Ty2
gcuuaacagaauugcgcc

SEQ ID NO: 3693619 - RNA, 21 nt, Salmonella enterica enterica serovar Typhi Ty2
gcuucaucaccaucgccggag

SEQ ID NO: 3693620 - RNA, 12 nt, Salmonella enterica enterica serovar Typhi Ty2
gcuucaugcugg

SEQ ID NO: 3693621 - RNA, 19 nt, Salmonella enterica enterica serovar Typhi Ty2
gcuucauugguuaauucaa

SEQ ID NO: 3693622 - RNA, 17 nt, Salmonella enterica enterica serovar Typhi Ty2
gcuuccaccucuucugc

SEQ ID NO: 3693623 - RNA, 20 nt, Salmonella enterica enterica serovar Typhi Ty2
gcuuccacgcacgccggccc

SEQ ID NO: 3693624 - RNA, 22 nt, Salmonella enterica enterica serovar Typhi Ty2
gcuuccagcaaaccuuccgcca

SEQ ID NO: 3693625 - RNA, 13 nt, Salmonella enterica enterica serovar Typhi Ty2
gcuuccagcucca

SEQ ID NO: 3693626 - RNA, 17 nt, Salmonella enterica enterica serovar Typhi Ty2
gcuuccagcuccaucca

SEQ ID NO: 3693627 - RNA, 15 nt, Salmonella enterica enterica serovar Typhi Ty2
gcuuccaguagccua

SEQ ID NO: 3693628 - RNA, 19 nt, Salmonella enterica enterica serovar Typhi Ty2
gcuucccacagucggcgaa

SEQ ID NO: 3693629 - RNA, 15 nt, Salmonella enterica enterica serovar Typhi Ty2
gcuucccccggcgcc

SEQ ID NO: 3693630 - RNA, 16 nt, Salmonella enterica enterica serovar Typhi Ty2
gcuucccgaaaggaag

SEQ ID NO: 3693631 - RNA, 17 nt, Salmonella enterica enterica serovar Typhi Ty2
gcuucccgaaaggaagc

SEQ ID NO: 3693632 - RNA, 15 nt, Salmonella enterica enterica serovar Typhi Ty2
gcuuccgccaugguu

SEQ ID NO: 3693633 - RNA, 17 nt, Salmonella enterica enterica serovar Typhi Ty2
gcuuccggcacuuucag

SEQ ID NO: 3693634 - RNA, 15 nt, Salmonella enterica enterica serovar Typhi Ty2
gcuuccguccccagc

SEQ ID NO: 3693635 - RNA, 14 nt, Salmonella enterica enterica serovar Typhi Ty2
gcuuccugcagugg

SEQ ID NO: 3693636 - RNA, 13 nt, Salmonella enterica enterica serovar Typhi Ty2
gcuuccuggaugu

SEQ ID NO: 3693637 - RNA, 19 nt, Salmonella enterica enterica serovar Typhi Ty2
gcuucgacauagccuuugu

SEQ ID NO: 3693638 - RNA, 20 nt, Salmonella enterica enterica serovar Typhi Ty2
gcuucgauuuuguuaugcgc

SEQ ID NO: 3693639 - RNA, 13 nt, Salmonella enterica enterica serovar Typhi Ty2
gcuucgccaauaa

SEQ ID NO: 3693640 - RNA, 22 nt, Salmonella enterica enterica serovar Typhi Ty2
gcuucgccaauaaugccgccgu

SEQ ID NO: 3693641 - RNA, 24 nt, Salmonella enterica enterica serovar Typhi Ty2
gcuucgcgaacugcacucggaugu

SEQ ID NO: 3693642 - RNA, 20 nt, Salmonella enterica enterica serovar Typhi Ty2
gcuucgcgcagccagcgccc

SEQ ID NO: 3693643 - RNA, 17 nt, Salmonella enterica enterica serovar Typhi Ty2
gcuucgcucucgugcca

SEQ ID NO: 3693644 - RNA, 15 nt, Salmonella enterica enterica serovar Typhi Ty2
gcuucggacuccuga

SEQ ID NO: 3693645 - RNA, 17 nt, Salmonella enterica enterica serovar Typhi Ty2
gcuucgguccggcgcua

SEQ ID NO: 3693646 - RNA, 21 nt, Salmonella enterica enterica serovar Typhi Ty2
gcuucguaaaacucaugaccg

SEQ ID NO: 3693647 - RNA, 17 nt, Salmonella enterica enterica serovar Typhi Ty2
gcuucgucaggcggcug

SEQ ID NO: 3693648 - RNA, 22 nt, Salmonella enterica enterica serovar Typhi Ty2
gcuucgucccugcauuauccac

SEQ ID NO: 3693649 - RNA, 22 nt, Salmonella enterica enterica serovar Typhi Ty2
gcuucgucgagcagugauucgc

SEQ ID NO: 3693650 - RNA, 15 nt, Salmonella enterica enterica serovar Typhi Ty2
gcuucguggcaauca

SEQ ID NO: 3693651 - RNA, 22 nt, Salmonella enterica enterica serovar Typhi Ty2
gcuucguuccgcgauuuccugu

SEQ ID NO: 3693652 - RNA, 16 nt, Salmonella enterica enterica serovar Typhi Ty2
gcuucguucuguauca

SEQ ID NO: 3693653 - RNA, 16 nt, Salmonella enterica enterica serovar Typhi Ty2
gcuucuauuaccgcag

SEQ ID NO: 3693654 - RNA, 22 nt, Salmonella enterica enterica serovar Typhi Ty2
gcuucucacggauccagaacug

SEQ ID NO: 3693655 - RNA, 20 nt, Salmonella enterica enterica serovar Typhi Ty2
gcuucuccaccauaucgcag

SEQ ID NO: 3693656 - RNA, 11 nt, Salmonella enterica enterica serovar Typhi Ty2
gcuucucccaa

SEQ ID NO: 3693657 - RNA, 14 nt, Salmonella enterica enterica serovar Typhi Ty2
gcuucucuuuccag

SEQ ID NO: 3693658 - RNA, 16 nt, Salmonella enterica enterica serovar Typhi Ty2
gcuucugauacugcuc

SEQ ID NO: 3693659 - RNA, 17 nt, Salmonella enterica enterica serovar Typhi Ty2
gcuucugauacugcucc

SEQ ID NO: 3693660 - RNA, 21 nt, Salmonella enterica enterica serovar Typhi Ty2
gcuucugcgccuuuggcagga

SEQ ID NO: 3693661 - RNA, 16 nt, Salmonella enterica enterica serovar Typhi Ty2
gcuucugucagccuug

SEQ ID NO: 3693662 - RNA, 15 nt, Salmonella enterica enterica serovar Typhi Ty2
gcuucuucgccagcu

SEQ ID NO: 3693663 - RNA, 18 nt, Salmonella enterica enterica serovar Typhi Ty2
gcuucuucuuuagauaau

SEQ ID NO: 3693664 - RNA, 13 nt, Salmonella enterica enterica serovar Typhi Ty2
gcuucuuggcgau

SEQ ID NO: 3693665 - RNA, 16 nt, Salmonella enterica enterica serovar Typhi Ty2
gcuucuuguucacgug

SEQ ID NO: 3693666 - RNA, 17 nt, Salmonella enterica enterica serovar Typhi Ty2
gcuugaauaacauaaag

SEQ ID NO: 3693667 - RNA, 15 nt, Salmonella enterica enterica serovar Typhi Ty2
gcuugagccagcgcu

SEQ ID NO: 3693668 - RNA, 19 nt, Salmonella enterica enterica serovar Typhi Ty2
gcuugaguuuuccgccauu

SEQ ID NO: 3693669 - RNA, 12 nt, Salmonella enterica enterica serovar Typhi Ty2
gcuugauaaaua

SEQ ID NO: 3693670 - RNA, 14 nt, Salmonella enterica enterica serovar Typhi Ty2
gcuugauaaauauc

SEQ ID NO: 3693671 - RNA, 13 nt, Salmonella enterica enterica serovar Typhi Ty2
gcuugauacgcca

SEQ ID NO: 3693672 - RNA, 20 nt, Salmonella enterica enterica serovar Typhi Ty2
gcuugaucucucccuggcag

SEQ ID NO: 3693673 - RNA, 23 nt, Salmonella enterica enterica serovar Typhi Ty2
gcuugcagcguaauagucugcuc

SEQ ID NO: 3693674 - RNA, 19 nt, Salmonella enterica enterica serovar Typhi Ty2
gcuugcauugcuuuuaguu

SEQ ID NO: 3693675 - RNA, 20 nt, Salmonella enterica enterica serovar Typhi Ty2
gcuugccacuacgcagcucc

SEQ ID NO: 3693676 - RNA, 16 nt, Salmonella enterica enterica serovar Typhi Ty2
gcuugcccagcauauu

SEQ ID NO: 3693677 - RNA, 19 nt, Salmonella enterica enterica serovar Typhi Ty2
gcuugcccgauggcgcugc

SEQ ID NO: 3693678 - RNA, 21 nt, Salmonella enterica enterica serovar Typhi Ty2
gcuugcccggccuacauucau

SEQ ID NO: 3693679 - RNA, 22 nt, Salmonella enterica enterica serovar Typhi Ty2
gcuugccgucacaggcggccag

SEQ ID NO: 3693680 - RNA, 21 nt, Salmonella enterica enterica serovar Typhi Ty2
gcuugccgucgucauaagcaa

SEQ ID NO: 3693681 - RNA, 12 nt, Salmonella enterica enterica serovar Typhi Ty2
gcuugccugcuu

SEQ ID NO: 3693682 - RNA, 19 nt, Salmonella enterica enterica serovar Typhi Ty2
gcuugccugugcccgcggu

SEQ ID NO: 3693683 - RNA, 19 nt, Salmonella enterica enterica serovar Typhi Ty2
gcuugcgccaucauccggc

SEQ ID NO: 3693684 - RNA, 20 nt, Salmonella enterica enterica serovar Typhi Ty2
gcuugcgccaucauccggca

SEQ ID NO: 3693685 - RNA, 14 nt, Salmonella enterica enterica serovar Typhi Ty2
gcuugcgcuauccg

SEQ ID NO: 3693686 - RNA, 20 nt, Salmonella enterica enterica serovar Typhi Ty2
gcuugcguguuugggcgagg

SEQ ID NO: 3693687 - RNA, 16 nt, Salmonella enterica enterica serovar Typhi Ty2
gcuugcugcguaaaag

SEQ ID NO: 3693688 - RNA, 19 nt, Salmonella enterica enterica serovar Typhi Ty2
gcuugcuuuucaucaccau

SEQ ID NO: 3693689 - RNA, 20 nt, Salmonella enterica enterica serovar Typhi Ty2
gcuuggccaguggggcugcu

SEQ ID NO: 3693690 - RNA, 17 nt, Salmonella enterica enterica serovar Typhi Ty2
gcuuggcggcuuccugu

SEQ ID NO: 3693691 - RNA, 20 nt, Salmonella enterica enterica serovar Typhi Ty2
gcuuggcguauagccgcccc

SEQ ID NO: 3693692 - RNA, 20 nt, Salmonella enterica enterica serovar Typhi Ty2
gcuugggccaccugccaggc

SEQ ID NO: 3693693 - RNA, 16 nt, Salmonella enterica enterica serovar Typhi Ty2
gcuugucauccugcuc

SEQ ID NO: 3693694 - RNA, 17 nt, Salmonella enterica enterica serovar Typhi Ty2
gcuugucgccaugcacc

SEQ ID NO: 3693695 - RNA, 19 nt, Salmonella enterica enterica serovar Typhi Ty2
gcuugucgcgagcuuccag

SEQ ID NO: 3693696 - RNA, 21 nt, Salmonella enterica enterica serovar Typhi Ty2
gcuuguuacugcauuccgcgu

SEQ ID NO: 3693697 - RNA, 19 nt, Salmonella enterica enterica serovar Typhi Ty2
gcuuguucuuuucaauaaa

SEQ ID NO: 3693698 - RNA, 20 nt, Salmonella enterica enterica serovar Typhi Ty2
gcuuguuguuuauccugcaa

SEQ ID NO: 3693699 - RNA, 17 nt, Salmonella enterica enterica serovar Typhi Ty2
gcuuuaacgcugcaaag

SEQ ID NO: 3693700 - RNA, 13 nt, Salmonella enterica enterica serovar Typhi Ty2
gcuuuaaguuuuu

SEQ ID NO: 3693701 - RNA, 22 nt, Salmonella enterica enterica serovar Typhi Ty2
ggaaagucuuaccuguauuaug

SEQ ID NO: 3693702 - RNA, 17 nt, Salmonella enterica enterica serovar Typhi Ty2
ggaaagugaaggccaga

SEQ ID NO: 3693703 - RNA, 15 nt, Salmonella enterica enterica serovar Typhi Ty2
ggaaauaauuaaucc

SEQ ID NO: 3693704 - RNA, 13 nt, Salmonella enterica enterica serovar Typhi Ty2
ggaaauagagcag

SEQ ID NO: 3693705 - RNA, 19 nt, Salmonella enterica enterica serovar Typhi Ty2
ggaaaucaacaaucccuua

SEQ ID NO: 3693706 - RNA, 22 nt, Salmonella enterica enterica serovar Typhi Ty2
ggaaaucaugccagaauugcac

SEQ ID NO: 3693707 - RNA, 22 nt, Salmonella enterica enterica serovar Typhi Ty2
ggaaaucuguuccagcgagcag

SEQ ID NO: 3693708 - RNA, 17 nt, Salmonella enterica enterica serovar Typhi Ty2
ggaaauuaaacugccuu

SEQ ID NO: 3693709 - RNA, 21 nt, Salmonella enterica enterica serovar Typhi Ty2
ggaacaacggcacacaggccg

SEQ ID NO: 3693710 - RNA, 16 nt, Salmonella enterica enterica serovar Typhi Ty2
ggaacacgaauaugca

SEQ ID NO: 3693711 - RNA, 15 nt, Salmonella enterica enterica serovar Typhi Ty2
ggaacagaagccugc

SEQ ID NO: 3693712 - RNA, 17 nt, Salmonella enterica enterica serovar Typhi Ty2
ggaacagauacuggaag

SEQ ID NO: 3693713 - RNA, 21 nt, Salmonella enterica enterica serovar Typhi Ty2
ggaacaguuuaguugccguuu

SEQ ID NO: 3693714 - RNA, 13 nt, Salmonella enterica enterica serovar Typhi Ty2
ggaacaucuuuua

SEQ ID NO: 3693715 - RNA, 18 nt, Salmonella enterica enterica serovar Typhi Ty2
ggaaccaaaugcccagcu

SEQ ID NO: 3693716 - RNA, 13 nt, Salmonella enterica enterica serovar Typhi Ty2
ggaaccaggcgcg

SEQ ID NO: 3693717 - RNA, 13 nt, Salmonella enterica enterica serovar Typhi Ty2
ggaacccagcaaa

SEQ ID NO: 3693718 - RNA, 12 nt, Salmonella enterica enterica serovar Typhi Ty2
ggaaccuggcag

SEQ ID NO: 3693719 - RNA, 10 nt, Salmonella enterica enterica serovar Typhi Ty2
ggaacgcugu

SEQ ID NO: 3693720 - RNA, 24 nt, Salmonella enterica enterica serovar Typhi Ty2
ggaacggcauacugucgcgcggcg

SEQ ID NO: 3693721 - RNA, 21 nt, Salmonella enterica enterica serovar Typhi Ty2
ggaacguccaguugucaucgu

SEQ ID NO: 3693722 - RNA, 15 nt, Salmonella enterica enterica serovar Typhi Ty2
ggaacguugcgccau

SEQ ID NO: 3693723 - RNA, 17 nt, Salmonella enterica enterica serovar Typhi Ty2
ggaacugacuccagcug

SEQ ID NO: 3693724 - RNA, 19 nt, Salmonella enterica enterica serovar Typhi Ty2
ggaacuggcagcagugaca

SEQ ID NO: 3693725 - RNA, 23 nt, Salmonella enterica enterica serovar Typhi Ty2
ggaagaaacgcuuaaagcguucc

SEQ ID NO: 3693726 - RNA, 17 nt, Salmonella enterica enterica serovar Typhi Ty2
ggaagaaggcuccggca

SEQ ID NO: 3693727 - RNA, 21 nt, Salmonella enterica enterica serovar Typhi Ty2
ggaagacauucacauauauuu

SEQ ID NO: 3693728 - RNA, 14 nt, Salmonella enterica enterica serovar Typhi Ty2
ggaagacuggcgca

SEQ ID NO: 3693729 - RNA, 20 nt, Salmonella enterica enterica serovar Typhi Ty2
ggaagauaagaaaaaacugg

SEQ ID NO: 3693730 - RNA, 18 nt, Salmonella enterica enterica serovar Typhi Ty2
ggaagauguugccguaac

SEQ ID NO: 3693731 - RNA, 23 nt, Salmonella enterica enterica serovar Typhi Ty2
ggaagcccucggcgaacaggcgu

SEQ ID NO: 3693732 - RNA, 17 nt, Salmonella enterica enterica serovar Typhi Ty2
ggaagcgcgaaucgccu

SEQ ID NO: 3693733 - RNA, 15 nt, Salmonella enterica enterica serovar Typhi Ty2
ggaaggaaauaacgu

SEQ ID NO: 3693734 - RNA, 18 nt, Salmonella enterica enterica serovar Typhi Ty2
ggaaggauagccguauga

SEQ ID NO: 3693735 - RNA, 18 nt, Salmonella enterica enterica serovar Typhi Ty2
ggaauaaaggucacauca

SEQ ID NO: 3693736 - RNA, 21 nt, Salmonella enterica enterica serovar Typhi Ty2
ggaauaacaucguaaaucaaa

SEQ ID NO: 3693737 - RNA, 15 nt, Salmonella enterica enterica serovar Typhi Ty2
ggaauaacuccagug

SEQ ID NO: 3693738 - RNA, 23 nt, Salmonella enterica enterica serovar Typhi Ty2
ggaauaagggugagaggggaucu

SEQ ID NO: 3693739 - RNA, 19 nt, Salmonella enterica enterica serovar Typhi Ty2
ggaauagacagugauuuac

SEQ ID NO: 3693740 - RNA, 14 nt, Salmonella enterica enterica serovar Typhi Ty2
ggaauaucaauuca

SEQ ID NO: 3693741 - RNA, 13 nt, Salmonella enterica enterica serovar Typhi Ty2
ggaauauccgcgc

SEQ ID NO: 3693742 - RNA, 15 nt, Salmonella enterica enterica serovar Typhi Ty2
ggaauaugauuuaaa

SEQ ID NO: 3693743 - RNA, 21 nt, Salmonella enterica enterica serovar Typhi Ty2
ggaauauucgcuucuucggca

SEQ ID NO: 3693744 - RNA, 17 nt, Salmonella enterica enterica serovar Typhi Ty2
ggaauauugagaauaaa

SEQ ID NO: 3693745 - RNA, 12 nt, Salmonella enterica enterica serovar Typhi Ty2
ggaauauuggua

SEQ ID NO: 3693746 - RNA, 22 nt, Salmonella enterica enterica serovar Typhi Ty2
ggaaucaauuucccuucaauca

SEQ ID NO: 3693747 - RNA, 13 nt, Salmonella enterica enterica serovar Typhi Ty2
ggaaucagccagg

SEQ ID NO: 3693748 - RNA, 22 nt, Salmonella enterica enterica serovar Typhi Ty2
ggaaucgaccaugguuucgaac

SEQ ID NO: 3693749 - RNA, 24 nt, Salmonella enterica enterica serovar Typhi Ty2
ggaaucggacacuugcaacucgca

SEQ ID NO: 3693750 - RNA, 15 nt, Salmonella enterica enterica serovar Typhi Ty2
ggaaucgucacagac

SEQ ID NO: 3693751 - RNA, 23 nt, Salmonella enterica enterica serovar Typhi Ty2
ggaaugaauguuagcgucugcgg

SEQ ID NO: 3693752 - RNA, 12 nt, Salmonella enterica enterica serovar Typhi Ty2
ggaaugcccagc

SEQ ID NO: 3693753 - RNA, 13 nt, Salmonella enterica enterica serovar Typhi Ty2
ggaaugcuuuaca

SEQ ID NO: 3693754 - RNA, 15 nt, Salmonella enterica enterica serovar Typhi Ty2
ggaauggcgggcgca

SEQ ID NO: 3693755 - RNA, 23 nt, Salmonella enterica enterica serovar Typhi Ty2
ggaauguuccccguugagaaugg

SEQ ID NO: 3693756 - RNA, 17 nt, Salmonella enterica enterica serovar Typhi Ty2
ggaauguuuggcgccau

SEQ ID NO: 3693757 - RNA, 18 nt, Salmonella enterica enterica serovar Typhi Ty2
ggaauuuaucaacaaauu

SEQ ID NO: 3693758 - RNA, 18 nt, Salmonella enterica enterica serovar Typhi Ty2
ggacaacgccgguacgca

SEQ ID NO: 3693759 - RNA, 16 nt, Salmonella enterica enterica serovar Typhi Ty2
ggacaacgcuccagca

SEQ ID NO: 3693760 - RNA, 13 nt, Salmonella enterica enterica serovar Typhi Ty2
ggacaauccgcga

SEQ ID NO: 3693761 - RNA, 16 nt, Salmonella enterica enterica serovar Typhi Ty2
ggacacauuucuuuug

SEQ ID NO: 3693762 - RNA, 14 nt, Salmonella enterica enterica serovar Typhi Ty2
ggacacccgcagcc

SEQ ID NO: 3693763 - RNA, 20 nt, Salmonella enterica enterica serovar Typhi Ty2
ggacagacuucauuuuccac

SEQ ID NO: 3693764 - RNA, 13 nt, Salmonella enterica enterica serovar Typhi Ty2
ggacauaaacgcc

SEQ ID NO: 3693765 - RNA, 19 nt, Salmonella enterica enterica serovar Typhi Ty2
ggacauaaacgccucaucc

SEQ ID NO: 3693766 - RNA, 17 nt, Salmonella enterica enterica serovar Typhi Ty2
ggacauauuccagaagc

SEQ ID NO: 3693767 - RNA, 11 nt, Salmonella enterica enterica serovar Typhi Ty2
ggacaucaucc

SEQ ID NO: 3693768 - RNA, 12 nt, Salmonella enterica enterica serovar Typhi Ty2
ggacaucgccau

SEQ ID NO: 3693769 - RNA, 21 nt, Salmonella enterica enterica serovar Typhi Ty2
ggacaucggcacgcgaucgcg

SEQ ID NO: 3693770 - RNA, 14 nt, Salmonella enterica enterica serovar Typhi Ty2
ggacaucggccucg

SEQ ID NO: 3693771 - RNA, 17 nt, Salmonella enterica enterica serovar Typhi Ty2
ggacaugguaauaacgc

SEQ ID NO: 3693772 - RNA, 12 nt, Salmonella enterica enterica serovar Typhi Ty2
ggaccguacuca

SEQ ID NO: 3693773 - RNA, 19 nt, Salmonella enterica enterica serovar Typhi Ty2
ggaccguguucaugcagcc

SEQ ID NO: 3693774 - RNA, 23 nt, Salmonella enterica enterica serovar Typhi Ty2
ggaccuguguauucugcgccagc

SEQ ID NO: 3693775 - RNA, 22 nt, Salmonella enterica enterica serovar Typhi Ty2
ggacgaacaacaucagacagua

SEQ ID NO: 3693776 - RNA, 21 nt, Salmonella enterica enterica serovar Typhi Ty2
ggacgaaugcgaaaaguaaag

SEQ ID NO: 3693777 - RNA, 20 nt, Salmonella enterica enterica serovar Typhi Ty2
ggacgaauuuccagcgggcg

SEQ ID NO: 3693778 - RNA, 20 nt, Salmonella enterica enterica serovar Typhi Ty2
ggacgagcgcgucagcgccu

SEQ ID NO: 3693779 - RNA, 20 nt, Salmonella enterica enterica serovar Typhi Ty2
ggacgauaaccaugcucagc

SEQ ID NO: 3693780 - RNA, 15 nt, Salmonella enterica enterica serovar Typhi Ty2
ggacgaugaaccugu

SEQ ID NO: 3693781 - RNA, 18 nt, Salmonella enterica enterica serovar Typhi Ty2
ggacgcaccagccaggcg

SEQ ID NO: 3693782 - RNA, 15 nt, Salmonella enterica enterica serovar Typhi Ty2
ggacgccaccacgcc

SEQ ID NO: 3693783 - RNA, 12 nt, Salmonella enterica enterica serovar Typhi Ty2
ggauagcaaucu

SEQ ID NO: 3693784 - RNA, 20 nt, Salmonella enterica enterica serovar Typhi Ty2
ggauaguacugaccagacag

SEQ ID NO: 3693785 - RNA, 21 nt, Salmonella enterica enterica serovar Typhi Ty2
ggauauaaaaaacauauaauu

SEQ ID NO: 3693786 - RNA, 19 nt, Salmonella enterica enterica serovar Typhi Ty2
ggauaugcgacgaaagcgg

SEQ ID NO: 3693787 - RNA, 13 nt, Salmonella enterica enterica serovar Typhi Ty2
ggauauggcaaaa

SEQ ID NO: 3693788 - RNA, 16 nt, Salmonella enterica enterica serovar Typhi Ty2
ggauauguuugacaag

SEQ ID NO: 3693789 - RNA, 17 nt, Salmonella enterica enterica serovar Typhi Ty2
ggauauguuugacaagc

SEQ ID NO: 3693790 - RNA, 18 nt, Salmonella enterica enterica serovar Typhi Ty2
ggauauuacccggccagu

SEQ ID NO: 3693791 - RNA, 21 nt, Salmonella enterica enterica serovar Typhi Ty2
ggauauucugcacgcacgaca

SEQ ID NO: 3693792 - RNA, 18 nt, Salmonella enterica enterica serovar Typhi Ty2
ggauauugccgaagacca

SEQ ID NO: 3693793 - RNA, 16 nt, Salmonella enterica enterica serovar Typhi Ty2
ggauauuggcguuaga

SEQ ID NO: 3693794 - RNA, 21 nt, Salmonella enterica enterica serovar Typhi Ty2
ggaucaaaaaggugagcauug

SEQ ID NO: 3693795 - RNA, 19 nt, Salmonella enterica enterica serovar Typhi Ty2
ggaucaaacgugccuggau

SEQ ID NO: 3693796 - RNA, 23 nt, Salmonella enterica enterica serovar Typhi Ty2
ggaucaaccaccuucaccggaua

SEQ ID NO: 3693797 - RNA, 17 nt, Salmonella enterica enterica serovar Typhi Ty2
ggaucaagcaaugccag

SEQ ID NO: 3693798 - RNA, 15 nt, Salmonella enterica enterica serovar Typhi Ty2
ggaucaauaugccag

SEQ ID NO: 3693799 - RNA, 16 nt, Salmonella enterica enterica serovar Typhi Ty2
ggaucaauuuuucgcc

SEQ ID NO: 3693800 - RNA, 15 nt, Salmonella enterica enterica serovar Typhi Ty2
ggaucagacggcuga

SEQ ID NO: 3693801 - RNA, 20 nt, Salmonella enterica enterica serovar Typhi Ty2
ggaucagcagauccaucgcc

SEQ ID NO: 3693802 - RNA, 14 nt, Salmonella enterica enterica serovar Typhi Ty2
ggaucaucggccag

SEQ ID NO: 3693803 - RNA, 15 nt, Salmonella enterica enterica serovar Typhi Ty2
ggaucaucggccaga

SEQ ID NO: 3693804 - RNA, 19 nt, Salmonella enterica enterica serovar Typhi Ty2
ggaucaucggcucagcaau

SEQ ID NO: 3693805 - RNA, 13 nt, Salmonella enterica enterica serovar Typhi Ty2
ggaucaucuuuua

SEQ ID NO: 3693806 - RNA, 16 nt, Salmonella enterica enterica serovar Typhi Ty2
ggaucaugguugaaaa

SEQ ID NO: 3693807 - RNA, 15 nt, Salmonella enterica enterica serovar Typhi Ty2
ggaucgggcuuccag

SEQ ID NO: 3693808 - RNA, 21 nt, Salmonella enterica enterica serovar Typhi Ty2
ggaucggucuggcgcauaaug

SEQ ID NO: 3693809 - RNA, 14 nt, Salmonella enterica enterica serovar Typhi Ty2
ggaucgguuuaucc

SEQ ID NO: 3693810 - RNA, 16 nt, Salmonella enterica enterica serovar Typhi Ty2
ggaucguacaacggau

SEQ ID NO: 3693811 - RNA, 13 nt, Salmonella enterica enterica serovar Typhi Ty2
ggaucuuccugcg

SEQ ID NO: 3693812 - RNA, 20 nt, Salmonella enterica enterica serovar Typhi Ty2
ggaugaagcagacaucgcgc

SEQ ID NO: 3693813 - RNA, 17 nt, Salmonella enterica enterica serovar Typhi Ty2
ggaugaccaguuaagca

SEQ ID NO: 3693814 - RNA, 23 nt, Salmonella enterica enterica serovar Typhi Ty2
ggaugacggcgaacggggagaca

SEQ ID NO: 3693815 - RNA, 18 nt, Salmonella enterica enterica serovar Typhi Ty2
ggaugagcguuagcgcca

SEQ ID NO: 3693816 - RNA, 20 nt, Salmonella enterica enterica serovar Typhi Ty2
ggaugaggcgcagccgccau

SEQ ID NO: 3693817 - RNA, 13 nt, Salmonella enterica enterica serovar Typhi Ty2
ggaugcagucugg

SEQ ID NO: 3693818 - RNA, 13 nt, Salmonella enterica enterica serovar Typhi Ty2
ggaugccccacuu

SEQ ID NO: 3693819 - RNA, 16 nt, Salmonella enterica enterica serovar Typhi Ty2
ggaugccccaucacgg

SEQ ID NO: 3693820 - RNA, 20 nt, Salmonella enterica enterica serovar Typhi Ty2
ggaugcgagaaugucgccau

SEQ ID NO: 3693821 - RNA, 24 nt, Salmonella enterica enterica serovar Typhi Ty2
ggaugcgccauccaccaggcaugc

SEQ ID NO: 3693822 - RNA, 19 nt, Salmonella enterica enterica serovar Typhi Ty2
ggaugcgccgcccaccgcc

SEQ ID NO: 3693823 - RNA, 17 nt, Salmonella enterica enterica serovar Typhi Ty2
ggaugcgcugaauagcg

SEQ ID NO: 3693824 - RNA, 22 nt, Salmonella enterica enterica serovar Typhi Ty2
ggaugcguaauccggccuggcg

SEQ ID NO: 3693825 - RNA, 17 nt, Salmonella enterica enterica serovar Typhi Ty2
ggauggcaguacagggc

SEQ ID NO: 3693826 - RNA, 15 nt, Salmonella enterica enterica serovar Typhi Ty2
ggauggccucugcca

SEQ ID NO: 3693827 - RNA, 16 nt, Salmonella enterica enterica serovar Typhi Ty2
ggauggccucugccag

SEQ ID NO: 3693828 - RNA, 12 nt, Salmonella enterica enterica serovar Typhi Ty2
ggauggcggcga

SEQ ID NO: 3693829 - RNA, 12 nt, Salmonella enterica enterica serovar Typhi Ty2
ggauggcggcgc

SEQ ID NO: 3693830 - RNA, 21 nt, Salmonella enterica enterica serovar Typhi Ty2
ggauggcgucgcuacgggcgc

SEQ ID NO: 3693831 - RNA, 11 nt, Salmonella enterica enterica serovar Typhi Ty2
ggauguaggcc

SEQ ID NO: 3693832 - RNA, 12 nt, Salmonella enterica enterica serovar Typhi Ty2
ggaugucggcgu

SEQ ID NO: 3693833 - RNA, 13 nt, Salmonella enterica enterica serovar Typhi Ty2
ggauguggugcgg

SEQ ID NO: 3693834 - RNA, 20 nt, Salmonella enterica enterica serovar Typhi Ty2
ggauguuaauuucaucgccg

SEQ ID NO: 3693835 - RNA, 17 nt, Salmonella enterica enterica serovar Typhi Ty2
ggauguugccacaggcu

SEQ ID NO: 3693836 - RNA, 15 nt, Salmonella enterica enterica serovar Typhi Ty2
ggauuacgacccaca

SEQ ID NO: 3693837 - RNA, 19 nt, Salmonella enterica enterica serovar Typhi Ty2
ggauuacgcgccugccuga

SEQ ID NO: 3693838 - RNA, 16 nt, Salmonella enterica enterica serovar Typhi Ty2
ggauuaucgaaauagc

SEQ ID NO: 3693839 - RNA, 19 nt, Salmonella enterica enterica serovar Typhi Ty2
ggauucgacggccagcgcg

SEQ ID NO: 3693840 - RNA, 21 nt, Salmonella enterica enterica serovar Typhi Ty2
ggauucucuaacgucagcgcc

SEQ ID NO: 3693841 - RNA, 16 nt, Salmonella enterica enterica serovar Typhi Ty2
ggauucugccaucgac

SEQ ID NO: 3693842 - RNA, 22 nt, Salmonella enterica enterica serovar Typhi Ty2
ggauugaaccuaaaaaccagaa

SEQ ID NO: 3693843 - RNA, 14 nt, Salmonella enterica enterica serovar Typhi Ty2
ggauuggucugauu

SEQ ID NO: 3693844 - RNA, 11 nt, Salmonella enterica enterica serovar Typhi Ty2
ggauugucuua

SEQ ID NO: 3693845 - RNA, 20 nt, Salmonella enterica enterica serovar Typhi Ty2
ggauuuaaaccgccccgacu

SEQ ID NO: 3693846 - RNA, 23 nt, Salmonella enterica enterica serovar Typhi Ty2
ggauuucgucgcuaagcgucaga

SEQ ID NO: 3693847 - RNA, 11 nt, Salmonella enterica enterica serovar Typhi Ty2
ggauuuuaaau

SEQ ID NO: 3693848 - RNA, 17 nt, Salmonella enterica enterica serovar Typhi Ty2
ggauuuuaaauugguua

SEQ ID NO: 3693849 - RNA, 18 nt, Salmonella enterica enterica serovar Typhi Ty2
ggcaaaacgggcggcggc

SEQ ID NO: 3693850 - RNA, 19 nt, Salmonella enterica enterica serovar Typhi Ty2
ggcaaaacgggcggcggcu

SEQ ID NO: 3693851 - RNA, 17 nt, Salmonella enterica enterica serovar Typhi Ty2
ggcaaaccccggacaca

SEQ ID NO: 3693852 - RNA, 15 nt, Salmonella enterica enterica serovar Typhi Ty2
ggcaaaccccugcuc

SEQ ID NO: 3693853 - RNA, 23 nt, Salmonella enterica enterica serovar Typhi Ty2
ggcaaaccugcgguuaauacauc

SEQ ID NO: 3693854 - RNA, 11 nt, Salmonella enterica enterica serovar Typhi Ty2
ggcaaagaccg

SEQ ID NO: 3693855 - RNA, 17 nt, Salmonella enterica enterica serovar Typhi Ty2
ggcaaagccccagucau

SEQ ID NO: 3693856 - RNA, 22 nt, Salmonella enterica enterica serovar Typhi Ty2
ggcaaagcucaacgcaggcugg

SEQ ID NO: 3693857 - RNA, 16 nt, Salmonella enterica enterica serovar Typhi Ty2
ggcaaaggaaugcuuu

SEQ ID NO: 3693858 - RNA, 11 nt, Salmonella enterica enterica serovar Typhi Ty2
ggcaaagguug

SEQ ID NO: 3693859 - RNA, 12 nt, Salmonella enterica enterica serovar Typhi Ty2
ggcaaauaccgu

SEQ ID NO: 3693860 - RNA, 11 nt, Salmonella enterica enterica serovar Typhi Ty2
ggcaaauagcg

SEQ ID NO: 3693861 - RNA, 14 nt, Salmonella enterica enterica serovar Typhi Ty2
ggcaaaucaacauu

SEQ ID NO: 3693862 - RNA, 19 nt, Salmonella enterica enterica serovar Typhi Ty2
ggcaaauuaucccuuccuc

SEQ ID NO: 3693863 - RNA, 12 nt, Salmonella enterica enterica serovar Typhi Ty2
ggcaacagccau

SEQ ID NO: 3693864 - RNA, 22 nt, Salmonella enterica enterica serovar Typhi Ty2
ggcaacagccauuuuaaaaaua

SEQ ID NO: 3693865 - RNA, 17 nt, Salmonella enterica enterica serovar Typhi Ty2
ggcagcgcgccagcgcu

SEQ ID NO: 3693866 - RNA, 12 nt, Salmonella enterica enterica serovar Typhi Ty2
ggcagcgucagc

SEQ ID NO: 3693867 - RNA, 14 nt, Salmonella enterica enterica serovar Typhi Ty2
ggcagcguccgcca

SEQ ID NO: 3693868 - RNA, 11 nt, Salmonella enterica enterica serovar Typhi Ty2
ggcagcucucc

SEQ ID NO: 3693869 - RNA, 15 nt, Salmonella enterica enterica serovar Typhi Ty2
ggcagcucugccugu

SEQ ID NO: 3693870 - RNA, 15 nt, Salmonella enterica enterica serovar Typhi Ty2
ggcagcucuuucaac

SEQ ID NO: 3693871 - RNA, 13 nt, Salmonella enterica enterica serovar Typhi Ty2
ggcaggcaaaucu

SEQ ID NO: 3693872 - RNA, 15 nt, Salmonella enterica enterica serovar Typhi Ty2
ggcaggcagcgccag

SEQ ID NO: 3693873 - RNA, 16 nt, Salmonella enterica enterica serovar Typhi Ty2
ggcaggcauggccaau

SEQ ID NO: 3693874 - RNA, 15 nt, Salmonella enterica enterica serovar Typhi Ty2
ggcaggccuaacaca

SEQ ID NO: 3693875 - RNA, 13 nt, Salmonella enterica enterica serovar Typhi Ty2
ggcaggcucacca

SEQ ID NO: 3693876 - RNA, 11 nt, Salmonella enterica enterica serovar Typhi Ty2
ggcaggcuggu

SEQ ID NO: 3693877 - RNA, 16 nt, Salmonella enterica enterica serovar Typhi Ty2
ggcaggcuuccacgca

SEQ ID NO: 3693878 - RNA, 23 nt, Salmonella enterica enterica serovar Typhi Ty2
ggcagggaauacccgcccgguuu

SEQ ID NO: 3693879 - RNA, 18 nt, Salmonella enterica enterica serovar Typhi Ty2
ggcagggaugacagaaag

SEQ ID NO: 3693880 - RNA, 17 nt, Salmonella enterica enterica serovar Typhi Ty2
ggcagguaucgauacag

SEQ ID NO: 3693881 - RNA, 16 nt, Salmonella enterica enterica serovar Typhi Ty2
ggcaguacgcacguuu

SEQ ID NO: 3693882 - RNA, 22 nt, Salmonella enterica enterica serovar Typhi Ty2
ggcagucccaaugcggaaacca

SEQ ID NO: 3693883 - RNA, 13 nt, Salmonella enterica enterica serovar Typhi Ty2
ggcagugcauaaa

SEQ ID NO: 3693884 - RNA, 22 nt, Salmonella enterica enterica serovar Typhi Ty2
ggcaguucagucgggaucgcca

SEQ ID NO: 3693885 - RNA, 12 nt, Salmonella enterica enterica serovar Typhi Ty2
ggcaguucccua

SEQ ID NO: 3693886 - RNA, 14 nt, Salmonella enterica enterica serovar Typhi Ty2
ggcaguuuauccgg

SEQ ID NO: 3693887 - RNA, 14 nt, Salmonella enterica enterica serovar Typhi Ty2
ggcaguuuauucag

SEQ ID NO: 3693888 - RNA, 19 nt, Salmonella enterica enterica serovar Typhi Ty2
ggcauaaaaaagaggaaug

SEQ ID NO: 3693889 - RNA, 17 nt, Salmonella enterica enterica serovar Typhi Ty2
ggcauaaaaagccaucc

SEQ ID NO: 3693890 - RNA, 16 nt, Salmonella enterica enterica serovar Typhi Ty2
ggcauaaacacagcaa

SEQ ID NO: 3693891 - RNA, 19 nt, Salmonella enterica enterica serovar Typhi Ty2
ggcauaaacacagcaaaca

SEQ ID NO: 3693892 - RNA, 13 nt, Salmonella enterica enterica serovar Typhi Ty2
ggcauagaaaaag

SEQ ID NO: 3693893 - RNA, 15 nt, Salmonella enterica enterica serovar Typhi Ty2
ggcauagacauccag

SEQ ID NO: 3693894 - RNA, 23 nt, Salmonella enterica enterica serovar Typhi Ty2
ggcauauggauauucaucgccgu

SEQ ID NO: 3693895 - RNA, 19 nt, Salmonella enterica enterica serovar Typhi Ty2
ggcaucagacgguggccga

SEQ ID NO: 3693896 - RNA, 17 nt, Salmonella enterica enterica serovar Typhi Ty2
ggcauccaguuucuucg

SEQ ID NO: 3693897 - RNA, 18 nt, Salmonella enterica enterica serovar Typhi Ty2
ggcauccggcccgugcca

SEQ ID NO: 3693898 - RNA, 18 nt, Salmonella enterica enterica serovar Typhi Ty2
ggcaucgcccguuuuacc

SEQ ID NO: 3693899 - RNA, 18 nt, Salmonella enterica enterica serovar Typhi Ty2
ggcaucggaaccggggcg

SEQ ID NO: 3693900 - RNA, 11 nt, Salmonella enterica enterica serovar Typhi Ty2
ggcaucucaag

SEQ ID NO: 3693901 - RNA, 23 nt, Salmonella enterica enterica serovar Typhi Ty2
ggcaucugaacacgccgacucac

SEQ ID NO: 3693902 - RNA, 13 nt, Salmonella enterica enterica serovar Typhi Ty2
ggcaucugaucua

SEQ ID NO: 3693903 - RNA, 19 nt, Salmonella enterica enterica serovar Typhi Ty2
ggcaucuuaaagcgggcuu

SEQ ID NO: 3693904 - RNA, 17 nt, Salmonella enterica enterica serovar Typhi Ty2
ggcaucuucagacaguu

SEQ ID NO: 3693905 - RNA, 22 nt, Salmonella enterica enterica serovar Typhi Ty2
ggcaugauguccagcgcgccgg

SEQ ID NO: 3693906 - RNA, 24 nt, Salmonella enterica enterica serovar Typhi Ty2
ggcaugcgccccguuuccgcgacg

SEQ ID NO: 3693907 - RNA, 20 nt, Salmonella enterica enterica serovar Typhi Ty2
ggcauggaugcaugagcacg

SEQ ID NO: 3693908 - RNA, 15 nt, Salmonella enterica enterica serovar Typhi Ty2
ggcauggcagcaggg

SEQ ID NO: 3693909 - RNA, 17 nt, Salmonella enterica enterica serovar Typhi Ty2
ggcauggcucgccgcug

SEQ ID NO: 3693910 - RNA, 17 nt, Salmonella enterica enterica serovar Typhi Ty2
ggcauuaauauccagug

SEQ ID NO: 3693911 - RNA, 17 nt, Salmonella enterica enterica serovar Typhi Ty2
ggcauuacccaguacca

SEQ ID NO: 3693912 - RNA, 17 nt, Salmonella enterica enterica serovar Typhi Ty2
ggcauuagccgccaucc

SEQ ID NO: 3693913 - RNA, 14 nt, Salmonella enterica enterica serovar Typhi Ty2
ggcauuauguuuug

SEQ ID NO: 3693914 - RNA, 14 nt, Salmonella enterica enterica serovar Typhi Ty2
ggcauucacgccac

SEQ ID NO: 3693915 - RNA, 18 nt, Salmonella enterica enterica serovar Typhi Ty2
ggcauuccccaucgcgac

SEQ ID NO: 3693916 - RNA, 22 nt, Salmonella enterica enterica serovar Typhi Ty2
ggcauucgcagaggacauuaaa

SEQ ID NO: 3693917 - RNA, 20 nt, Salmonella enterica enterica serovar Typhi Ty2
ggcauugccggaaaccaacc

SEQ ID NO: 3693918 - RNA, 17 nt, Salmonella enterica enterica serovar Typhi Ty2
ggcauuggcguuaccgg

SEQ ID NO: 3693919 - RNA, 18 nt, Salmonella enterica enterica serovar Typhi Ty2
ggcauuuaugccgccauc

SEQ ID NO: 3693920 - RNA, 17 nt, Salmonella enterica enterica serovar Typhi Ty2
ggcauuucgccgccauc

SEQ ID NO: 3693921 - RNA, 17 nt, Salmonella enterica enterica serovar Typhi Ty2
ggcauuucugucugacg

SEQ ID NO: 3693922 - RNA, 18 nt, Salmonella enterica enterica serovar Typhi Ty2
ggcauuuuauuaccuggu

SEQ ID NO: 3693923 - RNA, 21 nt, Salmonella enterica enterica serovar Typhi Ty2
ggcauuuuuuaucuuccacgg

SEQ ID NO: 3693924 - RNA, 19 nt, Salmonella enterica enterica serovar Typhi Ty2
ggccaaaaccacagugacc

SEQ ID NO: 3693925 - RNA, 20 nt, Salmonella enterica enterica serovar Typhi Ty2
ggccaaaaccacagugaccc

SEQ ID NO: 3693926 - RNA, 15 nt, Salmonella enterica enterica serovar Typhi Ty2
ggccaaacagcggcu

SEQ ID NO: 3693927 - RNA, 14 nt, Salmonella enterica enterica serovar Typhi Ty2
ggccaaauaaccca

SEQ ID NO: 3693928 - RNA, 21 nt, Salmonella enterica enterica serovar Typhi Ty2
ggccaacauagcggcaaggaa

SEQ ID NO: 3693929 - RNA, 16 nt, Salmonella enterica enterica serovar Typhi Ty2
ggccaaccugccgaug

SEQ ID NO: 3693930 - RNA, 15 nt, Salmonella enterica enterica serovar Typhi Ty2
ggccaagcagcgcca

SEQ ID NO: 3693931 - RNA, 13 nt, Salmonella enterica enterica serovar Typhi Ty2
ggccaagcgccug

SEQ ID NO: 3693932 - RNA, 17 nt, Salmonella enterica enterica serovar Typhi Ty2
ggccaagcgccuguuca

SEQ ID NO: 3693933 - RNA, 21 nt, Salmonella enterica enterica serovar Typhi Ty2
ggccaauccagcuacuggcca

SEQ ID NO: 3693934 - RNA, 13 nt, Salmonella enterica enterica serovar Typhi Ty2
ggccaauccugca

SEQ ID NO: 3693935 - RNA, 21 nt, Salmonella enterica enterica serovar Typhi Ty2
ggccaauuccgccauaacggc

SEQ ID NO: 3693936 - RNA, 19 nt, Salmonella enterica enterica serovar Typhi Ty2
ggccacaauugccagcagg

SEQ ID NO: 3693937 - RNA, 13 nt, Salmonella enterica enterica serovar Typhi Ty2
ggccacagcgcca

SEQ ID NO: 3693938 - RNA, 14 nt, Salmonella enterica enterica serovar Typhi Ty2
ggccacagcgccag

SEQ ID NO: 3693939 - RNA, 17 nt, Salmonella enterica enterica serovar Typhi Ty2
ggccaccaggccugagc

SEQ ID NO: 3693940 - RNA, 22 nt, Salmonella enterica enterica serovar Typhi Ty2
ggccaccgaagaauuuaucaau

SEQ ID NO: 3693941 - RNA, 18 nt, Salmonella enterica enterica serovar Typhi Ty2
ggccacggagugcgcggc

SEQ ID NO: 3693942 - RNA, 20 nt, Salmonella enterica enterica serovar Typhi Ty2
ggccagaaguagcagagaaa

SEQ ID NO: 3693943 - RNA, 20 nt, Salmonella enterica enterica serovar Typhi Ty2
ggccagauaaguuugcagau

SEQ ID NO: 3693944 - RNA, 15 nt, Salmonella enterica enterica serovar Typhi Ty2
ggccagaugcggcga

SEQ ID NO: 3693945 - RNA, 14 nt, Salmonella enterica enterica serovar Typhi Ty2
ggccagauucuuag

SEQ ID NO: 3693946 - RNA, 13 nt, Salmonella enterica enterica serovar Typhi Ty2
ggccagcauggcg

SEQ ID NO: 3693947 - RNA, 15 nt, Salmonella enterica enterica serovar Typhi Ty2
ggccguuuucaugca

SEQ ID NO: 3693948 - RNA, 15 nt, Salmonella enterica enterica serovar Typhi Ty2
ggccguuuucccggc

SEQ ID NO: 3693949 - RNA, 18 nt, Salmonella enterica enterica serovar Typhi Ty2
ggccuacagaacugcacg

SEQ ID NO: 3693950 - RNA, 17 nt, Salmonella enterica enterica serovar Typhi Ty2
ggccuacagacuguacc

SEQ ID NO: 3693951 - RNA, 16 nt, Salmonella enterica enterica serovar Typhi Ty2
ggccuacauucauuaa

SEQ ID NO: 3693952 - RNA, 14 nt, Salmonella enterica enterica serovar Typhi Ty2
ggccuaccaucgcg

SEQ ID NO: 3693953 - RNA, 20 nt, Salmonella enterica enterica serovar Typhi Ty2
ggccuacggauucgcugcug

SEQ ID NO: 3693954 - RNA, 15 nt, Salmonella enterica enterica serovar Typhi Ty2
ggccuauagacaccu

SEQ ID NO: 3693955 - RNA, 19 nt, Salmonella enterica enterica serovar Typhi Ty2
ggccuauagcuaauggcuu

SEQ ID NO: 3693956 - RNA, 13 nt, Salmonella enterica enterica serovar Typhi Ty2
ggccuaucagcga

SEQ ID NO: 3693957 - RNA, 21 nt, Salmonella enterica enterica serovar Typhi Ty2
ggccuaucuguucgcaggacu

SEQ ID NO: 3693958 - RNA, 14 nt, Salmonella enterica enterica serovar Typhi Ty2
ggccucauccgcau

SEQ ID NO: 3693959 - RNA, 13 nt, Salmonella enterica enterica serovar Typhi Ty2
ggccuccggcggg

SEQ ID NO: 3693960 - RNA, 12 nt, Salmonella enterica enterica serovar Typhi Ty2
ggccuccugacg

SEQ ID NO: 3693961 - RNA, 22 nt, Salmonella enterica enterica serovar Typhi Ty2
ggccugaaugcagaccucugcu

SEQ ID NO: 3693962 - RNA, 22 nt, Salmonella enterica enterica serovar Typhi Ty2
ggccugauaagacgcaucgcgu

SEQ ID NO: 3693963 - RNA, 19 nt, Salmonella enterica enterica serovar Typhi Ty2
ggccugauaagcacaggcc

SEQ ID NO: 3693964 - RNA, 21 nt, Salmonella enterica enterica serovar Typhi Ty2
ggccugauaagcgcagcgcca

SEQ ID NO: 3693965 - RNA, 21 nt, Salmonella enterica enterica serovar Typhi Ty2
ggccugauaagcguagcgcca

SEQ ID NO: 3693966 - RNA, 16 nt, Salmonella enterica enterica serovar Typhi Ty2
ggccugauagcacagc

SEQ ID NO: 3693967 - RNA, 23 nt, Salmonella enterica enterica serovar Typhi Ty2
ggccugaugcgcguuuagcgcca

SEQ ID NO: 3693968 - RNA, 19 nt, Salmonella enterica enterica serovar Typhi Ty2
ggccugcacaagaaacaug

SEQ ID NO: 3693969 - RNA, 14 nt, Salmonella enterica enterica serovar Typhi Ty2
ggccugcaucaaca

SEQ ID NO: 3693970 - RNA, 21 nt, Salmonella enterica enterica serovar Typhi Ty2
ggccugcauuugcuggcguga

SEQ ID NO: 3693971 - RNA, 17 nt, Salmonella enterica enterica serovar Typhi Ty2
ggccugccggguuuaau

SEQ ID NO: 3693972 - RNA, 15 nt, Salmonella enterica enterica serovar Typhi Ty2
ggccugcgcuggaac

SEQ ID NO: 3693973 - RNA, 12 nt, Salmonella enterica enterica serovar Typhi Ty2
ggccugcuccgu

SEQ ID NO: 3693974 - RNA, 19 nt, Salmonella enterica enterica serovar Typhi Ty2
ggccugcuuaaacaguauu

SEQ ID NO: 3693975 - RNA, 12 nt, Salmonella enterica enterica serovar Typhi Ty2
ggccuggagauc

SEQ ID NO: 3693976 - RNA, 16 nt, Salmonella enterica enterica serovar Typhi Ty2
ggccuggagaucagca

SEQ ID NO: 3693977 - RNA, 17 nt, Salmonella enterica enterica serovar Typhi Ty2
ggccuggcugagaaaaa

SEQ ID NO: 3693978 - RNA, 18 nt, Salmonella enterica enterica serovar Typhi Ty2
ggccuggcugagaaaaau

SEQ ID NO: 3693979 - RNA, 19 nt, Salmonella enterica enterica serovar Typhi Ty2
ggccuggcuuguuacugca

SEQ ID NO: 3693980 - RNA, 16 nt, Salmonella enterica enterica serovar Typhi Ty2
ggccugucacguaaaa

SEQ ID NO: 3693981 - RNA, 22 nt, Salmonella enterica enterica serovar Typhi Ty2
ggccugucacguaaaauuagac

SEQ ID NO: 3693982 - RNA, 15 nt, Salmonella enterica enterica serovar Typhi Ty2
ggccugucaggccug

SEQ ID NO: 3693983 - RNA, 23 nt, Salmonella enterica enterica serovar Typhi Ty2
ggccugucccuucgcccggcgcg

SEQ ID NO: 3693984 - RNA, 17 nt, Salmonella enterica enterica serovar Typhi Ty2
ggccuguuucuuaccac

SEQ ID NO: 3693985 - RNA, 22 nt, Salmonella enterica enterica serovar Typhi Ty2
ggccuugaaguuauccagcgcc

SEQ ID NO: 3693986 - RNA, 23 nt, Salmonella enterica enterica serovar Typhi Ty2
ggccuugaaguuauccagcgccc

SEQ ID NO: 3693987 - RNA, 17 nt, Salmonella enterica enterica serovar Typhi Ty2
ggccuugccagcgagaa

SEQ ID NO: 3693988 - RNA, 21 nt, Salmonella enterica enterica serovar Typhi Ty2
ggccuuguagcgcuguccaau

SEQ ID NO: 3693989 - RNA, 17 nt, Salmonella enterica enterica serovar Typhi Ty2
ggccuuuuuccgucagc

SEQ ID NO: 3693990 - RNA, 18 nt, Salmonella enterica enterica serovar Typhi Ty2
ggccuuuuuccgucagca

SEQ ID NO: 3693991 - RNA, 20 nt, Salmonella enterica enterica serovar Typhi Ty2
ggcgaaaaccgagcauccgc

SEQ ID NO: 3693992 - RNA, 12 nt, Salmonella enterica enterica serovar Typhi Ty2
ggcgaaaacgcu

SEQ ID NO: 3693993 - RNA, 15 nt, Salmonella enterica enterica serovar Typhi Ty2
ggcgaaaauccuuuu

SEQ ID NO: 3693994 - RNA, 19 nt, Salmonella enterica enterica serovar Typhi Ty2
ggcgaaaaucggcaggccg

SEQ ID NO: 3693995 - RNA, 21 nt, Salmonella enterica enterica serovar Typhi Ty2
ggcgaaagcacuucucgcgca

SEQ ID NO: 3693996 - RNA, 14 nt, Salmonella enterica enterica serovar Typhi Ty2
ggcgaacagcccca

SEQ ID NO: 3693997 - RNA, 22 nt, Salmonella enterica enterica serovar Typhi Ty2
ggcgaacagccccaccgccaga

SEQ ID NO: 3693998 - RNA, 19 nt, Salmonella enterica enterica serovar Typhi Ty2
ggcgaacaggcguaauacu

SEQ ID NO: 3693999 - RNA, 14 nt, Salmonella enterica enterica serovar Typhi Ty2
ggcgaacaggcuca

SEQ ID NO: 3694000 - RNA, 20 nt, Salmonella enterica enterica serovar Typhi Ty2
ggcgaacaggcucagcgcca

SEQ ID NO: 3694001 - RNA, 12 nt, Salmonella enterica enterica serovar Typhi Ty2
ggcgaacauaag

SEQ ID NO: 3694002 - RNA, 18 nt, Salmonella enterica enterica serovar Typhi Ty2
ggcgaaccggcaucggca

SEQ ID NO: 3694003 - RNA, 16 nt, Salmonella enterica enterica serovar Typhi Ty2
ggcgaacucggucagg

SEQ ID NO: 3694004 - RNA, 18 nt, Salmonella enterica enterica serovar Typhi Ty2
ggcgaacuucauccacgc

SEQ ID NO: 3694005 - RNA, 15 nt, Salmonella enterica enterica serovar Typhi Ty2
ggcgaaggcggcggc

SEQ ID NO: 3694006 - RNA, 16 nt, Salmonella enterica enterica serovar Typhi Ty2
ggcgaauccuaaacuc

SEQ ID NO: 3694007 - RNA, 22 nt, Salmonella enterica enterica serovar Typhi Ty2
ggcgaaucucgugaucgccaaa

SEQ ID NO: 3694008 - RNA, 16 nt, Salmonella enterica enterica serovar Typhi Ty2
ggcgacaaucucaccg

SEQ ID NO: 3694009 - RNA, 12 nt, Salmonella enterica enterica serovar Typhi Ty2
ggcgacaggcgc

SEQ ID NO: 3694010 - RNA, 13 nt, Salmonella enterica enterica serovar Typhi Ty2
ggcgacaucgcca

SEQ ID NO: 3694011 - RNA, 14 nt, Salmonella enterica enterica serovar Typhi Ty2
ggcgaccagcagau

SEQ ID NO: 3694012 - RNA, 20 nt, Salmonella enterica enterica serovar Typhi Ty2
ggcgaccaggaauuuaccgg

SEQ ID NO: 3694013 - RNA, 19 nt, Salmonella enterica enterica serovar Typhi Ty2
ggcgaccaguuuagcuaaa

SEQ ID NO: 3694014 - RNA, 21 nt, Salmonella enterica enterica serovar Typhi Ty2
ggcgaccgccaccauccggcg

SEQ ID NO: 3694015 - RNA, 20 nt, Salmonella enterica enterica serovar Typhi Ty2
ggcgaccuucacgccgccaa

SEQ ID NO: 3694016 - RNA, 16 nt, Salmonella enterica enterica serovar Typhi Ty2
ggcgacgaaucagcga

SEQ ID NO: 3694017 - RNA, 20 nt, Salmonella enterica enterica serovar Typhi Ty2
ggcgacgacgcuguuuaugc

SEQ ID NO: 3694018 - RNA, 16 nt, Salmonella enterica enterica serovar Typhi Ty2
ggcgacgauacaacuc

SEQ ID NO: 3694019 - RNA, 16 nt, Salmonella enterica enterica serovar Typhi Ty2
ggcgacgaucagcgcc

SEQ ID NO: 3694020 - RNA, 17 nt, Salmonella enterica enterica serovar Typhi Ty2
ggcgacgaucagcgcca

SEQ ID NO: 3694021 - RNA, 15 nt, Salmonella enterica enterica serovar Typhi Ty2
ggcgacgcuuucacc

SEQ ID NO: 3694022 - RNA, 22 nt, Salmonella enterica enterica serovar Typhi Ty2
ggcgacgguacaaaccccaccc

SEQ ID NO: 3694023 - RNA, 17 nt, Salmonella enterica enterica serovar Typhi Ty2
ggcgacgucagacgagg

SEQ ID NO: 3694024 - RNA, 23 nt, Salmonella enterica enterica serovar Typhi Ty2
ggcgacuaacgucuuauccggcc

SEQ ID NO: 3694025 - RNA, 17 nt, Salmonella enterica enterica serovar Typhi Ty2
ggcgacuggaacaggcc

SEQ ID NO: 3694026 - RNA, 21 nt, Salmonella enterica enterica serovar Typhi Ty2
ggcgagaacucgucuuauccg

SEQ ID NO: 3694027 - RNA, 22 nt, Salmonella enterica enterica serovar Typhi Ty2
ggcgagagaauuaacagcgcga

SEQ ID NO: 3694028 - RNA, 20 nt, Salmonella enterica enterica serovar Typhi Ty2
ggcgagauguuuuaccagua

SEQ ID NO: 3694029 - RNA, 22 nt, Salmonella enterica enterica serovar Typhi Ty2
ggcgcgaaacugcugccgcagc

SEQ ID NO: 3694030 - RNA, 13 nt, Salmonella enterica enterica serovar Typhi Ty2
ggcgcgaaagcgc

SEQ ID NO: 3694031 - RNA, 20 nt, Salmonella enterica enterica serovar Typhi Ty2
ggcgcgacgcuuaucagccc

SEQ ID NO: 3694032 - RNA, 16 nt, Salmonella enterica enterica serovar Typhi Ty2
ggcgcgauauccacca

SEQ ID NO: 3694033 - RNA, 13 nt, Salmonella enterica enterica serovar Typhi Ty2
ggcgcgcgcgcca

SEQ ID NO: 3694034 - RNA, 20 nt, Salmonella enterica enterica serovar Typhi Ty2
ggcgcgcgcgccuaccgcca

SEQ ID NO: 3694035 - RNA, 13 nt, Salmonella enterica enterica serovar Typhi Ty2
ggcgcgcguacug

SEQ ID NO: 3694036 - RNA, 11 nt, Salmonella enterica enterica serovar Typhi Ty2
ggcgcgcuggc

SEQ ID NO: 3694037 - RNA, 15 nt, Salmonella enterica enterica serovar Typhi Ty2
ggcgcgcuuaucugg

SEQ ID NO: 3694038 - RNA, 13 nt, Salmonella enterica enterica serovar Typhi Ty2
ggcgcggaaggga

SEQ ID NO: 3694039 - RNA, 15 nt, Salmonella enterica enterica serovar Typhi Ty2
ggcgcggggaacaca

SEQ ID NO: 3694040 - RNA, 20 nt, Salmonella enterica enterica serovar Typhi Ty2
ggcgcgguauuucgccgccg

SEQ ID NO: 3694041 - RNA, 16 nt, Salmonella enterica enterica serovar Typhi Ty2
ggcgcguagcuggccu

SEQ ID NO: 3694042 - RNA, 19 nt, Salmonella enterica enterica serovar Typhi Ty2
ggcgcgucacaacagccgg

SEQ ID NO: 3694043 - RNA, 12 nt, Salmonella enterica enterica serovar Typhi Ty2
ggcgcguccagc

SEQ ID NO: 3694044 - RNA, 22 nt, Salmonella enterica enterica serovar Typhi Ty2
ggcgcgucuucccggcgcucgg

SEQ ID NO: 3694045 - RNA, 18 nt, Salmonella enterica enterica serovar Typhi Ty2
ggcgcguucagcaucggg

SEQ ID NO: 3694046 - RNA, 19 nt, Salmonella enterica enterica serovar Typhi Ty2
ggcgcuaaugcuuauccgg

SEQ ID NO: 3694047 - RNA, 19 nt, Salmonella enterica enterica serovar Typhi Ty2
ggcgcuacgccaucaggca

SEQ ID NO: 3694048 - RNA, 17 nt, Salmonella enterica enterica serovar Typhi Ty2
ggcgcuacgcuuauccg

SEQ ID NO: 3694049 - RNA, 20 nt, Salmonella enterica enterica serovar Typhi Ty2
ggcgcuacgcuuaucgggcc

SEQ ID NO: 3694050 - RNA, 17 nt, Salmonella enterica enterica serovar Typhi Ty2
ggcgcuauccggcauca

SEQ ID NO: 3694051 - RNA, 14 nt, Salmonella enterica enterica serovar Typhi Ty2
ggcgcuauucccag

SEQ ID NO: 3694052 - RNA, 17 nt, Salmonella enterica enterica serovar Typhi Ty2
ggcgcucaauagccaga

SEQ ID NO: 3694053 - RNA, 15 nt, Salmonella enterica enterica serovar Typhi Ty2
ggcgcucaaucagaa

SEQ ID NO: 3694054 - RNA, 23 nt, Salmonella enterica enterica serovar Typhi Ty2
ggcgcucggaugugcauugacua

SEQ ID NO: 3694055 - RNA, 21 nt, Salmonella enterica enterica serovar Typhi Ty2
ggcgcugaguuucucccgcca

SEQ ID NO: 3694056 - RNA, 15 nt, Salmonella enterica enterica serovar Typhi Ty2
ggcgcugcgcgcauc

SEQ ID NO: 3694057 - RNA, 20 nt, Salmonella enterica enterica serovar Typhi Ty2
ggcgcugcgcgcaucgggcc

SEQ ID NO: 3694058 - RNA, 14 nt, Salmonella enterica enterica serovar Typhi Ty2
ggcgcugcgcggcg

SEQ ID NO: 3694059 - RNA, 17 nt, Salmonella enterica enterica serovar Typhi Ty2
ggcgcugcgcuuaccgg

SEQ ID NO: 3694060 - RNA, 17 nt, Salmonella enterica enterica serovar Typhi Ty2
ggcgcugcgcuuauccg

SEQ ID NO: 3694061 - RNA, 19 nt, Salmonella enterica enterica serovar Typhi Ty2
ggcgcugcguuuaucaggc

SEQ ID NO: 3694062 - RNA, 20 nt, Salmonella enterica enterica serovar Typhi Ty2
ggcgcugcuggcagcgcuga

SEQ ID NO: 3694063 - RNA, 22 nt, Salmonella enterica enterica serovar Typhi Ty2
ggcgcuggcguacgcauccgcg

SEQ ID NO: 3694064 - RNA, 18 nt, Salmonella enterica enterica serovar Typhi Ty2
ggcgcuggcuugaccgcu

SEQ ID NO: 3694065 - RNA, 15 nt, Salmonella enterica enterica serovar Typhi Ty2
ggcgcuguaauagau

SEQ ID NO: 3694066 - RNA, 22 nt, Salmonella enterica enterica serovar Typhi Ty2
ggcgcuguacgccucuuucagc

SEQ ID NO: 3694067 - RNA, 13 nt, Salmonella enterica enterica serovar Typhi Ty2
ggcgcuguucuug

SEQ ID NO: 3694068 - RNA, 18 nt, Salmonella enterica enterica serovar Typhi Ty2
ggcgcuguuuuuacgcca

SEQ ID NO: 3694069 - RNA, 17 nt, Salmonella enterica enterica serovar Typhi Ty2
ggcgcuuaccuaaguca

SEQ ID NO: 3694070 - RNA, 15 nt, Salmonella enterica enterica serovar Typhi Ty2
ggcgcuuacgggcga

SEQ ID NO: 3694071 - RNA, 21 nt, Salmonella enterica enterica serovar Typhi Ty2
ggcgcuugcgccaucauccgg

SEQ ID NO: 3694072 - RNA, 17 nt, Salmonella enterica enterica serovar Typhi Ty2
ggcgcuuugcuuauccg

SEQ ID NO: 3694073 - RNA, 19 nt, Salmonella enterica enterica serovar Typhi Ty2
ggcgcuuugcuuauccggc

SEQ ID NO: 3694074 - RNA, 20 nt, Salmonella enterica enterica serovar Typhi Ty2
ggcgcuuugcuuauccggcc

SEQ ID NO: 3694075 - RNA, 12 nt, Salmonella enterica enterica serovar Typhi Ty2
ggcggaagaggc

SEQ ID NO: 3694076 - RNA, 22 nt, Salmonella enterica enterica serovar Typhi Ty2
ggcggaagucaaagguaauauc

SEQ ID NO: 3694077 - RNA, 14 nt, Salmonella enterica enterica serovar Typhi Ty2
ggcggaauggcggg

SEQ ID NO: 3694078 - RNA, 20 nt, Salmonella enterica enterica serovar Typhi Ty2
ggcggacaacgcuccagcag

SEQ ID NO: 3694079 - RNA, 15 nt, Salmonella enterica enterica serovar Typhi Ty2
ggcggauaaggcgcu

SEQ ID NO: 3694080 - RNA, 21 nt, Salmonella enterica enterica serovar Typhi Ty2
ggcggauacagcggcgcgcca

SEQ ID NO: 3694081 - RNA, 22 nt, Salmonella enterica enterica serovar Typhi Ty2
ggcggauuccaguagcgcgccc

SEQ ID NO: 3694082 - RNA, 13 nt, Salmonella enterica enterica serovar Typhi Ty2
ggcggcaaagaaa

SEQ ID NO: 3694083 - RNA, 17 nt, Salmonella enterica enterica serovar Typhi Ty2
ggcggcaagaucauccg

SEQ ID NO: 3694084 - RNA, 17 nt, Salmonella enterica enterica serovar Typhi Ty2
ggcggcauaaaugccuu

SEQ ID NO: 3694085 - RNA, 19 nt, Salmonella enterica enterica serovar Typhi Ty2
ggcggccaaccccggcaaa

SEQ ID NO: 3694086 - RNA, 13 nt, Salmonella enterica enterica serovar Typhi Ty2
ggcggccagcauu

SEQ ID NO: 3694087 - RNA, 18 nt, Salmonella enterica enterica serovar Typhi Ty2
ggcggcccacucauccag

SEQ ID NO: 3694088 - RNA, 18 nt, Salmonella enterica enterica serovar Typhi Ty2
ggcggcccgcauugaacg

SEQ ID NO: 3694089 - RNA, 21 nt, Salmonella enterica enterica serovar Typhi Ty2
ggcggcgaaaugccuuauccg

SEQ ID NO: 3694090 - RNA, 20 nt, Salmonella enterica enterica serovar Typhi Ty2
ggcggcgacuggcuaaacaa

SEQ ID NO: 3694091 - RNA, 20 nt, Salmonella enterica enterica serovar Typhi Ty2
ggcggcgaugccuuauccgg

SEQ ID NO: 3694092 - RNA, 12 nt, Salmonella enterica enterica serovar Typhi Ty2
ggcggcgcagcg

SEQ ID NO: 3694093 - RNA, 14 nt, Salmonella enterica enterica serovar Typhi Ty2
ggcggcgcgcugcc

SEQ ID NO: 3694094 - RNA, 14 nt, Salmonella enterica enterica serovar Typhi Ty2
ggcggcggcgggaa

SEQ ID NO: 3694095 - RNA, 14 nt, Salmonella enterica enterica serovar Typhi Ty2
ggcggcguaaacac

SEQ ID NO: 3694096 - RNA, 23 nt, Salmonella enterica enterica serovar Typhi Ty2
ggcggcguaaacaccuuauccgg

SEQ ID NO: 3694097 - RNA, 23 nt, Salmonella enterica enterica serovar Typhi Ty2
ggcggcgugaacgccuuauccgg

SEQ ID NO: 3694098 - RNA, 14 nt, Salmonella enterica enterica serovar Typhi Ty2
ggcggcuaccgccg

SEQ ID NO: 3694099 - RNA, 19 nt, Salmonella enterica enterica serovar Typhi Ty2
ggcggcugcgccuuauccg

SEQ ID NO: 3694100 - RNA, 20 nt, Salmonella enterica enterica serovar Typhi Ty2
ggcggcugcgccuuauccgg

SEQ ID NO: 3694101 - RNA, 20 nt, Salmonella enterica enterica serovar Typhi Ty2
ggcggcuggcgccuuaccgg

SEQ ID NO: 3694102 - RNA, 20 nt, Salmonella enterica enterica serovar Typhi Ty2
ggcggcuucgccuuauccgg

SEQ ID NO: 3694103 - RNA, 15 nt, Salmonella enterica enterica serovar Typhi Ty2
ggcggcuuuacccgg

SEQ ID NO: 3694104 - RNA, 14 nt, Salmonella enterica enterica serovar Typhi Ty2
ggcgggcagcagca

SEQ ID NO: 3694105 - RNA, 17 nt, Salmonella enterica enterica serovar Typhi Ty2
ggcgggcagcagcaggc

SEQ ID NO: 3694106 - RNA, 16 nt, Salmonella enterica enterica serovar Typhi Ty2
ggcgggcgucaccguc

SEQ ID NO: 3694107 - RNA, 18 nt, Salmonella enterica enterica serovar Typhi Ty2
ggcgggugcgcagcccca

SEQ ID NO: 3694108 - RNA, 20 nt, Salmonella enterica enterica serovar Typhi Ty2
ggcgguaaauacgcggcacg

SEQ ID NO: 3694109 - RNA, 16 nt, Salmonella enterica enterica serovar Typhi Ty2
ggcgguagcugcgcca

SEQ ID NO: 3694110 - RNA, 23 nt, Salmonella enterica enterica serovar Typhi Ty2
ggcgguauaacugccuuauccgg

SEQ ID NO: 3694111 - RNA, 11 nt, Salmonella enterica enterica serovar Typhi Ty2
ggcugaagcgg

SEQ ID NO: 3694112 - RNA, 13 nt, Salmonella enterica enterica serovar Typhi Ty2
ggcugagaaaaau

SEQ ID NO: 3694113 - RNA, 15 nt, Salmonella enterica enterica serovar Typhi Ty2
ggcugagaaucaccu

SEQ ID NO: 3694114 - RNA, 16 nt, Salmonella enterica enterica serovar Typhi Ty2
ggcugauaggccugga

SEQ ID NO: 3694115 - RNA, 23 nt, Salmonella enterica enterica serovar Typhi Ty2
ggcugauaggccuggauagacga

SEQ ID NO: 3694116 - RNA, 12 nt, Salmonella enterica enterica serovar Typhi Ty2
ggcugauggcga

SEQ ID NO: 3694117 - RNA, 21 nt, Salmonella enterica enterica serovar Typhi Ty2
ggcugcacccggagagaaaca

SEQ ID NO: 3694118 - RNA, 14 nt, Salmonella enterica enterica serovar Typhi Ty2
ggcugccaucaggc

SEQ ID NO: 3694119 - RNA, 16 nt, Salmonella enterica enterica serovar Typhi Ty2
ggcugccccagacgcc

SEQ ID NO: 3694120 - RNA, 13 nt, Salmonella enterica enterica serovar Typhi Ty2
ggcugcccugcgg

SEQ ID NO: 3694121 - RNA, 20 nt, Salmonella enterica enterica serovar Typhi Ty2
ggcugccgucgaugucgccg

SEQ ID NO: 3694122 - RNA, 22 nt, Salmonella enterica enterica serovar Typhi Ty2
ggcugcgauaaugaagcauaaa

SEQ ID NO: 3694123 - RNA, 20 nt, Salmonella enterica enterica serovar Typhi Ty2
ggcugcgccuuaucaagccu

SEQ ID NO: 3694124 - RNA, 17 nt, Salmonella enterica enterica serovar Typhi Ty2
ggcugcgcugccagcug

SEQ ID NO: 3694125 - RNA, 14 nt, Salmonella enterica enterica serovar Typhi Ty2
ggcugcggcaaacu

SEQ ID NO: 3694126 - RNA, 18 nt, Salmonella enterica enterica serovar Typhi Ty2
ggcugcguaaaaucagca

SEQ ID NO: 3694127 - RNA, 22 nt, Salmonella enterica enterica serovar Typhi Ty2
ggcugcguaaaaucagcauccu

SEQ ID NO: 3694128 - RNA, 11 nt, Salmonella enterica enterica serovar Typhi Ty2
ggcugcguaac

SEQ ID NO: 3694129 - RNA, 11 nt, Salmonella enterica enterica serovar Typhi Ty2
ggcugcucggg

SEQ ID NO: 3694130 - RNA, 18 nt, Salmonella enterica enterica serovar Typhi Ty2
ggcuggagagcaacgcca

SEQ ID NO: 3694131 - RNA, 14 nt, Salmonella enterica enterica serovar Typhi Ty2
ggcuggaugacggu

SEQ ID NO: 3694132 - RNA, 20 nt, Salmonella enterica enterica serovar Typhi Ty2
ggcuggcaaugcgcuguauu

SEQ ID NO: 3694133 - RNA, 10 nt, Salmonella enterica enterica serovar Typhi Ty2
ggcuggcagc

SEQ ID NO: 3694134 - RNA, 14 nt, Salmonella enterica enterica serovar Typhi Ty2
ggcuggccagggca

SEQ ID NO: 3694135 - RNA, 18 nt, Salmonella enterica enterica serovar Typhi Ty2
ggcuggcgucgccaaagc

SEQ ID NO: 3694136 - RNA, 21 nt, Salmonella enterica enterica serovar Typhi Ty2
ggcuggucagcguacccgcgg

SEQ ID NO: 3694137 - RNA, 17 nt, Salmonella enterica enterica serovar Typhi Ty2
ggcuguaccuuaaccgg

SEQ ID NO: 3694138 - RNA, 11 nt, Salmonella enterica enterica serovar Typhi Ty2
ggcuguauaca

SEQ ID NO: 3694139 - RNA, 23 nt, Salmonella enterica enterica serovar Typhi Ty2
ggcuguauguaggguacagcgcg

SEQ ID NO: 3694140 - RNA, 13 nt, Salmonella enterica enterica serovar Typhi Ty2
ggcugucgauccc

SEQ ID NO: 3694141 - RNA, 12 nt, Salmonella enterica enterica serovar Typhi Ty2
ggcuguggcugu

SEQ ID NO: 3694142 - RNA, 16 nt, Salmonella enterica enterica serovar Typhi Ty2
ggcuguuaguaagcug

SEQ ID NO: 3694143 - RNA, 16 nt, Salmonella enterica enterica serovar Typhi Ty2
ggcuuaccggcuauca

SEQ ID NO: 3694144 - RNA, 21 nt, Salmonella enterica enterica serovar Typhi Ty2
ggcuuacuuuccaaaauccag

SEQ ID NO: 3694145 - RNA, 23 nt, Salmonella enterica enterica serovar Typhi Ty2
ggcuuaucucuacuuuccugaag

SEQ ID NO: 3694146 - RNA, 18 nt, Salmonella enterica enterica serovar Typhi Ty2
ggcuucaaccguuucuuu

SEQ ID NO: 3694147 - RNA, 15 nt, Salmonella enterica enterica serovar Typhi Ty2
ggcuucaaccuccug

SEQ ID NO: 3694148 - RNA, 16 nt, Salmonella enterica enterica serovar Typhi Ty2
ggcuucaaccuccugc

SEQ ID NO: 3694149 - RNA, 22 nt, Salmonella enterica enterica serovar Typhi Ty2
ggcuuccaguugaaaaccacaa

SEQ ID NO: 3694150 - RNA, 19 nt, Salmonella enterica enterica serovar Typhi Ty2
ggcuuccggcacuuucaga

SEQ ID NO: 3694151 - RNA, 23 nt, Salmonella enterica enterica serovar Typhi Ty2
ggcuucggcaauuuccggcgacg

SEQ ID NO: 3694152 - RNA, 22 nt, Salmonella enterica enterica serovar Typhi Ty2
ggcuucugcugugcauaaauaa

SEQ ID NO: 3694153 - RNA, 18 nt, Salmonella enterica enterica serovar Typhi Ty2
ggcuucuucaacauuguc

SEQ ID NO: 3694154 - RNA, 17 nt, Salmonella enterica enterica serovar Typhi Ty2
ggcuugaucgcgcagca

SEQ ID NO: 3694155 - RNA, 15 nt, Salmonella enterica enterica serovar Typhi Ty2
ggcuugcaggauguc

SEQ ID NO: 3694156 - RNA, 17 nt, Salmonella enterica enterica serovar Typhi Ty2
ggcuugccagauagaca

SEQ ID NO: 3694157 - RNA, 22 nt, Salmonella enterica enterica serovar Typhi Ty2
ggcuugguugacgugaaccguc

SEQ ID NO: 3694158 - RNA, 12 nt, Salmonella enterica enterica serovar Typhi Ty2
ggcuuuaaagca

SEQ ID NO: 3694159 - RNA, 19 nt, Salmonella enterica enterica serovar Typhi Ty2
ggcuuuaacgucagcauca

SEQ ID NO: 3694160 - RNA, 13 nt, Salmonella enterica enterica serovar Typhi Ty2
ggcuuuaaugcuu

SEQ ID NO: 3694161 - RNA, 23 nt, Salmonella enterica enterica serovar Typhi Ty2
ggcuuuauccugaccgcuccagu

SEQ ID NO: 3694162 - RNA, 21 nt, Salmonella enterica enterica serovar Typhi Ty2
ggcuuucacaccguuauccgg

SEQ ID NO: 3694163 - RNA, 12 nt, Salmonella enterica enterica serovar Typhi Ty2
ggcuuuccacgu

SEQ ID NO: 3694164 - RNA, 22 nt, Salmonella enterica enterica serovar Typhi Ty2
ggcuuucccguuucagccccuu

SEQ ID NO: 3694165 - RNA, 17 nt, Salmonella enterica enterica serovar Typhi Ty2
ggcuuugcgccaucggg

SEQ ID NO: 3694166 - RNA, 14 nt, Salmonella enterica enterica serovar Typhi Ty2
ggcuuuguaucagc

SEQ ID NO: 3694167 - RNA, 14 nt, Salmonella enterica enterica serovar Typhi Ty2
ggcuuuuaucgaca

SEQ ID NO: 3694168 - RNA, 20 nt, Salmonella enterica enterica serovar Typhi Ty2
ggcuuuuuuuuaugccucuu

SEQ ID NO: 3694169 - RNA, 13 nt, Salmonella enterica enterica serovar Typhi Ty2
gggaaaaccccac

SEQ ID NO: 3694170 - RNA, 18 nt, Salmonella enterica enterica serovar Typhi Ty2
gggaaacggauucucuaa

SEQ ID NO: 3694171 - RNA, 15 nt, Salmonella enterica enterica serovar Typhi Ty2
gggaaagccccuacc

SEQ ID NO: 3694172 - RNA, 23 nt, Salmonella enterica enterica serovar Typhi Ty2
gggaaauagccuacggcuaccgc

SEQ ID NO: 3694173 - RNA, 17 nt, Salmonella enterica enterica serovar Typhi Ty2
gggaaaugagaaaagga

SEQ ID NO: 3694174 - RNA, 14 nt, Salmonella enterica enterica serovar Typhi Ty2
gggaacacauuaaa

SEQ ID NO: 3694175 - RNA, 12 nt, Salmonella enterica enterica serovar Typhi Ty2
gggaacacuaaa

SEQ ID NO: 3694176 - RNA, 13 nt, Salmonella enterica enterica serovar Typhi Ty2
gggaacacucuaa

SEQ ID NO: 3694177 - RNA, 22 nt, Salmonella enterica enterica serovar Typhi Ty2
gggaagacuauuaccaccguua

SEQ ID NO: 3694178 - RNA, 24 nt, Salmonella enterica enterica serovar Typhi Ty2
gggaagaucauuaucaauagcuuc

SEQ ID NO: 3694179 - RNA, 22 nt, Salmonella enterica enterica serovar Typhi Ty2
gggaagaugugccacuccgcca

SEQ ID NO: 3694180 - RNA, 13 nt, Salmonella enterica enterica serovar Typhi Ty2
gggaagcuacgau

SEQ ID NO: 3694181 - RNA, 16 nt, Salmonella enterica enterica serovar Typhi Ty2
gggaaguaaggcauga

SEQ ID NO: 3694182 - RNA, 15 nt, Salmonella enterica enterica serovar Typhi Ty2
gggaauaugauuuaa

SEQ ID NO: 3694183 - RNA, 12 nt, Salmonella enterica enterica serovar Typhi Ty2
gggacacucaag

SEQ ID NO: 3694184 - RNA, 23 nt, Salmonella enterica enterica serovar Typhi Ty2
gggacgaauuuccagcgggcgau

SEQ ID NO: 3694185 - RNA, 17 nt, Salmonella enterica enterica serovar Typhi Ty2
gggacgcugcgcggcga

SEQ ID NO: 3694186 - RNA, 13 nt, Salmonella enterica enterica serovar Typhi Ty2
gggacgcugcuga

SEQ ID NO: 3694187 - RNA, 16 nt, Salmonella enterica enterica serovar Typhi Ty2
gggacggcggccagca

SEQ ID NO: 3694188 - RNA, 23 nt, Salmonella enterica enterica serovar Typhi Ty2
gggacguuucgauaaccaccagc

SEQ ID NO: 3694189 - RNA, 22 nt, Salmonella enterica enterica serovar Typhi Ty2
gggagacuucuucagucagggc

SEQ ID NO: 3694190 - RNA, 16 nt, Salmonella enterica enterica serovar Typhi Ty2
gggaggcggcgagcgg

SEQ ID NO: 3694191 - RNA, 16 nt, Salmonella enterica enterica serovar Typhi Ty2
gggaggugcugguggu

SEQ ID NO: 3694192 - RNA, 20 nt, Salmonella enterica enterica serovar Typhi Ty2
gggaguacauuuacaauaau

SEQ ID NO: 3694193 - RNA, 12 nt, Salmonella enterica enterica serovar Typhi Ty2
ggguaauaacgg

SEQ ID NO: 3694194 - RNA, 11 nt, Salmonella enterica enterica serovar Typhi Ty2
ggguaauacug

SEQ ID NO: 3694195 - RNA, 22 nt, Salmonella enterica enterica serovar Typhi Ty2
ggguaaugaucagcaaaauagu

SEQ ID NO: 3694196 - RNA, 14 nt, Salmonella enterica enterica serovar Typhi Ty2
ggguaauggucagc

SEQ ID NO: 3694197 - RNA, 15 nt, Salmonella enterica enterica serovar Typhi Ty2
ggguagaaaaaggua

SEQ ID NO: 3694198 - RNA, 18 nt, Salmonella enterica enterica serovar Typhi Ty2
ggguagaucacgccagcg

SEQ ID NO: 3694199 - RNA, 21 nt, Salmonella enterica enterica serovar Typhi Ty2
ggguaucuaacccgcucagac

SEQ ID NO: 3694200 - RNA, 16 nt, Salmonella enterica enterica serovar Typhi Ty2
ggguauugacgagcga

SEQ ID NO: 3694201 - RNA, 23 nt, Salmonella enterica enterica serovar Typhi Ty2
ggguauuuuagcgguaagagcgu

SEQ ID NO: 3694202 - RNA, 14 nt, Salmonella enterica enterica serovar Typhi Ty2
gggucaaaugcgaa

SEQ ID NO: 3694203 - RNA, 22 nt, Salmonella enterica enterica serovar Typhi Ty2
gggucacauccagacagccgac

SEQ ID NO: 3694204 - RNA, 22 nt, Salmonella enterica enterica serovar Typhi Ty2
gggucgacguuguccggcgacc

SEQ ID NO: 3694205 - RNA, 18 nt, Salmonella enterica enterica serovar Typhi Ty2
gggucgccgcgcccagca

SEQ ID NO: 3694206 - RNA, 19 nt, Salmonella enterica enterica serovar Typhi Ty2
gggucguacuaaagagcgc

SEQ ID NO: 3694207 - RNA, 21 nt, Salmonella enterica enterica serovar Typhi Ty2
gggucgugcaggauucgaacc

SEQ ID NO: 3694208 - RNA, 22 nt, Salmonella enterica enterica serovar Typhi Ty2
gggucuuauuucuccugcgcca

SEQ ID NO: 3694209 - RNA, 11 nt, Salmonella enterica enterica serovar Typhi Ty2
gggucuuccag

SEQ ID NO: 3694210 - RNA, 11 nt, Salmonella enterica enterica serovar Typhi Ty2
gggugaaauca

SEQ ID NO: 3694211 - RNA, 21 nt, Salmonella enterica enterica serovar Typhi Ty2
gggugaauauuuguuggaaau

SEQ ID NO: 3694212 - RNA, 22 nt, Salmonella enterica enterica serovar Typhi Ty2
gggugagcgagcguagccaaca

SEQ ID NO: 3694213 - RNA, 14 nt, Salmonella enterica enterica serovar Typhi Ty2
gggugcaaagaaac

SEQ ID NO: 3694214 - RNA, 22 nt, Salmonella enterica enterica serovar Typhi Ty2
gggugcaaagaaacguucaucc

SEQ ID NO: 3694215 - RNA, 17 nt, Salmonella enterica enterica serovar Typhi Ty2
gggugcagcgucaggaa

SEQ ID NO: 3694216 - RNA, 15 nt, Salmonella enterica enterica serovar Typhi Ty2
ggguggcgcuagcgc

SEQ ID NO: 3694217 - RNA, 13 nt, Salmonella enterica enterica serovar Typhi Ty2
ggguuaaaccagc

SEQ ID NO: 3694218 - RNA, 14 nt, Salmonella enterica enterica serovar Typhi Ty2
ggguuaaagcccug

SEQ ID NO: 3694219 - RNA, 15 nt, Salmonella enterica enterica serovar Typhi Ty2
ggguuaaagcccuga

SEQ ID NO: 3694220 - RNA, 14 nt, Salmonella enterica enterica serovar Typhi Ty2
ggguucgcccggca

SEQ ID NO: 3694221 - RNA, 21 nt, Salmonella enterica enterica serovar Typhi Ty2
ggguugagcgagucagacacc

SEQ ID NO: 3694222 - RNA, 15 nt, Salmonella enterica enterica serovar Typhi Ty2
ggguugccggaaagg

SEQ ID NO: 3694223 - RNA, 12 nt, Salmonella enterica enterica serovar Typhi Ty2
ggguuuuccggu

SEQ ID NO: 3694224 - RNA, 16 nt, Salmonella enterica enterica serovar Typhi Ty2
gguaaaaccagauacg

SEQ ID NO: 3694225 - RNA, 22 nt, Salmonella enterica enterica serovar Typhi Ty2
gguaaaauccaccacguuaccg

SEQ ID NO: 3694226 - RNA, 22 nt, Salmonella enterica enterica serovar Typhi Ty2
gguaaaauggacuuccgcacgc

SEQ ID NO: 3694227 - RNA, 15 nt, Salmonella enterica enterica serovar Typhi Ty2
gguaaaccaggccag

SEQ ID NO: 3694228 - RNA, 21 nt, Salmonella enterica enterica serovar Typhi Ty2
gguaaacgcuccggcaggcaa

SEQ ID NO: 3694229 - RNA, 12 nt, Salmonella enterica enterica serovar Typhi Ty2
gguaaacgugcu

SEQ ID NO: 3694230 - RNA, 14 nt, Salmonella enterica enterica serovar Typhi Ty2
gguaaauaacuuuu

SEQ ID NO: 3694231 - RNA, 18 nt, Salmonella enterica enterica serovar Typhi Ty2
gguaaauccacaaccggc

SEQ ID NO: 3694232 - RNA, 13 nt, Salmonella enterica enterica serovar Typhi Ty2
gguaacaccgcgg

SEQ ID NO: 3694233 - RNA, 18 nt, Salmonella enterica enterica serovar Typhi Ty2
gguaacaucgcccgcacc

SEQ ID NO: 3694234 - RNA, 14 nt, Salmonella enterica enterica serovar Typhi Ty2
gguaacgcgaaaaa

SEQ ID NO: 3694235 - RNA, 21 nt, Salmonella enterica enterica serovar Typhi Ty2
gguaacguuacuugauggaaa

SEQ ID NO: 3694236 - RNA, 14 nt, Salmonella enterica enterica serovar Typhi Ty2
gguaagaauaauaa

SEQ ID NO: 3694237 - RNA, 13 nt, Salmonella enterica enterica serovar Typhi Ty2
gguaagauguucu

SEQ ID NO: 3694238 - RNA, 14 nt, Salmonella enterica enterica serovar Typhi Ty2
gguaagcaauaugg

SEQ ID NO: 3694239 - RNA, 22 nt, Salmonella enterica enterica serovar Typhi Ty2
gguaagcccauggcaggcagca

SEQ ID NO: 3694240 - RNA, 19 nt, Salmonella enterica enterica serovar Typhi Ty2
gguaaggcguagccgccac

SEQ ID NO: 3694241 - RNA, 18 nt, Salmonella enterica enterica serovar Typhi Ty2
gguaaggcuauagccgcg

SEQ ID NO: 3694242 - RNA, 13 nt, Salmonella enterica enterica serovar Typhi Ty2
gguaaguugaaag

SEQ ID NO: 3694243 - RNA, 14 nt, Salmonella enterica enterica serovar Typhi Ty2
gguaaguuuuucuc

SEQ ID NO: 3694244 - RNA, 22 nt, Salmonella enterica enterica serovar Typhi Ty2
gguaauacuaaucucacccaua

SEQ ID NO: 3694245 - RNA, 17 nt, Salmonella enterica enterica serovar Typhi Ty2
gguaauagcccucgccg

SEQ ID NO: 3694246 - RNA, 14 nt, Salmonella enterica enterica serovar Typhi Ty2
gguaauauggucgu

SEQ ID NO: 3694247 - RNA, 18 nt, Salmonella enterica enterica serovar Typhi Ty2
gguaaucacugccgccac

SEQ ID NO: 3694248 - RNA, 15 nt, Salmonella enterica enterica serovar Typhi Ty2
gguaaugacuuuuaa

SEQ ID NO: 3694249 - RNA, 16 nt, Salmonella enterica enterica serovar Typhi Ty2
gguaaugacuuuuaaa

SEQ ID NO: 3694250 - RNA, 15 nt, Salmonella enterica enterica serovar Typhi Ty2
gguaaugcgugagca

SEQ ID NO: 3694251 - RNA, 15 nt, Salmonella enterica enterica serovar Typhi Ty2
gguaauggucagcau

SEQ ID NO: 3694252 - RNA, 16 nt, Salmonella enterica enterica serovar Typhi Ty2
gguaaugucauccagc

SEQ ID NO: 3694253 - RNA, 16 nt, Salmonella enterica enterica serovar Typhi Ty2
gguaauuagaucggca

SEQ ID NO: 3694254 - RNA, 17 nt, Salmonella enterica enterica serovar Typhi Ty2
gguaauuagaucggcaa

SEQ ID NO: 3694255 - RNA, 22 nt, Salmonella enterica enterica serovar Typhi Ty2
gguaauuucaaagggcccgugg

SEQ ID NO: 3694256 - RNA, 21 nt, Salmonella enterica enterica serovar Typhi Ty2
gguaauuuucaccuccgggug

SEQ ID NO: 3694257 - RNA, 20 nt, Salmonella enterica enterica serovar Typhi Ty2
gguaauuuugccaucgcgca

SEQ ID NO: 3694258 - RNA, 22 nt, Salmonella enterica enterica serovar Typhi Ty2
gguacacaaucaaggcagcgaa

SEQ ID NO: 3694259 - RNA, 14 nt, Salmonella enterica enterica serovar Typhi Ty2
gguacaggccgccg

SEQ ID NO: 3694260 - RNA, 14 nt, Salmonella enterica enterica serovar Typhi Ty2
gguaccccagccau

SEQ ID NO: 3694261 - RNA, 21 nt, Salmonella enterica enterica serovar Typhi Ty2
gguacccggucccuggcuggu

SEQ ID NO: 3694262 - RNA, 19 nt, Salmonella enterica enterica serovar Typhi Ty2
gguaccgggcugucaucga

SEQ ID NO: 3694263 - RNA, 15 nt, Salmonella enterica enterica serovar Typhi Ty2
gguacgacgcggcuc

SEQ ID NO: 3694264 - RNA, 13 nt, Salmonella enterica enterica serovar Typhi Ty2
gguacgcuccagg

SEQ ID NO: 3694265 - RNA, 15 nt, Salmonella enterica enterica serovar Typhi Ty2
gguacggccagcgcg

SEQ ID NO: 3694266 - RNA, 15 nt, Salmonella enterica enterica serovar Typhi Ty2
gguacucaacaucau

SEQ ID NO: 3694267 - RNA, 16 nt, Salmonella enterica enterica serovar Typhi Ty2
gguacucuuccagcug

SEQ ID NO: 3694268 - RNA, 23 nt, Salmonella enterica enterica serovar Typhi Ty2
gguacucuuccagcugcucuccu

SEQ ID NO: 3694269 - RNA, 23 nt, Salmonella enterica enterica serovar Typhi Ty2
gguacuugacgucgccauaucca

SEQ ID NO: 3694270 - RNA, 20 nt, Salmonella enterica enterica serovar Typhi Ty2
gguagacccggcauugaaac

SEQ ID NO: 3694271 - RNA, 15 nt, Salmonella enterica enterica serovar Typhi Ty2
gguagacgcaccaga

SEQ ID NO: 3694272 - RNA, 22 nt, Salmonella enterica enterica serovar Typhi Ty2
gguagacgcgcuagcuucaggu

SEQ ID NO: 3694273 - RNA, 16 nt, Salmonella enterica enterica serovar Typhi Ty2
gguagagcaucgcggc

SEQ ID NO: 3694274 - RNA, 14 nt, Salmonella enterica enterica serovar Typhi Ty2
gguagccgacggcc

SEQ ID NO: 3694275 - RNA, 15 nt, Salmonella enterica enterica serovar Typhi Ty2
ggugaggucggcggg

SEQ ID NO: 3694276 - RNA, 14 nt, Salmonella enterica enterica serovar Typhi Ty2
ggugauagcccguu

SEQ ID NO: 3694277 - RNA, 13 nt, Salmonella enterica enterica serovar Typhi Ty2
ggugauagcgcgc

SEQ ID NO: 3694278 - RNA, 23 nt, Salmonella enterica enterica serovar Typhi Ty2
ggugaucuggccaauuuuucaca

SEQ ID NO: 3694279 - RNA, 19 nt, Salmonella enterica enterica serovar Typhi Ty2
ggugaugaaagcggcacaa

SEQ ID NO: 3694280 - RNA, 16 nt, Salmonella enterica enterica serovar Typhi Ty2
ggugaugcgcaacguu

SEQ ID NO: 3694281 - RNA, 17 nt, Salmonella enterica enterica serovar Typhi Ty2
ggugauuaacagcgcca

SEQ ID NO: 3694282 - RNA, 18 nt, Salmonella enterica enterica serovar Typhi Ty2
ggugauucugcaucccgc

SEQ ID NO: 3694283 - RNA, 15 nt, Salmonella enterica enterica serovar Typhi Ty2
ggugcaaaacguuug

SEQ ID NO: 3694284 - RNA, 15 nt, Salmonella enterica enterica serovar Typhi Ty2
ggugcagaccucugc

SEQ ID NO: 3694285 - RNA, 20 nt, Salmonella enterica enterica serovar Typhi Ty2
ggugcagaccucugcaaaca

SEQ ID NO: 3694286 - RNA, 17 nt, Salmonella enterica enterica serovar Typhi Ty2
ggugccaaauguauacu

SEQ ID NO: 3694287 - RNA, 23 nt, Salmonella enterica enterica serovar Typhi Ty2
ggugccauauuguucaguuucaa

SEQ ID NO: 3694288 - RNA, 14 nt, Salmonella enterica enterica serovar Typhi Ty2
ggugcccgcgugga

SEQ ID NO: 3694289 - RNA, 17 nt, Salmonella enterica enterica serovar Typhi Ty2
ggugccgaaaucaucaa

SEQ ID NO: 3694290 - RNA, 15 nt, Salmonella enterica enterica serovar Typhi Ty2
ggugccgacgccagc

SEQ ID NO: 3694291 - RNA, 20 nt, Salmonella enterica enterica serovar Typhi Ty2
ggugcgauucagcgcaggca

SEQ ID NO: 3694292 - RNA, 15 nt, Salmonella enterica enterica serovar Typhi Ty2
ggugcgcagccccag

SEQ ID NO: 3694293 - RNA, 14 nt, Salmonella enterica enterica serovar Typhi Ty2
ggugcgccccagca

SEQ ID NO: 3694294 - RNA, 22 nt, Salmonella enterica enterica serovar Typhi Ty2
ggugcguccgguagagaacgaa

SEQ ID NO: 3694295 - RNA, 22 nt, Salmonella enterica enterica serovar Typhi Ty2
ggugcuacgggcgcugucgccg

SEQ ID NO: 3694296 - RNA, 14 nt, Salmonella enterica enterica serovar Typhi Ty2
ggugcucaauaaaa

SEQ ID NO: 3694297 - RNA, 18 nt, Salmonella enterica enterica serovar Typhi Ty2
ggugcugaauauuaucgg

SEQ ID NO: 3694298 - RNA, 20 nt, Salmonella enterica enterica serovar Typhi Ty2
ggugcugaauauuaucggcg

SEQ ID NO: 3694299 - RNA, 13 nt, Salmonella enterica enterica serovar Typhi Ty2
ggugcuguucuuc

SEQ ID NO: 3694300 - RNA, 20 nt, Salmonella enterica enterica serovar Typhi Ty2
ggugcuuagcuggccaauca

SEQ ID NO: 3694301 - RNA, 18 nt, Salmonella enterica enterica serovar Typhi Ty2
gguggaucccccuggccc

SEQ ID NO: 3694302 - RNA, 11 nt, Salmonella enterica enterica serovar Typhi Ty2
gguggccggag

SEQ ID NO: 3694303 - RNA, 20 nt, Salmonella enterica enterica serovar Typhi Ty2
gguggcgcaguuuacgcagc

SEQ ID NO: 3694304 - RNA, 17 nt, Salmonella enterica enterica serovar Typhi Ty2
gguggcgccacgccacc

SEQ ID NO: 3694305 - RNA, 19 nt, Salmonella enterica enterica serovar Typhi Ty2
gguggcggaaaugcgcggu

SEQ ID NO: 3694306 - RNA, 19 nt, Salmonella enterica enterica serovar Typhi Ty2
gguggggcuaagugagcau

SEQ ID NO: 3694307 - RNA, 15 nt, Salmonella enterica enterica serovar Typhi Ty2
ggugggugaugacgg

SEQ ID NO: 3694308 - RNA, 16 nt, Salmonella enterica enterica serovar Typhi Ty2
ggugggugaugacggg

SEQ ID NO: 3694309 - RNA, 21 nt, Salmonella enterica enterica serovar Typhi Ty2
gguggucacgccauuaucgaa

SEQ ID NO: 3694310 - RNA, 22 nt, Salmonella enterica enterica serovar Typhi Ty2
gguggucaucgcggccagcaug

SEQ ID NO: 3694311 - RNA, 13 nt, Salmonella enterica enterica serovar Typhi Ty2
gguggugggcggc

SEQ ID NO: 3694312 - RNA, 16 nt, Salmonella enterica enterica serovar Typhi Ty2
gguguagcucauaacu

SEQ ID NO: 3694313 - RNA, 13 nt, Salmonella enterica enterica serovar Typhi Ty2
ggugugccgccau

SEQ ID NO: 3694314 - RNA, 15 nt, Salmonella enterica enterica serovar Typhi Ty2
ggugugccugcgcuu

SEQ ID NO: 3694315 - RNA, 14 nt, Salmonella enterica enterica serovar Typhi Ty2
gguguguucccgcg

SEQ ID NO: 3694316 - RNA, 16 nt, Salmonella enterica enterica serovar Typhi Ty2
gguguuugcggcacac

SEQ ID NO: 3694317 - RNA, 21 nt, Salmonella enterica enterica serovar Typhi Ty2
gguuaaacacauccggcggcg

SEQ ID NO: 3694318 - RNA, 23 nt, Salmonella enterica enterica serovar Typhi Ty2
gguuaaagcccugacagaaauag

SEQ ID NO: 3694319 - RNA, 17 nt, Salmonella enterica enterica serovar Typhi Ty2
gguuaaauagcaggcaa

SEQ ID NO: 3694320 - RNA, 15 nt, Salmonella enterica enterica serovar Typhi Ty2
gguuaacgucagauu

SEQ ID NO: 3694321 - RNA, 18 nt, Salmonella enterica enterica serovar Typhi Ty2
gguuaacgucagauuuuc

SEQ ID NO: 3694322 - RNA, 12 nt, Salmonella enterica enterica serovar Typhi Ty2
gguuaacucuuu

SEQ ID NO: 3694323 - RNA, 23 nt, Salmonella enterica enterica serovar Typhi Ty2
gguuaauaauuuuacccgcgcau

SEQ ID NO: 3694324 - RNA, 16 nt, Salmonella enterica enterica serovar Typhi Ty2
gguuaaucagcacauu

SEQ ID NO: 3694325 - RNA, 20 nt, Salmonella enterica enterica serovar Typhi Ty2
gguuacgcagcuuaaagcca

SEQ ID NO: 3694326 - RNA, 16 nt, Salmonella enterica enterica serovar Typhi Ty2
gguuacucacugccgc

SEQ ID NO: 3694327 - RNA, 14 nt, Salmonella enterica enterica serovar Typhi Ty2
gguuauccagcagg

SEQ ID NO: 3694328 - RNA, 23 nt, Salmonella enterica enterica serovar Typhi Ty2
gguuaucgcuugguauggcgcua

SEQ ID NO: 3694329 - RNA, 20 nt, Salmonella enterica enterica serovar Typhi Ty2
gguuauuccgcuggaggcca

SEQ ID NO: 3694330 - RNA, 22 nt, Salmonella enterica enterica serovar Typhi Ty2
gguuauucggucagauaaauaa

SEQ ID NO: 3694331 - RNA, 19 nt, Salmonella enterica enterica serovar Typhi Ty2
gguucaaccgaaagaagaa

SEQ ID NO: 3694332 - RNA, 19 nt, Salmonella enterica enterica serovar Typhi Ty2
gguucaacgcgcugcagcu

SEQ ID NO: 3694333 - RNA, 15 nt, Salmonella enterica enterica serovar Typhi Ty2
gguucaagcuggaau

SEQ ID NO: 3694334 - RNA, 19 nt, Salmonella enterica enterica serovar Typhi Ty2
gguucaauacccuuuucuu

SEQ ID NO: 3694335 - RNA, 18 nt, Salmonella enterica enterica serovar Typhi Ty2
gguucaauaugccaggca

SEQ ID NO: 3694336 - RNA, 16 nt, Salmonella enterica enterica serovar Typhi Ty2
gguucaccaccaccca

SEQ ID NO: 3694337 - RNA, 13 nt, Salmonella enterica enterica serovar Typhi Ty2
gguuccaggcgcg

SEQ ID NO: 3694338 - RNA, 23 nt, Salmonella enterica enterica serovar Typhi Ty2
gguucccgagcggccaaagggag

SEQ ID NO: 3694339 - RNA, 16 nt, Salmonella enterica enterica serovar Typhi Ty2
gguucccgccgccauu

SEQ ID NO: 3694340 - RNA, 21 nt, Salmonella enterica enterica serovar Typhi Ty2
gguucgaacgacagaauaugc

SEQ ID NO: 3694341 - RNA, 17 nt, Salmonella enterica enterica serovar Typhi Ty2
gguucgccucccucacc

SEQ ID NO: 3694342 - RNA, 13 nt, Salmonella enterica enterica serovar Typhi Ty2
gguucucccggca

SEQ ID NO: 3694343 - RNA, 18 nt, Salmonella enterica enterica serovar Typhi Ty2
gguucucugccaucaucc

SEQ ID NO: 3694344 - RNA, 13 nt, Salmonella enterica enterica serovar Typhi Ty2
gguucugccagaa

SEQ ID NO: 3694345 - RNA, 14 nt, Salmonella enterica enterica serovar Typhi Ty2
gguucugccagaac

SEQ ID NO: 3694346 - RNA, 20 nt, Salmonella enterica enterica serovar Typhi Ty2
gguucugcgaggugauagcc

SEQ ID NO: 3694347 - RNA, 16 nt, Salmonella enterica enterica serovar Typhi Ty2
gguugacggcuacccc

SEQ ID NO: 3694348 - RNA, 22 nt, Salmonella enterica enterica serovar Typhi Ty2
gguugauaccggaggagugcgc

SEQ ID NO: 3694349 - RNA, 15 nt, Salmonella enterica enterica serovar Typhi Ty2
gguugcccgcaggcu

SEQ ID NO: 3694350 - RNA, 23 nt, Salmonella enterica enterica serovar Typhi Ty2
gguugcccgguggcgcugcgcuu

SEQ ID NO: 3694351 - RNA, 14 nt, Salmonella enterica enterica serovar Typhi Ty2
gguugccgcaaaug

SEQ ID NO: 3694352 - RNA, 20 nt, Salmonella enterica enterica serovar Typhi Ty2
gguugcgcccuuccgucagc

SEQ ID NO: 3694353 - RNA, 23 nt, Salmonella enterica enterica serovar Typhi Ty2
gguugcggcggggauaaucagca

SEQ ID NO: 3694354 - RNA, 20 nt, Salmonella enterica enterica serovar Typhi Ty2
gguuggaauaauuuucgcaa

SEQ ID NO: 3694355 - RNA, 10 nt, Salmonella enterica enterica serovar Typhi Ty2
gguuuauccc

SEQ ID NO: 3694356 - RNA, 19 nt, Salmonella enterica enterica serovar Typhi Ty2
gguuucccugccucaacau

SEQ ID NO: 3694357 - RNA, 17 nt, Salmonella enterica enterica serovar Typhi Ty2
guaacggacauaaagga

SEQ ID NO: 3694358 - RNA, 18 nt, Salmonella enterica enterica serovar Typhi Ty2
guaacggacucaggccuu

SEQ ID NO: 3694359 - RNA, 17 nt, Salmonella enterica enterica serovar Typhi Ty2
guaacguaaauacccag

SEQ ID NO: 3694360 - RNA, 23 nt, Salmonella enterica enterica serovar Typhi Ty2
guaacgugcgguauaucacgcca

SEQ ID NO: 3694361 - RNA, 18 nt, Salmonella enterica enterica serovar Typhi Ty2
guaacguuguccagcaga

SEQ ID NO: 3694362 - RNA, 14 nt, Salmonella enterica enterica serovar Typhi Ty2
guaacuauuucuau

SEQ ID NO: 3694363 - RNA, 18 nt, Salmonella enterica enterica serovar Typhi Ty2
guaacucaauaucgacag

SEQ ID NO: 3694364 - RNA, 15 nt, Salmonella enterica enterica serovar Typhi Ty2
guaacucaucgccag

SEQ ID NO: 3694365 - RNA, 23 nt, Salmonella enterica enterica serovar Typhi Ty2
guaacugcaccuuuuuuuccagc

SEQ ID NO: 3694366 - RNA, 18 nt, Salmonella enterica enterica serovar Typhi Ty2
guaacugcgguaaauaau

SEQ ID NO: 3694367 - RNA, 11 nt, Salmonella enterica enterica serovar Typhi Ty2
guaacuuacaa

SEQ ID NO: 3694368 - RNA, 13 nt, Salmonella enterica enterica serovar Typhi Ty2
guaacuuauccac

SEQ ID NO: 3694369 - RNA, 18 nt, Salmonella enterica enterica serovar Typhi Ty2
guaagaaaaacagcgaga

SEQ ID NO: 3694370 - RNA, 21 nt, Salmonella enterica enterica serovar Typhi Ty2
guaagaagaaccagcgcgaca

SEQ ID NO: 3694371 - RNA, 17 nt, Salmonella enterica enterica serovar Typhi Ty2
guaagaaugcgcgucag

SEQ ID NO: 3694372 - RNA, 22 nt, Salmonella enterica enterica serovar Typhi Ty2
guaagaauuauuaccaaugagc

SEQ ID NO: 3694373 - RNA, 20 nt, Salmonella enterica enterica serovar Typhi Ty2
guaagagagccuuacaggcg

SEQ ID NO: 3694374 - RNA, 13 nt, Salmonella enterica enterica serovar Typhi Ty2
guaagagagugag

SEQ ID NO: 3694375 - RNA, 17 nt, Salmonella enterica enterica serovar Typhi Ty2
guaagagcguuacccag

SEQ ID NO: 3694376 - RNA, 16 nt, Salmonella enterica enterica serovar Typhi Ty2
guaagaggcauaaaaa

SEQ ID NO: 3694377 - RNA, 13 nt, Salmonella enterica enterica serovar Typhi Ty2
guaagagguaucc

SEQ ID NO: 3694378 - RNA, 19 nt, Salmonella enterica enterica serovar Typhi Ty2
guaagaucccagggcggcg

SEQ ID NO: 3694379 - RNA, 22 nt, Salmonella enterica enterica serovar Typhi Ty2
guaagcauagcgccuucaggca

SEQ ID NO: 3694380 - RNA, 23 nt, Salmonella enterica enterica serovar Typhi Ty2
guaagcccauggcaggcagcaca

SEQ ID NO: 3694381 - RNA, 17 nt, Salmonella enterica enterica serovar Typhi Ty2
guaagcccuauuaggca

SEQ ID NO: 3694382 - RNA, 15 nt, Salmonella enterica enterica serovar Typhi Ty2
guaagcgcagcgcca

SEQ ID NO: 3694383 - RNA, 16 nt, Salmonella enterica enterica serovar Typhi Ty2
guaagcgccaagcggc

SEQ ID NO: 3694384 - RNA, 17 nt, Salmonella enterica enterica serovar Typhi Ty2
guaagcgcccguccaug

SEQ ID NO: 3694385 - RNA, 18 nt, Salmonella enterica enterica serovar Typhi Ty2
guaagcggcggaccagcg

SEQ ID NO: 3694386 - RNA, 16 nt, Salmonella enterica enterica serovar Typhi Ty2
guaagcuauuccugua

SEQ ID NO: 3694387 - RNA, 15 nt, Salmonella enterica enterica serovar Typhi Ty2
guaaggcaaauaugc

SEQ ID NO: 3694388 - RNA, 21 nt, Salmonella enterica enterica serovar Typhi Ty2
guaagggaggugcucucccag

SEQ ID NO: 3694389 - RNA, 22 nt, Salmonella enterica enterica serovar Typhi Ty2
guaagggaggugcucucccagc

SEQ ID NO: 3694390 - RNA, 13 nt, Salmonella enterica enterica serovar Typhi Ty2
guaagguccaggg

SEQ ID NO: 3694391 - RNA, 21 nt, Salmonella enterica enterica serovar Typhi Ty2
guaagucgaccaguccuuccg

SEQ ID NO: 3694392 - RNA, 19 nt, Salmonella enterica enterica serovar Typhi Ty2
guaagucgccgcagcucca

SEQ ID NO: 3694393 - RNA, 17 nt, Salmonella enterica enterica serovar Typhi Ty2
guaaguuaaaacgccau

SEQ ID NO: 3694394 - RNA, 22 nt, Salmonella enterica enterica serovar Typhi Ty2
guaaguuugcguacucagcaga

SEQ ID NO: 3694395 - RNA, 14 nt, Salmonella enterica enterica serovar Typhi Ty2
guaaguuuugcucc

SEQ ID NO: 3694396 - RNA, 23 nt, Salmonella enterica enterica serovar Typhi Ty2
guaauaacaaaaaacauauaucu

SEQ ID NO: 3694397 - RNA, 17 nt, Salmonella enterica enterica serovar Typhi Ty2
guaauaaccguggcggc

SEQ ID NO: 3694398 - RNA, 13 nt, Salmonella enterica enterica serovar Typhi Ty2
guaauaauacuaa

SEQ ID NO: 3694399 - RNA, 15 nt, Salmonella enterica enterica serovar Typhi Ty2
guaauacaggguuug

SEQ ID NO: 3694400 - RNA, 22 nt, Salmonella enterica enterica serovar Typhi Ty2
guaauacgcgucugucgaaacu

SEQ ID NO: 3694401 - RNA, 19 nt, Salmonella enterica enterica serovar Typhi Ty2
guaauacggagcaaaaaau

SEQ ID NO: 3694402 - RNA, 18 nt, Salmonella enterica enterica serovar Typhi Ty2
guaauauaaucuaccauu

SEQ ID NO: 3694403 - RNA, 17 nt, Salmonella enterica enterica serovar Typhi Ty2
guaauaugaauauccgc

SEQ ID NO: 3694404 - RNA, 12 nt, Salmonella enterica enterica serovar Typhi Ty2
guaauauuaaaa

SEQ ID NO: 3694405 - RNA, 23 nt, Salmonella enterica enterica serovar Typhi Ty2
guaaucaaacauacgccuuuacc

SEQ ID NO: 3694406 - RNA, 18 nt, Salmonella enterica enterica serovar Typhi Ty2
guaaucaauagcguuaua

SEQ ID NO: 3694407 - RNA, 22 nt, Salmonella enterica enterica serovar Typhi Ty2
guaaucacuaacugaccauaua

SEQ ID NO: 3694408 - RNA, 20 nt, Salmonella enterica enterica serovar Typhi Ty2
guaaucaucaccguuuucca

SEQ ID NO: 3694409 - RNA, 20 nt, Salmonella enterica enterica serovar Typhi Ty2
guaaucaucgcgaucgccaa

SEQ ID NO: 3694410 - RNA, 11 nt, Salmonella enterica enterica serovar Typhi Ty2
guaauccggca

SEQ ID NO: 3694411 - RNA, 20 nt, Salmonella enterica enterica serovar Typhi Ty2
guaaucggccuguuggccuu

SEQ ID NO: 3694412 - RNA, 20 nt, Salmonella enterica enterica serovar Typhi Ty2
guaaucuacaaacgcggaca

SEQ ID NO: 3694413 - RNA, 15 nt, Salmonella enterica enterica serovar Typhi Ty2
guaaucugacagaua

SEQ ID NO: 3694414 - RNA, 16 nt, Salmonella enterica enterica serovar Typhi Ty2
guaaucuuuucauauu

SEQ ID NO: 3694415 - RNA, 16 nt, Salmonella enterica enterica serovar Typhi Ty2
guaaugaacaccagca

SEQ ID NO: 3694416 - RNA, 19 nt, Salmonella enterica enterica serovar Typhi Ty2
guaaugaccacaccgucaa

SEQ ID NO: 3694417 - RNA, 14 nt, Salmonella enterica enterica serovar Typhi Ty2
guaaugacgcggaa

SEQ ID NO: 3694418 - RNA, 19 nt, Salmonella enterica enterica serovar Typhi Ty2
guaaugagcacuuuccaca

SEQ ID NO: 3694419 - RNA, 20 nt, Salmonella enterica enterica serovar Typhi Ty2
guaaugaucagaacucacau

SEQ ID NO: 3694420 - RNA, 15 nt, Salmonella enterica enterica serovar Typhi Ty2
guaaugcgccaggca

SEQ ID NO: 3694421 - RNA, 15 nt, Salmonella enterica enterica serovar Typhi Ty2
guaauggcauaacgc

SEQ ID NO: 3694422 - RNA, 13 nt, Salmonella enterica enterica serovar Typhi Ty2
guaauggccuaca

SEQ ID NO: 3694423 - RNA, 20 nt, Salmonella enterica enterica serovar Typhi Ty2
guaauggcgggaaaagguuu

SEQ ID NO: 3694424 - RNA, 12 nt, Salmonella enterica enterica serovar Typhi Ty2
guaauggucagc

SEQ ID NO: 3694425 - RNA, 21 nt, Salmonella enterica enterica serovar Typhi Ty2
guaauguuuucugccagcaga

SEQ ID NO: 3694426 - RNA, 23 nt, Salmonella enterica enterica serovar Typhi Ty2
guaauucaugcuguauaaacuca

SEQ ID NO: 3694427 - RNA, 16 nt, Salmonella enterica enterica serovar Typhi Ty2
guaauucucacagaau

SEQ ID NO: 3694428 - RNA, 22 nt, Salmonella enterica enterica serovar Typhi Ty2
guaauucucacagaaucaucag

SEQ ID NO: 3694429 - RNA, 14 nt, Salmonella enterica enterica serovar Typhi Ty2
guaauugacauggc

SEQ ID NO: 3694430 - RNA, 23 nt, Salmonella enterica enterica serovar Typhi Ty2
guaauugcgccguucacuucaaa

SEQ ID NO: 3694431 - RNA, 13 nt, Salmonella enterica enterica serovar Typhi Ty2
guaauuuauaaag

SEQ ID NO: 3694432 - RNA, 17 nt, Salmonella enterica enterica serovar Typhi Ty2
guaauuucauagaccgc

SEQ ID NO: 3694433 - RNA, 18 nt, Salmonella enterica enterica serovar Typhi Ty2
guaauuucgcuggcggcc

SEQ ID NO: 3694434 - RNA, 11 nt, Salmonella enterica enterica serovar Typhi Ty2
guaauuuucac

SEQ ID NO: 3694435 - RNA, 13 nt, Salmonella enterica enterica serovar Typhi Ty2
guacaaaaaaugu

SEQ ID NO: 3694436 - RNA, 15 nt, Salmonella enterica enterica serovar Typhi Ty2
guacaaacaaauaaa

SEQ ID NO: 3694437 - RNA, 21 nt, Salmonella enterica enterica serovar Typhi Ty2
guacaaacaaauaaauccaug

SEQ ID NO: 3694438 - RNA, 18 nt, Salmonella enterica enterica serovar Typhi Ty2
guacaagagccgccgcca

SEQ ID NO: 3694439 - RNA, 17 nt, Salmonella enterica enterica serovar Typhi Ty2
guagagaucgacaaacc

SEQ ID NO: 3694440 - RNA, 19 nt, Salmonella enterica enterica serovar Typhi Ty2
guagagcaucgcggcauca

SEQ ID NO: 3694441 - RNA, 16 nt, Salmonella enterica enterica serovar Typhi Ty2
guagagcgcggucagg

SEQ ID NO: 3694442 - RNA, 19 nt, Salmonella enterica enterica serovar Typhi Ty2
guagagcgcggucagguuc

SEQ ID NO: 3694443 - RNA, 16 nt, Salmonella enterica enterica serovar Typhi Ty2
guagaucacgccagcg

SEQ ID NO: 3694444 - RNA, 13 nt, Salmonella enterica enterica serovar Typhi Ty2
guagaucauuuac

SEQ ID NO: 3694445 - RNA, 20 nt, Salmonella enterica enterica serovar Typhi Ty2
guagauggcgcuaaaaccgu

SEQ ID NO: 3694446 - RNA, 19 nt, Salmonella enterica enterica serovar Typhi Ty2
guagcagacagccgaucag

SEQ ID NO: 3694447 - RNA, 13 nt, Salmonella enterica enterica serovar Typhi Ty2
guagcagcgauga

SEQ ID NO: 3694448 - RNA, 15 nt, Salmonella enterica enterica serovar Typhi Ty2
guagcagcgaugaca

SEQ ID NO: 3694449 - RNA, 18 nt, Salmonella enterica enterica serovar Typhi Ty2
guagcagcgaugacagca

SEQ ID NO: 3694450 - RNA, 20 nt, Salmonella enterica enterica serovar Typhi Ty2
guagcagcgaugacagcagg

SEQ ID NO: 3694451 - RNA, 18 nt, Salmonella enterica enterica serovar Typhi Ty2
guagcaguguaucgaaga

SEQ ID NO: 3694452 - RNA, 20 nt, Salmonella enterica enterica serovar Typhi Ty2
guagccaaaauuuacgggga

SEQ ID NO: 3694453 - RNA, 12 nt, Salmonella enterica enterica serovar Typhi Ty2
guagccacagcg

SEQ ID NO: 3694454 - RNA, 17 nt, Salmonella enterica enterica serovar Typhi Ty2
guagccacgcccgccgc

SEQ ID NO: 3694455 - RNA, 14 nt, Salmonella enterica enterica serovar Typhi Ty2
guagcgacugauaa

SEQ ID NO: 3694456 - RNA, 20 nt, Salmonella enterica enterica serovar Typhi Ty2
guagcgagaagccgauggaa

SEQ ID NO: 3694457 - RNA, 16 nt, Salmonella enterica enterica serovar Typhi Ty2
guagcgagaaggcuuu

SEQ ID NO: 3694458 - RNA, 16 nt, Salmonella enterica enterica serovar Typhi Ty2
guagcgccaucaggca

SEQ ID NO: 3694459 - RNA, 17 nt, Salmonella enterica enterica serovar Typhi Ty2
guagcgccaucaggcau

SEQ ID NO: 3694460 - RNA, 19 nt, Salmonella enterica enterica serovar Typhi Ty2
guagcgccaucaggcauaa

SEQ ID NO: 3694461 - RNA, 13 nt, Salmonella enterica enterica serovar Typhi Ty2
guagcgcgcgcua

SEQ ID NO: 3694462 - RNA, 14 nt, Salmonella enterica enterica serovar Typhi Ty2
guagcgcguucagg

SEQ ID NO: 3694463 - RNA, 20 nt, Salmonella enterica enterica serovar Typhi Ty2
guagcggaaccagccaugcc

SEQ ID NO: 3694464 - RNA, 18 nt, Salmonella enterica enterica serovar Typhi Ty2
guagcggcaacagcacca

SEQ ID NO: 3694465 - RNA, 14 nt, Salmonella enterica enterica serovar Typhi Ty2
guagcggcagggau

SEQ ID NO: 3694466 - RNA, 20 nt, Salmonella enterica enterica serovar Typhi Ty2
guagcgucaauacaccucgg

SEQ ID NO: 3694467 - RNA, 21 nt, Salmonella enterica enterica serovar Typhi Ty2
guagcgucagguagcccggca

SEQ ID NO: 3694468 - RNA, 21 nt, Salmonella enterica enterica serovar Typhi Ty2
guagcgucucaucaaaaaggc

SEQ ID NO: 3694469 - RNA, 20 nt, Salmonella enterica enterica serovar Typhi Ty2
guagcuauaaucacaggggu

SEQ ID NO: 3694470 - RNA, 20 nt, Salmonella enterica enterica serovar Typhi Ty2
guagcucaagcccgcgucgu

SEQ ID NO: 3694471 - RNA, 22 nt, Salmonella enterica enterica serovar Typhi Ty2
guagcucaguugguuagagcac

SEQ ID NO: 3694472 - RNA, 16 nt, Salmonella enterica enterica serovar Typhi Ty2
guagcugagcgucagg

SEQ ID NO: 3694473 - RNA, 18 nt, Salmonella enterica enterica serovar Typhi Ty2
guagcuggucgccagcgc

SEQ ID NO: 3694474 - RNA, 15 nt, Salmonella enterica enterica serovar Typhi Ty2
guagcuucagcugga

SEQ ID NO: 3694475 - RNA, 16 nt, Salmonella enterica enterica serovar Typhi Ty2
guagcuugaaagcgca

SEQ ID NO: 3694476 - RNA, 16 nt, Salmonella enterica enterica serovar Typhi Ty2
guagcuuuuccgcugg

SEQ ID NO: 3694477 - RNA, 13 nt, Salmonella enterica enterica serovar Typhi Ty2
guaggccaggcau

SEQ ID NO: 3694478 - RNA, 21 nt, Salmonella enterica enterica serovar Typhi Ty2
guaggcccgguaagcgcagcg

SEQ ID NO: 3694479 - RNA, 20 nt, Salmonella enterica enterica serovar Typhi Ty2
guaggccggauaagacgcgc

SEQ ID NO: 3694480 - RNA, 22 nt, Salmonella enterica enterica serovar Typhi Ty2
guaggccggauaagcggcagcg

SEQ ID NO: 3694481 - RNA, 17 nt, Salmonella enterica enterica serovar Typhi Ty2
guaggccggauaaggca

SEQ ID NO: 3694482 - RNA, 18 nt, Salmonella enterica enterica serovar Typhi Ty2
guaggccggauaaggcau

SEQ ID NO: 3694483 - RNA, 18 nt, Salmonella enterica enterica serovar Typhi Ty2
guaggccggauaaggcgu

SEQ ID NO: 3694484 - RNA, 20 nt, Salmonella enterica enterica serovar Typhi Ty2
guaggccggauaaggcguuu

SEQ ID NO: 3694485 - RNA, 19 nt, Salmonella enterica enterica serovar Typhi Ty2
guaggccugauaagcgcag

SEQ ID NO: 3694486 - RNA, 20 nt, Salmonella enterica enterica serovar Typhi Ty2
guaggccugauagcacagcg

SEQ ID NO: 3694487 - RNA, 19 nt, Salmonella enterica enterica serovar Typhi Ty2
guaggcucuccgguugcug

SEQ ID NO: 3694488 - RNA, 21 nt, Salmonella enterica enterica serovar Typhi Ty2
guaggcucuccgguugcugau

SEQ ID NO: 3694489 - RNA, 21 nt, Salmonella enterica enterica serovar Typhi Ty2
guagggcugccaucaggcagu

SEQ ID NO: 3694490 - RNA, 16 nt, Salmonella enterica enterica serovar Typhi Ty2
guagguauccagcaga

SEQ ID NO: 3694491 - RNA, 20 nt, Salmonella enterica enterica serovar Typhi Ty2
guaggucgcgaauagcuuuu

SEQ ID NO: 3694492 - RNA, 14 nt, Salmonella enterica enterica serovar Typhi Ty2
guaguaaaccgguu

SEQ ID NO: 3694493 - RNA, 13 nt, Salmonella enterica enterica serovar Typhi Ty2
guaguaaauagga

SEQ ID NO: 3694494 - RNA, 15 nt, Salmonella enterica enterica serovar Typhi Ty2
guaguaauauuaaaa

SEQ ID NO: 3694495 - RNA, 18 nt, Salmonella enterica enterica serovar Typhi Ty2
guaguacaugccauccgg

SEQ ID NO: 3694496 - RNA, 18 nt, Salmonella enterica enterica serovar Typhi Ty2
guagucaaauuccagcaa

SEQ ID NO: 3694497 - RNA, 14 nt, Salmonella enterica enterica serovar Typhi Ty2
guaguccuguaucu

SEQ ID NO: 3694498 - RNA, 17 nt, Salmonella enterica enterica serovar Typhi Ty2
guagucucccuccugcu

SEQ ID NO: 3694499 - RNA, 19 nt, Salmonella enterica enterica serovar Typhi Ty2
guagucucccuccugcucc

SEQ ID NO: 3694500 - RNA, 19 nt, Salmonella enterica enterica serovar Typhi Ty2
guagugcuucucuucaaac

SEQ ID NO: 3694501 - RNA, 17 nt, Salmonella enterica enterica serovar Typhi Ty2
guaguggaucagcagau

SEQ ID NO: 3694502 - RNA, 15 nt, Salmonella enterica enterica serovar Typhi Ty2
guaguuaaaaaaggu

SEQ ID NO: 3694503 - RNA, 15 nt, Salmonella enterica enterica serovar Typhi Ty2
guaguuauaaauuua

SEQ ID NO: 3694504 - RNA, 19 nt, Salmonella enterica enterica serovar Typhi Ty2
guaguuccuguagcgugac

SEQ ID NO: 3694505 - RNA, 16 nt, Salmonella enterica enterica serovar Typhi Ty2
guauaaaauggcaaag

SEQ ID NO: 3694506 - RNA, 12 nt, Salmonella enterica enterica serovar Typhi Ty2
guauaaaucacg

SEQ ID NO: 3694507 - RNA, 13 nt, Salmonella enterica enterica serovar Typhi Ty2
guauaacucagcg

SEQ ID NO: 3694508 - RNA, 23 nt, Salmonella enterica enterica serovar Typhi Ty2
guauacauacauaccacgcagcg

SEQ ID NO: 3694509 - RNA, 21 nt, Salmonella enterica enterica serovar Typhi Ty2
guauagcggcguuuauauaaa

SEQ ID NO: 3694510 - RNA, 13 nt, Salmonella enterica enterica serovar Typhi Ty2
guauaggaaaaug

SEQ ID NO: 3694511 - RNA, 20 nt, Salmonella enterica enterica serovar Typhi Ty2
guauaucuuucuuaucccac

SEQ ID NO: 3694512 - RNA, 15 nt, Salmonella enterica enterica serovar Typhi Ty2
guauaugaauauacg

SEQ ID NO: 3694513 - RNA, 22 nt, Salmonella enterica enterica serovar Typhi Ty2
guauauuugccgaacgcgucca

SEQ ID NO: 3694514 - RNA, 18 nt, Salmonella enterica enterica serovar Typhi Ty2
guaucaaacccuuccaga

SEQ ID NO: 3694515 - RNA, 15 nt, Salmonella enterica enterica serovar Typhi Ty2
guaucacaaucagcc

SEQ ID NO: 3694516 - RNA, 16 nt, Salmonella enterica enterica serovar Typhi Ty2
guaucacaaucagcca

SEQ ID NO: 3694517 - RNA, 14 nt, Salmonella enterica enterica serovar Typhi Ty2
guaucacgcgugcg

SEQ ID NO: 3694518 - RNA, 16 nt, Salmonella enterica enterica serovar Typhi Ty2
guaucacuguaaaagg

SEQ ID NO: 3694519 - RNA, 11 nt, Salmonella enterica enterica serovar Typhi Ty2
guaucaucgcu

SEQ ID NO: 3694520 - RNA, 21 nt, Salmonella enterica enterica serovar Typhi Ty2
guauccacccgguuuaccauu

SEQ ID NO: 3694521 - RNA, 16 nt, Salmonella enterica enterica serovar Typhi Ty2
gucaauacaucacgca

SEQ ID NO: 3694522 - RNA, 16 nt, Salmonella enterica enterica serovar Typhi Ty2
gucaaucgccugcugu

SEQ ID NO: 3694523 - RNA, 17 nt, Salmonella enterica enterica serovar Typhi Ty2
gucaaucgccugcugua

SEQ ID NO: 3694524 - RNA, 17 nt, Salmonella enterica enterica serovar Typhi Ty2
gucaaugccuggcagac

SEQ ID NO: 3694525 - RNA, 17 nt, Salmonella enterica enterica serovar Typhi Ty2
gucaaugugaauccagg

SEQ ID NO: 3694526 - RNA, 12 nt, Salmonella enterica enterica serovar Typhi Ty2
gucacaacagcc

SEQ ID NO: 3694527 - RNA, 13 nt, Salmonella enterica enterica serovar Typhi Ty2
gucacaauaacgc

SEQ ID NO: 3694528 - RNA, 17 nt, Salmonella enterica enterica serovar Typhi Ty2
gucacaauacuuccgcu

SEQ ID NO: 3694529 - RNA, 22 nt, Salmonella enterica enterica serovar Typhi Ty2
gucacaauaugguuauccagca

SEQ ID NO: 3694530 - RNA, 21 nt, Salmonella enterica enterica serovar Typhi Ty2
gucacaaucguucucaggaag

SEQ ID NO: 3694531 - RNA, 17 nt, Salmonella enterica enterica serovar Typhi Ty2
gucacagauccagacau

SEQ ID NO: 3694532 - RNA, 20 nt, Salmonella enterica enterica serovar Typhi Ty2
gucacagguucgaaucccgu

SEQ ID NO: 3694533 - RNA, 12 nt, Salmonella enterica enterica serovar Typhi Ty2
gucacauccaga

SEQ ID NO: 3694534 - RNA, 13 nt, Salmonella enterica enterica serovar Typhi Ty2
gucaccagcagca

SEQ ID NO: 3694535 - RNA, 20 nt, Salmonella enterica enterica serovar Typhi Ty2
gucaccagcagcauuucaaa

SEQ ID NO: 3694536 - RNA, 15 nt, Salmonella enterica enterica serovar Typhi Ty2
gucaccauguuaucg

SEQ ID NO: 3694537 - RNA, 15 nt, Salmonella enterica enterica serovar Typhi Ty2
gucacccacgccgga

SEQ ID NO: 3694538 - RNA, 19 nt, Salmonella enterica enterica serovar Typhi Ty2
gucacccgccggcagcagc

SEQ ID NO: 3694539 - RNA, 20 nt, Salmonella enterica enterica serovar Typhi Ty2
gucacccgccggcagcagcu

SEQ ID NO: 3694540 - RNA, 22 nt, Salmonella enterica enterica serovar Typhi Ty2
gucacccgcuuuuccuguucug

SEQ ID NO: 3694541 - RNA, 15 nt, Salmonella enterica enterica serovar Typhi Ty2
gucaccguauugcca

SEQ ID NO: 3694542 - RNA, 16 nt, Salmonella enterica enterica serovar Typhi Ty2
gucacgacguauuaaa

SEQ ID NO: 3694543 - RNA, 19 nt, Salmonella enterica enterica serovar Typhi Ty2
gucacgauaaccaggucac

SEQ ID NO: 3694544 - RNA, 15 nt, Salmonella enterica enterica serovar Typhi Ty2
gucacgccauuaucg

SEQ ID NO: 3694545 - RNA, 20 nt, Salmonella enterica enterica serovar Typhi Ty2
gucacgccggguacauauac

SEQ ID NO: 3694546 - RNA, 18 nt, Salmonella enterica enterica serovar Typhi Ty2
gucacuccggcugcacca

SEQ ID NO: 3694547 - RNA, 20 nt, Salmonella enterica enterica serovar Typhi Ty2
gucacugaccggcguuuuua

SEQ ID NO: 3694548 - RNA, 17 nt, Salmonella enterica enterica serovar Typhi Ty2
gucacuuacuuucuugc

SEQ ID NO: 3694549 - RNA, 19 nt, Salmonella enterica enterica serovar Typhi Ty2
gucacuuacuuucuugcca

SEQ ID NO: 3694550 - RNA, 11 nt, Salmonella enterica enterica serovar Typhi Ty2
gucacuucaac

SEQ ID NO: 3694551 - RNA, 23 nt, Salmonella enterica enterica serovar Typhi Ty2
gucacuucaaccuuuaucuguug

SEQ ID NO: 3694552 - RNA, 23 nt, Salmonella enterica enterica serovar Typhi Ty2
gucagaccuucaacccagcagca

SEQ ID NO: 3694553 - RNA, 13 nt, Salmonella enterica enterica serovar Typhi Ty2
gucagauccuuuu

SEQ ID NO: 3694554 - RNA, 22 nt, Salmonella enterica enterica serovar Typhi Ty2
gucagauccuuuuucugcgcca

SEQ ID NO: 3694555 - RNA, 15 nt, Salmonella enterica enterica serovar Typhi Ty2
gucagcaguuuuauc

SEQ ID NO: 3694556 - RNA, 19 nt, Salmonella enterica enterica serovar Typhi Ty2
gucagcauaauauccugca

SEQ ID NO: 3694557 - RNA, 16 nt, Salmonella enterica enterica serovar Typhi Ty2
gucagcauuucaucca

SEQ ID NO: 3694558 - RNA, 18 nt, Salmonella enterica enterica serovar Typhi Ty2
gucagccccguacaaggu

SEQ ID NO: 3694559 - RNA, 14 nt, Salmonella enterica enterica serovar Typhi Ty2
gucagccgggauaa

SEQ ID NO: 3694560 - RNA, 12 nt, Salmonella enterica enterica serovar Typhi Ty2
gucagccuugac

SEQ ID NO: 3694561 - RNA, 13 nt, Salmonella enterica enterica serovar Typhi Ty2
gucagcgcaaagc

SEQ ID NO: 3694562 - RNA, 15 nt, Salmonella enterica enterica serovar Typhi Ty2
gucagcgcggcuucc

SEQ ID NO: 3694563 - RNA, 21 nt, Salmonella enterica enterica serovar Typhi Ty2
gucagcgcuugccgcagcgca

SEQ ID NO: 3694564 - RNA, 14 nt, Salmonella enterica enterica serovar Typhi Ty2
gucagcggcgcgcc

SEQ ID NO: 3694565 - RNA, 15 nt, Salmonella enterica enterica serovar Typhi Ty2
gucagcuccgguauc

SEQ ID NO: 3694566 - RNA, 13 nt, Salmonella enterica enterica serovar Typhi Ty2
gucagcuuccugc

SEQ ID NO: 3694567 - RNA, 19 nt, Salmonella enterica enterica serovar Typhi Ty2
gucaggaaacgcgccggaa

SEQ ID NO: 3694568 - RNA, 22 nt, Salmonella enterica enterica serovar Typhi Ty2
gucaggaagcggacuaccugcc

SEQ ID NO: 3694569 - RNA, 17 nt, Salmonella enterica enterica serovar Typhi Ty2
gucaggaggccugaaua

SEQ ID NO: 3694570 - RNA, 22 nt, Salmonella enterica enterica serovar Typhi Ty2
gucaggauaaaauccugcacgc

SEQ ID NO: 3694571 - RNA, 13 nt, Salmonella enterica enterica serovar Typhi Ty2
gucaggaugcuga

SEQ ID NO: 3694572 - RNA, 22 nt, Salmonella enterica enterica serovar Typhi Ty2
gucaggaugggcuucuucacua

SEQ ID NO: 3694573 - RNA, 14 nt, Salmonella enterica enterica serovar Typhi Ty2
gucaggauuuucgc

SEQ ID NO: 3694574 - RNA, 12 nt, Salmonella enterica enterica serovar Typhi Ty2
gucaggcaacag

SEQ ID NO: 3694575 - RNA, 15 nt, Salmonella enterica enterica serovar Typhi Ty2
gucaggcagaaauaa

SEQ ID NO: 3694576 - RNA, 18 nt, Salmonella enterica enterica serovar Typhi Ty2
gucaggccgccgcaaaag

SEQ ID NO: 3694577 - RNA, 20 nt, Salmonella enterica enterica serovar Typhi Ty2
gucaggccgccgcacaggcg

SEQ ID NO: 3694578 - RNA, 22 nt, Salmonella enterica enterica serovar Typhi Ty2
gucaggcuacccgcaauaccaa

SEQ ID NO: 3694579 - RNA, 15 nt, Salmonella enterica enterica serovar Typhi Ty2
gucaggcucuaauaa

SEQ ID NO: 3694580 - RNA, 14 nt, Salmonella enterica enterica serovar Typhi Ty2
gucagggcaaggcg

SEQ ID NO: 3694581 - RNA, 15 nt, Salmonella enterica enterica serovar Typhi Ty2
gucagggcgcggcgc

SEQ ID NO: 3694582 - RNA, 16 nt, Salmonella enterica enterica serovar Typhi Ty2
gucagggcgcggcgca

SEQ ID NO: 3694583 - RNA, 23 nt, Salmonella enterica enterica serovar Typhi Ty2
gucagggcgcggcgcaacuuuuu

SEQ ID NO: 3694584 - RNA, 23 nt, Salmonella enterica enterica serovar Typhi Ty2
gucagggucuuauuucuccugcg

SEQ ID NO: 3694585 - RNA, 19 nt, Salmonella enterica enterica serovar Typhi Ty2
gucagggugaauaccagcg

SEQ ID NO: 3694586 - RNA, 19 nt, Salmonella enterica enterica serovar Typhi Ty2
gucagguaagcuauuacaa

SEQ ID NO: 3694587 - RNA, 20 nt, Salmonella enterica enterica serovar Typhi Ty2
gucaggugggaccaccgcgc

SEQ ID NO: 3694588 - RNA, 15 nt, Salmonella enterica enterica serovar Typhi Ty2
gucagguuuucuauc

SEQ ID NO: 3694589 - RNA, 13 nt, Salmonella enterica enterica serovar Typhi Ty2
gucagguuuuuug

SEQ ID NO: 3694590 - RNA, 15 nt, Salmonella enterica enterica serovar Typhi Ty2
gucaguaauaugaau

SEQ ID NO: 3694591 - RNA, 18 nt, Salmonella enterica enterica serovar Typhi Ty2
gucaguacgucgcauacu

SEQ ID NO: 3694592 - RNA, 22 nt, Salmonella enterica enterica serovar Typhi Ty2
gucagucgccagaaggcaggcu

SEQ ID NO: 3694593 - RNA, 22 nt, Salmonella enterica enterica serovar Typhi Ty2
gucagucgcucuaucgccugga

SEQ ID NO: 3694594 - RNA, 12 nt, Salmonella enterica enterica serovar Typhi Ty2
gucaguuccaua

SEQ ID NO: 3694595 - RNA, 14 nt, Salmonella enterica enterica serovar Typhi Ty2
gucaguuccauaau

SEQ ID NO: 3694596 - RNA, 14 nt, Salmonella enterica enterica serovar Typhi Ty2
gucaguucgccacg

SEQ ID NO: 3694597 - RNA, 22 nt, Salmonella enterica enterica serovar Typhi Ty2
gucauaaauacacgaggccacg

SEQ ID NO: 3694598 - RNA, 23 nt, Salmonella enterica enterica serovar Typhi Ty2
gucauaacgcuuuguacagacaa

SEQ ID NO: 3694599 - RNA, 14 nt, Salmonella enterica enterica serovar Typhi Ty2
gucauaaucgccgu

SEQ ID NO: 3694600 - RNA, 16 nt, Salmonella enterica enterica serovar Typhi Ty2
gucauagcaggagaua

SEQ ID NO: 3694601 - RNA, 15 nt, Salmonella enterica enterica serovar Typhi Ty2
gucauaucauccagc

SEQ ID NO: 3694602 - RNA, 20 nt, Salmonella enterica enterica serovar Typhi Ty2
gucaucaaaaucaucgccac

SEQ ID NO: 3694603 - RNA, 20 nt, Salmonella enterica enterica serovar Typhi Ty2
guccgguugcaguacaggca

SEQ ID NO: 3694604 - RNA, 20 nt, Salmonella enterica enterica serovar Typhi Ty2
guccguuaccccuuuuucaa

SEQ ID NO: 3694605 - RNA, 14 nt, Salmonella enterica enterica serovar Typhi Ty2
guccuccauggcuu

SEQ ID NO: 3694606 - RNA, 16 nt, Salmonella enterica enterica serovar Typhi Ty2
guccuccggcugaagc

SEQ ID NO: 3694607 - RNA, 22 nt, Salmonella enterica enterica serovar Typhi Ty2
guccucggcaacauaccgggua

SEQ ID NO: 3694608 - RNA, 19 nt, Salmonella enterica enterica serovar Typhi Ty2
guccucuuucccuuuuuaa

SEQ ID NO: 3694609 - RNA, 20 nt, Salmonella enterica enterica serovar Typhi Ty2
guccugaucaaggcgcaaaa

SEQ ID NO: 3694610 - RNA, 14 nt, Salmonella enterica enterica serovar Typhi Ty2
guccugauccggcu

SEQ ID NO: 3694611 - RNA, 19 nt, Salmonella enterica enterica serovar Typhi Ty2
guccugcaaggcaucgucg

SEQ ID NO: 3694612 - RNA, 21 nt, Salmonella enterica enterica serovar Typhi Ty2
guccugcggacgcagcucaua

SEQ ID NO: 3694613 - RNA, 20 nt, Salmonella enterica enterica serovar Typhi Ty2
guccugcgggaacaugcaua

SEQ ID NO: 3694614 - RNA, 16 nt, Salmonella enterica enterica serovar Typhi Ty2
guccugguacaucgcg

SEQ ID NO: 3694615 - RNA, 16 nt, Salmonella enterica enterica serovar Typhi Ty2
guccugucccugccag

SEQ ID NO: 3694616 - RNA, 21 nt, Salmonella enterica enterica serovar Typhi Ty2
guccuuaaccagcucgcugau

SEQ ID NO: 3694617 - RNA, 17 nt, Salmonella enterica enterica serovar Typhi Ty2
guccuucacaaacuucu

SEQ ID NO: 3694618 - RNA, 13 nt, Salmonella enterica enterica serovar Typhi Ty2
guccuucuccuuc

SEQ ID NO: 3694619 - RNA, 17 nt, Salmonella enterica enterica serovar Typhi Ty2
guccuugcgaagaccgc

SEQ ID NO: 3694620 - RNA, 22 nt, Salmonella enterica enterica serovar Typhi Ty2
guccuuuacugcgccagccugc

SEQ ID NO: 3694621 - RNA, 19 nt, Salmonella enterica enterica serovar Typhi Ty2
gucgaaaauaucggccuga

SEQ ID NO: 3694622 - RNA, 13 nt, Salmonella enterica enterica serovar Typhi Ty2
gucgaacaugcgg

SEQ ID NO: 3694623 - RNA, 18 nt, Salmonella enterica enterica serovar Typhi Ty2
gucgaacuuacgacgcgc

SEQ ID NO: 3694624 - RNA, 19 nt, Salmonella enterica enterica serovar Typhi Ty2
gucgaauuccgccugcugu

SEQ ID NO: 3694625 - RNA, 22 nt, Salmonella enterica enterica serovar Typhi Ty2
gucgacauaauuuccggccagu

SEQ ID NO: 3694626 - RNA, 19 nt, Salmonella enterica enterica serovar Typhi Ty2
gucgagaaaccgcucgccg

SEQ ID NO: 3694627 - RNA, 23 nt, Salmonella enterica enterica serovar Typhi Ty2
gucgagaauguggguauccacgc

SEQ ID NO: 3694628 - RNA, 23 nt, Salmonella enterica enterica serovar Typhi Ty2
gucgagauacugcaacgccagau

SEQ ID NO: 3694629 - RNA, 20 nt, Salmonella enterica enterica serovar Typhi Ty2
gucgagcaucuccagcgcau

SEQ ID NO: 3694630 - RNA, 14 nt, Salmonella enterica enterica serovar Typhi Ty2
gucgaggaagcugc

SEQ ID NO: 3694631 - RNA, 17 nt, Salmonella enterica enterica serovar Typhi Ty2
gucgauaaaauccucua

SEQ ID NO: 3694632 - RNA, 16 nt, Salmonella enterica enterica serovar Typhi Ty2
gucgaucacgguggug

SEQ ID NO: 3694633 - RNA, 14 nt, Salmonella enterica enterica serovar Typhi Ty2
gucgaucucggcca

SEQ ID NO: 3694634 - RNA, 13 nt, Salmonella enterica enterica serovar Typhi Ty2
gucgaugauuuuc

SEQ ID NO: 3694635 - RNA, 15 nt, Salmonella enterica enterica serovar Typhi Ty2
gucgaugucgccgcc

SEQ ID NO: 3694636 - RNA, 16 nt, Salmonella enterica enterica serovar Typhi Ty2
gucgauuuugccuuca

SEQ ID NO: 3694637 - RNA, 20 nt, Salmonella enterica enterica serovar Typhi Ty2
gucgcaagacgaaaaaugaa

SEQ ID NO: 3694638 - RNA, 22 nt, Salmonella enterica enterica serovar Typhi Ty2
gucgcaagacgaaaaaugaaua

SEQ ID NO: 3694639 - RNA, 14 nt, Salmonella enterica enterica serovar Typhi Ty2
gucgcacuccucug

SEQ ID NO: 3694640 - RNA, 16 nt, Salmonella enterica enterica serovar Typhi Ty2
gucgcagcaaacggca

SEQ ID NO: 3694641 - RNA, 20 nt, Salmonella enterica enterica serovar Typhi Ty2
gucgcagcggcggucugcgc

SEQ ID NO: 3694642 - RNA, 13 nt, Salmonella enterica enterica serovar Typhi Ty2
gucgcauacuucc

SEQ ID NO: 3694643 - RNA, 13 nt, Salmonella enterica enterica serovar Typhi Ty2
gucgcauccgcgu

SEQ ID NO: 3694644 - RNA, 13 nt, Salmonella enterica enterica serovar Typhi Ty2
gucgcauccggca

SEQ ID NO: 3694645 - RNA, 16 nt, Salmonella enterica enterica serovar Typhi Ty2
gucgcauggcuaaaag

SEQ ID NO: 3694646 - RNA, 18 nt, Salmonella enterica enterica serovar Typhi Ty2
gucgccaagcuguggaaa

SEQ ID NO: 3694647 - RNA, 19 nt, Salmonella enterica enterica serovar Typhi Ty2
gucgccaccaugcugguug

SEQ ID NO: 3694648 - RNA, 18 nt, Salmonella enterica enterica serovar Typhi Ty2
gucgccacgcgacgccag

SEQ ID NO: 3694649 - RNA, 18 nt, Salmonella enterica enterica serovar Typhi Ty2
gucgccagacccagcgcu

SEQ ID NO: 3694650 - RNA, 12 nt, Salmonella enterica enterica serovar Typhi Ty2
gucgccagcaua

SEQ ID NO: 3694651 - RNA, 12 nt, Salmonella enterica enterica serovar Typhi Ty2
gucgccaggcaa

SEQ ID NO: 3694652 - RNA, 23 nt, Salmonella enterica enterica serovar Typhi Ty2
gucgccaggcaagguuaacguca

SEQ ID NO: 3694653 - RNA, 13 nt, Salmonella enterica enterica serovar Typhi Ty2
gucgccauccuga

SEQ ID NO: 3694654 - RNA, 16 nt, Salmonella enterica enterica serovar Typhi Ty2
gucgcccagccauaau

SEQ ID NO: 3694655 - RNA, 17 nt, Salmonella enterica enterica serovar Typhi Ty2
gucgccccaaucgccag

SEQ ID NO: 3694656 - RNA, 23 nt, Salmonella enterica enterica serovar Typhi Ty2
gucgcccgcuaacggcaccagca

SEQ ID NO: 3694657 - RNA, 20 nt, Salmonella enterica enterica serovar Typhi Ty2
gucgcccggaaauggguauc

SEQ ID NO: 3694658 - RNA, 16 nt, Salmonella enterica enterica serovar Typhi Ty2
gucgccgcccaucggg

SEQ ID NO: 3694659 - RNA, 12 nt, Salmonella enterica enterica serovar Typhi Ty2
gucgccgcccgu

SEQ ID NO: 3694660 - RNA, 22 nt, Salmonella enterica enterica serovar Typhi Ty2
gucgccgcgcccagcagcagaa

SEQ ID NO: 3694661 - RNA, 15 nt, Salmonella enterica enterica serovar Typhi Ty2
gucgccggggcgcug

SEQ ID NO: 3694662 - RNA, 22 nt, Salmonella enterica enterica serovar Typhi Ty2
gucgccugcuguugggcaggag

SEQ ID NO: 3694663 - RNA, 18 nt, Salmonella enterica enterica serovar Typhi Ty2
gucgccuuccugcaggcg

SEQ ID NO: 3694664 - RNA, 21 nt, Salmonella enterica enterica serovar Typhi Ty2
gucgcgaaugcgcaaucccgg

SEQ ID NO: 3694665 - RNA, 22 nt, Salmonella enterica enterica serovar Typhi Ty2
gucgcgaaugcgcaaucccgga

SEQ ID NO: 3694666 - RNA, 18 nt, Salmonella enterica enterica serovar Typhi Ty2
gucgcgacguccgccaac

SEQ ID NO: 3694667 - RNA, 14 nt, Salmonella enterica enterica serovar Typhi Ty2
gucgcgauccgcga

SEQ ID NO: 3694668 - RNA, 20 nt, Salmonella enterica enterica serovar Typhi Ty2
gucgcgcauggcagggcgau

SEQ ID NO: 3694669 - RNA, 22 nt, Salmonella enterica enterica serovar Typhi Ty2
gucgcgccaaaagaggcagcaa

SEQ ID NO: 3694670 - RNA, 18 nt, Salmonella enterica enterica serovar Typhi Ty2
gucgcgccauuccgcaga

SEQ ID NO: 3694671 - RNA, 16 nt, Salmonella enterica enterica serovar Typhi Ty2
gucgcgcccuccucca

SEQ ID NO: 3694672 - RNA, 14 nt, Salmonella enterica enterica serovar Typhi Ty2
gucgcgcgccgcaa

SEQ ID NO: 3694673 - RNA, 16 nt, Salmonella enterica enterica serovar Typhi Ty2
gucgcgcgccgccugc

SEQ ID NO: 3694674 - RNA, 18 nt, Salmonella enterica enterica serovar Typhi Ty2
gucgcggauaugcagcag

SEQ ID NO: 3694675 - RNA, 19 nt, Salmonella enterica enterica serovar Typhi Ty2
gucgcggauaugcagcagc

SEQ ID NO: 3694676 - RNA, 14 nt, Salmonella enterica enterica serovar Typhi Ty2
gucgcggccaccgc

SEQ ID NO: 3694677 - RNA, 19 nt, Salmonella enterica enterica serovar Typhi Ty2
gucgcggcucaccagcuga

SEQ ID NO: 3694678 - RNA, 18 nt, Salmonella enterica enterica serovar Typhi Ty2
gucgcgguugucggcgcg

SEQ ID NO: 3694679 - RNA, 19 nt, Salmonella enterica enterica serovar Typhi Ty2
gucgcuaacccaggccgga

SEQ ID NO: 3694680 - RNA, 22 nt, Salmonella enterica enterica serovar Typhi Ty2
gucgcuaccacagaaaucgccg

SEQ ID NO: 3694681 - RNA, 16 nt, Salmonella enterica enterica serovar Typhi Ty2
gucgcuauggugcggg

SEQ ID NO: 3694682 - RNA, 23 nt, Salmonella enterica enterica serovar Typhi Ty2
gucgcucacauucauugccgcca

SEQ ID NO: 3694683 - RNA, 22 nt, Salmonella enterica enterica serovar Typhi Ty2
gucgcucgacauagguucugcg

SEQ ID NO: 3694684 - RNA, 22 nt, Salmonella enterica enterica serovar Typhi Ty2
gucgcucuuuuuuuugcuuaaa

SEQ ID NO: 3694685 - RNA, 13 nt, Salmonella enterica enterica serovar Typhi Ty2
gucugguggucua

SEQ ID NO: 3694686 - RNA, 13 nt, Salmonella enterica enterica serovar Typhi Ty2
gucugucaggacu

SEQ ID NO: 3694687 - RNA, 15 nt, Salmonella enterica enterica serovar Typhi Ty2
gucugucgguaaaga

SEQ ID NO: 3694688 - RNA, 21 nt, Salmonella enterica enterica serovar Typhi Ty2
gucuguucguagcccauagca

SEQ ID NO: 3694689 - RNA, 21 nt, Salmonella enterica enterica serovar Typhi Ty2
gucuguuucaacgcauccagc

SEQ ID NO: 3694690 - RNA, 22 nt, Salmonella enterica enterica serovar Typhi Ty2
gucuguuuugccuugccacgca

SEQ ID NO: 3694691 - RNA, 18 nt, Salmonella enterica enterica serovar Typhi Ty2
gucuuaaccuuuuguauc

SEQ ID NO: 3694692 - RNA, 17 nt, Salmonella enterica enterica serovar Typhi Ty2
gucuuacacuuagcaca

SEQ ID NO: 3694693 - RNA, 17 nt, Salmonella enterica enterica serovar Typhi Ty2
gucuuauuucuccugcg

SEQ ID NO: 3694694 - RNA, 14 nt, Salmonella enterica enterica serovar Typhi Ty2
gucuucaucagcca

SEQ ID NO: 3694695 - RNA, 16 nt, Salmonella enterica enterica serovar Typhi Ty2
gucuucaucagccagc

SEQ ID NO: 3694696 - RNA, 18 nt, Salmonella enterica enterica serovar Typhi Ty2
gucuucaucagccagcau

SEQ ID NO: 3694697 - RNA, 21 nt, Salmonella enterica enterica serovar Typhi Ty2
gucuuccagcauucuauuguu

SEQ ID NO: 3694698 - RNA, 15 nt, Salmonella enterica enterica serovar Typhi Ty2
gucuuccgacacuga

SEQ ID NO: 3694699 - RNA, 16 nt, Salmonella enterica enterica serovar Typhi Ty2
gucuucgaccgccaua

SEQ ID NO: 3694700 - RNA, 21 nt, Salmonella enterica enterica serovar Typhi Ty2
gucuucgcacugcccuucccg

SEQ ID NO: 3694701 - RNA, 23 nt, Salmonella enterica enterica serovar Typhi Ty2
gucuugauuucaggugcuuaucu

SEQ ID NO: 3694702 - RNA, 12 nt, Salmonella enterica enterica serovar Typhi Ty2
gucuugccuguc

SEQ ID NO: 3694703 - RNA, 14 nt, Salmonella enterica enterica serovar Typhi Ty2
gucuugucaggcuc

SEQ ID NO: 3694704 - RNA, 18 nt, Salmonella enterica enterica serovar Typhi Ty2
gucuuuauucaucaucuu

SEQ ID NO: 3694705 - RNA, 23 nt, Salmonella enterica enterica serovar Typhi Ty2
gucuuuccgacccuuaugucauu

SEQ ID NO: 3694706 - RNA, 15 nt, Salmonella enterica enterica serovar Typhi Ty2
gucuuucuucgcugc

SEQ ID NO: 3694707 - RNA, 16 nt, Salmonella enterica enterica serovar Typhi Ty2
gucuuuguugccuucg

SEQ ID NO: 3694708 - RNA, 17 nt, Salmonella enterica enterica serovar Typhi Ty2
gucuuuguugccuucga

SEQ ID NO: 3694709 - RNA, 12 nt, Salmonella enterica enterica serovar Typhi Ty2
gucuuuuauccc

SEQ ID NO: 3694710 - RNA, 13 nt, Salmonella enterica enterica serovar Typhi Ty2
gucuuuucugucg

SEQ ID NO: 3694711 - RNA, 14 nt, Salmonella enterica enterica serovar Typhi Ty2
gucuuuuucaucuu

SEQ ID NO: 3694712 - RNA, 15 nt, Salmonella enterica enterica serovar Typhi Ty2
gucuuuuucaucuuu

SEQ ID NO: 3694713 - RNA, 13 nt, Salmonella enterica enterica serovar Typhi Ty2
gucuuuuucucaa

SEQ ID NO: 3694714 - RNA, 21 nt, Salmonella enterica enterica serovar Typhi Ty2
gugaaaaacgggagauuguua

SEQ ID NO: 3694715 - RNA, 17 nt, Salmonella enterica enterica serovar Typhi Ty2
gugaaaagggaugcuga

SEQ ID NO: 3694716 - RNA, 19 nt, Salmonella enterica enterica serovar Typhi Ty2
gugaaacagguuuaaacga

SEQ ID NO: 3694717 - RNA, 16 nt, Salmonella enterica enterica serovar Typhi Ty2
gugaaacguguuuauc

SEQ ID NO: 3694718 - RNA, 21 nt, Salmonella enterica enterica serovar Typhi Ty2
gugaaauaaacguaccgauga

SEQ ID NO: 3694719 - RNA, 18 nt, Salmonella enterica enterica serovar Typhi Ty2
gugaaauuauuccuuauc

SEQ ID NO: 3694720 - RNA, 21 nt, Salmonella enterica enterica serovar Typhi Ty2
gugaaauuauuccuuaucaca

SEQ ID NO: 3694721 - RNA, 16 nt, Salmonella enterica enterica serovar Typhi Ty2
gugaacaccacugaaa

SEQ ID NO: 3694722 - RNA, 21 nt, Salmonella enterica enterica serovar Typhi Ty2
gugaacauggguuucuugccg

SEQ ID NO: 3694723 - RNA, 14 nt, Salmonella enterica enterica serovar Typhi Ty2
gugaaccagcaucc

SEQ ID NO: 3694724 - RNA, 15 nt, Salmonella enterica enterica serovar Typhi Ty2
gugaaccauggcaac

SEQ ID NO: 3694725 - RNA, 16 nt, Salmonella enterica enterica serovar Typhi Ty2
gugaaccauggcaaca

SEQ ID NO: 3694726 - RNA, 20 nt, Salmonella enterica enterica serovar Typhi Ty2
gugaaccauggcaacaugga

SEQ ID NO: 3694727 - RNA, 13 nt, Salmonella enterica enterica serovar Typhi Ty2
gugaaccgguaaa

SEQ ID NO: 3694728 - RNA, 14 nt, Salmonella enterica enterica serovar Typhi Ty2
gugaaccgguaaag

SEQ ID NO: 3694729 - RNA, 19 nt, Salmonella enterica enterica serovar Typhi Ty2
gugaacgcacgcagccaac

SEQ ID NO: 3694730 - RNA, 18 nt, Salmonella enterica enterica serovar Typhi Ty2
gugaacgccaaauacguc

SEQ ID NO: 3694731 - RNA, 23 nt, Salmonella enterica enterica serovar Typhi Ty2
gugaacgucuuauccggccugca

SEQ ID NO: 3694732 - RNA, 16 nt, Salmonella enterica enterica serovar Typhi Ty2
gugaagaaucccccau

SEQ ID NO: 3694733 - RNA, 19 nt, Salmonella enterica enterica serovar Typhi Ty2
gugaagaaucuguauaaaa

SEQ ID NO: 3694734 - RNA, 16 nt, Salmonella enterica enterica serovar Typhi Ty2
gugaagacgacgggaa

SEQ ID NO: 3694735 - RNA, 14 nt, Salmonella enterica enterica serovar Typhi Ty2
gugaagccaucaaa

SEQ ID NO: 3694736 - RNA, 18 nt, Salmonella enterica enterica serovar Typhi Ty2
gugaaggccaaguuuaga

SEQ ID NO: 3694737 - RNA, 17 nt, Salmonella enterica enterica serovar Typhi Ty2
gugaauaugacgggcaa

SEQ ID NO: 3694738 - RNA, 14 nt, Salmonella enterica enterica serovar Typhi Ty2
gugaauauggaaag

SEQ ID NO: 3694739 - RNA, 20 nt, Salmonella enterica enterica serovar Typhi Ty2
gugaauuaugaccaauguua

SEQ ID NO: 3694740 - RNA, 13 nt, Salmonella enterica enterica serovar Typhi Ty2
gugaauuucugcu

SEQ ID NO: 3694741 - RNA, 16 nt, Salmonella enterica enterica serovar Typhi Ty2
gugacaaucuccuccg

SEQ ID NO: 3694742 - RNA, 15 nt, Salmonella enterica enterica serovar Typhi Ty2
gugacaucgccggag

SEQ ID NO: 3694743 - RNA, 14 nt, Salmonella enterica enterica serovar Typhi Ty2
gugaccagcgguau

SEQ ID NO: 3694744 - RNA, 14 nt, Salmonella enterica enterica serovar Typhi Ty2
gugaccccggccuc

SEQ ID NO: 3694745 - RNA, 12 nt, Salmonella enterica enterica serovar Typhi Ty2
gugacccgccgc

SEQ ID NO: 3694746 - RNA, 15 nt, Salmonella enterica enterica serovar Typhi Ty2
gugaccgauaaaaaa

SEQ ID NO: 3694747 - RNA, 18 nt, Salmonella enterica enterica serovar Typhi Ty2
gugaccgccuuauccggc

SEQ ID NO: 3694748 - RNA, 21 nt, Salmonella enterica enterica serovar Typhi Ty2
gugaccgguaagcccauggca

SEQ ID NO: 3694749 - RNA, 14 nt, Salmonella enterica enterica serovar Typhi Ty2
gugaccugcugacu

SEQ ID NO: 3694750 - RNA, 13 nt, Salmonella enterica enterica serovar Typhi Ty2
gugacgccaggca

SEQ ID NO: 3694751 - RNA, 19 nt, Salmonella enterica enterica serovar Typhi Ty2
gugacgccgccauccggua

SEQ ID NO: 3694752 - RNA, 21 nt, Salmonella enterica enterica serovar Typhi Ty2
gugacggcaaaguuccagguu

SEQ ID NO: 3694753 - RNA, 16 nt, Salmonella enterica enterica serovar Typhi Ty2
gugacgggcuggcgcu

SEQ ID NO: 3694754 - RNA, 13 nt, Salmonella enterica enterica serovar Typhi Ty2
gugacuaaaagac

SEQ ID NO: 3694755 - RNA, 17 nt, Salmonella enterica enterica serovar Typhi Ty2
gugacuaauagccaaaa

SEQ ID NO: 3694756 - RNA, 15 nt, Salmonella enterica enterica serovar Typhi Ty2
gugagcauugcgcuc

SEQ ID NO: 3694757 - RNA, 15 nt, Salmonella enterica enterica serovar Typhi Ty2
gugagcccuccucca

SEQ ID NO: 3694758 - RNA, 13 nt, Salmonella enterica enterica serovar Typhi Ty2
gugagcgucaucg

SEQ ID NO: 3694759 - RNA, 15 nt, Salmonella enterica enterica serovar Typhi Ty2
gugagcucauccagc

SEQ ID NO: 3694760 - RNA, 14 nt, Salmonella enterica enterica serovar Typhi Ty2
gugagcucuuucug

SEQ ID NO: 3694761 - RNA, 22 nt, Salmonella enterica enterica serovar Typhi Ty2
gugagcuuugcacgcuguuucu

SEQ ID NO: 3694762 - RNA, 18 nt, Salmonella enterica enterica serovar Typhi Ty2
gugaguaauaacaaaaaa

SEQ ID NO: 3694763 - RNA, 21 nt, Salmonella enterica enterica serovar Typhi Ty2
gugaguccccaggagcauaga

SEQ ID NO: 3694764 - RNA, 20 nt, Salmonella enterica enterica serovar Typhi Ty2
gugaguggcggcgcgcaggc

SEQ ID NO: 3694765 - RNA, 20 nt, Salmonella enterica enterica serovar Typhi Ty2
gugaguuaugacggggaaca

SEQ ID NO: 3694766 - RNA, 16 nt, Salmonella enterica enterica serovar Typhi Ty2
gugaguuucgcaucag

SEQ ID NO: 3694767 - RNA, 14 nt, Salmonella enterica enterica serovar Typhi Ty2
gugauaaagcccgu

SEQ ID NO: 3694768 - RNA, 15 nt, Salmonella enterica enterica serovar Typhi Ty2
gugauaaauacgcug

SEQ ID NO: 3694769 - RNA, 16 nt, Salmonella enterica enterica serovar Typhi Ty2
gugauaacgcgauggc

SEQ ID NO: 3694770 - RNA, 21 nt, Salmonella enterica enterica serovar Typhi Ty2
gugauagcaggcacuguggug

SEQ ID NO: 3694771 - RNA, 12 nt, Salmonella enterica enterica serovar Typhi Ty2
gugauauagcaa

SEQ ID NO: 3694772 - RNA, 18 nt, Salmonella enterica enterica serovar Typhi Ty2
gugaucggagaaauagac

SEQ ID NO: 3694773 - RNA, 15 nt, Salmonella enterica enterica serovar Typhi Ty2
gugaucugguuuggu

SEQ ID NO: 3694774 - RNA, 16 nt, Salmonella enterica enterica serovar Typhi Ty2
gugaugacuaaaucag

SEQ ID NO: 3694775 - RNA, 16 nt, Salmonella enterica enterica serovar Typhi Ty2
gugaugcggacgcuga

SEQ ID NO: 3694776 - RNA, 19 nt, Salmonella enterica enterica serovar Typhi Ty2
gugaugcgggacugcugcu

SEQ ID NO: 3694777 - RNA, 20 nt, Salmonella enterica enterica serovar Typhi Ty2
gugaugggcaaugccauauu

SEQ ID NO: 3694778 - RNA, 15 nt, Salmonella enterica enterica serovar Typhi Ty2
gugauggguauuaga

SEQ ID NO: 3694779 - RNA, 17 nt, Salmonella enterica enterica serovar Typhi Ty2
gugauggguauuagaau

SEQ ID NO: 3694780 - RNA, 13 nt, Salmonella enterica enterica serovar Typhi Ty2
gugauggugcagc

SEQ ID NO: 3694781 - RNA, 13 nt, Salmonella enterica enterica serovar Typhi Ty2
gugaugugcuggc

SEQ ID NO: 3694782 - RNA, 12 nt, Salmonella enterica enterica serovar Typhi Ty2
gugauuacaaaa

SEQ ID NO: 3694783 - RNA, 18 nt, Salmonella enterica enterica serovar Typhi Ty2
gugauuuacuccaaaaau

SEQ ID NO: 3694784 - RNA, 20 nt, Salmonella enterica enterica serovar Typhi Ty2
gugauuuuugacccgcagca

SEQ ID NO: 3694785 - RNA, 18 nt, Salmonella enterica enterica serovar Typhi Ty2
gugcaaacgauaaaagcu

SEQ ID NO: 3694786 - RNA, 12 nt, Salmonella enterica enterica serovar Typhi Ty2
gugcaagcaccu

SEQ ID NO: 3694787 - RNA, 18 nt, Salmonella enterica enterica serovar Typhi Ty2
gugcaagcccaacuauuu

SEQ ID NO: 3694788 - RNA, 20 nt, Salmonella enterica enterica serovar Typhi Ty2
gugcaauaucgcggcaaaga

SEQ ID NO: 3694789 - RNA, 24 nt, Salmonella enterica enterica serovar Typhi Ty2
gugcaaucccggaacagcggagcg

SEQ ID NO: 3694790 - RNA, 23 nt, Salmonella enterica enterica serovar Typhi Ty2
gugcaauccugucgucaccagca

SEQ ID NO: 3694791 - RNA, 14 nt, Salmonella enterica enterica serovar Typhi Ty2
gugcagaacaucaa

SEQ ID NO: 3694792 - RNA, 15 nt, Salmonella enterica enterica serovar Typhi Ty2
gugcagaccucugca

SEQ ID NO: 3694793 - RNA, 15 nt, Salmonella enterica enterica serovar Typhi Ty2
gugcagacugcacuu

SEQ ID NO: 3694794 - RNA, 14 nt, Salmonella enterica enterica serovar Typhi Ty2
gugcagcaaauaau

SEQ ID NO: 3694795 - RNA, 19 nt, Salmonella enterica enterica serovar Typhi Ty2
gugcaggacagacagacgu

SEQ ID NO: 3694796 - RNA, 17 nt, Salmonella enterica enterica serovar Typhi Ty2
aaaaauacugauaaaaa

SEQ ID NO: 3694797 - RNA, 13 nt, Salmonella enterica enterica serovar Typhi Ty2
aaaaauauagcca

SEQ ID NO: 3694798 - RNA, 13 nt, Salmonella enterica enterica serovar Typhi Ty2
aaaaaucagcaau

SEQ ID NO: 3694799 - RNA, 13 nt, Salmonella enterica enterica serovar Typhi Ty2
aaaaaucagcauu

SEQ ID NO: 3694800 - RNA, 11 nt, Salmonella enterica enterica serovar Typhi Ty2
aaaaaucagcc

SEQ ID NO: 3694801 - RNA, 12 nt, Salmonella enterica enterica serovar Typhi Ty2
aaaaaucauuau

SEQ ID NO: 3694802 - RNA, 12 nt, Salmonella enterica enterica serovar Typhi Ty2
aaaaauccagua

SEQ ID NO: 3694803 - RNA, 14 nt, Salmonella enterica enterica serovar Typhi Ty2
aaaaauccggauca

SEQ ID NO: 3694804 - RNA, 15 nt, Salmonella enterica enterica serovar Typhi Ty2
aaaaaugauguguuu

SEQ ID NO: 3694805 - RNA, 22 nt, Salmonella enterica enterica serovar Typhi Ty2
aaaaauggguaugcgacugaaa

SEQ ID NO: 3694806 - RNA, 16 nt, Salmonella enterica enterica serovar Typhi Ty2
aaaaauuaaaaauacc

SEQ ID NO: 3694807 - RNA, 13 nt, Salmonella enterica enterica serovar Typhi Ty2
aaaaauucuuuua

SEQ ID NO: 3694808 - RNA, 17 nt, Salmonella enterica enterica serovar Typhi Ty2
aaaaauuucgcuaagau

SEQ ID NO: 3694809 - RNA, 21 nt, Salmonella enterica enterica serovar Typhi Ty2
aaaacacuggcgcucagcgcc

SEQ ID NO: 3694810 - RNA, 13 nt, Salmonella enterica enterica serovar Typhi Ty2
aaaacagcauaau

SEQ ID NO: 3694811 - RNA, 19 nt, Salmonella enterica enterica serovar Typhi Ty2
aaaacagugauuacaaaau

SEQ ID NO: 3694812 - RNA, 20 nt, Salmonella enterica enterica serovar Typhi Ty2
aaaacaguuuugucaucaga

SEQ ID NO: 3694813 - RNA, 23 nt, Salmonella enterica enterica serovar Typhi Ty2
aaaacauggggaguaaagcagcu

SEQ ID NO: 3694814 - RNA, 15 nt, Salmonella enterica enterica serovar Typhi Ty2
aaaaccaccuacgcc

SEQ ID NO: 3694815 - RNA, 23 nt, Salmonella enterica enterica serovar Typhi Ty2
aaaaccaccuacgccguuccagc

SEQ ID NO: 3694816 - RNA, 22 nt, Salmonella enterica enterica serovar Typhi Ty2
aaaaccagcaucaaccaccaaa

SEQ ID NO: 3694817 - RNA, 12 nt, Salmonella enterica enterica serovar Typhi Ty2
aaaaccagcgcc

SEQ ID NO: 3694818 - RNA, 14 nt, Salmonella enterica enterica serovar Typhi Ty2
aaaaccagcgccgc

SEQ ID NO: 3694819 - RNA, 21 nt, Salmonella enterica enterica serovar Typhi Ty2
aaaaccauagcccguacgauc

SEQ ID NO: 3694820 - RNA, 16 nt, Salmonella enterica enterica serovar Typhi Ty2
aaaaccccaucccggc

SEQ ID NO: 3694821 - RNA, 19 nt, Salmonella enterica enterica serovar Typhi Ty2
aaaacccgcagccggauag

SEQ ID NO: 3694822 - RNA, 18 nt, Salmonella enterica enterica serovar Typhi Ty2
aaaacccguuaaauacca

SEQ ID NO: 3694823 - RNA, 15 nt, Salmonella enterica enterica serovar Typhi Ty2
aaaaccgaucuccca

SEQ ID NO: 3694824 - RNA, 21 nt, Salmonella enterica enterica serovar Typhi Ty2
aaaaccggaauuuguugguuu

SEQ ID NO: 3694825 - RNA, 16 nt, Salmonella enterica enterica serovar Typhi Ty2
aaaaccggcaaauacc

SEQ ID NO: 3694826 - RNA, 23 nt, Salmonella enterica enterica serovar Typhi Ty2
aaaaccggcauacacgccgggca

SEQ ID NO: 3694827 - RNA, 20 nt, Salmonella enterica enterica serovar Typhi Ty2
aaaaccggccagcgucauca

SEQ ID NO: 3694828 - RNA, 22 nt, Salmonella enterica enterica serovar Typhi Ty2
aaaaccguccacauccagcgcc

SEQ ID NO: 3694829 - RNA, 14 nt, Salmonella enterica enterica serovar Typhi Ty2
aaaaccuccggcua

SEQ ID NO: 3694830 - RNA, 18 nt, Salmonella enterica enterica serovar Typhi Ty2
aaaaccuccggcuaugcc

SEQ ID NO: 3694831 - RNA, 18 nt, Salmonella enterica enterica serovar Typhi Ty2
aaaaccuucauaaauacg

SEQ ID NO: 3694832 - RNA, 14 nt, Salmonella enterica enterica serovar Typhi Ty2
aaaacgaaaaaccc

SEQ ID NO: 3694833 - RNA, 21 nt, Salmonella enterica enterica serovar Typhi Ty2
aaaacgcucucuuuucuuacu

SEQ ID NO: 3694834 - RNA, 17 nt, Salmonella enterica enterica serovar Typhi Ty2
aaaacggcuaccgucau

SEQ ID NO: 3694835 - RNA, 20 nt, Salmonella enterica enterica serovar Typhi Ty2
aaaacguugacuuaaaaagc

SEQ ID NO: 3694836 - RNA, 14 nt, Salmonella enterica enterica serovar Typhi Ty2
aaaacguugcugga

SEQ ID NO: 3694837 - RNA, 17 nt, Salmonella enterica enterica serovar Typhi Ty2
aaaacuaccguaccagc

SEQ ID NO: 3694838 - RNA, 21 nt, Salmonella enterica enterica serovar Typhi Ty2
aaaacucgccgcgaacaaagc

SEQ ID NO: 3694839 - RNA, 11 nt, Salmonella enterica enterica serovar Typhi Ty2
aaaacugcacc

SEQ ID NO: 3694840 - RNA, 22 nt, Salmonella enterica enterica serovar Typhi Ty2
aaaacuuauuuuauuuuuauau

SEQ ID NO: 3694841 - RNA, 18 nt, Salmonella enterica enterica serovar Typhi Ty2
aaaacuuuaacacuaacu

SEQ ID NO: 3694842 - RNA, 11 nt, Salmonella enterica enterica serovar Typhi Ty2
aaaagaaaaaa

SEQ ID NO: 3694843 - RNA, 12 nt, Salmonella enterica enterica serovar Typhi Ty2
aaaagaaaaaac

SEQ ID NO: 3694844 - RNA, 15 nt, Salmonella enterica enterica serovar Typhi Ty2
aaaagaacaauaauc

SEQ ID NO: 3694845 - RNA, 12 nt, Salmonella enterica enterica serovar Typhi Ty2
aaaagaauagcc

SEQ ID NO: 3694846 - RNA, 16 nt, Salmonella enterica enterica serovar Typhi Ty2
aaaagagagcgccaaa

SEQ ID NO: 3694847 - RNA, 14 nt, Salmonella enterica enterica serovar Typhi Ty2
aaaagauaaccauu

SEQ ID NO: 3694848 - RNA, 21 nt, Salmonella enterica enterica serovar Typhi Ty2
aaaagcacaucagcaaaugaa

SEQ ID NO: 3694849 - RNA, 18 nt, Salmonella enterica enterica serovar Typhi Ty2
aaaagcccgcccagcauu

SEQ ID NO: 3694850 - RNA, 22 nt, Salmonella enterica enterica serovar Typhi Ty2
aaaagccggcggaaaaaagcag

SEQ ID NO: 3694851 - RNA, 18 nt, Salmonella enterica enterica serovar Typhi Ty2
aaaagccugcacauugca

SEQ ID NO: 3694852 - RNA, 14 nt, Salmonella enterica enterica serovar Typhi Ty2
aaaagcgaaaauaa

SEQ ID NO: 3694853 - RNA, 19 nt, Salmonella enterica enterica serovar Typhi Ty2
aaaagcgauuuauucuuug

SEQ ID NO: 3694854 - RNA, 15 nt, Salmonella enterica enterica serovar Typhi Ty2
aaaagcgcccagcgc

SEQ ID NO: 3694855 - RNA, 13 nt, Salmonella enterica enterica serovar Typhi Ty2
aaaagcugauuaa

SEQ ID NO: 3694856 - RNA, 15 nt, Salmonella enterica enterica serovar Typhi Ty2
aaaaggaaagauuac

SEQ ID NO: 3694857 - RNA, 16 nt, Salmonella enterica enterica serovar Typhi Ty2
aaaaggauacagcgcc

SEQ ID NO: 3694858 - RNA, 15 nt, Salmonella enterica enterica serovar Typhi Ty2
aaaaggcaauaaagu

SEQ ID NO: 3694859 - RNA, 22 nt, Salmonella enterica enterica serovar Typhi Ty2
aaaaggcagagcgcgcucugcc

SEQ ID NO: 3694860 - RNA, 22 nt, Salmonella enterica enterica serovar Typhi Ty2
aaaaggcagauucuucugccuu

SEQ ID NO: 3694861 - RNA, 19 nt, Salmonella enterica enterica serovar Typhi Ty2
aaaaggccuggcugagaaa

SEQ ID NO: 3694862 - RNA, 20 nt, Salmonella enterica enterica serovar Typhi Ty2
aaaaggcgacgaugugcaua

SEQ ID NO: 3694863 - RNA, 16 nt, Salmonella enterica enterica serovar Typhi Ty2
aaaagggaaaagccau

SEQ ID NO: 3694864 - RNA, 19 nt, Salmonella enterica enterica serovar Typhi Ty2
aaaagguggguuccagcgc

SEQ ID NO: 3694865 - RNA, 16 nt, Salmonella enterica enterica serovar Typhi Ty2
aaaaguauauaucccg

SEQ ID NO: 3694866 - RNA, 14 nt, Salmonella enterica enterica serovar Typhi Ty2
aaaaguauggcggu

SEQ ID NO: 3694867 - RNA, 23 nt, Salmonella enterica enterica serovar Typhi Ty2
aaaagucacuuacuuucuugcca

SEQ ID NO: 3694868 - RNA, 15 nt, Salmonella enterica enterica serovar Typhi Ty2
aaaagucauuuucau

SEQ ID NO: 3694869 - RNA, 17 nt, Salmonella enterica enterica serovar Typhi Ty2
aaaagucguucagacau

SEQ ID NO: 3694870 - RNA, 21 nt, Salmonella enterica enterica serovar Typhi Ty2
aaaagugaacgguugagcuuu

SEQ ID NO: 3694871 - RNA, 21 nt, Salmonella enterica enterica serovar Typhi Ty2
aaaagugcgcacucagaaaau

SEQ ID NO: 3694872 - RNA, 20 nt, Salmonella enterica enterica serovar Typhi Ty2
aaaaguguguaccagcagcg

SEQ ID NO: 3694873 - RNA, 11 nt, Salmonella enterica enterica serovar Typhi Ty2
aaaauaaaaaa

SEQ ID NO: 3694874 - RNA, 13 nt, Salmonella enterica enterica serovar Typhi Ty2
aaaauaaaaaagg

SEQ ID NO: 3694875 - RNA, 15 nt, Salmonella enterica enterica serovar Typhi Ty2
aaaauaaaaaaggca

SEQ ID NO: 3694876 - RNA, 12 nt, Salmonella enterica enterica serovar Typhi Ty2
aaaauaaacacu

SEQ ID NO: 3694877 - RNA, 13 nt, Salmonella enterica enterica serovar Typhi Ty2
aaaauaacaggca

SEQ ID NO: 3694878 - RNA, 20 nt, Salmonella enterica enterica serovar Typhi Ty2
aaacaggccugcggaaaaag

SEQ ID NO: 3694879 - RNA, 15 nt, Salmonella enterica enterica serovar Typhi Ty2
aaacaggcugcccgg

SEQ ID NO: 3694880 - RNA, 15 nt, Salmonella enterica enterica serovar Typhi Ty2
aaacagguaaaacaa

SEQ ID NO: 3694881 - RNA, 19 nt, Salmonella enterica enterica serovar Typhi Ty2
aaacagguaaaacaaaaaa

SEQ ID NO: 3694882 - RNA, 19 nt, Salmonella enterica enterica serovar Typhi Ty2
aaacagguacuuacccaga

SEQ ID NO: 3694883 - RNA, 19 nt, Salmonella enterica enterica serovar Typhi Ty2
aaacaguccggcgaaaaaa

SEQ ID NO: 3694884 - RNA, 16 nt, Salmonella enterica enterica serovar Typhi Ty2
aaacagugauuacaaa

SEQ ID NO: 3694885 - RNA, 18 nt, Salmonella enterica enterica serovar Typhi Ty2
aaacaguuuugucaucag

SEQ ID NO: 3694886 - RNA, 13 nt, Salmonella enterica enterica serovar Typhi Ty2
aaacauaagcaaa

SEQ ID NO: 3694887 - RNA, 16 nt, Salmonella enterica enterica serovar Typhi Ty2
aaacauaagcaaaucc

SEQ ID NO: 3694888 - RNA, 14 nt, Salmonella enterica enterica serovar Typhi Ty2
aaacauauaucucu

SEQ ID NO: 3694889 - RNA, 15 nt, Salmonella enterica enterica serovar Typhi Ty2
aaacauauccauaca

SEQ ID NO: 3694890 - RNA, 14 nt, Salmonella enterica enterica serovar Typhi Ty2
aaacaucagccauu

SEQ ID NO: 3694891 - RNA, 13 nt, Salmonella enterica enterica serovar Typhi Ty2
aaacaucagcgca

SEQ ID NO: 3694892 - RNA, 14 nt, Salmonella enterica enterica serovar Typhi Ty2
aaacaucagcgcau

SEQ ID NO: 3694893 - RNA, 15 nt, Salmonella enterica enterica serovar Typhi Ty2
aaacaucaugcccaa

SEQ ID NO: 3694894 - RNA, 24 nt, Salmonella enterica enterica serovar Typhi Ty2
aaacaucauggcuuaaaacgauuu

SEQ ID NO: 3694895 - RNA, 14 nt, Salmonella enterica enterica serovar Typhi Ty2
aaacaucccgauaa

SEQ ID NO: 3694896 - RNA, 22 nt, Salmonella enterica enterica serovar Typhi Ty2
aaacaucgcugauauuguugaa

SEQ ID NO: 3694897 - RNA, 20 nt, Salmonella enterica enterica serovar Typhi Ty2
aaacaugguggagucugaaa

SEQ ID NO: 3694898 - RNA, 16 nt, Salmonella enterica enterica serovar Typhi Ty2
aaaccaaacaccagau

SEQ ID NO: 3694899 - RNA, 15 nt, Salmonella enterica enterica serovar Typhi Ty2
aaaccaaacuuaucu

SEQ ID NO: 3694900 - RNA, 18 nt, Salmonella enterica enterica serovar Typhi Ty2
aaaccaaagguauugccu

SEQ ID NO: 3694901 - RNA, 21 nt, Salmonella enterica enterica serovar Typhi Ty2
aaaccaacaucgcugaauuuc

SEQ ID NO: 3694902 - RNA, 20 nt, Salmonella enterica enterica serovar Typhi Ty2
aaaccaauacgcauuagcuu

SEQ ID NO: 3694903 - RNA, 13 nt, Salmonella enterica enterica serovar Typhi Ty2
aaaccacagugac

SEQ ID NO: 3694904 - RNA, 19 nt, Salmonella enterica enterica serovar Typhi Ty2
aaaccacaugaccagcgcc

SEQ ID NO: 3694905 - RNA, 16 nt, Salmonella enterica enterica serovar Typhi Ty2
aaaccaccgagacuac

SEQ ID NO: 3694906 - RNA, 12 nt, Salmonella enterica enterica serovar Typhi Ty2
aaaccacuccgg

SEQ ID NO: 3694907 - RNA, 20 nt, Salmonella enterica enterica serovar Typhi Ty2
aaaccagcuuuucauuuguu

SEQ ID NO: 3694908 - RNA, 19 nt, Salmonella enterica enterica serovar Typhi Ty2
aaaccaucccagguuauuc

SEQ ID NO: 3694909 - RNA, 16 nt, Salmonella enterica enterica serovar Typhi Ty2
aaaccaucuugcguua

SEQ ID NO: 3694910 - RNA, 15 nt, Salmonella enterica enterica serovar Typhi Ty2
aaaccaugaucguca

SEQ ID NO: 3694911 - RNA, 22 nt, Salmonella enterica enterica serovar Typhi Ty2
aaacccacccgguaauaccgau

SEQ ID NO: 3694912 - RNA, 18 nt, Salmonella enterica enterica serovar Typhi Ty2
aaaccccagauuacugcc

SEQ ID NO: 3694913 - RNA, 17 nt, Salmonella enterica enterica serovar Typhi Ty2
aaaccccaucccggcaa

SEQ ID NO: 3694914 - RNA, 18 nt, Salmonella enterica enterica serovar Typhi Ty2
aaacccgcagccggauag

SEQ ID NO: 3694915 - RNA, 13 nt, Salmonella enterica enterica serovar Typhi Ty2
aaacccgccaccg

SEQ ID NO: 3694916 - RNA, 15 nt, Salmonella enterica enterica serovar Typhi Ty2
aaacccggugcggca

SEQ ID NO: 3694917 - RNA, 18 nt, Salmonella enterica enterica serovar Typhi Ty2
aaacccguuaaauaccag

SEQ ID NO: 3694918 - RNA, 15 nt, Salmonella enterica enterica serovar Typhi Ty2
aaaccgaauucgucc

SEQ ID NO: 3694919 - RNA, 16 nt, Salmonella enterica enterica serovar Typhi Ty2
aaaccgacagcaauau

SEQ ID NO: 3694920 - RNA, 17 nt, Salmonella enterica enterica serovar Typhi Ty2
aaaccgauaaucaccag

SEQ ID NO: 3694921 - RNA, 11 nt, Salmonella enterica enterica serovar Typhi Ty2
aaaccgaucuc

SEQ ID NO: 3694922 - RNA, 16 nt, Salmonella enterica enterica serovar Typhi Ty2
aaaccgaucucccagc

SEQ ID NO: 3694923 - RNA, 17 nt, Salmonella enterica enterica serovar Typhi Ty2
aaaccgccucaauugcc

SEQ ID NO: 3694924 - RNA, 17 nt, Salmonella enterica enterica serovar Typhi Ty2
aaaccggcggccuacca

SEQ ID NO: 3694925 - RNA, 19 nt, Salmonella enterica enterica serovar Typhi Ty2
aaaccggcggucaugcugg

SEQ ID NO: 3694926 - RNA, 16 nt, Salmonella enterica enterica serovar Typhi Ty2
aaaccgggaaaucccg

SEQ ID NO: 3694927 - RNA, 20 nt, Salmonella enterica enterica serovar Typhi Ty2
aaaccggucagguagcagac

SEQ ID NO: 3694928 - RNA, 22 nt, Salmonella enterica enterica serovar Typhi Ty2
aaaccguagauuuucaucauau

SEQ ID NO: 3694929 - RNA, 16 nt, Salmonella enterica enterica serovar Typhi Ty2
aaaccgucauuuacca

SEQ ID NO: 3694930 - RNA, 21 nt, Salmonella enterica enterica serovar Typhi Ty2
aaaccgucauuuaccagugcu

SEQ ID NO: 3694931 - RNA, 17 nt, Salmonella enterica enterica serovar Typhi Ty2
aaaccguccacauccag

SEQ ID NO: 3694932 - RNA, 20 nt, Salmonella enterica enterica serovar Typhi Ty2
aaaccguucacgcucacgca

SEQ ID NO: 3694933 - RNA, 12 nt, Salmonella enterica enterica serovar Typhi Ty2
aaaccuccggcu

SEQ ID NO: 3694934 - RNA, 20 nt, Salmonella enterica enterica serovar Typhi Ty2
aaaccuccggcuaugccgga

SEQ ID NO: 3694935 - RNA, 16 nt, Salmonella enterica enterica serovar Typhi Ty2
aaaccugagcauauaa

SEQ ID NO: 3694936 - RNA, 17 nt, Salmonella enterica enterica serovar Typhi Ty2
aaaccugguauuacaac

SEQ ID NO: 3694937 - RNA, 15 nt, Salmonella enterica enterica serovar Typhi Ty2
aaaccuguuuguuua

SEQ ID NO: 3694938 - RNA, 17 nt, Salmonella enterica enterica serovar Typhi Ty2
aaaccuuccgccaggcg

SEQ ID NO: 3694939 - RNA, 13 nt, Salmonella enterica enterica serovar Typhi Ty2
aaaccuuucuucu

SEQ ID NO: 3694940 - RNA, 21 nt, Salmonella enterica enterica serovar Typhi Ty2
aaacgaaucaccucgcuuccc

SEQ ID NO: 3694941 - RNA, 15 nt, Salmonella enterica enterica serovar Typhi Ty2
aaacgacgcguuuca

SEQ ID NO: 3694942 - RNA, 15 nt, Salmonella enterica enterica serovar Typhi Ty2
aaacgacucaucagu

SEQ ID NO: 3694943 - RNA, 21 nt, Salmonella enterica enterica serovar Typhi Ty2
aaacgagucagcguuacuggc

SEQ ID NO: 3694944 - RNA, 20 nt, Salmonella enterica enterica serovar Typhi Ty2
aaacgaugaccauaaaugaa

SEQ ID NO: 3694945 - RNA, 22 nt, Salmonella enterica enterica serovar Typhi Ty2
aaacgcauaggggcgcaaagca

SEQ ID NO: 3694946 - RNA, 17 nt, Salmonella enterica enterica serovar Typhi Ty2
aaacgcaucccagguaa

SEQ ID NO: 3694947 - RNA, 21 nt, Salmonella enterica enterica serovar Typhi Ty2
aaacgcaucugggcugagaaa

SEQ ID NO: 3694948 - RNA, 15 nt, Salmonella enterica enterica serovar Typhi Ty2
aaacgccaagaauga

SEQ ID NO: 3694949 - RNA, 22 nt, Salmonella enterica enterica serovar Typhi Ty2
aaacgccaagaaugaaacaagc

SEQ ID NO: 3694950 - RNA, 18 nt, Salmonella enterica enterica serovar Typhi Ty2
aaacgccaggcgcugcgu

SEQ ID NO: 3694951 - RNA, 19 nt, Salmonella enterica enterica serovar Typhi Ty2
aaacgcccccagauagaac

SEQ ID NO: 3694952 - RNA, 22 nt, Salmonella enterica enterica serovar Typhi Ty2
aaacgcccgccgcgaccagcag

SEQ ID NO: 3694953 - RNA, 17 nt, Salmonella enterica enterica serovar Typhi Ty2
aaacgccugaauaaucg

SEQ ID NO: 3694954 - RNA, 23 nt, Salmonella enterica enterica serovar Typhi Ty2
aaacgccugcccgguuaaggggc

SEQ ID NO: 3694955 - RNA, 14 nt, Salmonella enterica enterica serovar Typhi Ty2
aaacgcgcaaaacu

SEQ ID NO: 3694956 - RNA, 17 nt, Salmonella enterica enterica serovar Typhi Ty2
aaacgcgcucgccagcg

SEQ ID NO: 3694957 - RNA, 20 nt, Salmonella enterica enterica serovar Typhi Ty2
aaacgcgucuucaucagcca

SEQ ID NO: 3694958 - RNA, 17 nt, Salmonella enterica enterica serovar Typhi Ty2
aaacgcuccggcaggca

SEQ ID NO: 3694959 - RNA, 12 nt, Salmonella enterica enterica serovar Typhi Ty2
aaacgcugcgcu

SEQ ID NO: 3694960 - RNA, 14 nt, Salmonella enterica enterica serovar Typhi Ty2
aaagcccgcccagc

SEQ ID NO: 3694961 - RNA, 16 nt, Salmonella enterica enterica serovar Typhi Ty2
aaagcccgcccagcau

SEQ ID NO: 3694962 - RNA, 17 nt, Salmonella enterica enterica serovar Typhi Ty2
aaagccgccauccggca

SEQ ID NO: 3694963 - RNA, 18 nt, Salmonella enterica enterica serovar Typhi Ty2
aaagccgccauccggcau

SEQ ID NO: 3694964 - RNA, 20 nt, Salmonella enterica enterica serovar Typhi Ty2
aaagccgccauccggcauuu

SEQ ID NO: 3694965 - RNA, 24 nt, Salmonella enterica enterica serovar Typhi Ty2
aaagccgcgucgcaccugcucuuu

SEQ ID NO: 3694966 - RNA, 17 nt, Salmonella enterica enterica serovar Typhi Ty2
aaagccggcggaaaaaa

SEQ ID NO: 3694967 - RNA, 18 nt, Salmonella enterica enterica serovar Typhi Ty2
aaagccgguuuucguuaa

SEQ ID NO: 3694968 - RNA, 13 nt, Salmonella enterica enterica serovar Typhi Ty2
aaagccgucggcg

SEQ ID NO: 3694969 - RNA, 23 nt, Salmonella enterica enterica serovar Typhi Ty2
aaagccgugaauaaaaccggcau

SEQ ID NO: 3694970 - RNA, 17 nt, Salmonella enterica enterica serovar Typhi Ty2
aaagccucuuuugcauu

SEQ ID NO: 3694971 - RNA, 20 nt, Salmonella enterica enterica serovar Typhi Ty2
aaagccugcacauugcaggc

SEQ ID NO: 3694972 - RNA, 19 nt, Salmonella enterica enterica serovar Typhi Ty2
aaagccuguuuaccaagca

SEQ ID NO: 3694973 - RNA, 13 nt, Salmonella enterica enterica serovar Typhi Ty2
aaagcgaauaauu

SEQ ID NO: 3694974 - RNA, 23 nt, Salmonella enterica enterica serovar Typhi Ty2
aaagcgaccggcacucaccucuu

SEQ ID NO: 3694975 - RNA, 20 nt, Salmonella enterica enterica serovar Typhi Ty2
aaagcgcuacagggcguuuu

SEQ ID NO: 3694976 - RNA, 22 nt, Salmonella enterica enterica serovar Typhi Ty2
aaagcggauaagauagcaggcg

SEQ ID NO: 3694977 - RNA, 21 nt, Salmonella enterica enterica serovar Typhi Ty2
aaagcggauggccugcucaau

SEQ ID NO: 3694978 - RNA, 15 nt, Salmonella enterica enterica serovar Typhi Ty2
aaagcggccuuuuuu

SEQ ID NO: 3694979 - RNA, 13 nt, Salmonella enterica enterica serovar Typhi Ty2
aaagcggcgaaua

SEQ ID NO: 3694980 - RNA, 14 nt, Salmonella enterica enterica serovar Typhi Ty2
aaagcggcuguagc

SEQ ID NO: 3694981 - RNA, 19 nt, Salmonella enterica enterica serovar Typhi Ty2
aaagcgucaguaaaagccc

SEQ ID NO: 3694982 - RNA, 17 nt, Salmonella enterica enterica serovar Typhi Ty2
aaagcguuggcgugcga

SEQ ID NO: 3694983 - RNA, 21 nt, Salmonella enterica enterica serovar Typhi Ty2
aaagcuccggacgcaccagcc

SEQ ID NO: 3694984 - RNA, 20 nt, Salmonella enterica enterica serovar Typhi Ty2
aaagcugcaccaggagcaaa

SEQ ID NO: 3694985 - RNA, 12 nt, Salmonella enterica enterica serovar Typhi Ty2
aaagcugccuuu

SEQ ID NO: 3694986 - RNA, 17 nt, Salmonella enterica enterica serovar Typhi Ty2
aaagcugcgaucaaguu

SEQ ID NO: 3694987 - RNA, 20 nt, Salmonella enterica enterica serovar Typhi Ty2
aaagcuggauaucacgcgcg

SEQ ID NO: 3694988 - RNA, 11 nt, Salmonella enterica enterica serovar Typhi Ty2
aaagcugguau

SEQ ID NO: 3694989 - RNA, 19 nt, Salmonella enterica enterica serovar Typhi Ty2
aaagcugguauugaauauu

SEQ ID NO: 3694990 - RNA, 20 nt, Salmonella enterica enterica serovar Typhi Ty2
aaagcuugaaagcagucccg

SEQ ID NO: 3694991 - RNA, 21 nt, Salmonella enterica enterica serovar Typhi Ty2
aaaggaaagauuacuucaggc

SEQ ID NO: 3694992 - RNA, 15 nt, Salmonella enterica enterica serovar Typhi Ty2
aaaggaaagggacga

SEQ ID NO: 3694993 - RNA, 18 nt, Salmonella enterica enterica serovar Typhi Ty2
aaaggaaugccugcgcuu

SEQ ID NO: 3694994 - RNA, 19 nt, Salmonella enterica enterica serovar Typhi Ty2
aaaggacguucuucuccca

SEQ ID NO: 3694995 - RNA, 12 nt, Salmonella enterica enterica serovar Typhi Ty2
aaaggaucgauu

SEQ ID NO: 3694996 - RNA, 17 nt, Salmonella enterica enterica serovar Typhi Ty2
aaaggcagacagagaaa

SEQ ID NO: 3694997 - RNA, 16 nt, Salmonella enterica enterica serovar Typhi Ty2
aaaggccuggcugaga

SEQ ID NO: 3694998 - RNA, 18 nt, Salmonella enterica enterica serovar Typhi Ty2
aaaggccuggcugagaaa

SEQ ID NO: 3694999 - RNA, 20 nt, Salmonella enterica enterica serovar Typhi Ty2
aaaggccuggcugagaaaaa

SEQ ID NO: 3695000 - RNA, 23 nt, Salmonella enterica enterica serovar Typhi Ty2
aaaggccuggcugagaaaaauac

SEQ ID NO: 3695001 - RNA, 19 nt, Salmonella enterica enterica serovar Typhi Ty2
aaaggcgcaacgucgccau

SEQ ID NO: 3695002 - RNA, 20 nt, Salmonella enterica enterica serovar Typhi Ty2
aaaggcgccgcuucccccgg

SEQ ID NO: 3695003 - RNA, 14 nt, Salmonella enterica enterica serovar Typhi Ty2
aaaggcuaccgguu

SEQ ID NO: 3695004 - RNA, 16 nt, Salmonella enterica enterica serovar Typhi Ty2
aaaggcuuuaaagcag

SEQ ID NO: 3695005 - RNA, 18 nt, Salmonella enterica enterica serovar Typhi Ty2
aaaggggagcccaguagc

SEQ ID NO: 3695006 - RNA, 21 nt, Salmonella enterica enterica serovar Typhi Ty2
aaaggggagggcaacaaacau

SEQ ID NO: 3695007 - RNA, 22 nt, Salmonella enterica enterica serovar Typhi Ty2
aaaggggagucgguacuccccu

SEQ ID NO: 3695008 - RNA, 20 nt, Salmonella enterica enterica serovar Typhi Ty2
aaaggggaucguguaacaau

SEQ ID NO: 3695009 - RNA, 21 nt, Salmonella enterica enterica serovar Typhi Ty2
aaaggggccacaggcggcaug

SEQ ID NO: 3695010 - RNA, 19 nt, Salmonella enterica enterica serovar Typhi Ty2
aaaggggggcuagcugugg

SEQ ID NO: 3695011 - RNA, 21 nt, Salmonella enterica enterica serovar Typhi Ty2
aaagguauuaagugaauagca

SEQ ID NO: 3695012 - RNA, 15 nt, Salmonella enterica enterica serovar Typhi Ty2
aaaggucgacauuua

SEQ ID NO: 3695013 - RNA, 22 nt, Salmonella enterica enterica serovar Typhi Ty2
aaaggucuuucuguguugcuca

SEQ ID NO: 3695014 - RNA, 17 nt, Salmonella enterica enterica serovar Typhi Ty2
aaaguaccaaaacagaa

SEQ ID NO: 3695015 - RNA, 17 nt, Salmonella enterica enterica serovar Typhi Ty2
aaaguacgcaaacaguu

SEQ ID NO: 3695016 - RNA, 16 nt, Salmonella enterica enterica serovar Typhi Ty2
aaaguacuucacaauc

SEQ ID NO: 3695017 - RNA, 19 nt, Salmonella enterica enterica serovar Typhi Ty2
aaaguaguuggugggugau

SEQ ID NO: 3695018 - RNA, 19 nt, Salmonella enterica enterica serovar Typhi Ty2
aaaguauaaagcugguuga

SEQ ID NO: 3695019 - RNA, 19 nt, Salmonella enterica enterica serovar Typhi Ty2
aaagucaacugcucuacca

SEQ ID NO: 3695020 - RNA, 20 nt, Salmonella enterica enterica serovar Typhi Ty2
aaagucacuuacuuucuugc

SEQ ID NO: 3695021 - RNA, 15 nt, Salmonella enterica enterica serovar Typhi Ty2
aaaguccugcgucgc

SEQ ID NO: 3695022 - RNA, 22 nt, Salmonella enterica enterica serovar Typhi Ty2
aaagucggggcguaaaaauuuu

SEQ ID NO: 3695023 - RNA, 18 nt, Salmonella enterica enterica serovar Typhi Ty2
aaagugaaggccagacuu

SEQ ID NO: 3695024 - RNA, 22 nt, Salmonella enterica enterica serovar Typhi Ty2
aaagugccagggcggaagcaga

SEQ ID NO: 3695025 - RNA, 23 nt, Salmonella enterica enterica serovar Typhi Ty2
aaagugccagggcggaagcagau

SEQ ID NO: 3695026 - RNA, 15 nt, Salmonella enterica enterica serovar Typhi Ty2
aaagugcugaacaau

SEQ ID NO: 3695027 - RNA, 19 nt, Salmonella enterica enterica serovar Typhi Ty2
aaaguggcauccgaagaac

SEQ ID NO: 3695028 - RNA, 15 nt, Salmonella enterica enterica serovar Typhi Ty2
aaaguggugggugau

SEQ ID NO: 3695029 - RNA, 18 nt, Salmonella enterica enterica serovar Typhi Ty2
aaaguguguaccagcagc

SEQ ID NO: 3695030 - RNA, 16 nt, Salmonella enterica enterica serovar Typhi Ty2
aaaguuacuuuccaua

SEQ ID NO: 3695031 - RNA, 13 nt, Salmonella enterica enterica serovar Typhi Ty2
aaaguuauucacg

SEQ ID NO: 3695032 - RNA, 15 nt, Salmonella enterica enterica serovar Typhi Ty2
aaaguuucaggauaa

SEQ ID NO: 3695033 - RNA, 12 nt, Salmonella enterica enterica serovar Typhi Ty2
aaaguuugaagu

SEQ ID NO: 3695034 - RNA, 13 nt, Salmonella enterica enterica serovar Typhi Ty2
aaaguuuuucaua

SEQ ID NO: 3695035 - RNA, 13 nt, Salmonella enterica enterica serovar Typhi Ty2
aaauaaaaaaacc

SEQ ID NO: 3695036 - RNA, 15 nt, Salmonella enterica enterica serovar Typhi Ty2
aaauaaaaaaggcag

SEQ ID NO: 3695037 - RNA, 13 nt, Salmonella enterica enterica serovar Typhi Ty2
aaauaaaaauucc

SEQ ID NO: 3695038 - RNA, 12 nt, Salmonella enterica enterica serovar Typhi Ty2
aaauaaaaccag

SEQ ID NO: 3695039 - RNA, 17 nt, Salmonella enterica enterica serovar Typhi Ty2
aaauaaaaggggccugc

SEQ ID NO: 3695040 - RNA, 16 nt, Salmonella enterica enterica serovar Typhi Ty2
aaauaaaauacuucca

SEQ ID NO: 3695041 - RNA, 12 nt, Salmonella enterica enterica serovar Typhi Ty2
aaauaaaauuau

SEQ ID NO: 3695042 - RNA, 13 nt, Salmonella enterica enterica serovar Typhi Ty2
aaaucaucaucag

SEQ ID NO: 3695043 - RNA, 16 nt, Salmonella enterica enterica serovar Typhi Ty2
aaaucauccugcggca

SEQ ID NO: 3695044 - RNA, 23 nt, Salmonella enterica enterica serovar Typhi Ty2
aaaucaucgcgcugauauuuuua

SEQ ID NO: 3695045 - RNA, 22 nt, Salmonella enterica enterica serovar Typhi Ty2
aaaucauuuguacaaaaaaugu

SEQ ID NO: 3695046 - RNA, 17 nt, Salmonella enterica enterica serovar Typhi Ty2
aaauccacaaccggcug

SEQ ID NO: 3695047 - RNA, 17 nt, Salmonella enterica enterica serovar Typhi Ty2
aaauccagggaaaccau

SEQ ID NO: 3695048 - RNA, 19 nt, Salmonella enterica enterica serovar Typhi Ty2
aaauccagggaaaccaugu

SEQ ID NO: 3695049 - RNA, 21 nt, Salmonella enterica enterica serovar Typhi Ty2
aaauccaucucaggccgacaa

SEQ ID NO: 3695050 - RNA, 20 nt, Salmonella enterica enterica serovar Typhi Ty2
aaauccccaccugacuauac

SEQ ID NO: 3695051 - RNA, 23 nt, Salmonella enterica enterica serovar Typhi Ty2
aaaucccccaacgucaccaucaa

SEQ ID NO: 3695052 - RNA, 17 nt, Salmonella enterica enterica serovar Typhi Ty2
aaaucccggcgauuaau

SEQ ID NO: 3695053 - RNA, 22 nt, Salmonella enterica enterica serovar Typhi Ty2
aaaucccggcgauuaauaaaau

SEQ ID NO: 3695054 - RNA, 21 nt, Salmonella enterica enterica serovar Typhi Ty2
aaauccgcgcucggucacuuc

SEQ ID NO: 3695055 - RNA, 22 nt, Salmonella enterica enterica serovar Typhi Ty2
aaauccgcgcucggucacuuca

SEQ ID NO: 3695056 - RNA, 20 nt, Salmonella enterica enterica serovar Typhi Ty2
aaauccuccauaaauaacau

SEQ ID NO: 3695057 - RNA, 18 nt, Salmonella enterica enterica serovar Typhi Ty2
aaauccucccaucgagcc

SEQ ID NO: 3695058 - RNA, 13 nt, Salmonella enterica enterica serovar Typhi Ty2
aaauccuccggcg

SEQ ID NO: 3695059 - RNA, 16 nt, Salmonella enterica enterica serovar Typhi Ty2
aaauccucuauuuuuu

SEQ ID NO: 3695060 - RNA, 16 nt, Salmonella enterica enterica serovar Typhi Ty2
aaauccugcacuucca

SEQ ID NO: 3695061 - RNA, 13 nt, Salmonella enterica enterica serovar Typhi Ty2
aaauccugcucca

SEQ ID NO: 3695062 - RNA, 23 nt, Salmonella enterica enterica serovar Typhi Ty2
aaauccuggauacguuccagcag

SEQ ID NO: 3695063 - RNA, 23 nt, Salmonella enterica enterica serovar Typhi Ty2
aaaucgaugaucgaggcgugcga

SEQ ID NO: 3695064 - RNA, 16 nt, Salmonella enterica enterica serovar Typhi Ty2
aaaucgcaaacgccag

SEQ ID NO: 3695065 - RNA, 23 nt, Salmonella enterica enterica serovar Typhi Ty2
aaaucgccaaagaaacgcugauc

SEQ ID NO: 3695066 - RNA, 12 nt, Salmonella enterica enterica serovar Typhi Ty2
aaaucgccauca

SEQ ID NO: 3695067 - RNA, 16 nt, Salmonella enterica enterica serovar Typhi Ty2
aaaucgcgcaaauauu

SEQ ID NO: 3695068 - RNA, 16 nt, Salmonella enterica enterica serovar Typhi Ty2
aaaucgcuaagcagaa

SEQ ID NO: 3695069 - RNA, 21 nt, Salmonella enterica enterica serovar Typhi Ty2
aaaucgcuauauugcugcgca

SEQ ID NO: 3695070 - RNA, 22 nt, Salmonella enterica enterica serovar Typhi Ty2
aaaucguauuggggaucgggca

SEQ ID NO: 3695071 - RNA, 15 nt, Salmonella enterica enterica serovar Typhi Ty2
aaaucgucaucagau

SEQ ID NO: 3695072 - RNA, 13 nt, Salmonella enterica enterica serovar Typhi Ty2
aaaucgucgccaa

SEQ ID NO: 3695073 - RNA, 14 nt, Salmonella enterica enterica serovar Typhi Ty2
aaaucguucgcgga

SEQ ID NO: 3695074 - RNA, 20 nt, Salmonella enterica enterica serovar Typhi Ty2
aaaucguuuucuaacgaggu

SEQ ID NO: 3695075 - RNA, 19 nt, Salmonella enterica enterica serovar Typhi Ty2
aaaucugccgucaucgacu

SEQ ID NO: 3695076 - RNA, 20 nt, Salmonella enterica enterica serovar Typhi Ty2
aaaucugccgucaucgacuu

SEQ ID NO: 3695077 - RNA, 20 nt, Salmonella enterica enterica serovar Typhi Ty2
aaaucuggugauaaagcaga

SEQ ID NO: 3695078 - RNA, 22 nt, Salmonella enterica enterica serovar Typhi Ty2
aaaucuguuaucuggauguaaa

SEQ ID NO: 3695079 - RNA, 13 nt, Salmonella enterica enterica serovar Typhi Ty2
aaaucuuccaguu

SEQ ID NO: 3695080 - RNA, 21 nt, Salmonella enterica enterica serovar Typhi Ty2
aaaucuucggcaaaauauuca

SEQ ID NO: 3695081 - RNA, 23 nt, Salmonella enterica enterica serovar Typhi Ty2
aaaucuuucuccugguuuuucca

SEQ ID NO: 3695082 - RNA, 14 nt, Salmonella enterica enterica serovar Typhi Ty2
aaaugaaaaagaua

SEQ ID NO: 3695083 - RNA, 18 nt, Salmonella enterica enterica serovar Typhi Ty2
aaaugaaaugcccauaaa

SEQ ID NO: 3695084 - RNA, 23 nt, Salmonella enterica enterica serovar Typhi Ty2
aaaugacgcccugcgccagcaug

SEQ ID NO: 3695085 - RNA, 16 nt, Salmonella enterica enterica serovar Typhi Ty2
aaaugacgccggguaa

SEQ ID NO: 3695086 - RNA, 13 nt, Salmonella enterica enterica serovar Typhi Ty2
aaaugacgccugu

SEQ ID NO: 3695087 - RNA, 13 nt, Salmonella enterica enterica serovar Typhi Ty2
aaaugaggugaaa

SEQ ID NO: 3695088 - RNA, 12 nt, Salmonella enterica enterica serovar Typhi Ty2
aaaugauauuua

SEQ ID NO: 3695089 - RNA, 12 nt, Salmonella enterica enterica serovar Typhi Ty2
aaaugaucguuu

SEQ ID NO: 3695090 - RNA, 19 nt, Salmonella enterica enterica serovar Typhi Ty2
aaaugaugacucauuaaaa

SEQ ID NO: 3695091 - RNA, 18 nt, Salmonella enterica enterica serovar Typhi Ty2
aaaugcccgucucauuuc

SEQ ID NO: 3695092 - RNA, 22 nt, Salmonella enterica enterica serovar Typhi Ty2
aaaugccugccguuuuuaacgc

SEQ ID NO: 3695093 - RNA, 21 nt, Salmonella enterica enterica serovar Typhi Ty2
aaaugccuguuuauauucugg

SEQ ID NO: 3695094 - RNA, 18 nt, Salmonella enterica enterica serovar Typhi Ty2
aaaugcgacaucucaggc

SEQ ID NO: 3695095 - RNA, 16 nt, Salmonella enterica enterica serovar Typhi Ty2
aaaugcgaugaacauc

SEQ ID NO: 3695096 - RNA, 11 nt, Salmonella enterica enterica serovar Typhi Ty2
aaaugcgcaug

SEQ ID NO: 3695097 - RNA, 16 nt, Salmonella enterica enterica serovar Typhi Ty2
aaaugcgcuuugauag

SEQ ID NO: 3695098 - RNA, 22 nt, Salmonella enterica enterica serovar Typhi Ty2
aaaugcucaauuauacgcuggu

SEQ ID NO: 3695099 - RNA, 13 nt, Salmonella enterica enterica serovar Typhi Ty2
aaaugcugggcuu

SEQ ID NO: 3695100 - RNA, 22 nt, Salmonella enterica enterica serovar Typhi Ty2
aaauggaaaauaauaaucguuu

SEQ ID NO: 3695101 - RNA, 17 nt, Salmonella enterica enterica serovar Typhi Ty2
aaauggagcgagcuggu

SEQ ID NO: 3695102 - RNA, 21 nt, Salmonella enterica enterica serovar Typhi Ty2
aaauggcaaguaaaauagccc

SEQ ID NO: 3695103 - RNA, 18 nt, Salmonella enterica enterica serovar Typhi Ty2
aaauggccccaaaucaga

SEQ ID NO: 3695104 - RNA, 17 nt, Salmonella enterica enterica serovar Typhi Ty2
aaauggccgucgccaca

SEQ ID NO: 3695105 - RNA, 16 nt, Salmonella enterica enterica serovar Typhi Ty2
aaauggguaucgccuu

SEQ ID NO: 3695106 - RNA, 14 nt, Salmonella enterica enterica serovar Typhi Ty2
aaaugguuuugccc

SEQ ID NO: 3695107 - RNA, 17 nt, Salmonella enterica enterica serovar Typhi Ty2
aaaugguuuugcccauu

SEQ ID NO: 3695108 - RNA, 17 nt, Salmonella enterica enterica serovar Typhi Ty2
aaauguaggccggauaa

SEQ ID NO: 3695109 - RNA, 17 nt, Salmonella enterica enterica serovar Typhi Ty2
aaaugucaggaucagau

SEQ ID NO: 3695110 - RNA, 19 nt, Salmonella enterica enterica serovar Typhi Ty2
aaauguuguuugaaaagug

SEQ ID NO: 3695111 - RNA, 21 nt, Salmonella enterica enterica serovar Typhi Ty2
aaauguuguuugaaaagugaa

SEQ ID NO: 3695112 - RNA, 12 nt, Salmonella enterica enterica serovar Typhi Ty2
aaauguuuuugu

SEQ ID NO: 3695113 - RNA, 15 nt, Salmonella enterica enterica serovar Typhi Ty2
aaauuaaauccugaa

SEQ ID NO: 3695114 - RNA, 14 nt, Salmonella enterica enterica serovar Typhi Ty2
aaauuaagaaagua

SEQ ID NO: 3695115 - RNA, 12 nt, Salmonella enterica enterica serovar Typhi Ty2
aaauuaaucagg

SEQ ID NO: 3695116 - RNA, 13 nt, Salmonella enterica enterica serovar Typhi Ty2
aaauuaaucgcca

SEQ ID NO: 3695117 - RNA, 18 nt, Salmonella enterica enterica serovar Typhi Ty2
aaauuaaucgccagcagc

SEQ ID NO: 3695118 - RNA, 15 nt, Salmonella enterica enterica serovar Typhi Ty2
aaauuaaugauuaaa

SEQ ID NO: 3695119 - RNA, 20 nt, Salmonella enterica enterica serovar Typhi Ty2
aaauuaaugauuaaaauaaa

SEQ ID NO: 3695120 - RNA, 20 nt, Salmonella enterica enterica serovar Typhi Ty2
aaauuaucuguugauaaaac

SEQ ID NO: 3695121 - RNA, 19 nt, Salmonella enterica enterica serovar Typhi Ty2
aaauuaugggauugcaaaa

SEQ ID NO: 3695122 - RNA, 23 nt, Salmonella enterica enterica serovar Typhi Ty2
aaauuauuccuugaucaggaaau

SEQ ID NO: 3695123 - RNA, 18 nt, Salmonella enterica enterica serovar Typhi Ty2
aaauuauuggcuuuguaa

SEQ ID NO: 3695124 - RNA, 22 nt, Salmonella enterica enterica serovar Typhi Ty2
aacacuauauguccuuuacugc

SEQ ID NO: 3695125 - RNA, 20 nt, Salmonella enterica enterica serovar Typhi Ty2
aacacucacaaaacuauuuu

SEQ ID NO: 3695126 - RNA, 12 nt, Salmonella enterica enterica serovar Typhi Ty2
aacacuuugcgc

SEQ ID NO: 3695127 - RNA, 17 nt, Salmonella enterica enterica serovar Typhi Ty2
aacagaaaaaaugcacc

SEQ ID NO: 3695128 - RNA, 21 nt, Salmonella enterica enterica serovar Typhi Ty2
aacagaaaaaaugcaccgccu

SEQ ID NO: 3695129 - RNA, 18 nt, Salmonella enterica enterica serovar Typhi Ty2
aacagaaaagaucgcugc

SEQ ID NO: 3695130 - RNA, 21 nt, Salmonella enterica enterica serovar Typhi Ty2
aacagaaaccauaaacaaaac

SEQ ID NO: 3695131 - RNA, 23 nt, Salmonella enterica enterica serovar Typhi Ty2
aacagaaaccauaaacaaaacaa

SEQ ID NO: 3695132 - RNA, 17 nt, Salmonella enterica enterica serovar Typhi Ty2
aacagaauuaacgcaga

SEQ ID NO: 3695133 - RNA, 17 nt, Salmonella enterica enterica serovar Typhi Ty2
aacagaauuaccugggu

SEQ ID NO: 3695134 - RNA, 17 nt, Salmonella enterica enterica serovar Typhi Ty2
aacagacgccuuucaga

SEQ ID NO: 3695135 - RNA, 13 nt, Salmonella enterica enterica serovar Typhi Ty2
aacagacuccguc

SEQ ID NO: 3695136 - RNA, 19 nt, Salmonella enterica enterica serovar Typhi Ty2
aacagagagggaaaaaaau

SEQ ID NO: 3695137 - RNA, 22 nt, Salmonella enterica enterica serovar Typhi Ty2
aacagagagggaaaaaaauccu

SEQ ID NO: 3695138 - RNA, 13 nt, Salmonella enterica enterica serovar Typhi Ty2
aacagaguaaccc

SEQ ID NO: 3695139 - RNA, 15 nt, Salmonella enterica enterica serovar Typhi Ty2
aacagaguaacccga

SEQ ID NO: 3695140 - RNA, 13 nt, Salmonella enterica enterica serovar Typhi Ty2
aacagauaaaugu

SEQ ID NO: 3695141 - RNA, 13 nt, Salmonella enterica enterica serovar Typhi Ty2
aacagauacugga

SEQ ID NO: 3695142 - RNA, 20 nt, Salmonella enterica enterica serovar Typhi Ty2
aacagcaaaucgggaaaaug

SEQ ID NO: 3695143 - RNA, 12 nt, Salmonella enterica enterica serovar Typhi Ty2
aacagcaaugcc

SEQ ID NO: 3695144 - RNA, 14 nt, Salmonella enterica enterica serovar Typhi Ty2
aacagcaccagcag

SEQ ID NO: 3695145 - RNA, 15 nt, Salmonella enterica enterica serovar Typhi Ty2
aacagcaccagcagg

SEQ ID NO: 3695146 - RNA, 12 nt, Salmonella enterica enterica serovar Typhi Ty2
aacagcaggacc

SEQ ID NO: 3695147 - RNA, 13 nt, Salmonella enterica enterica serovar Typhi Ty2
aacagcaggaccc

SEQ ID NO: 3695148 - RNA, 19 nt, Salmonella enterica enterica serovar Typhi Ty2
aacagcauaaacguuacca

SEQ ID NO: 3695149 - RNA, 21 nt, Salmonella enterica enterica serovar Typhi Ty2
aacagcauaaacguuaccaua

SEQ ID NO: 3695150 - RNA, 13 nt, Salmonella enterica enterica serovar Typhi Ty2
aacagccagaagc

SEQ ID NO: 3695151 - RNA, 14 nt, Salmonella enterica enterica serovar Typhi Ty2
aacagccagaagcc

SEQ ID NO: 3695152 - RNA, 16 nt, Salmonella enterica enterica serovar Typhi Ty2
aacagcgccaucagga

SEQ ID NO: 3695153 - RNA, 15 nt, Salmonella enterica enterica serovar Typhi Ty2
aacagcgccgcgaau

SEQ ID NO: 3695154 - RNA, 15 nt, Salmonella enterica enterica serovar Typhi Ty2
aacagcgccggcagc

SEQ ID NO: 3695155 - RNA, 17 nt, Salmonella enterica enterica serovar Typhi Ty2
aacagcgccggcagcag

SEQ ID NO: 3695156 - RNA, 16 nt, Salmonella enterica enterica serovar Typhi Ty2
aacagcggcaggcgga

SEQ ID NO: 3695157 - RNA, 21 nt, Salmonella enterica enterica serovar Typhi Ty2
aacagcguaccuuuaucuuga

SEQ ID NO: 3695158 - RNA, 20 nt, Salmonella enterica enterica serovar Typhi Ty2
aacagcgucauccaguguua

SEQ ID NO: 3695159 - RNA, 22 nt, Salmonella enterica enterica serovar Typhi Ty2
aacagcgugaacacgccccaca

SEQ ID NO: 3695160 - RNA, 22 nt, Salmonella enterica enterica serovar Typhi Ty2
aacagcuuaccccuguccuuuc

SEQ ID NO: 3695161 - RNA, 14 nt, Salmonella enterica enterica serovar Typhi Ty2
aacagcuugaucau

SEQ ID NO: 3695162 - RNA, 20 nt, Salmonella enterica enterica serovar Typhi Ty2
aacaggccaaacccugcgcc

SEQ ID NO: 3695163 - RNA, 19 nt, Salmonella enterica enterica serovar Typhi Ty2
aacaggcgcaggcauuaaa

SEQ ID NO: 3695164 - RNA, 21 nt, Salmonella enterica enterica serovar Typhi Ty2
aacaggcugaacccugccugc

SEQ ID NO: 3695165 - RNA, 18 nt, Salmonella enterica enterica serovar Typhi Ty2
aacagggggcgcaucacu

SEQ ID NO: 3695166 - RNA, 16 nt, Salmonella enterica enterica serovar Typhi Ty2
aacagggguuccggca

SEQ ID NO: 3695167 - RNA, 23 nt, Salmonella enterica enterica serovar Typhi Ty2
aacagggugauggugucaaucgc

SEQ ID NO: 3695168 - RNA, 18 nt, Salmonella enterica enterica serovar Typhi Ty2
aacaggguuucucgggag

SEQ ID NO: 3695169 - RNA, 16 nt, Salmonella enterica enterica serovar Typhi Ty2
aacagguuaaucagca

SEQ ID NO: 3695170 - RNA, 19 nt, Salmonella enterica enterica serovar Typhi Ty2
aacagguuaaucagcacau

SEQ ID NO: 3695171 - RNA, 17 nt, Salmonella enterica enterica serovar Typhi Ty2
aacagguugcguaacgc

SEQ ID NO: 3695172 - RNA, 13 nt, Salmonella enterica enterica serovar Typhi Ty2
aacaguaaucgca

SEQ ID NO: 3695173 - RNA, 18 nt, Salmonella enterica enterica serovar Typhi Ty2
aacaguaccugauaaaau

SEQ ID NO: 3695174 - RNA, 15 nt, Salmonella enterica enterica serovar Typhi Ty2
aacaguacggucagg

SEQ ID NO: 3695175 - RNA, 14 nt, Salmonella enterica enterica serovar Typhi Ty2
aacaguacuggucg

SEQ ID NO: 3695176 - RNA, 23 nt, Salmonella enterica enterica serovar Typhi Ty2
aacagucccaccagcgcggcaca

SEQ ID NO: 3695177 - RNA, 23 nt, Salmonella enterica enterica serovar Typhi Ty2
aacagugauuacaaaaugugcaa

SEQ ID NO: 3695178 - RNA, 19 nt, Salmonella enterica enterica serovar Typhi Ty2
aacagugggcuaugaagag

SEQ ID NO: 3695179 - RNA, 17 nt, Salmonella enterica enterica serovar Typhi Ty2
aacaguguaaacgccag

SEQ ID NO: 3695180 - RNA, 21 nt, Salmonella enterica enterica serovar Typhi Ty2
aacaguguaaacgccagauaa

SEQ ID NO: 3695181 - RNA, 13 nt, Salmonella enterica enterica serovar Typhi Ty2
aacaguucagaca

SEQ ID NO: 3695182 - RNA, 23 nt, Salmonella enterica enterica serovar Typhi Ty2
aacauacgggcaugaagaaaaua

SEQ ID NO: 3695183 - RNA, 13 nt, Salmonella enterica enterica serovar Typhi Ty2
aacauagauaacu

SEQ ID NO: 3695184 - RNA, 18 nt, Salmonella enterica enterica serovar Typhi Ty2
aacauagcggcaaggaaa

SEQ ID NO: 3695185 - RNA, 19 nt, Salmonella enterica enterica serovar Typhi Ty2
aacauagcggcaaggaaaa

SEQ ID NO: 3695186 - RNA, 23 nt, Salmonella enterica enterica serovar Typhi Ty2
aacauagcggcaaggaaaaccag

SEQ ID NO: 3695187 - RNA, 20 nt, Salmonella enterica enterica serovar Typhi Ty2
aacauauagcagcagucucu

SEQ ID NO: 3695188 - RNA, 12 nt, Salmonella enterica enterica serovar Typhi Ty2
aacauauuuuua

SEQ ID NO: 3695189 - RNA, 15 nt, Salmonella enterica enterica serovar Typhi Ty2
aacauauuuuucaca

SEQ ID NO: 3695190 - RNA, 15 nt, Salmonella enterica enterica serovar Typhi Ty2
aacaucaaguacagc

SEQ ID NO: 3695191 - RNA, 22 nt, Salmonella enterica enterica serovar Typhi Ty2
aacaucagaaaaaagccaagca

SEQ ID NO: 3695192 - RNA, 22 nt, Salmonella enterica enterica serovar Typhi Ty2
aacaucagcccuaucgcugcgc

SEQ ID NO: 3695193 - RNA, 23 nt, Salmonella enterica enterica serovar Typhi Ty2
aacaucagcccuaucgcugcgcu

SEQ ID NO: 3695194 - RNA, 12 nt, Salmonella enterica enterica serovar Typhi Ty2
aacaucauaaua

SEQ ID NO: 3695195 - RNA, 20 nt, Salmonella enterica enterica serovar Typhi Ty2
aacaucauccggcugcgucg

SEQ ID NO: 3695196 - RNA, 13 nt, Salmonella enterica enterica serovar Typhi Ty2
aacaucaucguuu

SEQ ID NO: 3695197 - RNA, 24 nt, Salmonella enterica enterica serovar Typhi Ty2
aacaucauggcuuaaaacgauuug

SEQ ID NO: 3695198 - RNA, 18 nt, Salmonella enterica enterica serovar Typhi Ty2
aacaucauuauuccccuc

SEQ ID NO: 3695199 - RNA, 22 nt, Salmonella enterica enterica serovar Typhi Ty2
aacaucauucccguaucuucau

SEQ ID NO: 3695200 - RNA, 14 nt, Salmonella enterica enterica serovar Typhi Ty2
aacauccucuccug

SEQ ID NO: 3695201 - RNA, 15 nt, Salmonella enterica enterica serovar Typhi Ty2
aacaucgcuccggca

SEQ ID NO: 3695202 - RNA, 15 nt, Salmonella enterica enterica serovar Typhi Ty2
aacaucguaaaucaa

SEQ ID NO: 3695203 - RNA, 19 nt, Salmonella enterica enterica serovar Typhi Ty2
aacaucguaaaucaaauga

SEQ ID NO: 3695204 - RNA, 20 nt, Salmonella enterica enterica serovar Typhi Ty2
aacaucguguccuggguaac

SEQ ID NO: 3695205 - RNA, 18 nt, Salmonella enterica enterica serovar Typhi Ty2
aacaucuuccaugccuuc

SEQ ID NO: 3695206 - RNA, 23 nt, Salmonella enterica enterica serovar Typhi Ty2
aaccgacugucgaaaccagcaua

SEQ ID NO: 3695207 - RNA, 17 nt, Salmonella enterica enterica serovar Typhi Ty2
aaccgagcauccgcgca

SEQ ID NO: 3695208 - RNA, 19 nt, Salmonella enterica enterica serovar Typhi Ty2
aaccgagguucaccagcgc

SEQ ID NO: 3695209 - RNA, 14 nt, Salmonella enterica enterica serovar Typhi Ty2
aaccgcaaaugcca

SEQ ID NO: 3695210 - RNA, 18 nt, Salmonella enterica enterica serovar Typhi Ty2
aaccgcccgcggcgauca

SEQ ID NO: 3695211 - RNA, 19 nt, Salmonella enterica enterica serovar Typhi Ty2
aaccgcgccaaagauaaga

SEQ ID NO: 3695212 - RNA, 16 nt, Salmonella enterica enterica serovar Typhi Ty2
aaccgcgccggaugac

SEQ ID NO: 3695213 - RNA, 22 nt, Salmonella enterica enterica serovar Typhi Ty2
aaccgcgcggcguucugcgcca

SEQ ID NO: 3695214 - RNA, 19 nt, Salmonella enterica enterica serovar Typhi Ty2
aaccgcuuuuccugcugcc

SEQ ID NO: 3695215 - RNA, 19 nt, Salmonella enterica enterica serovar Typhi Ty2
aaccggaccagcacaaaaa

SEQ ID NO: 3695216 - RNA, 14 nt, Salmonella enterica enterica serovar Typhi Ty2
aaccggcaacucgc

SEQ ID NO: 3695217 - RNA, 18 nt, Salmonella enterica enterica serovar Typhi Ty2
aaccggcaacucgccggu

SEQ ID NO: 3695218 - RNA, 14 nt, Salmonella enterica enterica serovar Typhi Ty2
aaccggcagaccgg

SEQ ID NO: 3695219 - RNA, 22 nt, Salmonella enterica enterica serovar Typhi Ty2
aaccggcccagcuuaguaaccc

SEQ ID NO: 3695220 - RNA, 21 nt, Salmonella enterica enterica serovar Typhi Ty2
aaccggcgcgccuuccagcaa

SEQ ID NO: 3695221 - RNA, 23 nt, Salmonella enterica enterica serovar Typhi Ty2
aaccggcguuccgcccaggcggg

SEQ ID NO: 3695222 - RNA, 15 nt, Salmonella enterica enterica serovar Typhi Ty2
aaccggcugccagcg

SEQ ID NO: 3695223 - RNA, 22 nt, Salmonella enterica enterica serovar Typhi Ty2
aaccggucucuuaaugccagcg

SEQ ID NO: 3695224 - RNA, 22 nt, Salmonella enterica enterica serovar Typhi Ty2
aaccgguggucaucgcggccag

SEQ ID NO: 3695225 - RNA, 22 nt, Salmonella enterica enterica serovar Typhi Ty2
aaccgguuugucauucgccuca

SEQ ID NO: 3695226 - RNA, 18 nt, Salmonella enterica enterica serovar Typhi Ty2
aaccguaaacgccugcac

SEQ ID NO: 3695227 - RNA, 17 nt, Salmonella enterica enterica serovar Typhi Ty2
aaccguagauuuucauc

SEQ ID NO: 3695228 - RNA, 14 nt, Salmonella enterica enterica serovar Typhi Ty2
aaccgucaucagcc

SEQ ID NO: 3695229 - RNA, 14 nt, Salmonella enterica enterica serovar Typhi Ty2
aaccguccacaucc

SEQ ID NO: 3695230 - RNA, 15 nt, Salmonella enterica enterica serovar Typhi Ty2
aaccguccacaucca

SEQ ID NO: 3695231 - RNA, 21 nt, Salmonella enterica enterica serovar Typhi Ty2
aaccguccacauccagcgcca

SEQ ID NO: 3695232 - RNA, 13 nt, Salmonella enterica enterica serovar Typhi Ty2
aaccgucggcaau

SEQ ID NO: 3695233 - RNA, 20 nt, Salmonella enterica enterica serovar Typhi Ty2
aaccgucggcgccggcgucg

SEQ ID NO: 3695234 - RNA, 22 nt, Salmonella enterica enterica serovar Typhi Ty2
aaccgucgggcgucgccugcca

SEQ ID NO: 3695235 - RNA, 13 nt, Salmonella enterica enterica serovar Typhi Ty2
aaccgucucacca

SEQ ID NO: 3695236 - RNA, 18 nt, Salmonella enterica enterica serovar Typhi Ty2
aaccgucucaccaggcgu

SEQ ID NO: 3695237 - RNA, 17 nt, Salmonella enterica enterica serovar Typhi Ty2
aaccgucuggcugccau

SEQ ID NO: 3695238 - RNA, 17 nt, Salmonella enterica enterica serovar Typhi Ty2
aaccguggcaccccucu

SEQ ID NO: 3695239 - RNA, 17 nt, Salmonella enterica enterica serovar Typhi Ty2
aaccguggccuccggca

SEQ ID NO: 3695240 - RNA, 22 nt, Salmonella enterica enterica serovar Typhi Ty2
aaccguucaucuaucgccagcg

SEQ ID NO: 3695241 - RNA, 16 nt, Salmonella enterica enterica serovar Typhi Ty2
aaccguuggggaaaau

SEQ ID NO: 3695242 - RNA, 17 nt, Salmonella enterica enterica serovar Typhi Ty2
aaccguuggggaaaaua

SEQ ID NO: 3695243 - RNA, 13 nt, Salmonella enterica enterica serovar Typhi Ty2
aaccuaucaggcg

SEQ ID NO: 3695244 - RNA, 14 nt, Salmonella enterica enterica serovar Typhi Ty2
aaccuauuuuacaa

SEQ ID NO: 3695245 - RNA, 19 nt, Salmonella enterica enterica serovar Typhi Ty2
aaccucaauagguguaucc

SEQ ID NO: 3695246 - RNA, 18 nt, Salmonella enterica enterica serovar Typhi Ty2
aaccucacguacuacgug

SEQ ID NO: 3695247 - RNA, 19 nt, Salmonella enterica enterica serovar Typhi Ty2
aaccucaucccggcuuaaa

SEQ ID NO: 3695248 - RNA, 22 nt, Salmonella enterica enterica serovar Typhi Ty2
aaccuccugcaaucguucuugc

SEQ ID NO: 3695249 - RNA, 17 nt, Salmonella enterica enterica serovar Typhi Ty2
aaccucuauaguaaauu

SEQ ID NO: 3695250 - RNA, 14 nt, Salmonella enterica enterica serovar Typhi Ty2
aaccugagaauauu

SEQ ID NO: 3695251 - RNA, 21 nt, Salmonella enterica enterica serovar Typhi Ty2
aaccugagcgcgaacgcucca

SEQ ID NO: 3695252 - RNA, 13 nt, Salmonella enterica enterica serovar Typhi Ty2
aaccugcgaaaag

SEQ ID NO: 3695253 - RNA, 12 nt, Salmonella enterica enterica serovar Typhi Ty2
aaccugcgauac

SEQ ID NO: 3695254 - RNA, 21 nt, Salmonella enterica enterica serovar Typhi Ty2
aaccugcguuacggucgauuu

SEQ ID NO: 3695255 - RNA, 21 nt, Salmonella enterica enterica serovar Typhi Ty2
aaccuggcagaaaggugaaaa

SEQ ID NO: 3695256 - RNA, 13 nt, Salmonella enterica enterica serovar Typhi Ty2
aaccuguccuuua

SEQ ID NO: 3695257 - RNA, 14 nt, Salmonella enterica enterica serovar Typhi Ty2
aaccuuacggcuca

SEQ ID NO: 3695258 - RNA, 17 nt, Salmonella enterica enterica serovar Typhi Ty2
aaccuucaagaaucaau

SEQ ID NO: 3695259 - RNA, 20 nt, Salmonella enterica enterica serovar Typhi Ty2
aaccuucaagaaucaauaua

SEQ ID NO: 3695260 - RNA, 15 nt, Salmonella enterica enterica serovar Typhi Ty2
aaccuucauaaauac

SEQ ID NO: 3695261 - RNA, 17 nt, Salmonella enterica enterica serovar Typhi Ty2
aaccuucauaaauacgu

SEQ ID NO: 3695262 - RNA, 14 nt, Salmonella enterica enterica serovar Typhi Ty2
aaccuuccgccagg

SEQ ID NO: 3695263 - RNA, 18 nt, Salmonella enterica enterica serovar Typhi Ty2
aaccuuccgccaggcggg

SEQ ID NO: 3695264 - RNA, 20 nt, Salmonella enterica enterica serovar Typhi Ty2
aacgaaagcucaggcgggga

SEQ ID NO: 3695265 - RNA, 20 nt, Salmonella enterica enterica serovar Typhi Ty2
aacgaacgcggaucagacgg

SEQ ID NO: 3695266 - RNA, 19 nt, Salmonella enterica enterica serovar Typhi Ty2
aacgaacugauguuccggc

SEQ ID NO: 3695267 - RNA, 19 nt, Salmonella enterica enterica serovar Typhi Ty2
aacgaaucaccucgcuucc

SEQ ID NO: 3695268 - RNA, 14 nt, Salmonella enterica enterica serovar Typhi Ty2
aacgaccagaauca

SEQ ID NO: 3695269 - RNA, 14 nt, Salmonella enterica enterica serovar Typhi Ty2
aacgaccagauacu

SEQ ID NO: 3695270 - RNA, 22 nt, Salmonella enterica enterica serovar Typhi Ty2
aacgacgacgcagcuucgccgc

SEQ ID NO: 3695271 - RNA, 17 nt, Salmonella enterica enterica serovar Typhi Ty2
aacgacgcauaaaaaau

SEQ ID NO: 3695272 - RNA, 15 nt, Salmonella enterica enterica serovar Typhi Ty2
aacgacucggcgauc

SEQ ID NO: 3695273 - RNA, 17 nt, Salmonella enterica enterica serovar Typhi Ty2
aacgaggccaccaucac

SEQ ID NO: 3695274 - RNA, 21 nt, Salmonella enterica enterica serovar Typhi Ty2
aacgaguugcggcaacgugaa

SEQ ID NO: 3695275 - RNA, 20 nt, Salmonella enterica enterica serovar Typhi Ty2
aacgauaauaucgucaccag

SEQ ID NO: 3695276 - RNA, 16 nt, Salmonella enterica enterica serovar Typhi Ty2
aacgauaauucgccgg

SEQ ID NO: 3695277 - RNA, 14 nt, Salmonella enterica enterica serovar Typhi Ty2
aacgaucauugacg

SEQ ID NO: 3695278 - RNA, 18 nt, Salmonella enterica enterica serovar Typhi Ty2
aacgaucccuaauaaaau

SEQ ID NO: 3695279 - RNA, 17 nt, Salmonella enterica enterica serovar Typhi Ty2
aacgaugaugaaaaaga

SEQ ID NO: 3695280 - RNA, 20 nt, Salmonella enterica enterica serovar Typhi Ty2
aacgaugaugaaaaagaaug

SEQ ID NO: 3695281 - RNA, 18 nt, Salmonella enterica enterica serovar Typhi Ty2
aacgaugauuauuguuaa

SEQ ID NO: 3695282 - RNA, 15 nt, Salmonella enterica enterica serovar Typhi Ty2
aacgcaaagacaccc

SEQ ID NO: 3695283 - RNA, 18 nt, Salmonella enterica enterica serovar Typhi Ty2
aacgcacgcagccaacgc

SEQ ID NO: 3695284 - RNA, 14 nt, Salmonella enterica enterica serovar Typhi Ty2
aacgcacuaccaga

SEQ ID NO: 3695285 - RNA, 16 nt, Salmonella enterica enterica serovar Typhi Ty2
aacgcacuuuuccagc

SEQ ID NO: 3695286 - RNA, 14 nt, Salmonella enterica enterica serovar Typhi Ty2
aacgcagcaucgcc

SEQ ID NO: 3695287 - RNA, 22 nt, Salmonella enterica enterica serovar Typhi Ty2
aacgcaggcgaaaucaaaaggc

SEQ ID NO: 3695288 - RNA, 21 nt, Salmonella enterica enterica serovar Typhi Ty2
aacgcaggcgauagccccagu

SEQ ID NO: 3695289 - RNA, 13 nt, Salmonella enterica enterica serovar Typhi Ty2
aacgcaucacaug

SEQ ID NO: 3695290 - RNA, 14 nt, Salmonella enterica enterica serovar Typhi Ty2
aacgcauccagcgc

SEQ ID NO: 3695291 - RNA, 15 nt, Salmonella enterica enterica serovar Typhi Ty2
aacgcauccagcgca

SEQ ID NO: 3695292 - RNA, 21 nt, Salmonella enterica enterica serovar Typhi Ty2
aacgcauccagcgucacaggc

SEQ ID NO: 3695293 - RNA, 21 nt, Salmonella enterica enterica serovar Typhi Ty2
aacgcaucgcggauggcggca

SEQ ID NO: 3695294 - RNA, 20 nt, Salmonella enterica enterica serovar Typhi Ty2
aacgcaucugggcugagaaa

SEQ ID NO: 3695295 - RNA, 11 nt, Salmonella enterica enterica serovar Typhi Ty2
aacgcauucac

SEQ ID NO: 3695296 - RNA, 23 nt, Salmonella enterica enterica serovar Typhi Ty2
aacgccaaaguuuuuaaacaaca

SEQ ID NO: 3695297 - RNA, 16 nt, Salmonella enterica enterica serovar Typhi Ty2
aacgccaagcgcggca

SEQ ID NO: 3695298 - RNA, 21 nt, Salmonella enterica enterica serovar Typhi Ty2
aacgccaagcgcggcagcagc

SEQ ID NO: 3695299 - RNA, 23 nt, Salmonella enterica enterica serovar Typhi Ty2
aacgccaagcgcggcagcagcuu

SEQ ID NO: 3695300 - RNA, 14 nt, Salmonella enterica enterica serovar Typhi Ty2
aacgccacugccau

SEQ ID NO: 3695301 - RNA, 22 nt, Salmonella enterica enterica serovar Typhi Ty2
aacgccaggccguugugucccu

SEQ ID NO: 3695302 - RNA, 17 nt, Salmonella enterica enterica serovar Typhi Ty2
aacgccauugcgaacau

SEQ ID NO: 3695303 - RNA, 18 nt, Salmonella enterica enterica serovar Typhi Ty2
aacgcccccugccagcgc

SEQ ID NO: 3695304 - RNA, 22 nt, Salmonella enterica enterica serovar Typhi Ty2
aacgcccgccgcgaccagcagc

SEQ ID NO: 3695305 - RNA, 16 nt, Salmonella enterica enterica serovar Typhi Ty2
aacgccgaagccagcg

SEQ ID NO: 3695306 - RNA, 21 nt, Salmonella enterica enterica serovar Typhi Ty2
aacgccgaccacuucaacgcc

SEQ ID NO: 3695307 - RNA, 13 nt, Salmonella enterica enterica serovar Typhi Ty2
aacgccgccgcaa

SEQ ID NO: 3695308 - RNA, 23 nt, Salmonella enterica enterica serovar Typhi Ty2
aacgccgcgcaaagcaauaccac

SEQ ID NO: 3695309 - RNA, 16 nt, Salmonella enterica enterica serovar Typhi Ty2
aacgccgcgcguaaau

SEQ ID NO: 3695310 - RNA, 14 nt, Salmonella enterica enterica serovar Typhi Ty2
aacgccgcguucgc

SEQ ID NO: 3695311 - RNA, 15 nt, Salmonella enterica enterica serovar Typhi Ty2
aacgccgggccugcc

SEQ ID NO: 3695312 - RNA, 17 nt, Salmonella enterica enterica serovar Typhi Ty2
aacgccgguacgcagca

SEQ ID NO: 3695313 - RNA, 19 nt, Salmonella enterica enterica serovar Typhi Ty2
aacgccguacuccagccca

SEQ ID NO: 3695314 - RNA, 22 nt, Salmonella enterica enterica serovar Typhi Ty2
aacgccguacuccagcccauca

SEQ ID NO: 3695315 - RNA, 22 nt, Salmonella enterica enterica serovar Typhi Ty2
aacgccgucacaaagcccaccg

SEQ ID NO: 3695316 - RNA, 13 nt, Salmonella enterica enterica serovar Typhi Ty2
aacgccuccaccg

SEQ ID NO: 3695317 - RNA, 22 nt, Salmonella enterica enterica serovar Typhi Ty2
aacgccuccugccgaugccgcc

SEQ ID NO: 3695318 - RNA, 16 nt, Salmonella enterica enterica serovar Typhi Ty2
aacgccugauccggcc

SEQ ID NO: 3695319 - RNA, 18 nt, Salmonella enterica enterica serovar Typhi Ty2
aacgccugaugcugcgca

SEQ ID NO: 3695320 - RNA, 13 nt, Salmonella enterica enterica serovar Typhi Ty2
aacgccugcacca

SEQ ID NO: 3695321 - RNA, 20 nt, Salmonella enterica enterica serovar Typhi Ty2
aacgccugcuccguccacgc

SEQ ID NO: 3695322 - RNA, 12 nt, Salmonella enterica enterica serovar Typhi Ty2
aacgccuggcgc

SEQ ID NO: 3695323 - RNA, 15 nt, Salmonella enterica enterica serovar Typhi Ty2
aacgcgaaauaauca

SEQ ID NO: 3695324 - RNA, 13 nt, Salmonella enterica enterica serovar Typhi Ty2
aacgcgacaacgc

SEQ ID NO: 3695325 - RNA, 18 nt, Salmonella enterica enterica serovar Typhi Ty2
aacgcgaccagcgcgcca

SEQ ID NO: 3695326 - RNA, 18 nt, Salmonella enterica enterica serovar Typhi Ty2
aacgcgcaucaacgccag

SEQ ID NO: 3695327 - RNA, 20 nt, Salmonella enterica enterica serovar Typhi Ty2
aacgcgcauuuuauuuaaaa

SEQ ID NO: 3695328 - RNA, 21 nt, Salmonella enterica enterica serovar Typhi Ty2
aacgcgccaaguaaauuugcu

SEQ ID NO: 3695329 - RNA, 16 nt, Salmonella enterica enterica serovar Typhi Ty2
aacgcgccacgcgcca

SEQ ID NO: 3695330 - RNA, 16 nt, Salmonella enterica enterica serovar Typhi Ty2
aacgcgccauccggca

SEQ ID NO: 3695331 - RNA, 14 nt, Salmonella enterica enterica serovar Typhi Ty2
aacgcgccaucuuu

SEQ ID NO: 3695332 - RNA, 18 nt, Salmonella enterica enterica serovar Typhi Ty2
aacgcgcccaacggaugc

SEQ ID NO: 3695333 - RNA, 17 nt, Salmonella enterica enterica serovar Typhi Ty2
aacgcgcgacuuaucuu

SEQ ID NO: 3695334 - RNA, 12 nt, Salmonella enterica enterica serovar Typhi Ty2
aacgcggccugg

SEQ ID NO: 3695335 - RNA, 14 nt, Salmonella enterica enterica serovar Typhi Ty2
aacgcggccuggaa

SEQ ID NO: 3695336 - RNA, 23 nt, Salmonella enterica enterica serovar Typhi Ty2
aacgcggcgccgaagcaggcgga

SEQ ID NO: 3695337 - RNA, 21 nt, Salmonella enterica enterica serovar Typhi Ty2
aacgcggcguagccgccgagc

SEQ ID NO: 3695338 - RNA, 20 nt, Salmonella enterica enterica serovar Typhi Ty2
aacgcggcuuuaaguuuuuc

SEQ ID NO: 3695339 - RNA, 16 nt, Salmonella enterica enterica serovar Typhi Ty2
aacgcguccaacuggc

SEQ ID NO: 3695340 - RNA, 20 nt, Salmonella enterica enterica serovar Typhi Ty2
aacgcgucuucaucagccag

SEQ ID NO: 3695341 - RNA, 22 nt, Salmonella enterica enterica serovar Typhi Ty2
aacgcguuaaucacuaccugca

SEQ ID NO: 3695342 - RNA, 15 nt, Salmonella enterica enterica serovar Typhi Ty2
aacgcuaggcaaccu

SEQ ID NO: 3695343 - RNA, 13 nt, Salmonella enterica enterica serovar Typhi Ty2
aacgcuccagcag

SEQ ID NO: 3695344 - RNA, 19 nt, Salmonella enterica enterica serovar Typhi Ty2
aacgcucucuuuucuuacu

SEQ ID NO: 3695345 - RNA, 23 nt, Salmonella enterica enterica serovar Typhi Ty2
aacgcucuuaccgcuaaaauacc

SEQ ID NO: 3695346 - RNA, 16 nt, Salmonella enterica enterica serovar Typhi Ty2
aacgcugagucagaaa

SEQ ID NO: 3695347 - RNA, 13 nt, Salmonella enterica enterica serovar Typhi Ty2
aacgcugcaaagu

SEQ ID NO: 3695348 - RNA, 16 nt, Salmonella enterica enterica serovar Typhi Ty2
aacgcugcaaaguuau

SEQ ID NO: 3695349 - RNA, 14 nt, Salmonella enterica enterica serovar Typhi Ty2
aacgcugcgcuaca

SEQ ID NO: 3695350 - RNA, 22 nt, Salmonella enterica enterica serovar Typhi Ty2
aacgcuggccgcaaauccacug

SEQ ID NO: 3695351 - RNA, 23 nt, Salmonella enterica enterica serovar Typhi Ty2
aacgcuguugccgcugcuggcgu

SEQ ID NO: 3695352 - RNA, 14 nt, Salmonella enterica enterica serovar Typhi Ty2
aacgcuuaaagcgu

SEQ ID NO: 3695353 - RNA, 15 nt, Salmonella enterica enterica serovar Typhi Ty2
aacgcuuauccggcc

SEQ ID NO: 3695354 - RNA, 23 nt, Salmonella enterica enterica serovar Typhi Ty2
aacgcuuugcgauagcccggcau

SEQ ID NO: 3695355 - RNA, 13 nt, Salmonella enterica enterica serovar Typhi Ty2
aacgcuuuugcgc

SEQ ID NO: 3695356 - RNA, 19 nt, Salmonella enterica enterica serovar Typhi Ty2
aacggaaaagcauugcuuc

SEQ ID NO: 3695357 - RNA, 17 nt, Salmonella enterica enterica serovar Typhi Ty2
aacggacgugcgcuuca

SEQ ID NO: 3695358 - RNA, 22 nt, Salmonella enterica enterica serovar Typhi Ty2
aacggaucaugguugaaaaaag

SEQ ID NO: 3695359 - RNA, 17 nt, Salmonella enterica enterica serovar Typhi Ty2
aacggauugugaaauuc

SEQ ID NO: 3695360 - RNA, 23 nt, Salmonella enterica enterica serovar Typhi Ty2
aacggcaaaucgcgguaaaaagc

SEQ ID NO: 3695361 - RNA, 15 nt, Salmonella enterica enterica serovar Typhi Ty2
aacggcaccagcaac

SEQ ID NO: 3695362 - RNA, 20 nt, Salmonella enterica enterica serovar Typhi Ty2
aacggcaccggaaccggcau

SEQ ID NO: 3695363 - RNA, 13 nt, Salmonella enterica enterica serovar Typhi Ty2
aacggcagccagc

SEQ ID NO: 3695364 - RNA, 20 nt, Salmonella enterica enterica serovar Typhi Ty2
aacggcagccgccaccacaa

SEQ ID NO: 3695365 - RNA, 15 nt, Salmonella enterica enterica serovar Typhi Ty2
aacggccagcaaaau

SEQ ID NO: 3695366 - RNA, 19 nt, Salmonella enterica enterica serovar Typhi Ty2
aacggccagugaaauaaau

SEQ ID NO: 3695367 - RNA, 13 nt, Salmonella enterica enterica serovar Typhi Ty2
aacggcccggcgu

SEQ ID NO: 3695368 - RNA, 18 nt, Salmonella enterica enterica serovar Typhi Ty2
aacggcgagcuuuaauga

SEQ ID NO: 3695369 - RNA, 20 nt, Salmonella enterica enterica serovar Typhi Ty2
aacggcgcaaagacagguga

SEQ ID NO: 3695370 - RNA, 18 nt, Salmonella enterica enterica serovar Typhi Ty2
aacugauucaaaagguga

SEQ ID NO: 3695371 - RNA, 22 nt, Salmonella enterica enterica serovar Typhi Ty2
aacugauuuguaggccugauaa

SEQ ID NO: 3695372 - RNA, 18 nt, Salmonella enterica enterica serovar Typhi Ty2
aacugcaaaucuucggca

SEQ ID NO: 3695373 - RNA, 19 nt, Salmonella enterica enterica serovar Typhi Ty2
aacugcauaucgccgcuuu

SEQ ID NO: 3695374 - RNA, 14 nt, Salmonella enterica enterica serovar Typhi Ty2
aacugccaaaccac

SEQ ID NO: 3695375 - RNA, 15 nt, Salmonella enterica enterica serovar Typhi Ty2
aacugcgccugcuca

SEQ ID NO: 3695376 - RNA, 19 nt, Salmonella enterica enterica serovar Typhi Ty2
aacugcgcgcccgccuccg

SEQ ID NO: 3695377 - RNA, 17 nt, Salmonella enterica enterica serovar Typhi Ty2
aacugcgcgccgcccug

SEQ ID NO: 3695378 - RNA, 20 nt, Salmonella enterica enterica serovar Typhi Ty2
aacugcggaauuuuauccug

SEQ ID NO: 3695379 - RNA, 22 nt, Salmonella enterica enterica serovar Typhi Ty2
aacugcggaauuuuauccugug

SEQ ID NO: 3695380 - RNA, 11 nt, Salmonella enterica enterica serovar Typhi Ty2
aacugcggcua

SEQ ID NO: 3695381 - RNA, 11 nt, Salmonella enterica enterica serovar Typhi Ty2
aacugcugcuc

SEQ ID NO: 3695382 - RNA, 12 nt, Salmonella enterica enterica serovar Typhi Ty2
aacuggaaaaag

SEQ ID NO: 3695383 - RNA, 13 nt, Salmonella enterica enterica serovar Typhi Ty2
aacuggaaaaaga

SEQ ID NO: 3695384 - RNA, 17 nt, Salmonella enterica enterica serovar Typhi Ty2
aacuggcaaucaugcgc

SEQ ID NO: 3695385 - RNA, 22 nt, Salmonella enterica enterica serovar Typhi Ty2
aacuggcacgccguuugccaua

SEQ ID NO: 3695386 - RNA, 16 nt, Salmonella enterica enterica serovar Typhi Ty2
aacuggcagcagugac

SEQ ID NO: 3695387 - RNA, 17 nt, Salmonella enterica enterica serovar Typhi Ty2
aacuggccacagcaaau

SEQ ID NO: 3695388 - RNA, 13 nt, Salmonella enterica enterica serovar Typhi Ty2
aacuggcgcaucu

SEQ ID NO: 3695389 - RNA, 15 nt, Salmonella enterica enterica serovar Typhi Ty2
aacuggcgcuggcag

SEQ ID NO: 3695390 - RNA, 23 nt, Salmonella enterica enterica serovar Typhi Ty2
aacugggcuugcauugcuuuuag

SEQ ID NO: 3695391 - RNA, 21 nt, Salmonella enterica enterica serovar Typhi Ty2
aacugguuaccacaauaaucg

SEQ ID NO: 3695392 - RNA, 21 nt, Salmonella enterica enterica serovar Typhi Ty2
aacuguagaaugcuauaugca

SEQ ID NO: 3695393 - RNA, 19 nt, Salmonella enterica enterica serovar Typhi Ty2
aacuguagcaggauauuuu

SEQ ID NO: 3695394 - RNA, 23 nt, Salmonella enterica enterica serovar Typhi Ty2
aacuguauccguaauaugaugca

SEQ ID NO: 3695395 - RNA, 13 nt, Salmonella enterica enterica serovar Typhi Ty2
aacugucagauca

SEQ ID NO: 3695396 - RNA, 18 nt, Salmonella enterica enterica serovar Typhi Ty2
aacugugcgacaaccugc

SEQ ID NO: 3695397 - RNA, 17 nt, Salmonella enterica enterica serovar Typhi Ty2
aacuguuaggccggaca

SEQ ID NO: 3695398 - RNA, 18 nt, Salmonella enterica enterica serovar Typhi Ty2
aacuguuaucauagacug

SEQ ID NO: 3695399 - RNA, 15 nt, Salmonella enterica enterica serovar Typhi Ty2
aacuguucagccagc

SEQ ID NO: 3695400 - RNA, 16 nt, Salmonella enterica enterica serovar Typhi Ty2
aacuguucagccagca

SEQ ID NO: 3695401 - RNA, 14 nt, Salmonella enterica enterica serovar Typhi Ty2
aacuguuuacccac

SEQ ID NO: 3695402 - RNA, 14 nt, Salmonella enterica enterica serovar Typhi Ty2
aacuguuuuucacu

SEQ ID NO: 3695403 - RNA, 18 nt, Salmonella enterica enterica serovar Typhi Ty2
aacuuaaauuaaugauua

SEQ ID NO: 3695404 - RNA, 23 nt, Salmonella enterica enterica serovar Typhi Ty2
aacuuaaauuaaugauuaaaaua

SEQ ID NO: 3695405 - RNA, 20 nt, Salmonella enterica enterica serovar Typhi Ty2
aacuuacacuuaccugauua

SEQ ID NO: 3695406 - RNA, 23 nt, Salmonella enterica enterica serovar Typhi Ty2
aacuuaguguccacucgcucauu

SEQ ID NO: 3695407 - RNA, 18 nt, Salmonella enterica enterica serovar Typhi Ty2
aacuucaucguuacgcca

SEQ ID NO: 3695408 - RNA, 20 nt, Salmonella enterica enterica serovar Typhi Ty2
aacuucaugguacagaucca

SEQ ID NO: 3695409 - RNA, 16 nt, Salmonella enterica enterica serovar Typhi Ty2
aacuuccaccaccucc

SEQ ID NO: 3695410 - RNA, 22 nt, Salmonella enterica enterica serovar Typhi Ty2
aacuuccaccaccuccugcugg

SEQ ID NO: 3695411 - RNA, 20 nt, Salmonella enterica enterica serovar Typhi Ty2
aacuuccgguagguuaaaua

SEQ ID NO: 3695412 - RNA, 13 nt, Salmonella enterica enterica serovar Typhi Ty2
aacuuccuuugcc

SEQ ID NO: 3695413 - RNA, 13 nt, Salmonella enterica enterica serovar Typhi Ty2
aacuucugcaggg

SEQ ID NO: 3695414 - RNA, 19 nt, Salmonella enterica enterica serovar Typhi Ty2
aacuugaaguuuucgggca

SEQ ID NO: 3695415 - RNA, 20 nt, Salmonella enterica enterica serovar Typhi Ty2
aacuugacuuugcucuccuu

SEQ ID NO: 3695416 - RNA, 16 nt, Salmonella enterica enterica serovar Typhi Ty2
aacuugauuccuggcu

SEQ ID NO: 3695417 - RNA, 23 nt, Salmonella enterica enterica serovar Typhi Ty2
aacuugccguuuuucucaucaag

SEQ ID NO: 3695418 - RNA, 16 nt, Salmonella enterica enterica serovar Typhi Ty2
aacuuuaacacuaacu

SEQ ID NO: 3695419 - RNA, 15 nt, Salmonella enterica enterica serovar Typhi Ty2
aacuuuaucaccagc

SEQ ID NO: 3695420 - RNA, 12 nt, Salmonella enterica enterica serovar Typhi Ty2
aacuuucagaau

SEQ ID NO: 3695421 - RNA, 16 nt, Salmonella enterica enterica serovar Typhi Ty2
aacuuucauuucacuu

SEQ ID NO: 3695422 - RNA, 11 nt, Salmonella enterica enterica serovar Typhi Ty2
aacuuuccaac

SEQ ID NO: 3695423 - RNA, 19 nt, Salmonella enterica enterica serovar Typhi Ty2
aacuuuccugccuucugaa

SEQ ID NO: 3695424 - RNA, 20 nt, Salmonella enterica enterica serovar Typhi Ty2
aacuuugcgccauuucaaua

SEQ ID NO: 3695425 - RNA, 18 nt, Salmonella enterica enterica serovar Typhi Ty2
aacuuuuggugcccaucg

SEQ ID NO: 3695426 - RNA, 20 nt, Salmonella enterica enterica serovar Typhi Ty2
aagaaaaaacuuauuucuau

SEQ ID NO: 3695427 - RNA, 14 nt, Salmonella enterica enterica serovar Typhi Ty2
aagaaaaaagugau

SEQ ID NO: 3695428 - RNA, 22 nt, Salmonella enterica enterica serovar Typhi Ty2
aagaaaaaggagccuuacggcu

SEQ ID NO: 3695429 - RNA, 20 nt, Salmonella enterica enterica serovar Typhi Ty2
aagaaaacuuucauuucacu

SEQ ID NO: 3695430 - RNA, 21 nt, Salmonella enterica enterica serovar Typhi Ty2
aagaaacaauccguuauuuca

SEQ ID NO: 3695431 - RNA, 18 nt, Salmonella enterica enterica serovar Typhi Ty2
aagaaaccgcagaaaaag

SEQ ID NO: 3695432 - RNA, 22 nt, Salmonella enterica enterica serovar Typhi Ty2
aagaaacgcuuaaagcguucca

SEQ ID NO: 3695433 - RNA, 15 nt, Salmonella enterica enterica serovar Typhi Ty2
aagaaacugugguua

SEQ ID NO: 3695434 - RNA, 19 nt, Salmonella enterica enterica serovar Typhi Ty2
aagaaagacgcugaaaagc

SEQ ID NO: 3695435 - RNA, 15 nt, Salmonella enterica enterica serovar Typhi Ty2
aagaaagauaaaaua

SEQ ID NO: 3695436 - RNA, 17 nt, Salmonella enterica enterica serovar Typhi Ty2
aagaaagggagaauacc

SEQ ID NO: 3695437 - RNA, 22 nt, Salmonella enterica enterica serovar Typhi Ty2
aagaaauguccauaaauagauc

SEQ ID NO: 3695438 - RNA, 22 nt, Salmonella enterica enterica serovar Typhi Ty2
aagaaauuuugcacuguuuuua

SEQ ID NO: 3695439 - RNA, 22 nt, Salmonella enterica enterica serovar Typhi Ty2
aagaacagggggcgcaucacug

SEQ ID NO: 3695440 - RNA, 20 nt, Salmonella enterica enterica serovar Typhi Ty2
aagaacgccgcaaacgccga

SEQ ID NO: 3695441 - RNA, 16 nt, Salmonella enterica enterica serovar Typhi Ty2
aagaacgguuggaaua

SEQ ID NO: 3695442 - RNA, 20 nt, Salmonella enterica enterica serovar Typhi Ty2
aagaacuuaggauaauuccc

SEQ ID NO: 3695443 - RNA, 19 nt, Salmonella enterica enterica serovar Typhi Ty2
aagaacuuccccaucagga

SEQ ID NO: 3695444 - RNA, 16 nt, Salmonella enterica enterica serovar Typhi Ty2
aagaagaaaccgcaga

SEQ ID NO: 3695445 - RNA, 19 nt, Salmonella enterica enterica serovar Typhi Ty2
aagaagaauuauuaucaau

SEQ ID NO: 3695446 - RNA, 12 nt, Salmonella enterica enterica serovar Typhi Ty2
aagaagaggcga

SEQ ID NO: 3695447 - RNA, 18 nt, Salmonella enterica enterica serovar Typhi Ty2
aagaagcacgacacaaaa

SEQ ID NO: 3695448 - RNA, 15 nt, Salmonella enterica enterica serovar Typhi Ty2
aagaagcgcuggaga

SEQ ID NO: 3695449 - RNA, 19 nt, Salmonella enterica enterica serovar Typhi Ty2
aagaaguaaacagaaucaa

SEQ ID NO: 3695450 - RNA, 20 nt, Salmonella enterica enterica serovar Typhi Ty2
aagaagucugugagaaaagc

SEQ ID NO: 3695451 - RNA, 21 nt, Salmonella enterica enterica serovar Typhi Ty2
aagaagucugugagaaaagcg

SEQ ID NO: 3695452 - RNA, 16 nt, Salmonella enterica enterica serovar Typhi Ty2
aagcagcuugcugcuu

SEQ ID NO: 3695453 - RNA, 17 nt, Salmonella enterica enterica serovar Typhi Ty2
aagcagcuugcugcuuu

SEQ ID NO: 3695454 - RNA, 18 nt, Salmonella enterica enterica serovar Typhi Ty2
aagcaggcgggacgccau

SEQ ID NO: 3695455 - RNA, 23 nt, Salmonella enterica enterica serovar Typhi Ty2
aagcagguagcgccuuuacuggu

SEQ ID NO: 3695456 - RNA, 17 nt, Salmonella enterica enterica serovar Typhi Ty2
aagcaguuaauacagug

SEQ ID NO: 3695457 - RNA, 16 nt, Salmonella enterica enterica serovar Typhi Ty2
aagcaguuccagcauc

SEQ ID NO: 3695458 - RNA, 15 nt, Salmonella enterica enterica serovar Typhi Ty2
aagcauaccuucaca

SEQ ID NO: 3695459 - RNA, 18 nt, Salmonella enterica enterica serovar Typhi Ty2
aagcauagcgccuucagg

SEQ ID NO: 3695460 - RNA, 16 nt, Salmonella enterica enterica serovar Typhi Ty2
aagcauagcgucauca

SEQ ID NO: 3695461 - RNA, 19 nt, Salmonella enterica enterica serovar Typhi Ty2
aagcauagcgucaucaaca

SEQ ID NO: 3695462 - RNA, 15 nt, Salmonella enterica enterica serovar Typhi Ty2
aagcaucugauauau

SEQ ID NO: 3695463 - RNA, 18 nt, Salmonella enterica enterica serovar Typhi Ty2
aagcaucuuuccggaacg

SEQ ID NO: 3695464 - RNA, 20 nt, Salmonella enterica enterica serovar Typhi Ty2
aagcaugguuaacuccuucu

SEQ ID NO: 3695465 - RNA, 17 nt, Salmonella enterica enterica serovar Typhi Ty2
aagcauuaccccguggu

SEQ ID NO: 3695466 - RNA, 18 nt, Salmonella enterica enterica serovar Typhi Ty2
aagcauugccguuuucaa

SEQ ID NO: 3695467 - RNA, 15 nt, Salmonella enterica enterica serovar Typhi Ty2
aagccaauggugcuc

SEQ ID NO: 3695468 - RNA, 15 nt, Salmonella enterica enterica serovar Typhi Ty2
aagccacaaucugau

SEQ ID NO: 3695469 - RNA, 13 nt, Salmonella enterica enterica serovar Typhi Ty2
aagccaccagauc

SEQ ID NO: 3695470 - RNA, 17 nt, Salmonella enterica enterica serovar Typhi Ty2
aagccagacgcgcagca

SEQ ID NO: 3695471 - RNA, 17 nt, Salmonella enterica enterica serovar Typhi Ty2
aagccagacucgcuccc

SEQ ID NO: 3695472 - RNA, 20 nt, Salmonella enterica enterica serovar Typhi Ty2
aagccagcacggcuucacgu

SEQ ID NO: 3695473 - RNA, 19 nt, Salmonella enterica enterica serovar Typhi Ty2
aagccagccaaauagcgcc

SEQ ID NO: 3695474 - RNA, 22 nt, Salmonella enterica enterica serovar Typhi Ty2
aagccagccaaauagcgccaga

SEQ ID NO: 3695475 - RNA, 14 nt, Salmonella enterica enterica serovar Typhi Ty2
aagccaggcaccau

SEQ ID NO: 3695476 - RNA, 20 nt, Salmonella enterica enterica serovar Typhi Ty2
aagccaggcaccauccggua

SEQ ID NO: 3695477 - RNA, 17 nt, Salmonella enterica enterica serovar Typhi Ty2
aagccaggccgccagca

SEQ ID NO: 3695478 - RNA, 14 nt, Salmonella enterica enterica serovar Typhi Ty2
aagccagggaaaug

SEQ ID NO: 3695479 - RNA, 19 nt, Salmonella enterica enterica serovar Typhi Ty2
aagccauccaucuccggca

SEQ ID NO: 3695480 - RNA, 23 nt, Salmonella enterica enterica serovar Typhi Ty2
aagccaucuucgguaauacaauc

SEQ ID NO: 3695481 - RNA, 14 nt, Salmonella enterica enterica serovar Typhi Ty2
aagccauugccgcg

SEQ ID NO: 3695482 - RNA, 19 nt, Salmonella enterica enterica serovar Typhi Ty2
aagccauugccgcgacaaa

SEQ ID NO: 3695483 - RNA, 21 nt, Salmonella enterica enterica serovar Typhi Ty2
aagcccaccgcgaacauugga

SEQ ID NO: 3695484 - RNA, 12 nt, Salmonella enterica enterica serovar Typhi Ty2
aagcccacgccc

SEQ ID NO: 3695485 - RNA, 12 nt, Salmonella enterica enterica serovar Typhi Ty2
aagcccagcacg

SEQ ID NO: 3695486 - RNA, 16 nt, Salmonella enterica enterica serovar Typhi Ty2
aagcccaucagcgcca

SEQ ID NO: 3695487 - RNA, 12 nt, Salmonella enterica enterica serovar Typhi Ty2
aagcccauggca

SEQ ID NO: 3695488 - RNA, 17 nt, Salmonella enterica enterica serovar Typhi Ty2
aagccccaugugccuug

SEQ ID NO: 3695489 - RNA, 15 nt, Salmonella enterica enterica serovar Typhi Ty2
aagccccccgcacag

SEQ ID NO: 3695490 - RNA, 21 nt, Salmonella enterica enterica serovar Typhi Ty2
aagccccccgcacagcacaua

SEQ ID NO: 3695491 - RNA, 23 nt, Salmonella enterica enterica serovar Typhi Ty2
aagccccuuccucgggaggggcu

SEQ ID NO: 3695492 - RNA, 22 nt, Salmonella enterica enterica serovar Typhi Ty2
aagcccggauuaacaagcagau

SEQ ID NO: 3695493 - RNA, 19 nt, Salmonella enterica enterica serovar Typhi Ty2
aagcccggccacagcgcca

SEQ ID NO: 3695494 - RNA, 19 nt, Salmonella enterica enterica serovar Typhi Ty2
aagcccuuucuuuuuuugu
